United States Patent 7,504,490 (NUCLEIC ACID AND AMINO ACID SEQUENCES RELATING TO APERGILLUS FUMIGATUS FOR DIAGNOSTICS AND THERAPEUTICS) - sequence listing, part 7

SEQ ID NO: 33773 - protein, 558 aa, A.fumigatus
  UNSURE (5): Identity of amino acid sequences at the above locations are unknown.
QPATXDVHVDRPSFRPGDNWQEFKQDFYPREPVLILLEDNTRLHGMIRDKANFAEQRYPDGTLKAPAYATYLVKVLDRPNEEALLDQDHITRDRKTFTKQMLRAFIKNNVTRESWNGAPWLVKPSVAEEYKIPTEVPKHLQYGARVAEKKAQKKADQEGFFGFFSSQQLPELKPAAKGQKNKLSPQDLARSKEAQYLEYQRSLNGNPTFVVSHKLPNAPSRPLKPQDEKKSQPVPTVIVKTEPPKPPTPPPIKYPIEDLEIPPDREKKKQRPPLKFLAADEDDDPNDEELLHDKIEMQSVGLLLETWNTLNVYCEVFQLDSFTFDDFLQAMRFSSDEVECELFVEIHCAVLKKLVNAENDDEGAVQVSLPDLPDVESDDSEADEENEEEEEKEPSPEPEPVVTRMTTRSSLAKAEAENLKAQANRSRANSEDIKIHRAAEMFGDYGWIERLRKRDFRHGGWQMVMVGLLHQLSARPRMEKVCNDILKHLAPLDAEPTQETVQSQYATLNVNLRVQALQIICILSLETKAIRNYLEECSNQMTEFRKEKIEYQRARKVA

SEQ ID NO: 33774 - protein, 151 aa, A.fumigatus
LTIFLRCRLEELRRLHQERKALQPEQEKSPSPVPELEALEDSKMSGVDGDSEQVMDTEDDDVPQQRSLRGGLDRILERKRKQEEERERKEQLAKQPKGSKQYQRVLKKIEDQKATVEKLEKKIEVVDNDLREAVCPRSTCVRKVRDETKQG

SEQ ID NO: 33775 - protein, 61 aa, A.fumigatus
SIFRHSSHQLLNMSLFQPDIRPQDVGKHQDTENVREPSTDTQNDVESGDEPSVAEIERIYR

SEQ ID NO: 33776 - protein, 195 aa, A.fumigatus
GLQFLITFSLLRLLLGIFIAGMWPGMTYYLTLFYPPSRTGKRIGQYFTAAQISAAVVGLVSAGFQKMDGERGLVGFQWMFLVYGIITIAVGIVLLWWLPDRPLAPGVEPPQRKYFKWLQRSPPALTGRDAEIHYHDLRRVYHRPQWSVRDLLRVFLDWRLWPLLVMYFGVVGVGIGVQNYATVIIRGYQPIPEWD

SEQ ID NO: 33777 - protein, 168 aa, A.fumigatus
  UNSURE (138): Identity of amino acid sequences at the above locations are unknown.
PQSSHSPNLACKYSPLLGCLSALGCKTDKKQMDLLGILVVTPFSDRFHKHRALFFSFPVCLQIVGLLLTTFAGSASNSWPRYGGLLIVGFGLGPTVPITMSWTAEVFQPRHGEVGVAAASAVVSGWGNLGSILTTYAXYTGWPSDSAAPGRATAARFSITTKPESNTR

SEQ ID NO: 33778 - protein, 111 aa, A.fumigatus
VRSSQSSRKLDYRIIPAFWVLYFLCSAIRSNVGLAQTMNMDVGHDLGSVLHLTPHQISTGLALFYVCYVVFDLPSNLVMTRLSPHVWMSRIVISVGIIGSCMAAMKAAWSL

SEQ ID NO: 33779 - protein, 237 aa, A.fumigatus
LIISPSSTLLPARVNASANTSLPLRSLPLLWAWSRLASRRWTASAASLASNGCSSSTASSPSPSASSSSGGFPTGLWLPVSNLPSASISSGCSAARPPSQAGTQRSTTTTCGASTTVRSGPSVTSSACSWTGACGRCWSCTLAWSAWALASRTTPPSSSGGINPSLNGIDLSLLTAPIWLVSIPPSLAVCPPWAAKLTKSRWTSSASSWSPPSRTASTNTAPSSSPSPSASRSSASS

SEQ ID NO: 33780 - protein, 605 aa, A.fumigatus
LWIALLRTSILFPPYLHVLQAADDSHPGLFLLIVVAFDHLSLYFPLGGANFGYGEFPYGALLLSRSGVTHMKTLGLFRSLLQPSNSHFFRLYHWNMSEKKRNGAPRTFPKREKRPPLTHFLCLPLVNDISLPQLESSLSTFKAAIPLVSHSDEEGSVQQQVSAERPLIPYGAVRPVGTLHLTLGVMSLPTKERLEEAIEFFHSLDLAFIMREAEEIAKKSKWSRKRSSSPRQQSDFTGAVGEGEETHPSRRLEQEDDPASVIVPRDNYEPLTISLESLHALPRGRAATVLHAAPVDSTSRLYPFCVLLRNKFLEAGFLQCEHIKNRPGSYHIEPQKPPKYVESDTGDATSTIHQAKPNLDQGHQSLTNILIQNRTTLLQEMPVDLAGELTQVHSQTREPITTTVGTAVQTKSKLKVRPLLLHATVVNTIYVRGRRRGGGPQNSGSRRNSQYSFDARDILAHYRDFYIDCQRTMPRSTSVTMASHPNEIERQQIANHDTGTESASNSASSTDGSGNEARNSPSEKRQKMSSMKRVHAFPFVWAKDFPLETICICEMGAKKLDPDDSGMNARLGEKYRVVAEMSLDFTSSGNSKVVAEGTACHRDNL

SEQ ID NO: 33781 - protein, 200 aa, A.fumigatus
PSPSFICSALTHPLYSRLKVSCTARKPPKMLSRISRSAASSAARPSLRVGRISATAPAAIHLQPRLNGVNNSAQAPRRGFQCTSCIRKGIFPDSADPPAPKPQSNNVAGASTHVTEPSPLTDVQYHEFAEHYLNVIQNEVEKAQEEGSDIEAEYSVRIAGLRSIFFFFLFRFFFGQLYAALIIYKASLADLRCDMRSLTL

SEQ ID NO: 33782 - protein, 707 aa, A.fumigatus
LEFYYRSNLSALRAFSIQHDMQSAYRFSTLSSTFRIKSGDAAATALGCITVDITPDLGTSLKNTLAYVPLVILVLVGIATISAAMYSPWGTTNFFHWTSNYGRDEDVLRLVTPGFGDCMQYIQFAVLTGALSLNYPGYYQPVISQVAWSTLMFNQSFVHSGQGRGPVIDGVYAVNATYGLERLEQYVGMSTASDIWPGMMIWLLVILGIVTALIQLAFAFRWLHHELANIPEEDLRSKNMPFTVGNVIRIVFNFLFLPVVSLSFFQLVIAADSPAYSVALAVVVIVALLVFSIWTVRLIVSTRPKSHLFDDLPTVLLYGPLYNTFCDDAAAFAAVPIFITFARGVAIGALQPSGIAQIVLLAICEVVYVLTLVAFRPFPHPTSMNLYHACFAIVRFLTILLSVVFVPSLGVSQAARGWIGYIILLLHALVLVFGFFLNALQTLIEVIARLAGAGGYEGGATRGGLVKVFGMRQLSRRLPRRDAAGTRQSMASDAAMLAHTDDRMSAQFDGSRPRSLSGSLLLNRATASDGRASGIFESGSAHGGTHSRANSSGLYTPTTLGGFQGAGYQTTGSNSPKSGLIYAMQPHDPYYRPPRPRRNNERGTSFENGRTVSHTVSRSGNLGDMDDDLIEGPSVSGRGTPVPAYIPAPKDDLDYDDSRPSRKEYAVREVDFYYRVRGPPLSQSGTRKLNTGRLLPRRRPARRKIKA

SEQ ID NO: 33783 - protein, 545 aa, A.fumigatus
PFTSYRYAFVEFETPEQAVAAVKQLHGTPLDKKHTLLVNKLMDIERYGREGRIDEEYKPPAIEPFKEKEHLRSWLADPNARDQFALYRGDKVGVFWNNKNHPPENVVDRAHWTQLFVQWSPKGTYLASVHPQGVQLWGGPAFSKQKQFPHPFVQLIEFSPGESYLTTWSARPIQVEEGQSILTYEEEGKNIIVWDIATGKPLRSFVSHDLTAGPAGDAEPKKKVQWPAFKWSADEKYVARMVPHQSISIYELPRMNLLGKTSEKIDGVMDFEWSPATVTREGVKQYEQLLCFWTHEIGSSPARVPMMSVPSKEIVRTRNLFNVSDVKLHWQSQGLYVCVKVDRHSKSKKSMATNLEIFRVREKGVPVEVVDSLKDTVINFAWEPNGNRFVLITTGEAVAGAAVAPKTAVSFFAPEKKGGAIGNFKLIRTIEKKNSNAIYWSPKGRFVVVATVHSQTSFDMDFWDMDFEGEKPEAEKDFAANLQLMKTTEHYGVTDIDWDPTGRYVVSSASVWTHQVRSLLPSFLSIFLALLSSSTTGAGATRAMR

SEQ ID NO: 33784 - protein, 823 aa, A.fumigatus
  UNSURE (24),(52),(773): Identity of amino acid sequences at the above locations are unknown.
LYTRDMVPVRVGADNAQGSSGQLXILREMVQTVSRECEPRLGMSASAIQAKXPTIDTFFDAIAAERLRRMPPDGSRLDAALRRASSLAFAVASLRDAVVSFMDGADEATKLVWGGLLLTLEVRHIQVSRTKAKQFQMGIEQVDILDAIVSRYGRVTLQISLLLQQESVFTESTSLQNEVAKTYASLLQLVLHVAMEYSDASRSLAWLIMGEHVDEAFFQFHNSCNTNWRKLSELALSKRTTMDVASIYQFLDLQDRPLQMILEGHNHSLADGSFAWFDPHLTTFALSNREMMVITGSPGAGKSALAQWTVERLQVSSECDIWNVIPCWVREDVPITTLTLTILKGILLQMLDRCVSSWKTQEGILAPVQQAADMASTGATDSQVEDVLWSAVRTATQSHMHFIIVLDGLDQIKNAKATMAGFLARLQGSISGTSSKLIIFSRELPAQQQLGESTQQLSLNPSLTQSDMLAAVTDAIRSDGQFYGLAGDQIDMMAQRIVARAKGCFVWAQLTLESMKHESTFKGMMTAIQQAPGNVSELIGNHLSTTDIARPDIRCLLAWLVASERPLRAKEVEELLSVDAESLKLTPRPAGAERNIFKPLGRLVMVRDGFVAFRHSMIRENLRQRAMSADSNYSDNQGFPFNLEEAHYDLLTRSLAWTRICVKEEVAISMDKLPVQQRDGLFDAYILLEYTSRYWFAHLLSSPMTTADREFAFTPVFKSALPSSVLFAQLELTGRESQFTRSNILELYRLSVAVRRVPLGEKSPAFLQSLILXARAANLAKANLGSQSSVRSMDAQSVATWDVLSDLHGVGAADADRSSASRP

SEQ ID NO: 33785 - protein, 65 aa, A.fumigatus
LHPLDPSIDSPVDPSSPAEKTDLESYIYCGRRSLHTRNMSTDINVTGYEWTDSPKRHGKDNTLNP

SEQ ID NO: 33786 - protein, 143 aa, A.fumigatus
LLSADMARWRRFSRIMEWRNATNPSRTMTRRPRGLNMFRSAPAGRGVSLRLSASTESSSSTSLARRGRSDATSHARRQRMSGRAMSVVLRWLPISSLTLPGACWIAVIMPLKVDSCFIDSRVSCAQTKHPLARATMRWAIMSI

SEQ ID NO: 33787 - protein, 115 aa, A.fumigatus
RRRRRLRFPPKGSRRVPDGIRTAPPVREERRPPLSRQILPPEPTQLPFDGGADRPPTRHRERRSRGRAAPRPQPHPRPCHSCQRRPRNARRYGGSETGRCHVGTQGPDARHSART

SEQ ID NO: 33788 - protein, 66 aa, A.fumigatus
RRFIILLFVNGFWNVQFDGTVIRGSMVHGTVAQLDCLNTVSGVNARMEESSSYASGQAGRCIVHNL

SEQ ID NO: 33789 - protein, 396 aa, A.fumigatus
TKILPEDSSSVMSSTFSLGEPINKSQEGDSEVAKVADNLKTSTIEEEEEEEIEDESEYSPSRCLFCSHKASDLQENTEHMRRSHGMFIPEKDYLVNLEGLIHYLYRKINENSECLYCHAIRNSPAGIRTHMRDKGHCMIAFETEEEQIEIGQYYDFRSTYSDDEAGSVTSETPEDGGVKVTSSDGDDDGWETETSASSLDDDEDDDFDSHRKAAVVYQTEYELHLPSGKSVGHRSLAKYYRQNLHNYPSMEERIARQLAIENGEVEEERPRGRNPTRALVTRANGGLGMLGATEDQKRVAVMSERKDRTRAIRQELRYRDRVNRAANNQKHFRVCTSFFFFFFFLSDLFNKKLTLTSRTLSCNDHRAGFSFLSWFNGHLVVKSMTGSYSGACMIHG

SEQ ID NO: 33790 - protein, 172 aa, A.fumigatus
PARTATTTGGRQKPPPPPWMTTKTTTSIPTERQPSCTRRNTNCTSRPGRASATALSPNTTARTYTTTLRWRSGSPANSPSRTAKSRKSGPAAATPPAPLSLVPTAASECSALRRIRNGSLSCRNARTGRAPFGKNLGTETGSTGLRTTRNTSGYVHPFFFFFFFCPICLTKS

SEQ ID NO: 33791 - protein, 345 aa, A.fumigatus
QRTNREIIDESDVFIDVHKAIRRMAPAPKSRVPKGRIVEEPPMLTLESTGPLLETDGQSRMPSVDRRRSSVEAPPPRFHMRLQTSDKNSDSTDGFLTHRGTTDEIREHLKHLGPSNLASRPRQTRYQNVKIKRASGSPSRSGHTDMDSGHSTSGSQVVNNTSSGLTGGIGAGLLHSGIDARDGVQAVKLGYGTMNHRTSDNGAVELDIPEAVHEEQDDKPPSTSVATSTTSSNRPEDRARLGSSYLHKGPARSGSITEQVVDVNGIRKVILHTTSSNTSSDDERSSNNQAKFPVRQDGQLINLDDDQSAPAAQPNGHKKKKRRRKHKSRTKNSDGPPDEEAPLLS

SEQ ID NO: 33792 - protein, 559 aa, A.fumigatus
  UNSURE (549): Identity of amino acid sequences at the above locations are unknown.
GCIAPAIPAAMSPVAPQLPTRFPCWCRAIYSWGGETKRDLGFVEGDLIECLNAGDGQWWMGRLRRDRRMVGLFPSNFVEVLGEDFVPVTRATSPMMPAGRSPITNPTSAPKKQKTVFRKPFQAHKEALAPAELARNATTTTQASSSIPQTPPRNGSSVRSVKPLRTPTTAVKNQSSLSRPPSQHRPSSGGGSPHAPPVADPPPQSPTPARESISRSRPPSRAPSPRLPYDMDLLPPSVPVRHTPLARPPSVHPPSHEISPLQLQEREESPPPPPPPPHRIAVNRRPSMDMDVPMHLDMNDRYATMSRTPSPAAHSDANGNTPSPLRDAMEDVMTSLEDMGLSRGAHSPSPAPVFDNPWSPEAFDSLRDSRPARHGHRPLTSLGFEGEQDHQFPDSQIHRNTMYGHDHYLDGPPQLNNYVQRMESRLRQMQEQSRRGSEDILPPEDAEGPPPPPPKHLAHHGRHTSVPAQYPYLRSQRSGQDLRGDALNRSHTKSSTTTSSSGVQSISTAMTASTEQTSQSLMSGPSAGAFSATSAGSYARRGLTTGNDXHYEVAGPRRA

SEQ ID NO: 33793 - protein, 124 aa, A.fumigatus
TEQFRVLREKGTEPPYTGEYDSHFSSKGVYTCAGCNAPLYKATHKFKSGCGWPAYFDSIPGAVTRHTDRSFGMERTEIVCSNCGGHLGHVFKGEGYPTPTDERHCVNSISLKFTEDEEAAKSKA

SEQ ID NO: 33794 - protein, 67 aa, A.fumigatus
RYILLDPRWASWNLGIFICIRCSGIHRGMGTHISRVKSVDLDSWTDEQLQSVIKWGNARANKYVSSR

SEQ ID NO: 33795 - protein, 364 aa, A.fumigatus
HPFQPLAVVQEKAKIERSSSQRVANTSQPPITHRPQASIDFFGDNEPITPPVRPSTTDPTPRIAAPRQQSQSQPATKPARPGDSLLGLDFFGSAQPASTSRPASTASTPGGSAGMSRPDLKQSILSLYSKPQPPVQHERESSFGDLASPAPQSSSSNLGGLTDAFSGLSFPSTTSPPSKPAEKPSPFANLTTFASAKSSPAAPKITSPTASASSGLGGGLFDSLTSPTIPPAKPQPQSRTDSIPPSSHDLGFTSFATAPSPKPNPPRSSFSNDLFGLSSTPAPAAPAAAPPTMASPQQELKSAFNLSSPAPAPAPAPAPKPVNSTSTVSGCNLIPNLEPWGGNNWIIPNRLPLPHPPQALIKVP

SEQ ID NO: 33796 - protein, 116 aa, A.fumigatus
  UNSURE (24),(96): Identity of amino acid sequences at the above locations are unknown.
LPCSHRRRKGLPAQSPRVSPSGVXLALYCRIRGARILLWRKEYLFELHPISSAKGYTPCAHLKNKSSPKTGGNGAGAPPRGTQETAGALGMGLQAXSGLVLLFAFLAYVLPILGGW

SEQ ID NO: 33797 - protein, 143 aa, A.fumigatus
  UNSURE (106): Identity of amino acid sequences at the above locations are unknown.
RDQLRVNKRGPSISSSEELSTSLIVHQDVYVRPAPCLALLTIPAPPGDSITGNTITSDSINAKGDLEKHDYEITATSTEVDDYPAPTEEEKASLRKVPASLPLVSXSLCIVEFAERASYYGAKNIFSNFIQFPLPKGILPVLI

SEQ ID NO: 33798 - protein, 125 aa, A.fumigatus
PFQMLSHSNNQNRTVATEVFFYFLIWLLNERGIGSVSTNQGASMTTNGAPNDLLNNFNALTIIVTIPFLSHVVYPTLAPYKNSLAPQAGLPLDSSSQPSPASSQGSSSGACSIPHLRLSGFNCYD

SEQ ID NO: 33799 - protein, 228 aa, A.fumigatus
QCRWADVYVGRYKAICVGVAICGVAHIIQIIGAIPSVLQKGPAHAAPPFIIGLLLLALGAGIFKPNIAPTILDQNRQKKQYTKVLKTGEKVIVDPELTTTRTMLVFYAFVNIGAFYMLPTAYAEKYVGFWLSWVLAGAIYFLLPVVLALVYKKTYKQPPSGSSDLTKAVKIISTALRRNKYRVWKKNFFDAAKPRALAAEGIEVDWDEKLVDDVRRTLGKSISNPSKC

SEQ ID NO: 33800 - protein, 115 aa, A.fumigatus
RDSRKYIFASPFLFYCVGRIVIFLLTLHLEPLDKLLYLISVQSIYFKLYCANNVFDRHLRPIDYVDNLDRRQHGFVIFGGFNPFSLQLQCHHGSFNINIAPAAPEKHFDPTAEEQ

SEQ ID NO: 33801 - protein, 187 aa, A.fumigatus
ILSRLTLLEETPENTSLPLHFFSTVSAGSSYFSLPFTWNHWTNCYISFLSNLYTSSYTVQTMSSTDTSDPSTMSTTSTAANTASSSSAASTPSPSNSSVTTAPSTSTSRRPPRKSTLTQQQKNNKRQRATQDQLVTLELEFNKNPTPTAATRERIAQEINMTERSVQIWFQNRLVEDGFRRFLNCMY

SEQ ID NO: 33802 - protein, 70 aa, A.fumigatus
TLSSLHWGSESLSQLTPLVCFPRFSLVFFLSSSSFLLTPPVSCQPSLFFSFPLSLFFTLHSFVSSILSLC

SEQ ID NO: 33803 - protein, 368 aa, A.fumigatus
CSQVIHHFTCRSLTIGSWRRIGQNAMDLVVFYSPEKACMTYYINNDSAGYKIEYPFSYIKNITLESGDANAQPNGVPTRPAGLLVELNRPPLFYMDSSNSGGFYQCGDFTEDQQASQILVHHLGGHPKVLSVQLAKLVSLESFQNRLAYSNLTMAPPMSPHFIQRPASQPNQFAPAFMNMYQDQSTLNIPVARGHKRQRSRSVPVAVDFSAMQMSHFPSYNMPQTPTPYHNADSGIFAPVPQSAQPLALNLRIDTSPSYGFDPRGHPMSATTTGSPSDFASPSIFATSATGESTPVATHMGPSFSLPFVAPSVDSSSMGHAAPSYSNVSHADPMIAEHSPPLSNMAHTPQDMHTLRTDLNSGVKEALP

SEQ ID NO: 33804 - protein, 217 aa, A.fumigatus
CLQVTATFVDETEEVADLYQVTDASIEVSSVALDQRPSPRPGLSSHGTPITDATDAFFLWRYIDFIGPRFDMFDDAPRYFSTVVPQLALKDPLVLLACVAVAARQYSLVNDQQQHSHEQALTYYNAAIHLLSKRLHDSGPDPAVFASCLLIAHCEMVESKASAWDLHLKGTGDLLKMYGWHGMSGGLAQAVCPISVCCDHVANLQPSIHSHSGFTAG

SEQ ID NO: 33805 - protein, 147 aa, A.fumigatus
VGGVWKCHCVHNRNADIGYEACDQCRRSHVKCDQSRPCALCKRRGIECSLCQEVTFTALEFKAPAAGLSRSFVSNTVDSPGEQSPRDGSRNTLMPSSNSNLCGRNGRGRRPIPGHRCEHRGLERRIRPASVATAWTVKPRYPHHGCH

SEQ ID NO: 33806 - protein, 120 aa, A.fumigatus
TVTSTRVLSRSSSAFSFPLLLLTHLRHCIGAGESESGSSQKSCGLRTRDYDVPLRIGTLFVVLVTSSIGVFLPMLLVKLPSAKINGVVSTVIKQFGTGVILSTAFVHVCLFSIQHDGRSN

SEQ ID NO: 33807 - protein, 270 aa, A.fumigatus
PEQLYTHANLMFTNECLGELEYEATTSAVVMAGIFLSFLFEYIGHRIILARATRCASPCPEQTGDMSPSSTSKELPASQPPPPPPQQQQPPTLAALGHHHGPPLDPTNPNTKLSVLVMEAGVVFHSILIGLTLVVAGDSFYKTLLVVIVFHQFFEGLALGARIAMLPGPLLGSKALMAGTFAVITPIGMAIGLGVLHSFNGNDQSTLVALGTLDALSAGILVWVGLVDMWARDWVMDGGEMMNARLSIVAVGGFSLIAGMVLMGVLGKWA

SEQ ID NO: 33808 - protein, 157 aa, A.fumigatus
SSSSERESSSPLRLFMYVSSPFSMTDGATNPNSSTRTPTSCSPTSVSANSNTKPPPPPSSWPGSSSPFSSSTSATASFSPAQRGARRPVPSRPATCPPHPQAKNYRPANRRRRRRSSNNHRPSPRWATTTALPWTPPIPTPNSRCSSWKPGWSSTAS

SEQ ID NO: 33809 - protein, 169 aa, A.fumigatus
YIAHPSSIVNRMTTTIRYATEADAPAIAELNIICFQDGPMYRNMLPNIDPLSATPMKLSRTYDKLANPRMHVLVATDPTSNQILGCARWLMPDASAHWRDESEMAILSDDARAKAAQMTQLRPAGMNVAVYEGLFKALEEMRGKYVREGDIGECTFPPFFLSQYLEDAG

SEQ ID NO: 33810 - protein, 207 aa, A.fumigatus
RTEQLTRTALHARQPHVHQRVSRRTRIRSHHLRRRHGRDLPLLSLRVHRPPHHSRPRNAVRVALSRADRRHVPLIHKQRTTGQPTAAAAAAAATTTDPRRAGPPPRPSPGPHQSQHQTLGARHGSRGGLPQHPDRTDPGRGRRLILQDAAGGDCLPPVLRGSGARGADRDAAGPAAGVEGADGGDLCRDHADRDGDRAGGAALVQRQ

SEQ ID NO: 33811 - protein, 139 aa, A.fumigatus
IASEQTRLRPLPQHPHQDHSRDQREPSNRHNAQSRIHHLAAIHHPVPGPHVDQPNPHQDPRRQRVQRSQRHKRALIIAVERVQHPQPDRHPDRRDHGKGPRHQRLRPQQRARQHRDPRPERQTLEELVEDNHHQQRLVE

SEQ ID NO: 33812 - protein, 62 aa, A.fumigatus
SLPLNECSTPSPIAIPIGVITAKVPAISAFDPSSGPGSIAIRAPSARPSKNWWKTITTSSVL

SEQ ID NO: 33813 - protein, 75 aa, A.fumigatus
VLFFSTEVRSSYDCWTQLTQVPCAQFHSPVPTKMGSKPSSFPRGYSVILKQTVILNNVMIIEVNRHLHYSKNSDL

SEQ ID NO: 33814 - protein, 176 aa, A.fumigatus
RTTSDLLRRHIRIYHPNRAPPASRAQKACAACHARKERCYGGFPCSACQKRGIACSPGKGKTPEEQIVDNNVQISQQPHPPRWIALDYVDIYFDNFHPKWPFLHRGTFDVTKEPCVLIQSVVMIGLWIEGSKKSREAATDLHRSLSTAIRTQMVRAYKNPGNLPLLTTFFFLFHPS

SEQ ID NO: 33815 - protein, 191 aa, A.fumigatus
KTDLSLLSDTMPPQPLSGSSLPPFQCDHPGCGAKYRRKEHLNRHAASHSRGDCFSCPYCESTLTRRDAKPCILLALIDRHTNERPVTSCAGISGFITRIERLRRRGHRRLALRVTPGKNAVMVDFPAVHVRNGVSPVLLGREKLQKSRLSTTTFRSRNNPIRLGGSLLTTSIFILIISIQNGHFCTEGHLT

SEQ ID NO: 33816 - protein, 83 aa, A.fumigatus
AVMHPCWMPRSIDIMPLGGSRPDEYTLLSVRVVFSRRPTSAGYYNNTIYQLLPITIRAQYKTTSSYSFLSPMAFGASTRMPLF

SEQ ID NO: 33817 - protein, 307 aa, A.fumigatus
ICHQNVTNAQAYIELAAGDRIQLHWTAWPECHHGPVIDMLASCGESCTTVDKTSLKFFKIDGVGLVDNSAVPGTWGDDQLIANSNSWMVEIPKCIAPGNYVLRHELIALHSAFETGGAQNYPQCFNLKVTGSGTDSPAGTLGTELYTESDPGLLVDIYKSIASYAVPGPAMYTGAVSITQSTSAITATSTATVGSGADSTPVPSSAASSEYSTVAVQVPTTKAQYTPVPSSSPSTFVTSPAPTTSVPSGSSVPVTSNTAAPLPTAAPGGTQTVYGQCGGQNWTGPTVCASGATCKTWNPYYSQCVPN

SEQ ID NO: 33818 - protein, 202 aa, A.fumigatus
SPCIARLRQAGRRTTPSASTSRLLDPVLTHQLVPWARSCTPSPTPVSWWTSTSQSPRTPSPVLPCTPAPSPSPSLPRPSPRPAPQPSAQAPTAPPCPRLLRPPSTRPSPCRFPPPRPSTPLSPPARLRPLSRRLRLPLLSPAAAPSLSRLTPRLPCLLLLLAVLRLSMVSAVDRTGLDPLFVLLARPARPGTLITPSVCLTR

SEQ ID NO: 33819 - protein, 101 aa, A.fumigatus
LAYRAVPLCHVLARLSRPVCNPQNKTPSPVHELSSVMRRHRVNISNAAILGLQKDLNIENTKYNTALTIFFVPYVLFEIPSNILLKKLKPHVWCMSFVFLR

SEQ ID NO: 33820 - protein, 122 aa, A.fumigatus
LSVPAIKTQLYSVAPWAAAFGFSMLIATLSDKFRHRYIFAMIPMLIAMGGFGILLNVHGVAHRNVQYGALFMVTGGCYSSMAVVVCWYAMNLSGHRRRGVGTAWQIGFGNSKLQFLQCVRGA

SEQ ID NO: 33821 - protein, 75 aa, A.fumigatus
LLFGYIGVSETDNGKAEGEIYSESADLPPLSTTTERKLMAKIDWHIVPCLCVMYLLAFLDRYAILKTKPLAPCMN

SEQ ID NO: 33822 - protein, 82 aa, A.fumigatus
  UNSURE (43): Identity of amino acid sequences at the above locations are unknown.
PVGGIIATYSFLAKDAPLYRNGYIISLSFLCFSAACCTAYLAXVWYDNRKRDRAMANGATIELTEQEQEQLGDLAPNYRYTY

SEQ ID NO: 33823 - protein, 186 aa, A.fumigatus
VCFLRERLTQSMTNRDVAGFYLLGMWYKRSEAQKRFSFFFSSTTLAGAFGGLLASGLGEMAGLRGYNGWRWVFIIEGVLTCVVSLVWFFVLPDFPEDVKWLNDEEREFIRAKLAKDVGAAGRDVKLTVRDVLAVFKDCEWRASLGVLIFADSFLDKIFIGGFMYFGQIVTAYGEHDSTWLLNGFHS

SEQ ID NO: 33824 - protein, 82 aa, A.fumigatus
TMEKEQIKVDLGDSQRITAMDEKQPVPTELGVMGDTTLEQNGFKIHPQPTSDPLDPLNWSRLEKHTILGIVMFKSVLAKLNV

SEQ ID NO: 33825 - protein, 126 aa, A.fumigatus
ESSCSSQSSQSSTYSQPLLIFDGRYFLFTYITTTTVPSFPELQSQFSISYSEVNWTVAIPALGLSVGPLFWTSLGDIYGRRTIFITGTVIALVSTIGVAVAGSYSGYMAARFFQGFGVSPAATVGM

SEQ ID NO: 33826 - protein, 63 aa, A.fumigatus
IDESLMMALLVLSRCAKFQLFYNEVLTIYSLTESTQSGFDCNHLSSFFSNRSDVIFDGIIDSP

SEQ ID NO: 33827 - protein, 100 aa, A.fumigatus
VKLVIFVCSPPTFSLLTSSYFPKYSWNIRPTAYALHPTDLPEVEATMVALQAVQAHNAALTSLASGPVAVFGMFAFYIILPSTMEQLLQIFLFRKKPSSR

SEQ ID NO: 33828 - protein, 325 aa, A.fumigatus
YPPVGGTSGIALSTALAFTRYTTSPKIYLVGRSQSAADTAIASIKRINPSAQPTFLQADISLLKNVDSVCAELASREKSINLLFMTPGYLTLKGRDETAEGLDRKFVLHYYARMRFITNLLPRLSAAAQDPSVDAGARLSRVVSVLDPMVSVRAGGAGTLDFSDLSLKHTFTLQKCGWHASLMGNFFLESMAERHPHTSFVHAYPSGVATGVMRELPAGRVLSAVLTPLLRPFMVPLHESGERHLFAATSGRFPSKAEGEGSEGDIAAGSDGTKGSGCYWLNWDGEVFPPNKKIQRTRMQGAVDKVVQHTEEVFKQVCEEGNTYP

SEQ ID NO: 33829 - protein, 261 aa, A.fumigatus
RSCVPETNLEPADTNRSNRAAEGPQTLVGSDSPHSSAPSTPEDSSRAGNRRSEAVKIAGEDYFLPDGRIPEARSSPATPQPVVTKTLVFSPRIQFHETWPSGEYDRRGDIATCNRLTPLLAQQIKEELNNFKMVSPHRDKSIPALVPTCILTLNHRKWKFTRPRRSTLISCEALARDDIVWHVSYCTSAIVTRPPSGVAFCNWHFKPQALACVSFFFRPMHDGRAFAKRAALVLFRLPIIPRPCVFPLVPAFVGVMPTQPF

SEQ ID NO: 33830 - protein, 65 aa, A.fumigatus
  UNSURE (2),(31),(35): Identity of amino acid sequences at the above locations are unknown.
RXTSPGKRAEVCHFNSAYTNLYHSAHIDRRXTPQXCTTLGPSSPVVKTKENKDIMMQKKRVRHAR

SEQ ID NO: 33831 - protein, 350 aa, A.fumigatus
YDSHFAFPCHYDFEWPAAEMMEPAVSNGGPVAEDNIINRRGGESIYQSCVNLKKRLAEVPNFEPHLREMEEEDERLGNTDPVASLWNCLRNGYPLLTIYNASDPPELLEIDPSKVPEAKRPKAATFKFLQASLQELAFPQQDCFLITDLYGDSTTGFIKVIKMVNRVLDILEMQGQLKRSLDSTTSAPAKGAVKLTKREFILKELLETERDYVHHLQNLQALKKELEETGALTGDASHQIFLNLNNLLDFAQRFLIRMEQHYALPEDKQNWGELFIQHEEAFRQYEPFISNQMRCDEVCLKEWDKIRSAPRPLDLQQMVAQPATLNSFFVKPFQRMTKYPLMLMVCCFQI

SEQ ID NO: 33832 - protein, 95 aa, A.fumigatus
CVRTVINLWLQELRKQTEDPDLQADITKAIDTIQSVLDSANDAIDKEHLASAFLDLDERVDDWKALKIDSFGELLRFGTFTVLQVFTTPRASMCE

SEQ ID NO: 33833 - protein, 121 aa, A.fumigatus
FKVLGGIADTVAQLITAFKARSTVRTRQDGDLISIEIHEMDKERPPPVGELGHAKHIPPPLDFERLTRFMSYGFFMAPIQFKWFGFLSRAFPLTKKSPTLPALKRVAVDQLMFAPFGMDIS

SEQ ID NO: 33834 - protein, 115 aa, A.fumigatus
SAHVRSFRYGHLLTSKIRAWADFDKGLACFFTFMTVAEGGGKRALTRKFQDVYLPTLKANYVLWPAVQILNFRVVPIQFQIVSEVSARLICMVLTIICHSHLYLASVSLGPHTCP

SEQ ID NO: 33835 - protein, 96 aa, A.fumigatus
QTKATYPAVGPKLIEEAHREHIRSGDFSLYFVCLVYPKVYSLCSSFPRASLADTAYNLIETPYTMSLTNKLAITDVDLKDKRVLIRVRCAETASMS

SEQ ID NO: 33836 - protein, 116 aa, A.fumigatus
HVPRAWQVDFNVPLNEKKEVTNPQRIVGALPTIKYAIEQGAKAVVLMSHLGRPDGKKNPKYSLKPVVPELEKLLGKSVIFTEDCVGKEVEETVNKASGGQVILLENLRFHPEEEGS

SEQ ID NO: 33837 - protein, 706 aa, A.fumigatus
SGTEGSPSSRKDSNFSQHVASTFAGSLRNLYLADNRLEDDIFRELSLIPELRVVNLSYNELTELPQGLLKRWPFLTELYLSGNELTSLPSDDLEEGSNLKVLNLNANRFQVLPAELCKVSKLAILDVGSNALKYNVSNWPYDWNWNWNRNLKYLNFSGNKRLEIKPNITSAGTTTANGTDLTDFNSLTHLRVLGLMDVTLTTPTIPEENEDRRVRTSASLAGSLAYGMADFLGKSEHLSIIDMIVPRLKPDNVETLVGLFDGQAQSTGGSRIAKFLHENFTSTFSSELKRLRVEEEETPLDALRRTFLALNKNMAAAAYKSIDDRSVRQFHRGSPATKLLNQDDIRSGGVATVLYLNNMDLYVANVGDAQAILVKSDGTLKYLTKNHDPAEPHERARIRAAGGFVSRNGRLNDILHVSRAFGHFQLMPAVVAAPHTMHVQLTEQDEMIILASKELWDYVTPDVVVDVTRAERRDLMIAAQKIRDLAISFGANNKLMVMILGVSDLKKREKFKFRGTSLSMGPPAFPEEQIIPSTKRTKKPRDMPGDSRLARFDYVDAPIGELAIIFTDIKKSTSLWETCPDAMRSAIQIHNDILRRQLGIIGGYEVKTEGDAFMVAFSTTTAALLWCFNCQTQLLEAEWPTEILEQPQCQVQYDMENNIIFRGLSVRMGIHWGEPVCEKDPVTNRMDYFGPMVDRALFTTRRRHRK

SEQ ID NO: 33838 - protein, 89 aa, A.fumigatus
TRKYSIIFRYLATIYIHHVPFDASGRLLSNLVRDIYYRVAMCCSLSLIVPPNFAGLPWKSRSEKTLNLGTHMGAPSSCRVRYWPLQQIL

SEQ ID NO: 33839 - protein, 238 aa, A.fumigatus
INISFLLPFLQTGETAAVFKGPTAPVTSVCFSPDGRLLFAGCWDKTIWSWDVASGQPQHRYEGHTDFVRSVISSSLRGQDLLVSGGADAQILVFDIASGKRLYTLKGHAKGVQDLIMDPTSLDLESKSLVLFSAGSDREIRWFDITCGSQDLTAMDPLLAHDTSVYKLFFDSDGDLWTASADKTAKCLVREDGWKANLTLPHPDFVRDVVVYEQGGWVITACRDEEVRVWHRSVSQCL

SEQ ID NO: 33840 - protein, 68 aa, A.fumigatus
NSQTGQLYHTFSGHFEEVTGLVLIGSTIVSVSIDATIRQWSLRPDDLRTAVEKAKRVKAEEEEQSEQN

SEQ ID NO: 33841 - protein, 157 aa, A.fumigatus
STKPMQCVFFLCYRHDCGNLDNLLTSMKQSMSRPGPAPQGPSQSQPPQQSQAPRPNPPGYPQQPQFPGFYPPYGQRFGAPGFPPGPGFPNMPYGAPPGWYPPPGQGFPPGPGQFPPQMPITAPGPQSPPQNRAGAPGAGPVNVPKATSELPVGDRQT

SEQ ID NO: 33842 - protein, 131 aa, A.fumigatus
TVLLARPLTNLLIPSYVGTLHEINPEASTIALENVVSFGTEGRRGNPAEEIPPSASVYEYIVFRGSDVKDISVAEEKKENAQPEPPRVPDDPAILGVSSTGPLNSFPLPFISWEPMLASRSNLTRSGWLIR

SEQ ID NO: 33843 - protein, 432 aa, A.fumigatus
KLADSAIPAGLSSTKCRHLMPPENDPSYHNIGVTLSVNMPGLGHETGDRARNASGIKNLYAKTDASHYKQIDPETLEPIGLAAQKDLHPELTGPLSAAHARSDPVTGNVYNFNLAFGPEGSIYRIFCVSASTGTTSILAQFPGTPAYLHSLLITDDYVILCVWNSHVNPTKLENSFVEAIQPFDASKPATWYVVDRKGSRGLLATYKSRPFFCFHTINAWQEPSADDPKQTDIVAELVTFDDLTIMKKAYYENMLSSSPSAKTFVQGKRDGCRSALTSFRLARIPSAPTSEVQEASINWTACQGYAPELPTMNPRYVTQKHRYTYAVTDCGESTFFDGIMKYDSVAKETIVWKQHGHSPGEAIFVANPAGADEDDGVLLSVVLDGKTGKSYLLCLDARDMSELGRAHLNGPVGFGFHGQYVPTGGGLPTGDY

SEQ ID NO: 33844 - protein, 67 aa, A.fumigatus
KQPRKTFDPAAILKARDLIKLLSRSVPVQQVSFRSDTAPNPSVTTDHRGPGPENPRRRRRMRHHQDP

SEQ ID NO: 33845 - protein, 221 aa, A.fumigatus
YGRGDGSVQGAEGGPPGGQRLHGQHPPNLPHQGAHDQARAGQGPHARQRILGPVPAQLQEAYVVEAPRSLQGYGQIEEGVHTVPTSAGKEQGGSADRVRRVLPVQGGQGARPERGGYGAAAPEARGEDEGAGKVVYSPRGARGRGEKEGEEREEEAEARGRGGARGQLREEGKEEEKEEQVEGRLFGQRSIEALVPQLPLCFIRRSHSAPAIFFRLFALQI

SEQ ID NO: 33846 - protein, 266 aa, A.fumigatus
VFAVTRPPTPASQLTTVVQALKILEDGVACDIIKIRNQVRNKERFVKRRQRLLGPSGSTLKALELLTSTYILVQGNTVAAMGPYKGLKEVRRVVNDCMANIHPIYHIKELMIKRELAKDPTLANESWDRFLPNFKKRTLSKRRVPYKVTDKSKKVYTPFPPAPEKSKVDLQIESGEYFLSKEAKERAQKEEVMERQRQKREEKMKERAKSFIPPEELEAEEKKKEKKEKKKRKREAEAEPEDSSEKKEKKKKKKSKSKDASSDSEA

SEQ ID NO: 33847 - protein, 73 aa, A.fumigatus
STSPSHGGGMVLKEGEMDITGMARIHFYFLSGENHDDHLQMKEKQDNTVQVALVLLQCDEYDESNCIHVCNTS

SEQ ID NO: 33848 - protein, 424 aa, A.fumigatus
DFEHLADQDDVADTQALGQASEEQAKALDQNKGVESDVKPGDNDMLPDAGEEPQDVAEENRLEDDMQIDGEGVPTEGQTVGALIPDRSRTQERTTDPTGQLEANEGLDEVDAHLAAIHLSSTLPPLTPREEAQRLWSHYENATNNLSLSLTEQLRLILAPTLATKLRGDFRTGKRLNIKRIIPYIASQYKRDKIWMRRSIPSKRNYQIMLAVDDSKSMLESGSGQLAFETLALVAKSLSMLEVGDLCVLGFGNEDHVRVAHEFGKPFSSEAGTQVFQHFSYQQTGTNVRKLIADSIALFREARWKQSPAGGNADLWQLELIISDGICEDHDTIRRLVRQAQEERIMIVFIIVDAVKGSSILDLTQASFEPDTESGTGEMKLKMKRYLEGFPFPYYLVVRDVRELPAVLATALKQWFAEVVDVSS

SEQ ID NO: 33849 - protein, 81 aa, A.fumigatus
  UNSURE (7),(28): Identity of amino acid sequences at the above locations are unknown.
SLFKEFXAFEWARSSEKGPCWSRYRHHXFQASKEFLQLGTCGTLYHDRGPIVIFRNAVLNSYQDNAQPVHPKHGSCIVLRL

SEQ ID NO: 33850 - protein, 425 aa, A.fumigatus
IPIKTTPSQSTPNMALVSYSDSEASDSEQETKVTQPSIKSQAPTPANPPKSSSGANFVVDRSNPRKIRVALPDIKPENHTADDEDGPARKRVKIGGGGAFSGFNALLPPPKRANVTVEKDKKTAAPARKVFSLKTGAAPGFDREADEDFRREQVFDSLAGNGDGDDEMIPKPGSLRSEQPSNNDAAEARVDGERKEEIKLKGNPMMFKPLSVGRASQKKKKQPTKPVSTPLPTANETTALQSSQPPNEQPAQPATPVPQKPKISLFSLSTEETTTSKMPEPQAQAATYEPLVYTTDLETTPAGPEPEPEPVTAPSQPPTDQTLGNIADDLNLSRAQRRQLFGRTADPSKSRILHFNTDKEYIANQELAHQTDLAAAQHNPVRAIAPGKHTLQQLVNAASTQREALEESFAAGRRNKKEAGSKYGW

SEQ ID NO: 33851 - protein, 73 aa, A.fumigatus
QVNCRKMGVHLIQPLVSLKLTGRVRCSLLCTGSVRYQCAYGLPFGRNSFSIYLHVILQSILLRNILRLFASVR

SEQ ID NO: 33852 - protein, 107 aa, A.fumigatus
RLVERPVVLNFRQILQKFNQITAPITLVCAGNRRKEQNTVRKSKGFSWGPAGLSTALFTGPLMADVLRYAKPLRQAKYVCMEGADKLVSIPPGIAHAILWSTDLAIA

SEQ ID NO: 33853 - protein, 326 aa, A.fumigatus
PLAERCTRTTVSPEMAASDPMWWRDERYAIYDLNVNSAAAYPQHNEVLDLATAGPSYTAKGYAYAGGGRRVTRVEISLNKGKCMLSNLYHFLTKLTCLAAWRLANIQYAEDRYRDFDGELFGGKVDMPWRETCYCWCFWSLDIPVPDLEASDALLVRSMDEAMSVQPRDMYWSVLGMMNNPWFRVTITKQNGTLLFEHPTHPVMAGGWMERVKKAGGDLTNGNWGERQEGEILAEPEPVKEINMKKEGLNRTISLEEFKKSNEEGAQWFIVKGEVYDGKPFLEGHPGGAQSIISSIGLDVTEDFSEIRGFSNSCLLRKRRANIIYR

SEQ ID NO: 33854 - protein, 79 aa, A.fumigatus
PNGYYGTSVKLNWAMDPNKLIMLAHKMNGEPLRPDHGRPLRAVVPGQIGGRSVKWIKKLILTDAPSDNWYHIYDNRVLP

SEQ ID NO: 33855 - protein, 109 aa, A.fumigatus
ENAGLTSFTDSETAKAMMPDYHIGTMDEASLKMLKEARKEEEPSKPRALFLQPRSWTKAKLAAKRDVSWDTRIFTFELEHQKQKLGLPIGQHMMIRVQDSTTKEKIIRS

SEQ ID NO: 33856 - protein, 73 aa, A.fumigatus
SRRSTKQRMKNIISESLASHSRVLTARRRGPSRVSPYLLHKFYGGPTYMNWIAGKILNSTQEGATGAGEFLWS

SEQ ID NO: 33857 - protein, 95 aa, A.fumigatus
VIFSSTASPLLLTRCNFQKIVYAKGTSDVIARLRGTYNVPTTTATQATGASTDLQKSIFSGPPGSTALPPKPAGQVNGEAQAAHGTKRPREEESD

SEQ ID NO: 33858 - protein, 158 aa, A.fumigatus
SSVKPKWYTLKSKRKPAKKKDSTVSGEILLQFALIDPSNASAPPTEIYQRFRSLVCSSEEDDDLPPVPTNESDEADRDEETSDETDDLTKPEIVEKRRKRLRLARLKRKSLAARAYQFSGVGNGVQGIVFMEIVQVTDLPPERNGMSLDLPSLRRLLI

SEQ ID NO: 33859 - protein, 455 aa, A.fumigatus
LLAVTYPELKQAELNAPQAVITCERKSIHSTASALFRTLPQCIPMNPSQFGLVSSIYTLGGLLGALLAGPVSTKHGRLFALRATTIFFILGPAAETFAPGIPILSVGRLLSGVGAGAAIVVGPIYISEIAPPNAKGFFGAFTQIMTNVGILFTQTLGYFFSKGNQWRAILAVAGLLGGSELLGLFFVSESPTWLAEHQQANLARHVLQRIRGKGSDIEEEIEGWKSSERPTGPEEESLLTPPSGNLPPKQPPVTILQAVTDPYYRPAIVAVIGVMVAQQFTGINSIIMYSVSLLQSLLPTGAALLTVMISALNLVITLACSPLPDKIGRKTCLLLSISGMGCNSVLLAFGIYFNQKILSAIAALLFVASFAVGLGPVPFILASELVGPEAVGATQSWALAANWTATFIVAQFFPVLNDALGGRGKIYWIFAVLACLLGSFIYRWVPETKGKANAD

SEQ ID NO: 33860 - protein, 496 aa, A.fumigatus
  UNSURE (440): Identity of amino acid sequences at the above locations are unknown.
KGYRTTVKMQPKAVQDAHASFPAGKHAADETEHLLPHDPPAEINIWGSRRRPRSWWALVAISLLLLTMTVLSLAVFFTLGFGAGAAPHVPHGRLSSPIKNVVVLVQENLSFDNYAGGLTYSPSIDGLVNRKYCNPANISDPHSPMVCAQPTAKNIAPDDPDHSITGGNQQVYSTYHPDSDFDAPNMQGFVAEQIAAYGIDGNLSRAGEVINYYTPEHIPVFNAMAENFVLFDRWFAAVPGPTNPNRAYLTSGTSHGHGTNDPDFDRSALPQRSIFEQLSEHNISWINYSNTTGFLPDALFYRWTAVSGLGETNVRPIDQFYRDAKAGTLPQFTWINPECCSYMSFHPPSPINMGEGWIKSVYEALRSSPQWHETLFILTFDEHGGFADHVPPPENVPAGDDLTYTETARDGKPSTFAFDRLGIRVPTVLMSPWVGKGVVXNRPADGNGEFTHTSILKFVADLWGLEYLSPRVAWSASFAHLITDTFSGGYARQPYP

SEQ ID NO: 33861 - protein, 193 aa, A.fumigatus
  UNSURE (7): Identity of amino acid sequences at the above locations are unknown.
YTAFRMXGIVFSSIGAGMLTTLGVHTSSAKWIGFQVLYGFGLGTCNQIPNMAAQTVLPREQVAIGASLMFFAQQLFGAVFTSVGENVLSNQLAKRLAISSQTVQNTGATQLLEHVPVDDRVASLGAYNDSLQVVFQVGLIMACLAILGAVPMEWRTVKKEQLSSTSDRNDGQAEEGAPGNAQSTMDYKQGTVN

SEQ ID NO: 33862 - protein, 120 aa, A.fumigatus
TASTATRPISPIPTRQWCAHSPRRRTSPRMIRTTVSPAGISKCTAPTIQTPTSTPPTCKASSRSRSPHTASTATSRAPARSSTTIPPSTSPSSTPWPRTLCSSTAGSLLFPAQPTPTAPI

SEQ ID NO: 33863 - protein, 138 aa, A.fumigatus
  UNSURE (12): Identity of amino acid sequences at the above locations are unknown.
SPASGNIRPFGXSELSFLPSAPVCSPLSGSIRQAPNGLVFRCCMVLASARATRYQTWRRRQCSPASRWPSARRSCSLRNSCLAPSLRRSARTCSATSWPSVWRSVRKRSRIPVPPSFWSTFLSTTVLHRWGLIMTRCR

SEQ ID NO: 33864 - protein, 318 aa, A.fumigatus
HIALLAIHTRGTHNSPTCHVAAPSVRCQAVSPREQLRNGVRFFDIRVQPQFPEDPSKDELILVHSVFPISLTGNKYFRDLMRDVNEFLNENPSETLIISLKREGPGNHTDEQLSRIVRDHYARPDSRWYTEPKIPTLGEVRGKVVLLRRFNIIEELKHEHDGRGWGIDGSDWADNTPNATCSSGQLCIQDFYEVLETKNIDVKIKYVTEHCERSSGHCYPFGALPDPEASKAHPFYINFLSASNFWKVGTWPEKIAAKLNPATVDYLCRRHSHLDGDWSTGILVTDWVGHEGDWDLVRCIVGMNAKLKMRQMREEQEH

SEQ ID NO: 33865 - protein, 76 aa, A.fumigatus
DALNTAVAYLVAAIPLLHGLSASAAFCCNAIASSTFPALYSSYTLDAVRGNTFANAAMQPADPTLNPASRKSDCPP

SEQ ID NO: 33866 - protein, 92 aa, A.fumigatus
  UNSURE (7),(13),(15): Identity of amino acid sequences at the above locations are unknown.
RRACENXRSLRDXRXGIRDPIREAQNGGSGVVIYFRKEGRALGEVVKYLVYNARKRGGDTADKYFTRTENIAGVRDVRYTVQNDPEFVLMIV

SEQ ID NO: 33867 - protein, 125 aa, A.fumigatus
MRFQALMPDILHWLGIKKIDRMLSMSNMKHDAIVQSGIKILKRVPIPEELIPSDSRVEIDAKINAGYFTTGKQYTMEELASVRGRGWEKWEDVTVSRALSVDEASLTLSSINLLYIRLFTSSTLS

SEQ ID NO: 33868 - protein, 372 aa, A.fumigatus
SYTEYKTPALPLSATPLTLQTISLTLSFPESTLQQANCNSTMGSSQPPTVSPQPHVPKPGVWCPAVTFFDHTTDTLDLDSQKKYYAYLSKTGLAGLVILGTNSEAFLLTREERAQLIAAAREAVGPDYPLMAGVGAHSTKQTLELAADAAAAGANYLLVLPPAYFGKATTMSVVKRFFADVAARAPLPVIIYNFPGVCNGVDIDSETMTAIVRESAAASPSGVSNVVGVKLTCASVGKITRLAATFSQDEFAVYGGQSDFLLAGLSVGSAGCIAAFANVFPRTASRVYELYRAGKVDEAMALQQKAALAESPCKSGIAATKYATAVFSASQAGIEAAGEKLRPRTPYEEPGEGVKQLVREVMAEVAEIERSI

SEQ ID NO: 33869 - protein, 86 aa, A.fumigatus
YVADNPSEIVAGNQHWGHATSKDLYQWTNHPIAIAPSQPGEWIYSGSAVMDSNNTSGFFPDQDDGVVAIYTLATEMVLTPGRVVRT

SEQ ID NO: 33870 - protein, 122 aa, A.fumigatus
LILPSLLTVGTGVPRLGVFAAVLTIRSSDPCWGTVGYKYPSILLIHPGWNVKHRSFNQTIKMRASFILFSAAVAAAQTAKYSGPVRPQVHFSPPSQFMNDPNGLFYDHKREVYHLYYQCELN

SEQ ID NO: 33871 - protein, 160 aa, A.fumigatus
LRSQTSSTPNGVVAAFKPVLIEGTMLRALSHDSLHRLREEQPPKLTYCEDESDDESDGYGSKSKKSKASEPSRGQAIGPRLGEAPKPNHVYLQWEARVVDAYIKVDQGDKHTGYLDFDASKATAHGEWAYPAMWSKESKLASSIYNRGDQPRENPTTWNY

SEQ ID NO: 33872 - protein, 133 aa, A.fumigatus
VNLGGCSSRRRCSESWDSARSMVPSMRTGLNAATTPFGVEDVCDLNQVALDKRREVYDSANAKGDVLSGLQGAETVCGITTSQSTNETLEDSKGMKIRSYKEPLGVVAAVFPFSVLPDMHSSMVGTDERRSPP

SEQ ID NO: 33873 - protein, 115 aa, A.fumigatus
YSPSWPRKPAFLPALLVSSTDIPRPSTSSWIAPHELTAMISFLGGYRAGEYVYTHGCATGKRVQANLGVMNHAAVLFNANRLSMPYVELLAASARQLCMALGTVVMIGVSDKWLP

SEQ ID NO: 33874 - protein, 121 aa, A.fumigatus
NPRACPGATMILAELAKEAGFPPGVISIIHGYSKAVNLILDSPSRAHGHDQLSWRLSCWRVRLHSWVRHWQACTGQPWCHEPRCRAFQRKQTINALCGASCSVCTPALHGSRHSGHDWRER

SEQ ID NO: 33875 - protein, 136 aa, A.fumigatus
GLIGLIAFTNQNISSASGNGDCPNSDGDYRLTLVDSNGFVNANGSSNLKNMVLGATPIVTVFYPESNLSQPDIQYVAVKPEDTSGLLGQVSGSLASGFTAPTVFALGTLVITLAFFSGIFGFSPRHMERLSEVIQD

SEQ ID NO: 33876 - protein, 62 aa, A.fumigatus
SLLILATPCSLIPQNIICTPDQTSFVSMSQPWDYIAKLVCIGDSGTGKSSVSVSHSFTRLLY

SEQ ID NO: 33877 - protein, 220 aa, A.fumigatus
NCADLRVVVKLTIRLCEGRFSSSHDVTIGVEFGSRIVPVGPPASKSLGVDSDVSDSSALTLSTARAMVASHESVASGLPSPPRKPLGDRSQKKMKLSLWDTAGQETYKSITRSYFRGASGALLVFDITRPSTFTSCTQWLQDLRQIAEDGIVVILVGNKSDLAEVKSDVNQRRVTRQEAEEWCRMNNVVRYVETSAKSGESVERAFLEVAERIYRNIEAG

SEQ ID NO: 33878 - protein, 484 aa, A.fumigatus
RATPLSFASFLLVSVCLTHIGNIDASRFLAQSQSRLGPPIDDARHNGSDRLNARSGIPRLSSSRAFFRMTLDPYHQATSQVSNLPFGSRNAPQHAPLFFSATDDFRDEDDEAEREREIADFYALQRSRRHFGSSQLKESSEIGGDGDSSISLEQQLLQDDRYVKRGRIRSSWRARSKSMDRESGRAFESIAMTADDHGGPDEVRRSRSLKENLVNVRLEDTLRSDEDVDKAGSVEGLDDSPPSVQLFREQASSEPRILGIETFLGPSEVDKQQLFDDHEPSSIADYGLEPYSVGETQSGAHDTFWGKLFLISLGCLLATSFLIYLHTSAPSGDKSRWGDTIYHTVHGSFYLLGIYTVVSVFISLLWLASLRYYVRPLVYAMIFAVPVILYAFSLYPFISSFKGIWHGTSIQDKAMRVVSLLPFIVSSFWIYNVVRSRHAIAKAIDILEFACRILAANLELLLLGLGILICIVSWTWVWMLMFVF

SEQ ID NO: 33879 - protein, 122 aa, A.fumigatus
  UNSURE (8): Identity of amino acid sequences at the above locations are unknown.
AGSPCSPXTFHTTSTIVQVVLSCLDIAINPLSNFEESAFDAFTGLCTGFNVANNIVHAAPLLCFLSGDTPLIHVGFHFREIALISNQNYNNTIFCNLPKILQPLGARGECRGTSDVKNEEGP

SEQ ID NO: 33880 - protein, 76 aa, A.fumigatus
CWRPNWNNTRSEFHANSNIMTGGEASFTESNSQLYNNTQVSTVLSEVQYNNRVNECDTLTLDFPVPESPIQTSLAM

SEQ ID NO: 33881 - protein, 439 aa, A.fumigatus
DCCLSILQALCRLRRCNSGNMILPISSFLYLCVLFIQSGAIALAQVPQDVLSPKRPFPQESTVPGISSEEWPLTPPGLIGETEDSIRSTLRDLVDALKVMQEEYFELWQGKWPTAIDWTAAVLGTHVSATLSSLTSTVGDVLLSSLSADTENAEGECQSAIHRSLAFENFINHFFGQSVSFYYGEDAISLRGQAYDDMLWVVLEWLENIKFQVLHSELHYDRSNASTEHRWHGVQFQIPAAHRARLFYELASSGWDRSLCGGGMIWSPYLGPYKNAITNELYISASIGMYLYHPGDVINSPFASPSRTSEVASDGYPHNPAHLQAAIEGYEWLKSSNMIGIGGLYADGFHISGWRSVTQPGTRRCDVLNPMVYTYNQGVILSGLRGLWLATASQDYLQDGHDLVRKVIRATGWPNKDAREWAGLGRGLHHGAGRSEQAL

SEQ ID NO: 33882 - protein, 77 aa, A.fumigatus
LTELPPLTVRLLLIDPSSIVSITEVQLRQYDITYIIIPISLCSIYTIWGHCAGASTSGRPFPEATISTGVNGAWDII

SEQ ID NO: 33883 - protein, 66 aa, A.fumigatus
NQSTNQRLCLARVRHVMIMSFRGSCFYSSDWTSVLRLYLYLLVPLYCILKTDGNVMPPTYLGTYDS

SEQ ID NO: 33884 - protein, 142 aa, A.fumigatus
AGLCLIACRSFLTYLIPLADSILWPILHYQSGVVYDDGPWQAYRRVNELFADAVAEAATRGSLIWVHDYHLMLLPKLLRQRLNKEKPCAIGFSLHTPFPAGDFWRALPVRNDLLEGMLASDLIGFHTDEYKSNFIQTCAQVL

SEQ ID NO: 33885 - protein, 265 aa, A.fumigatus
MDRGARTEIPGRIQYKDRLVETDKFIVGIDPQKFKDTLQKQEVQDRIKQLEEKYKGITVIIGVDRLDYIKGLTQKLKGYDHFLDRHPELRNKVILIQVAVPSREDVKEYQELETELSTIAGKINGKHCMCMSYSICGRVITQILNYELLTATPDGVPLLYMHRSVPFTELTALYSIADACLLTSTRDGMNLVSFEYIACQEQRHGVLVLSEFAGAASFMKEGSISFHPANTTELADAVYKAVMMGEDEKKKKYEYLRNFIETNTR

SEQ ID NO: 33886 - protein, 64 aa, A.fumigatus
KMAPDSSQVKRNLIIVSNRLPVSVKRTDGSYKSSLSSGGLVTSLSGLTKSTEFRWFGWPGLDVL

SEQ ID NO: 33887 - protein, 336 aa, A.fumigatus
HREAPTGDLRPFQAAREGGISPGEVQRRGQARHAGPRRDCSDQTVTGPEHDLHHPQPREDPAQRRHDGILPGQNGRGDVRLLDRVDPPVHLPRALPGNRGEEPAHSEVIDVQAYGRHRGGAHIFLAGERGRQPQLGLPVLLGPGHGVHPLRLPQDGLQRGGGGVRELHLRPDLPARAAGGRAGLETSLPAAHVHHPRRVRDPRGGAEPSGRVQVQQARAHRQRGRLPHTAGHLRRTAGQHLPVRQARQPNHLRPVARDPAHGQLRGRGAPRKGHVDLGVPRPDPELPLLQDHALGGAGPRRAPLREALQPPLPGPPQMDPRPRRALRRDHGARLQL

SEQ ID NO: 33888 - protein, 85 aa, A.fumigatus
SATKKRGPNQAAKYNVPIPNLWKLALAHFDNILSYSNHLGMFSEEVAISGEQMGNTPQAFSHLACVSAALNLERLGRDQDEPNSS

SEQ ID NO: 33889 - protein, 521 aa, A.fumigatus
NPDGPTRKGVVTLVGKFPRVPPKSPASSGRILSGDWSLQRARGHPVQVRGSAIRRGQKADLQRGRYALASEVFPAFNYAGIPHATRCKLSNDLSKHQLQTVHFESDTEKLQLEIFAHSKQLEKVGFPQVKFSVEDRPGMQGRGVIARIRLSQGQSMTFIIHSPEKILPSDAMMESYLDKMEEETFDYWTGWTRQCTFRGHYREIVERSLLILKLLTYKPTGAIVAAPTFSLPENVGGSRNWDYRYSWVRDTAFTLYVFLKMGYSEEAEAYVNFIFDRIFPHAQQEAGPGSKRPFLPLMFTIRGEYEIPEVELSHLEGYKCSKPVRIGNAAVFHTQLDIYGELLDSIYLYDKHGNPITYDQWLAIRRMVNYVAEVRHEKDMSIWESRGQIQNFLYSKIMLWVALDRGVRLCEKRSSLPCPDRLRWIHVRDELYDEIMERGYNFDRGHFTQSYESRDVLDAAVMIAPLVFFCAPNDPRFISTLQKILQNPNEQGLSSAKMVFRYDHEKARDGNPSNSSALSHP

SEQ ID NO: 33890 - protein, 149 aa, A.fumigatus
AIWKGTSAASPCASATRPSSTHSWTSTANCWTASTCTTSTATQSPTTSGSRSGAWSTTWPRCATKRTCRSGSPAARSRTSSTPRSCSGWRWTAACASARSAPASPARTASDGSTSATSSTTRSWSAATTLTAATSPRATRAATSSTPPS

SEQ ID NO: 33891 - protein, 117 aa, A.fumigatus
GPFDSEKPFNKAIIDAYQSKAPKRQIKNSLAGMLSHEKHRIVFTHGDLRLQNIMVTDGYVSGILDWEFSGWYPEYWEFSKALYVWKWQNDWIENLVQVLEPYYPEYAVHSFLTETLW

SEQ ID NO: 33892 - protein, 134 aa, A.fumigatus
ASATIPCREAQALRQGFGSLVLQQLDERMADFGPRAPHGPDMTGTHDPLEDMDVHEKGAFDALIRPDDSYTPDGVYWADLPLVKKIKFVGSYDAKEAKRELKGIWDMTKKDPLSPVAYYFRNMVLPGAGLGLEG

SEQ ID NO: 33893 - protein, 73 aa, A.fumigatus
ICGERSDANFPVSSPISYVLFSIGNVKPLFQAAFKSCWKDHKICNPQWINAVEYLEIVGIIVGQILVGVLGDW

SEQ ID NO: 33894 - protein, 223 aa, A.fumigatus
LATIGGEYPMTATSGMENAVGSGKVSTKEDRLHRGRKVTSAFLMQGWGQFFNQVILIILLLCFHHGSGNPPYSSVAAQWTYRISFAIPAVGTLWLVYYRTYHMKAASKQLAAAKKKASVTGYDVTSLKLAFTHFGFRIVATAGGWFANDVFFYGNKLFQSEFIKVISPETTSIMPTWLWNLVNVGVSLAGYYLASFLIDNKLYGRKWMSSPRGRKEPRNALGR

SEQ ID NO: 33895 - protein, 105 aa, A.fumigatus
SALYPSTCKDLLQPWQSPYCIAFSIDLYGSKNNDITYLELGCSENSLDANAPFSQPKASYVPAIRCGSISSRRWPNSRSEALFGNGIWCLAYPDIPNHWCHPGRS

SEQ ID NO: 33896 - protein, 112 aa, A.fumigatus
LQQDVFDGYMHRAKYYGYDRKDTVFVSQYSLLNGLTYTIRKLGGGEESPCKVFLEADDLRTLVDAKCKMRYAIGAIPGGGVELLKLRFPGYGEYTEDRMDRGDLDLRIVYKG

SEQ ID NO: 33897 - protein, 100 aa, A.fumigatus
RKHKMKLPFVLFTALYASCALAAALPPDHVDADKAILLLADGTTKTIEKTDLASHLNGTLLEAPTDNFPRSIKSVNFNSLEARGGRLHPGRKSRAISINP

SEQ ID NO: 33898 - protein, 84 aa, A.fumigatus
LLETDTQKQRTTKVTTYFGDQNPLIIAYRVSEFNIFNPFQGASLSLSQNLRIEILILPYPPRKKPENKSVGQKTLTSGLIAPVL

SEQ ID NO: 33899 - protein, 1034 aa, A.fumigatus
KIEVDASALQSSKELGKRKREDENIVPTTTTKDVSTSHNQNSDSELSGDETDDSFVDSKGTTKRKLAETAPAPPIPAPVIGGGLKRPLELGPDGFPVLKKRKRAPKAKPAAVSVPEVPWEGFNSDDKNDSAGSSDEEPEDSEIDAETKNVQDGEKDASSDNDESDEEDSGSDNEEEDEEDEDDEEGVVDDEEAESLAQLRIKPRQSAFKEWARQQINEVVGFKPSGPITAEEQPFVRESKRPVRNTVAEEEPLPLELQVTKGDPNRKAFSVQVDRSEEVQNSRLGLPVVGEEQKIMEAIHNNSSIVIWGATGSGKTTQLPQFLFEAGYGHPDSPNPGMIAVTQPRRVAAVSMAKRVADELGQYFDRVAYQIRFESNVSSKTAIKFMTDGILIREIAEDFALKKYSVIVIDEAHERSVNTDILIGMVSRIIDLRKAMSEEDPSIKPLKLVVMSATLRISDFTQNPSLFRQGPPPFVQAEGRQYPVTVHFARRTHRDYVEEAYRKVCRGHRKLPPGGMLVFLTGQNEIRHLAKRLKQTFKPTQRGEATQAKVQLSANDAPLEAEDLDLGGADLSHLGNEDDESDLEITGLDENPEEDEEFNLGEEAMDSSTRVHVLPLYSQLPTKEQLKVFEPPPEGSRLIVLATNVAETSLTIPGIKYVFDCGRAKEKQYDLETGVQKFQIGWISKASANQRAGRAGRTGPGHCYRLYSSAIYEGEFAEYTDPEILRTPIEGVVLQMKSMGLHNVINFPFPTPPSRQGLAKAEKLLKNLGALSANGKITQIGHRLSTYPLSPRFSKMLHIGHQHGCMPYVIALVSALAVGDLFIPENQIDPATSKEEDKSDGVYKNSDRLEDTAREQRHKDYTRAQRLFSKHDDTSDAMKYLSAICAYAYASNGDSFCDQMFLRAKAFKEATQLRQQLTDIVRANNPGLIGAYEPRLPEPTDKQIKALKQIVTAGFIDNVAIRADLAPVPPEMDRTPKRAIDVPYLTLFRSREGRATELREKAVYVHPSSVLARLSPKEMPQYLVYSHLQQSAPS

SEQ ID NO: 33900 - protein, 207 aa, A.fumigatus
LAVAPADLSVGFFNIVSMCPSCEVYGHRVLTAFCLYERRRALTEETWILSEIRDPQSGRHDYKLEGFDGGILFAHGFPQVNDTANHSNQDISVDAPLVGLVDDDNRIFLQSEVFGNLADKDTVGHELDRGFAGDVAFESNLVSDPVEILSQLIGHTLGHTDSSNSAGLCHCNHTRVGTIGVSITGLEQELRKLRGLSATSSTPDDDG

SEQ ID NO: 33901 - protein, 97 aa, A.fumigatus
RLSFLIIHHPLLIVFVFFILLLIITATILFIAFIIVGRCVFFSILHIFCFGIDFRVFRLFIAATSTIIFIIGIESFPWNFRYGYGRRFGLGRSFPLL

SEQ ID NO: 33902 - protein, 239 aa, A.fumigatus
TSSERSTCTLNALRFGSPLVTCNSRGSGSSSATVFLTGRLDSRTNGCSSAVMGPEGLKPTTSLICCLAHSLNADWRGLIRSCANDSASSSSTTPSSSSSSSSSSSSLSLPLSSSSLSSLSEDASFSPSCTFFVSASISESSGSSSLLPALSFLSSELNPSHGTSGTDTAAGLALGALFRFFRTGKPSGPSSRGRLRPPPMTGAGIGGAGAVSASFRLVVPFESTKESSVSSPDNSESEF

SEQ ID NO: 33903 - protein, 65 aa, A.fumigatus
NVSFFCWKSNPNHSGPVDRLNSYQKPQTSATHVDTPVASISAQACRTGSPTSISFRSFSFVISQP

SEQ ID NO: 33904 - protein, 73 aa, A.fumigatus
  UNSURE (10): Identity of amino acid sequences at the above locations are unknown.
EQSQLFNKLXRTSLNSVNFRGLAQRMSNRTTSGYDAGQIKQLLVGIGLTFSPLYYLRESTCSRTVLWPLRSDI

SEQ ID NO: 33905 - protein, 78 aa, A.fumigatus
TIWPAFSMTQNDTPRTSYSDPSHPIQYLDNMAQKYARDQPSGFTNRIERVAIVGVGLLPSSSENLTNNTTTTTRPAAP

SEQ ID NO: 33906 - protein, 117 aa, A.fumigatus
VCFHPPPRTSLTTPPPPPGRRHRRQIHHPGTPQDRPTHHNRAHARRQPKHPPCGRPHRHRRLPGRVDSGCSPARPAVPHHYAERLSAQGHAEQAYPGRGESGGPVRDAELLRLRYHE

SEQ ID NO: 33907 - protein, 319 aa, A.fumigatus
QHHHHHQAGGTVGKYITQELLKTGQHTITALTRADSQSTLPAGVRTATVDYQDESTLVAALQDQQFLIITLSVSAPKDTQSKLIQAAAKAGVPYVMPNCYGCDITNEKLRKEMLVGEPVRQACAEIEATGVSTWVALVCGFWYEFSLSTGPEWFGFDFQQKKLTFYDEGTVRINVSTWEQCGRAVAAFLKFKELPEDENDTSPTVRGWANRPLFISSFLVSQRDMFESWKRITGDKEEDWTIEYEPTAVRYQRGIERMHKGDRYGFAQAMYARVFYPNGGGDYESSRGLDNDVLGLPQEGLDERTKHAKEMIEAGYSYF

SEQ ID NO: 33908 - protein, 111 aa, A.fumigatus
CLKSMDIRPTNDSYSYTGTITKVLNEDLPRVCLTIAGKGTHPLQSPLVLADTFVLFQTTLGTMSIIIASAAKLRPAQCSDSCIRAFSALSSAIQVAVSNATRALDKPGVSL

SEQ ID NO: 33909 - protein, 161 aa, A.fumigatus
AFSRRFYNAYSVWVRTSLITNVVRLIEIAVEAVVIQGNINVDDVSILKRALIGDAVTDCLVDGCTYGFRKMHVVERRRIGLRHIRLGPFPLLFPNEKTATYITLQACLVHNFIDVVGRNTWSDLPRGNVQHLSSQTADLPHPFLLFLIQDGDVVTAYKLLL

SEQ ID NO: 33910 - protein, 396 aa, A.fumigatus
IRSTRAARFLFLLCADSSDQSEHKAIHKSKSNILSNLFPPKVVSEPDPATGHFNPFPSFQFTGSLRPVYPLSPMRTVPKSIPHPDYAKDGIPRSEQKFVGRHNITILNKEQQEGMRKVCRLAREVLDIAAREVRPGVTTDYIDEVVHKACLERNVSGCLFVRKEQRKRSQSNMSQSYPSPLNYMHFPKSVCTSVNETICHGIPDQRPLEDGDIINIDVTLYHNGFHGDLNETYYVGDKARANPDAVRVVETSRECLEKAIELVKPGMLFREPGNVIEKLAKSRNCSVVKSYCGHGINQLFHCAPNVPHYAKNKAVGTAKPGMCFTIEPMINIGTHRDRTWPDDWTSTTADGSLSAQFEHTLLVTEDGVEVLTARLPDSPGGPIPMPVTEDAKTAEN

SEQ ID NO: 33911 - protein, 99 aa, A.fumigatus
KQIFLSAADQTIIVASYGQIGSDLKALNLTSWVATSYFITLASFQPLYGKLSDIFGRRACLLFSYFVFGLGCLFCGLARNIHELIAARVRPIECLSDLE

SEQ ID NO: 33912 - protein, 153 aa, A.fumigatus
SEFSYLIKDDICFLCICDRSYPRKLAFTYLEDLATEFTTTYSPSQYHSPTLRPYAFVEFDTFIQRTKKIYQDSRASQNLDRLNDELRDVTKVMTKNIEDLLYRGDSLERMGELSGRLREDSKRYKKAAVRINWELLIKQVSCLHTREIREIPF

SEQ ID NO: 33913 - protein, 62 aa, A.fumigatus
KLLFDTSLDSGEATQATYLLCTGTAFLSISLSIQSDVLLGFCPHQPSSTWYIAQICENLSIS

SEQ ID NO: 33914 - protein, 211 aa, A.fumigatus
  UNSURE (82),(84),(96),(99),(109): Identity of amino acid sequences at the above locations are unknown.
TQEFAEVHPGTEVSRGPRVFPKTENFRERYDPLLEQFTKLLMRDGKLSKAQKVCTSLEIRQVAGANLVDVQNMSFILDHLRXAXPPQPHPKRRLLXGPXSPQLLLNPVXYLTLIVDSVAPLIKIRQQKGIAGGGAAVQIPVPLMQRQRRRTAIRWIIDASDKRRDSSFAQRVAHELVAVAEGRSGVWDRREAVHKLGVAGRSNLGLVTQRR

SEQ ID NO: 33915 - protein, 278 aa, A.fumigatus
NPRYPQFRQIVSLAARHPPGSVNVVVILCTIDQHYPHNFFIWPSHLSNQSDARTPQTDSNAPILQPPCRFVLRPTRQPLISPAQQLCGDPPQPRRRSPAPSSSSPTTNDVLSIGRVATSESVLFFSQNSLPVETVPSNAVGRTVARIASATGAYEQELEHDGHDQSFELEEFHTRNRYPLVTRERTSSNHFVSLESDSHEQVQESEKYTPPGEKSGQDHRANNPRVRFWAEALRRRQSPKESARGQRTAKMKFSHSIQFNAVPDWSAYYIAYSNLKKL

SEQ ID NO: 33916 - protein, 538 aa, A.fumigatus
  UNSURE (332),(346): Identity of amino acid sequences at the above locations are unknown.
YIAPANANAYRIYSLEQQARKANGQAQSDVESAPLLSETPTPEAVFRRALNAELEKICSFYEVKESEILKEVEDVVRDTEEYSSKTDGADVDPMSDAMIKSRRMSSNSRPRTSGSYRDYAEEETEDDDDAADSDDEHHPPTGQGGVPSSGRSRSDLSDSRFMADSRILGFDRRGSGGHDEHCKDPGFLELYNEGLSLRQRAVNAYVSLCGLKSYIQLNKTGFSKALKKFDKILDCNLRREYMSSTVSPAYPFTDSTMKKIDDAIGRVEQLYADLITGGDLALAKRELRLHLKKHVVWERNTVWREMIGIERKAQAANVGIRRTLLGMDEDPXTARQQGDYPEAAAXKIKTPFGRYSVPEWLCSLSFGTLIVILAVFIILLYAPIMDKPEQQNCLAMLVFVSLLWATEVIPLFVTSLLIPFLVVMLRIMKSADKPYHRLGPKDATGAAFSAMWTPVIMLLLGGFTIAAALSKYDIARRMAMFVLSRAGSNPKVVLLTNMFVSMFLSMWISNVASPVLCYSIIQVGLLFQEKIFFCLGTC

SEQ ID NO: 33917 - protein, 60 aa, A.fumigatus
NPYLSIYTYLLPLPLGIHSMKITRGSFVSMFNTEAVSRSYSAQVIASTPTAFGSLGIGTT

SEQ ID NO: 33918 - protein, 184 aa, A.fumigatus
TSFGLSSRPLLPYTSLGRIFTFGIFALNYVAMVPSANLLGFAGRRVDKEAAPRFLGILLDTTLSSVVEIVLFRVLIHNDRGGNLIPVIQAAILGSILANLLLCLGLCFFFGGIRRHEQSFHEAISEVGSGLLLVAGFGLLIPSAFYAALSSSSTKAIITPEDLDHSTLVISRSTSVILLVAFIM

SEQ ID NO: 33919 - protein, 177 aa, A.fumigatus
HRPVIQRGRLDRRRQRSSTPPRPGGRQTPLLRRRPARHDRRGVPPSRLGRGPNQHQRRHRSRRSGRRSGAKNQDRQSVRDRGDAERRGKAPPARLRMGSQWRLSDRLRHRAQRPGAPCAPDARCRPPSPLCAVCRAKPADDPACAFQHSAQTIQPCCVDPELSSCHKPENHRPLFSA

SEQ ID NO: 33920 - protein, 497 aa, A.fumigatus
  UNSURE (27): Identity of amino acid sequences at the above locations are unknown.
SLQLSEGGIRKGDDFYFAYDLRPSSTXYVENNRGGLCQAVVQALKDGGMNPINLGAIHTPALTFFALQKAKGSIMVTGSHIPFDRNGYKLNTSKGELLKKDEQPINNVVEVVREELLSQPFADSLFNEQGMLRGSPSNLPPVAPEGRAAYIQRYLDFFQGESLKGMKILVYQHSAVGRDVVVEILEKLGAEATSAGRSETFVPIDTEAIDEAQLSTVQKLYDSTGQSFNAVVSTDGDSDRPLLLAPEGDKLRFFGGDLLGMIVAEFLQADSVVVPISTNDAIDRGALAGALEPKTKIGSPYVIAGMQSAVEKRRQRVCGWEANGGFLTGSDIERNGQVLPALPTRDAVLPLLCALFAAQSRLMTLPALFSTLPKRFSRAALIRNFPRATSLKIIDRFSVREGGAQTAEEQSRRIRQELEGIFSARHGFSSISRIDYTDGVRVIFENGDVAHFRPSGNADELRIYAVADTQERADQIATEGVAEPEGLLRRLERLVQA

SEQ ID NO: 33921 - protein, 128 aa, A.fumigatus
  UNSURE (14),(17),(41): Identity of amino acid sequences at the above locations are unknown.
RPCTVRLTVIDTPXFGXYVNNRDSWQPIIEFLDDQHESYMXQEQQPRRTDKIDMRVHACLYFIRPTGHTLKPLDIEVMKRLSSRVNLIPVIAKADTLSPTDLARFKQRVRLPDKWPPPLVDTDSPNLF

SEQ ID NO: 33922 - protein, 188 aa, A.fumigatus
VKAVVEAQGIKIYTPPIEEDDEHAAAHARSLMAAMPFAVIGSEKDVKTNDNRVVKGRQYAWGVAEVENEDHCDFKKLRSILIRTHMLDLIHTTEEQHYEAYRAQQMETRKFGEARPRKLDNPKFKEEEEALRKRFTEQVKVEEQRFRQWEQKLISERDRLNKDLEATHAAYVHLFLHFLFHREVWRQC

SEQ ID NO: 33923 - protein, 337 aa, A.fumigatus
LDSGPVNAVTFSSYPGTYVLTGSSDRAIHLSRAIPNSSTTGHETTSPIQKYEAHGYSVLDVAVAADNARFTSVGGDRQVFLWDVEQGITTRRWAGHNARVEAVQFAGEGDSVVVSGKSPSSVTPVCSVVEASGILTFLSGSADTTINLWDTRSKSHKPIQTLTEAGDTVSSLHVHMPTYSIASGSYDGRARIYDVRMGRTTVDVLAHPVTSVRCSADGNALLVSTLDSRIRMLDRADGKLLKAFGGEEGLEQSTTGARVTYRNSELRIRSVFAKGDAVVLSGSESEKGDPSPQAHVFAWDVLSGEVIATVRAGNGVKVVSCVAWHSSTGVEAPRLRK

SEQ ID NO: 33924 - protein, 262 aa, A.fumigatus
AKRVSCQPRGEDKKWWEYRELFNTHSARRRLICVVGMACFGQLSGNSITSYYLPNMVANAGITDEKTKLMLNGIYPAICLIAAVTGARLTDKIGRRPLMIYSLLFCSVAFAVITGTSKMATDHPDNTDAANTAIAFIYLFGIVFSFGWTPLQSMYIAETLTTTTRAKGTAFGNLMSSISSTIIQYASGPAFDKIHYYFYLVFVGWDLVEAVVIWFYFPETKERTLEELAEVFEAPNPVKKSLQKRDIHSVLNTLEVQGDTKA

SEQ ID NO: 33925 - protein, 66 aa, A.fumigatus
STGVLKAVKNVNETIGPALIKENIDVKDQSKVDEFLNKLDGTANKSNLGANATPRVSLAVAKGWCC

SEQ ID NO: 33926 - protein, 65 aa, A.fumigatus
RGRPEIKALLSISSLYKYLNLYISMMEEKIVSYSMLIYITAISPLHLRSHGINKVACSWPEAYQD

SEQ ID NO: 33927 - protein, 168 aa, A.fumigatus
SRVCLESPRPSTTNLLTLVVIALADAFIQSSVKNGSSPFKVAWYKSDTTESINYLKDDTIDVGITYTPAAEEIAIKQGVAKSPAWYAWRDHFLLVGPPSNPAGLKKADDIKTMFSHIYAVASAGDAANVAIPVRFLTRYDKSATNIKESQLWIEIGQVSHPFHLDLTP

SEQ ID NO: 33928 - protein, 120 aa, A.fumigatus
VPWATKYSTWYHQYIAYPIQALTAAILLEEYTITDRGTYLSIDQALAHKTTIYKAATDDPADPLLNPAHMLVGKKASNMKMADKFTQWVISAEGQAVITGFKKNGKQLYTAAPANKTAPF

SEQ ID NO: 33929 - protein, 132 aa, A.fumigatus
RLSFVYNFNMIDDTNDFPGLPPFPSDIPTAPLLRLSLQKLLAREAYEVQRLVQACEDLGFFYLDLGGCEEGRGLLNGADKLFQTGENLLNLSLEEKLQYDFSSLNSYHGYKAQGAAVVDRQGNLDRNEFYNV

SEQ ID NO: 33930 - protein, 215 aa, A.fumigatus
  UNSURE (182),(193),(195),(211): Identity of amino acid sequences at the above locations are unknown.
VSKNDILGMTPQLPAPAILHQARPTLESFIRASHSIVTLILILLNDSLGLPPATLPNLHRLNALSGDQVRFIKSPPQPADDRRTALGEHTDFGSITILFNRLGGLQVFPPGADAQWVYVRPLPGHAIVNLGDAMVKFTNGLFRSNIHRVVAPPGQQADWTRYSLVYFSRPEDDVLLKRWKGXIDSELKKRDVXEXTNNRELDIRVRWGKRXIGGR

SEQ ID NO: 33931 - protein, 81 aa, A.fumigatus
GNRRNAICFPNLLIFPEKKTWILLFQPLSGLPRISPIEYNNCSFQSTLKPQISPPWCGRYFNSQKWNTLFNSSPQHNQVFI

SEQ ID NO: 33932 - protein, 229 aa, A.fumigatus
RGLPHGQLKYSSIVITTSHNPHSTFLNSGPVIGKSYSCTMTTPKPHIARELLARAHSPDTAEQLFTERVKQKPLYLRPTSPTPADNRERRRMHRVRKKEYFLRKQKPKPLSAREKRISGLYDLPKEECKYSIFQELHKLWVGYMQEILDLRVRKVPITPQSHGSKLVTADFHGAEVEVVRSRCPGRVGVKGIVARDTKFTFMIVTKKDEVKSEYPFTNPFIRPEKESFG

SEQ ID NO: 33933 - protein, 385 aa, A.fumigatus
  UNSURE (51): Identity of amino acid sequences at the above locations are unknown.
LSLCRLRKRKPRRPDKGNENGNVQANDENVQEVPSNRRRANSVEPRRSSDXAEKRWQEQDATEALRRAIQSSPARNLENHPGAAVDENSLTPKPVRRALFHSAQNEGCPLKSLGGSALNSPRRSPRVNCRDPGQKPQDKENAAIDKDLEGLFESPPFEYDLPASPTPRRRNQRSNLLGEKRNSLPCISPLSKARLEGSTDITPTKLSAQKLHRIQGSTTVTPRQNKTPKSLRSLGPDMPSMPDGGFNVEALDNIDSMLVNIFEDVPSSAQCDSLFSFGQSKDSTSGNWSGWIESDYISLNGSDVQEANGEQRTSRRSGASEDEDLIHAILSDPDIQKNAHFDPFQFTSASALDSGIFGSDSVTADVVTLGSRSKTAEEPASKESA

SEQ ID NO: 33934 - protein, 195 aa, A.fumigatus
SHRHIVYIDTIPRAVVAMPPPLPSQHRGMTANPLKPVKRYRPGKPIAEEPSSSEEDDDAEEEVQEQERRRQEQQRQRQQAPKATSFPAGAAAAGRITKGVQDVKIEEDDDEEGFVTEEEEEAPPKVTARVAGDRAETVTAQAGGDEEEEEEEEEEEEEESEEEESSSEEEAPRRVLLRPTFIKKDLHHRLKTRVT

SEQ ID NO: 33935 - protein, 91 aa, A.fumigatus
  UNSURE (56): Identity of amino acid sequences at the above locations are unknown.
SKQKKDEMSLQTPRILPAHLHAFHPSSGSSTHTVRILGTVTALHGDTASITCGNNXDVTLILKSDSHLQMGKLVEVVGKVTELEGGQVRAS

SEQ ID NO: 33936 - protein, 77 aa, A.fumigatus
APARLSVWFGFGSSLLPSCCWCCSSSCPIMPVDLIPPPRISLPFRPSPPNLFSPDVPPVTPLNQPPIPETPPVVTAC

SEQ ID NO: 33937 - protein, 79 aa, A.fumigatus
SLLWSIGSILEKNPATSCGLCNQQEGNVSEVILPDSLPLVHQPPIMLSLLTTLPCCLYISSLPAVWTVVPFRPSNNLTA

SEQ ID NO: 33938 - protein, 154 aa, A.fumigatus
IESVFKIVTTVYFSSFEGPHTPRGGERYNKSVNLNDSSLIYLSLICWKNSAKRHIPSNMAPTTTTKTKAVEESVRCCPLAIVTAVEWPLTSRQPQPKETAPPKKLSEMSEVIDKATFDQILEMDDDEDMDFSKGIVYGFFDQAETTFDKMDKAL

SEQ ID NO: 33939 - protein, 100 aa, A.fumigatus
HSHHREKKDLDELSSLGHFLKGSSATLGLKKVKDHCEKIQHYGAGKDETGTVDEPDEEKSLQNIKETLAEVKKDYKEVAQFLRSYYGETKSPEVTSPSSK

SEQ ID NO: 33940 - protein, 400 aa, A.fumigatus
KTQNYKDDMYEVKGRGATGEADGETGEDESYGLKPMNCPGHCLLFKSQNHSYRELPIRYADFSPLHRNEISGALSGLTRVRRFHQDDGHIFCRPQQIKGEIASALGFVDMVMTTFGLGPYRLVLSTRPEKDFIGSLELWDSAEAQLREALDNSGREWAMNEGDGAFYGPKIDIQLQDQAGKYHQLSTIQLDMNLPQRFGLEYQVAEGEEDYNPATPGRATPVLVHRANFGSLERFLALLIEQYAGRWPFWLSPRQGIILTVNQDEAVLQQAQEAAAKISGYRPLVAGQDNATSPKPLSSVDSTYLIDVDTSSQTLGKKIQRAKQMKYNLIFILGPKDVADSSITVDVTGQMQTKTDVNGQKLKEVLATRLGENALQNPRAVRLKVDEVHDLLVQLEKQFV

SEQ ID NO: 33941 - protein, 139 aa, A.fumigatus
LDVLAHRTSMGVITGDMFVNGKALDTSFQRKTGYVQQQDLHLETATVRESLRFSALLRQPPTVSIQEKYDYVEEVIRMLRMEEFAEAIVGVPGEGLNVKQRKLLTIGVELAAKPKLLLFLDEPTRYAIDGVHNLMDLVK

SEQ ID NO: 33942 - protein, 263 aa, A.fumigatus
ISGLDSQSSWAICSFLRRLADSGQAILCTIHQPSAILFQEFDQLLFLAKGGKTVYFGPVGDNSRTLLDYFESNGARKCGELENPAEYMIEVVNAKTNDKGQYWYDVWNQSPESRAVQEEIDRIHEERKATHQEDDDQAHTEFAMPFWFQLYVVSRRVFQQYWRMPAYIASKWGLAIMAGLFIGFSFFDAKASLAGMQTVLYSLFMVCSVFASLVQQVGSRITTSRCVTMILTAFSRSCPYLLPNDHCTRCANDPARRTHGRPS

SEQ ID NO: 33943 - protein, 255 aa, A.fumigatus
IMPLFVTQRSLYEVRERPSKAYSWKAFLIANIVVELPYQIVMGILTFACYYFPIVGASQSTERQGLVLLYCIQFYVYASTFAHMVIAAIPDTQTASPIVILLFSMMLTFCGVMQSPSALPGFWIFMYRLSPFTYWVGGMGATQLHDRNVICSATELSIFDPPANQTCYEYMAEYMKLAGGQLQNPNATSECKFCSLTVADQYLAGSEIEWSQRWRNFGIIWAYVVFNIFMATVLYYLFRVRKWDIASIKARFGRK

SEQ ID NO: 33944 - protein, 149 aa, A.fumigatus
GTFVNGKVIFDNPRGRLPLQWMKTIPNEGLIHFRDVFNRSHLLPTTHQALLDIMSTNTYDFEKPWRAREFLARIIGFGLILSEGAAHKKQRKALTPAFNIKNIRSLYSLMWEKTGLFLDELEKEIRQNPMEGTSPEDGVGKVEMSMWAR

SEQ ID NO: 33945 - protein, 127 aa, A.fumigatus
NCNMSLESALSIARQYAQSSLAQLPESAQNALLNPLVQKALTAALVYGALRQTNRLLSQWSINNWQRAHPWQGDRELVLVSGGCSGIGKQIMEDLSRKGIRVVILDINEPNFQLRKNHQSPLVCAID

SEQ ID NO: 33946 - protein, 195 aa, A.fumigatus
RSKARNVHFFKANITNSESIRAVAEKIRQKLGDPTVLVNNAGVGYDGTILDEPEAKIRQTFEVNTISHFLMVREFLPSMIRQNHGHVITIASMASFVALGEMVDYCCTKASALAFHEGLTQELRYWYQARKVRTRYEATFDLTGFGTDQMKCYSPTLGSYSDDPTVDRRGKPIQAARDDTPGGIGCSGQADPHAE

SEQ ID NO: 33947 - protein, 213 aa, A.fumigatus
  UNSURE (43): Identity of amino acid sequences at the above locations are unknown.
LAKFRSGRIRGIYPQHQPPSREKPFPKLPMAYASMDFDLDPNXGQEDLPLSYRFTFLGIFAVPALIDITLLTTIGRGLYLTTFMSNDEKTLATTALMVALLLCGGFGGWISSGGSYYLYAMAFPAMSMFVLTRFIAGVAVVSVGGLFAFIGIGIAKGFVSGVVFSAYLVMLTIYLMTLSALSIYQLPGFQFQSVGFCMHRITVIDADVIRAAR

SEQ ID NO: 33948 - protein, 786 aa, A.fumigatus
CDQGRTVIMSCIPILFVSPVLTIWLQHDIIIYPCVLAVFLTVLLLGARRVIAKWNNWYLHIPCITDGEVVDWYQRTYLASASTDDADKELASTALARQTLLACVQKERKRWFWTRSTADPFVKRLAEGYSATMFLLVWYCKFSRTKLPLAYSPTWNLQLKAAVDTMGDMQKGLKLHNAFLHWRHTGKDVWGGILYFIIALMDKWTALFTGEGLVGLSSASSETYRLAVGFGLCYYLIGAVILDGVSQPLWTLAHQRTPQPIPSLEFLREATRNDARARRALYWRNLLKFSFLHIWAVAVTCALVWSFEGSRSATIMYLAYVGAYTGLLWYQYNRIYTGSRSDRALTAGAIGGFVACILLRVLPREFAYSGVIGLAVGTWTTAIVSFFRADVAWTRGQKLTSLDKDTHAVTYTCSTLEPDPDFSQSTLSNTFEAIRALPSELRYKLDPSQHPGAEVMQILLRSKSEATTPPSLQQAFPQSETILHRTAELWQSGETVVELVSARHLMLPPQDPTMRAITQRAGDRLHIFILISLDLVGDEWVVNIRRNCQAIAETLVYVTAESRLGLSRDHAMLAQLLAAQHHDSGTLAVPEGIKRQLKSSPPERKRVIAHAQKTMLRHLLLGMDPDREWDLMPRHVHAFLIERACGQPTRLSAPDVEWIRCHPGTADAVELHCLLARSSLSTSLAVLVGQYAGAIAAHDEDFGPRSDFRDSSYDQLITTVSSEIELKNKGFAEFMRVAVIRFLQKIRTCIKFTVLSLVADPEYQRELNYILRGQSLVISWPITWIL

SEQ ID NO: 33949 - protein, 274 aa, A.fumigatus
VLEAHDVDTFHVPKAFYEKHPSKTHLKDLDEYKKLYDESIRSPDTFWARMARELLTFDKDFQTTHIGSLENGDNAWFVEGRLNASFNCVDRHAIKNPNKVAIIYEADEPNEGRIITYGELLREVSRVAWVLKQRGVKKGDTVAIYLPMIPEAVVAFLACARIGAIHSVVFAGFSSDSLRDRVLDAGSKVVITTDEGKRGGKVIGTKRIVDEALKQCPDVTSVLVYKRTGAEVPWTNGRDTWWHEEVEKYPCYLAPESMSSEGPPLPPLHLWFDW

SEQ ID NO: 33950 - protein, 172 aa, A.fumigatus
APKDPLFLLYTSGSTGKPKGVMHTTAGYLLGAAMTGKYVFDIHDDDRFFCGGDVGWITGHTYVVYAPLLLGCSTVVFESTPAYPNFSRYWDVIEKHKVTQFYVAPTALRLLKRAGDEHIHHKMEHLRILGSVGEPIAAEVWKWYFEKVGKEEAHICDVRTGRPPIQPPVLQR

SEQ ID NO: 33951 - protein, 105 aa, A.fumigatus
CLKQTYWQTETGSHVITPLGGITSTKPGSASLPFFGIEPAIIDPVSGEEISGNDVEGVLAFKQPWPSMARTVWGAHKRYMDTYLNVYKGYYVRSFIRTIPARALG

SEQ ID NO: 33952 - protein, 329 aa, A.fumigatus
TRAVQSAQRPCRNGTNEASYVVALVDVQVCVHIALVGTPHGPGHARPRLLESKNTLDIVARDLLAGDGVDDSGFNAEEGQGCTAWLGGSNSTEGSDDVRAGLSLPVGLFQALALEHGGLNRGSASPYVANVSFLLSDLLKVPLPDLSGNWFTDGAQDTQVLHLVVDVLITGTLQQTQSCGGDIELGDLVLLNDIPVAGEVGVGGSAFENDGRATKKKRRIDDVGVSGDPANVTTAEEAIVVMNVKDVLAGHRGTKEVAGSSVHNTLGLTSRTRGVEEEEGVLRSSSTQERDSRGTSRPPHATKCHAHWSKGLRHQCACRPAHWSHRGTA

SEQ ID NO: 33953 - protein, 232 aa, A.fumigatus
RRKRGSFGAHRLRSEIAGVLLDLLMPPSVTPIGPRDFGTSALVDQHTGHIGALLEGLIDNALGANHLATTLTLVRGDNDLGSSIKDTVTQGVRGETSEDNGVNGTDTGTGEKSHNGFRNHGKVDRDSVTLLDTPLLQDPGNAGDFAEELAVGNDAALIRLIGLVDDRDLIRVLDGMTIHAVERGIQATFDEPGIVSILERPDVRGLEVFVESEQLTGHAGPERVRATDRLVV

SEQ ID NO: 33954 - protein, 360 aa, A.fumigatus
RRSDTMPIISPFESSIAKPGQGKVVLSLLPPSIPTLTTLTYKYPLKLLTRAPGFVPQSSGLTGSSRPVHLYLLTYGGGLLPGDHIDVSITLDPRTRLVVTTPQGSTKIFKTEPTASVKGQRGTPARALTDKSRQLVNVQVASEAALCYLPDPAVPFKDSRYEQVQSFTVDGASKDHKRSSLCVLDWVTQGRTSRGENWDFHLWKGKNEVWTHDATGKKKLLLRDSIILDDEIDAVCLENDSETFSRNNLIRERTRPHGIIGTLILYGPVFEDLASFFMNRFTSQPRIGARNWSSSAPAAAETPPNADSEVTFTAARVRGGFVLVKFGANDFETAKNWLGGILRDEGTILREFGEESLMCL

SEQ ID NO: 33955 - protein, 408 aa, A.fumigatus
TVQESQGVLLLAFDRCGGFHHAVSTRPTLPSPPHSVPMTTDCCSNPYRGLVQFVSIVCGIVVSFFPDELDKAAGHWRHVPDNDLYTDITRWPTDISRDIIPVGCHSHNDYWRRIPLYSALQAGCIGVEADVWLIDNELYVGHTSTSLTTKRTLKNMYIDPLIKIIERQNPITHFHAAVDHPLHGVFDTDPSQTLILLIDFKTDGEKTWQRVMEDLSPLRERGYLTYFNGTGLTNGPITVVGTGNTPFNMITSNSTYRDIFFDAPLNLLAEHEAIAPPAEADVLHDSAATAQPPTGNDGQGLSGISAGDIGPDTFNWTNSFYASVSFKKSIGYPWRFHLTNEQMDLIRAQIQGAHRRGLKVRYWGLPSWPRSLRNHIWSVLAREGVDILNVDDLQSATKQEWKVRIFDW

SEQ ID NO: 33956 - protein, 72 aa, A.fumigatus
TSWRSTRPLLLLQRLTSCMTRRPPPSHLPETTARACQVSPPATLAPTPSTGPTAFTPRSPSRSPSAIPGDST

SEQ ID NO: 33957 - protein, 101 aa, A.fumigatus
RGSFPVCFFIAMTPITSTFILPRRTHALGACRTCRRRHVKCDQKRPSCRTCRSLGVTCERPPSKVRWMHNSNIEESADDQRETRRHLYTGEHPSHSRRIRA

SEQ ID NO: 33958 - protein, 409 aa, A.fumigatus
RSSANADTEQSRLSMTSSLRSRLVSGSINASLAEIDLRTRDIDNPPTGDIVVGPFAVLGLPTPESPRGDKVVHLQAQQDGPDSVSVESEGQPTQPVSPPNMEDSSEPIGQLTTFSQASFLADPVCHFDDFLHWSDLLGCSPDALGWNSAPITDDMDLGTNIGSFGAEFETDPMSFDGPENVGSFPLAPDSDDSMQTTGPTEMASTLLYAASLAEAPFLFKHFHDNVIPQTMPMPLGKKSPWKILNVPAAMMTYSDLTILGSQNINHARQANLYGLLACSAIHLSMYPSAPSTEAAQHWQGTADHLFEQAREHMQLSIKYETQEPKKAKYKDQLMAICCLTEYAVSSWHPMLCSLPENEANVHRFCLGNSTMLVGSLSTLSIFCACGGCRNYGSRQRRAFYTMFIHGCDL

SEQ ID NO: 33959 - protein, 463 aa, A.fumigatus
CLWSRSVIMALCLSNCSASFRRKLTIAPDGGRAAVMDMVSFRAAGRRRTGPREFSTKSWKQYNDQNKHERSSPRSSFGSRLRFALRTTKVEWYPIPVGLGIGLLGLLHFYKSQRAERERAEREALGESFDFEKPPPRPRVRPSGPWQVQILSTLPLKAMSRWWGAFNELELPYYLRVPGFKLYSWIFGVNLDEVAEPDLHTYPNLAAFFYRKLKPGVRPIDPDPHAIVSPSDGRILQFGLIDRGEVEQVKGITYSLDALLGAATPSSADHSKKFMNHMAEPSQKDAANMLADEEFAKVNGISYTLPTLLAGDKGGARRRAASLDASTKSEAAAEEAVKAEIARGDGSPWYAPKPTSNNALYYVVIYLAPGDYHRFHSPVSWVVESRRHFAGELYSVSPYLQRHLPGLFTLNERVVLLGRWRWGFFSYIPVGATNVGSIKINFDSELRTNSLTTDTAADRAAAL

SEQ ID NO: 33960 - protein, 130 aa, A.fumigatus
ARVSYTSFKHFKAETSGFQIMASNSSDQPSAPFETVPRSITLHVLCPSLPNRFTFDDLPLSTTVAGLKARLTESIPSRPAPSNQRLIWRGRALLDDAMTLESVLGPADVCPTPNSLYLAEPLAFGIATDD

SEQ ID NO: 33961 - protein, 411 aa, A.fumigatus
ADLRLDLTMADTRYTSPDPTTHDTVGASTIATPLFLPSSPPPAEERMVDSRPRADSPVSDRVAAESEGARSPALSRSSSPDHQVNELDARLAEYTVDFRALSGTQLAHDGDTLPDLKFPHEEDKLSEVGGPEDFTANMERYLMGMDDDLEDKGWEEGQSALVNDNPQPAITPGDKHEGQGEEKEADHQPQQQGHGLQQPGPDDEAEVSEYSEFGPPVDMSTPSHFLRRTGAFAKEMTQLEDIEEDPDDEAPPVSTPSVQRQTATPQHDTTDSNEDLRRQIAELKAAIRDRDQQLERNHRRVLEAASAGEQIKHLQAELQKKSSQLDDLQAKIDDEANLRQQIQMPQSENDEKESYMQRSSFSQSGLSALQKQLGDMQKELQSRDTRPDLDAERLETIAYLRLNAADGRSTL

SEQ ID NO: 33962 - protein, 145 aa, A.fumigatus
HALDTKQTRVVKVTVPTESFFNFFSPPQPPTDDDDTIATDIEERLELDYQLGEDIKEKLIPRAIDWFTGEALQFEELGDDMDADEFDDEDDEDEEEDEDDDDDRRSDRDVDDESEEEVRFFSLYASKYIFASTPFFTTMTALPQS

SEQ ID NO: 33963 - protein, 272 aa, A.fumigatus
SDSINLTYMSESLDHATAASLFARNPGLVSMIQGKLGSLVGRSSGYIESLPAPVRRRVAGLKGIQKEHAKLEAQFQEEVLELEKKYFAKFTPLYQRRATIVNGAAEPTDDEVQAGKEEEEEEEVDVKAEDERKQEEKDITTPGIPEFWLSAMKNQISLAEMITDRDEEALKHLTDVRMEYLDRPGFRLIFEFAENEFFTNKTISKTYYYKEESGYGGDFIYDHAEGCKIDWKADKDLTVRVESKKQRNKSTSTWICSVGKLTCSRHQTNPSR

SEQ ID NO: 33964 - protein, 96 aa, A.fumigatus
SKQGTCVSRGWLISMHDDVNIPVIRVFYWFGHYYSLSLLVQAVIMIGVQIVLLKVALDNRPSPGVKNSVEHVPFSNLDEKGFARPYEFWQWKSAKP

SEQ ID NO: 33965 - protein, 146 aa, A.fumigatus
RTLGLHRYWMFLAYFVGALSFVQILLPPIARSDFYVSLLGYAGLAVEAILPLPQIVANHRTRSCKGFRVSVLAAWILGDVMKMSYFFCSKEVIPWAFRLCGMFQCACDLYLGVQFWMYARHTLRAAGGPRHNTASWPAGEKDIRMT

SEQ ID NO: 33966 - protein, 112 aa, A.fumigatus
  UNSURE (71),(94): Identity of amino acid sequences at the above locations are unknown.
MTDVSHSGSHIMSFVLAQKQGWKPDSLTPAVLGPFQAMRNGVTGYNASHPDQATPAAEFFMWEHFTTKPYXHADADKPHPPLEENREIFTPWPXLLIVAFHSVFPDPDMTRN

SEQ ID NO: 33967 - protein, 250 aa, A.fumigatus
VRFRPARAGEDKGKVLVSQRTESSLMPSIPSDKSYFPEIVEFLPSKSHRRAVRFADGRVEMDIDAIVFCTGYLYSFPFLSSLDPPVIGDGRRTLNTYQHLFYIYNPTLVFPVLPQRVIPFPLSENQAAVYARVWSGRLTLPSIAEMKQWEESTVATKGDSTKFHLMHFPLDADYMNFLHDWADMAETRQGLANNGYGKQCNYWGMKQRWMRQKFPEIRRAFVEKGEERYNIKSIAELGFDFDEDWKQRQD

SEQ ID NO: 33968 - protein, 88 aa, A.fumigatus
TRMMWRKRKAASPAISDPADNFRKRRWKVVYVISSSDDENDENDDSTSSLDEDEWYINCILDETESQYLIDWEGPWSPTWVSWAKSLS

SEQ ID NO: 33969 - protein, 201 aa, A.fumigatus
RSSNQDASTSLPAIHAAEHAVLSLLPTFVISSPGDVKTECKVAKKELGRNLKIANEMRDQQIKENIRKLQPPARQRPARLTFYDAKGGSCGSGIASKAFEFVDVLLRRAVARIEACECVTPQGCMECVCDERCRELNSVMSKAGAGVVLRCLLGWDVDIDALPWGEDVEGEDGLRELAGGLETVIPATEVPLRRQCRSDNV

SEQ ID NO: 33970 - protein, 962 aa, A.fumigatus
KSRSTKTSRIQRVIKSPSPKRKPSAHWPEAFKSLSQIHRALNLVYTFCCTRKHFATTFENIQKAVQAQLGSGSALTVEDIARVRVLFPRAVKFEYVDAAKLEVMTVGEKETARNQSYGLSHPECDGSDVGADVQSKEVLLFEFLDGDLKREVRHPKNGEPTKPVRKLKDEDLKMPVYSQKQMLALIEKRNKKFSDAIDAFLVQCEDGGSDPVERLEREKDAWIPNPPVFEDDSLKTAKLLSMPPPEIPKERKSTAEIIDEIRAMDWYFAQIVPEGHRVFEAQSAVYGDLTFQLSQDLVNALYNTKGITQFYLHQAEAINSLYAGEDVIVSTSTSSGKSLIYQVPMLHELGRDPNSRGMYIFPTKALAQDQKRSIKELLQFMDGLQDVMVETFDGDTPMGSRNLIRDEARIIFTNPDMLHITILPQESSWRTFLKNLKFVVVDELHVYNGLFGSHVAFIMRRLRRICAAVGNRHVRFISCSATVANPEEHMKAVFGIDSVRLIDFDGSPSGRKEFLCWNTPYKDPNDPTSGRGDSVAETARLFCQLILRGARVIAFCRIRKMCEVLLQAVRNEFQAIGRPEVGKLVMGYRGGYSPQDRRKIEREMFEGHLLGIVATNALELGVDIGSLDAVITLGFPYSISNLRQQSGRAGRRNKDSLSVLVGDRFPADQYYMQNPDELFTKPHCELQIDLSNELILEGHVQCAAFEMPIRPDEDHVYFGKQLHEIAAMRLVRDSFGFYHCHERFRPHPSRCVPIRDTEDQHFAVIDATNARNVVLEEVEASRAFFTIYEGGIFLHQGQTYLVKELNTDQRFARVVKVHVDWSTMQRDYTDIDPIETEVMRQINQSSASRAFYGSVQIHAVVYGFFKIDKRGRVLDAVAVDNPPINIFTKGMWLDVPKRALEILESRRLNIAARYSCSRTCCALPAAHLRHLVARRRQNRVQSRKEGTRQKPEDRERDARSTN

SEQ ID NO: 33971 - protein, 180 aa, A.fumigatus
CSARGRAGPLAKLRKPSAKGSMWLKDCTSVSSWEASMRPGTNGTLIGWPASCAAFSTAAQPARTMRSASETFLLSPRALKRDWTASNAERASRSQGWLLTSQSRCGARRMRAPLAPPRLSLPRKVEAAAQAVEMKLLGGTPEARISSLSAAMSDASTSGWLTAGMGSCQIRTSLGTSGPR

SEQ ID NO: 33972 - protein, 467 aa, A.fumigatus
EQTRRSRRPSRGCSCPAGEQRSRSSELQTGGEDAVRGAVVVGVEHPQTANQDGHLGRRQVQQLRLVDEVVLRTRAGRALGEIAEAIGEGLHVVEGLHVRFLLGGVHATGDERHLDRVAGVLRGLLDGRAAGQDDEISERDLLAVAAGVEARLDSLQRGEGLAQPGLVVDLPVALRGQTDACAVGTPALVAATEGGGGGPGGGDEASWRHTGGEDLVLERGNVGRVDEWMVDGGDGVLPDQNLAGDLRAEVAGAGAHVPVGELEPGAGEGVGELVRMLEEAAGDLLVGGIEAERQVGGEHGGLVLLGGIVGVGNDLVSVLGNPLVGAGGTLGELPLELEQVLQEIVVPLGRGLGPGHLQAARDGVGTLAGAVLVRPAETLGFQAGGFGLFADVVRRGSTVGLAKGVATSDEGDRLLVVHSHAAKGVPDIVSGRDGIGVTIGTLRVDIYQTHVGGGQKSLQLTRVGGLV

SEQ ID NO: 33973 - protein, 86 aa, A.fumigatus
SRKPLGVPRVVAQPGILSSPVGGFVRFPGVWTASSEAKGLETHGLQGDVTGEDQEIGPRDLVAVLLLDGPEQTTSFVQTDIVGPAV

SEQ ID NO: 33974 - protein, 66 aa, A.fumigatus
  UNSURE (1),(13),(14): Identity of amino acid sequences at the above locations are unknown.
XDFLFPVSALVVXXELEDYNRFASYPNPGHIGHLYTAYAPIKKSCWYLIGQRREARRRAKRGSLME

SEQ ID NO: 33975 - protein, 179 aa, A.fumigatus
RDHSRRLRCLQEAQAHHAHHRLVAPLRSRLREDRPPLPRASGPVRRRLRPRLVQAHPPGHGPPRPLPRPGGPQRGSDLAGPHPRRQPSTRRRVRHCRAQGRDPRLRCASKKLHLHRLGRRLHLPWQRQARGCQRRTHPSGPAARLGGQQPTLAARGPLRVGGCPIALQRPRRQQEGLAR

SEQ ID NO: 33976 - protein, 666 aa, A.fumigatus
DKHIMTQDKCPFKEQSSQPNFAGGGTSNKDWWPDRLKLNILRQHTAVSNPLDADFDYAAAFNSLDYEGLKKDLRALMTDSQDWWPADFGHYGGLFIRMAWHSAGTYRVFDGRGGAGQGQQRFAPLNSWPDNVSLDKARRLLWPIKQKYGNKISWADLLILTGNVALESMGFKTFGFAGSRPNTWEADEATYWGRENTWLGNDARYAKGFSGSDKRGSLIADEESHKTTHSRELETLLAAAHMGLIYVNPEGPDGNPDPVAAAHDIRDTFGRMAMNDEETVALIAGGHTFGKTHGAAPADNVGKEPEAAGLEAQGLGWANKHGSGKGPHTITSGLEVTWTKTPTQWNNNFLEYLFKFEWELTKSPAGAHQWVAKNADEIIPDAYDASKKHKPTMLTTDLSLRFDPAYEKIARRFLEHPDQFADAFARAWFKLTHRDMGPRARYLGPEVPSEVLIWQDPIPAVNHPLVDASDIAALKDEILASGVPPRSFISTAWAAASTFRGSDKRGGANGARIRLAPQRDWEVNNQPWLREALSALEAVQSRFNARGDSKKVSLADLIVLAGCAAVEKAAQDAGHPIKVPFVPGRMDASQEETDVQSFNHMEPFADGFRNFAKGPARPRAEHYLVDKAQLLNLSAPEMTVLVGGLRVLNTNYDGSTHGVFTSRLEL

SEQ ID NO: 33977 - protein, 178 aa, A.fumigatus
SGRTPSPPSTIHSSTRPTLPRSRTRSSPPVCLQEASSPPPGPPPPPSVAATSAGVPTAHASVWPRSATGRSTTNPGCARPSPRWRLSNRASTPAATARRSRSLISSSWPAARPSRRPRRTPATRSRCRSSPVAWTPPRRKRTCSPSTTWSPSPMASAISPRALPARVRSTTSSTRRSC

SEQ ID NO: 33978 - protein, 158 aa, A.fumigatus
SIEQCRSPPYPCRWPARPAQSSSSLSNAHSSLPGHLPPQHPFSSFGFYDSPTPAFCSPHFVFPDTTLDLASFAPDPSVSDTDPSAFVPLPPDLASFGDLDYASLPTGTSSSPYAPDSFDVTAISTPAVDVKDSLPCLDIDSSGTDSGLSASAFTQALY

SEQ ID NO: 33979 - protein, 143 aa, A.fumigatus
  UNSURE (108): Identity of amino acid sequences at the above locations are unknown.
RSHMSRAWSSPPAPAAPGSTGQTHPWDTTQNDEEDVDDVATKLVMEDASHDWDLLRDLLNAMRLVDDAHVQALLGMVRADCAIEEVKLFVQKTLNDVQDAGRGGETVXRLHDMRMRVRIESGDPPFRPQVMDIHYLCHVAPYR

SEQ ID NO: 33980 - protein, 128 aa, A.fumigatus
FLRHRFRSVCFSLHTSIVLISADTQINPGQIHTLTPPLLMPASRPQRVSISAASTAKDNPPKETPNRVLKRQLNTLAARRYRQRRVDRMNELEAELEKVKRERDELKMRVSKLEGETEALRGLLKKDK

SEQ ID NO: 33981 - protein, 103 aa, A.fumigatus
  UNSURE (25): Identity of amino acid sequences at the above locations are unknown.
ISMTWGRNGGSPLSMRTRIRMSCNXLTVSPPRPASCTSFNVFWTNSFTSSIAQSARTIPSSACTCASSTKRIAFSRSLSRSQSWLASSMTNFVATSSTSSSSF

SEQ ID NO: 33982 - protein, 66 aa, A.fumigatus
TKLTSHQLNYLSFFNNPLNASVSPSSFDTRIFNSSRSRFTFSSSASSSFIRSTRRWRYRRAARVLS

SEQ ID NO: 33983 - protein, 142 aa, A.fumigatus
EALNFILPVYDITLEKLRYELVETHIDGQACFVPVAKVLVGEPNLHGAWGVAVDSSRRCLDLWGWRNSTLRLRTGVRKRLLLATRERDFQSPWNLPLDDLLFDRCQIEDDYATSCVVVADRADYDTFSLHSTTSRSGVEVVT

SEQ ID NO: 33984 - protein, 114 aa, A.fumigatus
  UNSURE (81): Identity of amino acid sequences at the above locations are unknown.
GGFSPGASKEEIDSGSEGFVASVPGDASLDAPPFWRSSCSSKLLTKGEHCWRWHSPIASPRLSIATKSSRGAEASRGAGPXEGAAAAMSVSTTSAGSSGSSSGVSVTGETSPVD

SEQ ID NO: 33985 - protein, 141 aa, A.fumigatus
SICEVRVPSEDSLVSEATDSRSETKEDWGKSAYFCRSSSAVKPSSSSTSSSSSVSESVEDMLLSSSSASLVVASVPLSSASVESRKSLPVSPRISRRLFSNSMVDCLIARSRARWSSTFRSSSQRARRIRSTSARAKSNIF

SEQ ID NO: 33986 - protein, 818 aa, A.fumigatus
  UNSURE (2),(533): Identity of amino acid sequences at the above locations are unknown.
RXRAPGEDSTSAPNDPTSHNARSKRSHSNVTSTPTIGIDELWNDIGGETDLGDEQGQRVPRLRIKVKKPVIGFQHPSHVIPPRKYNSFREWLESGEGRIEDGAVLTPEAALVEARKRCRVLEATEPGGLLSPEVCSAYLPEQQEEPPQQYSHQDHLVAHALYFKKLLDQEHRRHRNTARLLAQWCADAWRKRNKRPEDILREQQEEVRVKRKQLARDLQKMFDLARAEVDRMRLARWEEERKVEDQRALDRAIKQSTMLFEKRRLEILGETGSDFLDSTDAEESGTDATTSDAEEDESNMSSTDSETEDEDEVDDDEGLTAEELRQKYADLPQSSLVSDRESVASDTSESSDGTRTSHILQNIEDINDSQGETPLEQIELDEVDPMLLDDSEDESTDMDDDMGDSDEDGDADGTDSDDESDDGPGLLGFFSSKDRVLNDAHRFDDEGDDPLAVSNHEGGSGFHDDGQSVSVDEDGDEELEDADEVSLVPNGPSNSVSISQSTGEVSPVTETPDEEPDDPAEVVDTDMAAAAPXEGPAPLEASAPLEDLVAIDKRGDAMGECHRQQCSPLVNNLDEQELRQNGGASSEASPGTLATKPSEPESISSFEAPGEKPPQPSESPAPGLKTPIPHLLRGTLREYQHYGLDWLAGLYNNHINGILADEMGLGKTIQTIALLAHLAVEHEVWGPHLVVVPTSVILNWEMEFKKWCPGFKIMTYYGSIEERRQKRKGWTDDTSWNVLITSYQLVLQDQQVLKRRNWHYMVLDEAHNIKNFRSRKWQKLLTFKNRARVLPYKLHRLQKQSHRNYGPLLLLLGCPPDW

SEQ ID NO: 33987 - protein, 294 aa, A.fumigatus
  UNSURE (277): Identity of amino acid sequences at the above locations are unknown.
VSAPMRSSTLADAKPMAVGPYSPNACALCRSQKRRCDKTLPSCSRCIKSEFSASSLCLSVTDTQKRSKLSCDYAWNATRTEGLPRVSLSDFLLFHVPVTQDQLWLPGSFQALQPHWDNISFRRVDIDNYFVGLAMATLTEQCVSVERMLEEYFCNIHPWFSVIIEPGFRKRLSNLHREPCAETAMLLLAVSLVTGSHDRSSNDSHRTRIYQIGKYLFSFLQLQREPSLEMVPSGLLLVLYELRASRLNEASVSVGNCARLGYTLRLNIDHPNRGETXRGWNPRNDAEYGADYTC

SEQ ID NO: 33988 - protein, 215 aa, A.fumigatus
DSIRTLSNMWMTAIVVEGKTFALNGYNVSYRFHVDESTGDLRSDHFGGSVSGPIPDDSAPIMNGWTGMPDRVRREFPDQGRGDFRIPAIRIRQSQGHTVSAFRYDSHTVLKGKPALAGLPATFGTEEDVSTLVVHLYDQHSEVAADLMYSIFPKHDAIVRSVRITNKGEGTISIEALSSMSVDLPCEDFDMIGLRGDWAREAHRQRRKVDYGIQG

SEQ ID NO: 33989 - protein, 300 aa, A.fumigatus
  UNSURE (299),(300): Identity of amino acid sequences at the above locations are unknown.
AINTVDRTRLFTELDRFGSTTGFSSHLHNPFVALAHRSTTESHGEAWGFSLVYTGSFAANIEKGSQGLTRVSMGFHPNQLSWPLAPGETFTSPECVSVYSKDGLGGMSRSLHRLYRNHLMKSKFAADNRPVLLNSWEGLYFDINEENMHRMAQESAALGVKLFVMDDGWFGDKYPRVSDSAGLGDWVPNPTRFPNGLAPLVKAITSLKVAKSPENLRFGIWVEPEMVNPQSSLYHEHPDWVLHAGSYPRTEQRNQLVLNLALPEVQEFIIDAITNILNSADISYVKWSSPRGWKEPLQXX

SEQ ID NO: 33990 - protein, 64 aa, A.fumigatus
LRYRRCRERDMPPRPSFEYTDTHSGDVKVSPGAKGQDSWFGWKPMDTRVNPCEPFSILAAKEPV

SEQ ID NO: 33991 - protein, 204 aa, A.fumigatus
FWEEVMPENPNTPVPELLDQTFTSVDQQLEKLPLKNSGCTAVIALLRWEDRVPSSHSVTGSAALAPAAVAAAAEPNSEADNTPTQSAPVSVLPTLQEKASRQRVLYTANVGDARIILCRNGKALRLSYDHKGSDENEGKRIANAGGLILHNRVNGVLAVTRALGDAYLKDLVTGHPYTTETVILPDHDEFIILACDGVSILSLY

SEQ ID NO: 33992 - protein, 305 aa, A.fumigatus
SSFLPKGLPIKLAGNKRRSFSSQGGLLNRMFSGSSSPPKDKLETIPHSEAITTPSLTVKTDEATVSQKKFSPPSGFFGRRASDEPSPGGEKKRRSSTVTKAATLFSNAKNSLSWSNSRETAATLTVAHSPPTSLHKLGRMDPALIVPQGSLNNSAGESLPTPRSSFRVGVTEDRNRRCRRTMEDTHAYLYNFLGTPAPSGRADVNGRRQSGDVSPSAAEETSVVETDNGYFAIFDGHAGTFAAEWCGKKLHLILGRGHAGKPQHSGSGAARPDFHFCGPAAGEAAVEKQRVYRSHCSSTLGGQSP

SEQ ID NO: 33993 - protein, 70 aa, A.fumigatus
  UNSURE (1): Identity of amino acid sequences at the above locations are unknown.
XTDRVGPRGLTTSLKGIVVNPNHHARGLISGEASKAMINQHFGGFVSIRYIRYQIYRFLVTTYVPQLSKH

SEQ ID NO: 33994 - protein, 65 aa, A.fumigatus
ALLLCILHKQAHNSYVILYGYSSCLVSYQSAWPPMVYTNGLSEFTFLVAVDSFPEFVHVHVSMDE

SEQ ID NO: 33995 - protein, 211 aa, A.fumigatus
KKIHQLGLELHQRELLAMSYEMLQQISLRCFNDLRTVFLVHDKRMLGLVLEELDSLVSRNVISLHQANILNRGLVHTIIPGSTKLENFIVTCQSDTLFKDKHMLKPVRSGKGKGILFGDQISQDEWLSILQGMRDPFLENGKTTYVVQTQIQQRRYDVLLEEGKGIGNFPLIGTFHITHGVFLGLGLWRSGPGRICALSRGGSWLCTVIQQ

SEQ ID NO: 33996 - protein, 132 aa, A.fumigatus
VRHYQHPGHREKVCHPALLLIIMEVQVPTKSLASLPIIDFEAIANKDVTEIQKLVQAGRTQGMFYLNLQGPRTNGVFDDIPTLFKAGNAFFSLPADCEEKTKALRTGVERGYYRSCPAFSSYLLMNRQLPPQ

SEQ ID NO: 33997 - protein, 191 aa, A.fumigatus
  UNSURE (168),(179),(190): Identity of amino acid sequences at the above locations are unknown.
IPRDEYAAGSWELHATLQPEQERIARTMETFHGALQIVLAELCASVGITIPELSDDSTTPSDTALKFVYKFPIHEPGKVINGAHTDFGLDTLLWYDEETTQVAIYDENGERTEEWLTIPVVGGSVLVNVADELAARSNGSLHSTVHRVVAPPGAKRVRNGVLYFFPAXTELDWQKMSPXWRSCMQQRCNXR

SEQ ID NO: 33998 - protein, 66 aa, A.fumigatus
GTGCRYLVVVVVVAPAAVDNVGGACHIQASPLFQLGSINPHSSLIFILILSLTSVYLIHIFILGRH

SEQ ID NO: 33999 - protein, 162 aa, A.fumigatus
  UNSURE (135),(139): Identity of amino acid sequences at the above locations are unknown.
VKPRAHTPSDDKALVSVVLEQKEWEILTAYPTKSFTLRGSRGCNADGSRLTHVAILGLLGKMTGAAAVANSDIIMAENGRLRFDVSLKGLGTLGIYFSDLQNWSIARNFMVTIRGRAVPRKTVWKERCAHAKVLXVDVXAAWKAMGLDSGWSNEVLVQVFVG

SEQ ID NO: 34000 - protein, 178 aa, A.fumigatus
TSGSQLLPEAAVQSLRTKLLPLTTILTPNIPEAILLLKDAGVDVQLPKDLSELTQLAKQVRALGPKTVLLKGGHLPLTAAHEAAQNPEDASRVIDILYDGENTTLFETEFLMSKNTHGTGCSLASAIAANLALGKDMKRAVHSAVRFVEAGIKTSVDMGKGSGPINHFHSVYSLPFAP

SEQ ID NO: 34001 - protein, 64 aa, A.fumigatus
LLALGLTHVSDRFLEYALARPDVRPIWKKFTEHEFVHGLGSGKLPVERFKQYLVQDYLYLVRTS

SEQ ID NO: 34002 - protein, 151 aa, A.fumigatus
  UNSURE (2): Identity of amino acid sequences at the above locations are unknown.
LXRTPILACTAYSRYILDVGQSEDWLALQMALAPCLIGYGAIAKRLYTEKETLREGNRYWRWIENYVAEDYTEAVRLGSGKNTFFFSSQRTQVYVADRSVLELLETHIRQVSPSRMEELIKIFIRATELEISFWDMGLGDHPRAHMTSLSA

SEQ ID NO: 34003 - protein, 127 aa, A.fumigatus
ITSSPAMFDTVCTLPLSADLFSQALHPKEPIVSVGLSTGHVQTFRLPSEESDTDNDGAESTSSSRNGKGHIDTMWRTRRHKGSCRCLGFGVDGEMLYSAGTDGLVKAANAETGVVENKIAIPPANDG

SEQ ID NO: 34004 - protein, 299 aa, A.fumigatus
  UNSURE (17),(24): Identity of amino acid sequences at the above locations are unknown.
FCGRSVDAPTIVHALSXQTLLLAXDSSALHLYDLRIPFSPVSARPQQTHHPHDDYISSLTPLPPSDTSTSGFSKQWVTTGGTTLAVTDLRRGVLVRSEDQEEELVSSVYIGGLRAGGTSRGEKVIVGGSSGVLTLWEKGAWDDQDERIYVQREAGGGESLETLAVVPDELGKGKMIAVGLGSGGVKFVRMGVNKVVSEVMHDETEGVIGLGFDVEGRMVSGGGQIVKVWHEAVDSDEMDGDTIGGKRMFGSGSDSDDSDDGDDSDDSDRGSRKAAQPQRKKRKNKGKGGQDIMGFADID

SEQ ID NO: 34005 - protein, 331 aa, A.fumigatus
FNTWGYLTPRYPVPDCCIHSIGGRNWILDASWNAWIGAMHNSSQLMGILHAFYGLGAVVAPITATYFITDCDWEWYEFYYAMAIVAGMEFLTSVAAFCSSTGSKSKDSDACTEETLSSDSSDNLMSSTPTRKPTLESLRIPSTWVISLFLFIYVGAEVTVGGWVFTFLVDLRNVPLSTAGFVSFSYWGGLTVGRVCLGFLTPFFNRQRLAVILYLGCCIFLHITFCIVHDLRLLVLSVTLLGFFLGPLYPEAVIAQAKLLPKSLHVAAVGFACALGSAGGSVFPFITGAIAKGYGINVLQPIVLVMLVLCLVLWLVLPEKREHSRRQASPV

SEQ ID NO: 34006 - protein, 422 aa, A.fumigatus
YFEHLSTRSSTSRPCDRWCSHIEFLILSITPGHFSMTAVASPPSVQEGPRLGWYDSGKGGQGALTSMNDEVSRMFMPRKSIQRSNSSSSLGSNSSTSTVVAGSQNVHAVQSNTAESCTWSSKKKSSRSIWPSTKSEPATGVSTTRTQVMPAFSSGPGATSAMSVLHQPSSIVPSQHMLQSSQQNGVRAGSAPSGEPPAILTLLPINGTFEKKQITVPFYPDVLRIGRQTNAKTVPTPVNGFFDSKVLSRQHAEIWADKSGKIWIRDVKSSNGTFVNGQRLSPENRESEPHELRENDTLELGIDIVSEDQKTIVHHKVSAKVEHAGIYGTMPNIFDLTLGDLDPASGNGLLPSPLSQPLSHLRGRSGSAMSNRSSQSAASSQLSALQQQRQMNYWNSPISIEQIVKRLTVRLLLAFPPKVASH

SEQ ID NO: 34007 - protein, 431 aa, A.fumigatus
KLTKRCEQSTQCIAAATSDELLEFSNIHRTDCQAAYSTFVARLSSKGCIPLIPFSCVQSEMKQAKQQAQDVRQTDEFLTSLTKQGHQEREKAKHSPPDSGVSRQVNGRPKMPRVDSFSRFSDPPAPPPQQPLPEKPDAPPRTGADAFSPLKRSDTEKPKLGSNNSPASRESSQILSLIEALSSAKRELDSQGARVKELETLLLQERNARESAEEKARNLELQAKGVNGESLEQGMNGRSDDAAISEKHAHEQPANAELPPNSGSDKSSTSESLADTQAYHLQLRLETMMEEMEEMKKQVAMFRSRAEKAESETAEARKSLAEMIETLRRERAEKCELSNESAAKDITITRDDSATADAGYVAGGEVEEQAHPNTTPSSPYTNVNNSGTAFAKQPLKHDVLEQTSPYASMLGVVLLGVGLMAYLNGWQKMDK

SEQ ID NO: 34008 - protein, 327 aa, A.fumigatus
ALNHKMREKAMAPSETTPLLVVNVAPQRYRYPHHALRRACSFSLILILFIGLILFLIPFPILPREHGSLWSYLPGASPFPYPSWPNSPGLTYEQLQAVLQSTPSAAKAREWSSYYTAGPHLAGKNLSQALWTREKWQDFGVMDTEIVAYDVYLNYPVDHRLALLKKDGDKTDVTFEASLEEDVLKEDHTSGLPDRVPTFHGYSASGNVTAPFVYVNFGTYDDYQDLVDANVSLAGKIAIAKYGRIFRGLKVKRAQELGMVGVILYDDPQEDGDITEDNGYKPYPEGPARNPSAVQRGSAQFLSMSSFTFGPQALTDTDHSAVRHRSR

SEQ ID NO: 34009 - protein, 280 aa, A.fumigatus
  UNSURE (2): Identity of amino acid sequences at the above locations are unknown.
GXDAFPSSPAVKTASSSASESKTGSSSQKTKTRSRKEAVDRAPSFMVPPDIDDLLPSSSGNRTKPEFIASASIPNDTISSSSGFASSAQISHFFDSDDDCSSGTSLSSVPENLLEEFSQMEDVFLSDMDDSENTELKQSLCPWCKKTVDSDALRKFRAQPKQRICEQQQFCESHQKETAEKEWKERGYPDIDWDTFDERIKCHFDDLESILVPEGNSYYRNVLDTMLKSGKAKNFRLTLAGDALETICCGYYGTRGANKMYSHLLSLLTFKRCPIINPLS

SEQ ID NO: 34010 - protein, 765 aa, A.fumigatus
RPEQRIDDDVREVSTYSEAREFPKMLHTPTCPESSSAWTMPEFTLHKISLNSSQLPTRRMSDGDVSRDGEFVAKSDPLSSAFDEGRAAQTNFLCELPSGIRGACSPEFLFLVSSLIEQLQPSHPIEIIDSLQKDVISDIVAHDKSMKQPKQSTSFAIRAPFIVAKMVNTSDSPTDHELSFRDEYSIEISNLRTEFRTRIERRKGDLLAGIDRKFTVHAAAQNLTGLVEGGRADAFQEKAGFRCLLSDLDFWLVTAPITRSNLQVRAFDTISSTKSVEQLAVLVRRATTMFDSVAWSFERSSSVGSKRLRYIIYSLTQSAGNIPDPAFLTRISHVLRVAPTHLRQHDSWKIISRIRNVYNNLPVHQQRDLILKCSTDNTSIPDNAKVTVLSGFDQWRAWDLAHVQKSYVMQKIWDTSEQKPSEIPTALAASLTVKNFRFSIDPGPKESDFVLEDLSSALSISTQQTLLDKKPTRVIVSQTYCSSVGLHLRWEILELVDGVLKTLSSVKLESVSSAQESDDQPTEKNELHLIFGIDSGFITLDGINIKIAMHSKGLRSSIVRKLKEAENSEALSVLLSAQMCSAELSSLSKALMAWTVSDPYLYSSRIMEENKKELTHDWKIAGSCRKLRYDMKEDPVSLAHTADRVIADEVRYLHRLAKNLGDSWPSTSTVMRKPASNDFHVAMFLDDYRLSFCILPSLTYTIAGKVARMSILPKAESKIEVDFDLKKNFHTFYSNEGDERRALSQLGIPPINGRVAVNMPPSLHH

SEQ ID NO: 34011 - protein, 74 aa, A.fumigatus
VQCCSNNASVSFYDLLGKSFLSDCNIRTFYDFRRSTLGDPEEHDQCAPLCLTEFTRLTVNAAVRVNVINSLMVS

SEQ ID NO: 34012 - protein, 93 aa, A.fumigatus
LTAVSSLFSTVFLKCYCTSIAPKMPENYGDFQTEIYGRGALMGLKPNVTTDPRLLEEQARKALGARSFNYVAGGAGEKATMDANRLAFRQWKL

SEQ ID NO: 34013 - protein, 259 aa, A.fumigatus
MANQSLTVNLFGQEYPTPILMAPVGVQSLFHEDKETGLAEVCAEVGVPYILSTASSSTIEEVAEANGDGKRWYQLYWPQDDDVTMSLLKRAKENGFSVLVVTLDTWSLAWRPADLDNAYVPFIDGVGNQIGFSDPVFRAKFEKDQGFKVEEDIVGASRAWIGDVFSGKPHTWEQIAFLRKNWNGPIVLKGIQHAEDARLALKAGCDGIIVSNHGGELAHHREKAKALKQAHFFLSDNAQDCTSIALSAHWTCSLIMWTQ

SEQ ID NO: 34014 - protein, 79 aa, A.fumigatus
HSHVVVLGPVELVPSFPISVRLGDLFNSAATGCAKDVWNSDLSTYFSKARLLVLVEETLDSHWGHEDGGGILLAEEVYS

SEQ ID NO: 34015 - protein, 91 aa, A.fumigatus
QQRKKKFWLVLNVQPAVLIDNHREPNQHGILAFGHCDTKSINFFLLAFSSDLESFAHTLKFAFGTFHVNYVNHSLAISVCLPSKASLLVIT

SEQ ID NO: 34016 - protein, 238 aa, A.fumigatus
TCCKEGKLISKYLAPGWKGPAVIVSRSSYSSKTYSGLCSTVSSASFSSSSTVSSVSPTPEDSASEGASTARSLSFKSKARETIIIFNATLQISLLCTPSFFKASIHTLLASLACSMSSFFCSLRCAAFWPSSPLSSSFAVSSLDLYSRTNSALSRSLHSFGPRPSFGSHMMPLHCSASSGRMGPLPLGRKAKSCSGLRCMLNMLDRCTAQLLVKLVLEMIRNGTERRPRVQAYRSSSA

SEQ ID NO: 34017 - protein, 378 aa, A.fumigatus
RYALLGSSHPTCATKKLTYAELERYACTRGLRSVPFLIISNTNLTSSCAVHLSSMLSMHRNPEQLLAFLPSGKGPILPEEAEQCKGIIWLPNDGLGPNECKLLDKAELVREYKSNDDTANDELSGDDGQNAAQRKLQKKLDIEHARLAKRVCIEALKKEGVHSNDIWRVALKMMIVSRALLLNDKDRAVEAPSEAESSGVGETDETVEEEEKEAEETVEQSPEYVFDEYELLETITAGPFHPGAKYFEINFPSLQQVQQAQQTNGHDKDVQSRETKEFTPPSQPTRSGKGKSHPSSVARTSRKREWRFGLPFAFWRQIIADAVGADGILSYQQQVRIMAYAADWNAVSYELTIKGAEDHQQIWKFLETVKCITYSSLT

SEQ ID NO: 34018 - protein, 271 aa, A.fumigatus
  UNSURE (271): Identity of amino acid sequences at the above locations are unknown.
PPWTTDRTAIELLGLEAIGKVNSTNSFLSAFCASHTNNMMKNKRTNTQPLEDASTAPATFNDGLPLPKLIAFDLDYTLWPFWVDTHVSAPIKPRDNNSRCVDKYVPDSSVGVHLHILLLTQDLRHRWNESFAFYPAVSSIVYSCKTRSIPLAIASRTHAPDLARDMLKALHIIPTFSDNPAAKTKSVRALDYFDYVQIFPATKTQHFAKIQQASGIAYEDMLFFDDEARNKNVETELGVTFCLVRDGMTKEEVDRGVWAWRKRNGIKPGAX

SEQ ID NO: 34019 - protein, 95 aa, A.fumigatus
  UNSURE (11): Identity of amino acid sequences at the above locations are unknown.
GPGAGFYIDAXRTLREDILARVYMQSDLDFLEADADAVVGINGEGDHEGDTIADGLENLKINGKDNEATKKVSSKQSPKKSKVAQQNGKSSIQSS

SEQ ID NO: 34020 - protein, 66 aa, A.fumigatus
PEIGGASRIIMTYGIHLLIKTSNLPPVALNQQSDIIRNPIRPKSSISTYHHIINCSSNFAWIIYFQ

SEQ ID NO: 34021 - protein, 310 aa, A.fumigatus
RHALIESDFVCPGCATEGVLLDNLSVDDEAVSKIKAFEDEKADSRKDTQKNLTVHDSSSNSKGSDSERTVAGEKGPSSLPSVNDALDSATKKRPADENLPSTDHEGSNLSPSNKKQKADLIAQAGTESTNLQTQDSSNEVSSITHDQSMPFGFGFMNPQNMPTMPFTEAGFMGGGMGFINPLGFPTSGFPNNLNQAWNPLNNPGFDSLQNGIYGSQQSGAMNGYGQANMYSNMGNASMQMMGMSQLAGPIPPNAGFQQGPGVGHFSNQQRTSFSSPFAREEDSPYFRQPVNPQRHQGRHRRIRPSDYREL

SEQ ID NO: 34022 - protein, 447 aa, A.fumigatus
ITVPSGGVCEDDAAMTLTENQTPQPSKVHSDSPIVSNKRVSNQDESVPHLTTGLGFLTGVGSVVEASELPNSDAQTDQSLFADHSLPVTHQPDSVTDSSKPSGLSSSLMVAGSPIRAANNENEIVIDSKTTHVSLPHRSSPKHNVLGELTSNEPSQRANKQIRHAANKLEDEVTTPIDDHSRHRWKKVEIADRRTSISPRSKDPTKAQQMLDKGIQRIRTKTMDILGYRKLQGIIKYHDSIFTNEEKYDEMLLALLDELESSPDDKRQPLGRPLDLKTQVLLTIRLMLIHNKIYFSAYCSRALGALVLARKYYDANCHIVSGLEETADDIIALCEPAAVIDSVLDVIITEEKDDREYRSILMGVSVLTRILSRLNADKCRVPELPLDRLGQFAASKLADRQPDVRRLAVQLCVQLHGMVANEEEYWRVLGHPRENSRNLLTYYILKK

SEQ ID NO: 34023 - protein, 81 aa, A.fumigatus
DWNLSADVSDVLAQYHDFHPTLLRIIKYNWSTFSQNKTHTNQAQKSNEHQTMAALLPRSYPNLVPRPLRADRRCRTPNAPP

SEQ ID NO: 34024 - protein, 62 aa, A.fumigatus
GIYYSLWVISRLMKYGPNTKNYNLFCQYCLKYGVWEEHIKSGVSTVSLLHSSHSSTAVEMGV

SEQ ID NO: 34025 - protein, 201 aa, A.fumigatus
ACQIFERSSFLREVGAAIHVQPNASRILSDWDFDPKRARFVTGLRTMVVPGTSLTSNVGVDCSHFVETYGAPWYLAHRVDLHTELRRLATTPDGPGFPVETILRSEVVGFDAENGSVTLTDGSVHQADLVVAADGVHTTAIHQVIGHATPAVATGSAAFRFLIPTEDIQGDPETAHLLEDGLMRIYVAEGVRRLIWYSCAE

SEQ ID NO: 34026 - protein, 87 aa, A.fumigatus
GRNPSLRESGRRLAGHGLLHRLHGETRSVRKSGMLSFVPTQPVLAKVYLDPVVSTTESNRRGQSGDSATNYNDLHLRVSGSGVYLIS

SEQ ID NO: 34027 - protein, 74 aa, A.fumigatus
DIGSLIIRNHVYTFNSSCSCSTGARIGCQASHLTFAWSGHTRVDYLQGMGYSTTTKTRQETGHRYAAYKAQGSE

SEQ ID NO: 34028 - protein, 285 aa, A.fumigatus
GVSSSVIMSTPSIAPAPAPLVPALAAKPAISPSPGPGTPGSITSKEWVIPPRPKPGRKPATDTPPTKRKAQNRAAQRAFRERRAARVNELEEQIKKIEDEHEIHIAAFKEQITNLSREVEQCRSEMTWWRDRCHALEKEVSVERSAKEAIVKEFRSSLSDREAVRSDKGLAPLTTSTPQTRSSDRPDNGDASNNDSGEGREEVPLGCNDCSTSHCQCIEDAFTMPGVVAQEQSRRLDTTKPGLSEPQIKPDPEEMEIDFTSRFAATQQQDQSPTSVSSPAVDPLF

SEQ ID NO: 34029 - protein, 101 aa, A.fumigatus
RNLFFLVLAACSWQRPHVIVLDEPTNYLDRDSLGALSKALKTFEGGVVIITHSREFTENMINSAFRFLDGTHTSLGTLSNNAKNVCLLMKQLHSMGEMPGA

SEQ ID NO: 34030 - protein, 471 aa, A.fumigatus
  UNSURE (194): Identity of amino acid sequences at the above locations are unknown.
RCLPEFFYSLDRNLEDVDYFYKKKFADFSRRLKLLEERYGHSLHKGHELDSEDVEDLLAALLELRGQLRKLQWFGEVNRRGFVKITKKLDKKVGVQAQQTYLETKVDPLPFASNAGVTESLKTINDWLSVLGDQKAIDDASSTRSSLSLKKGPSRPNLNLPPSVLAEVDEALRKDDTHVLLELMETLKKAADDXREAVYPKGLKSLLQPSIYYRSKACISVLLGRIDSLDEEDDINKRNCIHRLVISIGRAQSSTDSESSASMVLDFSLETSHYITPAALPTMQPPRPVVKEANHPQILGRDDPSVSLLQFILDELQPHQRGALLAKDLSGRTPLHYGAQYGFKVVCEVIIEHLQAWDMFDVREGIDAPQWQDNDGWAPLHLSVVGGHPLTTRTLLEAENWQGASEEKASIRKHVSKSSAVLALATKANFVDIVQLLVDAGVDINYQDEQGRNCVACGPSVWSRCVRKDPT

SEQ ID NO: 34031 - protein, 69 aa, A.fumigatus
RLRLQPFIMKFGRNLPRNVVPEWSTSYIRYKALKKLIKSAAEEVKAGCEADLAGGFQSPCHTPHGETTC

SEQ ID NO: 34032 - protein, 236 aa, A.fumigatus
TPTNSLRHDSGLHIFGGCRGGGGGGGGAGQRRRGDVGGRWMEKTGAGTGRAHRDINGRRRSAGAGGRRGHRGRVDAGLDRLGDGELVALREDDVDVGAVDAADLVAPFGVGVAGDLNGVGQIGRGDVQGQRHISRRPGDKVPKVEAEVGGIGVDAGPPDGHSGPRCVGGVGCRTGDVDGRSQRAKRNNQGDHGAHHVDPRVLIGLILVGMGFRIYWGKQWSIEQKTRLKTNGLEKE

SEQ ID NO: 34033 - protein, 103 aa, A.fumigatus
QSNLLIYANSKVPESLKYPHDAVGHDYDSVGIFQQRAIYYPNIAADMDPARSAAQFFAKMKKISGWKTMDVGKLCQKVQVSAYPDRYAKRVPEAKKICAAGGL

SEQ ID NO: 34034 - protein, 78 aa, A.fumigatus
  UNSURE (13): Identity of amino acid sequences at the above locations are unknown.
RAEDLSPVMLTPXMTNRQPCNPNFVQARDAILDADTALTGGENQCEIWTPFAKRGLGAGAKYSSRNRVGSTEVPSGVC

SEQ ID NO: 34035 - protein, 280 aa, A.fumigatus
TCFLFYRPLLPPVDPETHTHQDQTNKNTRINMMRSVIPLVVSLGSLAAAINITSPAANTTYAAGSTVAVRWTSVDTDPTNFSLYLWNFVSWPPTYVPLALDIPTADLSYSVQIPCDTNPEWGYQISGINGTNVYIIFAQGDKFTVSEPVEPCVDPAPVPTPSTCPSAAASTVYVTVSPTGSSSRLFHPSSSHVSSSPLPSTTTTTTTSSATSKYVKPGIVPKTIGWCSDYAHPVTLDKVPTPTPAPIMTPAPGEGSGGRGPRVKTITTTVSVEACPIDAM

SEQ ID NO: 34036 - protein, 139 aa, A.fumigatus
SPWLFRLARWLRPSTSPVLQPTPPTQRGPLWPSGGPASTPIPPTSASTFGTLSPGLRLMCRWPWTSPRPICPTPFRSPATPTPNGATRSAASTAPTSTSSSRRATSSPSPSLSSPASTLPRCPRRPPAPALRRLPFMSR

SEQ ID NO: 34037 - protein, 169 aa, A.fumigatus
SRTISSRTLLTSTDIMLYLPLVALSFATTLVSAYPITGNGVNCRSGPGTNYPVVKSYPKGHEVSIVCQAPGTDIKGDKLWDKTSDGCYVADYYVKTGTTGYVTKHCDGGSDGGSDGGSGNLPGLSAKQSSHARKIIGEAKKEGLGRQGCLAAIATGLVEVSFNPLTPCC

SEQ ID NO: 34038 - protein, 79 aa, A.fumigatus
ERTLRNSRLLLNARTVGKPALPQSWLLYGTQAQNNAAGENFVNQNLYKRTSIIPGLVSEPSYYTATSSYDSVHCRQERA

SEQ ID NO: 34039 - protein, 228 aa, A.fumigatus
RLLSISPQSICWPAPFAVSRCRTARSQDTSTLLLAEHGLRSARVAPGIPQLISSSLSTRYISHLTSSLKSPNLTSAHIQVWEHQMATYSDPMGFKNYGFDQVIAGRGQINYCVRWDSNQKVTAAQREQIAAAVTRSFNKWIAGLAGFDGFPYNTVEVNVVGYAVRDRSLLEGDTSGLDIYTTTDEGGIPHCDPRCGRFFHHHGDYSQCPGGASRHYGIVLFPAVNYCG

SEQ ID NO: 34040 - protein, 93 aa, A.fumigatus
LVRNILLVSCNTHCLTIADYLLSQSSTTKEINYETLWTTLQTVLLPVWPSSRTHIDGRPLGDAWPRCGIVRKTRVKMGALQPSINSRSGSGTP

SEQ ID NO: 34041 - protein, 142 aa, A.fumigatus
THAVVRVLPDSSLRTPAGREMDEYGSRALSPQSTAMEACFVDLGVLTLKLAAEEHGRHNCGSTLPAFEATSDEIVEWRAMTVALLDKLHEQIMNSEVFSGVRLRLAQVLEAGSWKAGRELAAEKRPETRSSPILILGDGTLF

SEQ ID NO: 34042 - protein, 232 aa, A.fumigatus
DSSAEEDKTPFIFAHEFFDALPIHAFESIPPAPENSPEQKEIITPTGPAKLHQPMKPANTPQWREIMVTLNPKAVEDNIEGEPEFKLTLAKASTPSSLVIPEISERYRKLKSTPGSTIEVSPESRIYASDFARRIGGSSQPPRTVGSRNSPAAQPKKIPSGAALIMDYGTMSTIPINSLRGIQHHRTVPALSSPGQVDVSADVDFMALAEAAIEARSSPRGWKDPTRGAMPS

SEQ ID NO: 34043 - protein, 68 aa, A.fumigatus
YSGVSLDRALESMIARISQYLYNTNPTGETPWLRFLSLDSSSRACGDRLSVFTKNFACEFFIFSLFAI

SEQ ID NO: 34044 - protein, 182 aa, A.fumigatus
HGPICIPTGEYPVGSTKSEDCLFIDVYAPRNASNLPVFFWIQGGGFNSNSNANYNGTGLIEASGSQIVVVTFNYRVGPYGFLAATEVQNGGSLNNGLKDQIKALKWVQKHISKVRRLLLYLFLSRWLTLRQSLAATPIMLSSAVLAQGLLPSPCCSQPMEGETMAYSTLQLQSRKALPLCSH

SEQ ID NO: 34045 - protein, 115 aa, A.fumigatus
SPTLGVSFRAIVCCLIHADRARRQKMHLNNLHALVLLLLPAASARKSVVDLGYTQYQGHELSNGIVQWLGMRYAAPPVGQLRFAAPQDPLPIKGVQEANKVAIQSQPRCVVSFPS

SEQ ID NO: 34046 - protein, 449 aa, A.fumigatus
RPQRPDQGSQVGPETYQQGEASPALSISQPVVNSSSKFGGNPNHVVLGGASAGAASITLLLSAHGGRNDGLFHAAAAESQSFATMLTLNESQFAYNNLVIRTGCASENDTLACLRNLDTASLQRQNFNTPFPGAQLAPLYMYGPTIDGDLVPDYTYRLFHQGKFIRVPVIFGDDTNEGTVFVPKDVSSVSEVDKFLQNQFPKIELHHLAKINELYLQENQTQSFPDASVWWRPASNAYGEMRYICPGINMSAVYENAGVKSWNYHYAVEDEAAQASGTGVSHTVEVNAIWGPKYTNGGAPPSYTTTNAPIVPVMQGYWTSFIKTFNPNTHRYPGSPEWKTWGDGGGYNRNFIKTNETKMESVPIDQKQRCGYLTNIGTALGQYTQIGYTTSGPLFRGIMMRKREQFSFVLSDKCIYNNEALKPGTPLTIMMLEKPRIPYPRTARVSKMS

SEQ ID NO: 34047 - protein, 166 aa, A.fumigatus
  UNSURE (75),(79),(81),(82),(84),(93): Identity of amino acid sequences at the above locations are unknown.
WCSHSGYPHHGISANAAVVGVLNEFLCTKFPESSLLGPSTFNIGKIEGGVSYNIVPASSTALCAVRVATDMAECXKNVXEXXAXHPHVKLEFXFRLSENMLDHDVKGCQPYLCPNPADGLQGLKQPQCHMELMCLVSRETIKSTYTGLVQSSWPMERMSRSKLTSC

SEQ ID NO: 34048 - protein, 73 aa, A.fumigatus
QMLGFSFLLFLFLFLFIFLFYSSIYFFDLVNQGILSTKVIWHDNKLHCILPFLGMYFIYKHLVSTVSKFRCGA

SEQ ID NO: 34049 - protein, 124 aa, A.fumigatus
FRFTSIHPDKMGSTQPEFKNPATTTLLELVKARRTNYSLKAESPISDEAIERIVQDAVLHVPSSFNTQTSRVVLLLKEEHQKLWDIAINIMEGLVAAGKVPKEMFENHTKPKLNGFRAGYGTVG

SEQ ID NO: 34050 - protein, 214 aa, A.fumigatus
LKMPEAPVVSLLQSLIQVPSTSDHEQDIARWLDNHLSTLGYTVERLSIAPGSTRENVYAYLGSSRRVRACLTAHMDTVPPHIPLRVEGSTIYGRGACDDKGPMAAQICALEELRAEGAVREGEVGLLFVVGEEKGGPGMIAANDHDLKFEGVVFGEPTEGKLVVGHKGHLVFELVGEGKAWYVCSDALSAEANGAVIPGIPIMASAPMPLWLEF

SEQ ID NO: 34051 - protein, 147 aa, A.fumigatus
RCLCVLGNINTLFPTPYRQRRNQSPSIKSSTSPDNSDSPLYIQTKWARLNPNSRTPPPPLCWSWSRPGAQTTASRPRALFPTRPLSASFRMPSCTSPAPSTLRPPVWSSCSRRSTRSSGTLPLTSWRASWLPARFPRRCLRTTPSLS

SEQ ID NO: 34052 - protein, 154 aa, A.fumigatus
VKTDTRPSVQTIMKGRKSAYSSIARAESVQLRLGVVLKHLLGNLAGSHEALHDVNGNVPELLVLLLEQEDHTGGLSVEGAGDVQDGILNDALNGLVGNRALGLEAVVCAPGLDQLQQSGGGGVLEFGLSRAHFVWMYRGESELSGDVDDLIDGD

SEQ ID NO: 34053 - protein, 121 aa, A.fumigatus
IMDLDPTLMKSTNSTTGLRSFSVNTNAMNPATTRLSRRLLIFQEARNPSNMSEIVYLPVNKLGLPICGSGPELPSILELPLRILRAFTEIFNQPKYKGWYVSRPASLLLYHHRCIYIYIYG

SEQ ID NO: 34054 - protein, 79 aa, A.fumigatus
HDSMLYNSASYPALQMEYLLLIFRKWPETETYWLINRPGLPVSRHSPLVYNIPSDPILIPELLASLTETLTSDLAVYMG

SEQ ID NO: 34055 - protein, 78 aa, A.fumigatus
QKREGWFPRSRMNLCFRVHGGDAEKEKEFLAGAEKRLLQGLKGHRSVGGIRASNYNAVPLENVEKLAKYLEDYATGNV

SEQ ID NO: 34056 - protein, 374 aa, A.fumigatus
PQLIHECLYNYWLREMSHITFSQTDTRSNNLHAPRDSLELASLASSSPESVGRSSASSSPSGISSSRKLSLEDEDPLSDAHSHANLESGRARPTRSYSISSAFDFGNALFPLSQTAGGYAPLGAPSALDRQAGTDGSLERNKTLTYLNGLSLVVGIIIGSGIFSSPSQVNANAGSPGASLIAWAVAGLLAWTGAASYAELGGAIPLNGGAQVYLSKIFGELVGFLFTWCAVLVLKPGSAAIIAIIFGEYVVRAVIHADAETVSPWISKGVAFGGVFLVTVLNCISTRLAARIGDFFMFFKFVALIGVTVIGIVVAVTGFSSTGSASKEWKEGWFKGTSKDISGWAVAIYAGLWAFDGWDDVGFSHSAFSPRAIY

SEQ ID NO: 34057 - protein, 77 aa, A.fumigatus
SYLQTNYVTGEFKNPSRDLPRVIHTAMPLVILSYLLANVSYFLVLPHSTIEASNTIAVQFGDKVFGCLHRPGLEGNA

SEQ ID NO: 34058 - protein, 88 aa, A.fumigatus
DVRPPPRDSTILIYRTCSFVESQPHEIPTTKIRGTFVQPAFYPQQESSFSSLYCVFITYNLRTFSAKKATMASTDDCHCNCGRNRSLC

SEQ ID NO: 34059 - protein, 403 aa, A.fumigatus
DHHHETRRYSFIVRALSLRVNLMKSRLPRSGGLLFNPPSTLSKRAASRRYTASSSPTTSAPSPPKRRLWLRLTIVTATAAGIGAYVRSQQGSEPTTLNPVTFTKYRLVAREPVSSNGSIFTLKPPKPDDNREVYEDAWKTGVWSVMFKQPQLQIGRDYTPLPPISLNDQDEQEGCLRFFIRKDPFGEVSRYLHSLDVGSAIEVRGPRIECEIPSDTRQILFIAGGTGIAPALQAGHTLLRRTDADHKPRLHILWANRRRDDCLGGCNDSSAIDEVQQRSWFTGLFRSRPSSPPPACPTQDPAATSLMVRELEALKARYPGQVTVDYFVDEESSFIEKKSITRFTDTASSNGPPGGKMIIVSGPEGFISYMAGPKLWAQGMELQGPLNGVIKELDLKDWAVWKL

SEQ ID NO: 34060 - protein, 96 aa, A.fumigatus
  UNSURE (65): Identity of amino acid sequences at the above locations are unknown.
RIFATLSRYDRLNLPRLKAYSELPNRQLLPALAAMIQQHLVYHYTSYDDGVTYYEANMQSAYYLXRSGKNLEFVEDDLASMRRPSFRPSCFSDTPK

SEQ ID NO: 34061 - protein, 84 aa, A.fumigatus
SLTVSAFNGQSTLKRSALRITREVELLGGEVSSTHSRENVVLKTKFLSKDLPYFAELLAEVAFQTKFAGKWTAVVSHNLQCDIG

SEQ ID NO: 34062 - protein, 105 aa, A.fumigatus
YAHAIMLSRSSLSRNAPRALSAASASSRRSMASAATPGLQYDVSESAGVKVANREVAGPTGTLALVAKAGSRYQPFPGFSDALEFFAFKVGIIARLQSLQLTNVN

SEQ ID NO: 34063 - protein, 295 aa, A.fumigatus
TSSSSTSSSTDSKPFAADAENIAVDAAHALAFHRGLGENITPSASGPFEKYISADAIAEFAKDAYAKSNIAIVGSGSSTAEVSRWVGEFFTEVPSAGGSSQFKVRPNTASKYYGGEQRISSKSGNAVVIAFPGSSTFGTSGYKPEASVLAALLGGESSIKWTPGFSLLAKATQGFSQVRVATKNNAYSDAGLFTITVSGKADQVAAASKNVVDVLKKTAAGEIAGDEIKKAIALAKFRALESAQTLETGLEATGAALINGSKPYQIGEIAQGFDSVTEAQIKDVSLFSFPTHCVL

SEQ ID NO: 34064 - protein, 76 aa, A.fumigatus
QKKQTTRSKKESESEIRTCLKGSWVSIESSAPFSYFSLIDAIKNHVYLYHLISPDTEGDGKAGSARTRHFDQSANE

SEQ ID NO: 34065 - protein, 288 aa, A.fumigatus
MEVRYGLSACLKTSPLTNTCFFAEKYEAAPIALSLNEAFIAISLAFGNLHPILGSFRTSQHLIQAVAPGSSPLLQLPYFNNQVVKAIEGADAKDHYTVQKFMSLPEDKRRSLTVGAGLLSEKQYSTAVSVAKQLPVLEVSRAFFKVMGEKVITPSSLVQLVVKARFIPPGSTNIPEVNPAELEERDPDEDDLDALMGRKPPRTDLPGLSTANRSRTRLRLFNPLSLTHPTWLATTLLAGTFSWPMPSRARWPFLHSPSPPSTSPCSTRQESQPSTFRHSRCSSRLLLR

SEQ ID NO: 34066 - protein, 74 aa, A.fumigatus
RYVLLHSFPVLASQITNQISMIDSIAGQMQALKTGQPPRKKARKPSDESSEEESDTDGDAGDTSDTNTETDVED

SEQ ID NO: 34067 - protein, 167 aa, A.fumigatus
GRPRCSHGPKAPQDRPTRTVNGQQVENKIEIIQPPLAHAPYLARDHSPRWHIFLADAKQGKMAVPPFTFTTFDQPLFDEAGKPTFNVQTLKMQFQAPPQVGDFSFVMHMMCDSYLGLDTKLDITLHVDDPAKAAALEEEDDISEPDEGMFYCILFLYWQVKSLIKSR

SEQ ID NO: 34068 - protein, 126 aa, A.fumigatus
GPNDSGQTHGKLFCSLSPILQAVMMALHPFDPITPAEIQLAVKILEAAFPGVSLRYKKIDVNEPLKKEVVPYIEAERSRKALPAAPTRLLQVLFHRLDNGAFYKALLNAGTRSVVYAKQLPKEVQV

SEQ ID NO: 34069 - protein, 190 aa, A.fumigatus
LRTREVANKIDPRAPYHRKQAFDVGDVGFGITANQLSLGCDCLGYIKYFDGYRSDSKAHPVQLKNVICLHEQDNGLQHKHTNYRTGAATVVRNRQLLVHMICNVSNYEYIFAFIFDQAANIYLDVRATGILSTVPFDNEKFGTTVPWGTNVGPGVMAPFHQHMFSFRIDPAIDGFKNTVYYKDSVPMPDD

SEQ ID NO: 34070 - protein, 135 aa, A.fumigatus
NNPYLVGYTTEQTVLHTSGNGNTSVERHPVFKIRNDACINPITYKPVAYKLQTAPSQMLLAGNRSFGYKRAEFATKPIWVTKYQDDELFAAGEFTNQSKQSEGVEKWVQRNDPVENEDLVLWHSKSDRLFLLRRH

SEQ ID NO: 34071 - protein, 288 aa, A.fumigatus
KRRWYRILKPRDHGRLCRRHQLGCCRCCSIVLTMEHSTKRCSMRGPGLWCMPNSCPKRFRYRLCRSVNLGGNVSDSTQGPVDADELIEIEQLCLSHPAVQAEIAKMQLPQGVTVCNDPWIYGTDDPKETRRLFQCYMYVVTTDHPQNNHYSTPCKFSPVFDALTRELVRMDYLPGGVDTQVSETQPWKTVETIQYAHDLLTEPLRTDLKPYIVQQPEGPSFHVQGNLVSWQKWKFRVGFNTREGLVIYNTTYDGRNVFYRLSVSEMTVPYGGMQWPIHDCGQEKSLTR

SEQ ID NO: 34072 - protein, 115 aa, A.fumigatus
WRLSTSTCSPSVLTLPLMGSKTPSTTKIACRCPMTRTTHIWWVTPPNKPSCTPAATATPAWSATRCSRSATTPASTRSLINRWPISCRPRRARCCWRGTGRLATSGPSSLPSRSG

SEQ ID NO: 34073 - protein, 240 aa, A.fumigatus
RMAPLSSIWAYLNEDIGEDLLLECQLLLLSFATGIQDAATWPDYSCFASNQTGNTLFLAIGVAGLANNAYSFPNIGMSLGMFIAGGLLVGQLGNLFGVRRRLWLLLSSVIQTVLVVAGLVVQYTLPVKQEGPAALGVIACLAFSSGAQVAMSRSLKITEITTAMATAAYVDVVVDPGLLRVHNRPRTRRVLFLVMLTAGCFVGAFAQRAVNSSFALLWCAVGKAVVTVSLLWNKRLEKTC

SEQ ID NO: 34074 - protein, 78 aa, A.fumigatus
PIVLVEASLTVPAFGLTHNPRVEDFPVMPVERVSVMLKPDGFFTKNPALDVPASTQSFNRSTLHPEPAACCAPAKVKL

SEQ ID NO: 34075 - protein, 134 aa, A.fumigatus
TGIDQHVFSSRLFHSNETVTTAFPTAHHSSAKDEFTARCANAPTKHPAVSITRNSTRRVRGRLCTLNSPGSTTTSTYAAVAMAVVISVIFSDRLIATCAPDENAKHAMTPNAAGPSCFTGSVYCTTSPATTSTV

SEQ ID NO: 34076 - protein, 108 aa, A.fumigatus
HHALSSRTKPQAKQNNNMQPLDYRPGLINMSSPAVYSTATRPSRQPSPPHTTVAQRTNSLPVAQTPRQNTPPSASPGTAPAECAAGYVPSTVPDPPPHPHMPPSPWPL

SEQ ID NO: 34077 - protein, 74 aa, A.fumigatus
NAPLSRRWNSTCNNRVGAAGKAFRDLSASIYGTTSFFRGSLTSIFLYLKDTPGKAASRILTANWISAGVMGSKG

SEQ ID NO: 34078 - protein, 313 aa, A.fumigatus
RYYGGSLPYPVSQDMPVEHLKYLTTEQALADIPYFAANFSRLNHPDFDLTPRGTPWIMIGGSYPGIRAAITRNKYPDTIFAAYASSAPVQAQLNMSVYYEQIYRAIVGNGYSNCTKDIQAALKYIDGQLSNKRTFALIKRLFLGPDAEKNSNEDFTTALVTLYGPFQAHGLWSGNQSLPDFCNYLELDPATNQSAGPEGLSPIHGSKYVAERWASFPYFISLVNRMYGTNCNGLNASEPLSCDFSQTNTIPELISWTWQYCTEWGFFQNNNFGSHAFLSSYQNPGVSTRNSVIASSQMASRLAFYRHDHRRKA

SEQ ID NO: 34079 - protein, 74 aa, A.fumigatus
LVQMLIDHEDPSVGTYRNRFWVNEDFYISGSPIMVYDIGEATAEYSVSLLTNSSSWLSLLLQEFNAMGIVWEHR

SEQ ID NO: 34080 - protein, 100 aa, A.fumigatus
LIARPVDGLCLAKVQRQYSCQRSCKASPLQQVTRFLANMSHEIRTPMNGVIGISQLARSCRQTSRTTANAISFTVDLTRPFFRPIIKKPPLKNSVRTYCT

SEQ ID NO: 34081 - protein, 91 aa, A.fumigatus
TLAKQRPSTGRAINHFSIDCFHQKSTVLISAFEPFATIFTFALPKCLIFGNMLTTRDVSMMYGGCGRWSVDSKDLDHSYKNVTVVILRTLS

SEQ ID NO: 34082 - protein, 63 aa, A.fumigatus
YYTVLLVSHVLFKSPYVVSTREQSSTYQAYVLCQDASNDPFNRTQFSKSQDLNNLPCENGQNV

SEQ ID NO: 34083 - protein, 233 aa, A.fumigatus
DRYQDWYVNYFHRILIDVFVLTHASGMIMVFGEITTNAKLDYQKIIRGAIKDIGYDDSDKGFDYKTCNVLVAIEQQSPDIAQGLHYDEALEKLGAGDQGIMFGYATDETPELLPLTLLLSHKLNSAMTQARKDGSIPWLRPDTKTQVTVEYAHDGGAVKPLRVDTVVVSAQHSDDVSTEELRTVIKEKIIKKVIPAELLDDRTIYHIQPSGRFVIGGPQGDAGLTGRKNHVDT

SEQ ID NO: 34084 - protein, 224 aa, A.fumigatus
FLAGESTTTVATPATLGVDMILTTSETGITLRTTDDEAARGLDVVNGAVVQKLSGDDLLDDLLLDDSTELLGGNIIAVLSRDDDRVHAQGLDGTAVVSVLNGDLGLGVGTEPGDGTVLTSLCHSRVELVREQKGERKELRGLVGGITEHDTLVTSTKLLKSLIVVETLSNVGGLLLNGDKDVAGLVVKTLIGVIITDVLDGTTDDLLVVQLGIGSDFTKDHNHT

SEQ ID NO: 34085 - protein, 61 aa, A.fumigatus
PFHIRKQHKHKMSKFGVLVMGPAGAGKSTFCSALIQHLQTTRRSCFYVNARPRRRKFQLRA

SEQ ID NO: 34086 - protein, 73 aa, A.fumigatus
GTGAAGAKRRAGRGLRGCRYLILISSTHDVRLTTSTLYDTIHRRIDVCTSSADVRITVESHQGIFTTGLEGHA

SEQ ID NO: 34087 - protein, 256 aa, A.fumigatus
MLDPAAESFNYEPDLDIRELITLEDVMEEMELGPNGGLIYCFEFLLQNLDFLSQALDPLSEEYLIIFDMPGQIELYTHIPLLPSLVQYLSRQGPLNINLCAAYLLESTFVIDKAKFFAGTLSAMSAMLMLEMPHVNILSKMDQVRDMVSRKELKRFVNVDVNLLQDEIGGAEEPVEGDPSSKDTLLSGRSFKRLNRAVGQLIDDFSMVSFLKLDVQDEDSVPAVLSHIDDAIQFHEAQEPREPNDEQDVDYEDADI

SEQ ID NO: 34088 - protein, 92 aa, A.fumigatus
  UNSURE (21): Identity of amino acid sequences at the above locations are unknown.
NLLAPSTPCEYKHTTNLETLXLLYSKSHLGFTLLLPSQFRSASTHAGSAGGSPTEIAPPRLSTVAKLTSSWQAGSNPRVGPFFPIVISLMIP

SEQ ID NO: 34089 - protein, 60 aa, A.fumigatus
QETLQKVVSVSYCDGFAQQYNVSYRAFECLCFYAANKSHSTSIHLCRCGQSGVKRSALSP

SEQ ID NO: 34090 - protein, 110 aa, A.fumigatus
RLLNPSSTLQHMLDLWGQRRPMRLNTWYDKVKWNDIFIFFGLMLLVGTANLVRESILLLFNPLLDPARPVSGRYPPLLTAFVCAHGFLFTRGEINSFLLSADQFLSILDR

SEQ ID NO: 34091 - protein, 71 aa, A.fumigatus
YILPNAGNLININHVSHSTICFMVLCCSFSVIKYHRLPRGVLSNISIIIYLALTRFTFIKYQAYTLGVGNP

SEQ ID NO: 34092 - protein, 113 aa, A.fumigatus
FRTSSWSALFSIYIRVKGKNRESRRSFGPAFYREILLFLDFRPLFNWNDRGLIYYKDDFYKPTSAVSLQASGVDVVRPLEYNIPEIPSPIVYYYCTTSRKARSLRFLLNNVLI

SEQ ID NO: 34093 - protein, 537 aa, A.fumigatus
IDIDLPFETCRRPIIKNFLGLQHKKEYTDTRGLRYCHLMIMTDQDHDGSHIKGLLINFLQAQFPSLLKIPEFLIEFITPIAKVWKGDPKNPTKQHSFFTMPEYEAWKEEHKHERGWEHKYYKGLGTSTTEDAQVYFRDLDRHLKEFHTLQDHETELIELAFSKKKADERKEWLRQFKPGTFLDHSVDKITYTDFINKELILFSMADNQRSIPSVVDGLKPGQRKVLYTCFRRNLRKDMKVVELAGHVSGMTAYQHGDASLQQTIVGLAQTFVGSNNINCLEPSGNFGSRLQGGQDCASARYIYTRLSPFARRVFHAADDPLLTYNEDDGKKIEPEVYVPVVPMILINGADGIGTGWSSSIPNYNPEDIVDNLKRLMDGQPVKPMQPWFRGFTGEVTALGGDRFKFSGIIKETGDKEVEITELPIRTWTQDFKDKLEEIIKAEKTPSFIKDYKDYNTHTKVHFVIQMDEKNLQSAREEGLEEKFKLSKTIATTNLVAFDPEGRITKYASVDDILKEFYAVRLKFYERRKVCGSHASRI

SEQ ID NO: 34094 - protein, 266 aa, A.fumigatus
QYQLNELQKELDKLTNQARFVQMIIDGDLVISKKKKPALVAELKKHGFKAFPKVIDAVKAGEDAPVVEEEEDESGNDETEVLSSAYDYLLGMPLWSLTHERVEKLRRQIGEKEVEIDALIKLSKEDIWKRDLDDFINEWRFQLEDEARRQRKVANMGRRTSAKLMTAAGRGKATKKRKAALDDDSDDEDFAAPKSKKSAAAKKTEPNGGLLSYLGKPSAKPAPSGDGGDSDDDFEVEVLPKKNRGAATKATTKVKDEDEVMDDLGE

SEQ ID NO: 34095 - protein, 255 aa, A.fumigatus
  UNSURE (215): Identity of amino acid sequences at the above locations are unknown.
ILPKKSRGPAKPAPKPKEEADDDSEDIAPKKGRAAAKAKPKPKVEDDDDLDDDEFMEIAKAEAAKSVKSQPNRTSRKITNYTALDDSDSDNGDDLLGDVSKMVKGIGGATGDSTTDSRQLFSERSRPSSSSSGLKVSSSKPSKLSTDFDADETDYSKLIPQNSPRRSLQVKPKETKVNDDFDMDDDDDGDPVKPAAQAKPVAKKGNSAGTAASSXPATAPKPRGRPKKECGETGAPAPSLNQTICSLPPKAFSSQ

SEQ ID NO: 34096 - protein, 134 aa, A.fumigatus
FVIFLLVRFGWDLTDLAASALAISMNSSSSRSSSSSTLGLGFALAAALPFLGAMSSESSSASSFGLGAGLAGPRLFFGSIYSPRSSITSSSSFTLVVALVAAPLFFFGSTSTSKSSSESPPSPEGAGFADGLPK

SEQ ID NO: 34097 - protein, 134 aa, A.fumigatus
TSFSDSVSSALVASSSKSTRGLRTSARAMAMRCRCPPERSWLPLAVPHCVSSPSGSEDTKSHALAARHASSSASSDAASVAERPGIPCEMFSRIVPGKRVGSCCTRATCLRYRSGLRKDKGADESMVIVPLVGS

SEQ ID NO: 34098 - protein, 142 aa, A.fumigatus
  UNSURE (1): Identity of amino acid sequences at the above locations are unknown.
XRAYAQAILELMGFTVAIILMSGINIVVSSVLAVAVSWKLGVIGVFVGLPPIMLCGYARVRLETKMDDEIGQRLSVSASIASETVMAIRTVASLALENTVLKKYTDELDRAIIQASGPMFHMMIWFSLTQSVEYFVLALGFW

SEQ ID NO: 34099 - protein, 230 aa, A.fumigatus
IQRGDFVGFVGASGCGKSTMISLLERFYDPTNGTITIDSSAPLSFLNPLLYRRHVALVQQEPTLFPGTIRENISQGMPGLSATEAASDDALEEACRAANAWDFVSSLPEGLDTQCGTASGSQLLSGGQRQRIAIARALVRNPRVLLLDEATSALDTESEKLVQAALAEAASSGARITIAVAHRLSTVRDANCIFVFDAGSIVEVGSHDELLAKGGLYARMCEAQALDGSG

SEQ ID NO: 34100 - protein, 220 aa, A.fumigatus
CSKSQPSSQAQSAKTSHRGCQVSLPRKQHPTTHWRRHAGPPTHGTLCPRCRRDSTRNAGQRAVASSFQGGSGSALPLPGHWCAIPACFCSMRRPARWIPSRKSLFKLLWRRRPHLEQGLLLPWRIVSQRCVMLTAYSYLMQGVSWRLGLMTSCLLKGDCMLGCVRLRRWMALDDLPPSHGASTPFWELVMMLQPVTTNVALDVKEINPTVQSSRYPCARQ

SEQ ID NO: 34101 - protein, 69 aa, A.fumigatus
GILSYFPSTILFYSTIIHLIPPILPLLPLYLGKPTIPLCICEISFIIDILFSIYCFIFIHSWQDSTRYH

SEQ ID NO: 34102 - protein, 632 aa, A.fumigatus
REQKLTLLNCATGKITVDDVEYSINQDFQQGALQLADALNIDELEAAVLFFAAQEEAQVLDRPPLIAAIMRFHERRHFLLECLRLILQESFEVEREVTQALMQDMVAFVVEIKTGPLRNASLFARKCMKSMEDIEGWLLLLGEQIQKASIVGQVEDRDVMEAIEYQRSSLQQQHESLGAILCYFFKGPYTSPEDLRVLLNRLRKLERFDGLLLHYIPAMISSFVQHGSPERSNSYKEARSLHLAVTSTKDGQTWTIPTFHAAVIALWLAVYSGWDIDGPTSPVQGVDFEKEAEERTQMFMTALDDGGLDFLLAICSGVNNEEWADPARRELVALLLKESAFANLESEPCAGFLKTLLMENLEIFVESCIANMPDAVRKLKSEEDMQRLDQITALRDGLSSSLHRGLVEARTHLESFLMIIAFAFESRPDAAQEFWADPDGNLYGFLQWASKRQTVPRVSAFCELLCSISGGEENAAAAHRFLTEEDKFLSSKFKRSTSMNWSQMFAELQLYATRVTEKPSASQAVLRARKSEPADMSEPESPVMLTCYLRLMGHLCKQSGSIREWMLQHPSFSVVSTLLTLCSGPIPTHLRATVFTTLAALMTDRTSHNGNEMWLSLDQWISGGRHEWPRPW

SEQ ID NO: 34103 - protein, 62 aa, A.fumigatus
IQEEHANEIGLVKNNSHDNCIYAIERGLMFTSSDRRKLQKSPKPAKDLLSGYLHGGSRSRCK

SEQ ID NO: 34104 - protein, 478 aa, A.fumigatus
NTFSSRINGAQSCMYDPQSVYGMCVIQRLTYAYLIRTSLNDKACHKIFESLFRFISVERSLYNRASSKGACASRLSACASVIRTAINVFLRNLRTKSIRAIVDHITEILQVPGEGLWEHLGADYLKCLTTLLRYPPHLEHLAANEWDKVLNLCLRSIGAPEDGDSQSSDHNGHPSTLDDFLDASSRSTPSRRTSSLALREKQSGDKRIVAEAIVCIQLLTATPTAPVQVAAEKVLRGLGTFLKLSPIAGSEHQAAFNSINTVVMRVIFDQSDLVRMFLLDLIPVIRHLWSTKLMGLKDELLVTILLCMIILTDATRRAPTDSLALSIENLLDTIYSEYTKRSEKDILQIDELIFDRTSSTQIIDLALQPRLEVPRSEHNLTVVWVMAKLMRLSEESTAQLSHPAGETPSKKQRLNSASDQVFRDCVMSSGNRRVCALQLIPILLQGRLTMESKASLLQRLIPYILDDNGVIASWTMVA

SEQ ID NO: 34105 - protein, 71 aa, A.fumigatus
YQHHALDADCVRNTDSRAIVMAQITLDKAIALLSSEKLKERSDSLAGLSTAEPFNGNFADPTRFETHSPAE

SEQ ID NO: 34106 - protein, 171 aa, A.fumigatus
STAGINAFIYMTLGRLIHFFIPERRLGGISAKRYGLIFVWLDILAFIVQLAGASITTQREVPTSTIMLGIHIYMGGIGLQELFVLIFGALTIHLHRRMVQMENYGGLDNEKTTRGSVSWRWLFAALYAALILITVCAIAPGERGILTKVADPNHLPSLPVCAGHGSDEPCF

SEQ ID NO: 34107 - protein, 60 aa, A.fumigatus
SLILIPSLNINLPLKDYIRRKHLASSINAFNYYNPFPITWLNKMRLPRHISSYYYLSSYN

SEQ ID NO: 34108 - protein, 62 aa, A.fumigatus
EAKYPYLNPYPPSEPCINQLILACYTSYTSAITQASILSQEAPKTTILKPFDAFKISYPAAY

SEQ ID NO: 34109 - protein, 429 aa, A.fumigatus
RLGDSRPVPPPPKTETSADLGEESDDELSVRAKDLSLNATEAEQEPPAAAQSVSAHPLPDHLDSRRSSTYEPTSPKSPALPSEKRMSRPPPPIPTNPPMSPQFQGRAPPPPPGNIRRRSTADSRTSAVSQPRQAGEDLEGEVTEYDGDYDTDIASGARFKDALKSHGRDSSVDEGTITDDHSLQSPRSPQETRLPPPPPPSAPRAVPPPPPIQPPRSSGGASLESPRGPPPPPPHRELSFGREEDYDPYRYSAPQHGVPAPRVPPVPLGRPESPTVAPSQAAEHDSEDMYDASPAVQSASGRSAAPPLEKRSSFAPPPPTLPPSAPPPSAPRSNRASLDIPRGQPNLRRYMDASRPSIDQGFIAMDVDLAEGSLWWTQPNIPPPVFQNRKDVLFEVEESTSTKRSGKTTISKDVYVLFMDYSQTVITVA

SEQ ID NO: 34110 - protein, 217 aa, A.fumigatus
VARFLPAPVGEDDYSAAADTEDAEETSTSKEDLEDRSGADTHQAPKPEKKEANDKLEQDEGNESDEEEDEEEEEIDPEIKRRMELRERMAKMSGGMGMMGFFGPPGGMPVPGAGPRKPKAAAETEKKTEDSDRAARTTAPPVPVMALPGMNAVRPTAASPSVEKEEDVPQSASVTEQHPPQDIPDVEDVVKEDSSHRVPDETPAAPQGMHPCFSNGH

SEQ ID NO: 34111 - protein, 130 aa, A.fumigatus
GTSLAFLTNLWLFYCRYLRAFEVGREPTVSKYEIHIRLKTKRDGPVIRNMLRFPHSVQTESRICVVCPPGTRHEKEARAAGAVLVGEQDVFDAVKAGKIEFDRLICHPDSLDALNKAGCLNAAAGRKQIP

SEQ ID NO: 34112 - protein, 375 aa, A.fumigatus
ENEWLSQLEAFAPLDFKALDPELQRLDTHLLLRSFVVGYALSTADIALWGAIRGNRVAVAAIKKGSLVNVTRWFYFLEDLCPWATSTLEVLNQAVREKKAAKAKEGASYDIALLNTEKGVVTRFPPEPSGYLHIGHAKAALLNDYFAHEKYNGTLLVRFDDTNPSNEKLEFQDAIIEDLALMGIKPDKMSYTSDYFDELYQYALQIIKDGNAYADDTEKEVMAEQRMNGKPSKRRDASVEENLARFEEMKKGTPEGLRWCIRAKMSVDNPNKAMRDPVIYRCNPAPHHRTGTKWKIYPTYDFACPIVDSIEGVTHALRTIEYRDRNPQYQWFLDTLKLRHVQIWDFARMNFIRTLLSKRKLTKLVNQGVVWGWDE

SEQ ID NO: 34113 - protein, 110 aa, A.fumigatus
GIRRRGMTIPALREFILKQGPSKNITNLDWTLIWATNKKYIDPVAPRHTAILKKDMVKAIVKGGPATPYTEEKPKHGKNPAVGMKKGVLVTRSFSTRKMPRASSKMKRSP

SEQ ID NO: 34114 - protein, 189 aa, A.fumigatus
YFVYSRTVFQDILYRFQRQAFLKCSSYSLDSVYRPMPSRDRGRPVIPRINKYIYPHPILFTSAQEPHSQFTAQNQDDSDWLGKSSPDQTNLDSQHSNDLNQYGLGSMGLAMATNLQRHLATKGALNLVYSNRTMARGDTLKRLGAVPEPSFPNLVAQCGIIFTMVAPFYPEGDCETHNNRRRRSPTTPC

SEQ ID NO: 34115 - protein, 62 aa, A.fumigatus
RIAFLLEVAADRRMRTATTRKDSAMAVILYNHQYFVLNSLAYIYTTYKDQPGRQLDGSWKPI

SEQ ID NO: 34116 - protein, 114 aa, A.fumigatus
TTQISNDTVLSNLITTAVESGHSLKDKIFVDCSTVHPQTVGLTVSKLKEKQASFLAAPVFGGNPIAVDGKLVFAIGGPRSAAEVVKPLIQDVMGRKIIDCGEDATKSSLLKIAG

SEQ ID NO: 34117 - protein, 87 aa, A.fumigatus
MENGIVKKWDDMQHLWNYTFYEKMKIDPTGRKILLTEPPMNPLKNREKMCEVMLEQYNFGGVYVAIQAVLALYAQGECNGRADSTDS

SEQ ID NO: 34118 - protein, 197 aa, A.fumigatus
SLFVPGLSSGVVVDSGDGVTHIIPVYESTVLKHHIRRLDVAGRDVTRNLIALLLRRGYALNRTADFETVRQIKEKLCYVSYDLELDKKLSEDTTVLVESYTLPDGRVIRVGSERFEAPECLFQPHLVDVDQPGMAELLFNTIQGADVDVRSSLYKAIVLSGGSSMYPGLPSRLEKELKQLWLTRVLQGDPERLGVRP

SEQ ID NO: 34119 - protein, 81 aa, A.fumigatus
PKLIYLLQKFKVRIEDPPRRRHMVFLGGAVLANLVRNQCSLTFTFNDVSNISQIADKEDMWVSKQEWEEQGVRALAKLGTS

SEQ ID NO: 34120 - protein, 149 aa, A.fumigatus
SNHLPQHRMPHRSIPPSARYLGPSAPRRPVPRPRLPSSSPSRCSCNNQPKQSDTLPPKKKKKKKKKKKKKKKKNSEGRKKDSPSNLQQGRLGCVLPAVDDLPPHDILDERLDNLRRTPRSTDREDKLPVHGDRVAPEYRCSQERSLLLL

SEQ ID NO: 34121 - protein, 98 aa, A.fumigatus
AANASRPPSVSSNRTWWMSTSPAWPSCSSTLFKAPTSTSAQACTRPSSSAVEAACTPVCRRGWRRNSSSCGLRGYSRETLSALVYVPNLSFLGENDQS

SEQ ID NO: 34122 - protein, 192 aa, A.fumigatus
ARPLREDLCLAHGFHQVHRHDVPVTISLNNPTPCRQKKKKKKKKKKKKKKKKILKEERKTHPAIFSRDDLVASSPQSMIFRPMTSWMSGLTTSAALLGPPIAKTSFPSTAIGLPPNTGAARNEACFSFSLETVRPTVCGWTVEQSTKILSLSEWPDSTAVVMRLLSTVSLEICVVYYYAFRSLPRDRRGLPW

SEQ ID NO: 34123 - protein, 122 aa, A.fumigatus
SSMEELVSSRSDMLRRYVGYYTQNVYHAPCSCVFRLQNFPEHQFPSIVGRPILRTEEQAGDIVVKDIMCGDEAAAARSMLQISYPVRSASYVSVPVANSCSPSWRSSRHRLCSRALISETIG

SEQ ID NO: 34124 - protein, 129 aa, A.fumigatus
FLVCTVSFQPRPQSALRRRRLLIQRLCFIGGISLLLLVLIFPSWRAAILPTLSLGLIHSSEDLQLQTVRYYDLSKVQGTAKGWEKGERVLMLTPLRDASSHLPISSHTSEISPTLTLFSKLPRRPAYAG

SEQ ID NO: 34125 - protein, 89 aa, A.fumigatus
ECSPRALSTRPVFRPRSLRKSHSRRETVELWGRERYYILDSDYEAGSVILALRDPPLMDSLLKKMLRHVEIGVKGMGSPDSRISRVEGN

SEQ ID NO: 34126 - protein, 64 aa, A.fumigatus
  UNSURE (51): Identity of amino acid sequences at the above locations are unknown.
NGREYGDATTGGYNEHLRHCFKLIISNDLKLKNSFTLLKKGQLWGISIKFXLFLTNHKFPVYSH

SEQ ID NO: 34127 - protein, 597 aa, A.fumigatus
GRPGSSQHMPAPPQHQDNSLFLVADDQFCVDAQKALASLRDILPPYMIPSDLLRISHLPMVPSGKTDRRLIRMRAVDLAPEERRKYSSVLGQSRDQPVTQLEESLLGLWATCLKLPPSQIGVLDNFFHLGGGSLEAIHLAAEARNMGFAELSSAAVFQCPTIREMAGMLDGVTASVQGQDPRGCTSFQLESSLVAELLRKSQRTLEDLQEGFLPLTPFQEKTAKMKPMHLLLDIPGIDHSRLEAAWALVLEKHISFRSIYVEHQGRVYQAFLRQPDTVSIPIRWCDEPVHECAARFCEQDVDLILDGRPWWSMTRINNKIDGVLVLRLTHAQWDALTLDVLFKDFMAAYESRELSRRDLEFPAYMRFRLRHNASPATVRFWSTFLHGSRLTQPLLLDGAAEVDPGNEAMVFVSQQIPMLTPPHGITLGSVFRAAWAFVLARYTGQEDVVFGEFVEGRSLLVKSVEKVTGCAAAETPMRIVVPPTASVRDLLKHSQEQYVARIPYETCELEDIVPSSTSWPTDTTFNHILVIQHEPVLPPVALDGRPCPHRWPSTDGSRTSTSKWCSARIRCTLECLVRRSGCPGPLRPSWLRSWRRQ

SEQ ID NO: 34128 - protein, 116 aa, A.fumigatus
DKFNAHESWAGGRASIDDALATLSPWPGRVRPWSVIRHTLPEKLVDHALIYRPPLDTWVSAGGRVMLIGDAAHPYFPVVGQGGSQAIEDGVVVATALELAGKENVPLALRVAEKIR

SEQ ID NO: 34129 - protein, 105 aa, A.fumigatus
DSLMKLPAAAGDAIVIGPNAVRLIKSWGEQLCEEIEPHLSNATHAEMLDHHDRFIVRHELAGRGKGWFTNRGRLLSILYEHARKLGIDIRLGSRVANYWEEDGRA

SEQ ID NO: 34130 - protein, 195 aa, A.fumigatus
LLFSDILMDGPPAQSLGVEPVDPTIMNRPPRSRTARVLTRPLIQRVLTSAFMIMLGTLAIYVYEMGDADDLSTPGKRSRVVTAHDTTMTFTCFVLFDMFNALTCRSESKSVLRGELPLFGNKMFNYAVLGSLFGQACVIYVPFFQRIFQTEPLNAAHLFKLLCVSSTVFWVDEGRKYLNAVKRRRAVGGRYSVNV

SEQ ID NO: 34131 - protein, 518 aa, A.fumigatus
  UNSURE (223),(508): Identity of amino acid sequences at the above locations are unknown.
FVELAAKAAAICGGRECSTAATQVQVLNLEIHNPLGHAPGARVGLRLKRIGSCKWGFSVISDKDVQSICHATGVISLRQERHGKLEIGPQWSVIQRVIGYSHIQDVLDDSSAISLKEGIIYKVLEKVAEYKPCHRAIKSMTIKGTAAVAQLEMPAISRDSSEITVSDPLVMDQFALIAEVLALCRDDGKRDNVFICSGLSELVTFKSLQSGLGPWTVYTHQTXCGPRELLSDTFVFDSTSKQLIIGLLGARFVRITASSLNGIVKRANLNSQTSELSVETDAVNHPASVAYPPSNNNDTSDILSILSHLLHEITGLPPSEISASTPLMEASVDSLAATELENRIQEEFHLHRPISLYERQFNVGTLCQEIQTQRDDRLARASRTTTATRNTSFSLGRRTSSTESLPDDAEARFISKSAAVLAQLSRMLSESFNITESILPGTELRSLGLDSLVAVELEYDLQQAFGLKVDLMQLSPEPTVGGLARLILASESQTSGHIASSMMDCRQXTEGKSQMYLG

SEQ ID NO: 34132 - protein, 94 aa, A.fumigatus
  UNSURE (32),(59): Identity of amino acid sequences at the above locations are unknown.
LNVGGYCIVNWINYGLSFRGASIAWRLPIALXLFFICALFATVPWLPESPRWLLAHGPXKDGVQVLSCIEPKPIDDAYIITHHHEIQYRIQYQR

SEQ ID NO: 34133 - protein, 90 aa, A.fumigatus
  UNSURE (90): Identity of amino acid sequences at the above locations are unknown.
PFVLGGVVVTPDFLELHDLVGPTRTKILSTVTAIYDVGCFLGAILAFTLGERLGRKKSILLGTTIMAVGTVLQASSFRLPQMFVGRVILX

SEQ ID NO: 34134 - protein, 185 aa, A.fumigatus
  UNSURE (153): Identity of amino acid sequences at the above locations are unknown.
WMEGLGADVLRPYRFVQGSWRPDFLLESSENPEQIENYRICEINARFFSNGFLFTAFGQQALINMGIEKYGLKGATDPEKVSHPVPLYETNKVNRTQVITGLNKLVNPSLPLHIAKGEEYGFDTHMWVPYLQQNLAMDVKVIPPENLRLVPAXTPGGLKLYCLSSPDCKPPQVTNESWAIVYKTF

SEQ ID NO: 34135 - protein, 346 aa, A.fumigatus
CSVHIAWNGVLVNKWNRALDLMAETFEGSGASVLCAGSLMEPDQMIEILLEYRVNAIAGDTSQIMQLSRYICTLPDDTRKQLLINKVIYTSEPMTPVQRKFLSSVFPNVAVSSVIGSAEAGPWATSPAQLTEASKGQNYADFVYDQRLMHLEVFPFDIEESDGAGLASARPVPDGEKGLLVQTSLQRMRHPLIRYICGDVCSLHPLPASMKNIIPAEDAAHYKVARLYGRDRRISFDWYGEYFEFAVIQDAMRTESWGILQYQIIRRYNGGDKNNLDIVLELRVLRHNEPGAISTDELTRELRKLFWVFENNEELFDLRYLQSYAGFVRSSTGRKVINFIDETQIE

SEQ ID NO: 34136 - protein, 64 aa, A.fumigatus
HRFLQNIPAICLNVGPMLNGYMKNELAGSGMVVWKGREKYAAGEISREEFIDYVSRGYVPTSVR

SEQ ID NO: 34137 - protein, 455 aa, A.fumigatus
RTSSPAQVWWYGKAEKSMPLARSVERSSSITCPEGMSRLQSDDSRILTLCRAPSVGHCNTMGTASTMNALAEALGMALPGSAAIPAPYRERGQCAYDTGLQIVEMVHADRKPSDIMTREAFENAIVVNTAIGGSTNAPIHIGAIAKHIGVDLSLDDWDRLGFHIPLLVNMQPAGELLGEEYYRAGGLPAVMAELLDAGKLHADILTCNGRTVKENVQGKHTWDRRMIRAYDDPLMKDAGFLHLKGTLFNSAIMKTCVISTEFRQKFLENPDDPNAFEGAVIVFDGPEDYHHRLEDPNTPIDDRTILIMRGAGPLGYPGAAEVVNMHPPGRLLRQGVHSLPCIGDGRQSGTSGSPSILNASPEAAAGGNLALLRDGDRLRVDLNKRHVDILVPAEELEKRKKALEANGGYGVPESQTPWQDLFRREVAQLSEGMVLREAVKYQRLAQRFEEPRHNH

SEQ ID NO: 34138 - protein, 232 aa, A.fumigatus
DHQEDLTMPCNPQASASCEGCSCDAGANRAPVNIEDCEPELLALRRRTLELEKSLASMTAGAAKVSRAGRKLRSSRWFNCENDPGMMALYIERYLNYGMTKEELMSGKPIIGIAQSGSDLAPCNRHHLELVKRVREGIRAAGGVPFEFPTHPIQESSRRPTAAIDRNLSYLGLVEILHGYFLDGVVLLTGCDKTTPAALMAAATVVCDLCSPLPGAEPFLTPFSTEHSRNMP

SEQ ID NO: 34139 - protein, 238 aa, A.fumigatus
VRSQRGGSKGWNLRCPCRDNPVKKEDAQLLLNNLGLSVKPDEVDDFRTLLAAVHDCAEDVAKLPDYQPVPDLSRYPRQNIRRPSPEEQVFGQAWAHKFLIKGNADGGPLAGKTVSLKDCIAVAGVPQLLGSDVIPSWTPITDATVVTRILDAGADILGTSTCENFCHSTGSYTSAQGVVENPFAAGYSAGGSTSGGAALVAGGLVDITIGGDQGGSIRVPASLCGCMIAPHQTVAWPH

SEQ ID NO: 34140 - protein, 150 aa, A.fumigatus
  UNSURE (7): Identity of amino acid sequences at the above locations are unknown.
YLGTGDXWTKIDYSKKAEEWMKPLVPGRETGLVEIPANWYMDDLPPMMFIKAASNSHGFVNPRDVEDIWRDHFDYFYREYDTFIFPITIHPDVFGRPPVLLMHERLIEHFKKHDGVEFVTMEQVCDIFKKENPPPAGALMPAEPGAILKK

SEQ ID NO: 34141 - protein, 67 aa, A.fumigatus
PKPFGSRYELKIAEMGKKRVLVTYGVDVDAVAGWLGSYGGEDSTNDISRGESCGQRGFAGSSWLTRP

SEQ ID NO: 34142 - protein, 94 aa, A.fumigatus
TGVWAGTVGTRRLLKFFDKYGIKATWFIPGHSLESFPEDMAAVRDAGHEIGLHGYSHENPKDMTIEQQRDVLDKTYRMLTEFCGKPPRGSVAPW

SEQ ID NO: 34143 - protein, 142 aa, A.fumigatus
LNPIVIFATGILSIPSVMYDLGAFPGAVNLVGWCVLNAYGAIVLGNFRNSYPGCHSIVDMVHLAGGRWGPLMREIVGVMFIIAYVIVASSGIIGVSAAFNALSRHAMCTVYWSLVSTAIVALFASVRKFAHVVFATRWKIRV

SEQ ID NO: 34144 - protein, 108 aa, A.fumigatus
KAKHKPQEGTAHTISFKSLSLFSPSPPPPFSPPAPHPPAVPPIQPSTRRSPPAQPHTSAATPALSGRGAQISPSPVPPGYEPIDPDAAAAGRETPTLGRPGQAGHLTK

SEQ ID NO: 34145 - protein, 138 aa, A.fumigatus
QNSDDRFPDLFRPTPSQSVPENLTTQNLASIVLSYASAFPETASRLTSLNDLPVPDAQASASLVQLQPRLDQLARTQEEQAREISELRVRTARVLQRWYEVGLVGSGECWAEWEGRLEDVEREVKREEVVRERRAREI

SEQ ID NO: 34146 - protein, 79 aa, A.fumigatus
ATPVRAGRFSNVLAEFKEYQKRSGWIIAFIGASNVFYQNAREYTTTQFGTERVLNLITNDVLNERAGKRIIVQSKNCSI

SEQ ID NO: 34147 - protein, 156 aa, A.fumigatus
YSHIGQYPCHREYSSLCFTSLACSKARRQKMLGTRGEQVVDLRDGVGTTGNSLLAALALPDTNSLALDGVLSAEGADVAGVLGDFHLLHLLTQGGTVSVMNKPCQPTILALPNSIFHALNSGFNGVERIADDFRSIVRGARAKSIPGTIFTRDTDL

SEQ ID NO: 34148 - protein, 92 aa, A.fumigatus
CHIVKLFEFSVHSILPSRFDSPRITTDMESEKEFDLVLVGPTGYTGRLCAEHIVKNLPTNLKWALAGRSVQKIEVIAKELKTLNPDRAAPGK

SEQ ID NO: 34149 - protein, 62 aa, A.fumigatus
LNFAKSRTLSEPTHNQSLKKAAGSISSYRTVSIFDLNSRTRDKMTKRTKSECIRSRLTTEKR

SEQ ID NO: 34150 - protein, 66 aa, A.fumigatus
NGWLTWLVHYRYGASLRKQVKKMEITQHARYVCTFCGKNTVKRQAVGIWECKGCKKTVAGGAYTVS

SEQ ID NO: 34151 - protein, 112 aa, A.fumigatus
ANNSHRTTAETRKFIDEFIKAVPRSRNAQLARLDLIDWSFKSGSLKSHELITACQEYFDRNKTKLYCFVDLRKYLSDLDKASLTEFIQYASRTAGIQGDVCPTMIALYVLYY

SEQ ID NO: 34152 - protein, 130 aa, A.fumigatus
SNLGIIATLTPQSYLTPNNIADPGMIEQFGADWGLNARGIYYRHFYSPGWVTSDHELWLPSLDGIDWNHFSESSRLSRAEAFLKHVLNNERWKKSEYAWEADAWSDVFGQMKNDPVLAVSVSPHCCSLSN

SEQ ID NO: 34153 - protein, 422 aa, A.fumigatus
YSSIIVPLSTKSKMPRSQAFHAGRQPLQDQRVPLGSAHISGPLAFCNPTRAHFPLSTHSQLHQEPVEKPRIERLWRSRDNRKGRHALTIHQRPPGLAGKTYPRKTIHPIAIANGILRMFTTFPYWDISFWVALVFTVGSGIWVINAFFVWLPLEDPSTEFANEVLTGGGVTAFIGATVFEFGSILLVLEAVNENQTGCFGWAVETAAKEATDAAEEAVVRIKSDRDLCRHHHANRRSFLSPSEARQDSNEQTGIARRRSFAWLPTLNELRSHYRHEIGFWASAVQLVGATIFWIAGFTGLPGIMNHTSPAVTNGVFWVPQIVGGACFILSGLLFAIETQPKWYIPAMHILGWHIGFWNFIGGIGFTLCGALGPATANSGVEYQSTLATFWGSWAFLWGSVIQWYESLEKHPVEEKHPVEEKQ

SEQ ID NO: 34154 - protein, 172 aa, A.fumigatus
TLARIFAVVVKTLLPRLHLHAAAPQPRPQPPLCARHRRRLRQPPVPLRRRRTRPPARGVEGPPPPSVSVHCRPPSPALHRRRIPAPALPHLQERHLPALPHLGAVDDRHRDGGAFPAAALGRMQDLSRGVLAACAELGELSAYGAGGYVDLLVVVWIFMARDPWLWITLMMV

SEQ ID NO: 34155 - protein, 158 aa, A.fumigatus
RLYCLACISMRRLLNRVHNLLYARDTGVAFDNHQFPSVVAELAHQLEEWKDLLPPPFQFTVDPRPLPCTAAAFLRQRYLTCKSVIYRPYLTWALSMTATATVEHFPPQLLEGCKICLEACWLHAQNLGSYPHTVLVDTWICSLSYGSLWPGTLGFGSR

SEQ ID NO: 34156 - protein, 360 aa, A.fumigatus
  UNSURE (40),(290),(335),(344),(345),(359): Identity of amino acid sequences at the above locations are unknown.
LETIKIYAVRMKEISQDIYNCHPCSQSRYQRRQAFTMRLXCLLFMAIVGTFSSHAIHHQPSQDTLRFGTPESVGLLSAPLRQLVANITGYQQPANYGGFSHNEMHPIEPSSAVIVGHDRTIVSLFASGNMLLYADANGTELPRGQQLSARPDTIYDLASLTKLFTTIAALREIDTGRLALDQTVASYMPSFAANGKENITILMLLTHTSGFAPDPEPPLYDPVYTTVEQRTAAILNQSLLHAPGSTYLYSDLNFMSLGLLLEHITHKALDELIREYTDPLGMHDTFFNRXNIEGPAFPFYPRMAAEEYQIEVLGSMEAARPQPVRGTVHDENALXSGWGGRTRXXLLERRRYSQSLPKXS

SEQ ID NO: 34157 - protein, 156 aa, A.fumigatus
  UNSURE (17),(32): Identity of amino acid sequences at the above locations are unknown.
KAPGALLESRTENIEGXGFQIAQPWSGYAVHXTTLSRPAFWGNLLLLFLCHKATILWEGNSHALAMQALGVWMFISKFIKLLGHYIRYPVDVLLLPVSILFGYFHGGIKMYAVLTLNVVSIPFSQSLLACTKHGVDSSLLCPEIQMLRNFFFFYVS

SEQ ID NO: 34158 - protein, 307 aa, A.fumigatus
  UNSURE (43): Identity of amino acid sequences at the above locations are unknown.
CRQTTIAGVKTIVDSREAILEKCRCQEKARYLTLSFVRIVNSXSALHKTDFSFCVDGEYQVLLDTRPIRTPTKDILSIPSTKPHLAHAIALEWDVMTSARQALKNHLIPLTSLTARAGDIAQEDARGETTTRDQIVKLAMRYLDTDTLLCWVPERRPYAGEESGENGERPESLREAQMRVAKDIIAFLGTKVWPGVDIVPILDADSILPVSQPQATKDIIKQWVSSLQPHDLAALERGIVASKSLLVAVRLVVEWSENFRHLQRSGQKKFGIEEAAEASSLEVRWQTDMWGEVEDTHDVDKEDLRRT

SEQ ID NO: 34159 - protein, 164 aa, A.fumigatus
VSFSSLASPQRLMDQHAHLESSTARVWGAAYHIPASHAEEVHDYLDEREIDGYTVHYTPFHPISAVATSTVSRAPETETVPETQSLSPAHAAPITCMVYIGQPSNPQFLRDPARREPQDVAEVISHGRGQSGKNTEYLYLLEKALEGLGLGSADMHVTDLVRRV

SEQ ID NO: 34160 - protein, 254 aa, A.fumigatus
VLTTFRSASQGHNQPRQGSSNNLYSSTFSWNSPDISHTDQRRGVGRKAMATSGADDPGPPPTSSSSSKQLQLNPNQIDYFHQNPNASWSSSPKIAPMDSSGTFSHDFSEQEASPASATFRPSTGRTFASEPVDFDYNRDDRRPSVASATTISSQGSKSSTGGRFRKKLQGFFGDEYLPPGESKQEQEQDTRSLSSRPASIDHFKARERANSDGARNFPERSQDDTSSLHPSRPRTPLPSSEITPWLYQSFNVSS

SEQ ID NO: 34161 - protein, 473 aa, A.fumigatus
DIPQFGEAPIREVPIAPEGSRLAGQTATNSGAPREARRHHGSHRHSRSKEEKPTVAGDLAGYPARPATGRDDSYLGLRPFRDHSLNASTAMSSTTTLGGRSTSPTPSIQSAYSREQSQNSPGAPSNKRSILDKIRRTKAHGPLKHFPGSKSAQEASKSSSKLARREASPRRGRQGSLEGGTSLRNLDLGDYERRKDGKGIVMGSTKLRNRRGLGNEAPPGKDVKLSEEPGVWRLDTDLSHMEGIVSQQPPPSPGDKSKAQDGVPPKHEEGKKSEGLPPGHWDAPESWQVKKHGEDLAARLPNVASDATGIAREPDGTSYFIRVFRIDSTFATLSAGLNATVADILLMLGRKSFLQDHLNNYEIVMKRNDLSRQLDHSERPILMQKRLLEQVGYTAKDRIEEIGREDHSYICRFIFLPTKLSGYSSLDGDPGFSRMQKFSHVDLQGRSLVTIPITLYKKASEIISLNLSRNLVP

SEQ ID NO: 34162 - protein, 117 aa, A.fumigatus
VHDPIAHIRSRLHMSSLSVFGNFGVSYFVTIIRTFRNLEKLLFEKSPSPLKEVALLVRLLRTQVRQEKLGGTMAATVIHEARKKSRLSRVILLVIQLVQLQDVMILISDYAPSETIA

SEQ ID NO: 34163 - protein, 308 aa, A.fumigatus
  UNSURE (48),(52): Identity of amino acid sequences at the above locations are unknown.
AVPSSTDLIILLLGFLAAVASGVPFPIMSIVFGQLVNGLNSATCDVDXSTAXSYQAGINSKILLIVYVGIAYFALIYIHTLCWNIFSERLAQRIRERYFSAILRQDTMFFDNRPAGEVSARITDEIAVLQQGTNEKVGIVISSVSFFVAAYVVAFIKDPKLAGMLVSLTPAYLTMALGGGYLVQKYVGRSIEAMAMASSAALEAISNPLVVHAFSANARLEQRFVEVLAPALSAGVWKSVAVALQAGLLYFIAFSANGLAFWQGSRQIASAVESNISGITVGDTFTVILILIDGTLISLAQILNGSVY

SEQ ID NO: 34164 - protein, 177 aa, A.fumigatus
MGVYTKPTAAASLVLSQAAPFLRSFDAASVAFAKLEADMNRPAVIDGTVEGTGGLLSDVAGEVELRNVDFAFPSRPDKPVLQGLSFVCPAGRQTAIVGLSGSGKSTVAGLIARFYDPVEGTVLLDGRDLRELNVRSVRNHISLVQQEPYLLNRSILENIALGLINSPKHEHLRPALM

SEQ ID NO: 34165 - protein, 92 aa, A.fumigatus
CFYLRRGFRSGSHDGGHLFPLDTWFLYLGSFSTLGVSEDQIRGCKNASTDARVSTPYSPTTPVAKVYTPFLRKIIVTAEHVSTSPGVSFQNG

SEQ ID NO: 34166 - protein, 286 aa, A.fumigatus
SKYLGHCTGRRNRLVAGPFRSCKRSQTGPESCEDGIGLLTSTSYIVDGNALFLTATEAAWRRAAASHFAGGGIIVAIGYPLKGKLYDARRRSFDLTPPTACAPVGYGGADVFLDFIENSVRPAVQARFPQVSLAREALYGHSYGGLLALHALFTRPQSFDCYIASSPSIWWNSLCILHEAKAFVETKKVSHDQSPSLMVSWGSWEQHPPRWADELLDHYEARKRTAAELRMADNALDLCAMLHGCSRLHALIKTEYEGEDHTSVMSCSVSRGLTMFFEEWPFHQSG

SEQ ID NO: 34167 - protein, 385 aa, A.fumigatus
DLTNNNAPSSSRMRPRLSPFDFDIQSETFPSLCLRLLPPPPSLFSTNPFPSPSSFPLKPPGVEHLDIVRQAIRAKIDQWQSDQLSTQSANNSPGRPPLGLDANMISRSAQQHEDMSLRHLELAFKHWASLPPETRLEAWHLEITRAFAREVEKRKTLDEQLARVQQEANQLRAQVEKLGSCQWPREFALFPPDTLPLPPAVARELDAKESQISPGSPRWDYDSVVAKWKRVVMHDKSMGRVGVGYGNPPLDDRSSADTKARATEEPPASAALASTSTSAPPSAHPPPRALQPAPGPALAASPDQSSSHTGGASAPSSQNTSPYLRSPQAGPQAKRPRLMNGADGGHTSAANPSATAPNTWNPHSHQSLPGSNLASASGPPPSSGA

SEQ ID NO: 34168 - protein, 151 aa, A.fumigatus
AACSVFDVPASLSRKGAGVGLAGLTRWGRELGHLPADAADGDVMGEDAEEALEEVVEGGEPVHPGLPEVGECDVGDDDAAEGDDEGEEAGDEEGGEELVGGEGGDELAEADVVKLEDHEQHPGVAGAEGVAGEPYAPVPSCVSGGRQLDLG

SEQ ID NO: 34169 - protein, 165 aa, A.fumigatus
LSPTTNTTRYWGVWFPRDSFSSGYTWMLLMVFELYYVSFGQFIAAFSPNELFASLLVPCFFTFVVAFCGVVVPYVALPHFWQSWMYWLTPFHYLLEGFLGVLTHNIPVRCVSREVTQFSPPSGQTCQTYAGAFARQAGGYVEDAAGGLCSYCPYSIGDAFVRFSL

SEQ ID NO: 34170 - protein, 187 aa, A.fumigatus
MNSQSGPGSSRNLGRQMGIDDETRNPSAGVPEAAGNGTSDSSRSNHPKERERGGKKQKRARVDEDADEDVDVMQAEIQLMQAQQDRASAEISRSSKRKRLDLAIPGAEQEVADVMPVALETEDISEEVQRRLKIKEERRKKRDAKAEKRKRDSLASNGSASASSPGGVARPRKKKVKTSGAGEGGKR

SEQ ID NO: 34171 - protein, 60 aa, A.fumigatus
CHFPLPQALQQKDSVFRRQFPSASLDFGWNRDQTDYSSKRPIRTKEKLPGRAKNDSRAFS

SEQ ID NO: 34172 - protein, 191 aa, A.fumigatus
SYEEAAADATPPYWETTILAPGISSDEVYVDGLPVGSIFSFVWNAMISMSFQLVGFLLTYLLHTTHAAKNGSRAGLGLTLVQYGFYMKGGSDGGSDGGADYVPPPDPNSHNFDPTSVSENSGGNSGSGAISDITTSEWISYVLMIVGWFILIRAISDFLRARRHEQLVLQSPERGLSVPVIAEGERSETVV

SEQ ID NO: 34173 - protein, 464 aa, A.fumigatus
  UNSURE (33),(318): Identity of amino acid sequences at the above locations are unknown.
ELAPRQSFKPTASEDDGTVLTRTDVFLSPLKPXTKSSISAEAINAFLYYLHVATPEDELLLQEAEEEREQQAKLRKEQWGDGAPPEFARLNNVRRKPVPGSPLPETPLQQENYSPCSTAVDPLPPPTPPRPTLRQDFPSSESATAVSDISDHLGDSRGNTGETRAPPLPPRPLPFVPTEGAPSDPINNSSAKKSNRWSALSGYLNSKGLDSWKEKYEALSAGRLSLDSRGSELRPHTSDGAGSNARRASPSRSPGQSPHRRPRDHGQASDRQGFHITLIRRDPTHGIQWNVATISTSKADSTAVDIEVSTPGYNRFLXQDEPFSLQSLGINLPSDAQALPSSTLKFPTQSHPETRTPDSSLPRKFRRQLCVSRPYNHWDDSRGSLDLPTSRSSLDTFTGSPTRPHTQAHSKLKSGYYTFPSPWNGICTFSTSVNGRNLKCKHIDPTPSYPGHGNERFHPCKASR

SEQ ID NO: 34174 - protein, 237 aa, A.fumigatus
RVVTLRQPFKDPRNCSFAMKTLRIVRSTISILAVLSQLQLSDATPLEVEEVSLKEAGLEKRCANPCGYYSQLCCTSSQTCGTNSQGQAVCLDSSGGSGGGGTWEYYTTTYVLTETDTKTITSTWSSLIPTATGSTSCRTDLGETACGNTCCGAAFVCANDQCIVGSSSIWVTATATPPVRGTTQSTMTQIATATTTQGFIPPVGTDGATLIGIHACGGGLSGGANCGIVIGVICGVF

SEQ ID NO: 34175 - protein, 75 aa, A.fumigatus
SRFHEVFENERNVKKFCVMIELNKVSMREKNGRMRSDPAARGDLTVETQHNSQPPLIQNPTTGFSDSNYQSLQHT

SEQ ID NO: 34176 - protein, 455 aa, A.fumigatus
LLPLVDFVRAPAGPNMHAAELAYLLGGISIALNLVASVLHGLCLASSGASSIESITVTLSAASCLVLLMLVVLWRKSIWLQPRDCWAKWRTVAYGLILAYLAISSGFTAGAVVWSTSKLEVRGKEMGIPPSQLGLYISRSVVWTLAVLSQGLFAGFLLIDNPHNQCPSSLSQELVLQADQSSLKHKSATKEPALTIESGRQSVDRKTSCDSGPFANQPATSIASSHRYSGRTLYQPDSKNNSVDLQPPGLSMPSPDSNASRNLLETSPDERDSCSITTEERQGMRLFHGTQPEIKRCLDSLMLQPSSGTSSPAASTPKLEASRAPAPPKLHFPDESNIHPLFRSDSPSPPPTPLPGTNLHGLAVAGQTISVKTLNRMRSTNSLRPHGARSRSPLFERINQQGETTGDQKLNPCCENRGRLAEKTAIPGFLMAADVRQSIARYEKKYELNESPDES

SEQ ID NO: 34177 - protein, 61 aa, A.fumigatus
YRERTWVTLLFSSTILLPLKTPLHYSDPLSRLRQNNCAFNSTLVLLASRTCIHLLLIVAAG

SEQ ID NO: 34178 - protein, 78 aa, A.fumigatus
KKFSGPPLVSPIDYPQVPKGKSRVRVMIHAGNTEEQVDYLVATLCDFANEMIDIEEGGEKGKIPKAAQEIYALMAAHA

SEQ ID NO: 34179 - protein, 137 aa, A.fumigatus
SHGERRTELHLVVDRVDRPLPAWRDAAPHPGGRRPQPGRAADRQQLNRLRVQSVGVWLVRPVHLRLRAAGVPRLALRQRPAPPRRTLRARVRQRRLRHGHLLLALQPVHSAAEQDRSPRPGQGRLFQDPHGHRPGRG

SEQ ID NO: 34180 - protein, 159 aa, A.fumigatus
HRRLRPEPVLRVPQLHRGLLAQPRAGCRRRRRGRPEHPAAPAHPARPPRRRDLRRRLVGRRALQLAEWLRPRRHLRAKPEQLGNRQRHRLPRRARREHLCQPRPEHPAHLLRLRSGEPVRAGALGGIPAKRAVQHAQQYLHLPAGVLGFRARRDYHKWV

SEQ ID NO: 34181 - protein, 703 aa, A.fumigatus
ALNDWQLFWKIHGLSTACLRFVEKGSILRWVDEGSRLFRKYVLSPRTSVYLLRPSELSAHLASHFWKTSNGTDMKALLSLLTAVAVATATPLDLSLRALPNAPDGYTPAKVSCPATRPSIRGAGSLSPNETSWLEIRRKNTVEPMTDLLGRLNLGFDAAGYIDRVSSNASNLPNIAIAVSGGGYRALTNGAGAIKAFDSRTQGSTQSGHLGGLLQSATYVSGLSGGGWLVGSVYLNNFTTIADLQSGDHGNVWQFSTSILEGPKAKHLQFLSTADYWKDLLKAVDGKSDAGFNTSLTDYWGRALSYQFINDRTGNGGLSYTWSSIALTDPFRRGEMPLPILVADGRNPGELLIGSNSTVYEFNPWEFGSFDPSIFGFAPLEYLGSRFDNGQLPRGEPCVRGFDNAGFVMGTSSSLFNQFILRLNKTDLPDLAKDVFSKILTAIGRDGDDIAVYGPNPFYGYRNSTAAYSRSRELDVVDGGEDGQNIPLHPLIQPVRHVDVIFAVDSSADGPYSWPNGSALVATYERSLNSSGIGNGTVFPAVPDVNTFVNLGLNTRPTFFGCDPANLSAPAPLVVYLPNAPYSTHSNTSTFQLAYSDSERDEIITNGYNVVTRGNATVDKSWPSCVGCAILQRSMYRTNTSMPAVCNSCFKEYCWNGTVDSKTPRTYEPTLLLGSTSTNAAYTQGVTWLVGILAVGVAMGMTA

SEQ ID NO: 34182 - protein, 239 aa, A.fumigatus
  UNSURE (19): Identity of amino acid sequences at the above locations are unknown.
PLELAGFYAAQLPGERRLXALIGRGFLGDSERGHTDPRLWRWLFIIEASITVGISLFSAISLPNYPATTSWLEETNQAYAQWRLITDAGEADDTNAVRIKDALVMVSRDRRIYLFILLQHCSLLSQTFKYFFPTIVKTLGYGSIETLLITAPVWVATFLVSLLVTWTSGRTNDRSWHIVGLMSVSAVGCIICTATTNIGARFFAMFLYAASPSDPLREILTPVGCPWALCQPTKSSSPG

SEQ ID NO: 34183 - protein, 60 aa, A.fumigatus
TTSRPLRTSNPGIMGTSGSFPRLSWKGPRPNTCSSYPPPTTGRICSKRSTGRATRASTPR

SEQ ID NO: 34184 - protein, 82 aa, A.fumigatus
  UNSURE (80): Identity of amino acid sequences at the above locations are unknown.
VSGMYRCISENIYVLMIRTNCLVSPKLFRTPISTECIQNWVYNYLSKRGLAAGGSLGLRCSEHVTLRSSPRGWKGQSSKXNR

SEQ ID NO: 34185 - protein, 275 aa, A.fumigatus
AGNLPARVFPKGAFKVGIPQTPGPRPWGNEPGLRSQGAEPTPEPEVDQVEPPSVEKQKAVAPPPGLTTSYKVDKEDTTSSADSASTIRPQTGRAASSSGIITAEEHVAKGIECHEKGSLKESTYHLRIAAKQNHPTGMLLYALACRHGWGMRPNQREGVQWLRKAVDCVGLELMDDSNGTIPQRAKEMQKAYRAQFALSIYELGVSHLNGWGIEQDKSLALRCFEIAGQWGDADALAEAGFCYAEGIGCKKDMKKAAKFYRQAEAKGISMVGNSW

SEQ ID NO: 34186 - protein, 69 aa, A.fumigatus
CLSLCSLLSFCLSLLFLVPFLSFFFPPTSSTISSILLFIIEVRAVFLSAASVDSGAGAARSANDHLAAL

SEQ ID NO: 34187 - protein, 63 aa, A.fumigatus
YTLVSRTAISLHWRSEGQIAKLPPSSGNPRAPKNLIANDVLLHLPLNSSLHKLLTHYCHINIE

SEQ ID NO: 34188 - protein, 78 aa, A.fumigatus
LMSALITRDIEMDMASFFNPFSFGYHFKYYQKINFFVAGLLRAMQLGDNPGRSVKEPEKTQPFLVGSTGGPSNKGSGG

SEQ ID NO: 34189 - protein, 63 aa, A.fumigatus
DIVEVAMHISTQQYAVLNQVKGRGLRSCSNQVAEISIEECFLLYENDMCFLERSPSAFADTTA

SEQ ID NO: 34190 - protein, 110 aa, A.fumigatus
RSESNLSWFSEILQLLTPTLFSPEVEFCGYTIPHPSEAKMNLRIQTYGMYFCHTLARFDGADRNIADSTTAVEALEKGLEALMDLCDVVTDKFTSARDAFNAAQADKMTS

SEQ ID NO: 34191 - protein, 61 aa, A.fumigatus
YYHRSGPLRLRIRRNLAGVTGGEKAVKQLLGPTIRALETALAKYNMAYTEEIQRLQSLENR

SEQ ID NO: 34192 - protein, 178 aa, A.fumigatus
NKIGETMLTSGLTNAPITKLLLIYTIASSIALSILDIKHLASIHVSPHLWPYAQFWRLATWQLAGFTNSTEGLFAAMLAYHLRVVERAWGKRKFAVRPSPSTFSLLSSMSRFARNTDEKGKDIYHLHATIYLPPPAAPPRPPPSIDPLQTELSPLRTDRHAVCIAGAVSCGDPAYVSV

SEQ ID NO: 34193 - protein, 212 aa, A.fumigatus
  UNSURE (7): Identity of amino acid sequences at the above locations are unknown.
PSAAFTXLSVGVTQTANDELDRQLLRIDGIFPFIAGEISEEARLGSLTHWAYSNRNATKTATNERPRREVASNKQDLNHALENEAGSRTDARRDAARKQRRTHADSDFDDARASGSRKGQASKPRSGAGAATGDLSAVGHGAQTSGASGASGATKRRKVERPPAADAGAAMERSASGAGNASGRGASKDTTASDATKKRSRAPNTNAAARKR

SEQ ID NO: 34194 - protein, 337 aa, A.fumigatus
PTGRNNTGTSAANSPVLAPTPLAGASGAVRSAASPGPGAAARPQSSRAQQSSGQPTNGRQRPSSSASNRLTSNSMSPLHFLFVFLLLTLILIQAKSLIPRLYLKKLRKRIWLQLHLTQNCNAKPREENSGTATAKAVGPVSMKREDTETRPAESVESRETPVPQASNAAPKGRSSKTSTPVLSTLSEPNSQRTRPTRNTDSAPAKRSHKKSGSVAVSQQRAVSEEEDSLHEGDDEDEDGEPRYCYCNEISFGEMVACDNDACPREWFHLSCVGLTKPPGKNGKFHWSNESDHADRAQSNGTAMNARRICEEIGTRGNQSELGVSYAQAQFCWLGWSL

SEQ ID NO: 34195 - protein, 345 aa, A.fumigatus
  UNSURE (297): Identity of amino acid sequences at the above locations are unknown.
RSLTNTTIMTIKNLRLGLAIGHGTGRELIAVFKKVIHALASKHSLHVDFIESSRIYHSYHTLTVSGEEKDLIKHIADETTQDADEYRTFCETAAANGIAAIFRTAIHAQSLYLVRDQLKAVKIEHFSLGDSNALLFIRDEAQGFYAGVNEYDNGNHSITRSSPFSRSTFDQILAYALERAAEEWGVENVPESVTLVYKFHLFDGVFQAWAPHWRSRFGIDVDFIQPDTMNRNLMAWGIQGRRIIIAGNEYADIIQPVFLKWFGNSTIETMCAENVYLSPNLHRLSEYQTCMGRGRHXRPRARQSVCDHPCRGCHPRTAWRMLRRWIPAPNGKGDSKSPPEETDHT

SEQ ID NO: 34196 - protein, 300 aa, A.fumigatus
  UNSURE (20): Identity of amino acid sequences at the above locations are unknown.
VRTCIASASTRRAWVADAIXGQGLVNPFATIRAAAAILERHGGCSGAGFRHQTEKAIQSLLRRRLTTPDQGGSCSTDAVVEHFLRAITDLTDATTPDVHSDTAEAGLISNAWIGKKSAVVIVDYQNDFIASTPTPAVSELSRTIPRLIRCARKEGREVIFVRFLGNTSFQGPSWQHRDALLGKSEKCVEGTWGAELGPGITPAPGERIFDKKALFDPFLVPEFAEYIAQQGLEHLVLAGLYSDVCIDATARTAFQKGLWVTVVEDCTAALHANQVDHLRFMEKVYGARVGTVAILFGVKA

SEQ ID NO: 34197 - protein, 221 aa, A.fumigatus
VLSPQLNKDKYQHHCPKMIDSSTAGIEELHALRPKTIHQPLHNAIPPELVPRFDPVYVEYYNKYNAGRLHTHEVPIEDFRRNPAKYTIAYGRAAGPDVFRITEQKCPVKDGEITVRIFEPAPVSDDQGNPKKRAAYVNFHGGGWVFGDLSVDHDFCKRLVHGLDGHLVAFDVNYRLAPEYKYPIPVEDCWAAFNWVSDLVINSFTVQLSKSETKGLTVGSD

SEQ ID NO: 34198 - protein, 114 aa, A.fumigatus
QSVQIRLKKADEFNIDPDRMAIGGVSAGGQLSAVLAHLCRDGNIPLRLQLLTVPACDLHSVFTSDGQFDRENCPYESYREMEFTPALPAARMAYFHRHFLGNPRPPRSEEVGIR

SEQ ID NO: 34199 - protein, 85 aa, A.fumigatus
DWKISPMLAPNFENLAPALVHTAEMDPLRDEGEVYAAKLKDAGVRVELIRAVGAPHIFPLLDGILESGRVYNEKVIATLRKELLV

SEQ ID NO: 34200 - protein, 129 aa, A.fumigatus
SEDTVYLQDSKICYGTSECSFIHDASVIPFPGQLKKKDHSLSDSNVYHTLPTKIPESNGFCTDCPAVLCLWNTGPGVFGREARKTGWDSSVGETKGQKSGWTETGRSSVLFVSFYSSSSSARALCFLFF

SEQ ID NO: 34201 - protein, 221 aa, A.fumigatus
HTHCAVPSGPVVKMFLRSFVPFSRACASLVCSRPGWQSSPLTDQNRSLDRMTRIAAGTENVDYDSWVPSKIHLNIPLMWNILQFTCSDDSYPAVPSGSLLHSSLSASATRNDAEESSTLEIIVTTSPEVTVNTADGGQGVPMPLYRAPNSSKDSNTSPATAPRSMPPPDAVVAPIDSLMLNTPWLWADPAPFGDVDDLDYSTSAPAIGDIEGSAWWNLGNL

SEQ ID NO: 34202 - protein, 237 aa, A.fumigatus
GAEAEAWVCVCVGHRGAARESSRMREDVSASERGNRARGVAYPQRRAGARSPSHAAAHRTHTTRRRALLRDDAGHRDPKDRKSRHRRRHLRRRHRHGYRSLLRRVLGRGGRRHGRRVHPPPAPRAPVRQNHPRPSAGGPRDQPPPQWPQRHVPHPPPPGPRPLLPRARRRLRHWLLWPPPDARRGGLPRPHPEPRRREDHAVQAEGSTARIISPPPLGAYHYIKLPPPLGPNTLSPP

SEQ ID NO: 34203 - protein, 323 aa, A.fumigatus
PRESRASLVLSANMAPSPHIVIIGAGIVGANLADELVSRGWSNITVVEQGPLQMPGGSTSHAPGLVFQTNPSKTMTRFAQYTVEKLRSLEKDGQNCFNQVGGLEIATTPERLEELKRKHGYASAWGIEARLVSPAECVKMYPLLNEEIVLGGLHIPSDGLALAARATQLLIERTRHAGVRYLEMTPVTGIQKTGNRVTGVVTSAGVIGTDIVVSCAGFWGVEVGAMAGVSIPLLPLAHQYAKTTPVPALAGREINHRPNGLNATFPILRHQDHDLYYREHGDAYGIGYYGHRPMPVEAASLGRTPSHVDEKTMPSRLKGPPPE

SEQ ID NO: 34204 - protein, 456 aa, A.fumigatus
SIMQHSKGPEFPELARTLSRSRSTSMSSDSQLSRIHLLSPPPVNPPPSFIASSAAAQIITTDQEFNTADFVTSEEDNGANASALVTPEALSALNGFLDHLLYNILATAKSTQLACIRPAIADVLKPRLAKEVVSAADDELHEYMGGEEDEQSEFRGGQTSANDFDLVRSWKLTRLRCMVYTRLGDMEEDDEDEYIAQDRLIDSDDGIPPRFDSHVGNITPAAAIFLTSIIEHIGEQALIIAGETARSRLSLKLSDNHDEVTESGAERGRMDRLVVEELDMEKLALNPTLGRLWRTWRRRVRTGSLSRTVSRESFQRRRLTAPSAGSRKSSIVTVDECPPCLRVSPDVEHSKELDPASVALPMSEHDVEEIEIPGYVAEDGSEVHEIHEIRTMQAVVAHKVRPHSLMVLTLASPKSPSTGNSPVTPLSAQGPRVVRHARSRSLPSSPYPEDDTPNER

SEQ ID NO: 34205 - protein, 61 aa, A.fumigatus
  UNSURE (5): Identity of amino acid sequences at the above locations are unknown.
YHTFXSLLEKKLLFAVLFAYPSCVRNHKNTKPPNKQAVHKATFSVYKAGEILILSGSSRMI

SEQ ID NO: 34206 - protein, 248 aa, A.fumigatus
RLAQAIDEICEATASQNSRLWIDAEQQVFQPAIDAWTIDLMRRFNRNGQIVVYNTIQAYLKSTSENVHRHLCLAQKQGWTLGIKLVRGAYIAHDIRSRIHDTKADTDNSYDHIVESLLSRKFPLKVAADNAAAFPDVRLFVASHNAESVRKASALYRQRINNGQPTIPLEIGQLQGMADEVSCELLAGNSTGQSEMPTPGVFKCLAWGTTEECLHFLLRRAIENKSALERTKDTAVAMRREAWRRLWW

SEQ ID NO: 34207 - protein, 146 aa, A.fumigatus
RGRRSIRASNGYGIQERLPTDTTNALDLLSSICGSRMLQPSVFQNSWDNVHDCTKGVDDTTTLMQGFRIARRLHNQRHTATTLCREHLVESRWGRRCLGPATAVPHVGVGPPDVLQRIIIVLLQMCCDTTAAERRSLVTGALGTII

SEQ ID NO: 34208 - protein, 64 aa, A.fumigatus
TSIARADFARSSLDIISQSMSPGPVTTSWGTMSGATKPSSFSLSSRLSLNAAGPSLYIPRYLST

SEQ ID NO: 34209 - protein, 130 aa, A.fumigatus
RLSLFRGGLSSISFQVVGAGVPTSSMLMTGTDHHLTGLGQLPEYIALSGAHQGAPGHEGYLNERVVALPELLRDGGYYTLMSGKWHLGLKREYSPHARGFAKSYAMLSGAANHYGKSVQVVYLHSGSEGC

SEQ ID NO: 34210 - protein, 497 aa, A.fumigatus
SGSTRRMPGGLRSRTLCFPVRRIIMVSLCKLFIFILDLKVANETQGYEPLYDDAVTDVHPFFQTTVTALHMEDAEYSTKLPEDFYSSQTYASKVIEFLSERPKSENGKPFFAYLPFTAPHWPLQAPKSYVDKYRGMYNEGPAALRLKRLERLKELGLVAPDIVPHDVVTGPGDIDWEMMSNEERAKSARAMEVYAAMVEVMDENIGRVLDYLRQSGEYDDTIICFMSDNGAEGASYEASPLGGSGITAHLEKYYDNSLENIGRPNSYVWYGSRWAQAATAPSRLYKMFSTEGGCRVPLVVKPAGNPEALHEGGRVIDAFCTVMDIVPTILEYAGLQHPGTTYRGQKIERVRGVSWKPFLDAITVASTDTSPAPSSIHGEEHVTGWEIAGSGALRKGRYKITYVPLPRGPQRWELFDIVEDPGETRDLSKEKPEIFNELLRLWAIYAEEVGVVGLAGQISANNQVVEGVKDEFEDTGRWIRFIGKDNVPPEIQARLPK

SEQ ID NO: 34211 - protein, 63 aa, A.fumigatus
  UNSURE (24),(35),(41): Identity of amino acid sequences at the above locations are unknown.
NRSQNAFGDPLGCVIRSLTDYVYXIGKVIKPLTAXTTEHEXSILPPNIWNIQVSTRGIPINFV

SEQ ID NO: 34212 - protein, 86 aa, A.fumigatus
SKEARMQMAISAYKNQKIKSKSKAAEIFGVPKSTLCKRLSGVKLCIETRANSHRMIVMEEKSLIKHLLDADKRGFLIQPEFLRGIA

SEQ ID NO: 34213 - protein, 84 aa, A.fumigatus
ASGSRNRADHQTRFDFYFKSCSAQPATMPPKACINSKNSVEQEGRVLLAVSALKNKEILNIREAARVYNVPYTTLQRRLKGHTF

SEQ ID NO: 34214 - protein, 343 aa, A.fumigatus
QRERVQPKMGRLDIDYQKLYEAFFRFQTKPELTRYGEVYYEGKEYETNLRHLRPGELSAELKEALNMPPGAPPPWLINQQRYGPPPSYPALKIPGLNAPPPPGAMWGYHPGGYGKPPVDEHNRPLYGGDIFGVLQPQQTVQQGEPVERDLWGELQESEPSDDESEENEDEPEDDVDTETGVQTPSGLETPGGIVSSVPSEFIGAENVTGEFDVRKSYRGTQTEEHVGRRSAFQIIPEKQAHVQGFFGADRVYDLKAPPEGLPVLGAEDPNRKRKKPGDVDVSVDPDALQASDGMSKENLRSLYESHKHQETNPNWDFQEDLSDMIAYESRKRLKKEEDRRTKQ

SEQ ID NO: 34215 - protein, 91 aa, A.fumigatus
GSTESYCKASLIKVPDIIFMYTILLDSFAYSFKPLFNNIWILLLCTLIRYVLFISYTQLWMTFNKLIYLVNTKGSSRIMSTRSQQNLCYST

SEQ ID NO: 34216 - protein, 132 aa, A.fumigatus
  UNSURE (93),(132): Identity of amino acid sequences at the above locations are unknown.
RRLHNWPLISQTAQEAVAMLNTPEIVLDQFCVSLRNGFLPDTLPLQKLNDPYYSPWEEVVADLPALLTAGNLRQAVDSLPILSTSKLQKESEXRRAYVVLAFIINAYIWGSEQPKDVCVFLSLYDCSFLMAX

SEQ ID NO: 34217 - protein, 212 aa, A.fumigatus
VLPPAVSCPILEVSKHLELPPCATYAALNLWNFKVSSPDIDLTNPDNLSIITTFTGTKDEEWFFMVSVAIEAKGADLITLMLHAIYAANLADDQRVTSLLYQLSDGLKELGEILERMYEKCNPHVFFYQLRPYLAGSKNMASAGLPQGVFYDQGGYGEWHQYSGGSNAQSSLIQAFDIFLGVEHSATGEAKLSNTSQYKPKIGYIQVRIYSH

SEQ ID NO: 34218 - protein, 126 aa, A.fumigatus
DMRNYMPGPHRRFLEMMIRISNVRQFAMNYNADTEVRNAYNTAVMAVGAFRDKHIQMVSRYIITPSRTKPTRMSSAQVNLATVTAAHQVTRSKDTPAEYSGTGGTDLIPFLKQTRDTTKAAAKYTD

SEQ ID NO: 34219 - protein, 80 aa, A.fumigatus
VSDSLSQSNSFCCDLKSTGATSSSIMSTNGTLSKPEFPANAASKEYAASLDAADPFAGFREKFIIPSKANIASTKLAKPG

SEQ ID NO: 34220 - protein, 156 aa, A.fumigatus
VLVFRAADLTLFSSNVRTEFKPIPGAGGYQISNPSAIDLACLCAALSVFDETSIAELRKKSVLMTAYLEYLLLKDTTEESRQFQIITPSDPAARGAQLSLLLKPGLLHKVAHRLQEAGIICDKREPGVVRVAPVPLYNTFTEIWMFVQQLKAALEG

SEQ ID NO: 34221 - protein, 175 aa, A.fumigatus
IRNTRMGYANLHQYAIESHLAWHHLDPKETMVLIGPDEGTYEIPTEKILSYIDQHADEAALILLPGIQYYTGQLFDIPKITEYAHSRGLIVGWDLAHAYANVPLKLHDWDVDFAAWCTYKYGNAGPGAMAGLFVHEKHGQVDYSEGEDAPKFRHRLTGWYGGDKSVRFKMDNSEF

SEQ ID NO: 34222 - protein, 152 aa, A.fumigatus
  UNSURE (28): Identity of amino acid sequences at the above locations are unknown.
PFIVADEAFSGLSSEPCIYFCGNSLGIXPKATQKYLEAQLDTWSSIGVCGHFTKIEKSPLKEWQNLGEQACQSMSKIVGGGAQKNPNNGYINDESALVARKLFLNPTATKRKILMDWKAFPSDHVSDKFAIPAWVMLTCTSMPSNHILPGII

SEQ ID NO: 34223 - protein, 210 aa, A.fumigatus
LTDSGQLHLATCNGLTPHISLMSYTYLPSTPFDPYPTIIMTTNPSSRKTNHLMTNPRVSLLVHDWVSHRPPTRAPNPSGQRDGSPPPVATRSSLASLLLNLNTSALSSISTTITGTARFLEPGSEEEAWCKERHLENNTFEEELGMFGQQQQAAGQRRPSLSIDNDVRVVTVRVREGRIADWKGGVRDWKLVSESESQADEPLVNGTMTP

SEQ ID NO: 34224 - protein, 382 aa, A.fumigatus
SSHDLTSQEISLIKTEASHRQRDSLNLHNTLADPISLATDSISVPTITHDVFIQTQLHLSSTSSQGQEQTTTIRPTMKLAHLHFPDITSFTRVAHLQQILTNRLLAYKRLSSPATANTGAIQPSGVNSPPPDPTIITFTPNPVYTTGRRDLPPSNTAPFSPSAPLSLPPSLEPIRSILTAPPNGSPRAEYHPTLRGGQTTYHGPGQMVAYTILDLRRLGLTPRCHIRLLENSVIDVLRGYGIQGFVTEDPGVWVRPRPATNTVAAMAVSAGGDGDADGVLPKKITAVGVHLRRNISSYGIGFNVTEEPMWYFRQIVPCGLEGREATSLEGEGVPGVSTGEVADKFVDAFVQRVNADFACGGRATGEKIEGVYNVREEDLLQQ

SEQ ID NO: 34225 - protein, 60 aa, A.fumigatus
RPSTNFSSLYMLFDTYYPIPNDFWVRAYQRYTRVRIVEHLIFSPCLLDFFSFYDWYLILE

SEQ ID NO: 34226 - protein, 64 aa, A.fumigatus
IAISSASFLQEHSVLSAHRNNESTRQATSASASFSMSILSVSRNGVASVVVAGHPFNGHCSTPP

SEQ ID NO: 34227 - protein, 650 aa, A.fumigatus
QYLQQAFCRSIRSCRLTVTMNRLGRLPLPLPPSVCLFCRFRATASLPSSLQATRSMATARLRRRVARMTLSPDVAKPSVVKKTRGDKERFGPFAGMNQTEARIRETPRARSRAAQKRSGEPEEDSQKESPLYKALKMQTALTPIPYGRRAAIKAKIADITSFDQFQLLPVVRNSISSQALPGLVDVTPTPIQRLAIPRLLEEPKTEKKPTKADDDEPRYDQYLLAAETGSGKTLAYLLPVVDAVKREEARDKELEKKEQEEKAREREERLKNRAFDIEPEIPPLSNAGRPRAIILVPTSELVAQVGVKVKALSHTVKYRSGMISSNFTPRRIKNTLFHPDGIDILVATPHLLASIAKTEPYVLSRVSHLVLDEADSLLDRSFAPTTTEIISKAAPSLRKLILCSATIPRSLDNLLRKRYPDIKRLTTPNLHAIPRRVQLGVVDIEKDPYRGNRSLACADVIWSIGKAGDAESEGPYASYVAPKTKKILVFVNEREEADEVAQFLRSKGIDAQSLSRDSDARKQEEILAEFTEAPPPPSPDEILLAQKKRRYEDAIPFEMPEKANQGSSRRLANTKVLVTTDLASRGIDTLAVKTVILYHVPHTTIDFIHRLGRLGRMGKRGRGVVLVGKKDRKDVVKEVREGMFRGQALI

SEQ ID NO: 34228 - protein, 65 aa, A.fumigatus
TTTPRLTVYLYCQTGTRSPTDSQKSHLSFKNDTCAVANPSGAITQSSPVLLEEPGHPFFERIPQL

SEQ ID NO: 34229 - protein, 315 aa, A.fumigatus
SVPQYDPASVYVPQRPLATNRSPQKQPQSNSSPQQPQNRNDRQPGPRPPSPSKDQVSPAKSSLSRASRFGVKGTGFDPESEIWSDLDSVGNRYPKSVTFDAAPPQVNEYEMTTPDPSSIASESRDGSYDSEEDEGDVSFDRESSLDRDDSFDASLEDLEKTPVVLPDDWRYMSPSCANDELVKEDDPFTEDDESHSPGPTTPSQQKLPLQHSRVESLDSNGERRPLPPLPGASRQPVNPHSSSPGRLAAAFELGSGGKRVIHSPPAPASCTKSDISELSRASMSLEDRLRLMMIRKDERAKQEHENGLHHRASTA

SEQ ID NO: 34230 - protein, 273 aa, A.fumigatus
RASGNHSALLPALPIAVTVSSYDSSRRLFHPPSLLSSLRERILIRRISTRRVVRPRRSYTMPALINSAEPVAPVLRVRELEDDEEYVMTAFERHASHCSQCADPFRVHQEGRSLCDRGHQYALDVAEYFYSENGKAKSVIDRELSQPTLVKIPRDCVAVRGLLLAIEDGMRLQRKEQEKPQSQNQARVQVVTPVISYDRTFPIAPRQAATQQPAACNEIIEREPRTLKRRRVIIYQSPRRSSRGSLYDSDAADRAERSKESPSRIYRPTGYHR

SEQ ID NO: 34231 - protein, 77 aa, A.fumigatus
PPVTTFRPITRPEINQQAEIVADSVAADALFLSRINNQRLKALPACTSHSRLASHSVLWKPEESSPGKHQTLRVEWE

SEQ ID NO: 34232 - protein, 69 aa, A.fumigatus
GISAGIWLPAPQTSFWLVADGLITGYNKIMVLYMCMCSVRHSCSQPSGVKKLVYMHLGGSYCHALQANA

SEQ ID NO: 34233 - protein, 198 aa, A.fumigatus
TPSPTPLWHPSAPSSLLVSHVGDTRILLCYTATGAAIPLTSNHHPSSPIEANRLRRYAATFVTDSFGEERMSGLANTRAFGDVQSKRIGVSAEPEIRRIEMGPAEYSFLVLMTDGISGTLTDQEVVDIIKEAKTPDEGARNVVNFATEVTKEGDNATCLVVRLGGWERRLEGGLGSLGTKESREWRRQEATDPRSSRR

SEQ ID NO: 34234 - protein, 115 aa, A.fumigatus
QSLQTVLFICCALNELFFIGLYLLSFSSPILSPSLLQAQDPSAPPALASPWSAGALELARANKIDSFWPWVITGISAPVMALKQFINVVQLVKASKWLAEGDRARRKAEREGKTL

SEQ ID NO: 34235 - protein, 287 aa, A.fumigatus
  UNSURE (57): Identity of amino acid sequences at the above locations are unknown.
KFKGPDQKFPRSGFVPHTGAISHPPTSFQAVVDRETTVVGIPLRSAKHHFGAATSRXTRVSNEDTHQAGVLDIPAFAKRPPASVTIKRTTAPLENRGADSASGDPQVFYFGVFDGHGGSECSTFLKDTLHEYIQDTAAESEFQSSLSKDREGHFSKNESEICRGDLPIIQRGNHKRMAEMEKTLVQNWRRLVGGYFKRFVPAHFSYRGNSAQGNGSATGNGDDHTGGVTIEEILEYAFLRADLDFVSAQAAKEDDELATAHKPQYQDDILYGPKHTQQTEAWRLPTI

SEQ ID NO: 34236 - protein, 146 aa, A.fumigatus
DADRWCNGAGYSRVFLTIASLYYMPLHPRTCSLLYSISCLLDALDGYAARYYNQSTTFGAVLDMVTDRCTTACLLVFLSSAWPRWAILFQSLISLDLASHYMHMYATLSMGGASQSHKNVEATRSWILYQYYHSKVSAMQCLQKES

SEQ ID NO: 34237 - protein, 207 aa, A.fumigatus
TVRQPRLYSMTRKTTNYTSVGNRGPNKATNAAGSASAVKAAIAAITANPSSNTTTTTSSSNNRWTSDVQEILSMNLELWRNSLPEIMKWKDADPPSNDINVARMRAKYYGARYIIHRPLLYQALHFAGLPYPNPTSALVGSPAGSVLPSTKSEQVSSLLPHSQQASSMAHLSSNIGVPVHTASTYVQGSSTGSLHHGAGRTRADQMG

SEQ ID NO: 34238 - protein, 123 aa, A.fumigatus
FAWSQSHPDRVASADFSSYKQSSALFHTPFGTPSSGSSSASSTDGPRVSSSDYISLSRPQQQWQSSFSSSSVFDNDLAYFPHACSPASNLWYTSEQGTSRSAGNDSPFPRRMKKAALNTKELD

SEQ ID NO: 34239 - protein, 91 aa, A.fumigatus
LYILPQYKKACDRCRARKAKCDEGRPSCGHCKENNLICVYKEVLPHKCVTCLTSVLQLVSCRILTLKLDRKRPPSRSWTRYNVWKISSTSV

SEQ ID NO: 34240 - protein, 138 aa, A.fumigatus
NKDPYVAVLVDGDGAIFNKELLLDPRQGASEAALRLTQAVRNYLKDTPLGSEDVPIVVRIFANLTGLAKSLVTYNDIDHEDKMREFAENFTNSRAEFDFVNVGRGKENADSKMRSKFPTGGQFQLADLISRRDVQSFL

SEQ ID NO: 34241 - protein, 90 aa, A.fumigatus
HQSLGYDYNTAHKQLFAVPVIILRPSNGGKKWKFFRCAADDMQSVWSLVHGGAMIDTALFSKDCIKGPVHQSHRIFYVTTREQESPGSRC

SEQ ID NO: 34242 - protein, 65 aa, A.fumigatus
FLAEMFNHFYKNFQCKKIFFAGCHDNGYLHDLRDYAGESGPTSASVLFRRTTPAQVRALPPDGLF

SEQ ID NO: 34243 - protein, 261 aa, A.fumigatus
VLWYLTQPAVNRLVQLAEFYQLGGFEYWGRMHQSDLYGSDSDSSESSEYPSNLTRAEAVRQYPESAHQALAATLGLVYYKIRNEVGEGPNTHIPRPPKRERQQEDLASVSSGSKQKPVKMPRRPNNVSPTTLHRLITGPSLESKSLISEESDKLGWNVHSDVSDDAMSKLRGIVSEEVGTLLRALEQGRLKLKPSRSERLNMSPTESKGGSFQDKVPESAQEDEVRTVANTVATELVSPSSTRNEEHDLPDTASDATTPLT

SEQ ID NO: 34244 - protein, 123 aa, A.fumigatus
  UNSURE (2): Identity of amino acid sequences at the above locations are unknown.
RXIETHFLPPRVKTDLEQLQTDVCGCRIEISKLHAAISQLRTDLITLQHETSRHLNAVFNRFTLIEARMKHSERVRFNSLAHTTHAPITPVPVIEEDGSLQWPEYFPRTVWRFWCLKKRSRSE

SEQ ID NO: 34245 - protein, 281 aa, A.fumigatus
CPPSTHHEILDVLMSLLSSVSIRMASRMTCASRLMRPNPIVSRGHRRLPATLLQPSCRFVHPGEFKPFVPPSPSSLGKPIPAKTYTRTRIWLRRLAYLSIATGVVYAIDTQVYASSLTRTARTFSLGLLVALDYKINFRPNPPFAESITALHARNAERLFDLLRHNGGLYLKIGQAIAMQSAILPPEFQKMFARMFDDARQNDWKDVEKVIREDFGKSAEEVFGVAFTGDPTKGVLERKARASASVAQVHWARLADGREVAIKVQKREIAQQIKWDLWAFK

SEQ ID NO: 34246 - protein, 166 aa, A.fumigatus
MDANETRVVTWVYSRAFDIPFYSLVPYISERLFLETDFENEATNSETMAKLVAGESRLRGRVYIPKIYRELSSKRVMTAEWIEGVRLWDRESITRPWLGGWWEGSPGCQGTPLDAPKAEDPVTRVARNPNLAKIKPERNHWRGWNGKGGLGLSLKDVMTTMVDLFS

SEQ ID NO: 34247 - protein, 106 aa, A.fumigatus
  UNSURE (67): Identity of amino acid sequences at the above locations are unknown.
NCGEIRSNDQSPIFGSRLKQDSTNMTTVTGKSITPSLIFLSDILQSIQPDSSTTVDEPTYNALPPPXRTSPPAQRIRRNRETRPDMLQSRRRARQPTRRSVREISA

SEQ ID NO: 34248 - protein, 64 aa, A.fumigatus
TKRQEGCSKVAGKRRWPRDTMGFGRIKREAHVIRDAIRMDTEDNNDIKTSSISWCVDGGHQRGF

SEQ ID NO: 34249 - protein, 150 aa, A.fumigatus
RVFDLLSTSRLCFTVPIPWMKFNFQSGFLRSARQAIVDPIVVVPVRRTLPSAAAVSPTTLTLSSSDPTIPHYRHSSSLTLRYSRPVDTMPKDNKNSFNLKTPKGTKDWSGSDVLLRDRIFSTIADVFKRHGGTALDTPVFELREILAGKY

SEQ ID NO: 34250 - protein, 62 aa, A.fumigatus
SSIYGNYGVVSNLRKHVPRLCNSTLCDASVWIFLFHDSQDLPRSPGGEGFKAHYAFKKVHHE

SEQ ID NO: 34251 - protein, 61 aa, A.fumigatus
GKSRVNLSLQTLSVRSRLTSGVYDTTLRHGSMKELIQYKIEGEALDTQQAGKRLGFMKPSQ

SEQ ID NO: 34252 - protein, 402 aa, A.fumigatus
YQVPTKGTTHPVKELLYTIEDSDPSLVILHPAFDKVREPLRESVAKDVPFMNFQSFHAKKDLSSKSLPTFSPVSFLDRRALMIYTSGTTSKPKGCVTTHKNITFQARCLIEAWKYSPSDHLIHVLPLHHVHGIINGLTSSFLSGATVEMHPKFDPQVIWNRWQDQDSSTMFMAVPTIYSRLIDYFEANIRGTDKEAAARSGAKSLRLVVSGSAALPTPIKTKFAAITGQILLERYGMTEIGMALSCGLDVDKRIDGSVGWPLPGVQVRLVDKETGAIIETANEDGMIEIKGENVFLEYWRQPDATAREFTADGWFKTGDVARRDGSGAYFIQGRASVDLIKSGGYKISALEVERKMLGLDTIEEVAVVGLADEEWGQRVAAVVKQRPGVRQYACLEHISRKT

SEQ ID NO: 34253 - protein, 214 aa, A.fumigatus
DAPEIRPASHMEPVAGSGLLHDVHGRSDDLLSIDRLLRGQHTRYRQGSRRPKWRQVLEARRKRFRGAPYPYQDQVRRNHRPDPFGALRHDRDRHGAQLWAGRRQAHRRQRRLASAWRTGSARRQGNGRNHRNSERGRHDRDQRGECLPRILATARRDSQGVHCRRMVQDGGRCTARWFRRILYPRPGVGRPDQVRWVQDLGPRGGTEDAGLGYH

SEQ ID NO: 34254 - protein, 326 aa, A.fumigatus
FILGGGHIAETLGRSLNTGTSTLTKGSNLRELELMHKYSTETYMSLSNRPSDYHVWQVVIPRKALEHDFLLNGVLAVAALHVASTLKPPDALTYIDTALEYHNRAFAPYRQAIDNLTPMNCDAVFAHSVLTTVIGIALPRLTAERNESSGITENIVVVFELLQGVSKIFKISRPWLTMQLFTSQNDWDKVTRSKLDSETERALNRLAVLNDDIVATVDPEQYLIVKDAICRLHECFTGYATNGEAASVLRWLAVASKEFAHALRCRKPFPLMVLMYWGVLLGELDGKWWWAKNSGTALVSELLAVLQPGDIRWEEARLWPKHKMGL

SEQ ID NO: 34255 - protein, 436 aa, A.fumigatus
WPHNTTTQDSADDNCFRRHLCKLSKESMSDTIADEILRNGYAKTFTRHSVFLTGSTGSLGGCLLYKLALQLPTQKIFVLIRGSAESAIEKWRRLMPKQTQAILNTGKVHFVVGDIKKTDFGIEEAELSRLREEVTLVIHTAATITLDAGIVESIENNCLPSLELAKIVSRFRRLKLFLQISTAYVSSFLPDGYVGERVYSISDADPEDELAAILSTGNSLDTARFSSSYTHAKYLMERLLLKRYPLLPLLLVRPTIFGAAMRDPYPLYGPINSTPMNKFASLFFADRGGTHIWHATEGYETGANIVDEIPVDFVANGCLLHAASRTQGIVHLGAQLYVPFTFDDFLRLAEASAPPSIQKELPSLIFTQDRNAPQSLLADLVKVSTRNWVFDCGRSYWLKQMAGPLSLAACKHDVDALNSARIKEIYENTVKKLAKL

SEQ ID NO: 34256 - protein, 128 aa, A.fumigatus
LLIARQRPASKLPGTSYDFTWLAFNFKTVGSLSLDQQSSLHIYLCRLNLSINSSAVPEQASSALVKNTYCNGICPAFLRSRKFLVAENLHYRDTQIEACSFANRPGCCSAEEVMAGIYISNTLSGDSG

SEQ ID NO: 34257 - protein, 118 aa, A.fumigatus
MILADSQSLDVPTQLPPSCTLGPMMEREDTRDVLVMKKGLPNMSFSEMPAGSVVGTSSIRRTAQLARRYPHLKVQDVRGNIGTRLAKLDAEDSPFTCIVLAAAGLLRLGMEDRISPVS

SEQ ID NO: 34258 - protein, 131 aa, A.fumigatus
TCRSTPVQSRNKPRPPLLRTPTAMASAPPSSEAANSSSRRTFTIGTRKSKLALLQTDLVVAALKKSWPEYTFQIHSQETAGDKNTVIALREFTTKNLWTQELEELLMAGDVDLIVHSLKGKFITPASYRYK

SEQ ID NO: 34259 - protein, 63 aa, A.fumigatus
VWRTAYPQYLDSKNGGMLYALAKGALGVEIRKDDKVSAGYAQLYRASENDFGLLRRAKLPANS

SEQ ID NO: 34260 - protein, 162 aa, A.fumigatus
PIYLHCLGCCWSVEARYGGPHIPSILTLRMAGCSTRWPREHLALRSARMIRFLRDMLNSIGHQKTTLACFAERSFLRTLEGGCSALLGVETEWVQDSDRSSKLRMRAIVVSVDGRESAEVEVDGSVDTAESAEEFGVTVAKALVEKGAGEILAEIQRKKLTP

SEQ ID NO: 34261 - protein, 64 aa, A.fumigatus
ITRTSASGSAYRFIASPVTDYVYGVLEHLRDFKTDRLAPYSPFVLIDWLQANALSSCSYTISSV

SEQ ID NO: 34262 - protein, 115 aa, A.fumigatus
SIARGDEQGRMCNGQGMTGHKSSSIFGANARLKSPAKNILVENIYCNLSGGCAMGSLGADTDISDITYKNIYTWNSNQMMMIKSNGGSGTVSNVVFENFIGKQQALPLSFSIQAG

SEQ ID NO: 34263 - protein, 214 aa, A.fumigatus
  UNSURE (2),(3),(30): Identity of amino acid sequences at the above locations are unknown.
AXXAASLSGSVGPLTSASAKAAKKTCNVLXYGAKADKKTDLGPLLAAAFAACKSGGLVYIPAGDYAMSTWVKLANGKAWALQIDGVIYRTGTDGGNMIMIEHTSDFELYSSTSSGAMQGLGYEFHASNNWSGPRLLRLWDVSDFSVHDLILVDSPSFHFSIDTCSNGEVYNMAIRGGNHGGLDGVDVWSTNIWIHDVRIGFRSGIRSGYFGSQS

SEQ ID NO: 34264 - protein, 251 aa, A.fumigatus
AASTSLVIQHTGRLTEGVKTAIGHGNAYSLDIDSFWSSMSAVSGDGVTLNNITIKNWKGTEANGAQRGPIKIICPDKVPCYNILIEDFAMWTETGSKQWYSCQSAYGSGFCLKSGSHHTSYAVTTTTVSSAPSGYSAAKMASDLSTDFGSTKSIPIPTIPTSFYPGATPYSALMSKQSTKAAKARAVDMSVETPAAASRSEQVVQGAPQETGQSAPESAGPVPSGNPGPVPTGGSRPSRHRHGHHHFGSAI

SEQ ID NO: 34265 - protein, 550 aa, A.fumigatus
HFRWEDRSHRFNPRSLTRDNLPEPLQPLADMFPHIWPVKAPGDSKYNKVHSPLQAILLSSLPKNKESGGKGPKPPKVDKSYVPKRTPITAFISSVDNLRENDYVLHPALLSTEKEKLALAENRKRAGQSTEDGWVDTHVSSWEAGQVPEHEIQQGSVTAGRDILALDCEMCITEGGKSELTRISLVRWDGEVVLDELVKPQLPIIDYLTRFSGITKEKLDSVTTTLADIQQKLLNILTPRTVLVGHSLNSDLNALKLTHPFIVDTAIIYPHPRGPPLKCSLKWLTQKYLGKEIQKGQTGHDSVEDARAVLELVKQKCEKGERWGTSDASNESIFRRLGRSPRPGKATTSGEGRTGAVVDWGNPERGFGSQATVAIGCQNDEEVVQGVSAVVKGDPSNPSIPGGGVDFTWARMRELEVLRGWCNRLPDPNNANESTTLVPPPEETTPTGSGTVEPAAAARNSLADTVARTVANIQRIYESLPPCTLFIVYTGTGDPREVSRLQSMHKTFREEFNSRKPWDELTVKWTDAEEQALKKACERAREGCGFMCVK

SEQ ID NO: 34266 - protein, 447 aa, A.fumigatus
GHVQVRPSNWAYSPNIFWKLPKVSFREIVTMRTVEPLFKDGSLERFLCPTPKESTSRALVSTGPHKVDGSTMSMEQQIQHQGVSIDYISNSVNNLHDTMSELKHSFTSLRIELNGPGRLPPDNSGTHGSDFDMIRTVLKELKSKAEEIETLKLEIQALQLKNRYMEEQATRHPAATFGTETTVMPEVRSPGLLQAGRKRPWPDSFPSGRTEPIADSFDEEDGTFGDFSLADMHAQSVKIPLKDPEPGHAIADSTHHQIPPESPRLRIEVTRSRQHTPHFDNMVEDTEGTNLDTQQPAVVKRPRIFDSADRTSGGNTEKRRPGRPRKSLSQCAKPDFSQTPKPTPLSEQNGNVGTCIPNEQIPSNTSPSEPVDVLQRSSTRSRTLRSQSRPPSRRQSGNAVSQSTDGDQNAFRKKSANDYGGIIPTLKQRRQAFNHGNLRLTPRRRPP

SEQ ID NO: 34267 - protein, 61 aa, A.fumigatus
PPFPSSTHVDITTRIVSWKVTIMYAQRPLSYAPTPYSYTPNPALSATINLDEVLPFGSPVN

SEQ ID NO: 34268 - protein, 90 aa, A.fumigatus
LRSYQEVKLASSSAERDLHESLAEIYSIIVTLDGLEKAYIKDVVTEAEYTETCTRLLKQYKSSLGDETVAAEFVDLETFKRTWGVSTLSV

SEQ ID NO: 34269 - protein, 139 aa, A.fumigatus
LFWQLECPRATERLRIGLPATVEQASHGTPSGNAGPTTGGPVGGASGSLILTATENFITFLDALKLNMVSKDALHPLLSEVIQSVNKVTDRDFENRGKIIQWLITLNQMRATDELTEEHAPELAFDIEQAYQGFKSTLG

SEQ ID NO: 34270 - protein, 230 aa, A.fumigatus
RSLRILTPGLLNVAMPAMSRSFTIPTSSDEELTLTLHEPSLTADNLGMKTWVSSYLLSRRLHTLLDVAPALVPSSSTTPKSDRTLRALELGAGTGLVGLSFAALRGSSATIHLTDLPDIVPNLAHNVSLNVELLTRTDAAVTTGVLDWSVAPSPPPREEQYDLILAADPLYSPKHPKWLVDTIGHWLRRGLDARVVVEMPLRDAYLPQVQEFRQRMQQLSSRPGAGRIRA

SEQ ID NO: 34271 - protein, 74 aa, A.fumigatus
ESCHTLLQSLYFDVTTMPIWVAFWVDWTTRFEQQMASHSVASTSGLSSSSLVSWILYVSLRQNNEAMMTPSINL

SEQ ID NO: 34272 - protein, 260 aa, A.fumigatus
THIGWKDIRCNFEYRSAGWISDRLNHWLGRKAVIAIAAVFSLVAPIACGVTQNWHQLLGCRILLGIGMGLKEVTVPVFSAETVPTSIRGGLVMSWQVCRCSLFPWLILEFGSSSGLTTDNGYPGTAFGIFLGTCANLAVVNTGKIAWRLQLGSAFIPAVPLLLGIWFCPESPRWLLSKENPRKAYESLLRLRNSPLQAARDLYYIHAQIKMEKRLLRESEFTRGGNTLARFLELFTVPRVRRATQASGIVMIAQQMCGST

SEQ ID NO: 34273 - protein, 270 aa, A.fumigatus
LRSKCVEVRESSPNLVTNYGHRSYCKTVNIIAFYSSTIFEQAGATNIQALLASFGFGLVNFLFAWPAVWTIDTFGRRWLLLATFPNMCWTLLAAGFCFWIPASSSAHLGLIALFIYLFNIFYSPGEGPVPFTYSAEVFPLTHREVGMAWAVATNNFWAAVLSLTFPYMLRDFKPQGAFGFYAGLNIIALLLIFFFLPETKQRSLEELDRVFSISTRAHAKYQVTEVLPWWIRRYLLGRKDDVVRDIYRHLSPDPVLIAEKPKKEEHLESV

SEQ ID NO: 34274 - protein, 83 aa, A.fumigatus
TGRSGRDGRYYSRESRNRIRPPAGSSTYWGRWRARANDGQTCRWSRRRARRRGSSPSQSRRTQAGPGCSWRRLAQRWWTSRTR

SEQ ID NO: 34275 - protein, 216 aa, A.fumigatus
PCERRETRAGEPGMMCHGFKGGTGSASRVIDGVAFGAETNYIVAGLVQANYGAKRDMRFGGAPVGLLMEQEDGAVATAAANEDDARKAKDGSIIVVIATDAPLHPTQLQRLAKRATVGLSRVGGWGSNSSGDIFIAFSTAERIPRAPDFSWKPTVEQQVSVVQDVTINALFEGAADATEEAIYNALVGAEDMEGPRGKIVKALDHARLKSIMERYL

SEQ ID NO: 34276 - protein, 171 aa, A.fumigatus
LAIASFSNLVELLSRLYESVISPAPFRTKEHAGAQLVFCVSYNAFSSAMAHTLEFASACRSGEFPIDCIEIWKTSTMEPIRTEPEEGFASNWRFITCENHWTIVFKYGGRQAIATKYRGYDLKWRHDDLAEPSVVLKFEPRPSCPSMSDVAWKICAVENPNTKAFDCSQFV

SEQ ID NO: 34277 - protein, 86 aa, A.fumigatus
NMYAPHWGEGIRANYMSMPQTKHEADPHPPTYCEPNARRLDTVSNGTEQLVSDMQGDKSNVIALDCSAEAAQRDARRCSINSSTGP

SEQ ID NO: 34278 - protein, 429 aa, A.fumigatus
DFMDLFSTLMVSLKLDSHRVRFTKYDHTFTSEEAINNLGSLKFSQSNRMPDPKDPSRIVTTTTTTTFSMAKEMARSVCQRFVDARFIEPVDGKALPIFPLKGALFQLTPKGINILQRFCQRNGITARHVIDVLESPRNTMQLVNLERDTETDKLSHDRATIEVIFRRFAGQDGPNVKSSISTSDSDSLSDYSNGLVGVKMAKERKINDKIYMNTFTGKAAVDWLMDCSTTIERRETVLIAELFVKYGLITMLQEDKGYPQPDASIVVFQPSKYAIYGITERGQRVCGWIARDKSRETFYDNRGMPKDSNNARLNHILQDPALRLLFREFLRFSLCEENLSFYLDVSEFTAAYHKSEKMGAFKKADAVRETLAAAYGKPLFIGDSDWLYSFCSLSSRSLQCFPCPRFSVRAQYRSRPAKQLSEPYDKGCR

SEQ ID NO: 34279 - protein, 124 aa, A.fumigatus
TAIADFPGRGEDLETSEVESQQSLSGRRRHTLQRNSPISEQQLEAGFAALPSKMHQTSSRLLRMTEDDRPFTKVWKEKKTGASSIINLSMIHRMLKSLETIFVDDLGFFFCRILWTFSRPLWSV

SEQ ID NO: 34280 - protein, 119 aa, A.fumigatus
GILIGYTVFAHFLPGLYNAFLAPGSPCELNIDHALRNSLASRMTKAVGDDESMFKSLQEVVQLFEMAQTSVFKLMSSVSPFSSDNSLVNHSSLMRIRTLFQSSYVIRNMRLSCRSMTST

SEQ ID NO: 34281 - protein, 211 aa, A.fumigatus
TLISTAWLRRGSSKNQDPIILLSPSASSLIRMSNVRSFLQDGVFVPPDHPTLAMPSSSNNLLYIYRPLRSEAGSTSASRPLGASPPGATSKKPTRFILVDSTANFRPDYWNRLVAVFTTGQTWQFKSYKWTSPPELFKHATGIYVGWRGENVPREVRGWGRGVQSFAVERWDEKGGVHGAGRWRDREVVENIWTAIEESMKARGWGAGSTK

SEQ ID NO: 34282 - protein, 170 aa, A.fumigatus
SACPTSAPSCRTASSCPRTTRPSPCPAPPTTCSTFTAPSAQRPARRPPLAHLALLRPEQLPRNPPASSSLTAPPTSVRTTGTVSLPFSQRARPGSSSRTSGPPRPNFSSTPQASTSAGAVKTSPVKSAAGAAACRASPSSDGTRKAVSMAPAAGAIVKSSRISGQPSKKA

SEQ ID NO: 34283 - protein, 94 aa, A.fumigatus
PTIDSQFTRHLLGSPSLDCIVATLFNPTSLTSNNRRTIIVRSNSNSTTTTTYNKRFLPIPPSRRPAAIELLRPTSRRTGRISNNMPAPLRRNTQ

SEQ ID NO: 34284 - protein, 70 aa, A.fumigatus
RLKLTLSHFTWGYSTFTTFFDKSAYGAFVFICSLCVFAYFAPLGRSYTNLLRRIANSNNMTCTYQTLVSN

SEQ ID NO: 34285 - protein, 395 aa, A.fumigatus
PLESSFLPQPLNCFRSCMAGVQAQPTMTDYRLPIHQAPSRKPVPGLHRGYPFQSYEPHQQQPPHHYRPQQQQQHHHHHLQQEVSPHPSVSSASRNRASSSHVSPYGAHQQQYAGAPSPQYTMTSHVSHQSRRLSSATTSTSSTGNNFSSDIRRSTSSRSTNTQVGYVALMRRQKATVWCDRAQPEDPRLRAQKLADKKRAYLEVHGAGAGRTGTLASGKNKHGNKGVTEFSASALVGATVPVRLSANEVGDGDEDGHSDNGFPHRRTGSGRSSLGSNYRYPSSYQRPSQGTSGSNNTPPNERADLPEVTENPPAERHEQERASSAKDDSATSHSKTSEQEDSFGSVGDMAAPSAATTAAEKARKADELRRRGSVDERTTTMTNVRLFVANPDLSD

SEQ ID NO: 34286 - protein, 740 aa, A.fumigatus
PFHISPGKTNGLQREIMDQIFPERVSLSRWCLNKRSNSKVTLFFFLADIRRFIHQTGQNSLDSASGQNLRSLLKALSTQLPCVTPKVVRTKSGSRTTGVPIKSADAFSVISPAAAGVFDDDIAPMLVGPACKLAVESPSLDEVRNKPLPREPPIALAPLSVRHNGPRPFQACQRPSSDWLCTTTPASPATRLSHSQRTLSQAAQELENFLAGITEQRHNEPQLFSSQISNGPLQISRGNMDMIATRPAPRPPTNIASVKSKDNSSQKISPEKPERDLQKPMKKTKYKGPFSFSVPGFSRKYTNTHLRSFSSSSLKSEVESPSFRPQRPPRPETIHDEAEDTAEVAQSPFLPVPSQRQRSSSFCSERELRLRLPRLQTKQVRSHEDLVSSSSSFVEAERVAERSMPSIRANNVEEKIFVASSKSGRSNTSDSLFELDGGMPQRMIYELDAGLPSPHPKINISVHKPSKTTAVQLPDDIALKILEQVASLDDLFHLAVVSKQYYRVFKQHELHLMKTTVYRMSPPAWELREMSPPWDSEWQILVDPDAPVPEYTPTLYLQRYAQDIYTLAQLKSLILARCNTFLRQETINGLTGKDDTRAAEIDDAFWRIWTFCRIFGCGKNRENDIVGQMDWLNGGVMAHDRNSIMTTSLTEPFGMNNVLFEPPEGFGRGNGEGLSQSQLYDMTEIWTCLAVLLQPIHGRRTEARKAGVFAGLDIAENDTAKEEAMIGKCSFLSSSSYLGS

SEQ ID NO: 34287 - protein, 65 aa, A.fumigatus
TDKGIEEWTYYVLTLGPSAVLSIGSICAFDDSEATFQTAQSIGLTKWEPADSSISRSTFLKEAVF

SEQ ID NO: 34288 - protein, 73 aa, A.fumigatus
QKGTLTYHSFFLRRVIFCDVEPGKNASLSGLSAPAVNGLEQHGKTSPYFCHVVELTLGKTFPVPAPEPLRRFE

SEQ ID NO: 34289 - protein, 86 aa, A.fumigatus
DIVHTEWLSERRGHDAVTVVGHNAAIQPVHLSYYIILPILATAKDPAESPDSPKGVIDFCRSGIIFACQTIYRFLAKEGIAAGQDE

SEQ ID NO: 34290 - protein, 305 aa, A.fumigatus
  UNSURE (63): Identity of amino acid sequences at the above locations are unknown.
WGQQAGTSNRKNLPCGPPKMPDLPGIPVTPGVLPEQQKEALAAALERIAGKMIDTVRIDTTHXVCREGRGPLWEKAVEMNIPVVVPEWVDACEAEGTIVGVRGYYLNADPKARQLGPIHASTHQHTRSSVSMATNAPSQSQSQSQSQSQSQSQSQSQSQSQPQSQSQSRLSLQPQPTHQRELSVGDPPVTPFPGADMSGQPRADEREVSSDEEDLPPPPPPKDDAAGAEPAVNGKPESTSPEGVVSSGDKEERSESDEKHDEKDEDETAHEEAEEKQEQEEPTSNDSDAKGKGKEGEGDFIEISL

SEQ ID NO: 34291 - protein, 176 aa, A.fumigatus
  UNSURE (113): Identity of amino acid sequences at the above locations are unknown.
VEAGGSVYSETVIGVGIETETETETETETETETETETEMAHWLPSTRRIWYVDVSRHGWGRAVWPWGLHSGSSPGLRRWCPRLHRHPPTPEPRRECSSPPLSPTAGLCLLYIXSEWYRCALCRSSCRQYVPKPRRAPLFAVRGGPPGSPGYRANRASWVVRMAGSSDWMCRLVGPR

SEQ ID NO: 34292 - protein, 389 aa, A.fumigatus
FRDTINHLKFLLAHSQFSSFSATMSVLSTLAPVPPDEIFALNRAYATDPFPQKVSLGVGVYRTDDGKPWPLPCVREAEKQLLAEDSLTRHEYTAIEGDIPFLELARDIMFGFDGKNAAEKHKSRIGSVQTVAGTGANHLGALFLATHMKPGKVWLSNPSWANHMTIWELAGVPRKTYPYYNPTTRSFDFDGMMATLEAEAQQGDVILLHACAHNPTGLDPNKEQWKAIADLCERKKIFPFFDSAYQGFASGSLEEDAWAVRYFLNEKPGMEMCVAQSFSKNFGLYGQRVGAFHYVLPQGSESLRDTVVVNLCHLIRGEYSMGPTAGCNLVKKVLTNEELTAQWHKDLKVMSSRIRSMRKALYDELLRLQTPGSWRHIVEQVFPLRSLLP

SEQ ID NO: 34293 - protein, 65 aa, A.fumigatus
GCRPRGPGDTLWNKYFPSAPSSLEQVCNQYLTQKANTYLEWNVLLHRPHPCAGSFPQRQVSHLPA

SEQ ID NO: 34294 - protein, 154 aa, A.fumigatus
CTGQVCRHRHCSARSIRDADRGHHREISIKSPSPSFPLPLASLSFDVGSSCSCFSSASSCAVSSSSFSSCFSSLSLRSSLSPEETTPSGLVDSGLPFTAGSAPAASSFGGGGGGKSSSSDETSLSSARGWPLISAPGKGVTGGSPTLNSLWCVG

SEQ ID NO: 34295 - protein, 80 aa, A.fumigatus
YAFQLLHVAIQDLVFGADMHEAWVEYPLHQLTVISSVSIRQLGQNIPFLLAYNVTLTPKLALHLSVCGMIYPVRGVFWPQ

SEQ ID NO: 34296 - protein, 148 aa, A.fumigatus
TWTCINQQLNPKTNKWEDKRLLYNQAKAESNSHHAPLSDGKTGSSYPHWFTNGYDGNGKLIKGRTPIKFGKADCDRPPKHSQNGMGKDDHYLLEFPTFPDGHDYKFDSKKPKEDPGPARVIYTYPNKVFCGIVAHQRGNQGDLRLCSH

SEQ ID NO: 34297 - protein, 61 aa, A.fumigatus
ALPMFTLLLIIQRYHAYQSVNKITMPAARTDLYLQSYISLNVGPSNGKSPHKSKVWSHDAR

SEQ ID NO: 34298 - protein, 269 aa, A.fumigatus
  UNSURE (257),(259): Identity of amino acid sequences at the above locations are unknown.
VSLILIFPKYPPQLLFFPSLLTVTRAALIIPTPRQTFLIMSNTFSFGAPASSGASSGSLFGTAGNAFGSNQNSSNTTTGGGLFGNVGASSSGTSTPSLFGSAPATGKSGNTLFGGGTSATSSSTPTGSTPAFSFGTQTKSGSTPQSPSLFGGGSQTPKPGESSASGQTGGNALFGNAAKPAGNIFGSAAATPAPSGGSLFGNTSTTPAGPPPQGTAAGQGQSLFGQAAQKPGGLFGGLNATTTSSSTASPTATTARXSXHEDDMMSLGS

SEQ ID NO: 34299 - protein, 81 aa, A.fumigatus
SCKACEEVKKAQVISYNMGFFLSCLFGYYLSVNSWEKSARYQSYSVQGEVGTSPYPIRHGTLTFLLNFGYIFARFRVPMAF

SEQ ID NO: 34300 - protein, 85 aa, A.fumigatus
YYWRLALGQPFTVDTSGHYERSFMCGLRHMAETPVEPGHRQQLHIDDNVIQCKASLPHLYIHYTFPPDILLVSTDRFYMKFSRKN

SEQ ID NO: 34301 - protein, 253 aa, A.fumigatus
ALFARIYTNIISNSQPPIIDFDTFQSFPDLHAALDQYLDKLYPTSKNVESLPPLEPIQDASSIFSTERSLSLWSQLVAPPPLQPQNWVKSRIRRLFLVSLGVPVDLDEILPASKQKKLVLPSINLSGSDTTGSAVHSRSHSQARKSGSQDGIDSPTTSAPTGRHRTSRRRDRSPPPQLDLSAVRRLCATTDAALDGLTDAELRTHVKELEQVTLRASSVLEYWLKRRDGLVSEREAFEGVIENLVNHARRVRK

SEQ ID NO: 34302 - protein, 101 aa, A.fumigatus
PRGLGDLGHALMQIAAIQGLAATLDASSDGRSKFSASEDSSDMVLIIIHISTAHESSFETVANDVRRGNLVSSLQSMCHAQYYLTQWLCLLHTALGIIADC

SEQ ID NO: 34303 - protein, 267 aa, A.fumigatus
SADEEQVRDHYDRGDDFYAWFLGPRMIYTSGIISDINKEETLEELQDNKLAVVCEKINVKPGDTILDLGCGWGTLAKFASVHYGAHVTGITLGRNQTAWGNKGLRSAGIPESQSRILCLDYRDAPRVEGGYKKITCLEMAEHVGVRHFGSFLSQVYEMLDDDGVFFLQIAGLRKSWQYEDLIWGLFMNKYIFPGADASTPLGFVVDKLEGAGFEIKGVDTIGVHYSATLWRWYRNWMGNREKVEAKYGKRWFKVSPSDKFLLHVVHH

SEQ ID NO: 34304 - protein, 175 aa, A.fumigatus
YPAIKNAPVPADAAGSDSFSNILLFSLLLFVPWYLARQVGGGFYTTIFFAIFTTVPILMVFWSVASSISPRKNEKAKYAGRPVEHYLHFHNEHDRATYRGKSKIPMEVFYEKYFNGEVDFKGDALEALEFRHDWANFRFTMGLYKHFLFGFIPELLVHSRSQGKVAFSWLFCTDE

SEQ ID NO: 34305 - protein, 98 aa, A.fumigatus
PHRPVNLRFEIRVAKLIMIHPSSVRSLVTLRLSGSSPGLMIRDQVLSEYSIHHASVSLLNLFLCDSIAHTNALSSHLLGKKSWNVYNPENIARVRRDE

SEQ ID NO: 34306 - protein, 186 aa, A.fumigatus
WMMPYWIPLESCSSDTPKNRLDLFQRMVKIGSVNLHVYDILTDAGHGTDLDMPGKSKRRRGLDEASNFGAREVLSKKRELSQVNVWIQYIVFPHLLGVNLQNLSPSRLVRKRDLHVQFETTRPQQSFVNHVLPVGHTNQEDIVQLINTIQFRQQLVDHTVPNACATTCAAATLLAHSIQLVKNNDM

SEQ ID NO: 34307 - protein, 116 aa, A.fumigatus
LITSSVAVSTQDFPPSRDGLDLLLLVNDLYVFSARPLDGFPPGHISMSDPQRTWAGVAFTDSVKAQIYDPFSQGGQAYLGSTDIEVGFAGKKRIETPYDQDELANAVVKVNTRLDR

SEQ ID NO: 34308 - protein, 363 aa, A.fumigatus
NFENQIFSPGQKILMDHKSIPLLLTVKTVQRVDLTSEKAGATAGSTETDPTARGISTRHTQITFFKDARTGISLKPSNRRPAASSIITPDFKFEDMGIAGLDAEFSTIFRRAFASRIFPPGLVEKLGIQHVKGILLCGPPGTGKTLIARQIGKMLNAREPKVINGPEVLNKFVGQSEENIRKLFADAEKEYKEKGEESGLHIIIFDELDAVCKQRGSGAGGGTGVGDSVVNQLLSKLDGVDQLNNILLIGMTNRKDMIDEALLRPGRLELHMEISLPDEAGRAQILKIHTQKMRENNILDPDVDLAELALLTKNFSGAEIAGLVKSASSFAFTRHVKVGTMAGISEDVVNMKVNRADFYHALE

SEQ ID NO: 34309 - protein, 61 aa, A.fumigatus
RLTEPIFTMRWNKSNLFLGVSEEQLSSGIQYGIIHYSPTINEILKGVQLFVKQVSNAESSP

SEQ ID NO: 34310 - protein, 205 aa, A.fumigatus
HGPTASGKTALAARIAIDSGFPFIKLISHEDMVVFSEMARVQYISKIFDDAYKSRTSVVVVDNIERIIDWVPIGPRFSNTILQTLMVFLRKQPTKGRRLLILATTTERAVLKQLDIYNSFNSDIMVPNVMTYDELRHLMEQSEAFDASEIDQALAGVGGITEDRTIGVGVKKVLLGIETAKQDPDKVGRFVRVINRAIEEERTFQ

SEQ ID NO: 34311 - protein, 107 aa, A.fumigatus
LRLLAGSYALVGAKVAADSTVAKKLRQAGVIILGKTSLSEWANFRSLNGSSGWNAQGGQTYAAYYPKQDPSGSSSGSGVAADLGLAFAALGTEVNDFHLHGLYAIVC

SEQ ID NO: 34312 - protein, 67 aa, A.fumigatus
AERKCVPDRSSIVYRSIRGCASLYFHSHVTLKQMVSGALCVCDDHCIKSSEFAEWYSSSSMCISLPD

SEQ ID NO: 34313 - protein, 65 aa, A.fumigatus
SFTKVMNKHTKKGEKQILLFNGHGSYLIIKFLQLCKDNSIIPFRFLPYIIYLYQPLDGKLFLSYK

SEQ ID NO: 34314 - protein, 196 aa, A.fumigatus
VVIRAHVWAHTDVNQTIRFRPSNDSPREITDQDTTIASIKSLLSTMTKQIDRLENKIEELNLTAKVAIQKKNRVSALAAVRSKKLAEHNLKQRLDTVTQLEEVYSKIENAADQVEYVRVMEASTGVLRGLHTQIGGVERVEDVVEELREEMSRVDEIGNIMNEVAPEIDETELDDELEELESRERQAVEEKEAEKT

SEQ ID NO: 34315 - protein, 140 aa, A.fumigatus
NILVIPKLLEEYINQALERAEPSISRYISKTWVYCFEKQLPEYLSLGSVRQKMKESKYIQAEDAGLLGSWYNQLTNIIKDTPAWLVYNFDKCRFQPGEGKSRKVISLKGKGKVPNLTESKRGENITAIECVSVDGWHMDP

SEQ ID NO: 34316 - protein, 157 aa, A.fumigatus
RDSLSNMSDLLNYILTQEDSFKKSVTTCISKQKFAPKRKADYLGPETACPSLYSDFTLQKKTNPDGYAVNVAAWERALTRAARRGYVSTSPSREPSSTTGTAVQSDHLILRTDDSLLRDLEIPEYGRPVALGAMLVCLSFQSPEDLHLLSMLVPCTG

SEQ ID NO: 34317 - protein, 91 aa, A.fumigatus
SLFCLLFFHRLSLPTLQFFKLIIQLCLVDLRCNLIHDVADFVHPGHLFTQLLNNVLNPLDATNLSMQSAKNTRARFHHSDVFNLVCGIFDL

SEQ ID NO: 34318 - protein, 169 aa, A.fumigatus
ELYSGLSGSSCHGDALAVTSYFQGSALSTVDMKSSISARLCPRGPADGLSPGIPSMARPATWPPQGMRSVVGLKPYTPQQREGIWIDPAMSVPTARIEPRKATSAPSPPLDPPAVRLVSCGFKVRPKMLFSESPVFVVSVIEPGYARVWMSTTTNHHRLRDIKNCPEVK

SEQ ID NO: 34319 - protein, 314 aa, A.fumigatus
PGSMTDTTKTGDSENNIFGRTLNPHDTNLTAGGSSGGEGALVAFRGSILAVGTDIAGSIQIPSLCCGVYGFKPTTDRIPWGGQVAGLAMEGIPGLKPSAGPLGHSLADIELFMSTVLKAEPWKYDVTASASPWQELPLRPEYSSQVKLTIGILPESKDFPLHPPVRRALESAIKSLCQRGHHIVRLPDDPSRDLAYASRLAFQYFIYGPHIDHITSSGEPLVTSVAKMSSPMFTGPFPLDMELPPCEKISALHTARQEYADAWRTCWVGNGLDVVLAPGAQNTAVPHDTFGWPPYTVIWNLLDVRSLWTDAWML

SEQ ID NO: 34320 - protein, 166 aa, A.fumigatus
PPQLCKAVEPCHYRDIYRRKMAISPSPKTDWQGLVAAKRKRPDAQIPSEWRLSDDFRASVPADGHLIEADIARRSGILSDKELDITENFSAVELLKNLAERKLSAVDVTTAFCKRAAIAQQLVSGFDIPREVPSIIAVRYRRLITVDFMFNGTFLCQSHRACAVLG

SEQ ID NO: 34321 - protein, 104 aa, A.fumigatus
TSCLTEHFFAKAIERAQFLDEYLQREKKVIGPLHGLPNSIKDSFCLEGIQSTVGYVSLLQNEPVSHNSALVEILFDLGAVLNIPQTMMVSCRTHPYPGITGFND

SEQ ID NO: 34322 - protein, 515 aa, A.fumigatus
LFHHCGVGCFWPYDDSPFALFCLSTQRVFPNPRIVSLAYALSLDDRFADKKIILVDRWNFEPPNATGSVHNPAAANADTSRVIRRDYPHGPYASLALEAMKHWRGKFGENNRYVNQRLLFSGEGSSLTTPPKALETVNYIKKAYAISCELTPGGRDAVQVLDSLDEVRAFLGNTPSHPPHLPLNKDPAARDLRGYISNDCGWADAGASIEWLRQEVLRLGRVECVVGEVESLVYSDDQRAVKGVKLVDGKVLTAELTVIAAGARSSHILGIPKLCDVYSEFVAYIQLTKEEADELRRRQWPILVNCHRGVFAVGPDHDNCLKFGHFSYSGIVDVLREASIQVPTRPDGWEAQQKYWSDPRFAFGGEVKVSALGDVDDYENPAAQRALADYRLFLLELLGPTGLQGVDTLGLDQSDNLLNNIANRPFTRVRKCWYNDTPALDFVVDYHPSYGKTLFVATGGCDHAFKFLPIIGEKTLALILRNRGDSAVSLPAGVEPSLEELSELWRFPVELLQDN

SEQ ID NO: 34323 - protein, 120 aa, A.fumigatus
RNMKKTALILHTLQSQRKYIHYIACDVDRVALQRGLRNLQAIFPASTSSIKIQGLVATYEDCAAWLQRNPGSGHTSLMWLGNSLANFPPPEASEYIRSFLSTGASLIRLQPPGLEGSALA

SEQ ID NO: 34324 - protein, 475 aa, A.fumigatus
RKSFLRLVTMSPDEKWWKNAIIYQIYPASFKDSNGDGIGDIPGIISQLDYIASLGVDVVWLCPMYDSPQHDMGYDVSDYEKVYPPYGTVEDMETLIDACHRRGLRIILDLVVNHTSHEHKWFKESRSSKNSPKRDWYIWRPAKYDANGDRKPPNNWRSVFGGSAWEWDEKTQEYYLHLFLAQQPDLNWENPEVRQAVYASAMEFWLQKGVDGFRVDTVNMYSKDPSYPDAPIVNPKSDTQVAFSLFCNGPRIHEYLREMNKVLAKYDAMTVGELPETHTLEGVLRYVSAAEKQLNMVFSFDVVDLGLGKEYKFLTTPRGWTLPDLKAAIKRTQDILKGTDGWTTVFIENHDQGRSVSRFGSDRTPELRDTSAMMLAMFQCTLSGTQFIYQGQEIGTVNAPEEWPIEEYKDIDSTKYYHMVREMTNNDPVHMKTAMKALQHLARDHARLPMQWSPAANAGFSHPSASSPRGWQDPR

SEQ ID NO: 34325 - protein, 176 aa, A.fumigatus
KPANLCGEVPFPCFLSTGLALPGNSNTNFCYCLVIIMEIEKSTGIEHVEEEAASRRPHPQPASHQDLIASSEAQAALEKEHSMTLWQALKIYPKAVGWSILLSCAIIMEGYDVVLIGSFFAYPQFNQKYGHIMSDGNYGLAAKWQAALTNSMSCGQIIGLFINGVVSECFGCPRTL

SEQ ID NO: 34326 - protein, 343 aa, A.fumigatus
HTAIAPTMDALGAFTYMCDNLPAWIDQVSELAAYTAAKHAEYTEAYKKYAPVRSRRRKNSSVCSIHTDDNFPLSQKRGTSVEPTQGTPSTAAEASITQIRFVGNPRKRNADGTPSINSAEETADFVSIRHNVVIHYDAHTQKSLEAMVRNIGTARNNMRRGKMSQISLGGLRPRMGKPDARRNLLGQADSSDADILINIRSMRTRGPPPAEASSSRIPPKESVFDVVDRQLELAHSHCETAAYQFLRYGDCSAELKSVVETFRSLLELATEEARNLKAEQPEESLQEDMKKESVTVSPTKTAAEPEGGKPQASCTHEIEVDDASAVSVESIDIKAFRASRLRV

SEQ ID NO: 34327 - protein, 267 aa, A.fumigatus
RGSFEPCGEDIAGFEHPNRDKEAQDFWLLSHTHFSRFFAIVNGSVPLSEQVQRSIEKHLLKLSKLHVEMAKERPAAFALLPDSIPLVQSYWTLVVKLGENYSQLGEDGDSDNKTLMEKVGLRALLLIRACSKMAFNPAQTFKYQTPQDKEEKQRSIEQIKSDIFTHEFVVSVMELLVTQFFRFRKADFQEWEAEPEEWERKEEDIAEAWEFSIRSCSEKLFLDLVIHFKDLLIPRLLNVFFSFASKFKLPRTSTNTIDHFPSRSREA

SEQ ID NO: 34328 - protein, 245 aa, A.fumigatus
TSSSHLQVSSSYQGHLPTLLTISPPGPEKRDVLLKDSLYSAIGLASASLEQQLDFNSFLETALVQEVQIQEHGYNVLRRRIAIVLGQWVPVKPDELNRNAIYQIFQHLLGKQDPLNDLVVRITAGRQLKNVLDPFEFSPAVFMPYAQSILQDLMSLIQEVELPETKMGLLESVRVLVVKMEHHVCTPLPTQLNKSANPRLDCAILGPDISFTASFVGAIRRGASHETGHSNFNLVTHTFFEAGLD

SEQ ID NO: 34329 - protein, 67 aa, A.fumigatus
RHNKPIPGATGHYSFGGRDSQKGACWSWKSIFRPGGWKEPDIAIAGNAFETDLLFLLSEIDDDKKHP

SEQ ID NO: 34330 - protein, 101 aa, A.fumigatus
FIYQFSNDHLILKTTLSSHSLASLVPYIAYPYLSRSAPVSMAGFDFSNYNRNAALHAKGVPLPKATSTGTTIVGCIFDNGVVVGDDGAHRIIACDDGLSAS

SEQ ID NO: 34331 - protein, 74 aa, A.fumigatus
EGKIESACGQSIITSDYSVGSIITYHNTIIEDTTHNCCTRTCRFRERHTFGVQSRVAIVIGEVEACHTDGRGAG

SEQ ID NO: 34332 - protein, 240 aa, A.fumigatus
EVGFKGVSGDSNVRFLPTPWPEDALPAPTSSLLAVAPTKGIVAGGARNWLVMASSDAVRKAIGATTGESKVKTKPFEPQATIPFPARPTHVAFASGDNALVLATENGAELVVYQTATLLTGNPQPALGIPMNGTTLRAMAPNPSPSEDILSSLVALVTANGELLIADLKGANLIRGPSGQVLRTGVSSVCWSNKGKQLVAGLADGTAVQLTPDGTQKDVIPRPSDLEGDCHGTLGHYYSL

SEQ ID NO: 34333 - protein, 222 aa, A.fumigatus
SRIVSSIAWLENDIFLMVYTPNATEDDMGQTPASSYYIITRRKGAPFLVQKMPELCMPFGVNRSPAYQFIARLRDYKPHLKDILIVSSTASTDIGLITRSDQPLASDDSAKGTVGLFTTTEVNDDTKRASLPLNEASSDTSVIGLGVDLSSTEPVVSPIQGEDIAESSTPLPNLFLLNNEGILCSWWIIYSDSIRQKLPYHGMVSVSPQPPTVFTRGWKERS

SEQ ID NO: 34334 - protein, 136 aa, A.fumigatus
SGRNDSHSSLSPCPNRHQHPLAPILRAYFRSVIVSPTISTLLGSTANPSPYTPFNRGTSTSVKLVASGFLFAPGVPSPMISASGTNSASSILSNAVLIGGTALLLTIAMGIRREWSPSSSSRRPGNGFVNFSSCAA

SEQ ID NO: 34335 - protein, 221 aa, A.fumigatus
RSPHNVDELLSTCMFMGITSLCPDRFQPTDSWVLTNAPGAMNWLCLQSGIRTIIKLAGPYIQSSIWASAFQQTHQEEVQLYEEGVPQGREGLDPDLADLCGIDDSTTAASMNPYYEPLRLLAAISGLEKNMKNAAQCASFMGRLDNDFLALLRERDPPALLILAQWMGLLCTLSEWQPWVEGRIRGECTAICMYLEHSTDPRVRRLLLFPASACGYHLTYA

SEQ ID NO: 34336 - protein, 241 aa, A.fumigatus
LTRSIKLRSTMADLVILDFDGTIFDTREAIQHAARLTFTTLLPTHEIPYAKARRLMATGAGLSETFRALHPDPSTFNEEKWVATYRSLYAAHEEKFTNPFPGLRELLEGLHSRRIPIAIVSNKAVPPIKTALERMELAEFVPEALIIGDGTPGAKRKPDATSFTDVLVPRLKGVYGEGFAVDPSRVLMVGDTITDLKYARNIGARGCWCRFGQGDKEECESFRPDYAVDSLAEVLEIAVKE

SEQ ID NO: 34337 - protein, 78 aa, A.fumigatus
  UNSURE (33): Identity of amino acid sequences at the above locations are unknown.
IGRDVSGVVNAAWDVGGAQGASGRYRHREAFAXCLQMALMMGMDDDEWEDVTRGGETADVLDKISREERARIRAMVRR

SEQ ID NO: 34338 - protein, 230 aa, A.fumigatus
RRVVSKANWTYKLCQLTLGGIVANNASHDTKDNTGPRGQKPRGGSRSNQAGNSAGTPADHRPLSSQTPIEKNPGNSSKGSSQVCVPASHGSPNVGPEGRTTVESKPTKPEEDRSEENERDVVRTEVQHHTFLTTTEDHRIGEGCHTGSDFDRTTTGVIQNTIFECPTIHIPYPANHRTIDNSSPDEGENHSRKQTSTFCNSAHYNSRSDATELHLCHPGWVSLQCPLNPN

SEQ ID NO: 34339 - protein, 64 aa, A.fumigatus
IPPSDRVIVLAAFSALCLSPGIGNPNYIPSLCPPYNAAVTHPGERVWFSRVLRFSAFFINSTGT

SEQ ID NO: 34340 - protein, 221 aa, A.fumigatus
PLFFIVKYWIRIDDSMDVFAEHGVAGIIGLIFNALFADDAIVGLDGVNTGTGVGGWVIHNYKQLYVQIAFIVASCAYSFVVSAIIAYAINAIPGLKLRASEEAELLGMDDDQLGEFAYDYVEVRRDYLAWTPQKHDQLEDGHEIPHAARYGIGEHSEMLEGQTPVGIDSRGCSEGDSGIQEIKIAPAPRPVAEHNPPAQVQETQVPPAAPQIDEKRDGSSQ

SEQ ID NO: 34341 - protein, 135 aa, A.fumigatus
FQYVLLLVSARFVWDHDSNGIISGTENVNKWFQSGDQAYIIVASAMVMVMIPGLGFLYSGLARRKSALSMIWACMASFSVVTFQWYFWGYSLAFSPTATNGYIGNLRNFGLMKTLADPSPGSPLIPNLLYAFYQV

SEQ ID NO: 34342 - protein, 215 aa, A.fumigatus
MQFCGVTAAIIMGAVAERGRLLPAMVFTFIWATIVYCPMVCWVWNVNGWAFKYGVLDYAGGGPVEIGSGMAALAYSMVLGRRQERMMLNFRPHNVSLILLGTVFLWFGWLGFNGGSSFGANIRATVACWNTNLTAAFGAITWVLLDWRLARKWSMVGWCSGTISGLVAATPASGFLTPWASVILGIVTGVVCNYATKGKLTEFIGPVCLANHSSL

SEQ ID NO: 34343 - protein, 63 aa, A.fumigatus
ILDARLGGEYVCLIGQRCCCATINVLSPGYAIYSSRRSLYTMSKRQGEITAAPLHGCARAPPG

SEQ ID NO: 34344 - protein, 166 aa, A.fumigatus
LTVSTTGKYRNKFTDAVEFRVRSTANTNVVFFNGQLLALKEDSPPYAMDPITLETKGLYDFEGQLPALTFTAHPKFDPVTGEMVCFGYEARGDGTPDVCYYRVSPTGQFKEVVWLVAPVVAMIHDFAVTDNWVSEPVWQESSGDVRLMPEPRLFFQSYPKCVTLNA

SEQ ID NO: 34345 - protein, 224 aa, A.fumigatus
WFQYKNSFPGHTANAYEDKEGHLVIDLGLSEKNVFFWWPDAQGNAPEPNSILSQLVRFTLNPHAEDLALPEPKILHQGNSEFYRIDDRFATHSYRHCYFDLMDPQLGTDFERIRPNLGGGYPLYNSLAHFDNATGQTEVYFPGNTHLVQEPVFIPRKDSTTEGDGWVLALVNNYATMASELHLLDTRDFTHAQAKILLPIRLRHGLHGSWVDGRDIGSQTEQLQ

SEQ ID NO: 34346 - protein, 414 aa, A.fumigatus
  UNSURE (14),(15): Identity of amino acid sequences at the above locations are unknown.
LPSTCAARPGHVCXXLPPRRSPLLNVRHGKEYGLAVWFWIGTGLPQCLRWVWILTQQLPTTLSMTFGRPPAIPDSYVQLDLPVVDSVGEGEPFVDDKTIRHSIQFFNSTMSVAAPLPAPQQTLPQFDCKDWTDADQNPLQTNGQHHRPSLRPILGCGSGPSVGETVGRVLLIENQLFSWVMALPENLRLLTLQGLHEEISKSENQPGPFFSLKFRVILTLRYLHTQILVHRPILVKFLDASLPSGLEHGQERIMNEIGHSSMNKCVESAMGIIDIIHEWFFATGRQRDLVGAWWYSLYYSKLPLSSLASIPVCRWLILSCFGGTAFNAALVIIGATWVQRARQSAHDSPVHQSTNIQPYPSRAVATLYRLDTGNRMVDRCRYYLEQLISVLHLQRKGSNALPVDSMTLIGLHSR

SEQ ID NO: 34347 - protein, 75 aa, A.fumigatus
SQFLLFQKQKATVFTFGKIKPINMNSSIPFNLKAIRTADSIAIALSVTRCLSRPPSFHVGRGANGSEAGSWPARE

SEQ ID NO: 34348 - protein, 427 aa, A.fumigatus
  UNSURE (371): Identity of amino acid sequences at the above locations are unknown.
RLQAARKRSIGSSGSDPTIQSQMAHGSEDCASVLEQFVHDVANLPAEINHLMEEIQAKDKIIQDCRATINSRDSSLQKFIKLNGSLTPNPKEEQYSKVILQNLDRAQQLQDEKIQLSEKACILLDRQIKKLDIKIRDLQNDGVLSNDPPLPSLFNNKDQYRDPPKIFFPDATAADTTSSPLQPTSGNTNSLLGISQRLNQSLARSTSSAALATQGAARSSAPATPSGTTHFQHRQRESSAGAVENKRRRLNASLGTLPAASSNLRQSSLGPGTPKGGTPASSRAGSAGPRATGATKKAATKKVAPHQQLKKIKAHGKATKRSSSASGRVKLTGATKKSPSAAGGDEDEDDSLLSSAEASDSNASDTRRMDXDIDEENEEEEGKRDTKVYCTCRYVSHGDMGACDNEHCPYKCFLGRGWSDRGAGGNW

SEQ ID NO: 34349 - protein, 178 aa, A.fumigatus
RGVLINGSWNKWTVCEFVLLNLRDLGIDSSLWIGLANVRVTDEEIAFLKKQCPYFNHAYLRYLSTFQLKPSEQIDIKFRPVQDSGSDDDLGDIEYMVKGLWVETILYEIPLLALTSQAYFMFTDKDWDHSNQEEKAFRKGCTLLENGCIFSEFGSRRRRDYHTQDLVMHGLCRAAEKG

SEQ ID NO: 34350 - protein, 354 aa, A.fumigatus
QHLSYGITAEDIKADLTAGKGLPEWIFSAYGPGRNAPRQLFGGPQREQSFEELRLRHYEAAAAGNIEVAVQEAQALYAESIKQMEAALNDVNGAVKFILDGINEHPNRIDITEGKAGPASGQGPSPFGQPAAVAQTSAFGQPSALGGAGAPAFGKPAGFGQPSAFGQPSTLGQTPGFGQPSALGQSTPFGKPSALGQPAFGKPAFGQPSFGQTAFGQPSAPGTGTGPFGQPSTTSPFGQISSQNQGQGGGFAQAAGATTTSPFAQAAGGQQPAAPAGFGQTSTTTQTSATPFGRPVQAPSPFGTASGTDSSFWPTRCSPEPIRSCGSTGNSVTFQSTYWRFWSSSSSGSNNLSI

SEQ ID NO: 34351 - protein, 75 aa, A.fumigatus
KVHKIRITLTSRKVASLEKVCSELIDRARSKSLQVKGPVRLPTKTLHISTRKTPCGEGSKTWDKYEMRIHKRLIE

SEQ ID NO: 34352 - protein, 158 aa, A.fumigatus
  UNSURE (110): Identity of amino acid sequences at the above locations are unknown.
RDASYVPKLFADNEHRPEYYIPQLENFDETVYTHEDYSEGTLLLLNPVGAEMVSVGYSSSWGSLDISSLTRSLTMDPSRFCACIRRDPQEEYLRLSIGILYTFLDWVLNXRRGKDGRRLPGIKRKSSLETFWKVFRLVYERATSSKIEKPMNRQMHRV

SEQ ID NO: 34353 - protein, 325 aa, A.fumigatus
YVPYDLNVTDRLATGSVSDALRNLIMHHADTRTFLKYYLHRRIDKDLAAIIRGLDPQEDMMRAACRMSRTIDPKRPQELTTAQSSSVNKQPEIQDLIRRRGELRRQLGRPLARHHGTVKYEVYQKLNQELAGARQRARDALLAQLQEKYDREQPMLEIQRQLSGTKLAETVNQTLDYCEELPAPQKRLIETIFTLPRSTLEDEMRRRTDAIDAIAAYCLFEEGVTCRLARDKRPTGQMVEATKPEGYDVKDQETNAAESCSQSDQLLEAAIRSVMTEKRPRVCFICVGQPNLDIKRRVKQFKEHGDLTKHIRRKHVKPSPEGRSL

SEQ ID NO: 34354 - protein, 108 aa, A.fumigatus
VIRKLAKKHKLSSKGREKSAMYVEDLAKVVETVISTTKKKFGHGRHRIELCLFLQLAGLTTNRPQAILDLKYRHIKVCLLRDPKGGPHRIVIEFTFEFTKEFLGAKDE

SEQ ID NO: 34355 - protein, 138 aa, A.fumigatus
PWTRNTFILPEIIFDPSLILSPHVFLLGLLFADRAFARVDGEEVLMSAEQLLRLRIPDECNELQLTLDPALDNIPVFRQSERTLEGITISLDKALPYSTLLPWVKKVGAIAGFRQVSRPYSLRYGAGKALDNSGSLLF

SEQ ID NO: 34356 - protein, 859 aa, A.fumigatus
SGSRFGNYIGEPVDSEEENQDEELKPQTFAFDEAFGEEEDENQNADQLMEVDGISYLSKHYYLTPVLTSYAEGPSNAVVLHEDKQYYPSAKQVYGDEVETLVQEEDSQPLSQPIIAPVQQKKFSIEEADLPPVHFSREFMTDLLSFPSQIRNIALVGHLHHGKTAFMDMLVTETHDLTERLEKRVGKRKEEQLRYTDIHFLERERGLSIKSAPMTLVLQNTKGKSHLFNIIDTPGHVNFVDEVATSSRLVDGIVLVVDVVEGVQANTEQIIKHAVLEGLPITMVVNKMDRLILELKIPPNDAYFKLKHVVEEVNTIIERTLPGQGERYRLSPEKGNVAFACASMEWCFTLQSFAKMYAETYPQVETSDFALRLWGDIFFNPGSRKFTRKGVEENSKRTFVQFVLEPIYKLYSHTISESPDDLKETLAGVGINLKPSQLKSDARVLLNMVCHEFFGPATGFVDMIVQHIPSPVEGSQRTLDRYYTGPLDTKVAAAMAACDPDGPLVVHVTKLFTSTDATKFHAFGRVMSGTARPGQPVRVLGEGYTPEDEEDMATATISDTWIAETCYSIPTSGVPAGNFVLLGGVDNSIVKTATIVPLRLEDDEEAYIFKPIRHMTESVFKVAVEPVNPSELPKMLDGLRKINKSYPLISTKVEESGEHVVLGTGELYMDCVLHDLRRLYSEMEIKVSDPVTRFCETVVETSAIMCYSITPNKKNKITMIAEPLDDGIAEDIESGRVSIKDPIRKVARFFEDKYDWDKLAARSIWAFGPDEMGPNILQDDTLPSQVDKKLLGNVRDSITQGFSWGTREGPLCEERKSSGCFSIAQSVSFLSNDLLHHFSSPLEPYNVFSCRGTSYIFKL

SEQ ID NO: 34357 - protein, 95 aa, A.fumigatus
STIIAMSEVQKPVEETPVAVPTAEPVEAPAATEAAATEAPAAEAPKETPVENGEATPAAAETTEATAEQPKEEAKEEITPATEGVLGHKGPGLVK

SEQ ID NO: 34358 - protein, 66 aa, A.fumigatus
SKRYLRTLTRHRAMLTSSFFFLVIRGLRFSKRFFYFSNDPVEAKQLSVFQQNEKPAVANPIVAWAT

SEQ ID NO: 34359 - protein, 80 aa, A.fumigatus
SFRLITEVAFRLRMWIDSFVINSRKTQGAPLPVVQIDRSKLNGSRLSTESLGLAWADPFRTNPLIVPKFLGRFQLNFGRF

SEQ ID NO: 34360 - protein, 180 aa, A.fumigatus
RNHTRLDHVLIPQFQQLPQSLGMSIRQVVHLARIIGQIIQLPSLGTFGFRNIYDLPVTEAKRRTAAGLPSLDEVLLVNPFRLATRPRIEALAAHGDHFTALVRGSRMLDSRHIEDSRCEIHDRGKLVCNSTPRRGHAAGEPGQEGDADAAFSCVGFVQTGRGGGGLRPARTVTDERSWLG

SEQ ID NO: 34361 - protein, 194 aa, A.fumigatus
AFVAATFGAVVGHEADKGVVQFADGGQVVDDLADIGIDALHHAGVDIHGGAGLFFLFRCVVGPFFNLVCDDGVRFYVRTDHPQLLEPLQSLQTQRIGSVIVDAAVVVDVLAGRLERPMRGREGQVREEGALILSLVPVGEILKHLIAVSIRRIPPLRQLLHVMVIFHVEGDVARFKESRRVIGPLELRLIGIVV

SEQ ID NO: 34362 - protein, 180 aa, A.fumigatus
ARRQMGKRALEASLVWRSLGRKPQVPFPRHDGVVARIPQQLGQRDDALVQVSLVTGHAALRCGADLGALGSVLPGDVGPFDQVPKTCDVVVCPGHDHGAGGTIAVSPGQEQEGAEMLEKRHLRTSSRSMKVCETYASIESKTIDIWCADFSSEAAYIGEAQVIGDDDEEVGTFIHDSATG

SEQ ID NO: 34363 - protein, 113 aa, A.fumigatus
  UNSURE (53),(58),(60),(61),(63),(64),(67),(68),(69),(70): Identity of amino acid sequences at the above locations are unknown.
QTNPTYNPKSPIHQPLTQPIFITNSNSNTINFTILILINQSKSIPLPNNSKIXQHFPXQXXVXXQKXXXXLPSSPPSSLQISLSHSQHHPVALSWINVPTSSSSSPMTWASPM

SEQ ID NO: 34364 - protein, 329 aa, A.fumigatus
NRTPSSQTRLKNGPTTHRKRKKSPAPPWMSTPAWWSASMPMSARSSTTWPPSANWTTPLSASCPTTAPKVAATKAYPMSRVGHAPSPEYTTNSLEILAKPTPFICYGPRWAQAATAPSRLYKAYTTEGGVRVPFLARFPSSVAAARSGITDQFATVMDLAPTILDMAGVKHPAPTYQGREVVPMRGKSFYPWARGESERIHEKDFIQGWETCGRAALRFGDWKIVYIPKPKGPERWQLYNLADDPGEVHDLADAHPERLRQLLKLWDQYVIETGVIPLNPDLGDFLEATEAQMPENAWMEYDYWKKGARDEPEKFMRKPQRFQRVVKQF

SEQ ID NO: 34365 - protein, 86 aa, A.fumigatus
RMDRLHTGREKKVLHRHGCLRRHGGVHRCQCRQGRPLPGLHRRTGQHLCLLHVRQPRRRLPLRRPTPCPEWVMPHLQNIRQTAWRF

SEQ ID NO: 34366 - protein, 108 aa, A.fumigatus
  UNSURE (15),(20),(21),(22),(25),(26),(28),(29),(30),(31): Identity of amino acid sequences at the above locations are unknown.
PIQIHSPSQQFQNQXTLPFXXXCPXXKXXXXSPLISPLLPSDLPVSFPASSCCAIMDKRPNFLVIVADDLGFSDVGCFGGEIRTPNIDRLALNGGIRFTDFHAAAACS

SEQ ID NO: 34367 - protein, 362 aa, A.fumigatus
HFSTLLLLTWTNRDSPTRAMIMTGTDHHIAGLGNLIEWTNISGQNGPKGSQISTAPQRGMPGYEGYLNERVVALPELLRDAGYHTVMSGKWHLGLTPERSPYKRGFERSFAHLPACSNHYAYEPQLQGSDDTPTFLEASYIALHMEDDHYVKQLPEGWYSSDGYGDKMLQYLSDWHERKDERPFFAYLPFTAPHWPLQAPREYIDHYRGVYDDGPDALRLKRLQRLKELGMIRPDVEPHPVVADEVKEWTDYTPEEKKKSCTAMDVYAGMVECIDANVGKVVHYLASIGELDNTFVCFMSDNRAEGCRYEGLPHVQSGSCPISRIYDKQPGDFSQANSFHLLRSALGAGRHRPVPSVQSLHN

SEQ ID NO: 34368 - protein, 188 aa, A.fumigatus
RPSGPGGAGSQTTAPTVPEGWTTTVTVCTQCAAKPTTVTWTLPVTETGSTSTDAVPAPPAATGEGSNPTQPSGASPTGGNGSFSEEPVPPPAVTQVSTSTEIVTLVRPTSSRPLILGTGTVHPSSTLAVKPSAKPSGQNSGSSSHVPIPPSYTQEAVSPLSTGAASRVTGLGHGLVLTVLTLSAFFVL

SEQ ID NO: 34369 - protein, 128 aa, A.fumigatus
LMRTVELLLDEVSFDHERDHLIFAGDMINKGPDSLGVVDLVRKYNASCVRGNHEDRVLLLRHDMDASNTLSPDSDDGISPDLFFGLKKEDRALARQLSNEQVQWLDACPVILNVGQIPEMGQVVVVHG

SEQ ID NO: 34370 - protein, 357 aa, A.fumigatus
SSLNRHALATLADVGTPKVHCIRKRLGQIVPWVKFDCRNELFGGSAAADLLAPWSWDDSDKGRKPDYVLDCIDNITSKVELLHYCHSNSIPVISSMGAGCKSDPTRIMVGDISLSTDDPLSRSTRRRLKLLGVNSGIPVVFSTEKPGPGKASLLPLAEEEFAKGQVGELGVLPDFRVRILPVLGTMPAVFGYTVANHVICDISGYPNDYNVGGKGREKLYDSIIASLQGLHERLARAEAGQDLIGLRIPISKDDVGYLVEEIWRGRSAISNLTNRLILVPWQRPARGFLPDPEWEKEGQKFIPIDLKNLVCMTKEEGARHEREVLRGGKDVTEVYDPKVLEKVKWHMAEVEVQEKFR

SEQ ID NO: 34371 - protein, 696 aa, A.fumigatus
VGGDPDHVIGLEFWPVYRRKPFQDYRRRDYEKGGYRRMVRLEAEISSFQKDGHDLERHGERIRDIEEFRSAAERMEGSRDLGAQLFTALVRALGMEARVVANLQPLGFGWTKAEAYTPRPKVDEGPVEENGGSEPIVGLESDSTDSESDPPHKYNPRKYDKDLPFPIYWTEVASPVTHEIIPVDPLILSNPVATTPELQAAFEPRGAKAEKAKQVICYVVAYSSDKTAKDVTTRYLRRRTWPGKTKGYRIPVEKIPVPGRKRKFFEYDWFRTILRVYERSEENRTKVDEIEDTTDLRPNQPEKKQVKEGDTLQSLRSSTEFVLERFLRREEALRPGAQPVRTFVSGKGDKAKEEKVYRRADVLKCLSAESWHKEGRRIKMGEAPLKLVPIRAVTLLRKREVDEMERETGEKPKQGLYAKYQTEYIIPPPIRDGIIPKNEYGNIDCFVPSMVPRGAVHIPWPGTVRICKKLGIDYAEAVTGFEFGSKMAVPVIQGVVVASENEDLVKDAWRAEDAEKRKKEQLKAEKRILQTWRKFLFGLRIAERVREEYGAEDGDMERESHNPFASRQARSQARPPAVPEALHDWHGEPADRGGGFLLPGDDDGDDGDLVVEDHHPRQAHPPVQQTEALSQDEGEEGTGYDAVSISSDGPGDLSSPQQISDSEETEPSVSASDYEPPSRRRRTRNSGQRTRGKLSQ

SEQ ID NO: 34372 - protein, 111 aa, A.fumigatus
TDFLDNSPNSQQDIAFEHQHGCELPPELTKNWPLGLDRIKELWTANTEGHLLAFLCSVAEKYEPGNSITQYFLFGPRAFHILQPENVEAILSTNFKGSHGYLHQFYLSHAI

SEQ ID NO: 34373 - protein, 140 aa, A.fumigatus
  UNSURE (72),(92),(133): Identity of amino acid sequences at the above locations are unknown.
GSEVFVFTPPGPLNNREAIRTTILPTGGGPDANRLILVRKGEAHVFSQYVNSRKKNIYGPDAYCFRSGNMVXRQTGSYWGGIFSFPRKAFGXALGRISPLIGISYPICEAYAKLFHPSSCQRGHRINPFWRRXKPPPLGP

SEQ ID NO: 34374 - protein, 81 aa, A.fumigatus
LHPKSLEWKDGDRDSWGTPLPFAGVRSEICALLTFPRACYAMYDKAPPALSDELGVWQKKCLSNLLPDLFPPDVVYRSKGV

SEQ ID NO: 34375 - protein, 73 aa, A.fumigatus
VNSRLLVHHEQAMIRLREEIASVMGDSAHPTKEQIKKMPYLSCVIKESKYSFPSIPSPVAKEVRSSSLPPPVH

SEQ ID NO: 34376 - protein, 262 aa, A.fumigatus
ARQQHHSVLFIRSESLSHFAARERGGDSFYQFQRFAWLPASVLPFSRHLDYGFGARAAIFAPLLGNGIFTQEGPAWRHSRDLLRKQFSRVQNRILEHFHEHVDNMVARLPLDGVVDLQPLFFNLTLDIATALLFGRSVYSLKAGTDQDADNRLFAESFNIAQDGLAKRFRIAPWHFLYNPPGFRKACGDVHRFLEQYIDQLDLENSEDLDDKTYGFIKRVAHESASRQHLRDQLLNVLLAGKDTTACCLSWTLYVALVEEFH

SEQ ID NO: 34377 - protein, 87 aa, A.fumigatus
ERSGAVSPRRLYFRRKVSSKMFSTVKLEILTFISLKITLEDKDLVRDVQQTFSAFGPCHVKIKRDKRKIPTAFVQFEVSTSWLLSSS

SEQ ID NO: 34378 - protein, 377 aa, A.fumigatus
  UNSURE (3),(4),(15),(24),(25),(27),(54): Identity of amino acid sequences at the above locations are unknown.
HRXXKPPAKRSKGVXRDIIPRERXXLXTRLADLLERDLDTIAAIEALDNGKAFXIAKGDVTLSANCIRYYGGWADKIVGQTIDTDPGCLTYTRHEPVGVCGQIIPWNFPLLMWAWKIGPAISTGNTVVLKTAEQTPLSALYVAKLVKEAGFPPGVINILSGFGRVAGAAIAAHMDIDKVAFTGSTLVGRQILQVAARSNLKKVTLELGGKSPNIVFPDADLDDAIKYVNLGIYFNHGQCCAAGSRVLVHESIYDKFLALFKQRAEENKVGDPFHPETFQGPQVSQVQFDRIMGYINEGKKAGAKVVTGGARHGEKGYYIQPTIFADVHEDMKIVKEEIFGPVCTVQKFSTEEEAIEIANNTNYGESLLYSVLWVIRC

SEQ ID NO: 34379 - protein, 241 aa, A.fumigatus
RTPVMSRWASVARSSHGTSRCSCGRGRSDRPFPPATPLSSKRRSKRRFPLCTWPNWSRRPASPPVSSTSSRDSGAWRALRSRPTWISTRWPLPARRWWAARSSRSQRGATSRKSPSSWAASLPTSSFPTPIWTTPSSTSTWVSTSTTANAVPPARVSWCTNPSMTSSWRSSSSARRKTRSATRSTRRRSRVPRSLRCNLTGSWDTSMRVRRPAPRWSLVERAMVKRVTTSSLPFSPMCMKT

SEQ ID NO: 34380 - protein, 158 aa, A.fumigatus
AGGRLWPDHPMELPAAHVGVEDRTGHFHRQHRCPQNGGANAAFRFVRGQTGQGGRLPPRCHQHPLGIRARGGRCDRGPHGYRQGGLYRLDAGGPPDPPGRSEEQPQESHPRAGRQVSQHRLSRRRSGRRHQVRQPGYLLQPRPMLCRRLACPGARIHL

SEQ ID NO: 34381 - protein, 88 aa, A.fumigatus
FNPRFPSFYLTLRHTLPHRRRPDTMDTEQGLKNHTAKTSPHDETAMASLTTIPTSVTLSAEQFEKLYLSPLTQRQGMLSKQMGNPTPL

SEQ ID NO: 34382 - protein, 355 aa, A.fumigatus
  UNSURE (313),(340),(342),(343),(352): Identity of amino acid sequences at the above locations are unknown.
RLTVVRVIGNLNGLLLGAKLLHRTDRPEDLLFDNLHVFMHIGENGRLDVVTLFTMARSTSDHLGAGLLTLIDVSHDPVKLHLRDLGTLERLRVERVADLVFLRALLEERQELVIDGFVHQDTRAGGTALAVVEVDTQVDVLDGVVQIGVGKDDVGRLAAQLEGDFLEVAPRCDLEDLAAHQRRAGKGHLVDIHVGRDRSARHAPESREDVDDTGGEAGLLDQFGHVQSGKRRLLRRFEDNGVAGGNGRSDLPRPHEQREVPWDDLATDAHRLMTGVRQTARVGIDRLADDLVRPATVVPDAVCREGNVALGDXESLAVVERLDGGDGIQVALEEVRKASXEXXALPRDDVPXNTF

SEQ ID NO: 34383 - protein, 138 aa, A.fumigatus
IPRLTYLMASSRSASGKTMLGDLPPSSRVTFLRLLLAATWRIWRPTSVEPVKATLSISMWAAIAAPATRPNPERMLMTPGGKPASLTSLATYKAESGVCSAVLRTTVLPVEMAGPIFHAHMSSGKFHGMIWPQTPTGS

SEQ ID NO: 34384 - protein, 79 aa, A.fumigatus
LYVHIAHWQEIVCGVLTIILPILIDTHKSRNLRDPNYSYRDFSNAIHTCQTSMLLSPVCLTSRGQSHQCWFHVCAIECK

SEQ ID NO: 34385 - protein, 63 aa, A.fumigatus
YGCLILKVVYALQRVSFTYPQKFSVPNLCYYRWGKRCTGSKCRVTVWAETLRNPTLEDIMTKE

SEQ ID NO: 34386 - protein, 153 aa, A.fumigatus
QLLNQYECSAHIIDVWVETVAQGRSNVAPQKLPWEMMRTLITETYGGKIDNAEDFQVLDNLVNSFLTPAAFEVDYKLVSGVEKDECLALPGETSIRDFVEWVKRLPEREPPTYLGLPANAEKLLLVGHGNKMISDLSKITTLLDEGEQLMIDG

SEQ ID NO: 34387 - protein, 267 aa, A.fumigatus
TCGISPLCKDIVPAAERFIEAVFGREFFEGSSDLKDVVEQVAATTPISLSSSPGFDASYKVDALVERMHATCANIAMGSNEGLESADKAISNAATAGTWVLVKNVHLAPSWLQSLEKRLESLKPHKDFRLFLSMESSPKIPVNLIRASRVLMYEQPAGIRANMRDSLSTLMERAGKPPVEKARVYLLLCFLHAVVQERLRYAPSLGWKGFWEFNDSDVSEHHKGIHHCDPTNNFLISTNARLISSMSGWRQLPRVDPMLRLRNSLGK

SEQ ID NO: 34388 - protein, 217 aa, A.fumigatus
  UNSURE (211): Identity of amino acid sequences at the above locations are unknown.
GQPSTSAPAKGKCSKPHDPKKPLIQYALMIDAGSQGSRIHVYRFNNCGPSPELEDEVFFQTEPKKGGSGLSSYKEDAEGAAKSLDPLMEVAMKNVPDEYKSCSPIAVKATAGLRMLGPELSQKILDAVRNRLETVYPFPVVSKEKGGVEIMDGSDEGVYAWITTNYLLGKIGGPDETPTAAVFDLGGGSTQIVFQPTFPNSKSGGMSSHTXAGRIRT

SEQ ID NO: 34389 - protein, 345 aa, A.fumigatus
NKIDVRNMAESQGRKVQDGDKTLETMVLDPHAVAVVPHLLWLGFLHASSVWDRPVVGLTTSLWSKALLIYTNRFQLSPLNQEKSFILFICFVHTNSGYLCYSFASCHRTRFARRPILDMKHIRGLISITQALRLTFLPPFQTTHVQSLRYNNALRGTQLRFLQSSRRLPSQQPRQTQIRDEDIRSEYIQIVNENGDLEPAMKLRDVLRSFDRSENFLVQVSPALPGRPPICKIMNKMAMREHERAKAKAAHATKTAVKQIELNWAIDSHDLAHRLKQLTNFLEKGRRVEIILTRKKGKRAPTVEEIKNVMDSVLQATKEANAMQIKPMEGEPGKHVTLYVKKKDA

SEQ ID NO: 34390 - protein, 173 aa, A.fumigatus
NPTNDVNVTDNEIGLEYGKCYRIQNVCGERLGYQQGASYQYGNPDHQVFQVCLTATGNCLREGKADQKVESRNLFYLYDTRGSSWSKGPTNIGFYGLYLYPNIYPNRPDLMARFQAWKDCDEVDEGEPCPLAVNLKGAYNNWNGLANTPAYGYVMQVANAYETVHWVFKEVKN

SEQ ID NO: 34391 - protein, 71 aa, A.fumigatus
WSIISIVQRPHKPRLITAVQPAQSTKQAREATPLAAFQWSTFIFTCAIIALGTFAIAETCDELSTVRSITA

SEQ ID NO: 34392 - protein, 740 aa, A.fumigatus
  UNSURE (740): Identity of amino acid sequences at the above locations are unknown.
AKKLLVLSPLVFAIEHYLTGPTLTRLAFCQLCAVSTVGIAATGFALGRIDRPSSKQGRFRRKTLLRDNHAPTANNTVSPAFSTTSPDSPSFPSTVCDVNTHHITDPSQPHSNVASPELNSGDSQSRRKSSFAGVIRRRRGHTMTSPPSHLKEENDTPSHSRRPSSSWLRRLSIQPQESRLSNNGPLSPSSNDPTSPGLSRPSSQRRVPNKLVKRPPSQHSSGLPLSSHAPSSPWAPSQLRRPATSYQRSEVLRHRATHSLNFEPSSITGPASHSVEAGASIDIEEGAWQPYLRPSLEGVTERLARRLSTVTRPKEQTLRRILPSPDALPALLLATSITVKEPAINITSNEFAPASPVQFRDPFKLDDPPHARDAPSVVESNSGPSSIVLEADPRSPEKGSSAAASKQSNSGPPVWSRRRAASTSFSELPNSKAATSVSRRLHGKRNITDPNIFRRPPDTFKAGYPNFLTAKIMRSRRSVTPSYLREYRAELGRCRDYGNRPLTSDAIALSASQNAFFRASDLTFLWSVRQRPRRHSIAASDPASSAIGSEDTRIFTSGDEDESDFLTDTAFDSIRTHFTIGSISGSRGLRIETMFDKNSVESLANHEITIEALEPRGPRMPDGLTSAKCDMGIDSDAVSGSTPRTREIAELDDSEDNRISFPSDLSEDEDARSTVAALPGETNSPFIFPRSPLVASNFYPEGNDIRAHVHSNSSHASDESSPRGWKDPSGCYQKTPPPPX

SEQ ID NO: 34393 - protein, 397 aa, A.fumigatus
PVQSGSLEGKQKQIPLSVLYKRPDLRHIGSIQNPTSDLFVTVQLWSDSKQLGVPMQTSYKSFKSVRAWNEWLQMPISIKDAPLRCQLAITIWDLSPFGGQGADGHYIPFGGTTVPLFDEDGKLKTGRQKCKVYRHKTADGFSSTTTPSTPPPQATPRTMPRTLLAPSVDEMELERVEVLIKKHEMGELPRIDWMDQMVFRQLEKLKLNAEEAARKRAIRLKAAKNKAPETPGADGVNSDEEEIDDENFVLYIEFPRFDHPIVWTDHQYPPPPVSSYSQNASANPNATLKPVPEVRFGPGIEGADGDGVIRIYDPEVGQTGNPCEDKHRRLIRSHRTGIMDRDLKPNPKIRDELNVIVSYEPTQDLTAEEKDLVWRFRYYLTREKRALTIFVRSVNWR

SEQ ID NO: 34394 - protein, 140 aa, A.fumigatus
VTTFDNGTYATKNTAPEFSVTWQFNPGPATQPVHAFSNVMIDDGLPISLEKIQHLNVDFHWTYGVGNTPAEATNEAELTAASVNTNVAIDMFMSQEEKVKDSADYTHEVMVWFAKFGPAAYVIGQDDGIVATKEVNGTIL

SEQ ID NO: 34395 - protein, 61 aa, A.fumigatus
TNFITNQLHLLSGTIPVKHMTSLLWSLISLSKNSNYENNSILFPCTLHLPYVYRYPKVNVC

SEQ ID NO: 34396 - protein, 146 aa, A.fumigatus
RVVPFPVLAYYVCTISQTVYDMSTLQISEDNPFLTLITETNNDAVSNIQRFVIRDYVKPLYQDQLQSRYENHRVNRNAQQAAKILAPDFAGWDLDEILMRLDGPTKEEGFVDPRNCLVIWARPPSPIRDLVEFVQSELRRVAPSKF

SEQ ID NO: 34397 - protein, 78 aa, A.fumigatus
RRWNTEGESLQKQTDGENGYAVQSGGPAGINMCIQAVMEYKYPMCFWNDSCEFLSSGLTQLVSMKYILRRGEGRTLPT

SEQ ID NO: 34398 - protein, 231 aa, A.fumigatus
PGTRTCSLVRPYAHVLVGQSLMKSSERDGRDHVRGPEARASQFLYGTSTQPQSQQFANNSNEVQVSAGEEGISVGSAAALTPDDVVFAQYREAGVFQQRGFTLRDFMSQLFANRNDYGRGRNMPVHYGSNYPRTVSTRPPLELVVNPGSYLTQHASTPSPPHSQPRFPKPPAPATPRSSKPSKTPIPRPASVPGTSAKAPPPKATSSPGLKLRRPRGSGPVLLHLAETTGL

SEQ ID NO: 34399 - protein, 74 aa, A.fumigatus
TVSILESTPKPLRLIFKCNDNSGRRGWTESRDCCHRLSCAYVWKDYSAGWLSGRVNDSIYINGSGSIQDAHKSL

SEQ ID NO: 34400 - protein, 88 aa, A.fumigatus
HDVGPDANRVLRISPRIIRNQHLSAPAPKKGTVILPSISINEILLDCKNFSHVVKIYGPLTAAGAQPADSPPFRQAMGQLHLSAARIG

SEQ ID NO: 34401 - protein, 84 aa, A.fumigatus
RKYGNRVRFPGAVNSKFTTEMSFINPAETSSIPTYRVMNSDGVMLEKDRKSLDVSNEEILTWYKNMLTGETLCSCTGWTITDEK

SEQ ID NO: 34402 - protein, 110 aa, A.fumigatus
HAGSLRLQLPPHSKYPPAPRTGGQPGIISDTTCKHTISSPLATQIPQASGARYAPKLQALQNPDTPPRIRTWYFREGAATESDFLARPETSPPTRVRPRPSSSGRNNRVT

SEQ ID NO: 34403 - protein, 94 aa, A.fumigatus
CFDSLEDFESTWLVFDGLDTFATITFCDQHVGSTDNQFRQHHFDVSQILKECKQDPVLRINFGSAPNIANTIAKSPDAEGQGTRHHSCHPELVH

SEQ ID NO: 34404 - protein, 407 aa, A.fumigatus
RFGNSAARSLNGCWTCRVRKKKCDETRPVCRSCSYFGLECHGYGPKPEWMDNGRQQKEQAAKFKRIVSQRKASNRKDRQSREVRSSLDCNQSLGPVSTGDVPTHIASSATSAPLPFHDCNDVGGHGPFFDTILSSFMDPTWGPLPNYDYVATAAQSLMKEEHHQHPSAFFRNMDSTQSSLSPGSSGDVSWLAPDMMGLHEVKAVRSAIVQHDEKGHSTNERPFSMGNEWAWDSSSNGNGFSSHASVSDYAAGKPTAPGQFVASGDDQKHRAPPEALIEPLRQRGAEDTLFMHYLDRVFYIQFPFYLSRNPRGRACLFSIIRMVKPAYLATLALGERDLLSFHPQQGDVAISLTQLRANGGYHDLAAQATQRLLQESHTWNRSAYMVHNIESLASILQLLFWEVCHLH

SEQ ID NO: 34405 - protein, 142 aa, A.fumigatus
TQNKRGQGRSGSNSSNNASGMSFMEAIFLDDGLSEEDKKVKSEAAEILTGLVGNSAVVYDLTSASTPTASSASITSMKMEDAAESFSSAFGDAVIQEGRGIGHVTNGDIDVPAIEHDGFDMAGLYFHGHGGYGMDDIYGGAA

SEQ ID NO: 34406 - protein, 254 aa, A.fumigatus
SSSVLGGFLHALMLSAAKKFIETELGDGRFPDPVHAFVQFLSMVPPGPVSITCKFLRVSKRQCVVNVELVRSSAALWKKPELPATVGIFTYGDLSKERGLSQASDPALRIPVPPRETECVTIDDPVVDSTPVTRKLHWLAPRSANGLWGHRLGGHNREVWISFRDGSKISDCLHLALLSDMVSPHGIYHPVLKADQLTQTAASACRNPPTRLLQPLRTIHALHFRGVQATARPVHTVGDDPVEFAHGVQWPLRC

SEQ ID NO: 34407 - protein, 450 aa, A.fumigatus
AGPSSPVVKTLGQSVSVDSIRQRAYMAVGNALNEVDLETLQVISQQRYPWSIFALSQETDYSVPLTVATTLSIHIHDSRLSASEEEAAINLRCEEPVTALVPDSQVYARPDSPLLQLQPDGRPPYRIRSPDPSQKGADYAPLFQPGPLSLLHPPAPHVNTILLAGRFPSILQYDRRFFPRLQNTVHSGGRLCGLTSMPAPHFPVSSGSTYPHSHKVVACGEYNGKGSLELYELTPSSLNSGDSPSEVTSNMNSVCQNRQSAAKSKVLSVESHGTRIAYSDAEGNIKWVERDGRIDVRCFNINSYLQQARSQNNRQSSLQTSDAFAGDGDEEQEEEGASGLWRSVFRSQTDGEVARKILPTGGNLTGDELLVWTGEQVGRVVLSTSSGDNQGEEDDDDEMSIDGDLDDSTREELRSRRREHQRQEREYARRMRRALERQADEVRRMRGFGL

SEQ ID NO: 34408 - protein, 208 aa, A.fumigatus
KIDDDQESSYHMEQSRSSPKPVARRRRPPLSCTVCRRRKLKCDRELPCGQCTKSKTPDQCIYVGPQAGSLSSVRRAESRDTTANDRTRASTDCGSPVYNGVYVFDSKHQRFPTRVTKPKSHSDEVQELRTRVLTLENALAKASSIQTPDTLGTVPSIVSELGPRTAGDEHYISEDIRSLPCAFFRGKKSNTRFCGRSHSFLALSFVSC

SEQ ID NO: 34409 - protein, 577 aa, A.fumigatus
FRDVGDFLRQRKSKHKKDSVYGSLKKIQKEMWLKQRQEQQQRVRQELVSSFVDLLPPRRVADKLVQLYLSNFETTHRILHIPTFLKQYEEYWIAPQHPDMVFLAKLLLLMAASSCFYGPTKKINDKDTLASTAIHWIEAVQTWSATTIGTRNTNFDMLQIHCLLLIARQAIASDGDTIWISSGSLIRLAMAMGLHRNPLRFQKLSRFWAEMRRRLWATILELDLQSSMDGGMPPAIDLEEYDCDPPSNYDDADLVESMTEDPPPKDPDIVTRSSFQVLLSRSLPVRVHIAKLVNRLRFTISYDEALLLSEQLMRSLNDALEVFPSDGYPSHIPGVENPAFTKSYFIFLIRRHLLALHRPFCLSIMRTPKFSYSRKICLDSALDILSLLEPSLDIAETEPQPHLGHLTGGMFREELLNAAVMVCVELVLQADEYSRSKSMLPGQSSVLSSLNDMEESQQAVLVRAIENTLNVFGSRIAPGGRGCKPYFFLSLTLASVKARLNGEDPFVAMDQVVTNVIRDYHLLMSGMPWADVRKQDENSTKDVSDCRFITQRLFTDTQLDQYSYTWAHCRYAVRSAL

SEQ ID NO: 34410 - protein, 253 aa, A.fumigatus
RLQRDGELDAEKPEAGKDMLSRWMAIHLSDPEKLTTRDVIVHLSTNVFAGSDTTAIALRAVFYFLLRNPSVLAKLNAEIDNADREGKLSTPISYRETMNHLPYLQAVLKESMRLHPSVGLILEREVPKGGVTICDRHFPGGTIVGINAWVLHRDARVFPDPDKFIPERWIDSDPQHLKKMDQSFFAFGAGSRTCIGKNISLIEMHKIIPQLLREFEIRLHSPEKEWKTKNVWFVQQEGLVCDLVCRRDAKCYH

SEQ ID NO: 34411 - protein, 83 aa, A.fumigatus
LLYLTRREIIFLKTIFAFCLHPLLPPFSGFQPNNTSTHISSNNIIGNTRVPLAGVRKICVSGPGSQFPSEKPGIPLTSGSNWR

SEQ ID NO: 34412 - protein, 147 aa, A.fumigatus
FLEGIFAVWLLERDTLIVVGHIGTAILLREGAEWSATGSLTGGHCLLKCSSCATAKASTASETASCSEATSSTGGGGGGAKAPSRFVAEQSTTSCSSASKASSGSCSACRTEATKSSTARGGSSAAEETTTGCCASAKTASTILAPE

SEQ ID NO: 34413 - protein, 69 aa, A.fumigatus
RPVSLIRPLLPLDYLILLKFFCFSAALVSIGCDDVTRHIRHASHPIYIARAGYSRSIFPQGNKKQSHNL

SEQ ID NO: 34414 - protein, 83 aa, A.fumigatus
ILNPQRTSSIIMSFGGFGGFGQNTQQSSGFGAGSGFGSTTSGGGRSCDPSLCCGITHIPPVIRDLLVLPRLLGISIQDYAGAS

SEQ ID NO: 34415 - protein, 73 aa, A.fumigatus
TATGSPLNFLGCLPSHFALGAAFFLFFLTSARHIFPSIPFPPQLLAIFPTPIATIPLDTTLSGFDGLLQSVLS

SEQ ID NO: 34416 - protein, 561 aa, A.fumigatus
  UNSURE (330),(339),(345): Identity of amino acid sequences at the above locations are unknown.
YGSRVLSCPGSLLPRASWDPCLRTDCFNPLCFANFFFFFFFFFQKAIHLQVLTWDSFLGFGTNTQTQQNSLFGGQNRTGGFGTGTTTGGSLFGGGTSTTGGTGFGGFGSTGTTGTTGGFGSTGTTGGGLFGNKPAGGFGTSTTTTGTTGGFGTGGGFGGGTGFGGGTGTAFQQAVPPCEGTGSTPFSPFTEKDSSSNVTNHYQSISFQQPYSKYSFEELRLGDYNQGRRFGNGSGQAGAFGTSAFGGSGFGAQPSSGFGSTSSPFGASTSAPSGFGTTQTTGGFGSTSTNPLFGAAKPATSLFGGGTSTTSQPSLFGGTTATTGGFGSTXTGTTGFGTXTGTGGXLFGGSTQQQAKPLFGGGTGTATTGTGTGFRGFGTQNTSTASPFGGTAATSSPFGGQQQTGGTGAFGGFGQQNQAQNQTQNKGLFGGFGTTTQQQPSSGTGLFGGGTTGTTGTSLFGQNTQQPQQQTTGGGLFGGNTQQTGTSSLFGGNQQQGQKSLFGGGTTGTGTGTSAFGGFGGTQNQQTGTGGLFGGGQAQQQQKPSLFGGSTVFTTGLEGAV

SEQ ID NO: 34417 - protein, 193 aa, A.fumigatus
LIFNKGVNESFESSSSGVAKETGRRLASRSDSSLVLAKCRTWGTLPDHLEIPDVSIPVDGKGKSALADAVLPETFTVDSCKLGDEFVDTSIIPGLRSKVIGKGVTATVKLMHRKGTGKQQYYAVKEFRRSRKENLQAYDRKVKLEFSIAKNLHHPNVVETIRLCSHAGRWSHVMEYCSQGDLFTIVQQRYLYF

SEQ ID NO: 34418 - protein, 90 aa, A.fumigatus
WNTAVKGTCLQSCNNDIFTFESQLCLFKQLFQGVAYLHSIGIAHRDIKLENLLLTQDSHLKITDFGCAKFFSELRRDLRSSQRPGRIRMG

SEQ ID NO: 34419 - protein, 64 aa, A.fumigatus
GRTSRHHDIMLAFPHQRYMTNYSAYIDPMCEHSAISVAVKEALKSDILLPDSMKHGVDRLSQRG

SEQ ID NO: 34420 - protein, 109 aa, A.fumigatus
QLLSAFNAIVSASVVLLDIAYGMPIVVNCLRGRNMLPERPFVLPNIVGWIANAVSCFYGSFRDENSSVALGLPCLHFCHHCALLVPSRPPRIGQQHEYVLMHCNAGLSS

SEQ ID NO: 34421 - protein, 65 aa, A.fumigatus
LTPLHLDYCVAAFGIIIVISAIQWVIDGRKNFTGPRTDMDILTGQLPVGHYPVDSNAAHVVPQGK

SEQ ID NO: 34422 - protein, 91 aa, A.fumigatus
VPPGLHAFCNHFHHDNKQPYDLRFCKVITDQTIGLWICADKPARDGGLPASRFFSKVHPKLKVPLNSLYLNLALVVIFGCIFLGSTRLVAS

SEQ ID NO: 34423 - protein, 925 aa, A.fumigatus
DKLLLAPLFVAHIYKHKDREDYAEDVVTATGLKVRLDSLKLDVHQRREQIKTVAKGRLKQTKTSAMRINQGQLDLQAADFRAVSVSIEGTNLDDIQKNRDDIISSFQQPVPSVDLSRFTIPDQNLDWVDMDDFVELDWILPQESNPKTHILPLAFTPRFTYFRQTDHGDITPDQTGYSPFGHEPTHDCVMSESNEPRRVQMELIRDRLATVEAQIRNFDRQIGEQELRMAKDVDHHSDLKKEHDDFIRQAESLARRRAFLVTGLRRLEAQLSREEKTPMDKKPENFASDSSFRLGADSDSTNDGKEADLDGLYSSHNDEYASDFNNRFLIHNMQLKWNNSLRNIILRYIHQVSQRRGFVYYMSRRAVKFILDIVEEQNKNNQRRAKMFKDSSRRPSNADTDEDSVEDRIEQLLNDTKRFVSAEEQESVDSVTQTQPDSDSSSENISPEFTPQNSYYLRLIAPQIQLQSAKNQKSVLLVAASGMQLKVISIMDKERVSDDVSGLVQRRFSLDMDGAQFFVATQKNLMNHLQFYAGNKYGNAPGSAWPPWVTLEAMFDFELNPFGFSRIIQKTSASLRYDKYNNLRLKYNEEVAKGQSKHVGPDGQETRMDHISVDFPHFRAICDSAEYYSMYIIVLDLLLYSEPLEKVRNERLERILLTSDFSDLRGAPEMVFKLQSRIRQLEEIKEHFQINAKYLDKHGWEDRLVLEKDLAQCEDELFFLMKAITTSQRRIEPTTSGANGILRWKISASEVVWHLMMDQCQPLVEFQLRNAEYDRTDNSDGSNHNLVAVERIYGLNLLPDAIYPQIIVPYLDQAKNLDEPDENMIRVKWHMLEAVGGIPVLDDFEVSLFPLKIQLERELGQRVFEYIFPNVRSNGFDGGFSPFMIKNMKPLDVSESEEDNDSPSPPPSAQGASDIPTEVFNGARR

SEQ ID NO: 34424 - protein, 465 aa, A.fumigatus
RSWRGRIGGSTLNNGDSSRPATMSSVTNPKPKQSELLRELEKFSRYKVEQLVLIKEAKLLISLSGGYVSIHDLQTYEFQEQLTMTRGATTFAVTSNIVHDPETGVPSIVSRLAVAVKRKILLWTWRDMELENDTAEMSLASGIKTLTWVSGTRIVAGLSSNFVMVDVETTNVMDLVGPGSIGGLPGQETGRLAGVGVASMSYIGIGGTAPKPLATRLSEGQVLLAKDINTQFIDIDGNSLGRRQIPWSHAPSDIGYSYPFLLALHDSSKGVLEVRNPETLSLLQSIPLPSASLLHIPQPSISLAHAGKGFLVASDRTIWRMEALSYDTQIDALVEKGYLDEAISLANMLEDALLTDKYGRLRSIKLDKAQTLFSLQKYLESMELFTEISAPPETVIRLYPRVIAGDLSSIPEEQEGSEAGTTDSQPRPEQEQKQDTVPATSDDAALARTPPPYTLGEVPPSNEDR

SEQ ID NO: 34425 - protein, 395 aa, A.fumigatus
RAIFRPFQKSKKDRRPVRRIVSQDPNRSKSKTQSLQRRMTLLLPERPRHTPSVRSLLRTKTDDTSDAGSVRSKLMEDARIDKRLEGKDLKLAVRELQAYLADVRRRFQRFLNPDGSLKMEPTADAVKDEFTESVMKLLEMDKDQGEDGFGERLRAKAKLVDTTLFRVYMYATPSLAGSLFRIANFCDPDVVIEKLEESGRQNDLIDFLYGKKMHRQAVELLKKFGQAEVDEETATQLQGPKRTVGYLQNLSPEHIDLIIEFAEWPVREKPDLGMEIFLADTENAETLPRDQVLNFLKGIDVRLAVRYLEHVIGELNDMTPDLHQNLLSLYLDRLEEQKNKEWEFASEEDRADWRNKLLDMLRTSSQYSPAKILDRLSRDGKSRAGKPLAKAHILI

SEQ ID NO: 34426 - protein, 167 aa, A.fumigatus
NLVRRYCNHLHKIEDATSTETTAIQNIALPDFEGEKPSIYLTLLSLYLSPPHGYKPRYGPALEVLAKHGSRLPPNSALELIPETLPVKELQFYFKGRMRAATSILNESKIVANLQKSQSIKTQAQLLVGEGGDMKASRSRHVTITEERICGICHKRLGGSVIDVFPE

SEQ ID NO: 34427 - protein, 67 aa, A.fumigatus
HVQQLVPPIGPVFFTGELPFFVLLFLQAIQIKAEKVLMEIRSHVIQFSNDMLKIPNSQTDINPFQKI

SEQ ID NO: 34428 - protein, 109 aa, A.fumigatus
HFYRRSPHLNRRLPYPSLRTPLWSCGSERYRKVYSLACPESPRGSHSQPHLNSTRRARGALMKQTLPLAVVADISFQITGDDTPAIQAVLDADVWRKRLLAEQEVGLAL

SEQ ID NO: 34429 - protein, 160 aa, A.fumigatus
ASWPKPIPERQMKSIDGIWEREFDPNNLLISPKSVTRRLMFVFSFGITGTTGLQRMELLSGGQKSRVAFACLSLTNPHILVLDEPSNHLDIEGMDALSEALQRFEGGVVMVSHDVTMLRNVCTSFWLCDKGTVHKFDGTVDAYKKMISSQANEAGVVAQH

SEQ ID NO: 34430 - protein, 261 aa, A.fumigatus
IACNRALCHSCSNTNQGYLTHASNAYVEDANAPSPLSEAADMVTELLVSASGDFSEHNEKAIRNLVEKFISSLSSSDGVDAERRQMPFTAKKLDQAIHVGSQRNMSSTLGLAGGNVDLESANSRKVESRVDRKKLEKAERKIRAKQEKKQMKTVQYEASRLLNQPESTLSYEEFFMAVNPLQLGSDSQSKSKDIKVDSIDISIGGHRILTDASLTLAYGRRYGLVGQNGIGKSTLLRALSRREVAIPSHISILHVEQEVRL

SEQ ID NO: 34431 - protein, 69 aa, A.fumigatus
SDTEPSNMLDVPSITFLSNYLQSYPSTILVVSHDRAFLNEVATDIVHQHSERLDYYKGANFGKDHSLVL

SEQ ID NO: 34432 - protein, 156 aa, A.fumigatus
YPGNSGCSRRRRLAETSSCRARGGPRSMTSSVESELADDLQKISKQLAAIEAERSSMADTSKDAARLDHEREGLDITLNDIHSKLAEMESDKAESRAASILAGLGFSPERQQYPTKTFSGGWRMRLALARALFCEPDLLLLDGKLRASQFRIKHQY

SEQ ID NO: 34433 - protein, 161 aa, A.fumigatus
RQTPAFIDKFRYNAAKSSEAQSRIKKLERMPVLEPPESDYVVHFKCPDVEKLSPPIVQMSDVSFGYSKDQLLLRNVELDVQLDSRIGNGGPNGAGKTTVLKLLTGQLQPTSGLISTHARLRIGYFAQHHVDALDLTTSAVSFMAKTYPGKTDEEYRRHLGA

SEQ ID NO: 34434 - protein, 64 aa, A.fumigatus
MAVELRNRDFQQKSFFPLYNNNVLFKAYSQLLTQDGNSQCRLPTVTDTQPNQNTPWSVFPARLT

SEQ ID NO: 34435 - protein, 1055 aa, A.fumigatus
  UNSURE (904): Identity of amino acid sequences at the above locations are unknown.
DLPFALRHNGWKEEFSFLFQKRRFLYYPERQCFAPLSYVLDAEPKPPVKVFQQAQGLTSKEEIDRIQHHYGDNTFDIPVPTFMELFKEHAVAPFFVFQVFCVGLWMLDEYWYYSLFTLFMLVVFESTVVWQRQRTLNEFRGMNIKPYDVWVYRQKKWQELTSDKLLPGDLMSVNRTKEDSGVACDILLIEGSAIVNEAMLSGESTPLLKESIQLRPGDDLIDPDGLDKNAFVHGGTKVLQITHHNSNGEDGSEKARKLSSGVPLPPDNGAVGVVVKTGFETSQGSLVRTMIYSTERVSANNVEALLFILFLLIFAIAAAWYVWQEGVAKDRKRSKLLLDCVLIVTSVVPPELPMELSLAVNTSLAALSKFAIFCTEPFRIPFAGRVDVACFDKTGTLTGEDLVVDGIAGLTLGHEGADVGKDGAHTELAKSANVPLDTTLVLASAHALVKLDEREVVGDPMDKATLQWLGWTLGRNDTLMSKAAALAGPRTVESVQIKRRFQFSSALKRQSTIATVVTADRKTSKKNKATFVGVKGAPETIRTMLVNTPPHYEETFKYFTQNGARVLALAYKYLSEESELSQGRINGYIREEIEADVIFAGFLSLQCPLKEDAIKAVRMLNESSHRVVMITGDNPLTAVHVARKVEIVDRDVLILDAPEDDMSGTRLVWRSIDDKFNRDVDPTQDLDPEIIETKDICITGYALAKFKGQKAFSTLLRHTWVYARVSPKQKEDILVGLKDAGYTTLMCGDGTNDVGALKQAHVGVALLNGSPEDLAKIAEHYRTTKMKEIYEKQVSMMQRFNQPPPPVPVQIAHLYPPGPRNPHYQKAMEREAQRKGAATLATAGNQTEHIPTITSPGAQALQQSNANLTPQQQRQQQASIAAAGFADKLTSSMLEQELDDSEPXTIKLGDASVAAPFTSKLANVIAIPNILRQGRCTLVATIQMYKILALNCLISAYSLSVIYLDGIKFGDGQVTISGMLMSVCFLSISRAKVSYVMRHLLLGDLVLTLVPVRGGFVQGAAPAEHFQCVHHWLRSRPVRHPYRYSDLPVELCLFH

SEQ ID NO: 34436 - protein, 160 aa, A.fumigatus
FMLLTLTRRKSDIDLEGEFEPSLLNSAIYLLQLIQQISTFSINYQGRTFRESIRENKAMYWGLVAASGVAFSCATEFHPELNEKMRLVPFSTEFKVTLTVLMIIDYAGCWIIENVLKNLFSDFRPKDIAVRRPDQLQREMERKKQEELETQAEKERQRKV

SEQ ID NO: 34437 - protein, 204 aa, A.fumigatus
ILWDMLLTPMTVRNSMLWTFPRVAARHGGIPDLFLKDFMKRHKFPTAAYQNFYEYEPARQYLDSVNHNVVIKADGLAAGKGVIIPQTKEEAHKALREMMLDHHFGDAGNEVVIEEYLEGDELSILTFSDGYTIRSLPPAQDHKRIFDGDQGPNTGGMGCYAPTPISSKEVLEEIDRTIVQPTIDGMRKDGSSESNKFRALSDGC

SEQ ID NO: 34438 - protein, 177 aa, A.fumigatus
CDSYLSGLLEKTASKMAQEQLRVLVVGNGGREHAYAWKLSQSPLVDVVYVAPGNGGTAQGASSKITNANVKGDDYPALVEFAQKNGVNLVVPGPEAPLVDGIQGYLHASGWFVPCWNLLNILNPMGHAIDTHDSSEFHALDFPKGCSPAWRDPRPFSKGLHEAPQIPHRRVSELLRI

SEQ ID NO: 34439 - protein, 566 aa, A.fumigatus
  UNSURE (429): Identity of amino acid sequences at the above locations are unknown.
IQQISSFIGRMLISSVKSGFPFVGILFTGLMMTKDGPKVLEYNVRGGDPETQTLLPLLSADTDLAQIMVACTEHWLDGVDIKIEPKFSTTVIAVAGGYPGSYAKGKAITLDPAPEDTLIFHAGTKLFGNELQTNGGRVIASTATASTLEEALRKSYAGISAIHFEDMFYRKDIAHRAFRQRDAAASQQQQSLTYASAGVSIDAGNDLVNKIKSCVARTKRPGTDAVIGGFGGLFSLAAANSAYHPESPTLIGAIDGVGTKLKIAHTVGVHNTVGIDLVAMNVNDLVVQGAEPLFFLDCYSCGKLDVETAAAFVAGVADGCVQAGCALIGGETAEMPGLFVDETYDAVGAAVGAINTTGKNAKSILPANSAMQAGDVLLALASSGPHSNGYSLVRKIVERSGISYDDPAPFTMPSSSSESLTLGRALLTXTRIYVKPILKALSIPPSNSSSGSSAIKGLAHITGGGLVENVPRMLPSTLSAHIDVSAWQLPPVFSWLKKTGNVTAPEMARAFNCGVGMVIVVEKGSEAAVKELFEKEGEVVYQVGELKPRQDGEEGCVLGGLQTWDA

SEQ ID NO: 34440 - protein, 93 aa, A.fumigatus
  UNSURE (29): Identity of amino acid sequences at the above locations are unknown.
FFFKKGAQFFFLLPSSRVGPTMYPGILRXVCRRKSLPLLPSSMKVKIIAPPERKYSVWIGGSILASLSTFQQMWISKQEYDESGPSIVHRKCF

SEQ ID NO: 34441 - protein, 281 aa, A.fumigatus
  UNSURE (13): Identity of amino acid sequences at the above locations are unknown.
QSLQDGLDVNAGXGEEGATQGQRFGGRGRHGEGGRVVVAYSGSLDDLADQRVSVGVRARGRQCEQNITGLHGRVGRQDGLGVLTGGVDGTHGGTHGVVGLVDEETWHLRGFTADQGTARLDAAVRDAGHESGSGLDIQLAARVAVKEEEGLGTLDNQVVDVHGHQIDSYGVVHTHSVGNLQLGSDAINRSDQSGRLRVVGRVGGGKGEESSEATNHCIRARALRTSDTALNLVDEIITRVDGHTSRGIGERLLLLGSSCVSLSEGTMRNILAVEHVFKVNC

SEQ ID NO: 34442 - protein, 549 aa, A.fumigatus
  UNSURE (415),(422): Identity of amino acid sequences at the above locations are unknown.
YLLDNDVEYYNEAEPVTLLCPLLPGQPLNVLQVPIILPDTRPTHTFQDGSSSRQPDVRTMNPEDKYMNPRRPPKPKLPRLRTSPPLLQAPTPAWSFSTSPLGALTNRATSQPSSSVNKTPRSSSSKAARSVSPPRSRGLRAAVRYLNASSPDLSNTHHSDRELDSKGEDAAGVCRTGSSGKGRFDFPEQSCHAFAPASTAKHYEHSLHPEDLLFRRPVSADHENPLTMSIQDRRALNIKSIEHLSCKSPLTVETQPDDTSASEEYSSKTFSYMAAELLAALESPSFLRTATIPDATTPTPFTYKEKRLPTLPNSPSSVMDEALRDIDARERELDTENLGSRFSDFTETEGSVVGSSYCERSHFSEWSTDTEIISPESMTSSSTFNNETQLSHNPGDAESADRIVPFLGSDTSDPXTPHLTVXSKLSPATSVASDSPRFNFPLPRLTVSFSPSDLDMAGLGIEDMCNVERDPKRHAAFFGAMNAFETLGLVKSPDASTTEFPDGVQNDTASLIDNRDVSNRLSCASTSMLDMMDELAYLRNVIQSGTAEE

SEQ ID NO: 34443 - protein, 119 aa, A.fumigatus
SACILWATKPGPPCHTTAITEILHASGEAEKLYELLHDLGAIGCLASDDSTDLQNLLSLVRVHWGLTIRSRNANDGQSVGALQILGIVTIRHEVGIGYIEIQSKCYDIVETSAVTRMTT

SEQ ID NO: 34444 - protein, 98 aa, A.fumigatus
LDTGATDILWISTGTILHGTITAVSPQMNTSLRTVKMTPKGRDPISLDTINIRGSTIRYYILPDSLPLDTLLVDDQPKPKNKARKETDRGRGRGGARG

SEQ ID NO: 34445 - protein, 245 aa, A.fumigatus
ALLCSAGAGPLLIIQFVTVASALALAPTAVVARQGAAAFVTVNSIDVCPKKVAQEIINPGPKVVTTPYTCDQVKLGHGLDVSYYNFDIEPLTKDTFPYCKALKVFDNEGCLGFPTLWIPLESPLEDKCIPEHYFSDEVKSISFQLDCREDAPVKKEPYGPKEGAEQSAPQAEHSTKQDAQQGSHQGQEVQNSPKQEARQGSRPAEAAPKQEQEAEQASEAAPEKKASNPADSLGLGELTKVLGFR

SEQ ID NO: 34446 - protein, 256 aa, A.fumigatus
  UNSURE (231),(232),(235),(245): Identity of amino acid sequences at the above locations are unknown.
GITPQCKKSSLFLRTITAMHFKNVRQTCTYIMHDTNSDSIALQHLSFLLILTPALASTTARIWAEFLPSCPINRIHPASAAPDHLPHEEFISALNISPGTCTNIFVPLSYGHEVTHMSFDAEVEVVGTRPEKCRISIYEVPGCVGQPLLDEEVKHGFASSDCVARNFASYNQVWAMLDCKEQDADEKVQSTGQPAHSHKPLLHDHPYLHVNNSTDLANQNAPLCEMGPGPXXCAXAGLPSGRALXYTAGRGILPLG

SEQ ID NO: 34447 - protein, 178 aa, A.fumigatus
TLLSSLGIRTQQEAHAKADPICSRRAVARAVIRVTSGIFLAMASSRKLSTPSDYAELLCRYDTWLFDCDGVIWSGDHATEGASKAIDFLRDHGKRVVFVTNNAARSRKMLKTKFDRLRIAASEVRAKCLEDGPPTDISQPGRDCIQFLRSSCVSQGSAQVSCRSEGVCHGNGRGRSGT

SEQ ID NO: 34448 - protein, 118 aa, A.fumigatus
PQLVGAGSLVTPLIASTKRNPIVIGKPHAPMLDTVKSLYNIDPTRTIFVGDNLYTDILFARKGRVDSLLVLTGVTKEEDCQTEGIWPTFIAPSISNIVAAESGPSIIADGTSTIHASL

SEQ ID NO: 34449 - protein, 182 aa, A.fumigatus
RPSLTDCESQPVRYGPSVWRMGHQLTYPNQDEIVSSSFAAAVYLKEVLKFPADRKVFVMGMEGVEAELDAVHIKRCGGTGPEDNKFLAANDYSSLAGEEAIDPSVGAVVCGFDMHMNYGKLCKAFKYLTRDGAQGPVLAGETGGGCHFILTNDDKVVPALGELWPGSDPVPTKTRAVADRSL

SEQ ID NO: 34450 - protein, 94 aa, A.fumigatus
QLASELVHLKVENEELSDINDALKLQVSELKIVVDKQPAEVEEKLRTEMDRIMKRNMEVQNENRSLSEQMAEMERELVEAKMQWAEVSIQRLLR

SEQ ID NO: 34451 - protein, 76 aa, A.fumigatus
QDAFEQDGKPYILSAAAGESFPDPRNKGFNISVKTTFASLEDMEYYDKECEAHKALRAVAGPVKEDVLTTYFESVL

SEQ ID NO: 34452 - protein, 98 aa, A.fumigatus
RGVSFLEVPGAHYSDLRQRLSHTGLTLEEDIAVLEKLHILVDFDEKGYLLQIFSKHVLDRPTVFIEVIQRNNFDGFGAGNFKSLFEAFEREQARRGNL

SEQ ID NO: 34453 - protein, 747 aa, A.fumigatus
SMPKSYPELANTPQYTSRARIISVFFKSLYSRSHDVIEAANAGLRDVLTQTNKLPKDLLQNGLRPILMNLQDPKRLSVAGLDGLARLLTLLTNYFKVEIGARLLDHMKVIADDAVLQKVSFSLVEQNQTIKIVTAIFNIFHLLPPAATSFMEHLVNKVLELEEKLRRTSNSPFRKPLVKYLNRYPKESLAFFQARFKEERFGRFFGQILADPESEALRAAVVADTEGFKSAVFGQDSSDGRNTAAINGIYVVHSVCSYEATKRWLVSHGDLKTMLLNAGRDLEKKLRSDRLPANERLRVEQAEDQLMDIFTIYLSESVQDLDFLFDLIDGLSSEELKRTLAFPKFIYRHIITNESIDYRRSVIMRCLDLYGQRTCSQKMKTYAFHNLVNPIFAMDVQTTWNSPSNSPKLMDKSMTESIQSRLWRPQLADLSEESTQAGVDHSRMELLQLSALLIKYHHQTVQDSRRDIIKFAWNYIRLEDIINKYGAYVLISYFIAHYETPFKIVVQVYVALLRAHQNEGKALVTQALDVLAPVLPSRIMSATSNAQAPDTRYPLWAKWPRRILAEETANLQQVMSIFQFLVRHPNLFYESREHFVPLIVPSLIKIAAPPNSNNESKKLALNLIGLIWQWEQRRVTSSRTAMTNGILESPNARKRKLDDTQGTYSPSAALGPPSSHERTEYIIPSDLRAAMTKYLITFITTVPERFPVPAARFRELPSSKPQPQQPPILTGDMIKKAVFLLRNLLST

SEQ ID NO: 34454 - protein, 662 aa, A.fumigatus
SRKPYSCSGIFSQPEYWGDLDIELYQKITEPILAGEKADKPDEKHITSMINALQVVRVLLAVKPDEWITARLPLVQKLFEKPLRSDNPEIQDSLHGVEDSMDISPKLPPPVRRVLDALPEDQPEEEDAMDVENSPSEFVTYLSAIATETLSANNYISSLNTLWTLSKNKPAEMDTHILPVMKAFSQKLAKEHVAASTNNQQAQYPPGAAKPAENLPDQQEYEIGVDLILKTIELISVRMSHLGEQRRPFLSVLAQLVERSQNEALCTKILNMVETWIFHSTESWPTLKEKTAVLHKMLLFETRADQKMLKKFLDLVIRIYEDSKITRTELTVRLEHAFLIGTRAQDVEMRNRFMNIFDRSLTRLASSRLSYVLTCQNWDTLADSFWLAQASHLILGCVDMTAPARLHPDDFTVYPLSFLLSNAEKDARKADIMVDIQLEAFISDRKRFIADIGDVRIRDLMEPLCQLQHTDPRVAYSLWTTLFPIFWSTLSREDRIDLEKGMVTLITREYHQRQLDKRPNVVQALLEGAVRSKPRFKVPPHVMKYLSRTYDAWYTAASYLEESAISPIIDTPTVRESNLDALVEVYAGLQEDDFFYGTWRRRCKFVETNAALSYEQQGMWNKAQQLYENAQIKARSGAMPFSQGEYHLVFTSSSPEPHIAYR

SEQ ID NO: 34455 - protein, 80 aa, A.fumigatus
WLPTSTREWIPPRTTGTPIRESKFACHATFEFTSNHCSRYGTSPHGGYGLGLERFLAWLCARYTVRDCCLYPRFTGRCTP

SEQ ID NO: 34456 - protein, 417 aa, A.fumigatus
TEDPSLPKPVRIRLDVTDPAIVKLGSPETQTAGTRVRVLGRVHRLRVQKDVIFLTLSDGYGYLQCVLTGNLTKTYDAMTLTLETSMAIHGEMRAVPPKQHAPNDRELHADFFTVIGRAAGDKEAITTRVAKDADPQTLYDNRHLVLRGEISSAVMKVRAACLKAFRQVFEEKRMLEVTPPAMVQTQVEGGSTLFKFDYYGEDAYLTQSSQLYVETCLPSVGDVFCVCPSFRAEKSLTRRHLSEYTHIEAELDFITFTDLLDHLEEVICRVIELTLANPATAALIKQLNPDFKPPSRPFRRMKYADAIQWLVEHDIPNEEGKPHQFGDDIAEAAERKMTDIINQPIFLTHFPAEIKAFYMKKDPEDRRVTESVDVLMPGVGEIVGGSMRMDDWDELMAAYKHEGMDPTPYYWYTDQRK

SEQ ID NO: 34457 - protein, 96 aa, A.fumigatus
MLTDVRQDPNAQPSQQLELEAAFPQSQPQNGRIEDTEYYTNFLEQLLGLVPHGDQESVSRMISVIRSGASQEEILKTLSEISTNIRNGQEGNRGNR

SEQ ID NO: 34458 - protein, 219 aa, A.fumigatus
LDVNSKVAWQANLLSLIGVPVVRGGIHSLVLVGSHQFVPVVHSHTAADNLADTRHEDVDTLGDAAIFRILLHVEGLDLGGEMGQEDGLVDDVGHLALGSFGDIVTELVGLALLIGDVMFHQPLNSVGVLHATEGATGGFEVGVELLDEGSGGGVGEGQLNDPADDLFEVVEQVGEGDEVELCLDVGVLGQMTTGEGLFGAEGRADTENVTHRGQAGFHV

SEQ ID NO: 34459 - protein, 138 aa, A.fumigatus
QRDWSDVSRDRFKHGIKVLKVLSYAAFETSESSTRAILCALMRDPVRYRNLQQEIRSNFSASKPITDSQLVGLPYLTACINEGLRLWPGLNGQFTSRVSTGAVVDGVYVPPGVRRMIPLPSYFFSLLSCLFVILESRN

SEQ ID NO: 34460 - protein, 74 aa, A.fumigatus
TRKTQTKCAHSGRFPQGPRSCPGRQIALQKLRLTLAKFMFFVDMQVVNPQFEWDRNVPVGPLVELGRGHGADEP

SEQ ID NO: 34461 - protein, 64 aa, A.fumigatus
THEALRATPLVELSSLQQDEALISNKYPVHSMLITITQTHKLPYPLLQRGMPMRTRSRFRNLSA

SEQ ID NO: 34462 - protein, 65 aa, A.fumigatus
PDASWIDNWNSQKTHQNLIGVAFALGSFLLSRRGLKMLVDSFGPFWIPKYLDPAHLIDVALKQYV

SEQ ID NO: 34463 - protein, 81 aa, A.fumigatus
IPQLTGFDVQCLVSADLYTLQRHPRYWHDPDTFKPERWLDPKNPDEMRAFRPFSAGAPLVSRPADRAAEASAHARQIHVLC

SEQ ID NO: 34464 - protein, 70 aa, A.fumigatus
NLITYRTAYSPETRRIQASLRVENAQTDCQFFPFKPTLLPPLVSFSDRQGVELNGRNIPWVVFGTHRGII

SEQ ID NO: 34465 - protein, 150 aa, A.fumigatus
VQSRIPWYLFRSSRPGRTPLRMESVDTVAPVLPTTQRTVIIEAGDRVRVRDDMPLPTLEKHQFLIRTEAVVINPSDTKTRGPCVTPGGVLGTDYTATVVACRPEVTEVKVGDRVCGAQHAMNANTPHRGSFGEHDISSMIIKEDAASSSP

SEQ ID NO: 34466 - protein, 110 aa, A.fumigatus
QLGLLQRHRSIPIDAAVDVDLSLSGKLHRVANEIDEDLTNAEPIANYHRWHIHIHQVIELESLVESSRRNGIYYILNHRPDMEPGVDQGHLSSLNPRDIEDIVHQLAQVG

SEQ ID NO: 34467 - protein, 779 aa, A.fumigatus
GKCWYWIDFFLDIHEQHVAELKAAQERQRFAIDAKYRAFSNSIPQVVFEAIEHRGLIFVNEQWHLYTGQKLEEALDFGFAKHVHPDDLEKCGSLSVYIADLQNKTTADSTGKDGCTGTEKAGTPGRQFSQGVTPALAELVRLGIASVQKDENGRVFYSTEIRIRSKGGDYRWHLVRLVRVETSSFGSGEASWYGTCTDINDRKNLERELNKAMQQLNNQMESKTKFFSNMSHEIRTPLNGILGTIPFILDTQLDTDQRRMLDTIQNSSTNLRELVDNILDVSRVEAGKMSLVNSWFHVRSVVEDVIDTISSRALDKGLELNYLMDVNVPPMVIGDRFRIRQVLINLVGNAVKFTTQGEVHINCGIYRDASVPLKETELLLNFDVVDTGKGFSARDAERLMQRFSQLGENASQQNAGSGLGLFLSKQLVEMHGGRLTPSSKEGQGATFSFFVKVDAPPPPSPDDPRLVRQSSSTSDLGTQSKPEPLQRMLFARESADSRSDLADLSPALESPLSQPSSSVDPSARATFNNFSEHSSMSSAMPTPDIHGTEPLPKIECSRHPVQSDSTENRGIAPTSSSQDASRSLYRPSESGLEPLARRSQAFETPQSLYSIVILCPFDYAHKAIKQHIEQVVPHDIPFSIASMPDVEDWRDSMSDGATPQPTHLVLNLPSVEEVLDMISYVAECDQVTAPALVIICDLVQKRQINSSLKDLSSSGKRVFTVPKPVKPSAFSAIFDPDNQRDLSKDRNQDMAREINNNFKTMSKMVKEVIGNKGYRILAG

SEQ ID NO: 34468 - protein, 104 aa, A.fumigatus
HVTCQCDIQMPVKNGYETCREIRRWEMKNHYPQIPIMALSANAMTDQIENAARAGFNDYVTKPIKHNELGKMMMGLLAPDRPLLLRDRLKPDHDGHLSDASHSQ

SEQ ID NO: 34469 - protein, 665 aa, A.fumigatus
LDNLYQKFAHANLLSEGHIDDPLTSLPWLPVVLQSAGNSRHLASWTPESASYDCFKLEIATLAQRETVYKESSTSPQLLEFGKHLESAHRLVCADRYHKKAPIACYQCTLHCSTDRKSFRLETFILWRDSLDIIDEKLLSAGALDTFAKYVLQRDAEVDNKARDRGFAPAVIWSPRDFYDNVHVPKDAPESSAEIKSDLIHCRLYPFQRRAVRWLLEREGVKLQENGHVLPLEDKSTSELPTSFEKRTDAEGKTYYVSPLFVTVTSDLSNWYAPADYLKGGILAEEMGLGKTVEMISLMCLHRRPLQPDMDLEIGGMRQSGATLIITPPAILQQWMQEIQLHAPALHVLHYTGINRHQKLSDRELVELLADQDVVLTTYDVLAREIHYSGAAPKRNLRHEKRFQPRKSPLVEISWWRVCLDEAQMIESGVSNAAKVARLIPRQNAWAVTGTPLRKDISDLLGLLLYLHYEPFCGFVWNRLCRSFHSVLSGIVSRVALRHSKDYVRSELDLPSQKRFVITIPFTAVEEQHYAQLFEQMAEDCGLDMSGAPLKDDWNPEDQAVVEKMRSWLMRLRQACLYPAGSGRRVLGFGGGPLRSVAEVLEIMIDQNDALVHAEERALIQSQLRRGQLLENALRRPQALELWTKSYERSSALVKECRIRLQSEP

SEQ ID NO: 34470 - protein, 242 aa, A.fumigatus
HCTIHYNMVYSAAAILPISIYLQIITHASNRVIVCACVYRLIRNNVDQYFSVRSRGYRTLAKSCRRCVILDRCGSCSDPLCRYLPATVCDILLAHYMMECSPCLRWSTQTFTIAQMTPIWIFPAYPMLIIGPHAGILSAKLEPSRALPIIIGGTTIQGIGLLVTLTVYSAYVYRLFSQKLPRENVRPGMFVSVGPSAFTVSGLVTMAAHAKRCFPDDFMGNGALAANILEVVVNFACLWLWG

SEQ ID NO: 34471 - protein, 117 aa, A.fumigatus
ELVPYKFRGLEMIGTIVFLFNIVLYITIWCILLLRFYLYPYTFKLSLTHPTESLFVPASIVSFGTMLINISQYGPEATGPWLSHAVGVLFWIDAALAVILSAGIYLLLYVTFFLLTI

SEQ ID NO: 34472 - protein, 119 aa, A.fumigatus
HLHSLAIFFFFIATFAHWSTIGPGRMNFSMAWFSFVFPNTALITATFAIGNAFSCKPILIIGCAMIFPLILMYIFVFYMMIRAIVLRQIMWPQKGEDKDEGGFEINRTKPETPGEQTPV

SEQ ID NO: 34473 - protein, 117 aa, A.fumigatus
  UNSURE (69): Identity of amino acid sequences at the above locations are unknown.
GGQSFPSLPPPISKIFNWPKNASTKPFTASLPQSHVAWCQNSWFHPSVSASIRCGNTTSDTGLFFFFFXKCLGFSSSTFYWIPKGHSDFISHKNPLEAVARSLIFFYREFTLPRFLL

SEQ ID NO: 34474 - protein, 227 aa, A.fumigatus
VSPVPFRRLALRMTQQRKTIAVVNATGRQAASLIRVASAVGHNVRAQIHSLKGIIAEELQGLPNVTLFQGSLLNNTALMDTLFQGANLAFINTTSQMGDEVAIGKALADAAKRAGSIQHYVYSSMPDHSVHGPWPPVPLWAPKFTVENYIRQLGLPATFVYAGIYNNNFTSLPYPLFQMELMPDGSFEWHAPFDPDTPLPWLDAEHDVGPALLQIFKDGPKKWHGHR

SEQ ID NO: 34475 - protein, 91 aa, A.fumigatus
TRRGACAASDFQGRAQEVARSSVGSPRGIPRSWKTVADGSLSHRIALTFETLSPNQVCAAFSRALNRPCRYVHVPKIEIKVNIPAGYREQL

SEQ ID NO: 34476 - protein, 169 aa, A.fumigatus
STSSTALPRPLTSSSTSQPLKLSVLLVATVQVNTSTPGALPNGKRVQANLGAKNHAAVLPNCNKNQTLNAIVGAAFGAAGQLCMALSTVVMVGETKEWLPEMAERAKALNVNGGFEKGADLGPVISPESKKRIEDLIASAEQEGATILLDGRGYKPEKYPNGNFVSLPS

SEQ ID NO: 34477 - protein, 144 aa, A.fumigatus
SFQPRGEHGWRATSIIARQQIMFKFVNLIRANWDRLAASITLEQGKTFADAKGDVLRGLQVAETACGITTQLTGEVLEVAKDMETRSYREPLGVVAAICPFSKSLPSIACPVDPSRSFSVTNRSTRRLPRNDPSLVHSYRYDYR

SEQ ID NO: 34478 - protein, 121 aa, A.fumigatus
VGPTIITNVTPDMKCYKEEIFGPVLICLNVPTLDDAIELINKNEYGNGAAVFTCSGSTASRFQKDIEAGQVGINVPIPVPLPMFSFTGNKKSIAGGGAQHLLRQARPAILHPAEDRDQPVA

SEQ ID NO: 34479 - protein, 98 aa, A.fumigatus
  UNSURE (43): Identity of amino acid sequences at the above locations are unknown.
LTAPPVDFPAMIPLWCIPIATITGNCIILKPSERDPGAAMILXELAREAGFPPGVINIVHGSAKTVDFILDEPAIKAISFVGSNRAGKYIYTRGSAQW

SEQ ID NO: 34480 - protein, 125 aa, A.fumigatus
NATRRKSSALSSSASTSPRWTTPLNSSTRTSMVTEPPSSLAPARPPRASRRTLRPARSASMSPSPSPYPCSPSPATRRVLPVAVPNTFYGKPGLQFYTQQKTVTSLWRSEDAISTKAHVVMPTHS

SEQ ID NO: 34481 - protein, 89 aa, A.fumigatus
LPRQTHESHGDHCPPGQPYFNTHSSPSSKCQKDNQSFFPSLDNCKRFESIPILSSTIYYPSKSIMAAPADVTIKNLSGEWTMVWVVLKF

SEQ ID NO: 34482 - protein, 143 aa, A.fumigatus
AYKVAVGILLRLIAPAIQKDGGTLLFSTGDQVFDALLALGADDRAEIGTLFETAVDVESLGSLRHLGKPFFGFSNHDNCAQGHAQLSSGAEGSTDDGVQGLVLVAVRQHRSMVLRTQVGLDTLTIGQSPGCRCIYLHGCYQQN

SEQ ID NO: 34483 - protein, 205 aa, A.fumigatus
SHIPWSLELHCITYLGSFHCHSMFTDNLVQQGISWVTRKAISYATVTLIIKEYADSEDAKVMHIDIDQVLTGGIKGTSEKRHTDWAERDHKDHIFGNLKGRSRLIRGSKGDDGKVRPAVEINTKIDDPKVKQFLRGEILIDGSPCEGFLVDSEGEEYGEGEGLFLQSFVVNQDDGAGWTAEQVRIFDSLPGGSATDANLCIDLGL

SEQ ID NO: 34484 - protein, 166 aa, A.fumigatus
  UNSURE (166): Identity of amino acid sequences at the above locations are unknown.
PLPSRRMVAPSCSALAIKSSMRFLLSGLMTGPRSAPFSKPPLTLRALARSAISGSHSLVSPTMTTVLRAMHSCPAAPKAAPTMAFRVWFLLQFGSTAAWFFAPRLAWTRLPLGRAPGVDVFTCTVATNKTDSFNGWLVEDEVNGLGRAVDDVDHTRRKAGLPGQLX

SEQ ID NO: 34485 - protein, 138 aa, A.fumigatus
GDGDGDIDADLAGLNVLLEARGGRAGASEDGGSVTILVLVDEFNGVVQRGDVEADEDRAEDFLLVAFHVRRHVGDDSWADLRGRWVSEGEAERVRRVSLQSCRWDTSQAYSPCHPEGWWHPPVQHWRSSLRCASCSRG

SEQ ID NO: 34486 - protein, 210 aa, A.fumigatus
  UNSURE (48): Identity of amino acid sequences at the above locations are unknown.
MYLPARLLPTKLIALMAGSSRMKSTVLAEPWTMLITPGGKPASRASSXSIMAAPGSRSEGFRMMQLPVIVAIGMHQRGIIAGKSTGGAVSHGERTGGIHRTSDGRQGLTERANSRNDSQGLPVASSLHILGHFEDLTGQLGGDATSGLCNLQTAKDVTLGISKGLALLEGDGRCETVPVGTDEVDKLEHDLLPGDNAGCPPAMLTTRLKG

SEQ ID NO: 34487 - protein, 74 aa, A.fumigatus
HSLSSWSTVLSTVTYFFGLRTVLGAQPRAQLYPVTYNYNTSIPALLSHNVPLSWITACTPNPAKILQFLSSLLD

SEQ ID NO: 34488 - protein, 392 aa, A.fumigatus
TSTYLLPAVFNPSGLTHCSFPYFEEEPARFTATLQAYHAFKVQGVDATLGYIPNTLVQSIPWPKEHWMIDSRAIVLLSPPGNAASTRTQVIHSAIHRMIEAGYTDVLKGWRNERFPVYRPDGGVILEIERSASALFGIVTSGVQMLCYVKDAKNGIRLWIAKRSMRKQTYPGMLDCTAAGALSAGESPQSAMILEATDEASLAREIIESGMKYVGTISYFHMKDSSLASSEGSSTAVLLPEVEYLYELPLDEGTVPRPRDSEVEDFRLWNVDQVVDALGRGSFKPNSAVVVIDFFIRHGVITPETEPMYDEIIRRLHRELPFPTAHWCTGACGRQAKPDSCMPSRILCPLRWGHKSIHLGNSLPGLCTKTTPNPSKRTMFDRLTKKQQAHHI

SEQ ID NO: 34489 - protein, 74 aa, A.fumigatus
  UNSURE (5): Identity of amino acid sequences at the above locations are unknown.
ILGRXDLARISTEWKTRGWDGIVEAYSFSLDPIMGLLLAFFVLMEYSFIYCDLFLRSPHCIRSSAEGTVISGYL

SEQ ID NO: 34490 - protein, 98 aa, A.fumigatus
SINRRSFRSARCPIMVATGVSARGLDIKNVMHVVNFDLPSAAHGGITEYIHRIGEHIGYVHYLGLPANGPQDVLHALATKALQPPFTMTKTPISPPTS

SEQ ID NO: 34491 - protein, 78 aa, A.fumigatus
RASSPSQERKLLPSLVMIYPYSVFDDSKFDDAGLHPIMRENIRLCNYEVPTPIQAYAIPAVLTGHDLIAIAQTGEYES

SEQ ID NO: 34492 - protein, 134 aa, A.fumigatus
YPSSNTTNKTNELGSGKTAAFLIPVLSQLMGKAKKLAAPRPNLANGFDPSVDAVRAEPLVLIVAPTRELSTQIFDEARRLCYRSMLRPCVVYGGAPVREQREELQKGCDILIGTPGRLLDFMDKPHVLSLRRVK

SEQ ID NO: 34493 - protein, 65 aa, A.fumigatus
IIYAEDHLKKQCLYDLLLAMPPSRTLIFVNTKIQADFLDDFLYNMGLPSTSIHSDRTQREREDAL

SEQ ID NO: 34494 - protein, 97 aa, A.fumigatus
LPEDVNEDADHRYMMFSATFNRECRRLARKFLAEDHVRIRIGRPGSTHINVDQTVSKLKAQSEPEAILKMYRSSMPRITLKSNAFTTFFWQCRHRGP

SEQ ID NO: 34495 - protein, 102 aa, A.fumigatus
RSTGRTARIGNEGLATSFYNDKNSDIAPDLVKILIETGQKVPDFLESYKPADDVVKFDDDTDDEAADGDDNVITNNDDAGTVWSGIPMESSSDDAPVSTDWE

SEQ ID NO: 34496 - protein, 214 aa, A.fumigatus
FSYYSHTSQDSYTTFMLTQKEMRNDGASRASILMKTGACVGGTIIGYLSQFVGRRRAIIISALCSGILIPAWILPQGERALSATGFFMQFFVQGAWGVIPIHLNELSPPAFRSSFPGLYLVPYRSWRILTNVQRYHIPSRKHDLLALRPDCQRHCRENHDHRSIWSAGSCVWPCHGSCHGHHCDGYRGYYGIWTGEAWSSVRDCRCGPPVSQVR

SEQ ID NO: 34497 - protein, 135 aa, A.fumigatus
MSFLHPRSVLPSQVCTSYHTDRGESSLTCKGITYQVGNMISSPSAQIVNAIAEKTMITAPSGQRVPAYGPVMGVATAIIAMGIVVTTAFGPEKRGRRFETAVAGLQSARSDKEIDLEEGLDDKAAERRVEEVGKL

SEQ ID NO: 34498 - protein, 104 aa, A.fumigatus
VEISEITSHLSSFYQNSKILPGQTTNMDAKTTIIIRAVVIPLAFLIFILTIIAIFILKCRMDRKKDERENLNYSFASYEQWQTPNQPHNQKMDAAQHSHNSMAR

SEQ ID NO: 34499 - protein, 96 aa, A.fumigatus
YGSTCQFTAPKTMIPPIRLSVRRCDSLKGSSISSQVMHPLQVLTPNGSAPPNCNETVETCMQWVGIFGYKYDALKSVVENTPDDKYENHLRVTSCK

SEQ ID NO: 34500 - protein, 73 aa, A.fumigatus
GLIHYLKEIGLRTNSSFLATILAVVHGSNGRRKGGRILHMIDGYGFDNNKAQPMQVSAGSATTKLNMLLRTRF

SEQ ID NO: 34501 - protein, 254 aa, A.fumigatus
  UNSURE (218),(244): Identity of amino acid sequences at the above locations are unknown.
VANAINFTQETWANDIAAAQAAHIDAFALNLGYGLHNYDLILNDAFTVAHRHNFKMFLSFDMGQGPQWPVDEIVHLIDNYATGGAYFKHHDDKPLVSTFEGGQNADVWKDVRHNAQSDFFFIPDWSSLGIEAASSSPVVDGLMSWHAWPAGAHDMNTTLDEEYIAALDGRPYIMPVSPWFYTNLPVFHKNWAWRGDNLWFDRWQQVLELAPEYVEIIXWNDYGESHYIGPMHQEDLGIFAVGEXPFNYAEGDAA

SEQ ID NO: 34502 - protein, 138 aa, A.fumigatus
YQLIRLGRHGYRSIMQNLTRTADHLATELQKLNFTIMSDGAGSGLPLVAYRLPPDENRLWDEYALAHVLRQRGWVIPAYTMAPHSNRLKMMRIVLREDFSMDRCDVLIEDMKMAMKSLEEMDRAMIEQYIRYGLLLTD

SEQ ID NO: 34503 - protein, 244 aa, A.fumigatus
  UNSURE (3): Identity of amino acid sequences at the above locations are unknown.
SEXSRGINMIADLFHAPTADGAGVQDAIGTSTVGSSEGIMLAMLAMKKRWQNRRRAEGKDSTHPNIVMNSAVQVCWEKAARYFDVEEKYVYCTETRYVIDPEEAVDLVDENTIGICAILGTTYTGQYEDVKAINDLLIHKKIDCPIHVDAASGGFVAPFVNPDLKWDFQLPKVVSINVSGHKYGLVGTTPESPDVPNRPRSTPASAGYSGAQPSTSLKNSSSTSTTSAPSKQRLRSTSPRAPPT

SEQ ID NO: 34504 - protein, 291 aa, A.fumigatus
  UNSURE (182),(223),(264): Identity of amino acid sequences at the above locations are unknown.
AIDISDAACDIWTATDFRPGMPWNDQLLTVAAGRSLQSRPRDRLRLHGSDHLPRVDVLVPCCGEPTDVVLDTVRAACTMDYPVTHFRVLLLDDGASPALRDAVAGLRSQWPHLSYHTRGQHSGRVFAKAGNLNYALFSLQNEVQPEFCAVLDADCMPAPDFLRATLPHLLKDPQAALLTTRXYYYNLPDGDPLQQSRVHFYTWHNSELDRMGACIDAGSGAVXPAEGNRRCGALSPPFPSSENGNSSWMFRAFGFPTITGSETXAIGGRSPLPWKELSPQPNRRAIGPSQT

SEQ ID NO: 34505 - protein, 354 aa, A.fumigatus
  UNSURE (248),(269): Identity of amino acid sequences at the above locations are unknown.
NFIHFLSLLVSRVLAHSICTMYFTTLLSALSLMAAAASALPHQLSSRASGAQNVVYWGQNGGGTVENNDLASYCTSTSGIDIIVLSFLYQYGNGNTIASGTIGQSCYISPSGQPQNCDALASAIKTCQSRGVKVILSLGGAVGAYSLSSQAEAETIGQNLWEAYGNTQGNGNVPRPFGSTFVNGWDFDIESYSGNEYYQYLINKLRSNFASDPSNQYYITGAPQCPIPEPNMQVIVTKAQFDYLWVQXYNNPGCSVNGPINYDQWVSNXANTPSANAKIFIGVPASPLGATGTSSGAQYYLQPSALASLVAEYKDNPAFGGVMMWSAGFSDANVNNGCTYAQEAKRILTTGSPC

SEQ ID NO: 34506 - protein, 86 aa, A.fumigatus
NLTRQSKLAFINTEYILTLDTANCSKRRLRDKQCCRTYADSKLNWWTGSRYEPVPSRITNTTAHTKQGSQELSYLHIKAKGRKPDS

SEQ ID NO: 34507 - protein, 124 aa, A.fumigatus
  UNSURE (55),(90),(115): Identity of amino acid sequences at the above locations are unknown.
REFFPAQITLPQIDRVCSVNNMSMKVFFRRGALSTLARRAPVTLRSLPRKGLTTXQEEIVKSTIPALQEHGVTITTLFYKRLLDAHPELXNIFNTGHHATGEPPGNPGACCVGVXIPNRTTRCP

SEQ ID NO: 34508 - protein, 182 aa, A.fumigatus
RSSCPVSLAFFNGVASVTRLKWAFARDEGLPFSSFFAYISPRYKIPLRALFLVAMITVLLALINIGSTTAFNALLSLTTLGQYISYLIPVIFLLIKRLRAPQEIRWGSFRLGHWGVPINVFAIVYGVYIAIFLPFPPNYPVTAQNMNYAAPVFLAALVFATGDWIVRGRTRWQGPMVKVRAE

SEQ ID NO: 34509 - protein, 203 aa, A.fumigatus
GLQESGSRNQTSDSTHAGVQTGRGAGEQRGGRAGGGGARGRWGAAWRGDRGLGGDDGLGSSGRGRSRSGSGSGGGSRGGLLGGGGSNRRRGLGVSVCQSVGNSVGPRVGDGIGQRSRQGTARSSTDLPDGAAAIVGAVRAWLAAALTDSAAAVGDGNAGRLAGLVTRVRFAAGDLASNKAIVACRKGDSGQERSSQKLVHCKD

SEQ ID NO: 34510 - protein, 150 aa, A.fumigatus
GRLRARHVLHRRWLLPHRGDLYWTWRYPDGNADRYHHQHVDQHCYQHSDKHSHRDRGAYYYHHHRGDHLYFHLHFHFHFGFDPGHYFQARHPHPAHGHLSKRHPIALGLLHRQPFLPSVHRRRVPSERRRGCCRWSDCGSRSPVILTRAR

SEQ ID NO: 34511 - protein, 206 aa, A.fumigatus
SFIISIFTMYKLLTASLLATVALAAGHNGLIARQVSSCESHPGYKTCKSSCIPVTYSCCAIGEGGCEPGTYCTDDGCCPIGEICTGPGGTLTGTLTDTITNTWTNTVTNTLTNTHTETAAPITTTTTEETTSTSTSTSTSTSASTPATTSKPVIPTQPTVTSPSGTPSPSGSSTASPSSPLFTGAASRLNAGVGAVAGLIAGAALL

SEQ ID NO: 34512 - protein, 187 aa, A.fumigatus
SLQPVLAEQDVCSRRSERADGPVHHQMDSTEWWAPHCDHKPVRTDTSVMWISTDSNSNPDKDDLWTKELEQRGAHIEIMAADVTKKQEMINVRNQILSAMPPIGGVANGAMLQSNCFFSDLTYEALQDVLKPKVDGSLVLDEVFSSDDLDFFLLFSSISAVVGQPFQANYDAANNVKFGQSAAVRTY

SEQ ID NO: 34513 - protein, 595 aa, A.fumigatus
FRGEHEGCFQTLLLAFAAPRDGSLWTIFVPTQIGRLTIFPNSSVGINTPASVTIDTHLHEFTAGHKADLPMIKGDVSVYSSEAGQLRIRLEGLTMSPIAPSTEKQDKRLYLKRTWLPDILSGPVLERGKPVFCYELFGLSLAPKSILAATRLLSHRYAKLKILQVGTSSVHLVHSLCRELGSSMDSYTIACESDSSMEDMRRRLLSDALPIKYVVLDIGKSLTEGDEPAAGEPTDLGSFDLIILLKASADDSPILKRTRGLIKPGGFLLMTVAATEAIPWEARDMTRKAIHDTLQSVGFSGVDLLQRDPEGDSSFVILSQAVDHQIRFLRAPFDSTPPFPTRGTLLVIGGASHRAKRPIETIQNSLRRVWAGEIVLIRSLTDLQTRGLDHVEAVLSLTELDQSVLENLSRDTFDGLHRLLHQSKIVLWVTYSAGNLNPHQSGAIGLVRAVQAETPDKVLQLLDVDQIDGNDGLVAESFLRLIGGVKMKDGSSNSLWTVEPELSVQGGRLLIPRVLFDKKRNDRLNCLRRQLKATDSFEKQSALARPIDPCSLFSPNKTYVLAGLSGQMGQSITRWIVQSGGRHIVITSRCEQTRL

SEQ ID NO: 34514 - protein, 156 aa, A.fumigatus
MLARMAGPCGRKQEAGSSHPQVAEACVVAIPDQLKGQLPFAFISLSVADHPDSAIPAPTIAAEVQSLVRSRVGAFASLGGIVQGKGMIPKTRSGKTLRRVLRELLENGVYGDLDRSVEVPSTIEDATAVQVARAQVREYFNRNKGKHKAIEARETA

SEQ ID NO: 34515 - protein, 81 aa, A.fumigatus
TLSADPSAPVVKKGEASYLPVEVCLVEPGQPAKSKLTPMQTRNMLSFAVRGPASNAYSIVSKGTAVLGLKNPLNPTLVCVL

SEQ ID NO: 34516 - protein, 493 aa, A.fumigatus
ASFGIQPDLQLVTVPGRVLPAPRVYYKDAKSNQRHIDTMGGSWNMKSIKFSTSTKLPSWTWLYINSERGIPRFENPGQLNTSLQAFTAKLNEIGVAAAAPKPGMMIRLTGNDHEGEIDRAVGELMGRHTPTLILTILYSSDVEAYNCIKKICDVRRGVRNVNVLAEKLRGANDQYYANVGLKFNLKLGGANQILKASELGIVAEGKTMLVGIDVTHPSPGSSAEAPSVAGMVASIDSSLSQWPADIRIQTSRQEMVSNLDEMLKARLQRWARANKNALPENIIVYRDGVSEGQYDVVIEQELPLLKKACVETYPAASTKKNFPRISIVIVGKRHHTRFYPTRDEDADRSANPKNGTVVDRGVTEARNWDFYLQAHTAIKGTARPAHYFTVWDEIFAHQKPVAPFQNAADILEDLTHRLCYLFGRATRPVSICPPAYYADLVCTRARCYLSSVFDPTPAATPSVSEIGGIGRGGLVKGSDVQIHENVRDTMFYI

SEQ ID NO: 34517 - protein, 280 aa, A.fumigatus
PVLRQRRPQVQPEAWRSQSDPQSERTWHRRRGQNNARWHRRHAPVPRLLRRSPQRRRHGRFNRLIAEPMARRHPHPDLPAGNGVKPGRDAQGPAAALGARQQERPPREHHRLPRRCLRRPIRRRHRAGTAPAQEGLRRDLPRRKHQEELPAHLHRHRRQTPSHPLLPHPRRGRRPLRQPQERHRRRPRRHRGPQLGLLPPGSHRHQGHRPSCPLLYRLGRDLRPPETRRPLPERGGYPRGSHPQTVLSVRPCHQACEYLSACLLRGPGLHSSPLLPEQCL

SEQ ID NO: 34518 - protein, 170 aa, A.fumigatus
PSCPPNLNLGYSTRPQTSSRSAPGPLASSPVNQRTNSSSVQLQLVTTRNPPLRTNLRAILGYRSHTRRWITFPSLFPSTTTSSDNETASNVPLSSTISNPPCAYGNQSSRPSPSNCPSEFKISHSSNLIIMSLSSSGTGLASAVSAPFETTTSSSSPSSCSSPSDSLPLK

SEQ ID NO: 34519 - protein, 177 aa, A.fumigatus
LCISFYSLAQAKTGTGKTLAFLTPVFQNIMKDPSLKGLNWRRSQASSSDIRAIIISPTRELAEQIAVEARRLAAHSGVIVQTAVGGTQKREGLRRIQREGCHVLIGTPGRLKDVLSDSYNGVTAPNLSTLVLDEADRLLDDGFSDAIIDIQRLLPDPMKVDRQTLMFSATVPMEVMH

SEQ ID NO: 34520 - protein, 173 aa, A.fumigatus
RRNGIIPNWGLQRGTKPLDASVQQGNTTWASSWRGNTHGKGKELFGLGCQQTSATFCSASPIAIVAIGYPTGVPTDGDWYEDQCHGQGTFVEKKTGNKYVGGYKDGKRHGKGISYWEVADEEMDLCQICYSEEQDALFYDCGHVCACVTCARQVDICPICRKNIISVVKIYRT

SEQ ID NO: 34521 - protein, 61 aa, A.fumigatus
AFPLRRTDPRRPRTWPSQDASSPDSPPSLPLLLFLSGIYFSRNTINSSLNPSQFSNSPPPL

SEQ ID NO: 34522 - protein, 148 aa, A.fumigatus
TMYPPVFEAWSTESMAARRRLRCMWGMARKSRSFLDVLTLGSFEITPVPVQGASRRTRSKPPSALGKAVRASRFVTMVFLHPRRWMLPIRPLARGLLASLAMTQPVLRIRAEMYVVLPPGAAAISRTRSLGCGANAITGRKDEAACRM

SEQ ID NO: 34523 - protein, 621 aa, A.fumigatus
WYSGRSRFRRGRGEGEDSVGNQGRRHLGRAMFSDDEDLSDAEEKLTAANIEGLSRKLDEARQAEEEEAQRELQEFAMQTNIAGDRPDVFADAEGKPGLAPDLQLLRTRITDTIRILGDLKTLGQPGKSRADYLQLLLDDICTYYGYTPFLAEKLFNLFTPMEAFAFFEANETPRPVVIRTNTLRTNRRSLAQALINRGVVLEPVGKWSKVGLQVFESAVPLGATPEYLAGHYILQAASSFLPVMALAPQPNERVLDMAAAPGGKTTYISALMRNTGCVIANDASKPRAKGLIGNIHRLGCKNTIVTNLDARTAFPKALGGFDRVLLDAPCTGTGVISKDPSVKTSKNERDFLAIPHMQRNLLLAAIDSVDHASKTGGYIVYSTCSVTVEENEAVVQYALRKRPNVKLVDTGLGDFGSPGFTSYMGKKFDPKMTLTRRYFPHRENVDGFFVCKLKKIGPTPTPKPSAGGFTAPAAAADKPGKKADDDEVVDKTPILNEDGTTLDIEGGAFGPFDEEEDQERIARAERNRLRRKGLDPRAVLNKPKKSASKKTDASKKQEESKKEESAVENGDEKAAKTSDKVDEKADKKDKKADKSKTDSDSKGSKKNKKAASSSPGKKAGK

SEQ ID NO: 34524 - protein, 312 aa, A.fumigatus
VRILPAPVVKTQLEEGYLKLKPWRLENDQCSLPQTHANPTLQQADRSDVNKSGLQCTPEPELCASQPHTGQAGHATSVRVNEPRHYRLFGAYMNCIVTYQDCSTALLANDDFMSRMSSTVYQKLGGIPGTRVVRGFVETKRQKETPAVKSRDHSVGTKSSSDTPNTASTDHEVKSVAEISSDTCHNEDVREKETNQDDPRSTLERQMSSLAGEPQNTAELEEQARKQEEKEMEDSREADEEDREREIDHLVLVTHGIGQRLGLRLESINFIHDVNVLRKTMKSVYKASPDLQALNSSFSDSHKNCRVQVLPV

SEQ ID NO: 34525 - protein, 264 aa, A.fumigatus
LLETLLDFPYRGVRQNRKELDLADADFDDDNSYPGLNDITLDSVPAVRNLISDLAMDVLLYQSAYCEHISTIVKQECNRILKLFKQRNPTFNGSVSLCGHSLGSAILFDILCQQPSTPPTPGERRMDREGSQDILLDFDCEELFCLGSPVALFQMIKGNTIAGRSMIDEANMKRSKKACDHRNPKSFSSASRGASVQASTASSEGLTIVSSPKCRQLYNIFHPSDPVSYRIEPLISPAMSSLKPQPLPSVKKSLWATPGAKPYP

SEQ ID NO: 34526 - protein, 181 aa, A.fumigatus
AVNLAGNVVAQAAALALGKEEPLGNSWGKALSMIGSRVGQSVGTLWSNFATGVASSLLIRSLGLGSEDASQSTMTATETQMSRKSLANSSLGEDGSSRFGSGVDCQEASANRYRTLIDSNLETLYEGTNRAKTSCHNDILHSAATESVVGRESEDLRRLKMEDAKVRALNTNGRVDYSIQE

SEQ ID NO: 34527 - protein, 63 aa, A.fumigatus
ENRMQMAVSAIKNKKIKLKQEAASIFSVSEATLHSQLRGIKPQSETRANRSSPRGWKDARRCK

SEQ ID NO: 34528 - protein, 219 aa, A.fumigatus
  UNSURE (144): Identity of amino acid sequences at the above locations are unknown.
ITSQEHGKCTPDSMARSWLMFSYISPRSQFISSNNPHALQSSLSPDFCSLIMLRPVAFLAFSAVAQAHTVAWAKGMYCLGGPDPSTDNANTNTAVNPLYNLKKEDWWFQHDRGCDAAPPAEGDILELPAGGKFTVELAHNRAQXTLSYGGKYASEWPDGKEHPEDWAGPGNPPDCIQDDGALHTNTRSMAAGAAFAISYQSDLSAVTMENLAVFTVLEQ

SEQ ID NO: 34529 - protein, 64 aa, A.fumigatus
LTRARYMAGYKCNVTGSTSSKKVAPAQVPVYCADDSSKCVKGAKQMIAFNRESAFLLEVWSEVT

SEQ ID NO: 34530 - protein, 284 aa, A.fumigatus
EDNAGEDFAPEFLQEIYDSIKQNEIILPDEHENKHAFDYAWRELLLKSSSAGDLVVGETNIYDSEMFEATWKPVVATLSYVFMSASDDAVYSRVVMGFDQCAQIAARYGITEAFDRIIFSLASISTLATDKPPSTALNTEVQAGKKTVMVSELAVKFGRDFRAQLATVVLFRVLAGNESVVQQSWKYVFQILSNLFVNSLIPPFESDMIAELGIPSIPLQPPSQVVDRDARGSESGLLSAFTSYLSSYAADDPPEPSDEELDNTLCTVDCVAACAINDVLFNIK

SEQ ID NO: 34531 - protein, 318 aa, A.fumigatus
LNKACSENEVVARGVKAVGLIYHLTNRVPTLIKQSHLEEREGTYKACLVGAELAINFDNAVAWSAYWSPIFQSLSAQCINPCRDIRHHAVSTLQRCLLSVHIDSTDDKEWTGIFDQVLFPLILLLLKPEVYHSDPLGMGETRVQAATLVCKIFLRYLDQLPNREGMLELWLKILDILDRMMNSGQGDSLVREVAFLELSRNGYTNYLLQAEAIPESLKNILLVMADGGHLVPPSQDPSKEPIWTETKKRLERFLPDLFKEIFPEDLIEKPAAVPAVSSPISSSHDNTNATDANVGESQPTPGQSEIEGEAIKPETKTD

SEQ ID NO: 34532 - protein, 202 aa, A.fumigatus
TAGHRVAGLYQGCNESALAGPFPDRLLFVQFIATEPCAHALPYLFLIVYVQSINIFQDQSFMRVPVILHGISSFEQDVLESVAVPTIKGLSQCISEQGLLRNELTVSPDFWSMLQRLHQHTEAAPLVFELLRRIIESVPPIVTADNYESAVGLANDFISAGSVGYIEERQRDVAYRRSKGVKPSKPRFVSFSKSEIDISSSS

SEQ ID NO: 34533 - protein, 758 aa, A.fumigatus
RCQTGQGRKVMIVRRMSSLVGSSPYSILLTEAETPPGEIPVIDSSQEQGESQLNVESNKKNKGAPTAFYTVRENNPDRTTEAESSWALSIPSQDDSSQSAPVAPVSEASSTAALLRPSLRSKGKRKLKSLSSGSIGRQEPQNEREDDVIDPRSYKYSTTLLGGKVKSYQLDDKLMDRQQRLMSRIAYTYDVLSGNRRQRRKLREGEIIRAERMLVRVEVAVQKELPNDYTENDSLRLETKVVESWREFLVVCRVISDAESSVALQMYKTRVVPEIQKSNSKVKPYHEIALNRKNTKVNLYSCLDKTIVIWRPCKRGTKIYIIRPKSAVHATEWFTFIYQVLGRHRPSSLSINVPDLNVSLVFRNPFKQFESNGEAQKGDKIDGTSVQSTDRVADVAAAIIRGCMDLLENRTEWAEVLREWSKTEKMGLAWKRYDRLEWVVGLGEEKMYGSLAMQTTHQLQLRPRQHYQTFVKIGDEKVEEPPPVEGFLVRLTSQRGVHQRMNRMFFKRLYFFTQDHYLLFCRPAKALPPTPPKLCSDEAGIPSARQILNEMPLSYDVDPFPIHDGEITWMSSGNEAHLKEHDQNAYAHSKRSIHNVTHADGFIDICKVREVRQVWRGSSPADPNIREGLDVEFHSEAQDTHRDDGATKQFDDDRTFEMVLENDLVVRLQAYDKTTRDEWIKRMDALAKYWKARVAADSVELKAIRRRNLNILDIDEGTESVVGQCSEEWETKKSEASPLLHNICTLSGCRTIKVRCAS

SEQ ID NO: 34534 - protein, 67 aa, A.fumigatus
HFRPLGTVFEQVHTTPNDSRSNIGYAICRLNGCAIDFVPLLSLTIGLELLKWISKDKRNVQIRDIDG

SEQ ID NO: 34535 - protein, 279 aa, A.fumigatus
PLLKTDGQSTPSGDQSAAPLTSDGRFSALKAFYKDQIAATSTSPTDPLGTDFGPGFASPGALNRIMSLYAASSRLSSLYGSANKKPKSKPPVMREALTASEGLKVATPGAEDAIIQRISSEVCGWDGLASIEQRMFQSPDVRFVEDLLPLPVLLRTKRSKRCKSCKHILVKPELKPQSTRFRIRLIALSYIPLPTLRPLALGPPTGLPAITPSASSSAPNLDALPPLKPFQLLLTLKNHMFDPVRVTLATPSVTPGRVAHKSHNPLPAVRHRSQQRRLE

SEQ ID NO: 34536 - protein, 161 aa, A.fumigatus
SPAGHTNWRRQSLLPFRRDETSGNEKVAEAGKVWDKGRNWTTVVLEVVPGTLPGGSLGTRRRQSLGDDEGGDGASSPSTDDNDETNNKNASLDWSGQAQDPKNQLQPDEDVLEIPVFVRMEWDSENQMEQAAGKGQNSDTVKRELAYWMVLGVGRITAELA

SEQ ID NO: 34537 - protein, 94 aa, A.fumigatus
GRNSVLNLDYFPLRRPTPLATRKAAPAAQPATRRSSAIMAAINKIAHNSPSRQNPSELETAIAGALYDLESNTQDLKATLRPLQFVSAREVRLA

SEQ ID NO: 34538 - protein, 63 aa, A.fumigatus
WTLDSTGFVHTYIFFRSSNTVLQVEVGHGKKAVIIFVPVPLLQGFHKIQQRYEMPSRNQYHSR

SEQ ID NO: 34539 - protein, 127 aa, A.fumigatus
QDCLCSLTRELEKKFSDRHVLFVAQRRILPRPKRSVNSRTNQKQKRPRSRTLTAVHDAILNDLVYPVEIVGKRIRTKEDGSKTLKVILDEKERGGVDHRLDAYGEVYRRLTGRSVIFEFPQSGAAEY

SEQ ID NO: 34540 - protein, 64 aa, A.fumigatus
SVDDLVNTICLRCYCLRCKGRRKSRDERSPKRAEANPTTAKRNTAKRGAETPIPHQHDRAQIVG

SEQ ID NO: 34541 - protein, 60 aa, A.fumigatus
HKKRGKDPRGQFIFTGCRLNDQVTFPFPLGEVTTPAVYLMTLMTPMNAPTHFELQPRIIN

SEQ ID NO: 34542 - protein, 80 aa, A.fumigatus
LLNCLLFSGTFLSNLLNLLILPSTSPSTTFTLNLVVPADTVLLDSFLAAFLKLSRYIFPRPPSSFRSPCLGLVYRTGLEG

SEQ ID NO: 34543 - protein, 162 aa, A.fumigatus
SAEIRALFSLSLPPMPKHYRKVVHDMAGALSLKSQSRGKGSSRFPMLYKNSRTPKHTQKTIAQVGENIIENLSSLNAGPKARTSEQQETGERLLRGPPTSSVSYMEGDVVGASAPEIGAENKGRAMLERMGWSSGTPLGAINNKGILLPVAHVVKNSKAGLG

SEQ ID NO: 34544 - protein, 425 aa, A.fumigatus
CLRDGTLKQSTLEDHQTETDLRYHVHPRRTTLGASLIEKSMKTPTIVEDTNLARRVTAQRILGLPHHSHKTPTQSCATTEDALGHLLHATESTLPERTDQIQPRAIDETVDFIPFKSTHASIREQYSRLSEEEENDILTDYIANIDDDYGDYCQWTELCRSTSTESENGRMDRSANTLVSAELVNVNCCGPPNNGERIISCERGQMLTECEDESDPDLTWRGMPSQLHPNSYLMLKSPGFTAKSNGFAVLCTSLPDKHSTTGSSECSDFKTKGIGNHSEIETESNCLSRPHSNHNKAKRNHFASATAFAEALESDPFYGFDIMDFNRPSLRNKTKGNQRAFDLSLSDSELELQLERAWRNDREKKKTRKQKREELRAGGLLGRTANAPDLRAKYSSGFDVDDLRSELRSFLLSSKERYESSCSRY

SEQ ID NO: 34545 - protein, 63 aa, A.fumigatus
PRTVIGPSPEHNLTPWAGTQITVVEKHDPGIPVKTTLWAGFKPINGGETTPSRFYPLYESAQF

SEQ ID NO: 34546 - protein, 61 aa, A.fumigatus
WSSSVLCFKVPSRKHYLILAGVIPSGGDMVYMLSICGILSIRCNSSRGWISHRISVGLFWG

SEQ ID NO: 34547 - protein, 259 aa, A.fumigatus
ARRTLVLRVMPSNNKRKKKPASNPARGFATVSVPSKPKSVDSTTPASTVDSRSVTESDRPTPAEPSQPPSEKQEPSSLQNYSPEELEKHLENAELQLLVEKFAAKCKNDAARQVAKLETERRVLRQQAVSLNLSEWLPKEVQELILSLAEAEEREISPPSSLKKSSSEEELYMRLWTLRETLMKLGFPEVKVEEALKHVLFYLPGTATSSNRDVVPNLDESLDWLAMHCLSAELPSYTQSSAQTRNESERLVSYISGKF

SEQ ID NO: 34548 - protein, 404 aa, A.fumigatus
  UNSURE (380),(404): Identity of amino acid sequences at the above locations are unknown.
NQEIWRACESLSSRARLLAELMLSRSSAIELVSWLLLTPPESAFQHGHCSRALFSFDFLGTELPQEIRQSLIGLLFTTYPLYVDRPSRQAVQQCLRTILKAPVPTEDLKYLTQNLLAEASKPGLAPSSAFVLLEWCSLLLQILKNDPDTHLSIVLDIVAVDAKALETCLAARPRPTLKQSALTVTRRALRAIFSSDNWGEDAVRQSVARLTGDSAAGQKNAPFLGVISGVCARLPNSKAVLENEKKLILAYYIKELVGSKAAVPNHIASGLSDFFASFITYEDFTSELVPPLEKSLLRAPEVVLGGLVPSLCSSLPEDFDLSEILFSRLLKHLLSSMKSNNATIRQGAVQSLESILSKSKKEEWLVKIAGEIIGPIKTQXITSPEHRAVYAQAVCGILPSESVX

SEQ ID NO: 34549 - protein, 171 aa, A.fumigatus
GHHQLFDVATKGAPTGSYLDLHVSSRTRRGLSPVHLPKSRIVTDAFLSSSVIIPVSKIGSSVSNISPRRSAVSPLSSMNPAPFSASVDASSGFLTSGSTGPPFPSSRATRLENAASLLRSSSFSLHRYSASSRSNNTSFSMLASLRWSLATWGSSVVTLACSRPDFLPFFG

SEQ ID NO: 34550 - protein, 249 aa, A.fumigatus
PWTRSFVLTGCLQIPHHGIFSVTNEPFPRPAPIDEHWQALQGIVRSCRDVACTIFRTMSTALHLPADKTFESFHHPCHASLDIIRLLKYQSAPPGETTPRVPQTAHTDLGSLTMLFASTPGLQICPRGSDDWLYVMPRANSMIVNLGDAMSIWTDGVFQNVLHRVSSMPGQAMEERYSFAVLMRPADGAPMVSLMRPSPSGLEAEPMRCDIWLRAKFLALRGQKNGERKDSDIAVLTGCPDGRPRFLEV

SEQ ID NO: 34551 - protein, 105 aa, A.fumigatus
LRHAVGADRLKVLYLTGRNAALASDYALHRKRELMEHHVCECRGHNMWIEPPLNMVGSLVATRGDDYLGRQLFVAMHCRMKTIAHLLPLDSDISLTACSLGHPRS

SEQ ID NO: 34552 - protein, 81 aa, A.fumigatus
ITTPYQTSKRTYNYCQAVLPRNSYGGEDFDHLGSSPALACVDTVRLAQPEDIFCDNKRMYYYGGMEEMVLLFILLRSRYHT

SEQ ID NO: 34553 - protein, 198 aa, A.fumigatus
YYFASLPFHFRTVFCLVVHYLLYHTHISTASLFFPSPYITFSIRKSILHIMPYNTRRKSLSLPSLGIHLPNSSRRSPSASKQPHATDDPLPPSKKVKRSHDSVSSSPEPSPSSTSSTDAKDQQTIRPNGRRGIYEHTPPPSPTDGTAAPKIDIEGINDDIVVGVIEQLEKTGNRPHLVKELAAILVTLNENVAKYAIP

SEQ ID NO: 34554 - protein, 348 aa, A.fumigatus
  UNSURE (282): Identity of amino acid sequences at the above locations are unknown.
GARSHSRYPQRECRKVCYPLALKPSYAWKLTVSLLPSSANPAALLSSRLGTYMKRPWTALAPCPIAKELIPIHPRKVYYYLTTLPRRPIPENSDDVIIPGVDGKDFTPSVSNADLDDEEMMARERSLSPEVDLSSPDFEEENIDRSAGRPGHSFSEHHSHARLMHSNRAASPPLEGDEKEFTQTASAVRERASEQKAATEKSSALSDALSELENGVMSISETAIENSPLSSINEERLPDHEDSDYFSHGNYQAQQRLQQQLELEQVDTDSVAASALFGTSPXPSLASVASSLSSRTSAASDDGLEVEDRATVLASALQISLLEDPSAPSVSTLKRSIDMLNIELPDLE

SEQ ID NO: 34555 - protein, 112 aa, A.fumigatus
QMLILQGYWLQISGASVLSITDIVHGTYGEGSDGIFGDVDDVDVVREIIRDNATRRAVDNFILNLSGPRTALVFAPIIYGRGRGIINQRSIQIPELARVAIETGRAIQVGKG

SEQ ID NO: 34556 - protein, 129 aa, A.fumigatus
IFFRLRENEAAFDRYKILPRVLRNVDNVDTTTEILGTKVSLPFGFSPAASQKLAHPDGELAASRAAAKYGICMGLSSYSNYSLEDVAAQGTGNPYVMQMCVLRDRSITIQLLERAQSASLGFLSGVDTY

SEQ ID NO: 34557 - protein, 67 aa, A.fumigatus
YGAEAGYKALFLSVDVPVLGKRLNEYRNSYTLPEDMNWPNILSCGADTSNRTDYGRSSQFPMAAAER

SEQ ID NO: 34558 - protein, 110 aa, A.fumigatus
SSTHGGRQLDGFPATLDAMRVCALMARGRIPLAIDGGIRRGSDIFKALALGASYCIVGRIPIWGLAVSFVLWHVAMIGLANYIQYNGQEGVELAIRILQQELKITMALAG

SEQ ID NO: 34559 - protein, 105 aa, A.fumigatus
ACRSASPLSPVRRLILESQRPLTVNLIIHHTISHRSTIRTMGDLFVDIRTPNNHAYRQPTGLFIGGEVVAASSGQTITSIDPAYVWRILSESSPRACQDPSLSCN

SEQ ID NO: 34560 - protein, 63 aa, A.fumigatus
VSLLAEEDSGGGPAGLTGFPTVGASISGATGGSDETSVFSESVMVVSNCLTILEKKLWRKSRR

SEQ ID NO: 34561 - protein, 463 aa, A.fumigatus
LTAINITMASSPRTPHSHFSLKRQSTQHIFSCYACSYYPTSFFIAYMSRICKAMADNGEGSSRPPIWHSKSPRTQPPRIPFPYINPPSEPSPEDVLPDIFEQRPDIYPGSAWRGWRLRAPFGLKHNLPQYEMNKQCTHGIMVRRFVDDRILCPNCARQPLLGWLLLCVEDLDQPNGPGLSRGISRAMINGHYTFRERTIVRQQRAIVLQHMEQEYGLAAAPFSHIEVIQGIEPGDEVDDNGNDGLPTERMEGIRQENQVESMPCLEQPSRQPRPPCRFWCCYHCMDHIPERASIHLDGFFKNPCTAITLPWELSNKRVSDARVVRNLDNHYKQREHFFGLPTPPYTLSESMSLAIMQPRLMRLCAIASRTDLRSLCDPLKVKEYSSAGLIPGVSDSDSGSAHSFLSGGSRGILIAYAKENAVEPAEVRSTHERESDLDVEVGDDDYGLESLFRSTTLDICDLN

SEQ ID NO: 34562 - protein, 208 aa, A.fumigatus
KTVRSLHAIPPPRPHRRNPGFSPFPLSCLRTGIPSGSGVLVPLRTWGSATLKSPPSDPIIRNLTLAQVAVNMVYQFLENVGYLASKGVISKKWIDRWGGINKWYLWSIRAWFGHIIFQFFVLWRQVVLRRRKIASNPAEAQTKEGQEELRAEIRAWKKALVNNVCWAPLCLHWCFENGVGIPDSLSGVISFMAGAWGFYDLWAATAKS

SEQ ID NO: 34563 - protein, 103 aa, A.fumigatus
FNTEEITYDELTHCNQHHHGIVAENTPFTFFLKATEHTAHFQLLCLLLLPNFFLHSLHVTHMQSHGGQWRGKLETSYMAQQKSPNATSSNSISLHQPAFRALA

SEQ ID NO: 34564 - protein, 830 aa, A.fumigatus
DPRPPRAPPPPPPVKVDLPHSRPGEDMSVVEDGPLFRATMKALEQKTGNMRAKIKKVLKKAEAAQQAQGACNDAVEAFLSALSEASTTNSNAIQPALDHYFEKIARQILNYERLNTIQLQKLVIEPLVKLYNNDIKQAEAKKKEFEEESRDYYAYVSRYLGQRQDSLKEKKRAESDSQYQAKRRNFELKRFDYSSFMPDLHGGRKEHEVLSPLTRYADEQAKSFLAAAKKVDDMIPQLDALIHEVNQADKEFQFQRTEREEKRRALEKSSNLFLEPDSLANPSVPSSLTGNGSSCHMSESDLGRADSTGSQLRSVVSNSSSMASQTNAAMNSTAGIPPISSNANSSGQQRKEGLLWALSRPGSHIDPKGINKQAWHKFWIVLDQGKLSEYSNWKQKLDLHMDPIDLRMASVREARNAERRFCFEVITPQFKRIYQATSEEDMGNWIRAINNALQSAVEGRGMSPPVPSKNDSSSLGRDIGSVLTGKSSSYSGQHSQSASSVSSVSRRTTVGARPSYVRNDSTGYEENPAKLLQTVRDADQGNNWCADCGSTSKVEWVSINLGIVLCIECSGIHRSLGTHISKIRSLTLDVNSFSNDIVEILLQIGNRVSNMVWEATLDQSQKPMATSTREQRLKFITAKYSDRAFVQPLPSPLSRFSTPDETLLAAIKKNDIQGVLYGIALRADVNITDRSRNTHAVFLALAAADPASPGSTPSNLPPRPSTANAAKAIPFPIAELLVQNGAEIPSQPPPIPLSPAAQLYLSQRTTRYVTPMAGSSTADTVGSLPSIRGTAGDQAVPSGSLDSKERDRLHKRGSAGARFAGKVASLGIER

SEQ ID NO: 34565 - protein, 61 aa, A.fumigatus
RPLRLNSTATDLTIQINWLTGCIRRHVKLAALRLLRGATHKNGFKAAVEDNTDIYIVTRGI

SEQ ID NO: 34566 - protein, 91 aa, A.fumigatus
YKVMAFDQEGTAQLTETTTSYEPPPIYDTIADPIILRTLLVEDIYLPGGQFAIHLSIAHSALPKGATTNPTWPLAFPPSAEYNPFLNGGRF

SEQ ID NO: 34567 - protein, 415 aa, A.fumigatus
  UNSURE (415): Identity of amino acid sequences at the above locations are unknown.
HRPSTFITLFAENKEKKRKGLTAQEMEPTPFQSSDHGFQSTGPNVDRKGSVKRARQMLEAGRRPDIAMAPSQSIHPGPNPKVKADQSHMTQWPLPTDGVLQTSVSSTQARQFIPNGLPPERPPRPDAPSPSVYSERSMSDIAPSPLHLARPIPSFSHPLPNPPPPRPPFKGHLPPYGPDRAAYAAPRVPMTTDESFRQSTASSFMSIPSIPDFALPAQPATAETNPAQKEHQRRLAPSNAARFSTKRRSSVSPIPEELSDSPTILQGSYASSRVIPSSWGSAPAGSEFLGAYQDVESGDDQDSPPTVHEGDSNLVRQASLGKRGKPSLRTIQKPSSPSPVSMVEERSVSHIVHAATASERIAAGSKNERHSVSTISTDSSVLDPEKRRSWWTSTANILHSSTRMMIWNLRRRSGX

SEQ ID NO: 34568 - protein, 85 aa, A.fumigatus
NQARMWMSKVDPYLEASAQPLMGVLISRTVLLQAMKEEPAPDAKCKDKFLVQTVAVTGDMEFSNVSSIVRLSLAASCLPYFLTAI

SEQ ID NO: 34569 - protein, 146 aa, A.fumigatus
SAPEEEPPSYTSPGANYQTPAVGASTKFSNDTSPIPPPDFSEKPKRDAFAQQSNETSATSVKSNTSGIPASADELKAQLSEANAQIQKLKERLADQGLRQRKIGGDNEKSTPTMQQQQVQPDAAGVPLQIVAGLCLLSFLIAYFFF

SEQ ID NO: 34570 - protein, 66 aa, A.fumigatus
KYDFLVTLMIRIQQMQQFCLYLAEEHGDFSIKYHAQLSIVSYEFPSKLFRLCRMTIFQSSSQSSCY

SEQ ID NO: 34571 - protein, 126 aa, A.fumigatus
RDWTSRSRSVSLPTASVAKWGSVGSGVSTTTTTATAATTAATPAAITAVTTTAAAVASHLSETGVNLLLGLSEDSNQVTSLLGVCIEESLVMTITDRGSRKRNLLSVVKKVMAVPFAPARPVRPIR

SEQ ID NO: 34572 - protein, 432 aa, A.fumigatus
VQGPHGMSTIFRRPDKAWTSHVIPTWFLLEESQAPCHCHTTSIWVRELRKENREGRGESCDSIIPIPREATSVATMIGLLPVLNSFKTQSLSCCCLSPWIAGIVVSKRHWGNDKMIRRLTKCGPSVLAEESSNLISNALSAGENQTLVATVFHDFLEVLNHLVALFEVGNDLDNLSNSVVSRQVHGTDVHLDVVVQEVRSELTDFLGPSGGPHAGLSVRTNLRNNLANLRFETHVQHAVSFVKNEVRDTAEVGPASFQHVNQTTRGCDADFDTAAQITNLRALGNTTIDASVANPGRLSELADFGLNLNSKLTGRSKDEDNRTIAGSKERLSVDVYNGRETVGKCLSGTSFSNTDDIPTRKSHWPTLRLNGSRTLEALSLDLTQDVLGEPSLVEILDGTRNIASLHSHLVLLAELLNLALRASGNIGMLFVE

SEQ ID NO: 34573 - protein, 105 aa, A.fumigatus
FSPALSALLMRLLDSSARTDGPHFVSLRIILSFPQCLLLTTIPAIHGDKQQQERDWVLNEFKTGKSPIMVATDVASRGIGMIESQLSPLPSLFSFLSSLTHIDVV

SEQ ID NO: 34574 - protein, 76 aa, A.fumigatus
LFNADSKQARDLVTILTEAKQQIDPRLAEMARYSGGGGGHGGYGRWGGRGGRGGGRGRGGTYTASNAAPLGNARRW

SEQ ID NO: 34575 - protein, 77 aa, A.fumigatus
LTNTYSSRGGHDTGYQNGNGYSGGYSGGGGYGGGYGGGYGRGGGAAGGDRMSNLGAGLKKQDWGKLTTLDSRSDFGC

SEQ ID NO: 34576 - protein, 258 aa, A.fumigatus
KWCSYHEDLGLTVQCSRLIRTFCSEFSISVLEPRWSRDGLSLTSTLLRLHSKVTLGPRSCPRRWTLPQTDFDYRVRERVMHQVSHDSKGRLGLVAIFTNALFANLNLFKDVRDITHVLNYDYPNNSEDYIHRIGRTGRAGAKGTAITFFTTESKFLLRLPLSVIVMTNDSSMQTPSRLVTWLLSSLRPSSRLTPVSLRWLATAAAVVVTAVMAAGVAAVVAAVAVVVVVLTPLPTLPHLATLAVGKLTDLDLDVQSRH

SEQ ID NO: 34577 - protein, 387 aa, A.fumigatus
LPWIPVLTSGADLLSLDLDSLPKFEKSFYKEHPDVAARSEREVEEFRKKHEMTVQGRNVPRPVENFDEAGFPQYVLSEVKAQGFERPTAIQSQGWPMALSGRDVVGIAETGSGKTLTYCLPAIVHINAQPLLAPGDGPIVLILAPTRELAVQIQAEISKFGKSSRIRNTCVYGGVPKGPQIRDLSRGVEVCIATPGRLIDMLEAGRTNLRRVTYLVLDEADRMLDMGFEPQIRKIVSQIRPDRQTCMWSATWPKEVRQLATDFLNDYIQVNIGSMDLSANHRITQIVEVVSDFEKRDKMIKHLEKIMENRSNKCLIFTGTKRIADEITRFLRQDGWPALCKSSDHFIIPPMPLANNNPSYPRRQATTGKRLGLERVQDRQEPNHGGH

SEQ ID NO: 34578 - protein, 61 aa, A.fumigatus
YYGMSGLFQNYVNNLLDGSKGRGAFGMGHQGATGLTTFFQFWCYGEICPPRTSQTTTNVLT

SEQ ID NO: 34579 - protein, 126 aa, A.fumigatus
  UNSURE (120),(124): Identity of amino acid sequences at the above locations are unknown.
LDVVTPILGAIIADQYLGKYKTIVLFCGVYLVGLLILVCTSIPTALEHGAGLGGFIVAILVIGLGTGGIKSNVAPLIADQYRRKKMAVSTTKKGERVIIDPALTIQRIYRSSTAHQPGLXVSAXYS

SEQ ID NO: 34580 - protein, 338 aa, A.fumigatus
  UNSURE (4): Identity of amino acid sequences at the above locations are unknown.
SLLXTLNMERDIGFWSGYLLCLCMFACGTLVLIVGRKFYVVRPPQGSIITDAFKALGIMIINRNMDAPKPSWQAANGGSRRNLPWDDHFIDELKRALVACRVFCFFPIYWVVYGQFSGNFVTQAAQMQGHGIPNDLMQNFDPISIIVFIPILETLVYPLLRRFHIRFRPITRISLGFVVASLAMMYAAIVQHLIYSAGPCYEHPLCDASKIDGTAQGNRVHIAIQTPAYMFIGISEIFASVSGLEYAYTKAPPSMKSFVQSMYLLTNAFGSAIAEALTPAAFDPAIMWMFVGLACASFLVGVIFWLVFHHLNAQEDDMNKLDADDPDTPPPRAREEKN

SEQ ID NO: 34581 - protein, 343 aa, A.fumigatus
SFQPRGEDRGLEAERLQQQKLVESLKQKIEEHEATAAAHLQKIAALEQSHKTAQEQLSDLLATKDRASGEAEGFQSRVSELEKEIEIHKSAAESHKKDLESLQELHKTELAELEERAKAVAQAEYDSRIAEKNAEHEEAMKSLTSEIETSRNELVKLLKMVSELLNSDVTADNLADQIQDILTQKQHFSDKYAELIDANEDLRKQLEAKKGDANKLEDLTQREAAKDAKVNELAILVATLEDTLQRKEEQVKKKDALIEEITAEKDKSLRLVEELEEQITNSFDQHHNRLSVIQHERDQALEEAKAKIATYEKEIETYRMRIEQLEVSTAVLHTAIRIPTNGL

SEQ ID NO: 34582 - protein, 182 aa, A.fumigatus
LQLKNGAGQDSSHDRTSSLTSNLRKSTSATSLPSPPPAIPLPPLPTIQSATNGSVSPPNSRHTSKELVSVQIVEDQEARIRTIEKHLNAEKQLTATLEEALGDLEAQSNKVKADCEAWKKKAWQLEEELTALRKERNSQRLSLQAVEEERNARREAEAARAQLEERMNALNKKKKKSTLNCF

SEQ ID NO: 34583 - protein, 229 aa, A.fumigatus
  UNSURE (98): Identity of amino acid sequences at the above locations are unknown.
SQFGPAPFDMPAGEIMRATYRPDPTATRETLDFFSTIPKCAEILSQPDLRVNHPRNPDAFFHSTLRSNNGILKSIFIYQPAHSHTPASDVSPSEANAXAIPRERGQEGGRERGYLLLHLGAGVSGQPDIAHGGFLATVLDQVTGTAIRASGLDRGRGAVTVYLNVIYKKPVRVPGVVVAKAEVKKVQGRKIYVVGEISVAEADGGGEEQGVCVVCEGMFLVKRDAAGRI

SEQ ID NO: 34584 - protein, 61 aa, A.fumigatus
FSAAGDSSSNIKAQPQLLKYKWGAKSIRTTPTLPPKDLVCWQKATKRVHLHHFPRLSTTKK

SEQ ID NO: 34585 - protein, 60 aa, A.fumigatus
KVIFPSYITRSSRNKEIFKLVKAYLISSPSIRTNFNPTIVWEHDILILTLYIDFSFEDNI

SEQ ID NO: 34586 - protein, 1066 aa, A.fumigatus
PRGHNPFPKSTVRALTSTDAVPKNEKAAHDILWKSISQVSPAERALGIRAAIAAQRLGEWYREVQAWDWPKRADAELGKGFMPPSSSNVNSEEQGYYGSLPSVVVKQHEDRIEEIRDGMETLDVDELKEHVLNAHIPARSRPSSSNSTVSVPPPLTYVQLSDFTAVITATILRALPLLSRLNNLLTTWDVRLLVLRQIPGLLRALHFAQSEVDSAMDLLKATAPPSENDPLYSRENYHAKRTSLEAIVLSAGRRMDIVLDALEGREDSLPESWIDKLEAVESDFSTWVMEAEKRTVENEWLRMRSTTSESKEAQRVQNKQNRLSNIPEEEDSKFPVADSSDPSPQSSCSLPMETINEGDGDQLLVEAISDAVTHNQNSAQGLNALDPSQSHLDSSEFVSLSGPDTKISNEPSEQSTIEIAIDAVLPVDVDMPRPESSEIVKSFSEDSSDDSIGGSSDKPSNDRPSQSTPSVCQIRPAVSEAASEEVSLEELVAAATQRHGNTTVLQIPEQGRSTSIEQSSGEMTDDTSSSKKHQAPRDLQCSLPIDHFVANRPGVECLSVSSELVPENTYLVSHVEEKLCSSQLSASAQEVSSIATRLADSSYKEHKVPLKEPSFATTKNDSFRIAESETPSLRTTGTSMEQTDAVCGINENQTSSTTAGDNSQEERKQFSDGLSAVATPSDSGRQLSVEPLEDKVAPTVSSNLAEVAFTEETSAAELLDRQGLNVDIGRAIDPFDSEKSSPIENEAATLASVIAEAATTRAPSTSTSLKREESFSRSATSSPEPAKPVSNSRNDKASAVDPGEPQQSSETVPPPKIRLESPIKLSKTRPQSLNISKGNSKSQARRTSTASAGSLSDYPSLTSSPGIREPRTASSNGTPLLLETPPPFQDLSLASDYVSVGTDHTLREERLRRLDNQKVPNATVSHNRALSLPLQRFINERLDMQYESGAGGDLNGALGYRRASVASIDLRPQSEQHATDLQSSKDGSTVPTNNLKLLASQHMELSQRRQSTSKLDDATPKPSKAWANNANAFARDSVIPSPSLESTVRNDTVSSPRGWKGPRNKS

SEQ ID NO: 34587 - protein, 98 aa, A.fumigatus
QKKMHFSKFFLVAAATLAAAHPGEVHDAHALKREIRARDAYAVAAKRALDACASTTEAQQLNQRNVARRARTARQLRQNKGITTSKRPLRFVVLPADG

SEQ ID NO: 34588 - protein, 121 aa, A.fumigatus
DAHKWRRDLAALEKWEAINHNKTDVLDYSANTPESRIFGGNTSAILAPTITDGPYYVWGEILRQNVKEEKYCDGVDLTLEVQYIDVNTCRPVKGAVVDIWNANATGVYRYDLVAYPENGPC

SEQ ID NO: 34589 - protein, 212 aa, A.fumigatus
PDSGISTSGNYAADGWDSTYLRGIQQTDDDGVVTFDTIFPGHYEGRATHTHLLTHLNATMNANGTLEVGTGSIAHIGQLFWNEVLRSAVEDTSPYNTNTQAITTNADDMWSVLQASDEYDPFPEYLYLGEGLEDGLFAWIQIGINASADYTDNSYYSIAAYYQEDGGHQNSASSAFGGSGGDMNGTMPSGVAPSGAMPSGAIPSGASPSSSA

SEQ ID NO: 34590 - protein, 89 aa, A.fumigatus
RAQWWISGTPMPPVSTGMTSSLIPRTDPADLTVASLHPATTPLTAGIPPTCAVSSRPTTTGWLPSTPSSPATTRDAPPTLTSSRISTPR

SEQ ID NO: 34591 - protein, 330 aa, A.fumigatus
SIRKFWKTGRLMPSTPPLTSRPVVAIAGATGHLCKHVAAAFLSPPLNAYFSEIIFLSRHDNPPVPSVPESSGGGAVVTVRKYDEDNLPAALEGVDVLVNPMGASAHEFKRKLLRAFPSTGVQVYFPSEFGVDHYVHDFPHGEWDQKKRHFELAGQLIPQVKVCRVFCGLFLEDSIGPWFGFDTVRGRYGSVGSAKSLVSFTGLEDVGKTVASLAAMPLMSIPEVVHIAGDTRSIEEIAKVMEGAGAGPIEITEVDLMKYKEETTGKVSNDPASYLRFLMGENKINHTASGLGSDNDLINLQQKTWKWKTMKDLAKSTNGRPWKDFPWPPK

SEQ ID NO: 34592 - protein, 86 aa, A.fumigatus
KHHVQFLSLAYNELYTYRFVHAVCPRDSYPSPSNVIYALEEGLAPEGIAPEGIAPEGATPEGMVPFISPPEPPKAELALFWCPPSS

SEQ ID NO: 34593 - protein, 186 aa, A.fumigatus
GQLGGNLVYFLRPRGIGFVPAGAQPRVPPDVGEGFDPPVRKPCGGAWPIAEKPSGPDHRESMTLSPHRDSCTRYRQRAELHHVRGAGERQQPAGDGGPVADAVPVVGGGAQGQGQRRRAVHAGHAGAAAHGAAAVYGGGQVLRAAGGVVPGGGDSHTDASADQSADVSHAHCDVCAVLAPWNRVGY

SEQ ID NO: 34594 - protein, 126 aa, A.fumigatus
RKRAEAKEEITPDSTKSTQQKIKEGVTDTGDRVARGLQTDGSKSGTQEAFDKTQRSHDNHAHCRGKRIYLNLLPTPLILAPHLQLGLPSLADKVPKPFRPRNPLNLAPWESQLIIFLRSLHFCQSP

SEQ ID NO: 34595 - protein, 64 aa, A.fumigatus
LRMPAKLPSNYTSDAEAAVDSRDLQTESGYVSGDSSDVYTPEIVFTKPHLQFLNRQLQFLEPQG

SEQ ID NO: 34596 - protein, 247 aa, A.fumigatus
EILRWCITSLPHLFQTTAFGLTGLVTLDMLSKLQVPRPQMVDLIFLDTLHHFPETLALVDRVRKRYPLNNIHIYKPAGIETAEEFSKKYGAKLWETDDQFYDWVAKVEPAQRAYRELNVHAVLTGRRRSQGGKRGDLDVIEVDEAGLIKVNPLANWTFEQVKQYIKENDVPYNELLDRGYKSIGDWHSTQPVKENEDERSGRWKGQEKTECGIHNPRSKYAQYLMELERKRQEEALSQALQNQLTTA

SEQ ID NO: 34597 - protein, 74 aa, A.fumigatus
PETPHAATDKPINGNSSHHDILRTACVIVNFFLSFGCSWHFDITCSDQPYLLVPVVASTMCLLTVSSWRIETVL

SEQ ID NO: 34598 - protein, 74 aa, A.fumigatus
SRHRATCTRMSISLNLKLFSLVNANITLIILISGQVLMCLWIDRPFTYGLGITLTMRNQSVVIAQYRLLVLRHM

SEQ ID NO: 34599 - protein, 79 aa, A.fumigatus
EKEVRSYIVKTDRGIGDVDLPRQNLIIRLHEDDRKGNGSTSGGSIEHMSQVYSLRAYRNGQESFYDMHVSHASQVFAFA

SEQ ID NO: 34600 - protein, 173 aa, A.fumigatus
ASVSSPARTWSSQLYNSRSCQRRSRTSSAAAPRPAAARITCCTLLSITNLLSTAETRSHGASPGPPVAPMYRTRAGNEAGSTSDLSWMSSPCSESRLKIQSHMLCAGAVRGTSLEPPEVSSAAALGGAAGRSRRPGFGAVADDGSTSCASLRPDRVATNTEDPVGLYVALRRR

SEQ ID NO: 34601 - protein, 874 aa, A.fumigatus
GTRVFQPVVKTTSIPPQPSLSHDAMRDFHQIGGSALEIDTINSFEASAEADRFSITRLIFKDDKRFIEAAKLLNQSKAPVAECIPEPDWTDSDLLEAQKEVVQLVTLRTLSIPAGRAMLAFSGRLPLLTEKLPIPSFSLQCVMKPSNVTVSAERAFFSEEKVCWAFFHNGVSTGLAISKKSKGIDTSWILFNKPQELTNRHAGFLLALGLNGHLKSLAKWVAFKYLTPKHTMTSIGLLLGLSASYLGTMDTLITRLLSVHVTRMLPPGAAELNLSPLTQTAGIMGIGLLYCNSQHRRMSEVMLSEIENAEQEESSPSHEDLRDEGYRLAAGFALGFINLGKGKDLRGMRDMHIVERLLAIAVGTKTVHLAHVLDRATAGATVALTIIFMKTNDEVLARKIDIPDTTVRFDYVRPDLFLLRTLARHVIMWDSIRPSYDWIIESLPKIYRRRYRLTGVSRLKSDDMPFFNIIAGLCFALGLRFAGSAQLAVRDLLVAYLDQFIRICRLPAVNYDGRLTRNSVRNCQDIVALSAATVMAGTGDLALFRRLRSLHGRVDADTPYGSHMAAHMAIGLLFLGGGSYTVGTSDLAIASLICSLYPIFPTTVLDNKCHLQAFRHLWVLAAEPRCLVPRDLDSRRPIHLPITVTNTSGQKQTVTAPCLLPDLDSIAKVEIRSADYWPLVLDFTQNKRLYDKFRHGDQSVYLRRKATYNPTGSSVFVATLSGLNEAQDVLPSSATAPNPGRRLLPAAPPKAAALLTSGGSKLVPRTAPAQSMWDWIFNLDSLQGLDIHERSLVLPASFPARVRYMGATGGPGDAPWLRVSAVDSKLVIESSVQQVIRAAAGRGAAADEVRDRLWQLRLLYSWLDHVRAGEDTEA

SEQ ID NO: 34602 - protein, 172 aa, A.fumigatus
RRPVSCPIWTASRKWKSAAPTTGPLFWTLHRTSGCTTSSGTGTSPSICDARPRTTPPDPPCSWRPYPASTRRRTCSRHPRPHQTQAGDSSPPHHPRPPRCSPRAAPSSSLARRRHRACGTGSSTSTRCRDSTSTRGHSCCRPRSPHAFGTWGRLVGRGMRRGCASRPWTANW

SEQ ID NO: 34603 - protein, 271 aa, A.fumigatus
FFLATMDRVTHIIDPDGEVVIILRNANTPFAELDEDMVASIASQPAEVSTPEPAEENGLAPAEQPPEQQAEQQPEEEPEEQLQQPEQPAEDPIEIGGETEDETCFRIQVSAKHLMLASPYFKKLLTGRWRESVAYQHMGSIELPEEGWDINAFLILLRAIHSQHYRIPRTLTVEMLAKGTVLADYYKCEEAISVWTTIWINALEEEIPSTYSRDLFLWLWISWYFKLPKQFKQATSTAMSRSDNWIKNGPGLPIPTKVISKARRTLSVLSH

SEQ ID NO: 34604 - protein, 72 aa, A.fumigatus
AALKATPPSAAEKSLACVMKDLDQVIDSFLSAVVHRVYVPLVTEHAESSSSLTYDFRRYWKTRTVLNPIITS

SEQ ID NO: 34605 - protein, 168 aa, A.fumigatus
  UNSURE (8): Identity of amino acid sequences at the above locations are unknown.
SIFVFTCXCIPVTAMWDMTQLPTAKCVDQLAVVYANAAFNLLSDLMTLILPVKLCWALQTTLKQKVLLCVVLAMGSFACVIAIVRIVTMMPFVHSMDFTWYKVTLAKWAYVFFPFPLFCRFRLVGPMLMNLKDGRNQCRHHLRLSPRPPASAATRRSPVSRQQELGRG

SEQ ID NO: 34606 - protein, 105 aa, A.fumigatus
RMVEINVGIICACLPVLRPLLLRVVPQLAGSKNSGADKQSDESYTLRDAVPRKKKGIRNWDYLTTVGGTQNPREDDVESVHVRPNGKSESQEGIILSTETKITYH

SEQ ID NO: 34607 - protein, 572 aa, A.fumigatus
VQTAISRRNLPFLQPPAGIKATVAAAPPVAIPMSVMTRSRFLRPSKRGSRSTPANKRSASRSALGMWQLSEVRRMILENGSWKRKGICEQLFCLELQDPRDMSDGTDWGSGDDASRDTQGGQSKRKGFPKLPPYEPEKVGLYVLGLQEVVDVSSAAEALRPYVDPGPSNKWKAALEKALPEGFQLVSEAQLVGLLLLIYAAPSVVESISSVSSANVGTGLLGYMGNKGAVATRLMLGETTCLVFVNSHLSAGSDKSSLERRNWDASQIVGRAKFDPIDPDKGLREDPGDSIGREDFAFWFGDLNYRLEDIPGGDVRQVLARHTENEYDKRHKPSHHVEGEVPSSPMVGVEHDHKSEESFPTLSDDEIDPHTDPSSLQTTIASLLPHDQLRMQQKKNRAFHDGWREGDITFLPTYKYDVGSVARFDSSEKHRGPSWCDRILYRARHDRLRYEKRVQEAEKSRQRDEEMKARGLDKAAADDSVLFDYDPDVDGADSGDEYDSNKDKSSDSDSVSSESDKDECCRLEYYVSHQGILSSDHKPLTAGFTIKYEAVDPYLKAKVHQEVVRELDKAEK

SEQ ID NO: 34608 - protein, 329 aa, A.fumigatus
VFPSTTHILTMTTRKPRRTNNGSGNHHRPNHNGTQPSDYESDYPNYFSDTQQQQEQHMPPPPLRSNEELNLSVLRRHNPSVNTILSLAPYAVVYLFNPTSRQWEKSGVEGSLFVCQLSQGSLGEERYSVFVLNRRGLNNFDILLTDGDNVELTEEYVIIKSDYDLDTDQGISNNGDYSGAKKNVNPADVRIYGLWIYSEPPPNSTAETRTINAHMIRECAVHAGQSLKIARERLEATRQNGLHVATAAAEAGSMDGMHSSVPMGRQISLKDLFGQQRAQDDEWSVKAHNFGQPQWQQTPMEMPAAEPLPRQDVLRDLFRRAGLACQEYS

SEQ ID NO: 34609 - protein, 62 aa, A.fumigatus
LEVIYYIFSVLYTSFTKESTGVNSMSIPLHYTYSHNDDPQTPTNEQWQWQPSSSQSQWHATL

SEQ ID NO: 34610 - protein, 146 aa, A.fumigatus
SPTSSSAFPSSVRLLLFPPLPVPSYLICHCIILISLLFSLVTYWLSNFCSDAFVFFTWVMWLFLDLLAAESLVVFVTSIFPNFVIEFALVAFANGLWMSVGGFLVSPTILNPFWKYVFHYIDYQYTPHPIFFSQAVDCGRHVSDYH

SEQ ID NO: 34611 - protein, 301 aa, A.fumigatus
AGGCSDRFVDCAGDVEVCCGSLVTKVCFQSSFSVLQGLRTGACSSVSKAQRRDRIQTLLESFGILNQAATLVGTPIRKGISGGQKRRVSVASQLITCPKICFLDEPTSGLDSTASYEVISYVKELAVANNVRRIPLLVGDWTDASFAAHRHRKYPSAVDNHIPALRQIASFVKRQVLLLWARSSDIDLFRQYRAPHPVEHESRRVHSRHCQLRLLRCKGRQCRGTSAAYPGILVAVRRAEGRRQPNLAADRAPRAGQEEDHNGRTLPAKHCQYHLVTVAPLFHQELPRCCGVWHPHRHVSG

SEQ ID NO: 34612 - protein, 149 aa, A.fumigatus
LRASAGVSSRVCYCCILATLESHSVDIAKGELVALMGPSGCGKTTLLNVLARRAATSGAKTTGECYVNGGALDNATFGRITSYVEQEDALIGSLTVQETLKFAADLSLPRYASNHRSLCYKAYGQGPAALFQKHSDVTVFRLYWSPLVF

SEQ ID NO: 34613 - protein, 182 aa, A.fumigatus
DESRYWLETGLTQVSQLIVIASIHQPSTTTFQLFDKLLLLSKGKSCYFGPVPQISTYFGSIGHPIPLNTNPAEFILDIVSSDFSDAKEGNAAERVRHIQESWLQSAERRAVDNQISQLIEHPEQDRKKITMGELSRPNTASITWSLLHRSFIKSYRDVVAYGIRIVMYLGKYLSREPGSGAC

SEQ ID NO: 34614 - protein, 180 aa, A.fumigatus
LTRGLAIMMGTVWLRLHESQEYIQPFINAIVSNPCSSSERRSRSDVQFFGSAFMSFMAVAYVPAFLEDRATFIKERANGLYGALPFIISNFIIGLPFLCASPPLPPTSRPLISNLPLYNPNLTPLLPRHLLALQLLLRRIRLLHMGHVALPRPPSRRIPRRLRDIHLPQLRHRVCPRRLR

SEQ ID NO: 34615 - protein, 191 aa, A.fumigatus
PQGPDRDVSAVAFSILVLPVVGSDSNSVNLGGLHTLARLDTTVTVVDAFNLLSNFDTAEFLSDRYGSKDIIPEDERTISDLMVDQIEFADVLIINKIETVDENTRARIRRLLKTLNPEAKVLETSYSRVDVKEILDTGRFDFLKAASGAGWLRSLHEMTIQNTGNGQRMAPKPETLEFVSPALHPTSGKVH

SEQ ID NO: 34616 - protein, 117 aa, A.fumigatus
ASTGTSLSISGNIDAYWQYRLNIDAALITHHRVSQTKEKLIQLQNGCICCTLRGDLLSELAHLARQKEVQYVVIESTGISEPMQVAETFTAEFSSAMLQADQEMLVDEDSRKVLTEM

SEQ ID NO: 34617 - protein, 308 aa, A.fumigatus
QFRILEMGREWLRSRRPWSLSPLPSIQHQGRYTDLNRYGINNFVYTARRPFHPRRLFTLLHDKFILLQNNEADEGDEDEDEKEAADEGEEEGEEEDDHMEMDEDEDENDGDDDDDDESISDFEQPDPSEILKNKRNHPAFSSVLRSKGFFWLATRPFQFGEWSQAGGMLTMGCGGPWFAEVPDEAWPEDPDVRKSIENDFREPPLGDRRQEIVFIGEGINTELITKLLDECLVDDDDMSRWTKIMNNKRLSYRQKEEKLGKLWEDGWEAWPEFGIVDEDEEDNNEGGKKKHKQYTSEYQGRVQSHSYK

SEQ ID NO: 34618 - protein, 107 aa, A.fumigatus
TFRQQEIFTKNLTLGCWFWDNQFRYIQRYGVGTQSLKEPIDIVWSKQRFYAFSGSMLTRSSSQSYKIAEMNGWFYIPSKAYNTHASGFPEARKILERSEQCGRLHHK

SEQ ID NO: 34619 - protein, 61 aa, A.fumigatus
NIEPESRERAFHSGALEFALSRAYFSDELMSWIFHSGQYLFVVESSALLTTFKYLASLGKA

SEQ ID NO: 34620 - protein, 186 aa, A.fumigatus
PNFKLHRVFITAYDTIRDSVLQSRLLKHILPTSSRIAALRCRLALAFLTSDPERLTEAPDVMSDLKMIINLLKDRRFNINLYKGRGNPEYDYGELSAVTDLLNVAIDSGWSGLAFPTKEAEKDFNADVDRLSDRVKKIFVSIQDSGASHLKRTLAKEALETLHYRIINSVRSKPLPKKTIAWSLRS

SEQ ID NO: 34621 - protein, 125 aa, A.fumigatus
HPVMSQNRPGVFSNLRMGGKEHPNAESNCSENITQEPVELTALLSDHTEVVREKVQDGLTGETKEISYSQCKIVGNGSFGVVFQTKMMPSGEDAAIKRVLQDKRFKVCVHYKGNCPRCPTQRYCR

SEQ ID NO: 34622 - protein, 107 aa, A.fumigatus
FLLQVWYCHADDRQDVWSTGCVMAELMLGQPLFPGESGIDQLVEIIKVLGTPTREQIRTMNPNYMEHKFPQIKPHPFNKVTTLLKNFLRICTDLMTPGFPESSSRGH

SEQ ID NO: 34623 - protein, 68 aa, A.fumigatus
LPYHRLSQKDEVYLNLVLEYVPDSVYRASPYFNKLKTTMPMSEVKLYIYQLFRSLAYIHSQGICHRDI

SEQ ID NO: 34624 - protein, 87 aa, A.fumigatus
PQVFRRAPHEAIDLISALLEYTPTQRLSAIEAMCHPFFDELRDPNTRLPDSRHPGGAARDLPNLFDFSRHGLLSLEAQIHSSRWLIR

SEQ ID NO: 34625 - protein, 71 aa, A.fumigatus
GADCSFESQFSHSLTEGNPIMYKCQQIGSFWGNRFTQHNFQVDPVYLIKKNREERQHEEMIHVSVFIHTSE

SEQ ID NO: 34626 - protein, 543 aa, A.fumigatus
  UNSURE (286): Identity of amino acid sequences at the above locations are unknown.
VGREHWEHPGWVEENKVMQISSLAGQGLRGGFRNFIGHNFRKGNQSGEGEWIFNKDFVANVYVGLTSLLKGGKPNLSLLLDQLFGLKASAGVGTPTAKREPTILSDLICSSDLLARLERYLNMHPQKRGEDLLSSLRSYRDESKAFHHRYQKQRKKTDKGKGRVLDLPTAENMHVHKMSLVTQVQDLFPDLGSGYIVRLLDHYGDNPEAVVAHLLDDSLPPELQELDQSEQLPVSETSPRHDPVPPHATPPEIPSPAAPAPRKNMFDNDVDLAEIARSADQARQGXLHFGRRDSDLTADTILADRSQHAVNKAAIMSALAAFDSDDDEHDDTYDVADVGGTVDGLTAVTDAEADADIRNRRAEDLDMTLFQAYKANPALFARDSATRRSQPRASLKRETGMTDEAIEGWSVMLARDPKRLAKLEDRFTMLAGAPGGALAQPELPSTAYRKPGPREDGESDSDTDQPSSASGGRGGPRRGGGRGGRRGGGGGRARRGGTNAGASGDQNPTVARQRKEENKASRANHNRRQQRARKIARGGGMPG

SEQ ID NO: 34627 - protein, 128 aa, A.fumigatus
LAWMTELIFCPLGMVYIRNYRLSRDTHHKMYKMCSVSFVLRNRSTWHATTPGNLPGSLLASVVIRPASLIFFLPLSSHSGVLVSRSSSISPSSARPATTATSSTTATTAPSGTSSATRSGTGLIGVTI

SEQ ID NO: 34628 - protein, 75 aa, A.fumigatus
VGLASFQQRGQANIDVRNKVLVENPLSLSGLIPLPKIVSYEIPKPSPKPLARQGRNLHNLIFLHPTRMFPMFPSH

SEQ ID NO: 34629 - protein, 231 aa, A.fumigatus
RVFRAPYYDRIMHFDAMANFMLRYQNYLYYPILLFGRFNLYRLSWEYLFCGQAPKKGPAWWHRWFEIGGQVFFWYWFGYGVLYRSIPNWSSRIAYILVSHMVTAPLHVQITLSHFAMSTADLGAQESFPQKMLRTTMDVDCPTWLDFFHGGLQFQAIHHLYPRIPRHNLRRTQKLVIDFCRDTGIPYAVFTFYDGNKKVIGKLGDVAKQVRILEECRKSCAEQGVFSDHHH

SEQ ID NO: 34630 - protein, 428 aa, A.fumigatus
AVETNCRPSPSEHHDPHLSRLLQSRALPGDRRHISGSVRARGDFSYQCIPKDTKSASLLPFERFWFSIPVAEPRLTILVDFEEASHIFTDILITSPHRLDSLDHYSNILYVMGARPQLAFVAQVATATDKFRPETCCVVGNYYSLKSEHEKAVMYFRRALTLDRNFLSAWTLMGHEYIEMKNTHAAIESYRRAVDVNRKDYRAWYGLGQAYEVLDMSFYALFYYQRAAALRPYDPKMWQAVGSCYAKMGRVEQSIKALKRALVAGSYYADDASQGGGMGGPGRKILDPETLHQIATLYERLGDEEEAAAYMELTLQQETGQGPEDESFASDNDNDDDQSGGEGQQGSRRARQSSSFGNQNDSEDGTYHGTGVTATTSKARLWLARWALRHGDLERADQLAGELCQDGVEVEEAKALMRDVRARREGGG

SEQ ID NO: 34631 - protein, 149 aa, A.fumigatus
FAGKAKPGNLYSRSKRIARPRFQFPSSVKSPWFLPLYAKYLAGEKRKDEETEMVLAPADGGMTFNRELPGLAWGLEGWFAERRERGLEERNQGWLEYLYGVVLLKGRNEEEAKKWLIRSVHLNPFHWGAWQELNDLLSSTEDVRCHAAD

SEQ ID NO: 34632 - protein, 429 aa, A.fumigatus
RRIFGPLVKIQLSAEEARMVPAEDLHHEEEWRRQLQQGQVSSYYIVTKSQTTSSGTSSCPMTASSPSKGPSFEAIATTVIRTQPQHLSGDSIQQWNRVDDERVPADAISIFVDDSMATVSSPESSEPPRKLLRSNDNLSSIQGSSKKRNQESSSNPSKGNSASYGEENGTTFPSNDSNASIELEACITLPLQPRKRRRLTENHASNVAPVVPSSCSNQPRCVKAPLTMIPLYFRQDLDRGDSTNTLIPPNSSNLAGDLQTFVQKVCLNKPYPTKSSNSNTGHLNPALGLLIATISQDSLGRLLLEVSQQVSTALKSNRHKAPRSGKIFILDAKFLVLKARLDDPRFLFRMTWESIGREYFYACVSWSLELGVEYADGGASEIRGTPANSDGGQRSCLRELIKSQSAARAPRVSITFDSRELGDLGDLGA

SEQ ID NO: 34633 - protein, 102 aa, A.fumigatus
FEIDGDDFVSRGGSCIVSCLGEVLAGPIWEVSADDAPDSTVTARAAGADTDGNAVGDGLLVAEIDLYDCERGRLDMDVAGSYSRNDAFRLTVEGLDLSPPPF

SEQ ID NO: 34634 - protein, 526 aa, A.fumigatus
LFLHRFVSKNLVIVFIRTTIYWTWVEVGIGVGWGGGEGSLTLFFFFLFFFFLPGFFFRPPGTIIGSIPLSMPWFRKKHKSPSPAASPAFRSVEQLTIPPPSTGSSPRVPPEDLAFYQRFSDVRLPTSPADPPDNSYRQQPQHEQQQHHPHQLYRHRHRQDHPDHQNHSEHPPPHQPTITRTQSHHSPTLLNSVLATPALPAATHFIDADPADQSSVDRASEQPALAPNAHNSNKQDPLQKSRRKLFGLHSSSSSSSSTGFLERSLSVKGTSSSQSSRQRRHQQQLSLDTQRTHRDRDHQKRTRNINYHSSSETVPEDHVVDPNRSSSQSLLMQQDPASAHQRPPRSPQRPPSIQRSNTDPSLLEKLYSSSPVDSASRQPADPSRVISNQSQTHLQQQQQQPQQQSPVSQLQVEPPLSARPPSRQSMGPPSPLPPFSHQPDPHPSSTHQSGMASSSDRPAGPPQTQPQGHPAFQGGGQQNATESGRSTPPVNSSRRDDLGDIDVRALLQKHDELRKRCTGAPVGQTY

SEQ ID NO: 34635 - protein, 61 aa, A.fumigatus
SADDGEQLTVISTEVSGDVTTLDPFSLIGFDCGGLSLPGPQVGQCPLVSWSFPYCDIAEKR

SEQ ID NO: 34636 - protein, 149 aa, A.fumigatus
EIVNMGAGGVVIRFFNLAIRVLQFLDAAVILGIFSYFLAVQSQHNQPIPTWMKAVEGLSGAATLYGLLGSLFTCCVGGLAFFAFLAIVLDVCFIGAMIAIAVMTRDGTQSCSGIVYTPLGSGADNIDRASGVRLRYSCMLYKSTGAVSF

SEQ ID NO: 34637 - protein, 319 aa, A.fumigatus
IFPSPTSVLNGFLFSPPCFSSPCLSVSSKTASSILSTQQPVMSSSQTMTAPAVGHRPPDAGPDMSSLFEYGRPHHHHHQEGQEPQQQQQEQQNHQQQRDNGSFSPRSDSANRALHDSTSNNSVSPRGLPSSSGMNGIKSESSDAGNDFAGAQPDYQNDLRRQSAASALLAQLLGNQSSAPPASTETQPAESSSSTNNPLNPTENSENNPSDQIAGGQGSTSVSTEITAPAESAASQDQFSTSTDLPRLPGDGEKNREERPADMSFSKSEESGNHGVNTVMNTPDPAEGLTDPMMFSQDGLERLRSCIHTRSLEGTAICG

SEQ ID NO: 34638 - protein, 204 aa, A.fumigatus
ADCHDLPKTSVKTISNLGANNQTKRETKMPPKSKKQHPKPKSQPPDHPKPNWPPLRPLIPSSNLSLESLLHDQIYLIRNFLPSSLCKTYAFFLASLPLTTTPSKPKKGEAVRVNDRFQIQDADFAERLWSGTALRELVSGAVDEDQDGDGQPRSNREIWGGEPLGLNANIRVYRYSRGQFFAQHCMSPPPPLSLSFLFFGDEMG

SEQ ID NO: 34639 - protein, 61 aa, A.fumigatus
FPDSSDFENDISAGLSSRFFSPSPGKRGKSVDVENWSWLAADSAGAVISVETLVDPWPPAI

SEQ ID NO: 34640 - protein, 156 aa, A.fumigatus
  UNSURE (4): Identity of amino acid sequences at the above locations are unknown.
RHGXGLMGPSYFFWPLVPACASQEVQVERGKDTLKPLQGLIPLVTMWTLVPVYLYLQPTILEHYTIPFMLLVGLINAYAVGNMIVAHLIKADFPFSRIFIGIVPLALGVLDGAAPLLGLWQSVLGSESGQVAYLFGCLGLAIGVYGSFVVRSAARQ

SEQ ID NO: 34641 - protein, 72 aa, A.fumigatus
RSVKLLFSWRGVPDIWHMSTVQHYINPFLHIFYSLLLNSVLLLVLTALVDIVRRFFSLTDCISVTLEKRHGR

SEQ ID NO: 34642 - protein, 60 aa, A.fumigatus
TLVPAPRSFFMDVKCPGCFTITTVFSHAQTVVVCAGCSTVLCQPTGGKARLTEGCSFRRK

SEQ ID NO: 34643 - protein, 155 aa, A.fumigatus
TTSLLPVVCLSSPDQFSSQKVVKVSSANTISSFHNRFSRSTSSTLLLRLRLASTSLRYDTAIRTSPPRSRIRWLMLGIASTNRPLCLLPVPSSWTSSAPAASPSPPSSPMPRLSSSAPAARPSFASPPVARPDSLRAAPSGGSKCHITMQPKPER

SEQ ID NO: 34644 - protein, 113 aa, A.fumigatus
WTCKWRAAFAGWIRRSAKTHNLRDATSSEREAGTPNHTPNGTRSSGAAVVKVNADVSLSGGPITPKGRGVENRGKLSRSASRKSVVEIIPDDDAPQENNIADADTDGDAVMQT

SEQ ID NO: 34645 - protein, 752 aa, A.fumigatus
HCTDVGPWRCPTCVGEKLQPSTEQNGTNPRQPRQKKMRRELLPAHTGEKGPGFHSIFSTVDVSDDLLTSSRSLRKRKASSTDVGEPTPGHRKLRRQSSMRSARAESRDQGFGNTDGQSPVRTRSRRTRGEEKGTCRVVLRQFGRLVLAFRLNETKVSKILSSRSRSQLRGRRTPKPPPAVQEPLSHFAPITPAPYLSPFYSFNDRETDESKSKPYGGILSEADADTSRTLPTHTDRERFEIARQKAEEEWQRKLLEIENSGEAAPHASQKLSGPPSRIKYINFGGYEIETWYAAPYPEEYSRNRVLYICEFCLKYMNSDYVAWRHKLKCPAKHPPGDEIYRDGSISIFEVDGRKNPVYCQNLCLLAKLFLGSKTLYYDVEPFLFYVMTEFDDLGCHFVGYFSKEKRPSSANNVSCILTLPIHQRKGYGNLLIDFSYLLTRIEGKTGSPEKPLSDMGLVSYRNYWRLILSYQLRNQKTPISIAELSERTGMTADDVVSGLEGLRALVRDPITKTYALRLDCKYFEECIRNWEEKGYVQLNPDALVWTPYIMGRSNQSQFDRAPLHTVAQREDPEEEEGEEVKKADGAVIPTASWTGHADSGGRSTVAAGPPSTQALSNTSGFHHPTTATASSSTSAPSDPAAGIPPSRFEIYPPVQAPVFKRKPGRPFGSKSVFKAGGTPTSARTSGRGTPRRTSTLASAATPTSNPGSVRRGRSAKLMDSPAPEPSGAKTNGLVNGEQHLQDGSEEAPRHIT

SEQ ID NO: 34646 - protein, 173 aa, A.fumigatus
  UNSURE (150): Identity of amino acid sequences at the above locations are unknown.
LHDSSGRTRKTKAIDFGFSFGLASAPPESTSEPAPQTATTVTATEPAGSSQTTSVLGETAKSLVSAAQTPSSRNLGSGQRTPGSARNGLPERPSMFDIPSDEELELGRSSKRRKIGMLLRAPDDLITVSNNAKFKNLPKLTRHRANSDVXAQETSLAQSRAGQHEEKRTREPS

SEQ ID NO: 34647 - protein, 559 aa, A.fumigatus
ATRIPIVCAIIVLFYLHRRNVKKLRQEDANDKHKSLDFGLDLEPRAGSKPMTQAEKGSNMHSKGMSLDIGQSPYLLPPGLHGSRESLHSLSRSIIGDDDKYRHASSFLGDNASVRSQPRGFHDETSAFSRSQSKASLRGDDMNQGLLQNAQRMSRSSPPLYNAPSDGGSSHSPRGQGNGQDMGLQLNLPRSLSPVHIPGVNGSRGTSPAPGGHADGSEDISSSETRNANLPQQPLKNAMDPSLELHLDTREQQGRPIQEDLSTKLGSTSPSKQSPSVPTPRISLPVSDAASDYGDNRNSHAEIPAVNVDGAEDAQKRDGAPNHAAAPPIPQEPLQSQNQSLDVRRDTRRFTLGLRPLPPEDPSDNPEQRANRIRSFYKEYFDESKTGRETIYEDYGPEYFQDDGYVYDPATGEYYDAVPAPFAEPVNRRAMTPPPRAPPRFQGAARHMATGSVGGGASDRSNYPGPRAFSSASHRLPGPRAPRKPMPPPSPLQVLPSPHLLKEDSLMNAAEYAPGMNYKDKREGRAETPLGGLRPYTPVTPARTPLVSAFDELAPIPSP

SEQ ID NO: 34648 - protein, 71 aa, A.fumigatus
RSIDLGDFCIGRPTQKSLRPDELGRPCIIITNIYIFPVMESTWPCVPRRVDQTLYLETVCLSWLAPKIQPL

SEQ ID NO: 34649 - protein, 73 aa, A.fumigatus
MAESKSGSPYAVGASPGTRMRGSVKRFAPASRTSTWVFGSATNLLATTNPDMSPPLNDQIKGCDVYQQPSWYL

SEQ ID NO: 34650 - protein, 70 aa, A.fumigatus
VQSLVRSSVSSQLLYQSQCLILWKATTSSELHMSKGLPALLDAINISHQQTLNPANTPLRVDLQDKMETA

SEQ ID NO: 34651 - protein, 238 aa, A.fumigatus
GYLCSFDRRDARRCDPGSVSFCSSRPGVCVVRLRAFSPRLRRLKRCEKKYGEMTKTYIKCLCRRTFLRATLPQAGKLFITRRSSVGLGSTNSCGRSSRGRSHGGWRGRSRHRSRGCSCRLRRRLLLRDRCRHRSRRCRRRSSCVVVGCGILVFRHCAKTDFLSLFLGAAENEGRISRQVNCDESCFPTQGEKGRKGEGIKRVRESVCWRSNGRRLPENNQQDSVNRCANDNAKQAVKS

SEQ ID NO: 34652 - protein, 62 aa, A.fumigatus
TPRYRNQQQHNCFAFGNGGSYACTYLAGAAFVAACSYNPGSCVYFDPSSLRDCDRGCCDRSC

SEQ ID NO: 34653 - protein, 132 aa, A.fumigatus
  UNSURE (58),(61),(83): Identity of amino acid sequences at the above locations are unknown.
QNQDHICERHVGRKSTNNLNLTCQWGSCRTTTVKRDHITSHIRVHVPLKPHKCEFCGXAFXRPQDLKKHVKTHADDSVLVRSXEPGARNPDMMFHGAGKGNDECRCSLCTLGADMILLDQAMLLPPITSSHP

SEQ ID NO: 34654 - protein, 152 aa, A.fumigatus
YPPFILRCSQEKGQEISLGTMSEHQDTATNNNTTASPSATAAPMPAPISQEQPSSQPAATTPAPVSTSTPPASVTATAAAATAAVSAPQANGTPPSDEQLSCLWQGCSEKCPSAEALYVSLCHFSILFFASLQSPQPRRKRPQPDNTNSWPT

SEQ ID NO: 34655 - protein, 247 aa, A.fumigatus
PGYAAAAHYFEPSLNAVPSQGYAHGAPQYYSSHPPHQPSNPSYGNVYYALNHGHDGHASYESKKRGYDALNEFFGDLKRRQFDLHSYAAVGQRLLGLQNLSLPILTGGPLPEYQPMPAPVAVGGGYGPGGHGAPVYHLPPMSNIRTKNDLINIDQFLQQMQDTIYENDDHVAAAGVAQPGAHYVHGGMSYRTTHSPPTQLPPSHAVATTSASTSMSNPATHSPPTGTPALTPPSSAQSYTSARSPIS

SEQ ID NO: 34656 - protein, 544 aa, A.fumigatus
FSFYSDSVVAHGIITQVGSGTGHNSSRPLLTWQCLLIVSSPPSSGLVALTLYSFLYTLLVFCPVVTSYDLHLSPFPSEESCLTIPISLAPGRAIPIGTSLSPTTLTTTTSIAAKSTSTAHNYQADPLVPDPSSRANTSNVRVVSLAVEQMIGKAKGTIIILSSLIAYFSINSLVRALNPDAFIWYDEDREEQRWIASSPSWLDRKACRWLSLCGTAHFHTVGPRFGQRRVLTEPNASVTAQDEVAPWRSFWFREQEHLANQWDDAERSLREIPDYVFEYAPLVHLFSKEQFWPCDIAEHLFHTTPMLNYTPVQSEHSHPTLEDLDRLNQWQDGRYVFLTSNDNVEERPPWMEGEKNIPVAPDEHEEESWSDWDSRVDGAIPGDTPEGRLKWYDTNHNSMSKDEAANLPWENLGYSKSEDLLQDERVRDELRKRYGGEPVKMQETGGRSEAPAVLLVVDKGNGIVDAFWFFFYSFNLGNVVLNVRFGNHIGDWEHCLVRFYNGQPKALFFSAHSAGEAYSYEAVEKIGQRVSCHSHTGDFGWVRG

SEQ ID NO: 34657 - protein, 171 aa, A.fumigatus
VATPTLVILVGLEADQLFPMCIQPVIYSAVGTHAMYATPGVHSYVLPWGLLHDQTDRGPLWDPLLNSHMYTYDHVNDTLRASTASPLAPTEWFYFNGHWGDKFYPLGDRRQYRFAGQYHYVNGPLGPRFKHLHRRKVCQGPDEDPCVIKDWVGEKMRPKRLPNPRPHENPV

SEQ ID NO: 34658 - protein, 97 aa, A.fumigatus
PLLPQSIPLISRLAGVLSHQASDNVKKLGKNNDLIERVRRTAFFAPILDELDTLLDPSTFIGRAPQQVEKFTSTEVKKALEPYEEHLLNAETAALYV

SEQ ID NO: 34659 - protein, 138 aa, A.fumigatus
TVGKRACLWIQDLLMDLRNLERARNDLRFRGVKGTTGTQASFLQIFNGDHDKVEQLDELVTKKAGFDSAFIISSQTYSRKIDVDVANALGSFGSTCERIGIDIRHLAMLKEVEEPFEKDQIGSSAMVSRTLAHKVRSM

SEQ ID NO: 34660 - protein, 85 aa, A.fumigatus
TYHAMQAYKRNPMRSERLCSLGRHLQNLPKDALDTYSAQWFERSLVSYTPQRRRMHATFSLTFSRMTALSAVSAFPSFTFRPMPA

SEQ ID NO: 34661 - protein, 203 aa, A.fumigatus
SESVPARICFSQATNLGHGALMPAQPVSCQLQEDIHIGADFLCHSDVPHVFVKVLGSPASRDSREKVQKLLARSDSQKKLVPVIHSVSLSTSFSLSAAESSMDEWLALPEVNKQYTPLLWVGPTAPGHEKLSTDTNIPANSAVWQYALDTTKAARSRGMEVLGMYNATLQAASWDGKHYGEKVAMMQAMMVSSRLCSEADYLI

SEQ ID NO: 34662 - protein, 139 aa, A.fumigatus
KVGRAEFEDMLPRKLICPDTDLLAAQSNGYRRMSANLYRTKNEGEFFHIHGSLEATTTLNMIGLEGHRPDLTDYEEIIEVIESHVQKYSAAELEEMNKERRQAGVTAFKYEDFINTPHVRLVNRSVATGPQADCFAGTA

SEQ ID NO: 34663 - protein, 126 aa, A.fumigatus
SIVPSLLDHKLIVLQGRLNVQEPPWKVKRLTGDLPPTPFPASRSASRKILEGIKVLELCRIIAGPTVTRILSEYGADVLKITSPNLPDVPFFQVDGNMGKHAADLDLKTTEGRRQFVFTAGLQRAL

SEQ ID NO: 34664 - protein, 135 aa, A.fumigatus
TRKLRVNMTDTETDNPYSPVDEARLIFSYLCDQAERLSLPPQIVENKDAVSFSSSHNEIYYPIPFKETETLAALKGVEGAVASAIADLRFGEQKRNVKINLEKATAFGCQAYMAKLDGLSKLDPAVKSKLKGRSS

SEQ ID NO: 34665 - protein, 63 aa, A.fumigatus
GVFEIRSILLLSFGYQFLVWIWQSSSDALSKAQSNFFVNGARNERHSWVDKRELEVLNPETNR

SEQ ID NO: 34666 - protein, 277 aa, A.fumigatus
FGAHAPILGLVRSSPEQLWIHVEMERMVGELGPNIIVCMLTVGFRIEDLELPLVHPRMAFITGAIDKEIRLSFAQRIRGTLPDPYQELITEGKEKDTPDFKYSSDSESYLICCPRSAYSKGLTKILIPTATPYAKEGREIMQLIRRKAGDEEIQPLITAIEEQAKALGVDDPMLPSTDAFVTSICFVGSKSLSHVLSCIERNKERLLAIGPKSARARCQIITSVMEYWVDQPGVAINIIDKLLNYTILTPLSVIEWALVERLQAGTILQQNTSSQRR

SEQ ID NO: 34667 - protein, 308 aa, A.fumigatus
LLGLELVKIILFTIPYTMASPATGFEAQASALLEKTDIIASTPHALVDLVNPFALKDGEPTAVQSVISLLQNQLQAEANRGWELACLPRPWKRSESEEDGPIEAGPKHAFPQITVPNPVRKGARAIFPEIYLSVYANQDLETVPPTSDIASSLLREALVDTINILDFNRIATAKFLIDVDCYFTPYTFVKRATPFDRLRDLPGDRPTWKPEDVAVDAVFSQLFQLPSPEHKLVYYHSVLTECCKIAPAAIAPSLGRAIRFLYRSLDTIDLELMHRFLDWFAHHLSNFGFTWKWSEWLVSLVRTSLSVC

SEQ ID NO: 34668 - protein, 98 aa, A.fumigatus
MSGADMLNACRSLIALSLIMALLQFKPAPMYILDEVDAALDLSHTQNIGRLIKTRFKGSQFIVVSLKDGMFQNANRIFRTRFSEGTSVVQALTPADMK

SEQ ID NO: 34669 - protein, 152 aa, A.fumigatus
MMPGILPFSIELRRPQSCVAHGANQAVCSAGRNNNCQMSPSSVILPTATLSLWVSITISGIERLPGTLIQSFSNVNPDNSSGVPNYYHLHLNTISWVYLVTSRLQIYQPWSYPRVDQISHSADNNARGRTIAQHPVAAHFSSRFFLRYQMVP

SEQ ID NO: 34670 - protein, 69 aa, A.fumigatus
ILKFEYSSHRPKYQEKTGQTAGSYPLVLNGPECSVPRYENTSSGTMHGGSGVRNNHHHHHHHHHTHTPP

SEQ ID NO: 34671 - protein, 179 aa, A.fumigatus
LCSFRTGWRSKRYVILFPGKRMPLGGRSCLSQQNEVANHLDDEDPQEGFFPNDEKTQKYGNLLFLLQSEPRHIAHLCRLVSMSEIDSLLQTVMFTIYGNQYESREEHLLLTMFQSVLTYQFDNTPEYSSLLRQNTPVSRMMTTYTRRGPGQSYLKQVLAEQINSLIELRDVDLEINPLK

SEQ ID NO: 34672 - protein, 74 aa, A.fumigatus
SACRPFSASFQSISLGSPISSHPPCAPYFTVHNHFLPTISYTNGLDVLFKLLRLRQFSSDCLNCFPAPRDRFLP

SEQ ID NO: 34673 - protein, 72 aa, A.fumigatus
VTLIGPVETYRLRCLIGSGTAQKYLRELKAKISSQSKKNFVLEKDVRYLDSRIALLIQNRMALEEVCYSISR

SEQ ID NO: 34674 - protein, 113 aa, A.fumigatus
NPENLMELLNQLDGFDYLGKTKIIMATNRPDTLDPALLRAGRLDRKIEIPLPNEVGRLEILKIHSSTVQLEGEIDFESVVKMSDGLNGADLRNVVTEAYGSHLRTPLFTGINC

SEQ ID NO: 34675 - protein, 222 aa, A.fumigatus
LVESLGYDEYKPITKEGKQMVPGGLGWIIVDALDTLMIMNLTSRVQHARNWIHNSLQYNQDHDVNTFETTIRMLGGLLSAHYLSTAHPGLAPIADDDAGSPGEDLYIEKATDLADRLLGAFESKSGVPYASINLNTSTGIPSHADNGASSTAEATTVQLEFKYLAKLTGEAEYWRVVEKVMQVVDDQKMEDGLLPIYIYPDSGHFRGDNIRLGSRGDSYYGE

SEQ ID NO: 34676 - protein, 322 aa, A.fumigatus
HSGFLEYLIKQYLQTSKQEPIYKELWDESLMGVRKHLIAYTKNAQLMILGERPSGLHGKLSPKMDHLVCFMPGTIALGATGGVPLSEARKSPDWNQRRDEEILIARELMKTCWATYLATKTGLAPEITYFTLDDPPKMFHDMYPDSTASAGNRKSQGADLPMKSQPLYPLDDETLKWREDIQIQSQDRHNLQRPETVESLFYMYRITGDEIYRQWGWEMFKSFIRHTAVVEHDHSHETDSPADAAAGSQSEKVARPSRITGFTSLSNANTVPPVPRDNMESFWMAETLKYFYLLFSRPGLYLPGGPCVQHGSASAATVSAYG

SEQ ID NO: 34677 - protein, 64 aa, A.fumigatus
RGYGSVWLTSSNSFIYRNKLLTLHSGLFAIKDYRDAISQDDFNKAVRKVAEAKKLEGKLEYQKL

SEQ ID NO: 34678 - protein, 68 aa, A.fumigatus
ATPTPCPLYPETTWRVSGWQRRSSISTCCFPDRDFISLEDHVFNTEAHPLPRFQPTGDLKTGWTRKPR

SEQ ID NO: 34679 - protein, 217 aa, A.fumigatus
  UNSURE (5): Identity of amino acid sequences at the above locations are unknown.
FLAEXTELALVPGPKGMLGFEVAAHGHPAHSGYPWWAKRAISAILPALGRVDQLGDIPVEEGGLPPSDKYGRTTVNIGRMEGGVATNVVPSKARAGVAVRLAAGTHDEAREVVLKAVRDVTGGDDRVVVNFSLEGYGPQDLDTDVPGFNITTVNYGTDVPNLQLHPRPDGKVRRYLYGPGTIHVAHGDNEALTVAQLEEAVRGYKKLIQAALDRSAS

SEQ ID NO: 34680 - protein, 145 aa, A.fumigatus
  UNSURE (31): Identity of amino acid sequences at the above locations are unknown.
ETAGDAMRPFTSPPPQPLPRRFPHRNFWRNXPSWPWSPAQRACWALRSPRMATPPTPDTRGGRRGPFPPSCRRWGAWINWVISPSRRVACPPAISTVARRSTSGGWRAASRRTWCRARHGQGSPCGWRRARTTRRARWCSRLSGM

SEQ ID NO: 34681 - protein, 201 aa, A.fumigatus
TTQVPQHVTALLSHLTSRPGVQSTFILSRKDGSIIQSTGLLASPPPRNSTTSETQTPPAPNDANSTTTIPTESLDPSSPAGASTARAPTAQKPYQPSQAEALAARIFAFVESASELGMTLSCPRAEDMDSYQTGLNGDGAGRDDARSEGVDREEEDEVKLLRLRTKKHEIVVVPDRKYLLCVVHDAAHASGGSGVAGVRSR

SEQ ID NO: 34682 - protein, 92 aa, A.fumigatus
SRSDVQGRITSYLSTTNVQLGATYGISRAATTAFSKGYEAAAKFVNASPDEVCSLTLVAPACSDPITSDLLGYINNSALAQPFDRAQVRTRR

SEQ ID NO: 34683 - protein, 128 aa, A.fumigatus
LRLALTPLPQICLGISTTQLLHNLSTALKFEPGDELVLSKLNHEANTAPWVRIAERLGLQVKWWSASDTRNPVCDLDELGQLLSEKTRLVACPHASNITGTITKVKEIAKLVHQYPRVSSLVASSCHC

SEQ ID NO: 34684 - protein, 238 aa, A.fumigatus
NKLCAGLSLPEVKSSCQDLAKSHRNEDESYTRSSTPGRALFEFWTSTFSKNQSLYNAVLEDCYDQSTSICLLCARGESRVSAFFKLLTNHVHASETDISIVGSLPKDAPDVGLGLVGAPACGDVMKLQIRVDKDTSKITDVKFKTFGCGSAIASSSYLTELVRGMTLDEAAKIRNTDIAKELCLPPVKLHCSMLAEDAIKSAINDYYTKNPKAAKTDLSGTAASISNVEKTDGSTASL

SEQ ID NO: 34685 - protein, 186 aa, A.fumigatus
LVRIFQPVVKTVFLEKNGSIFIKLGQHLSSMGYLLPLEWTTTFVPLQDKCPVSSIESVEEMFVTDTGHRIDELFSSFEPLPIGAASLAQVHIGTLKETGQKVAVKVQHPALAEWVPLDLALTRFTFSMLKRFFPEYDLEWLSNEMDFSLPQELDFRMEAENARRASEYFKNHSDAPLVIPEGSFHL

SEQ ID NO: 34686 - protein, 338 aa, A.fumigatus
VFQKSLRCSVSDSGRFVPFITIKKESSAALLTPQAVMWAQKRILVMEFLSGHRPDDLEYLDSNHIDRDEVSAAFAHIFNEMIFGDNAPLHCDPHGGNIAIRKNPNRRRHNFDIILYDHGLYRDIPRDLRRNYAKLWLAVIEADEGRMREYARKVAGITDEQFPLFASAITGRDYTVLANKDVASPRTAAEKENISGALGEGMLQQLVELLGQVPRIILLILKTNDLSKLYSLTMHSFPSFCFLLEFPANIACSPPSARSLDENLHTRQGPIRTFLILARYATRTVFEEKMENINETGGMLRPLNFLRFLWAWTGYLRVELKLSIYETLLSMKSRFGLI

SEQ ID NO: 34687 - protein, 322 aa, A.fumigatus
  UNSURE (306): Identity of amino acid sequences at the above locations are unknown.
LGIGFPPLALGLHGPNKLSRHYEAEDIEWDLDPSRTILASLSIGILAGAAVALSSSLADVSKVGAESVRVSFRLGVYVADISTKLEAPQSDGTLQSWAHVVTGMSHEAVQEELSQYNAVTQNPEITKVFVSAADKTSVSVTGPPSRIKAAFQHSPSLRYSKSLPLPVYDGLCHAAHLYSQDDIEIVINSAKSVIPTSRPVRLPLISSQTGKPFAAKTAGELFLEIGTELLTGTIFLDNVTAGILEHVKLQEPTGNYEIVSFRMSQVLNGILTAIETDFPELGRARRDMVSWVHGDYGARRPLSTRXQSSPFLYGLQANGKRQ

SEQ ID NO: 34688 - protein, 280 aa, A.fumigatus
PSMSLQLNGKSRGTSPGNAQPLPIFDALCRSLPVGTADEQFWWKLTGRHLARMMLEAGYPEHRQVECLVFHRFKVVPTFGPQPRSAEPWYRSRVAASAGDGAPISYSWRFGTADRKPYIRNYIEPLGPLTGTAADPNNDVATRAFLQDLTTTLPNLDLSLFWTFEPHLVSRFSDKADREKYAGPSVLTGVELSPDSDAIDIKMYLYPRNPEQISQLLSTIIPKAMRDAYGEDVCLDSLNIVKHFLTGHPDGRQLKPRGTTGIDCCQVQHSKVKFYVATDN

SEQ ID NO: 34689 - protein, 100 aa, A.fumigatus
DSDGDTLQEGKSLSFPFYDLNLTDERQVMVDGAEKLTPCSPGDSGAIEMSWVDIEADQLLEPPLMLKDFIKAVRNSRPTVSQEDLQRNAEWTKEFGSEGA

SEQ ID NO: 34690 - protein, 170 aa, A.fumigatus
IELRRSFQPRGEDQLFNMARENKPAIIFIDEVDALCGPRGEGESEASRRIKTELLVQMDGVGKDSRGVLILGATNIPWQLDAAIRRRFQRRVHISLPDLNARMKMFMLAVGQTPCQMTQADYRTLAEMSEGYSGSDISIAVQDALMQPIRKIQTATHYKKVRASLFPFTT

SEQ ID NO: 34691 - protein, 92 aa, A.fumigatus
KIRISTRLFVVSERLLFKKQLKLMDALLQTLYFTFSQRQFSVSPTGGHMQLILKLINFGRQSVLFLRGTLNFGAQLLFKRFFRFQKGSLIVL

SEQ ID NO: 34692 - protein, 624 aa, A.fumigatus
TDESGSLQRELSQERSQVRELQRALDEEKQRSSENGRIIRAQYKEEVERLQEEIESLQHEIEDKEGQFALEQDRWESAKRTLQLQKDRAEDQAAGYKRTIEKLEQVEHSVSAREVKLQEVIDSEKARHFNAEAVLSRQVKELNDDIASKREVIDELRNELLSVKEELRVTKREEVALRERVQALDDEVVVLQASLEEEQEYTKARLQKGSSEDGHLQKLVAEKQKLRDQLANAHVELHDLRTSVAELEAERDELQSQLDNVKEQVGDTARFDREKIDLRKSTLRLEGEVKRLKDDKASLLEAKESLEKQLSSEIERATQEENRLSAEIDQLQDKLHVASGGRDRELTLAKGKVQRLEKRIHELELLLEQQPLGDNEQSSANADLSMLRHNLDEARKRERVLLQREADQKSSVRKCKQRISELERELHDALMNKYETSSPHGSPSDKLHEQTRSLRKQLSETHRALKELRAKNRDLERAAMREEDQRDLHELLKSSTLEAESLALQVSERDARLSDLKSQLRRVREERAFCSRKAEAATKELESLRERYDRIVKSMESHADNKNRHDKEISGLGREIIWLRARLRREEKFRRDLAWSKGLMELGERVRVAWYVVPVLCFLLSYSH

SEQ ID NO: 34693 - protein, 83 aa, A.fumigatus
LSTSNEADLRMINEMGVKPLDRTYFRTPRQKLKAAISMILATVRMQRKSREWSKTKKLGEGLKRAKNEVLKKRRESSGKAAMT

SEQ ID NO: 34694 - protein, 256 aa, A.fumigatus
PSNISLANAFLDGVNSSAPLPWVHKSIAPGLSTDFFVTNLPTRSAAIMLSAKQPPPKVLVPEKLSPDGLALLRASLEVDERRGLDADELLQIIPEYEALVVRSETKVTANLLRAAKQLKVVARAGVGVDNVGELAQPPLPPSPSLGSWPLTSHRTDVEEATKLGIVVVNSPSGNIGAAAEHTIALLMAMARNIPEACSSLKSGKWERSKFVGVEVKTRPCRSSVWEKVSFLQSGDEAFISATMGGRVDGLTDKQSA

SEQ ID NO: 34695 - protein, 282 aa, A.fumigatus
VSPTPPPPFPQPWFMATDKSPHRCRGSHQARHRRCQLAVGQHWGCRGTYHCPADGHGAQHPRGLQQSEKRQMGTKQVCRRRGEDKTLSIIGLGKGELLAIWGRGIHFRYDGGSSGWADRQTVGLTVARLAKGLGMHVNALDPYASPAVAASASVTLVSSLSELLPTADFLTIHTPLIASTKGMISTAELAQMKPGARILNVARGGTIDEAALLESLESGHLAAAAIDVFTTEPPQPESTAARLVAHPRAVVTPHLGASTVEAQENVSIDVCEQVLQILNGSL

SEQ ID NO: 34696 - protein, 128 aa, A.fumigatus
IVVERSPRWSWLYDTMVGVPHSTGCSMCRERRIKVGDSSHTSRFNPTERNKCDEAVPQCSQCRKYGRPCPGYRRTFRFQDEGPALQRRHQSRSQSRRRPETATDAATAAAAAVVRSSTTGGRSIRAMR

SEQ ID NO: 34697 - protein, 149 aa, A.fumigatus
EGAVEDLEDLLADVDGDVFLGFDRGGAEVRSDDRAGMGDQPSGSRFGLGRFGSEDVDGRCGQVARLQRLEQGGFIDGAAASDVEDTGTGLHLRELGCRDHPLGRRDQRRVDGEKVRRGQQLRQRRDQRDRCRRCDSRGRVRIECIDVHS

SEQ ID NO: 34698 - protein, 173 aa, A.fumigatus
REPLRIWRTCSQTSMETFSWASTVEAPRCGVTTARGWATSRAAVDSGWGGSVVKTSMAAAARWPDSRDSSRAASSMVPPRATLRIRAPGFICASSAVEIIPLVDAINGVWMVRKSAVGSSSDSDETSVTDADAATAGDAYGSSALTCIPSPLASRATVKPTVCRSAHPLDPPS

SEQ ID NO: 34699 - protein, 204 aa, A.fumigatus
LVPNALCTRMRFNDGAVDSHGRFWAGSMNDPKVQKPTNEGVLFRLDPDLQLHRMVEGVSIPNGIGWNLRDDTMYFTDSPTAKIFAFDFDASTGTISNRRVHYDVGEPMEPDGFAIDEEGCIWSAIYGGGKIIRISPEGKLIGEISFPTRNITCPTFVGTELFVTTAKDDVNDEQFPESVRYGGRVYRIDVGVRGKPKNEFRFQK

SEQ ID NO: 34700 - protein, 120 aa, A.fumigatus
RASEIFRGMSDENQDFAARPVSDYNASVYVQFHFISARAHRAPLQSSEFRDCESTDESDQGNQNGVAKSWYGAPSCTVGLITVFRATVVIIVTVAVAVAVAVTVDRGSRGMMRIGATGRC

SEQ ID NO: 34701 - protein, 321 aa, A.fumigatus
PPGRLGPRAHHPLRRVLYGRALHEGRHGARPRRRRGGRGHRPGRPAPEERRPGRLGLRARQLRELQAVPDGLGDVLSRAQVLRIRRSGPGLVRDARRLARGLPLQDPRCAQQPGRGAADVRRLDGVECHRGRRSEARVARGDRGDRGPGPSGHPVCGQDGLRGGCVLRQRQQEGGGDEAGRVRVLCDQGRHGAQGRQAVGQPHHHDQRSARLEAIPSDSSAGRGHLPSDGGRKGSANPIHASARQRDPYPGRYRCSAPVASGHARLCGTPRHQADHHDVSDERGRNPGVSQDAAGWQNEISWGFGGRQAVISSIAIVGFTV

SEQ ID NO: 34702 - protein, 347 aa, A.fumigatus
KTKISVYKRKRTTMGFDFTVYKGSSDGSIKKATTHRDDLQGDSVLVRITHSGVCFTDVHYMKADMALGHEGAGVVEATGPGAQHLKKGDRVGWGYEHDSCGSCKQCLTGWETFCPERKFYGYADLDQGSFATHAVWREAFLFKIPDALSNQDAAPLMCGGSTVWNAIVVGEVKPVSRVGIVGIGGLGHLAIQFAAKMGCEVVVFSGSDNKKAEAMKLGASEFYATKGATELKVGKPLDNLIITTSAQPDWKLYLPILAPGAVISPLTVDEKDLQIPYMPLLVSGIRIQGGIVAARQSHRDMLDFAAHHGTKPIIMTYPMSVEGIQECLKTLQDGKMRYRGVLVADKQ

SEQ ID NO: 34703 - protein, 127 aa, A.fumigatus
YGPSISGNSGHDEADVLYIAFAGKEAVPARAKWDADSYEAFEESITAQGGQLVSQLFGDRSTATGGSDPHHTSAAPIDSDSDSDSDSDSDDDDDGSSKHSDKSDGARRSTIPRLCHTILVALIALVC

SEQ ID NO: 34704 - protein, 77 aa, A.fumigatus
LDTTTKLSANYKLTATFSVSVSFLSPSLSSPSLTRLPLLLAYFIVIALHPFRPSIMEEIAPEYDVVVLGTGMYYPAV

SEQ ID NO: 34705 - protein, 373 aa, A.fumigatus
TSVDCLLVLQLFKKYGNVRPGEEPWKKYGRVNDWNIDLVPKLLMANGELTNILVSTDVTRYLEFKQIAGSYVQQGKGPKATVAKVPSDAGEALRSSLMGMFEKRRAKKFLEWVGEFKEDDPATHQGLSLHCSIYSIANVKGSGLNVAQCTMKEVYDKFGLEDNTRDFVGHSMALYPSDDYITTPGMAVETIHRIRLYVNSMARYGKSPYIYPLYGLGELPQGFARLSAIYGGTYMLNTSVDEVLYDESGKVSGIKATMKDRDDNSEAMKFTTKTKKIIADPSYFPGKVRVTGYLLKAICILNHPIEKTDGSDSLQLIIPQSQVGRKHGESTLESVGFKTLLIRIRRLHCHGIIRPQCLPQGLLHRHCLYYCRD

SEQ ID NO: 34706 - protein, 112 aa, A.fumigatus
SESDVYIAMVSSAHNVCPKGYYIAIVSTIAETDANHHLELEPGFERLGQIEKKFFGPPIPLYEPLDSGEKDNIFISKSYDATSHFETTTGMSQFFRHIMVANGQNRRRAGPL

SEQ ID NO: 34707 - protein, 96 aa, A.fumigatus
HQHQRRIYPVSLNNNSKTNKQTNIPACNSTSIPSGNALRSEFTTCAVGVDPNDTTTFLPSFLSRYPAARTTPSNSLFSTAAAASSVRHAYECPAWQ

SEQ ID NO: 34708 - protein, 269 aa, A.fumigatus
LLTSTARFFSMNLNNVMEQYVDHLTPNVTYAPTISGGIGARDLRRFYEHHFLRNLPPSMRLRLLSRTIGVDRVVDELYASFEHTQEIPWMLPGVPPTNKKVEAILISIVSLRSGKLYSEHVYWDQASVLVQIGLLDPKLVPQGVEGVYRLPVVGKEAARRILTEDPESEQRRYHNRLIRATHAKHKGQHGKHELVEGSGAELRSEAGDSVKTGNVKGKSVQGQSWPEKEDGADGEEEETGTGRNGNGVANGSNGKRAASVEDDNGENDD

SEQ ID NO: 34709 - protein, 97 aa, A.fumigatus
ACKRRSAGTTRRINQGMGTGERLNIGHQAYTYDNVQPGFAEHDLEEYDRLAAELAFSRSLQVIRSTVTDKIDLEKRWEDHLEGMSPCVPCNLQGPDC

SEQ ID NO: 34710 - protein, 181 aa, A.fumigatus
IRFEGRCRREWRWNYTPVCLFVCLSLSCYSKKRGRFDAGADARCVGNFPANDLQQVCTGLVAEEQQAVRVLVEVCSVYPERNEALINAGTVALTKETSDVVGFGRVTDRPGWAVVRMAQEHGILGLANASGVQRVEETFRVGQKVMLYIQHACITAAQHHVYHVVDEEDIVRETWVPWKGW

SEQ ID NO: 34711 - protein, 114 aa, A.fumigatus
  UNSURE (113): Identity of amino acid sequences at the above locations are unknown.
RLPTLHLLTSIPRLQDRHQWLRPHRYPSAFSPQPEVILTAGPLPGRNVLRAALNRPDLQIVAINHTCTTIDDLIHLIRYDSSMGNLPPSIPIHALSDTLLSVFTTGLEGAAPXG

SEQ ID NO: 34712 - protein, 269 aa, A.fumigatus
PILSWILPNTVYRKLQRLRWIFTSRLFFLFCQTFPWMARLLLKLSVVRQLPKNIPHDPHFKPRYKPWDQRLCICPDGDFFKSLHTGRADVKTDTIRQVTTSGIELNSGDFLDADIIVTATGLKLQIAGGTSITVDGEKQRVPDKYLWNGVMLQDLPNASFVIGYTNASWTLGADATALFVCRLLKWMEQHHKIAAVPRLNPMLAKQMQPRRLLNLNSTYVTAAEKDLPKAADRGPWQPRDNYLSDLMFAKYGRLDEGLEWVDGGWKKQQ

SEQ ID NO: 34713 - protein, 66 aa, A.fumigatus
ATITTVHLSYHTPYIILYSIVYTTAMAPSINDFPHSTSSPQSPVCKIGINGFGRIGTRQPSHHNRK

SEQ ID NO: 34714 - protein, 73 aa, A.fumigatus
VQSLLLLLAPALFAASVYMILGRIIRLLNAGSLSLVRRNWLTKVFVAGDVISFFMQCGGMRFLQMYTRHETPS

SEQ ID NO: 34715 - protein, 151 aa, A.fumigatus
SQYSPVGGGLLAGAKTQDKVNMGEHMIIAGLFVQILFFGFFMLVSVIFHRRMLATPIHHMMSTQLPWNYYMKILYTVSVLIMIRSVYRVAEYVQGSDGYLQSKEAFIYVFDAALMFACCVILNVSHPSKLLSHSQADQKVDSDLEMLNPER

SEQ ID NO: 34716 - protein, 93 aa, A.fumigatus
FERSKISLSASFFHGLIFVVVILRLSLFVIFQVIAEPIILVIHIYVFFVPVIFATSSFSSSFGLLLFLLLNVFSLLLLSLFLLLLLLGPILIQ

SEQ ID NO: 34717 - protein, 184 aa, A.fumigatus
TNVSKGTCLTVTAFDKTWFKVGVAPETLRRTNLGSLEKGSRVNLERAVLAETRMGGHFVQGHVDTVAKILSVTPDQNSLVFRLQPRDQSVMRYIVEKGYVTLDGASLTVTKVVDGPDGYFEIMLIAYTQEKIVTAAKKPGDYVNVEIDIVGKYVEKSVQGYFAGTAGGDMSILEKMVSRIVDEK

SEQ ID NO: 34718 - protein, 189 aa, A.fumigatus
LPPLSGQECDLSLRSRKKVDLSEQSRGGARINNFAAPKNISFADTKTSTSEIQRNLSIKCCENYPSIMRDVKKRKIAHEAPEHGSDTESTSSHKSVAQQDDPLETQDEATATESRPAPKSFKDLGIIDQLCEACETMGYKAPTPIQAESIPLALQGRDLIGLAETGSGKTAAFALPILQGMIPSDLTIL

SEQ ID NO: 34719 - protein, 173 aa, A.fumigatus
ASWSSIDVYFPVVSVSDKPPTALMENPQSFFGLILAPTRELAFQISKSFESLGSTINVRCAVIVGGMDMVSQSIALGKKPHIIVATPGRLLDHLENTKGFSLRTLKYLVMDEADRLLDMDFGPLLDKILKVLPRERRTFLFSATMSSKVESLQRASLSNPRLHHGAGRTRAKS

SEQ ID NO: 34720 - protein, 475 aa, A.fumigatus
YSYLDLYYNGQGTYEEAHTCAGSKCFCRRQKQHEQNSEVDGHQSRRFAGRLQCQPTGQGCPFDDGARYSCTIEGKRFVEHTGGFLESATDDGSFKERKSNRLRDYTTMAGPLGVTHLMLFSKSATGNTNMRLALTPRGPTLHFKVESYSLCRDVEKALKRPRGGGQDHKTPPLLVMNNFNSPNATEDSKVPKRLESLTTTIFQSLFPPINPQATPLSSIRRVMLLNRELTAGSEKEEDSYVLNLRHYAISTKKTGISKRIRRLDPKEIRSREKRKSAVPNLGKLEDAADYLLDPSAAGYTSASETELDTDAEVEIAGSTTKKVLTKRELQRMKSGEKAKAQKADTPEVEKRAVKLVELGPRLKLRLIKVEEGLCEGRVMWHDYIKKSEEEVKSLDKNWAKKKKEKEERKKQQRENIEKKKQEKAKARAEGRGGEDDGDEEDVDMDDEDDWLSDDLEDDEEGQAQDNDDEDESMEE

SEQ ID NO: 34721 - protein, 216 aa, A.fumigatus
CARLCISKGNIFWRRKIVDPSSSAALLRQIYFFSGPEREVTLLSRQRRKLLGLGFIPNNIHIWTYITMAKARTKKRTHVRAQNASAAAKNSMSKTPKSMVIRVGASQVGSSVSQLVKDVRLMMEPDTAVRLKVSVSWSTLAGFWSRQLMMGHLRNGNPIDSETTRQWRALWVSLILCFSQNQLQEILICDWRLHLAVQPFISKSKAIPFAETLRRH

SEQ ID NO: 34722 - protein, 96 aa, A.fumigatus
KIQETVDTMRSNIFKVSERGERLDSLQDKTDNLAVSAQGFRRGANRVRKQMWWKDMKMRVCLVICIICLLIVIIVPAGMSPSLLALRTTRAPERAG

SEQ ID NO: 34723 - protein, 76 aa, A.fumigatus
SYSASIVSMKRLSIDPRQDIPPIRDSPATALPASLPKAKNIKTSPARAGEENASVYFVGNATTILSVASCLVSMRC

SEQ ID NO: 34724 - protein, 251 aa, A.fumigatus
SRSRSISSAGPAHHHYQPCQVHIDVQGSRLFPASVRARAIRADDGQYQRRQLENQTTAHPSHRNARQTHPDQQGRGEIERVRGGSKQFPDTAMTHGNELTIKIPPTNGWMVELGYGSTQTMQTDFEVGYRIYISGDTLMVDELKEIPRRFDGQKIDLMLIHLGSTTVPYPKMWPLTMMVTMDAKQGVELVRLIKPDLTIPIHFDDYDVFASSLEDFKIEMQKAGLGGQVVYLDRKDAYRFQVRSDLTCTSR

SEQ ID NO: 34725 - protein, 94 aa, A.fumigatus
PSGVPADCPLSRPACFQTGDEQFDEFALAHKMRERGWILPAYTMAPHSNELKLMRVVVREDFSKNRCDALLTDIKLALKTLSDMDKAMLEKYTL

SEQ ID NO: 34726 - protein, 153 aa, A.fumigatus
RRVISSRPNGDGHVLYPPFPSTSHQPSKPELFLKMTSQSPSDPLIAALCGLLTLNIYTLLALLLSIPPFLDLRLSTLYVLALQGLISLVVVRLFYIATCRPFQLRCRTTLALMLLYAVFPVPRVALWVFDTVVPGLCVRKGFFQVCRGDACSV

SEQ ID NO: 34727 - protein, 101 aa, A.fumigatus
GFCKYLIDTPTLLAVWPLFSRPGDCQMLERELIEPSSKIETGLSLLWLPASTAITSSTSLKRIRIIRTRHLLILSSYLSFFKFEVFGEMPIFMLVLFIDWD

SEQ ID NO: 34728 - protein, 194 aa, A.fumigatus
LSATQLTTVHPQPEMIEDIGVPKNEVAKWVGISSAASSSCQAVMAVTWGTISDTVGRKPIILCGLTFTMIFSLMFGLSKSLAMLIASRALLGLMNGNVGIIRTMVAEMVPEKELQPRAFSIMPLVWTIGSIFGPAFGGSLARPAVKHPETFGNWKLFKAYPFLLPNLASAFLFVIGITTGWLFLHVSVIQATGS

SEQ ID NO: 34729 - protein, 287 aa, A.fumigatus
  UNSURE (6),(19): Identity of amino acid sequences at the above locations are unknown.
CGSPRXWDPLWPPGIVGFXTSHLRSDWIVQSPNQTLEGQTVRDTWDGQIDTMGSGSDFNAFQDFAGIPSYDLGFSHGPKDPVYHYHSNYDSFDWMDRFGDPGWLYHEACTKIWALAAAKLVETPVLAFNATDYAVGLSTYLDQIRPAAEQLPGHSSFNLEPLDKAIARLQKVAAKFDAEAAELTSQLDENLPWWLWWKKVRLYFLIRGVNDKYKAFERKFLYQPGLDGRNWYKHVVFAPGIWTGYAGATYPGLVESLDAGDLKNAKVSHFHFSYFLHHLACSSLLTL

SEQ ID NO: 34730 - protein, 99 aa, A.fumigatus
VSLTHSLFFSSLCLDNFCTDSQTIGIYYTLIGIIGMFVQFFIFPVAAKRFGVLNCTKATAIASPVLYLMTPFTALVPASIRSFVVFMLMLSKLICSIFS

SEQ ID NO: 34731 - protein, 738 aa, A.fumigatus
HLRSYLSMDDGPLRISRMGKTAVMSLMPIVLLVSLLICTVHAAIPYSPSHIFYTSQYNDSFAYLLRSSDSQPHATQFLSLDVSGKVDAANPEYTVLLDELPFHTNNQSSAFVPAIDQHGHIKVYVGDCGQSNEHDRLWVFTPNVNSSSGNGTWEVRDLDLGQGSLGVNSYGPNYLSAAFAWSSSNMTESSLYTFGGMCPFNITPKATWIYAANYSQSMIVLSPPSSDRVSPYQISAAGLRAPPIPEAGFAVTPLNPTYALSPLGRTLQQQSFLFIGGHTQKAFINMSELAIYSLPQDSWSFVTVESGSDIGKTELAVRDSAFVEPRSGHTAVLSPDGSKVILFGGWVGSTSRPAQPQLAILEMGEEFGGTGSWRWVIPSTPKSVFADGTGIYGHGAAMLPGGVMMIAGGYSTSTTTKRSAVGPQPNSQIFLYNVTSGSWMTSYRNPSLPEPEPEPVGSPSGSDSSLSKKAGLGAGLGLGIPSAAGLAVFAWFYWRRRRARRSRDRELRKLALSAQRAHFWGRDEPEMASSIRMSKTRDQNKTISWTTAPSRNGQDNGEGAAESTSLLRDIPAPDRNSQQSLGTRPYRYSAPYSEYRRSETAGEIHPIDERDEEEASSPAFGGPDTAAASEPFLGAEFVTPRSTISNPVGIPFRTVRAVPAEDPARDGVLSPDQDERTSSNLSDSSARSGNSAPRRPASLRTPTTLPDNGCNSPGLATPRSSTVATGTVHRRSATPPDS

SEQ ID NO: 34732 - protein, 176 aa, A.fumigatus
DPLVAPILHCRKKQGWVQDSDWGFHQLQAWLCLLGSTGGDAVRGGLGIGNCASSRSVHKGHTSGAGTSRKWRAASACPRPGTRIRRSPGLPLQVGTDRTTAKVLRRAPACFVTSRPLTEIASKVWERALTDIQHHIASTEEARLQVKYIQSTNGMRKKQVHQRSAAPILPRPLSLS

SEQ ID NO: 34733 - protein, 254 aa, A.fumigatus
DLNIRRPPDIPPIELTTRLDIEMGRLITGSTNPVVLYVSGGNTQVIAYSSQRYRIFGETLDIAVGNCLDRFARTLHISNDPAPGYNIEQLAKKGKQLVDLPYTVKGMDCSFSGILAAIDGLAASYGLNGEEKEEEGAGDDSKPTRADLCFSLQETVFSMLVEITERAMAHVGSKEVLIVGGVGCNERLQEMMGIMARDRGGSVHATDERFCIDNGIMIAQAGLLAYKTGFRTPLKESTCTQRFRTDDVFVKWRD

SEQ ID NO: 34734 - protein, 166 aa, A.fumigatus
ILGSFNNKFFPVMIAIGLEGSANKLGVGIMLHPEDGSTPRVLANIRHTYVSPPGEGFLPKDTARHHRSWVVKLVKRALREARISVRDVDCICFTKGPGMGAPLQSVAVAARMLSLLWGKELVGVNHCVGRMCDHRRCPLSAASCLRPEHSTASRHSSYRANNSLRY

SEQ ID NO: 34735 - protein, 87 aa, A.fumigatus
IPLIDAYMQEPYQFTCLTTHGCSQVTHHMMNDFIYDRAAHISFLGYYNMNVDMQHHQMPPLLPTFLYLICSSWAGARLRCGHRQVIG

SEQ ID NO: 34736 - protein, 226 aa, A.fumigatus
PLIFTLSVARSDIFDGEELFSIPRGLVLSAQNSKLKDLLSQDLEELGPWLSLILVMMYEYLLGEQSAWAPYFKILPKSFDTLMFWSPSELRELQGSAIVSKIGKEGAEDSIMQMIAPVVRANPSLFPSVDGLASWDGEAGSHALLRLAHIMGSLIMAYAFDIEKVEDEDDENNDEEDGYVTDDEQDQSSKGMVPLADILNADADRNHVRSLSPHTRIRPPAWKVNS

SEQ ID NO: 34737 - protein, 175 aa, A.fumigatus
TSRSDIGVGGPDCKNGKSLTEMLSAGGTKSEASFGDVSGVSNSASCLTATGAGSSASSAALGPSIAGTGGRAASPAGCSLARIPRSWICIKRETICGSSRGGGGISARSAFMSFSKICFRSSRYSCVNTSFSSSSSSLDRPKSGISVSSCKAGLSSGATFFSGPTTGSGARGGVT

SEQ ID NO: 34738 - protein, 731 aa, A.fumigatus
  UNSURE (1): Identity of amino acid sequences at the above locations are unknown.
XMDPTPVASMGPVPAASDRLPDHAIVELPRKPAMAEARRDSIRPDLAASRPDPVKDLPSPLPIKRSPPPAAPQVPAFGSVTAPIPDLSADKGPIDTIPAEVAPSVAEKERNETSSRAPVQPPTGPKAERASAQPPPEPRYRREEVRRDDGPETSEKDHSISRAPRAHVSPSLHARKQTPELSPPTAPAAMIGKESSIPHAEASLTGRTGSIVGSPELSKARTPSIGATSPGLHIPTGPRALQQRSTPTRGPSKVKAQWARPGYNRHPAGAGTVPVPKRDSIDGKEGTMSISEDSRREPPAPADDHGNELEAGEILPDKGMEVDAHMSPESSKADAVCHVTPPRAPEPVVGPEKKVAPEDKPALQEDTLIPDFGRSSDEDEDENDVFTQEYLEERKQIFEKDMKALRAEMPPPPLEDPHIVSLLMQIQLLGILANEQPAGEAALPPVPAIEGPKAADEAEEPAPVAVKQDAELETPETSPKLASDLVPPADSISVKDLPFLQSGPPTPISDLDVYQENAAIHARMKDVFSQELMKRRKEIARKNAELREEYLSYYKRWRMQVWELDRAKARASATPGAGTSPAPSAPTPPVAEGRRYKGNSELDFQNALRASEISAQEELERRRGNKATAQPDLAREAVIPDMLEPGEAKAQIYKDTNNSVDPANAMDVFGFLPPPNDFTPEEHEIFTDAFMAHPKKWGKIAESLPGRDFQQCISPYYLSFHTRQVARNQGE

SEQ ID NO: 34739 - protein, 404 aa, A.fumigatus
EDEVLHAQVALEKKGSVQPLVLKAHLNLSTSSMSLAWFNASAETGECAAESFATCVVRFEDPAAWTREWDRLSHLVLGRIEALEQRAVEGKASKLSKPLAYTLFKNVVDYADRYRGMDQVVLYEHEAVAEVTLVAERHGTWHTPPHWIDSVSHLAGLVMNGSNASNTRDYFYVTPGCSSFRLLNPLKAGGKYRSYVRMFPLPEEANMYAGDVYILEGEQIVGMVGHIRFRRVPRLLMDRFFSPAAASHTEKQLQETAPSATNVKKSTPPPAEAPISVPVAPGNPVAIPLPTASKSQVATPPLTPPSQEESPGESAVITPATSDRGDSTDAGVVGQCLKVMARETGLEVDALTPDASFVQLGIDSLMSLVLSEKFRAELGIEIKSSLFLECPTIGEMTAWLEEYC

SEQ ID NO: 34740 - protein, 76 aa, A.fumigatus
TTMASRLPILIIGAGISGLTTARLLTNSGIPNIVFEASSPDRRQGFAISLREWGYTILLSALGDPPVFTTEVPHPR

SEQ ID NO: 34741 - protein, 161 aa, A.fumigatus
SPAAMNFNGGQMPPDMAGGQFFMKGMPDAMGGPNGMRPPSSNPAFSGPQMGQPIPAGAVNRVPSGNWQQQQGQPMGPQQSPAQQPQSTGTPQTQNSMPPPQAPPAGANAARTSPQSQNAAPPTPQQANKPAPKKKEPKDTARKVCFYIPIFRKPTVFVLPY

SEQ ID NO: 34742 - protein, 64 aa, A.fumigatus
SAPYNPDSLSFVQFNSGMNYACEDMMEVDASFLPFNLYRWPKNLNFVLDARSSTHTFENTPRWR

SEQ ID NO: 34743 - protein, 464 aa, A.fumigatus
GGRFDLGAQSIFSTLSLPLVCYLTLTFNMGSSADISDYSDTGKAVGAGNDKGEKFFAPPQYDGDMIGEMSEAERHIYEHGIKKFSRLGWKRLTVVLIVEAIALGSLSIPSSFATLGMVAGVICCVGLGFVAIYTSYVVGQVKLKFPQVSHYPDAGRLMFGRFGYELINVMLILQLTFLTGSHCLTGTIAFTNITESSICSVVFGVVSAIILLLVAVPPSFAEMAILGYVDFASIIAAIGITIIGTGIKSGNAPGGLSGVEWSAWPKEGITFTDAFIAITNIVFAYSFAMCQFSFMDEMHTPKDFVKSIWALGLVEIFIYTLTGALIYAFVGMDVQSPALLSAGHTLSRVAFGIALPVIFISGSINTVVCGRLIHGRIFRNSHIRFINTPAGWATWLGLITTITVVAFIIAEVIPVLLRPALHLLGPSFIFRLPPSNFPLRPKVVSFLHPAKGVSWELKPKKTWA

SEQ ID NO: 34744 - protein, 432 aa, A.fumigatus
GPSFFGLQFPTNPFGGMKEGNHLRAQGKVGRGKPEDERGPEEMESRSEKNRNHLSDDECDDGDGGDQTEPGGPASGGVDEADVGVPEDASVDQTAADDGVDGAADEDDRQGDTESHPAESVPGRQQRRALHVHANKSIDQRTSERVDEDFHQTQRPDRLDKVLGGVHLVHERELAHGETVGEDDVGDGDESIGEGDAFLGPGGPLHSGQTPRCIAAFDASANDGDTDGGNNRREVDVAQNRHFGETRRDGDQQQDDGRHNAKHDGADGTLGDVGERNRAGQTVRAGQEGELENEHDIDQFIAEAAEHEPSCIGIVGDLRELELDLTDDVTGIDGDKSQTNTADDTSHHTQGREGGGDRQTTKRNGLHDEHNGQTLPSETAEFLYTVLIDVSLGLAHLPNHVSIVLGRSKEFLALVIASSHGFAGIRVVGNVG

SEQ ID NO: 34745 - protein, 599 aa, A.fumigatus
DIPRPAWTSATSQTTVRALSIPSSDVSNYSSYYLMGSSDTYSLRIVIATSGPSSNYPQRAYRNPLDALVNFLDTKHGKNWWIWEFRAEGTGYPDSEVYGRIHHYPWPDHHPPPFALIPAIMGSMRNWLHRLDGPDGEGASHPVEENKVAVVHCKAGKGRSGTISCSYLISHDGWNMEDALERFTARRMRVGFGPGVSIPSQLRWVGYVDRWAKQMGKKYIERPVEVLELHVWGLRDGVKVAIQGYVDEGKKIKCFHLFHRGERTVVDDGKTIFPAKNTQDGEESSGSSKTDTTTDAALPAFQSSSRPSNIASTSSPKPTVTAPLASGADGLSAAPQRRISAVILRPSTPVIVPSSDVNIDFERRSKAAYTGWAMVTSIAHVWFNAYFEGGDRHDSGVFEADWESMDGIKGTSKRGVKALDRLKVVWRYAPPSHFGIREPGKEDTAVVAHAITEPKPGEPIRESHPADWRGQETGAANEHEREQESISSRIAEVDTGTKGLTSATEHPLLTSVSTTAAKAVSATAHSIHGLSKELGLRKQTDESKDVSLAESEAESVQTKTGTDKEHENGDFEGVRPYFGDSGNDSEHHSGDAESTRSLP

SEQ ID NO: 34746 - protein, 225 aa, A.fumigatus
PPSHTSGSTPTSKAATGTTRASLRQTGSPWTGSRGPPNGASKLSTASRSSGGTRHLPTSASASPGRRTPPSWRMPSRSPNQASRSAKATQPTGAARKQEPPMSTSASRRAFPRALRRSTQAPRVLRARRSIRYSRASVRRLLRLYRRLRTRSTGLARSWGCGSRQMRVRTSVSRRARRSQYKRRRVRTRNMRTGISKASGHILGTVVTIPSIIRAMLNLRGVYRR

SEQ ID NO: 34747 - protein, 106 aa, A.fumigatus
IKATSVGALVVMDATKARASSYVLRGRENNEEAPVYYAFSEKEKIRSVAVASMVTFLSPVSGSIYYPALQSLSQDLGVSINTIYLTITVYMVRFPYDYRENATEKV

SEQ ID NO: 34748 - protein, 389 aa, A.fumigatus
PLLFVFDGRQIFQGFTPLLTGTLSDQNGRRPVFVACLIVYIGVNIGLCVQDSVLILFVLRCLQSVGSNGVSVVATATIADLITRAERRKYMAYGSLGFTFGPAVGPVLGSVLTQFLGWRSIFAFLAIVAATLLTLILAFLPETCRAMVGNGSVPAPWWNRSCLQWLRLSFQSGTIAEDRGTLVSPCHRPSLWDSIRITRQRSTGLLILASTTLSSGSTAILANIPALFEDHYRFNALQVGLCYLPDAIGALSAPWTVGTLADRNFRRCCRLAGITVARNQQTPQQLLSMPLEKARLQLMLPLVYVSAGVLTIYSWVMQMRVHVAGPLIPLFFLGNVISGARNSLAMLIIDIHAQRPATASASLAFFRFAGGCWRGGGDGALHQGHRHHG

SEQ ID NO: 34749 - protein, 101 aa, A.fumigatus
IGHSFRGFQLFCLRPAVVVLYQRLSTVIFNMSGCNLPSSSRAISSTKTAKLTESQIKRLSAWIENDIWILFLQRVVENWIGSMIVHTRTASVATRAVLSLG

SEQ ID NO: 34750 - protein, 95 aa, A.fumigatus
KDCMSLPSDIRNGLEPSKPNKLHCADTDYRSLQFSVFYFSGTYQIIETVTMKLICSSILYDQSHAASSDLVIRRVRRDQKALSRQQGSTRIALSH

SEQ ID NO: 34751 - protein, 68 aa, A.fumigatus
NGKYSCYFSNQYFLFEGKYAIAKDVIFFDIASVTSPPISVRSENGPKLMPKTMYLWTRIQSNPILCRY

SEQ ID NO: 34752 - protein, 751 aa, A.fumigatus
YKSTDAISSDAETVELFQQLRQLSRELVTLLRLSSLLPSTGTRLSPLVARKFEVYIAKTDLSQAGNLADFMADVTDPTFEEKLRVLASLALRTMLERVVKLLARQVRGIKNNVKVTTISTSSFPSNSPFDISQIDPRDRELLAKRAMAGLTGLTPPGAAGGRNNEDEKETIEVDELQKRLQEAELSPEARKVADKELRRLRKMNPANAEYGVCRTYLENIADIPWTKVTEDKLGPETLKRARNQLDEDHYGLETIKKRLLEYLAVLRLKQSTNQDVERQIAALTKELDAANEVLAEKDVPALSESDRVSLEAKLNLLQSRRLADKSPILLLVGPPGTGKTSLARSVATSLGRKFNRISLGGVRDEAEIRGHRRTYVAAMPGLIVNGLKKVGVANPVFLLDEIDKVGGANFQGDPSAAMLEVLDPEQNSTFVDHYINIPIDLSKVLFIATANSLDTIPAPLLDRMETITLSGYTTVEKRHIAKRHLIPKQIRANGLSEGQVVLSDEVVDKVITSYTRESGVRNLERELGSICRHKAVQYADAVDNGRLDTYNPVVALGDLEDILGIERFDEEIAEKHGRPGVVTGLVAYSTGGQGSILFIEVADMPGNGRVQLTGKLGDVLKESVEVALTWVKAHSFELGLTHDPNEDIMKNRSLHVHCPAGAIPKDGPSAGLAHTIGLISLFTGKAVPPQIAMTGEVSLRGRVMPVGGIKEKLIGAHRAGVKTVLLPEQNRKDVKDVPQEVHDGLQIVYVR

SEQ ID NO: 34753 - protein, 127 aa, A.fumigatus
LLALGLLFHCADNIPQCRPDFTIALIRTPFLPPRYATFYVPLNFNKLDMRDYLQRLYGVGVLRIRSYVEQQKVTRLRPLGKFGYGRLRRPMSKKKMTVEMKEPFVWPEAPTDMSPYVYCFWHFPPKS

SEQ ID NO: 34754 - protein, 101 aa, A.fumigatus
PVLTQRNKGFGFDKFISGLLFPFCFIRSGDGKAGSCSFLCGIFLSLIPFSFYMFINFVPYVEISSGYKHNIQEPSFTGKTPIWDMKLKMGGIRSKTKAAIN

SEQ ID NO: 34755 - protein, 79 aa, A.fumigatus
NRWEKDQYFNAEKYQEEIQRSQRPDAAMEPNKAEREEYAKEAKQLLEGTKTWRPTWQALGLNYDRSLLKETKGSASTSS

SEQ ID NO: 34756 - protein, 230 aa, A.fumigatus
LPKYVYGVICVNNQLSCFNVRINHVLPDIDNLQAIVDLLRYILDILPVLLRKEDSLDTGAVCSNQFLFDTSNRHNPSPQGDFTGHCNLGRNSFACEKGDQPDCVSKSSRGTVLGDSSCWAVDMQTSVLHDVLVGVMCKTELERMSFDPGQGDFHAFLQNIAKLACKLNAAVAWHVRNLNEQDTTLAPSRVRDKTGYDAWPTMLLGNLFVKTLNSENVFQVAKGNYRVVRI

SEQ ID NO: 34757 - protein, 77 aa, A.fumigatus
RRGYGIKGIGSGYEENLAQVDWDVNVMIDECGVLFRIQDFQHCSGWISLEIGPAHFIDLIKKKHRIGNPNLFETVHN

SEQ ID NO: 34758 - protein, 320 aa, A.fumigatus
  UNSURE (320): Identity of amino acid sequences at the above locations are unknown.
DNSRAGSADEKKHLTILHIPLFEYWLYILRMAHPLVFITGATGFLGSATAVAALKAGYRLRICVRKPSDELQNLLSGYSEQVEFVTVADWTAEGAFRGLLDGADYVIHLAHPIPSGPEKEYYFTPAVKATTALLREAARVPSIKKVVVTSSIAALMPLDGIPSGGVIKGAFSGLLGRAYRTWTDIIPEDNDWDFDVDETEDFAASNDPRGVPMRLYHASKLLANQTAWEFRKAAKPPYALVTLHPAFVYGRNPVQTTAEAIQESSNGLLWHAIMTGVPHHSYSRVPGVHIDDVVEAHLRALDPAIPDGSKYLLAAKGGTX

SEQ ID NO: 34759 - protein, 380 aa, A.fumigatus
  UNSURE (64): Identity of amino acid sequences at the above locations are unknown.
SQRLGYRQFQGSKFGHSGPRGTEMTKWIRNDLQSRIAPDDYTIQGGTWAQLFLAGHHWLGRQGXGISAPCRTRKTVSADPNEMIIATPGLGTKILFILGMLLGNTTWLAKLPTKQNRLIDTGCRNIRDATRRMIREQKAKMEDPNAAAEVDIISVAMRSGNFDDDNLVDQLMTFLGAGHETTAGALQWAIYALCKHPDVQSRLREEVRANLPPIHGENPGPIDAATIDSLPYLNAVCNEVIRFHPSVPNTVRVALNDTTLMGHPIPKGTQVVISPELVNHMPALWGPDAERFNPDRWMGPGKANTGGAASNYAFLSFLHGPRSCIGQVFAKAELACLLAAVVGSFAFELKSPDAPLEVREGATIAPKDGVLAKFTPVEGW

SEQ ID NO: 34760 - protein, 78 aa, A.fumigatus
RRRRKKVPRFTMGYDNMFITITMLTLFHPIHCIPNGSFFYHSADTITMTSALSAPHGDQILKFFGLESAAWVNSCNGK

SEQ ID NO: 34761 - protein, 110 aa, A.fumigatus
SRRQLVDAFVTLPDYEKAVLEDKAAKDFKPPGKLVHGYVSRNRNFEIWAGSLADPEVRRLLDRAQIFVSLFIEAGTPLATNDPEWTLQRWTVYFVYVDLLFHDVMTHHSR

SEQ ID NO: 34762 - protein, 325 aa, A.fumigatus
VPYRYEIVKPPTPTASKYSIVGYATTYRWWHYCRDRTQVPVVKNDPFPSGPEIHPSQLPSRLRIAQFLILPPHQNSGHGRHLYTAIHSACVQDPSVVELTVEDPNEAFDVLRDSADYHILRPEFIKHEVNINPDPYEAHSRNQRPRRVPTAALIPVKLLHDIRTSYKIDSTQFAHILEMFLLSQIPLKNRHAGGANMSRLLIKKHRAEDPNERRYYWWRMLTKQRLYKRSKDILIQLDLDERIQKLEETVSNVEEGYEVLLKEFSEREEKLKARGVVESPAATVSDDASAGPSGTSRDQRVKRKFTVEDDEDKVEEEDTAKRTKV

SEQ ID NO: 34763 - protein, 80 aa, A.fumigatus
  UNSURE (73): Identity of amino acid sequences at the above locations are unknown.
LPLGLLTAAQGHPMLVELKNGETLNGHLANCDNWMNLILKEVVQTSPESDRFFRLTEVYVRRNNVRYLHPTPXRALVPSL

SEQ ID NO: 34764 - protein, 79 aa, A.fumigatus
NAFIPGTCDANDAVNITLVQPDEQKLKTVSSFHPQFTYPIFGDDERIFGYKGLIIRLRFAAHDLPPSASHLVRREIQAC

SEQ ID NO: 34765 - protein, 538 aa, A.fumigatus
  UNSURE (36): Identity of amino acid sequences at the above locations are unknown.
GEIRMRRILRKSAGMLDDWDVKRNTKNLATATAKLXEVPPQEIGLHVLDRASLLSIFESLSCEAMLRNDTLLQEHFDEPFRLIQTKRSLKVSDYVPAVTRFLFDSNQSRSFWAIHSWMRYSRPPTALEFDWAIKEGLLDMLKTASQQPPQIAVIQRLWRGMQLVVKRLDKDQITHHLRALEIDPCRLSVEHLGIQSPGLRFLLNTIQIFLEKAPGDFWDAMQTISPQAIIELVFYNPQLEAFLMQISEGEPYEKSALKDMLSWVEPFMSSLKGAHQPSACRSLVYQLLDRLQNPRFPDLARYHCFYVGLASLLQTLRSFTDNESSRGSVARIVLSETMGVVSANIETILNPPKFAVEQRRQEEISSLCMDVIRNTLALECQSLKSDYEVILRQNLLQHGVSTYSASIWEAVVRNLHEDNRALSTSALLGILPLVGLETFPTKGESSPEKTHFNLIYGHLTRLSCQIIERLADFKPEHLNELFKSQDTSSALISALFAADLDTYQAAVDLIKNMSGQSARKGCDLSSSTVLFHNDDVRT

SEQ ID NO: 34766 - protein, 69 aa, A.fumigatus
RARTNLQPADLLSISSLIDSKTRASRTWLGIIVFMLDWLVYFKHFAASLTMNLHEARWRASCCLRPWEL

SEQ ID NO: 34767 - protein, 270 aa, A.fumigatus
NQRMPGWQLASNTSHPIRWKQKGQQNPGSKLLAHRPLLIPTINRNNPQTHGPRVLLRQGSQPTTRTDNRHRLPRPSAGLLQPLVHGNPGAQHRRHRIQGHVLGNLRRMRRLANRVLLEGAIDGIPGQQGILAKRFIGLLAELAGETGPVQPLDACVVADLEFRDEVALGYDDAGALVATDEGHLDRERPVAFHGVEVGVADARVTDLDQDLIGSGLWDRDLLEDQRAADLFGHLGPLHGGDVELSHGCYRWGELVKEICLMVYKPSDVID

SEQ ID NO: 34768 - protein, 63 aa, A.fumigatus
LPRILIATRPGIAWTLIGWWCIVLLLDSPPPPPPHIHTEDQPVDKLYIFLLDSLACMFSDTRK

SEQ ID NO: 34769 - protein, 169 aa, A.fumigatus
  UNSURE (42): Identity of amino acid sequences at the above locations are unknown.
EAGDVRAAWSRGFAALFVSTGSDGTCSMLTANQAYVDFTKSXDLVADVKAATPDGLGAHAVILLAFSEKPFQQATEYVRSRGTVVAIGLPANAFLRAPVLNTVVRMINIRGSYVGNRQDGVEAIDFFARGLIKAPYKVAPLADLPKIYELMGMFLPSPSVLWWVSLTGQ

SEQ ID NO: 34770 - protein, 270 aa, A.fumigatus
IHLINHQSSVNHIAWLIHHQTNLFHQFAPPITTMTKFDIPSMQWAQVAEQVGGPLVLKQIPVPKPGPDEILVKIRYSGVCHTDLHAMKGDWPLPVKMPLVGGHEGAGVVVAKGDLVTEFEIGDHAGIKWLNGSCLACEFCKQADEPLCQNALLSGYTVDGTFQQYTIGKATHASKIPKHVPLDAVAPVLCAGITVYKGLKESGARPGQTVAIVGAGGGLGSLAQQYARAMGLRVIAIDGGDEKRAMCEQLGAGVLLPFLFPPDRMGRVRC

SEQ ID NO: 34771 - protein, 69 aa, A.fumigatus
TNHRQITGRPLNCFLIVPFPSISFSSHFELAILRQIWTAFPTTYFADLDSLDSRTLAALLDLTVIRQCP

SEQ ID NO: 34772 - protein, 165 aa, A.fumigatus
KGRFSSTLCLRPSSKLFKPTSPSPNPPLSLSSLSPSPFKPPSPTYKARFPLSILSIQLCSPTPPFSSNPSTVPTASSQPRRHESPRPLLKPMPQTLAQTRHHRLCHPSMRSSSPLPSLVSSFMTSCPKSEESSRLFTPCKLPWSKESLALTHGRDIRAVWRVKRS

SEQ ID NO: 34773 - protein, 297 aa, A.fumigatus
VSWQNNSSIRMTRDWTGHFVSLVTGKYLAVRYNDNSFTLHRDYHGNGSLFYLSDDEIHIIRDRTYVGQLHSHPIYKDNVFHICRGSQYISREGRWTDNINEALDVQIDPEDPHSTDSADRAPILSLCEPILNPAHPVSADGIDLYHPGKQFALYPVTSDRLWNGDASNFNGKLVFGGNPYSAGLPFQLSVHEGRTRIRANDGMYLTVVMEDDLVPYLKGECQRHSRVSPCAHCSTWYSLGFRPEPADCLALIPHGLPSMFVLHDGAFYYSMNVLKASYAETKRVKHIEEASLFQFVG

SEQ ID NO: 34774 - protein, 201 aa, A.fumigatus
IPSLTPHRSRPPGSGQTLKRKVLFHVVSKTFIETVQANVSQSESAAQSLLSQSQSLQAAIANLQGEISSLNSFNSTLQSNTSILQQSLHRADGVIAAAQARISSSTAQAHASNSGSDAAPSALPPIDEVLVAPTVVGKQLYDLVSEERGIQQAIYALQAALVKGVIGVDTWSRHTRSLAREAFLKRALIRKIGKGMGLEEA

SEQ ID NO: 34775 - protein, 370 aa, A.fumigatus
PIQQNRHLCSEILLGCFRRTSEFSGFRDWNPITTYVSLGEETGSICTVCTPPKPRILWGRDMKGLIKAYEDPRDAALYERQVKAQPSPFLIFRRVDDDNIGHFLVTLNVQTLLHKAYARLGSSGSSNPSFYWRLVPNAYDERRVRFPKFNFLSNRNDSPHSQPPNFRKALRLEQLRSLTWMLEQEKDDIAPFVEEEVEEAILPSMMWRAEGKVMVQRTVRGGVLADDVGYGKTAITLGLIDVQHSRGHDTVPKPMAGFIPSKATLVLVPQIVLQQWQLEITKFVGEKYEVLVLSSGKDFSETMISNILRADIILVPWSVLNRQSYYERMQKFTGMPRVPESAGRNFDAWFAEAQNSLRKTSPNSDGSRNL

SEQ ID NO: 34776 - protein, 251 aa, A.fumigatus
SPFSQTAYGSLEKIPKNPDLVIAGFSCVDFSGLNNNRKTLDELGESGGTLWGIIRYAIAYRPRIVILENVKTAPWEKIAEHWNEINYLAVHKSVDTKAYYLPQTRERGYMFCIDRNLLGKCGLSEQSVMDWAKIFDDFKRPASSPAGMFLLDADDPRLEQIEKDMSIRVKSTTVRPIIDWTKYQARHQNYRSAQELGFERPISKSQDTGGCQMLDFAWQTWFRYLPERIWDTIDVNFLRKLVEGYDMNFKE

SEQ ID NO: 34777 - protein, 620 aa, A.fumigatus
TSKSKAVPPFEKTSNPANGCHRRCIELSQGVEREVDSRAFGIVGCITPAGIPYITTRGGPLCGLEALALQGLPVNRLLLTRESPRDLQDLAGNAMSSTVVGAAVLSALIVGHKVLPPGEHSPTPSNCIPKNKRISLHQNLLPMPRVSQLSQLHTANILDLQRQATSSARYCLCERQSGVKQDILKCTLCAHTACTDCAGNPSHAYERWPGLIRSQPSAFIRRFKSILPARLIMSGLNRESYRSFDRSLPGNTDHVWEKYLDAVTRTVGDELRFLDVRRSKDWTAVYEGKCSILKLVISGSTFEWLLFAKPLDSEPALSLHREILSKPIARMIQDRGIWEVCAPLSSKFTLTISGTGSQVPTYEARCGLQKREFVNASRWNRLEVQGSSYDCEHLEVDIRGTYQLLPDCGTANGYLHKKEATDRDPEVYLFLDPTKLGEPKNDSFVFALEHQRSPGYESRITIAELSHKWRSSKANDARRNVNAYYRKWVQVQTMGLDVHPSDSTITCWGLRPGTTVFMANTGCHDANFPLLSLSAPADAIDSLWRKGPWQITNPTESTSLLRDFAWLLQKNFRVLWLPRLEPYYHICFTGRRNRLHLHCVHPSKTQNTVGSGYERFDQSI

SEQ ID NO: 34778 - protein, 82 aa, A.fumigatus
SGIQKCHLLWQCTCLSQFSASNLKQTSEASSYSVLPSAPKPSPAVLPDSWSLAPGPRLLSGSSFKTLLIHLGERVCSKPKSC

SEQ ID NO: 34779 - protein, 60 aa, A.fumigatus
CIATCGPISDPYKGALSIIGAPDTYPTIPRGETFWFKRYDGYSLSLLRRNVNRIYHSVSD

SEQ ID NO: 34780 - protein, 543 aa, A.fumigatus
MCGSNNDKTVTIYSLTRSKVLKVLPHQACMNYAIMSPDSTLLAAVGDETRAYFYDVTCDYETTIQTDNGEKLPAWDWDLIRCIEMDIGTRFDDGCCFTVAFSPFSRLCAIGSQSGVITVFDVATVRDTEGEADGKNAIICNFNSSRPCCNGGAVRCMAFAPEPWDLLVWLEDKGRAGVADVRQAFIRRQILNLDMNDPNLEEVYTEPILNDPEELESDLDGRVLAESRHGTDATHRAILDSIERTSNERGNGADHSPLRESLIQDLTQRERLIVEFLNTARWTSRLEEGLTERRARVNASSHPTPRSQFQASTEGTRRPSRPTSPPHRSDALIDTFRENYLGHAGISSRNLNAGRDNHVTPPRGYPEGSRSVIGANVRPQPSLTLSWTASPSELQSATFLDHLHPVDRDADGPSSSSSEEGSDTRTHDPITRPSATVDHSSSRLTASDSRHDLGRLSTSELRTNVAAERLRRQRQIINEAQNRNSQREQRYRQQLLGFEQTRSPRWIRSVLNELPDRSLGPGARDQESGSTAGLGFGADGRTL

SEQ ID NO: 34781 - protein, 656 aa, A.fumigatus
TTVVSNKKIQAFQLHHVATPRDPTIDAIPGGAMQDTAGEKTIEPGTRSPCGTETRRRTLRPMSSSPTLTDLRSLLPLYEASELLVDTYFDRVHWFMLIFQQDDFRQNWPHLYETQSDGPNEVCNDLGFLSTFLMVIAIGAHYTGPYRQRLLARYKVEPEALKQRILKAIKSSLLDIISVGSLEVVQTCVLLGTYYLFHGAPRLAWPVCGCGLRVAQSLNLHRKKEHATLPLTPAERNQNETRKRCWWAIYEIETFCSMSYGHPHSIGDADCDVEPLNPSAKLRNAPSPVSFDEPLRCETTLLAYKYYMSKLSVLTKSVLSELYGFGPGLVNNNKAPGESGSRLRAVVIRVAKLDARLRDWRAEIPPKLRWETVASTSVSYSSLEEFDRDIGASGVRFDNHIYHLQALALELAYENTMILVHRPLLSFKLVTKSTDKRDDMSYFDIQENPFLKSMKACHDAGMSLSELANSPILELVSETYAAAFVSIHTFTAGVALGILGSIEPLTPQAQEAKVGLHRLMSIQAKLQTRSVLATQGLDILQRLTKLVLDKELSMMLDVSKPIRWPEQHSGVQGDVGALQTSTLSPKPSSSDQRTRTLPHDAAGAIMPTDAPLNMSDTTDTRETESQKAAPDRNSLGNYTHLQYIEDTSVSEALHDF

SEQ ID NO: 34782 - protein, 95 aa, A.fumigatus
ELTTLRGCMTPRGTDSSIPFHSVGVACNSAKYLAAEAAFTACERAVLTHGGMGYAMEYDVERYLRECLVPRIAPVSREMILNYVSEKVLQLPRSY

SEQ ID NO: 34783 - protein, 181 aa, A.fumigatus
AARFLPAPWGRPLAPLLPVLMGIPHSGLGNRARHTTHGTRKRSPRRPPRRRARKYQRRRDRHHRRRLNGRAGPAQAHHRAFARRHYPLRPRLNEAGEADDVRHDPVQALVDTDWLHATGARVEAHLLAAGEPRFSAGDAKSVRASVPAQDDGNGAETDCAGSNSCSGAASCVRHASASVSA

SEQ ID NO: 34784 - protein, 256 aa, A.fumigatus
QRVSFQPRGEDPSLLSCLSSWGFPTVDLGIARDTPPTELENALRDALRGVGRANTSVDVIVTTGGVSMGELDLLKPTIERSLGGTIHFGRVSMKPGKPTTFATIPFKPSSTPTGSTQQERESKLIFSLPGNPASALVTLNLFVLPSLHKMMGMGQRQTAPGVTPALGLPLVSVTLAHPFPLDPKRTEYHRAIVTASRSDGRLYATSTGLEGVGQRSSRVGSLASANALLVLQPGSGKVDKGTLVEALLLGNVVSEA

SEQ ID NO: 34785 - protein, 79 aa, A.fumigatus
RYVGSIHYPGCSTEHLLINSTANLLPRRGRDKPGYEGEDRLRGVAGEADTYGCLAVDNLYNIMHTTDRRSLLICHLNRI

SEQ ID NO: 34786 - protein, 156 aa, A.fumigatus
LTPSAIAYRLNAAVDVDLANSLKVASIPGTSSSFWESFGSVFRWSTSTVPAPIRPATLTKLPSNVEMETHDFTREEIAEKRMLLLNDNGQIDYFISGGGGPLNIQYLNMLSAHSSYWILSDFVRFIVIEIARKQGRESTLPAFRAEKKKGWKIHKG

SEQ ID NO: 34787 - protein, 72 aa, A.fumigatus
DADFPPVGKIIISHQPSKLPDIDFATTSVRSDIFEFDTKNLFLCGSPVGFFLLLNKGMLDLYITQVVLPNTC

SEQ ID NO: 34788 - protein, 83 aa, A.fumigatus
  UNSURE (62): Identity of amino acid sequences at the above locations are unknown.
FLSLLCLFAPPPLNIFLCTVSMISYHCPKSFSVPLSGVNHPSPLSLCSGGHLADTSQGSKAXVAAWENPWLSLGFVWLKIALQ

SEQ ID NO: 34789 - protein, 476 aa, A.fumigatus
LMLATAVNLIGGLVISFSIAWKITIVLCPTIPVLLVSGMMKLRVQKQLAERHQKAFAKATAVTIEAVDDIRAVSAFSLEKQSYQVYGRALRGPYRATIKATFHGNAWLALAFSISNLVYALAYWWGSKQIAEGRYSQTQFFIVMPALLFSTQSCGQMFALAPDISKAGVASSNIVELLTTRSAEDEVTPGSSHSFQRSSSLLEEKTAVQDIEAQEYARSTRQRAAERGGMGAQLRDVHFTYPHRPERPVLKGLNIDIKPGQFCALVGPSGSGKSTTFAMLERFYRPNAGAVVIDGVDVTRQVGTEFRDDIALVPQQNILFEGTVAFNVALGACPGHEPTQEEIEEACRMANIHDVIMTLPQGYQTMCSHDGKQFSGGQRQRLSIARALVRKPRLLLLDESTSALDVESEKRIQEALATLAGRTTVVAIAHRLNTIHRADQIFLIEDGRCIEQGTHQQLIQRSETYRTSVIHQSLET

SEQ ID NO: 34790 - protein, 92 aa, A.fumigatus
  UNSURE (71): Identity of amino acid sequences at the above locations are unknown.
FFSSGVFVLIPFLTLFVCSTPLKHLSLHCKYDLVSLPQILFRPPLRGQPPLPPVSLLWWAFGGHKPGIQGXCCCMGEPLAESGVCVAKNCFT

SEQ ID NO: 34791 - protein, 242 aa, A.fumigatus
IDNRCIVRSQVLAHVQPETVPAVLYHGEFQLPRADFDRLFRPHTGESNILAGVGDGFNTPFAVCNMTKTHVHMDWSYSRPVRGSGEDDPLYRPNLASEEAKRIPTALVEELASRDLAEPWSLFLNGEAIQHHRVFHWAVRCVSVTREDMQRAVGRGVAFVGDSWHAMPIFGGEGGNHALADGIELAGAIAAGATGDLGTAIGNYYDQAWKRSQDAVRRSKQRFYTLHRPMAEWRELSKKKPL

SEQ ID NO: 34792 - protein, 89 aa, A.fumigatus
DDWRGREEPHPLQRALTVRAGKCGADTENESTGYLDVDYAWMAIESNEDQKTLYLSRREIDKKIAAKVDQDGTRHRSGWLGRATEENRP

SEQ ID NO: 34793 - protein, 165 aa, A.fumigatus
  UNSURE (139): Identity of amino acid sequences at the above locations are unknown.
LVPKIRNPGSFFSLVWSVKAYIDINSRPATKQPSIIKMEKSNRRKRPSTPHLSCELCRERKIKCDKVDPCNNCVSAGVVCIPVHRPRLPRSVHARRARPMSPTFVPPRAPTPVAGPVPSKKKQTDHSSGAVTGVDDELXETRSPGLKGESTACVAAMQDSSSANG

SEQ ID NO: 34794 - protein, 775 aa, A.fumigatus
SDSHLRQINSVPALSPALAPLDVSDLAFSSPSPEPELQMLPSPASTEILETSKPQNHQSKDPDASHGPYVLERVQRTSKGGAGGMMQIDRPLSAAERLQIWDHAATVGVTEPCESTAFAAEEGRSQRNSQDIQLQANLIIQKLDNHDEQPASHSAPLAERKVSEKEHEWLVTETPVKENTAVVLQSRPASISPSTTCYSSHTNDAAFEASIQCSNNDSGESDTHHSAPDPHASSTQEQANRKSVSNITVEGGIVSTNQNVPTLPVLDSQIVSKQGQPTSRIQQSNISAFMVGDSDLTAATQTRLQTNTPATVFNQHLQQRKRKRQLTNKSFVGSSQSEQQEQQRQVRKPSFTTVGSLAAFMETRGRNEMRNMVTQSPYFPAGKSTDDVSKRQSDEVSIEKPESCLNEPNKSENVSDIVQTATQLPRFQQQTGEQPILFLSTTLLKSHLRLVRCLEGMAGLPVIVYRDYNQETSGSEPRGKHTTSSMNNNPTHQIEADIIISPSTGLVLTTSQAATQLYLPGHKSTHPETNTECINSPLRERIFLLAPRYERIYLFICHSAPSPKESQGKQSGPTADKRLLASIASLTAFCNSMSAYATINPLLAPSSPETAAGWILSLANKHIARLPENPTRIPPSTSFTPINSPQKNRLRPEIMMRTAVWELFLRQAGLNPYAAQLILAFIKREDEEERTYIRYASPKAASSSSVEDGGTHGLARFIEMEPDRRKEVFGQLIGDRMMGRINHILDKDWQCDWVLNFDVDTELLHHRGRRIHAKS

SEQ ID NO: 34795 - protein, 82 aa, A.fumigatus
LPISIVYPVDFLPIPNTEQMQLIDSFIADMEATFGIKTEKVSIADTWKAFPPNEAGNHTIQEYLKDVRISGSLSSRFEETLC

SEQ ID NO: 34796 - protein, 157 aa, A.fumigatus
PCLRVRDQIQIQLIGSCAVCCSPSLLLNSDLIADKQAIIIPMDDPGSTVQASMFFLTPDELHKQQRPYTFKFPPYNGCPQSNMTHEKINGITVENMRGREDQFQLERNGFTILKVNTGLEYDDSFKQKGVTQYLRLMEGVLKARLGASRVDVFRYGV

SEQ ID NO: 34797 - protein, 69 aa, A.fumigatus
RSKHRTYFDSGDYALAAAHKVTDEGDIQTGTAHPLRESIPHPYAPVPSSGNVAGDANKDSHCRRSSSPE

SEQ ID NO: 34798 - protein, 258 aa, A.fumigatus
FPTLHDITANTLISSKIPSACPSKITVSGRHILCTTIVEHHEDDPRSPHLSLYHDGSGQRRKEGSQRNLGRTGMEISWLFRAAINIKSGDTNDSRLVYWIDRDFSQHSIIDRLSVLKPGFHLLEDTKSSPDGPRVGFIRSNLFNVNSGRVLPQNIEGPDNNIIDLLEPEVRQAIERQAEVYVFGARFDTKDGIHDVHMNQGNKGRWKGITPSFKTEHSLFISQILTDGLAFSSALHPRQPIPMIGLGMPYHRRLGVTT

SEQ ID NO: 34799 - protein, 761 aa, A.fumigatus
  UNSURE (49),(332): Identity of amino acid sequences at the above locations are unknown.
PPIRSKTDADRAKSKQQLNLLRQHQHGAFKLDAAQEAPAIPLDLPTILXGRRKKFNPSKLSSEQFRKCVEPWALSAVLAWIRDLCEEETALRKSAIVDAIVALFTPKVPTMNIADAETLAARVVDNMLEQEALVKEEEWVKFGRGTLSGVLFQITGTGCYSPLLHEQETEILGRCYSHHCMRTLKKVNLKAHKMAPQKKVEDWVTFYKVPKEVWEAYPKKEVDRQNNLHEIVTTEDAFIGQLDVLRELYRDQLANMQPAIIPPKRLPKFLNDVFGKVDAVKKVNEEYLLAQLKYRQKEQGPFIVGFSDIFREWIRKAKMVYIDYAATFPYAXYLVRKEMERNAHFRQFLNQAREHKMSNRLSWDTYLKAPITRIQRYTLLLSTVHKNMVKECEEKTNLAQAIDEIKVVALECDNKVGETSKKVDLMELSAKLQLRPEMKKEVELNLQHLGREIIYRGDLQRPGTRTRFLVDTHAILFDHYLVLAKLSTTRDPTRGIKYESYDVSKLPIPMDLLVLESTNDDPVVKSSVRGVSTVTPPQATTRGAGAAPLIHSNSGNSGNSTSSGKTLVAATVLESSKDDKILYPFKVKHLGKNGTFTLYAFSAQNRQEWCDKIMEAKTRHAAALFAQNAEPFRLRVLADTAFASSDHSGISKRTVTVKGTPLDRAIREVEERYGGSKSRPVPVCRTSVHCATVFQQPPGRMMCAVGTDYGVYISEYNDPRGWVRVSTFHCGLLASAKIGPRPFRSSECRRLRSLKSSISSC

SEQ ID NO: 34800 - protein, 517 aa, A.fumigatus
  UNSURE (358): Identity of amino acid sequences at the above locations are unknown.
TRLRVILRRPVVEVHPHSSQFPLYTAQSPHHSDAAIAPPYPDELPPEPPAHSTPAEDLYGKRQSFGRRGSGRSLPTPPIQQAQSQISPRRTDALTRHPQSRPLPGPPVDADSDSSPLDDLNGVGGRDPRSDRPVGYGDLMREVEAAVIDNRMSRETRYNTRPPRVDAQSSHHEEYDPSPSVTATSSMRLSPDERHTHTNGTLATGTGQYVNYDAYSDDSDAEAAAGLAMLQMADEEDRIQAEREQARTRRETNASIISAYGSHSSARAPSPRRDSRQDELHFATNTTYGSNHYERYHYDADMDEHADETHNEGVDQATRLAPSGSLSRSNLSADDRGEYSDDYDYYPVPDDQVHQYYXYISAARVDAAGTGGLSEPGAYERRMSFDYGDEADAYPDDVHHSGSEGSDTGGIPGELFFHPGMRPLPPAPVEPANNADLLPHLMPAGTYRPQESGEYPEETQYTSPQYPVSADSFASTVSTPTSQVPRSTSLSSHPIGPGLDPLSGPRPMRIGRSPSSS

SEQ ID NO: 34801 - protein, 333 aa, A.fumigatus
AIPIIRVSQIAVFEEFNLFLLIADKSLIAYHLDVVCPASGVSSQTTKDSARRAPQKLSGNREVGFFAAGHMKDRTLVMYKKRDGLSSTFKVLEPVLQKSTTSKSRLFHTRRSQTEFFREYDEFYIPAESYGINMFHSSLAISTQRGIEILTLDKKQTWSVPDFRSEAPEAQAQLSSIANRISNLRPLGMFRLSDSEFLVAYTDCAVYVNKHGDVSRSVIMEFVGRAHSACLYGKFLILFNDDFVEVRNAMNGRLRQVIPGHNVVCLDDGSALPGSSANTVPTNSGTSINLASGLSNGVAMASSGRTVKICMQHPEYERSQLVLELIENEGQKE

SEQ ID NO: 34802 - protein, 60 aa, A.fumigatus
FGLWGIPVMTYSVQPQYLAYVSPWGLPPLITSPYLPDTAMIFSIQFLGFLPTSWFLHVIY

SEQ ID NO: 34803 - protein, 93 aa, A.fumigatus
SGSLLTCLSQTFYVFGAAMFAYIPIIYCFFPETAGRTLEQIDFLFASKSPFVWEEEKEFAKRMTRFHAEIQKMEIENGGYAGEKTGEEFVEKV

SEQ ID NO: 34804 - protein, 87 aa, A.fumigatus
SSLSSFWGSFPRLGFSMLYIDSKSTLFPPPPFSSATRFTMMHRHFWKTVPGPRLLRLITVVSAVAISYEGMSQGVMGAVNVAPEYGV

SEQ ID NO: 34805 - protein, 323 aa, A.fumigatus
SNITLQHRMGFADEQGKVIKPSLQGGIAAMYYLGALFGAFWAGSFSDAYGRIKGIWLACAWCLVGAILQASAVNLAHMLCARVVAGVGVAFIIVIAPSWTAELAPAAHRGQMIAVTFLANFGGIALSSWIGFATSFTDYAGGAFRWRFCFACQVIPIFFLVIGTLLIPESPRWLVKVGRNDEAFEIITKLRGDGDRAHPNVQKEIREIVAVVQMEHESQSSSYLQMFLGIGSGDIHIGRRIQLAFWLQVLMQYGTGIAAVVIYSGNIYRTAGFDDFKSNWLSAVCMTCGILGTGIAALTLDRVGRRWTLYWGAVVLSVILFTL

SEQ ID NO: 34806 - protein, 114 aa, A.fumigatus
VFESSSSWPWLLLTFSRGGLNRGAVNNPDKAEQYGTGAAAMVFLYVVVFSSSWLMIPFIYPTEIFPTWLRAKGNAFGVAGWAVGYGAGSLLVPVMFAGIQEKVSAVLHLDRVHC

SEQ ID NO: 34807 - protein, 68 aa, A.fumigatus
SGAAIIIYSGIGISYALYWYGYLLLRHISATHAISLGTATTDCGQWSAPYLSLRPLKPPRESGWEQGS

SEQ ID NO: 34808 - protein, 81 aa, A.fumigatus
DATKHSPKETSGIFSLGVFFWLNKLFLAGYRHVFTIKSLYPLDSTFDAQALHEEFAKKMDYTKLKGDKFGLLKVLVRTLWV

SEQ ID NO: 34809 - protein, 271 aa, A.fumigatus
LFPSIDLINAGLTYWSDATESIHPAHPNSYYAGIYALLQICAIIALLLLLGITLFIVSVKKAGANLHQQALSTLICAPLPFFTNTDTGVVTNLFSQDLNLIDTELPEAILNTLFCLFQSIGQAAVMLTSSVYLAISYPILGGLLYFVQKYYLRTSRQLRLLDLEAKSPLYTHFLHTLKGIVTLRAFGFIPNDIHKNIRLVDSSQRAAYLLLMIQEWLNLVLNLVVMVIAAVLTTLAVRLHSNWAFPGASLYSLMKFGDSLSGIVISYTRLE

SEQ ID NO: 34810 - protein, 589 aa, A.fumigatus
YVHCGCNYSCLFPPRAALMAFYSCHLLFIESLITYLSHSDPDPNVGYWLIGRCYNHLLGDWHLVCLVLVRIPAVTAYFSDSRHFARYCHHRLRTMVRSILVTETFKAATRVRLGAGILINFTGDSHRSWMSGVQKRVGLTATVIASMKWHKISGLAGPVAEYVQQLRVDELAAGARYRRIMIFAAVFAFMRQLISPPLTFAFAQNPLNASTMFTSLSFLTLLTQPLSQLFQSIPELVSGLACLGRIQVFLELEPRRDYRQPQVEAQSCGMEKSSKQLNLKSTDCIVIRDANFGWKADKFVLNNINTQIPAASLTMVIGPVSSGKSTFCKALLGEIPFSQGSFVMSTPPRHVGFCEQTAFLWNGTIRENIVGFTPFDCERYDQVIEANSLRFDLATLLQGDQTNIGSDGVALSGGQKQRLSLARALYLPSDFLIPGDVFSGLDADTEEQVFRQVFGPDGLLPRRGSTVVLCTHSVRHLPTADYIIALENGSIAEQGTFVHLSTRAGYVQRLEVGLKPEGEDTNADDEPGPCPKLFEGQTRTGKKLDPAITVNSTQSSTLNASAEAGARQVGDATVYKVYIKSMGWFVARL

SEQ ID NO: 34811 - protein, 825 aa, A.fumigatus
SDRFFSGSTSRSRVIIARLALSQNPGTGSLALRPTQLPSLVRAACQLLSRCSLGLVSDSPKYIKSEESWPLGPAILSFSLVSMSGRPGLTEKRLSAHRFQPLPDYSNDTMMASPHDVTIDIPLTNVPSRTPTGARRGSAHTATSPAAYHPPLDDVHTNTSEKAGLVAGTGPGRRKRTVDDSTGRSLEDPEDGTLTRMGKIYQAILNFSIVTRYIIYVTPIALLIAIPIIVGATVAEDARIGGVTLPWFFAWIEVVWLSLWICKIIAHFLPYLFQFLCGIVSPGTRKYALILRALELPIATVFWTIVSLVTFLPVMTYNPEKKRTGDTSTKPWEKSVKNILFALFVCSLILLAEKFLVQLISISYHRKQFDLKIKESKRNIELIGQLYDASRNMFPMYCKEFREEDLIISDSLLTAATAKGPIHSRSSSSMPLRLIRNVGHNVGRFGDRVTAAFGGVAHEITGKEVFNPTSVRGIVTQALERRKPAEALARRIWMSLVIEGRDALYPDDIPEVLGAGKEMIAEECFHMLDRDGNGDISLDEMVMVVGEIGRNRKALNNSMYDVDQAIHVLDNLLLTVAGIIAVLVFISFVTSGFGTVIAAGATSLLSLSFVFATTAQEVLGSCIFLFVKHPFDIGDRVEISDKDYMVERISLLYTVFKSVTDQRVTQVPNVVLNTLWVDNFTRSNAMHETLKIPVSFDTTFADIQLLRDEMERFVRDKENYRDFQPDVDLDVVGVGDMDKLELTVSIRHKSNWANESIRAMRRSKFMCALVSAVRKIPIRAPGAAAEDAAGDSENKDDKDDTNDKPHKPDADNAEQNYFTRIVSGR

SEQ ID NO: 34812 - protein, 84 aa, A.fumigatus
PSASAINPTGLTSRSVPCVGPNSCVPWSAPCARFPSALLVLLRKTPPATARTRTTRTTPMTSLTSLTPITQSRTTSRGSSPAGS

SEQ ID NO: 34813 - protein, 486 aa, A.fumigatus
DFSCLPITLYVHLKWIKINETSRPRTPTNSGVSPRECIKRLSFSERKSSEQATDPQSSCSGLYYLLPCRDTLVCILIHQDDIGLTRSALGLAVTASSITISPSPTSEPSTTSGQWLIISGTSIFWPTYTDYFYGPTTGPEAPVVTCNAKWVEYYGRSDGLRSLGPTGTSITFDPYPTSGGACRTSSSLEGYSDTHTGPVTTLCDGIPRALGPREMVTSYYPGTGPCSTYTITFTDTVELYREPPTPDCELNTQECIPIWSTYSELSSSFDATATTVTPGDTKSPIPPDGCPSTTRTYPEDPCTACHFLPGTATVFYWPVTTAGGDLCLQNGTTIPATPTGNGPNTAVVNGQTFVSPSIYVSFTSIYAWSNRRAHPGSQCGDTHNDAIIAVDPASVSSVRNHRNAKYPTIGTAYPFNFAEFMPQDVGNYTMPLIPWPQYRGGSQCPLYDPSCTMIRDDYMPLPGCSQAFRQIDPLWDHGDAPWYSPL

SEQ ID NO: 34814 - protein, 521 aa, A.fumigatus
LETQWSTSQSSRYSPRHSVLYLDLCYSPKTAAAMASDLTNSILDALSASDGPILSDKAFPSTPSLDLKSALDRLASRSMIEYERMEREAIALTQEGEEIAANGSHEAKVFQAVLAAMDGLKIGDLPGIVGKENAKVGQGNAFKKGWIKKDKDVLRPNTESIVDETQEQLLTVKNTQTLSDQKAVADLKRRKLIALQKVFTFRISKGPKFAKEFVKEETDLTPEMLANGSWKTVTLKPYNFKAKGAPTPAGAFHPLNKVRQEFRNIFFEMGFEEMPTNRFVETGFWNFDALYVPQQHPARDLQDTFYISDPATADPPREDPLNDPHRLKSVHPASVVSSEKPLDYKEYWENVRQVHENGKYGSIGYRYPWNADEALRLVLRTHTTSVSTYVLHKLAANPRPARYFSIDRVFRNEAVDATHLAEFHQIEGVIADFGLTLGGLIGFMEVFFAKMGIHQLRFKPAYNPYTEPSMEIFGYHKGLGKWVEIGNSGMFRPEMLEPMGIPRDMRVYGWGLSLERPTMIK

SEQ ID NO: 34815 - protein, 78 aa, A.fumigatus
PYVPRKCSATNRIIKANDHASVQISIGKVDENGRYTGENQSYALCGFIRARGESDDSLNRLCQRDGYIRNVWSASRQR

SEQ ID NO: 34816 - protein, 77 aa, A.fumigatus
CYSLPCNISLHILHLVLLQSHDRVGLDEVKVDFVTEKLSNIAHSVSAKKETSVHGLKGKYGRTHLIMVGLSRLNPHP

SEQ ID NO: 34817 - protein, 300 aa, A.fumigatus
TTLSGFKSLTQAQLLSDALYYTPSTDSQPWLIYYISRPLIGLFDPGKVISAVVPGSLPQRVVTNTGAKSGDSTTSLPKKEIKSFGELLANFPMIARQMQPGLDRLFREFGKELGKPLPPPPSRSPSIPDGYERKEDRDESSADEVASIRSASSRNRDGLPFNSEEYFEDDEDLMRRSLETAVTAAIDLFRLVDKQQLSFLGATTDLTGPLVQRLIERYVAEQVHESLLFPRLCSFRQPEDAELDSRIRHMENLDVSQVGIAVEGGREGKRELLHRLGRAVEEFRKMTDAKCPHDMLNTLL

SEQ ID NO: 34818 - protein, 139 aa, A.fumigatus
GGDACPSSPAVKTASGVPEERVLTFARRAAALIGLDAEKDISMDDVRLDDRFAGTAYGVLDAQTSTALDLMAKKEAVMLDPVYTSKVVRGLLHWVQQEELAKDWSLRLGDRERPDCMNVLFIHTGGQAALGAYADMVEL

SEQ ID NO: 34819 - protein, 375 aa, A.fumigatus
FRRYHGKCLKIARGKVKEFDKYTCPICDWRQKIPRDAARPKLEDLQDWQAEIPSLPFQPDEEQVLENIINQATTFRDFIQSFTNAACTTTEEVPTLIFYLRKIEGAEVLLAYETNFFRQEIHKWAPVAPEPPPILEQSLSTRKPRPTKQQKIMAQLGVERPEDLPPHLRTKQPNHAKRKSLESQTPRPATLQRTSHTPCEDSNRTGPALTPMTEAQNPPYPFSANYSLPASDSTPAFAPGASAFLPHVSAHSPSFPPRSPSPHHGLDSALFSSPRFNRDPTEGPPVVDVDNQDPFNSSPRQNLDDVFADLTNQDAEPEPEPEPMENTHANEALEALDASNGGDHSDAMQDDNSPDTGVNGDMNGQADAENTTESS

SEQ ID NO: 34820 - protein, 396 aa, A.fumigatus
FGPLILAPLSEIYGRRIVLSFANWFFVVWLVGCALAPNIESLIVFRFLCGIGGCGCITLGAGLIADLFPVEQRGMATSIWSLGPLVGPVAGPICAGFIGESIGWRWIFWILLIASGAISFGIECLNRETCAPVLIRWKTAKLAKELGRTDLHSAYEPDGQGVSVASTLKLGLMRPLQLFFKSPIVFLLSIYMSLTYGLLYLFFTTIPSVFQKQYGFSTGLSGLAYLGIGIGFFVGLALIAFTNDRILMKLTAKNGGKSEPEMRLPTMIFFSCFLPVSFFWYGWSAAKKAHWIVPIIGMCPFGISLMGLFMPIQTYVIDCYPAYAASANAILTATRSLVGALVPLAGPSMFNSLGLGWGNSLLGFLALAFVPIPILFTRYGKAIREKFPVNFDGKKA

SEQ ID NO: 34821 - protein, 102 aa, A.fumigatus
RRFPETNLSRGIVGWDGQNDPANPQNFSAGQKWGLLALMSSITFLSPLASSMFAPAASYVAVDLGVTNETLLSFSVTIFLLGYTVRIRPIYIWLRSTQNKEA

SEQ ID NO: 34822 - protein, 87 aa, A.fumigatus
IGMNKPINEMPKGHMPIIGTIQCAFLAADHPYQKKLTGKKQEKKIMVGKRISGSDLPPFFAVNFIKILSFVKAMSARPTKKPMPMPR

SEQ ID NO: 34823 - protein, 177 aa, A.fumigatus
IESRNTMGDLKNSCKGRIRPSFRVDATDTPWPSGSYALCKSVRPSSLASLAVFHRISTGAHVSRFRHSIPNEMAPLAISRIQKIQRQPIDSPIKPAQIGPATGPTSGPKLQIDVAIPRCSTGNRSAMRPAPRVMQPQPPIPHKNRNTMRDSMLGARAHPTSQTTKNQLAKLSTILRP

SEQ ID NO: 34824 - protein, 65 aa, A.fumigatus
MLVSSPLITLFLGNKSDSGPEVTDGGTMVLYPVVGELCIIIAASHKVKNQANLTVFGSWSEASGT

SEQ ID NO: 34825 - protein, 482 aa, A.fumigatus
QQLHRVIAAAQVWNPVNSLLDEFQNFMAKKGSLAEATGIRSVARRYLDRLEAVFARDISSESGHCMMCDHDEMEERPSGVSWGEVLELVSGRRELLSWPPFMMVPSVEADISGDEHIPMQKMDIDVPEEYRDHYLRQSRKTKAAVDKWLNEQVAQPTSAPEEVDDETLTFAMLTHLGPELRPLFCSLLGITSTSTPTPRTDDQLPRAKPQALVSSSIAIQRLYRLSTLPRDPETAIYMLNNPGIHHVLATLAAISDDEWDILISGRFDGFLRSGAEDPIPGIPGATPTRWSSSRSNTPFTTGGMSRGPTPSHMEGGVRPASQPYGVNSPSPASFGGPIALDEETEIAALAEIEREIFLGMEALEDAFEALHCKAEAVRRTLRERGAGLSIANQNRRGSYVEARLGTPSSALGTWESGTEDDGIDDDRSLAPDDSASNISSNRRRRPKRRTERRTPAPVEEEDEEEEESHPSRRDRDRGSRRR

SEQ ID NO: 34826 - protein, 133 aa, A.fumigatus
CKCDWGESSAWGYFLSTQYQGSQPQNWASARIYHMNNNNNKRVALPQDPNTPIEDEPPFGSTDPWLMPGAPGSLVAVMVQSVILWNASLTDGTDTPTTSGLPWLRACSQSMERSSLVSSLASKENGIRQWRTP

SEQ ID NO: 34827 - protein, 293 aa, A.fumigatus
HFLSSFAANGKTEQPRMFAQPFDHAFNDLFSQYVDMDSSMVDGNKDVSIPSDFDQIFSLDSLSSDCGDHSPPVPTKPTHQSPQPWATDLWSLPQDAASSASQCSFTFQDTVHPSAVSDLSFHLEAPPTSHPVPAVTCKASSRSPSTPPATPHHKSTKSALVTPKSIRRHRDSHERKLLRKQSFSPSLMRPSQLQAGRMMYPEAWAQRFQNFSLHSSGEHLPLSPPPSDILVQHENTPADNVVTHMNHSTEGLSRNPAEMASHYETGIFNHSPAIFYAITVRQVANATAAAQPI

SEQ ID NO: 34828 - protein, 266 aa, A.fumigatus
RLIPYVAASHPTSKAGLIQPTTMPLIPDDSSLASHHNISSPPERLVTRSTPASAIHSREASAVRGRAADPSALAPSTLQPQNNRRGQSHSKSPDPTAARPGIGYDVSLERRPSNSYGHHRQTSIVHGVQHSRNPSFAASSNSTSPLSPELIASLGRGAGNEQEISSAGRLDQNEMPTIHHSPGGNGTSHILQGTLSTIEDQDTGEVGNANSASSVHRRMNSAGKSWKERSHSRSHSRQQHSESKTVGEYALHHLFNSVSTTFCTQR

SEQ ID NO: 34829 - protein, 96 aa, A.fumigatus
LLLQFVGQADNKVNQAIMKLGHSDAPVEEVCGPGVDPNFDQLISALGHISRQKPKPLIDTIMLWRKAKGDAAIMAKQASQVCHEIMKPLVYIALKG

SEQ ID NO: 34830 - protein, 217 aa, A.fumigatus
LVLKQKPSTSDNVPIARRNTEPSQNVVDSAAPTDSTTSSTILTRQEDVVLAERRATVSVYLVCRVLIEIFNQSNIASITIDMAERLEDIVFGQLKTVDPDQISASPLRMANWRIYSQLLGIMSETNFTSVTGRFLAELERYQKEEMLRGPSREGDSRAELLILGMRHIRIRTYSDNWSKSCDFMRSLAPLFGNAHGQRFKQVTVTFSKKSSWPLPPI

SEQ ID NO: 34831 - protein, 386 aa, A.fumigatus
  UNSURE (40),(57): Identity of amino acid sequences at the above locations are unknown.
LSMSPPEIDDEKKPRSTDDSRGSARIVSSRESKQPFPPLXADEHATTMHDAPNNSYXGLDDSDMLSPTTDDLVEEEEDPDFHSSYSLDNQSFSDESMESDEEAAEDGIAMHHPFRQSSSSLHGPNAFAPPFYNRPPTPLPPSPSLTSLLRPPFSTTTSRPTTPDSSDVETPNDTEAAVAKSARRATTVPRASPKVPTYEYYGFVLYLASSLAFCESNPMRCRKRSPILILPTVIYILWSYLPSPFLHQLGIYYYPNRWWSLAIPAWLVMLIIYIYVALASYNTGYLTLPMNSIENIVDEVANVAVIDGKGRRRPGGAAKMKPGATSYQIMGPQNRKVNWKDIWSEGTDAVMDVPVGGVCEVLYGQERDDGELSDGHTGFAPGTAET

SEQ ID NO: 34832 - protein, 211 aa, A.fumigatus
SHQEINRMKAKAIREQREAEEAKKRVATPSSLSSVSGVKRTYSSMTASETPATLRDASANRPLDAIKPARNFAKYVEYDFSKMTDTKGGFLTQEDDPYNKALNVRDGKEEQKPAHMTQKEWERQQLVDSLRRERAGPFEPGLSVLEDKSKQKKCRECGSLEIDWKWEELLRCCVCHACKEKYPEKYSLLTKTEAKEDYLLTDREYIPNAFL

SEQ ID NO: 34833 - protein, 77 aa, A.fumigatus
RADCLESLCLLSMEYSQLSINCRIVSCTQIILSWTYASPIFLLVTYAYTDLTETLGFYQFMILQYFVATPFWCYEWI

SEQ ID NO: 34834 - protein, 140 aa, A.fumigatus
AVWHLVVKISGPEYASYYAVQITLKGAIYSLKLKWEFAVLGRLVDVIHGHRRPMIGRDAVHLCSLEFNTGPNNGTVPPGMNGDVNVCEISAMNNAEAGKIKRTTTGSFNGRISDGKILAMTEFSTWVEHRCHGNGDRRMA

SEQ ID NO: 34835 - protein, 193 aa, A.fumigatus
RTCKASSAMECDITNHTAREPDGCLALSDEGSESFSSSVGASLAVASTMAASSSGSSGRTRLRTNPMTAVIANPFSMTSSTAFNRPSRAWLSPLYVKKYENQSGTSVAAIPTAKEAVRINRLRRVNGIVEMIRMPEMATDENKNVVMPPRTGLGMATMAAANLAKTPMTTRKKQQQYPALRLAHFVRAMTPLF

SEQ ID NO: 34836 - protein, 461 aa, A.fumigatus
ETSEYFMTVALLSLNLLVTPGLYVSSMLSQLTYSFTNVQQDAVKALLSTAGISLLSILPVIIIIVRQYSSAHPRQPRGCRRLGLPPGHTNLHDEFDPKYSKGTSSDVDGKGQPSWSIKALFTHPIKSCAAIELDVTHVVSTGFAFRRQFCFAEQFTPDQASASDGKTHPYWDARNLRKRAITAGLTLIRPEIWVPDPAAPDYAPDLDEVRSQGVMVVYYPRPAERGRSSFLIKLGVALRLVPRELSFRVPLVPPSDRASAYPSVPVRIWKDTPVAYDYGRHLPHSLREFLAPTAADAGVSRPLTLFRVDPTHHRQVFRNAPRKEELGFQPVTGFADAYPLHILNIASVHDVAARCARDIPRLSVRRFRANIIVEGPEAFAEDHWKRILIRPAGGKSDADSGVEIHVACRTMRCRLPNVDPATGIRHASEPDRTLKSYRRIDPGDPTNACLGMQCVPAAQGS

SEQ ID NO: 34837 - protein, 374 aa, A.fumigatus
THFPGLWLRVLTVLLIEASLIKSGMRDWPGGSGCGSDPSARALCPSAGAPHALPWGSAEFIGLGFLVFVTIILCERFGSPIMKSCAVVVGLLVGCIVAAACGYFDRSGIDSAPVVSFIWVKTFPLTIYAPLILPFLALYIVIMMESIGDITATCDVSQLEVEGADFDSRVQGGVLGNGLTCLLAGLFTITPMSVFAQNNGVIALTKCANRKAGYCCCFFLVVMGVFAKFAAAIVAIPKPVLGGMTTFLFSSVAISGIRIISTIPFTRRNRFILTASFAVGMAATLVPDWFSYFFTYSGDNHALEGLLNAVELVMENGFAITAVIGLVLNLVLPEDPEDEAAIVEATARDAPTEELKDSDPSSLKARQPSGSLAV

SEQ ID NO: 34838 - protein, 334 aa, A.fumigatus
  UNSURE (33): Identity of amino acid sequences at the above locations are unknown.
GHAWMLFQMKSSRLRISTARLTNLFAKISAQSXRSHHSFFLGAGENSSFNPQSLSFDARKWARAFYNARYRQDDGHPLRVVGVAFKNLNVFGYGSPVDYQMSVGNALLKVPTMVRQALGGGKQRVDILHDVEGLVLPGEQLCVLGPPGSGCSTFLRTIAGETHGLNVDAASYINYHGISPKQMSTAFRGEAIYTAEVDAHFPMLSVGDTLYFAALARAPQVIPGGLSRQEYAKHLRDVIMAMFGIGHTINTRVGNDFVRGVSGGERKRVTIAEAALGYSPLQCWDNSTRGLDSANAVEFCRTLRTQSDVFGITSCVAIYQAPQAAYDVSEIPLE

SEQ ID NO: 34839 - protein, 68 aa, A.fumigatus
GVSGAGKTTLLDVLASRTTVGVVTGETLVDGRQRDSSFQRKTGYVQQQDISPLSVFTTSAWISDRLRP

SEQ ID NO: 34840 - protein, 542 aa, A.fumigatus
VKYHWNEPARHQLMDGQLFDKVLVLYEGWQIYFGAAHEAQAYFEQLGFQCPESQTTADFLTSMCSPAERIVKPGFEHMAPRTPEEFAQRWKESPQRQSLLHAIEKYSTEHPLDGPDLHQFALSRRAEKSHRQREKSPYTLSYWGQVKLCLWREWQRLKNDPSVTLAMLIGNFFEALIIASIFYNLTGDTSSFYYRGALLFMMVLLNAFASVLEILTLYEKRTIVEKQSRYAYYHPSAEALSSFIMSLPYKFVNSSLVNLTLYFMSNLRREPGPFFFFLLISTSMMLAMSMFFRWFASLTKTIDQALAPSSIILLALVLYTGFTIPVSYMRGWASWIRWLNPVSYGFEAVMINEFHGREFPCSSFVPSGPGYEDVSRTQRVCSTVGATSGSDVVSGDVFVRSSYGYVNSHRWRNFGIIIAMTVFLAVCHFVTTELVASKRSKGEVLVFRRGSAHIARAKQGQRDEEQPSASAVPSEKYSEAPTPVEGVETQTSIFHWEDVCYDVKIKNETRRILDHVDGWIKPGTLTALMVSLFCLSVTFERR

SEQ ID NO: 34841 - protein, 186 aa, A.fumigatus
VTLSVGLSSPVVKTRAFGIPVNTFSNEVVTLWYRAPDVLLGSRTYNTSIDIWSAGCIMAELYTGRPLFPGTTNEDQLQKIFRLMGTPSERSWPGISQLPEYKPNFHVYATQDLGLILPQIDPLGLDLLNRMLQLRPEMRISAADALQHPWFHDLPQLQAQLQQQQQQQQQQMAGGYGGMVPPQQTY

SEQ ID NO: 34842 - protein, 92 aa, A.fumigatus
WLLFACRRFMPADALWTLAMACNVYLTFFHKYNSEQLRQLEWKYVLFCYGLPFIPAFVYFFIETEARGKVYGSAIVSATFVVGESVICRVTL

SEQ ID NO: 34843 - protein, 83 aa, A.fumigatus
KKHVRLDMHKIWTHFFFLSFRFLFFFCLCLSASPFYSLGETVFIPNWLLLMVEDQPLVLLLMDEFFIGQNLNMRNHLVRSPVH

SEQ ID NO: 34844 - protein, 279 aa, A.fumigatus
GIFQPRVKTMSKASVQMILSTTGFGSQVDLSRIQTASQQHHTANTGPARDSGRSSFDQRQRFTHVPRRQTQVRQSRPLPKFDMDLADLFNDPGPVPDRAGSSTRKPVQAYPRRSEYPEPSTPNFGSDLPPRPHPQRTPSMEYYGGYENPVSPRTQQQQYFYSNSPQHSVSSSGAAPNVGQHQFSPVDQESAAGISLDFLDFDSTGAENTVSVGSDGNPEYNMSAVPSLGHGAGHSVGIDLGFGMAVDFQHDWSENANYDMLEGYFFGGSVGNPPGDGSI

SEQ ID NO: 34845 - protein, 189 aa, A.fumigatus
VRRRDCLQGFLCESFVVNLFPALKYHPDRNPGRELEFNAKFQAIQAAHEILSDPQQRLKYDTDRLRAGYGKLYGPNKANTARKAPTNPYASASTAKPQTPKPPFSSRPQSFHNGPSTGAQRYASYARAAPKQPWEKTQDEGQTRADAYRGFQEMKGISPPGWSHLDPRSGRTRYLGAAPPDSTPKGAPH

SEQ ID NO: 34846 - protein, 66 aa, A.fumigatus
GHESISQSFTIDTWLGAGYAAPTTSSGASSYRQVAKCKWPVRDIGNEELADLDAKTAAPRYGTRFG

SEQ ID NO: 34847 - protein, 824 aa, A.fumigatus
SVRLIEESLSPPPPPYFLPSQQQQHPQSREHVNHESSNRGSVSPSAAPSYHVEPHVEYRQRAIPRTRPLSMASPGDAAHGRQMSLPPPPPLPQGATGSRSSSQSRVDAYGDRASFSTGQRPCTAVSQAQESLQSSSSASEQYQLNPTPQFDNFTRAPGAKRAVSAGPMIGSASSSRATSQSRSHSPSTHGWEPGMPLPPPPPGPPPTARSQSVSGLSETSGMRNSQISMRRRPPPVMGPGLDSIPPTPAGWADEGSGQNGHRQDRELPNIDTSSAALANRGITGSESRDPAHASQTSANSGLFRSPAIRDASAKGIRERRIERRNRQSQVFEDFSAVSSSSNPWADALDQVKPSDLILDNSNASHGNGRHPNSTKFTPRSTASAGSDGQQLGTRSRASSTGLFSGRSSFSTPRAEPSPAGPPRTFAQTPPFSPDNENVSPTFAKAAASQALPPKALPTPPLQSGQDVRSSSRLTPSEERPVSHILHLPNDALPAVAPLSPRRLAAQQGSSLDSVLSQDLGFIRDAMQRHKEFIEKEASAVNETEALRIFADFIIAESQIRRERYGKVWDSGTFDVEAARRKLFELPPKPIVEPQNNISATVSLSRQPSRGPRAVPALDIPTSRPESAWWSNYKPCLSPIASMSMSNDEMSSRGRPPSRWWESKTGSESEGGERKVQRSKRESKYMGVPREAMQWAEGQGSFGASQRSYESNATSQYAAYGPDEYPPEKVGWHEEQEPAPSDFPSSAPRHGFGRTREVQKLDVSRLITLPPPYPRHHPAVNNSHPDLVAYRTLVRPISNLSEIKATRHGHQSGRGTFIEEPSGDS

SEQ ID NO: 34848 - protein, 90 aa, A.fumigatus
AVWFSEGVILMLSRRFGIEFAPEVVKADGNVHNLARRICNAKRVLVCSRLPPYLTTYFFLAAEADYEYYIAQAPYSLTRNGATTPTEGKE

SEQ ID NO: 34849 - protein, 74 aa, A.fumigatus
SGVFGKVFCFLQGFCRSRTEKNVSHHEEDMGGVTVKDVSKTYLTEPTESASYQRLDEKFLSDELVSKTAWSKAS

SEQ ID NO: 34850 - protein, 139 aa, A.fumigatus
AESKPIWRRPVPDIKQAVFCEGVETAHCAQGDNAAVAQLLGITSPSVRLDSQAKYCSIARGAGDIYLRLPVRKDYQEKIWDHAAGDLIVREAGGQVTDIYGQRLDFSKGRTLAANKGVVAAPEAIQDQVISAVKTVLKL

SEQ ID NO: 34851 - protein, 302 aa, A.fumigatus
VLPLQGSCRPVCSRQGIIDASLIMKLGTLVPSHDAPAEIDLVSFLQSKTQQHDAIFTEAVQLLESMKSSPSCNRVAASRLVASCQSIGGTTDHTEQSTYLTLEHVRSLYAARLAVCELDGAGASIPPPCLPVTLEAPRKKGFFGFSSNHKSTTITADSMPTEILESCLRSLESRPQWWTSYSNSRQNAMVICQATRLETEKEELLELHRSIVESSIKLSHGLEEALEMAYAESSQHQAFIEATAALQAKLRQDLEATETGFKALLGNLMEGIKSAVDSGVTTVTSTLARVHNDAASLETVRV

SEQ ID NO: 34852 - protein, 129 aa, A.fumigatus
LVRLLGTMRAHLQNYVLGVSEGHICILSLVGVGYRASIESTATTVEPEYPGQQFVSLKVGYSHPIELGVPKGVKASTPQPTRILLEGVDKNVVTQFAAEIREWRKPEPYKGKGIFVNGETIRLKAKKIR

SEQ ID NO: 34853 - protein, 286 aa, A.fumigatus
LTQSPGIEFSRQDVSLTDLHEITSATTPVAITIDGHAVRDAPSPKGLPFFGNFFQIFPDHLGNHQRLFEQYGPLIKTNTLGRTVYQTNDPILSAIVFNESDFFTKKINEAHPLYSLKTPAAGVFLGDTDTPEWRVAHKFLPPALGPKAVRHYAPTMQKTVEDACTIFDQLDAQGEAWNVYQYMLKLGSQAVGKLTLGLDFEHFSSADAPIHEMVHLIAEVLSLNKKVTSKGDWYASLPFGDPKRLRDTKARIEQLVEESVQKAQRGGVEDLPLQDAALRAANMVGE

SEQ ID NO: 34854 - protein, 249 aa, A.fumigatus
TNQNPSPAPQKGSTPVKQQTDYALRATDNKGEKLPKSSLVWALVVATGAGFTTTSSLLSWLIYGLVTYPGMQDRLLQELVDHGFDDTTEITADFADQLTFLDKYIKETQRRHNPSFQPGRTAKLDLILPGGYKIPQDAVVIPALHHIHNNPAIWDNPARFNPDRWDTDEVKQRHKAAYIPFGTGPRMCIGFNFALQEIKVFLPKLIYRYKFTREGDGPIEYDPMFQLIRPNNLYVRAERRVKWPYKSDA

SEQ ID NO: 34855 - protein, 133 aa, A.fumigatus
AIEMASQQFYLLGEPISSARTISLDGINDLEGLRNLIASHFAIVEPSGESHLRVPTDSTNLPNPQESNSLDKTYPSPISTKSPQPQLPSPSPSTAMLSGTPPPPRGSPSSATSSRYSQTTWATTSVSLSSTVP

SEQ ID NO: 34856 - protein, 132 aa, A.fumigatus
REFPRYRAMLFLIGCSPPLLVPAMHIHLLNCKSDDPLTRQLSLNKLDFCMLILKVMQDVHTAASYYRGIFSEAIRHLSSTTSKPTGQGPVVVETPASLPGEPTMETLLSGDFLDGLMDEASFFNFWEPLSNM

SEQ ID NO: 34857 - protein, 70 aa, A.fumigatus
SVDSSTKSIVYIQFSDSPHMRSNGRDSYASDLYGHLTLLSARTYRLFGRINWNIGSYSMGPSPSRVNLYR

SEQ ID NO: 34858 - protein, 63 aa, A.fumigatus
LRCISQSVNTASFKQFIKRGSKEDYHLLNYSKSTSSMLPSFVEILCHNPCWSKEPFRWVLFPI

SEQ ID NO: 34859 - protein, 115 aa, A.fumigatus
PWVLAAIVQSYRRSSFGGGRKFVIILPSNVEGGVMEWKGAREWAIERNSISNKEEYAKRWGYELEIVNMLAKKRYSHEWRESWEKVDIIRDAMRKYPNAEWSVKPCMWSLPRLTD

SEQ ID NO: 34860 - protein, 162 aa, A.fumigatus
CRFWWLDLNTWIMEYSYSLQDQIFDRLGDLTYRDINLYNPLNISHPPTAPYLDELSRSAEGDGNPSSIDLLLSQDCGGFNLGSFFIKRSLWSDRLLDLWWDPVMYEQKHMDWEHKEQDALEYLYQSQPWIRSNVAFTPQRYINSFPPGACGEGDDPDVHYSE

SEQ ID NO: 34861 - protein, 686 aa, A.fumigatus
WICSALTNQKKFLLSMPAHFFRACFYRGTCTSPRDTSASTPISPKKSTVAIKSGYLHKRGRKNPKYSRYWFSLKGDVLSYYADPSNLYFPSGHVDLRYGISASLGDPKEKGREPRDFQVTTDQRTYYFRADSAMSAKEWVKALQKVIFRTHNEGESVKISFPIESIIDIEESPMVDFAETFKIRVIEDDDSYAIDEVCLFTTIRLYKAHGSQYFFTFFNSGREAFEFLKILINDQSLKISSQHLSPQPDRSPRSDRTRKSRNRWSLTSGTSRAETQRKRSASTSHMSLAHDIVKSSPATRHQDSSDSILNSFEQATESSAAWQSITDAAESASQILNRSDVFQSPTIYGLDRRPSGRERRGRRNSDETARSPSTRANVGTGQQIDELDRRTDGNTSGREARDTTSESDQYTQDPTKSFSGAPSLNELVKAGVYPLQRAAGLAEYLRTRSKQMSNLLASESMGYIEKVSGMWTGGRKHYGEAEDVLPDDQDVDPEDKEDGCNYGDRFRAHFALPPTEKLQATYFAYLHRVLPLYGKIYVSQKKLCFRSLIPGTRTKMILPLRDIENVEKEKGFRFGYHGLVIIIRGHEELFFEFRTSDARDDCAVTLHQHLEAVKFMAESGLLAEQEQNESEAAMTEHRMLQEARYYDYGENDLRPLNESSELHPIFDDPRASIVNFKPAESLRITC

SEQ ID NO: 34862 - protein, 306 aa, A.fumigatus
STSRMRPFLDDAKRRVDRKLSARRQSLSASRFLPSALPDRLKDNHDAQVDFTAPPGGSGSREGHLQYMQQSIFGIIAAVGSRSDFHARFDESSDSDGETGQRPRKESSVRKGTSVSVNTSSLDPSQRSSSQTDGNSEKDLGTRGRRHRRTISDHKLLRPFMSNSKHEPDPSTGDEMPTVSPPSRPRSATPRAAPILSRMVEAQAQFDLKASSTERSQSSLNETGAKGPRDASVSPLSTRLMDMFGFDKPEKVLVEYACSLLQSMLLQGYMYVTEGHICFYAYLPQEIYSSYQVWISSQAWPKEPQV

SEQ ID NO: 34863 - protein, 401 aa, A.fumigatus
  UNSURE (111): Identity of amino acid sequences at the above locations are unknown.
QQGIVVMPTEAEDVRAALLWAPEHQIDLAVKGGGHSVAGTSSSDGGLVIDLSLMNSVSVDPAAKTVTVGGGATWKEVDEAAAAHGLAAVGGTVNHTGVGGLTLGGGYGWLXGQYGLTIDNLLSATVVLATGQVVTASATENADLFWGLRGAGYNFGVVTSFTFRAHEQPNPVYAGLLAFPPDQVEAVIEQLNRTLEHPDPRSGAICIFAQPPGAPVPMVNVIVFYNGTQAQGEKRFAGLLALNPVVNTTATIPYSQVNALQNPMATYGGRKSFKGVFFHPPLAPSFARSMLDDLTARLQAEPDLAASALLLEFYDMRAICAVPREATAFASRSWTQNGLINLRWTDARKDGEHRAWARERQARWKAELDARVQEGVPQYINYAERTSLHLLSSSLAIADKC

SEQ ID NO: 34864 - protein, 192 aa, A.fumigatus
VAYRHRPKNLLLHDGRILGHVRKRRILHEIPGLADLLPAKQQPRARLLALRDVPQDPPVLGPIDDRPLGGGRVQRIAHHPGVLLGGTHIRREELVVDRVLDVDARSRRADLPVVGGDADPRPEERVVQIAVVEHDGGALAAELQRDLFQVRLGRGGEDLPPGGAGAGEGHFADGRVLGEALAGGEGPRPRGC

SEQ ID NO: 34865 - protein, 218 aa, A.fumigatus
TGDSVDRTKCNYIIIYLTVLTDVHPSSASSPMSRPNPLSLTPPNGAFALSIAHALTVTWPDSSARLTRCARFTLVVKIAALRPCRVSFALRMTSSSVENLAILCISSISIVPHLFLVRADPGRLLTATGPKISSFMMAASSATSANAVFSTKYPVSPTFSPPNSSRAPVSLPCAMYPRILRCWAPLTIGPLVVAGSSGSPTTPGFSLAARTYAARNLS

SEQ ID NO: 34866 - protein, 348 aa, A.fumigatus
  UNSURE (61): Identity of amino acid sequences at the above locations are unknown.
PVPHELRLRGPSGQNRDGRRRRHLEGGRRSRCRARAGRRGRHRQPYRGGRADPGRGVWLAXRPVRPHHRQPALGNGRPGHRTGGDSVRDGKRRPLLGPPRRRVQLWRRDELHLPGPRAAQPRLRGAAGLPPGPSRSGHRAAQPHPRAPRPPQRRHLHLRPAPRRSRPHGQRDRVLQRHPGAGREALRGSAGPQPRRQHHRHDPLLPGQRPPEPDGHLRRPQIFQGRLLPPAAGPVVCAQHAGRPDRPAAGRARSRRVGPPARVLRYARHLCRAARGHGVCQPQLDAERTDQPAVDRCAQGRGAPGLGARTAGALESRVGRPGAGGGPAVHQLCRAYVSSSPLFIPCHS

SEQ ID NO: 34867 - protein, 231 aa, A.fumigatus
SKPSGNSPLSRTEARPIHRRTRVPPPGSSTSSRAWAFPAGQSFAEHPAIRKVSFTGSSATGRKIFAAAAKTNLKKVSLELGGKGPSIVFDDCDLDNALLWTRIGITANNGQICAAGSRIYVQDTIYDKFLAAYVRAAKENPGVVGDPLDPATTKGPIVNGAQHRRILGYIAQGKETGARLLFGGEKVGETGYFVENTAFADVAEDAAIMKEEIFGPVAVSNLPGSARTRNK

SEQ ID NO: 34868 - protein, 100 aa, A.fumigatus
GTILMLLMQSIAKFSTEEEVIRKANDTLHGLSAAIFTTNVNRAHRVSRALESGQVTVNAWAMLSANAPFGGVKESGFGRDMGEEALEGWTSVKTVKYMIM

SEQ ID NO: 34869 - protein, 409 aa, A.fumigatus
  UNSURE (282): Identity of amino acid sequences at the above locations are unknown.
REEMKRRTLGIVDVLRDPLLHPGVQLGFPARLPFARPGPVLPVLARIGPPQVDQSVLRPTAAGKRRGLARHGTDGAHIVELEQEGRRGEIGLGLQPGGQVVQHAARKRRGQRRVEEDALERFAAAVGGHRVLEGVDLGVGDRGGGVDDGVEGQQTREALLALRLGAVVEHDHVDHGDGSAGGLGEDADGAAAGVGVLEGAVELLDDRFDLVRGEGQQPRVDGVGLLVGPEGEARHDAKVVPGAAEAPEEVGVFRRGRCHHLSGGQDDRCREQVVDGEAVLAXEPAIPPAQGQPAHPGMVDGASHGGQPVRGSGFVDLLPGGAAADRHGFGRWVHGDGVHEGQVNHQAAVGRAGARDRVAATFDGEVDLVLWGPEESGPNILGLSGHHHDSLLSTSVMIRVWSIAQPWKT

SEQ ID NO: 34870 - protein, 135 aa, A.fumigatus
KRSRWSSAARAPPSCSTTAIWTTRSSGRGSASPPTTGRSARRDRASTSRTRSTTSSSRRMCVPPRRTPGWWAIRWTRPPPRGRSSMGPSTGGSWGTSRRARRRARGCCLAGRRSARPGISWRIRRLRTWPRMRPS

SEQ ID NO: 34871 - protein, 176 aa, A.fumigatus
  UNSURE (62): Identity of amino acid sequences at the above locations are unknown.
TGLGCSWARKVKLVTTPKLYPAPRRPQKRSAFSVADAVTTCPVARTTVAESRLSMVRPYWPXSQPYPPPRVSPPTPVWLTVPPTAASPCAAAASSTSFQVAPPPTVTVLAAGSTETEFMRDRSITRPPSDELVPATEWPPPLTARSIWCSGAQRRAARTSSASVGITTIPCCQPQS

SEQ ID NO: 34872 - protein, 390 aa, A.fumigatus
PPAIFLLIKTFRKFPAVTDRSSPNSSSNPGSPPGVVNILAGVGLPRRPELRRAPGHPQSVLHRLQRHRAEDLRRRGQDEPEKGLAGARRQGPLHRVRRLRSGQRAPLDADRHHRQQRADLRGGIAHLRPGHDLRQVPRGVCACRQGEPRGGGRSAGPGHHQGADRQWGPAPEDPGVHRAGQGDGRAAAVWRGEGRRDRVFRGEYGVCGRGRGCGHHEGGDFWAGGGKQPTRIGTYEKQVRYYTNAADAEYRQVLDRRGSHPQGERHPARPQRGDLHHQRESRAPGEPRAGVGPGDGQRVGDAQRECAVWRGQGERVRSGHGRGGAGGVDVGQDGQVYDYVVAFRPIYRIAGLHTDRVHLMKHIVRIILGLELLQSPQILAVDVVDHRVTR

SEQ ID NO: 34873 - protein, 170 aa, A.fumigatus
RLLRTLASAVAVPEHDILPPSPDATLKRRNSSTTDPDPDSKRRRLSTQEEKDHPASDRKPSILDTAEQRPGRRASRQANGREEERKRGQRLFGALLGTLSQRSSTAAEKRRADIERKQQVKLKLQDEEYDELKKKKREERVALRKKQQRYYEEESVSARCSQFTSLRAYG

SEQ ID NO: 34874 - protein, 74 aa, A.fumigatus
NCLVGVAIMFVDKINVTGDPRVQFRQARVNGKQYGMHLVTSARCARFSGRRPELLRCRTDYAGGTIANHILTIY

SEQ ID NO: 34875 - protein, 84 aa, A.fumigatus
DAPEDISLYSHKQCADDIKELALQLGADKIIVGGHDWYVPPGFNFYILRVPVTDYILQGRCICVPSCPLVSRPRYSSVHGLRTV

SEQ ID NO: 34876 - protein, 139 aa, A.fumigatus
PFFSLQYYKPWQLRPEDEDLICRQIEEAEATISRERAEFEARHPPQEESESKEETEFQTGNQQEAPQPDADVQQPKDTTEESSDQANAGTKESQNNEASVPDTVDDIPASVNHTGSDDHRAADDDGGEVVEDNEDTVIY

SEQ ID NO: 34877 - protein, 120 aa, A.fumigatus
IANGTTVNWYRTREVNHKEELAILDRRITAPVLFIQALRDAALPAHLGKGMTKTIPHLTYKQVNTSHWALWEKPKEVNEMIAWWLEEVGSLILVCSSCEGCIKIAFYTIVCDSICVILRN

SEQ ID NO: 34878 - protein, 61 aa, A.fumigatus
PAAPYRSAWGFDTAIPSTGLGSHGAKKESVTRPEHVGELELTDKEDGGSVRACFRFAIKVT

SEQ ID NO: 34879 - protein, 64 aa, A.fumigatus
FELHVESILTICSTLKTGLVAKAIKAGKTVDEKTLQHFYETEKVSAIETVGLSDAKTPHSSRTP

SEQ ID NO: 34880 - protein, 322 aa, A.fumigatus
SVRNPSGGGNQTNTQRQQQAQKPTLSLFGNQNAAPQLSTQQTATSGTVVPGVKVDLSNLLPTTKYESCADEIRSELEKFDNYVLLQIKLCNEVSNMLPTIASQAETIPNDVDFVQGKLETIEHALENDARDIDQLRSLVSRDAAEAQVAFRAIDTLKLPLQYQSAGGAGWWSAQDQKGSDRQALRSTRKNTLALPDDVETDASSATSINGVPVNLVDYFSQRSDEMGTVLERYTRNLKEIEDHLHGIELSLNRQIQEFVASRSRDGATAGTQKSKLNDLAAVLGDVENGILGVASRLGAVTEQVLEVVLGPPSGDGMLNYKP

SEQ ID NO: 34881 - protein, 174 aa, A.fumigatus
TEEYTMAPLLEEPAATPYLGHFTVPKKEPAEHNKFWYEPGRTTVKRHDDYPYEDLLPSFPDVRWEPIGEVPYEDKGLRGDPKFRHLLQDATDVFDYTPRIGTEIHGVNLARLNDAQRDDLARLIAVRGVVFFRNQKDFDIDAQRELGKYFGTLHKVSLNSPRSSSGRDWSLTVV

SEQ ID NO: 34882 - protein, 225 aa, A.fumigatus
HATTAVPKKKGLEDVHVVYTGDNSSDQRALFSPSFLWHSDVTYEIQPPSYTSLKVLTGPPRGGGGDTLWSSQYAAYDALSSHMQNYLKGLTALHTANMQASDSRALGRTVRREPITTEHPLIRTNPVTGWNSLFFNPGFVTKIVGIPKTESDAIIRYLTEVVATTQEAHVRFQWGENDVALWDNRTTVSDAQIFPMIPPDFLVESLRFLWLFSSPSSCRSSRLPR

SEQ ID NO: 34883 - protein, 65 aa, A.fumigatus
ACRSRFIIKHTISRRRTQYHFQHLFRDRTEPTSNAKYTVFHISKDRCKIIELRFLGSSGRSISTS

SEQ ID NO: 34884 - protein, 146 aa, A.fumigatus
PLLQSGATHLVAGGEPYKNVKDGKGFFIAPTIFTNVKDDMRIYREEVFGPFVVISSFKTEEEAITRANDTTYGLGAAVFTKDIERAHRVASEIEAGMVWINSSNDSDFRVPFGGVKQSGIGRELGEAGLEAYTQIKAVHVNLGTKL

SEQ ID NO: 34885 - protein, 77 aa, A.fumigatus
  UNSURE (35): Identity of amino acid sequences at the above locations are unknown.
LQLQVANGQVVIELPGSPSDPNGFKVRVPGCLALXYGKIQKYNRENKYQGAGFTKHAFILMCGASKLVGLNFTGLLL

SEQ ID NO: 34886 - protein, 410 aa, A.fumigatus
ARMSKGDMVNSWYARKYAPAWEAASSLGRTSDASMLRRRINPFDGADKMRLYSQDPGDLNFLFLSTTLFHPFQAIHMSHAMEDDALHQLQQEQSKLLDKIDELRTIGVGGLVELPQLIVCGNQSSGKSSVLEAISRVRFPAKSNVCTRFATEVILRRNAAFSKIKVSIEPGPSRTDEDERRRLRSFTYEDFSNGDDLPPLIEKAKVHMGITESVNTGFSDDVLKVEISGPDKPELTLVDLPGLYYSTSQEQDLQGILIIRKLTERYMSNPRSIILAVISAKTDYHLQEVLNIAEQFDPKRERTLGIITQPDTLEANSEEEDTYLHFVKNEKIPLELGWHVLRNRSFETRDISDDARDEMEKAFFNQGRWASLSRECVGIESLRRRLSGVLLKLIRRNLPRANHRDPRQGV

SEQ ID NO: 34887 - protein, 119 aa, A.fumigatus
GGLLHPRRYDTFFDSCTNGQGKVNPNLYEDGRICLSILGTWPTKSPEESWSPVKSTALQILVSIMGLVLVKNPFYSKYILELLDVLNHLVISQTRPAMTPLLWATIVASSPHNIQKRHS

SEQ ID NO: 34888 - protein, 98 aa, A.fumigatus
RAFASVPRRRRRLTRKRYPLRKAHFTLIAKLSQAESASEKEEMTPKSKKRGRAQTKDEPEEKATTPKTKRVKKGSRIKQKSDTEDDVSSPRGWKEPRH

SEQ ID NO: 34889 - protein, 85 aa, A.fumigatus
HATRGCVTPKIIANLNEAVEEASGDSKDLDAIDGFEELPSEYQEKVRKALEQGHVDDEDWKGVGFAPFAPNLYRFQDETNTGLGS

SEQ ID NO: 34890 - protein, 148 aa, A.fumigatus
VYPRTTRRSKSLSYLTDEAGYDALAVGDNRRVESSQYTEKAFLMTRNFIKHALHHPVAGLEDVLTWNYIKSEQKDDASSRPNLLRRAIDSAVGMIDHHNNTSATDKLDEESAAAPFVSRLSLGAVVMLRKHVTDLGNIESTIIANNSS

SEQ ID NO: 34891 - protein, 198 aa, A.fumigatus
GHSISMSTCKAVAQRWPRYLHRHIPFVAPSPSIRPALRRCRMSKQPSLLRSYASISAADLKFGQPLHETHPHLLNPGECVYMLPIACECDTTKNERINLKLVTPGITALEYAQRRSRLANKLPKNAIAVLAASEVTYRATGIFNNYRQDSNFFYLTGMLSLQVENKASSSLDILSIGFNEPNALAIIGKTGLPVKRLR

SEQ ID NO: 34892 - protein, 91 aa, A.fumigatus
MFMIVPDIVEVRISKQASASPSNRKYSSSLTFGTFLIRLPSGIYVPDSERWPEQFRGIGIRIEDSVCVGDDNPIVLTTEAVKEVSSNSIHF

SEQ ID NO: 34893 - protein, 139 aa, A.fumigatus
LFEQTGDIGRIGDILPTILSGATEIYTDIPAFNPGRSSLHHFLYGPTNASEKLKKMVDYHKVKPLRNILNEMRVFKSEDEVVQLRRVGQASGRAFTETMRQTFTKEKNLNSFLEYNFKVNGCDGSAFVPVVAGGSVSTS

SEQ ID NO: 34894 - protein, 142 aa, A.fumigatus
RNGDMVLVDGGGVRTFSILGTDCDTNRLQEWGTYISDITRTWPVNGKFSDPQRDLYNAVLNVHRSCVSLCRESAGLSLDKLHSIAENGLKDQLQQLGFDVSGSVSRLDVKVPIRQADPCLPRTGNGHPFPSSSGTLHWVRCS

SEQ ID NO: 34895 - protein, 65 aa, A.fumigatus
LFIVCLFSRLTLLQYSHQRLSSVDAASQVNLYCTITYEWVSMCYSRFFYLVPKRLDIINLFNILY

SEQ ID NO: 34896 - protein, 81 aa, A.fumigatus
LYRIGHHQLHLDGLTYFCLGFTNYLKTYLMFLIDLMYYTVRYRCCRRLTLGFPGWIGIVWTLHDSKVCFKFGTIIVLLILW

SEQ ID NO: 34897 - protein, 95 aa, A.fumigatus
  UNSURE (23),(24): Identity of amino acid sequences at the above locations are unknown.
RPTTIDHIPFVKALNLEALGSNXXCIAQYTGIHRIGDVLDVHAVLEHIVGNAVGNVVALDGDVDVDGDFVILNVDAGKTVVIRLATWFVSWVVTL

SEQ ID NO: 34898 - protein, 155 aa, A.fumigatus
SSNVSFFKVKQLAQPYESSGGHRDCCTVTINEWSCSKGEDRVNIASTTLLSTSKMNCRSQVNWGQLKKMLEYPLGHAYIRSINDGSLRGRHSGGICATIIQPAPPTPIFQSSKAFKSTISFYLLNRELVIEVRCLLLVICFWYLLFPTYYLVLLS

SEQ ID NO: 34899 - protein, 262 aa, A.fumigatus
WSILLLVGCAAAIDVPRQPYAPTGSGKKRLTFNETVVKRAISPSAISVEWISTSEDGDYVYQDQDGSLKIQSIVTNHTQTLVPADKVPEDAYSYWIHPNLSSVLWATNYTKQYRHSYFADYFIQDVQSMKLRPLAPDQSGDIQYAQWSPTGDAIAFVRGNNVFVWTNASTSQITNDGGPDLFNGVPDWIYEEEILGDRFALWFSPDGAYLAFLRFNETGVPTFTVPYYMDNEEIAPPYPRELELRYPKARLHHGERSTAHRI

SEQ ID NO: 34900 - protein, 129 aa, A.fumigatus
TIEPGPIIIIIIINAVSHLNTAFSSLKLNCQTPTNSKMQFSTILSLLAVAGMTMAAPSVARTSPNPYRVTTQLTNQVANLITTVLPASTLRITKSPSTSTSPSRATTLPTALPTMCSRTAWTSSTSPMR

SEQ ID NO: 34901 - protein, 255 aa, A.fumigatus
SAVTDYGSRVHHQLLRQSTGNGPPPAMAADAHDSLDREDAPFLASSAESSASSSRIGDQDDEAELKHVYNDNEAEDDGLDNRKGTKAIEKIRFRFMVTLFAMILAFEVGIVMANGPMTRIYESIACRQYYAEYDPRQIAADGQVAESMCKIKEVQTELAAVKGYMEFFDGVLSAFLAIPYGLLADRIGRKPIICLSIPAFALNSGIMLAVMWYSDIFPLRAVWASCLAWLLGGGPVVAFAIIWTMMSDVTAEDER

SEQ ID NO: 34902 - protein, 89 aa, A.fumigatus
GTLRAFQSGRISYVFKWSGPSLTLDTACSSSMVAIHQAARALQAGDCRSALVGGVNVITSPDVSESFHKHDAVQAMEPHFYKHYELTAP

SEQ ID NO: 34903 - protein, 100 aa, A.fumigatus
MYLGLDRAHFLSPTGQCKPFDDTADGYCRSEGCAAFVIKKLGDAISEGDRILGVIRGIEINQSGNAHSITHPHSPTQEDLFRTLLKKTRIHPHEVRHPSG

SEQ ID NO: 34904 - protein, 262 aa, A.fumigatus
QITVVETHGTGTQAGDPNELVSIRGAFCKGRDPANLLHFTSIKANIGHCEAASGGAALAKLLLMMRHGQIPPQISLQTLNHKIKDLGTDGSVIDRDGATWPRPSRHPRLALLNNFGAAGSNGALILQEYSRLNAPPQDEEQREAPSYILGLSARSSSRLLAYKDALISYLEAPSIRSSLRDVAYTSTARRQIFDYRISVTGSTIQEIVDNLRNAEIYNIRESANPQPRAVFAFSGQGSQVKLHRCTSGFTNLSEIVVPTNGP

SEQ ID NO: 34905 - protein, 142 aa, A.fumigatus
IPSSRFHVEDFYQKKDGRTLRTKYGNFLENPFMFDNELFGISRREAHSMDPQQRVMLQTAYRALEDAGYVPDSTPSFSRETFGCFIGNATLDYTDNLRDNIDVYYSPGKSCHAWLRSRLWHANHLSVRNVTRFSEWTDQLRL

SEQ ID NO: 34906 - protein, 62 aa, A.fumigatus
MRMRDGMRISALIDLDASNNAEYSVTFRYRITKFLDHESRAAFRPAVAICCIIKWLALACRA

SEQ ID NO: 34907 - protein, 143 aa, A.fumigatus
LVANLPAAVMKFFPRQLWKTIQPNFKPSVAMDGYVPHGPRIGVKRGFEDEEEEHDIEETKRRRGIDEDEDAERDEREEREEDVDVLDPDEDQEEEIVDDDFEDDEDEMGGDYNAEQYFDAGDDEYGDDGFADGGGGGGDEDTY

SEQ ID NO: 34908 - protein, 67 aa, A.fumigatus
TLLTILPQKMLRSFTFTIFVVSTTGQGEIPANARSFWRSLLLKKLPPTFLSGVNYVSFGLGDSSYPK

SEQ ID NO: 34909 - protein, 106 aa, A.fumigatus
GLLLLTSCAQRYNVPRARPLNPREQKQVDLYRALRDRFHDGPYYSVLQSTSVTARKDEAARAHFDPFHGMPTYSGKYQKPESGIGPEFERTSVRVSVVLAGYMGWG

SEQ ID NO: 34910 - protein, 420 aa, A.fumigatus
SSTGGEDTREMITKVIAQVTEIWFQWASLPAAAAEHKVLSFLPYLQHEPPTHLQTGKTTTQRDGVAQSLQSADLSQQSEVSAHSTDDPYGPRRWRSSMVELSGKDRALNEFSVERVGEEVDQHLVMLHGYGAGLGFFYKNFEPLSRLKGWQLHALDMLGMGRSTRPLFRIKAKNREDAIKEAEDWFVDALEEWRVKRKIERFTLLGHSMGGYMGVAYALKYPGRLNKLILASPVGIPEDPYAVSADMPEPSESTLAQEFTQDQQTIAQSSLSVPPEVAQKGDNNVLLKGYGNAAAPPESRPARRSIPKWFAYLWEANISPFSLVRWAGPLGPRIVSGWTSRRFSHLPANEAKALHDYSYSIFSQRGSGEYALAYILAPGAFARSPLIRRIQNVGRQIIPPSNPQWGACERHGPLSLATAF

SEQ ID NO: 34911 - protein, 139 aa, A.fumigatus
FGAYRTSDGRSFRLPTPSGEPANVTDPSPSQPPSDSATQASSAPGKRETGIPIVFMYGDHDWMDAAGGFAAKAKIEEEKRRVLQNASPEEREADNGSAKVVIIKGSGHHIYLDGWEEFNKVVLEEMEEVSQRERARSRT

SEQ ID NO: 34912 - protein, 260 aa, A.fumigatus
  UNSURE (122): Identity of amino acid sequences at the above locations are unknown.
RVFWFFLKENKAPGLLKLWAVGRCPTNPQGPRPIVSRFALFLVQRPGLSDEAVERGLAFPSMIGKELPSPAFPCYGATPKQQTFYPWRHSQAASCSPDGRRQRHHHRSATTSLIPSHTRRAXTSPSASRSNRSAGSGARSRGLSPRPRSQDASSLSTYSDFFHAMASAPQAHSQLHLSNSSEVPGGYFAFRPGNGANSSGSAVSTGTTTPVEDRSSTTSRNMGRFMAHYPAGVRYRRRSVSGANLGSQLPNASLSIDRPF

SEQ ID NO: 34913 - protein, 95 aa, A.fumigatus
GTISAACGSQLHSNASCDIERKICPDQMPIGLLVAPEPVNNMMNHNGDVCCICKTKKTTFTPHFHHPHRHALSMASLIANTGTNMSCNSSSSDTK

SEQ ID NO: 34914 - protein, 160 aa, A.fumigatus
SSKMGKKNKKSAEHKERVAAKQSKKAAQKEKRHKAKGRDADSDAEDVDLDAILAQYAEEQAKFLKVTEVVSGPPSPRSSATIIASPSNRNELLIFGGEHFDGTLATFFNNLFVYNIDRDEWKEVTSPNSPLPRSGHAWCRGGNAGGVYLFGGEPCASFPG

SEQ ID NO: 34915 - protein, 460 aa, A.fumigatus
KWPQNDIFQGMYQNLFTSSEYHAEAIQNYIILFGGFQDTSQQTKYLQDLWIYDCSKFTWFNPTLPPAAQKPDPRSSFSFLPHESGAVLYGGYSRVKASTGVGGKPQKGGPQRMTMKPMVHQDTWFLRITPPDADAPASAAPTVRWERRKKPANSPNPPRAGATMAYHKGRGIMFGGVHDVELSEEGIDSEFFDTLLAWNTDRNRFFPLTLRRPRATGKKQQANQMRSRNRAKADEEELLQNLRALEAKGGLRDLDDDDEFQRISHRMEDAPAKSEKPSIVRFEMPHKRFNAQLAVQDDTLFIFGGTFEKGDREFTFNDMYSVDLVKLDGVKEIFYKEPENWHLLNEAESDDEMDEDDEDEDEEEEDDDENAMSLDSASPAPTEVTVPSVTQGMEQLEMEEQEAEPSVQDSRPLPRPFESLRDFFSRTSEEWQKILLDTLKEKGITVEKNVKELRLNAGSR

SEQ ID NO: 34916 - protein, 212 aa, A.fumigatus
YLVASTLMALLLLSSIISSSTTLIEMSGRKLRVPTALYLEAGMHGAVEEMPEVSICSEVSPVQVSPDESGINCYFQCSGEFSSPKQGTFYHYNDFWHLDPATREWTRLETKGKGPPARSGHRMTYFKVCIKIYSHLVNITLRPSRTILSSSEAFRILHSKQSTSRTCGFTTAQNSPGSTLHCPQQLKSLILGHRSHSCHTNLELYCTVVTLA

SEQ ID NO: 34917 - protein, 61 aa, A.fumigatus
RSLFFLYSGRNKNGRGHVKPVRCSNCARCTPKDKAIKRFTIRNMVESAAIRTFEPLSILYH

SEQ ID NO: 34918 - protein, 406 aa, A.fumigatus
SLLTDTRLHSRGDDSGLYLAAPGPVSRCASPVSPEGLRAQMIQTLLAKRPKNQSLPRRDGRGGSFPYLHPSHVPHLETLVLTDVPSHVPEGSHILPALIRFITACSNEALLATLLAGSDYSLPPGRARAHAEQERSRSLFALRRLVLEITPTTHLAGAARISPWKSISQQSGMSRSSTGDRDSENLWSAATGDFSFFGEDECGIPENDPGKYFPMAILNEKVTLIPEDEDSGRSGSPEVDASFASNSFQPAGAFFRRGRSQTDSSISVSGSVADARPSSTAVNKGDGGHMPVADTKQVDLVAELAAFRRAKKLEYEEVVRADRERRSMSSAAFSHLSPPAEPTRPVSPSPSVRTMAAVSAPHLSIAQFVEGHWKGEVKIVRNAVPKGRTGVVDMYGNYFEKGYLYP

SEQ ID NO: 34919 - protein, 79 aa, A.fumigatus
  UNSURE (33),(45): Identity of amino acid sequences at the above locations are unknown.
RSLWLGSKSPVNIANPQARSRSTAYRNEGKSTXLKVQLPKDITHXLRFDRTSIDIKQPAQAIYLIWALLPRKFIGGTIR

SEQ ID NO: 34920 - protein, 332 aa, A.fumigatus
RSLPFQYANFPDPVELVGNRDLITSGITYFDRGQTTQSGNVYGADICHILDRSGIDTDKGQHRRTAEKASSRDRSLPKYDTGALQQAGLSGGVTKSALFPAADYLYNFEFLLHNSLPETIDTELISTRYYLEAQIEPSGLFASKVLCQVDVPVIRLPAENSLELTEPIMFARKWHEQLAYDVCIFGKCFPLGSQIPIRVKLTPLVKLQCHRLRVYVSEHVQHHAKGQIARFLQLPTKKVLLFEKQPGLASYTSYPGSTMRIMTDEGTGTPPGIQSMSLLGEEFETSEINLEVQLPRCREMKTKGKHQWIHFSTKGGSSEESHWIQVRKIKIP

SEQ ID NO: 34921 - protein, 163 aa, A.fumigatus
VLPPQSPMTISNNPGQQPVDILVNAAGISISNILAKLEPDDISQVLRTNLEGAMLASRALVRASIRSQMKIRNTSSTSEVPLPSKCIINISSLLAVKGGTGAVPYAASKAGILGLTRSLAGEAAQSLRGVVIRSNAIVPGYIDTPMIAGESSSSGDVTGCDDS

SEQ ID NO: 34922 - protein, 60 aa, A.fumigatus
SNTDDITTDFSAGETSRLKESIPVRRFGTPHEVADAAVFLAQNEYANNCVLNLDGGLSAM

SEQ ID NO: 34923 - protein, 82 aa, A.fumigatus
VPCTLPHDGSFIVKASQRMVVVYHTDWWSSPQIFGQISWPNMYDYRRHIWHWIRHCRTIPPRRCQARHPRWQISRTACQSRF

SEQ ID NO: 34924 - protein, 212 aa, A.fumigatus
RKDNSDSVMYHTHIMRSRSRGAAVSASWATLGHQARQAKTKFHAHFLMMAPLLSRPLSGWSWSTTRTGGPPLKSSDRLAGRTCMITGGTSGIGFAIAERFLQEGAKRVILVGRSHERLVKAASRLEAPTSGSSFAAVQSSNDSIAWEVAIKAPETDQQSQNKDTEAKSHGRLIDSSSRISLLIGDISEAGTWLRELEKAMVSSPAPVSDDNI

SEQ ID NO: 34925 - protein, 193 aa, A.fumigatus
KMHTKQISPALCLTAYNTANHITSIPQSHSADDMHEKAQESPRQARNQLNQLLPAQQTSHPFRTTHPLPLNLNQQKEGNKKRIKMPTPESAAFLAKKPTVPPTYEGVDFEDNVALHNARDAIIREQWVRSMMSRLVGEELGKCYAREGVNHLEKCGKLRGEFSSGGSFVSERCVVVAWLMGDDCNLQRNILSC

SEQ ID NO: 34926 - protein, 317 aa, A.fumigatus
  UNSURE (25),(29),(64): Identity of amino acid sequences at the above locations are unknown.
LYIVIMSDAPRPSLKLTLGEKKAPXGASXPPNQPPPLSSETPQRKITLKIARKPQPTEKEENAXKKNPPKKRPAEGLAGPSAPEASAQPAGPKRIKLNASKKPGVQSIRIKNKGLVPNRPVGVGYDSEASDTEIDPYIEEQFILRMLPGEDCEYLRQAINERRFDRSEFSFKPLTREGRRAVLRIRDKQYAAALVDLPCIIEGMKSWDRRGWYKSADICQMLLVLGPVSSDAEALNYPLPSDVEILDEKTLQYPHGLTPPLRYVRKRRFRERLSTRTIEQVEKAVEDLIAQDEAAIASRYELLDKTSLNRAEGLVQS

SEQ ID NO: 34927 - protein, 142 aa, A.fumigatus
RRWSKACLYRPRKCTLSRSRPPYVSPPTIQPITSLQFPNPIPPTTCMKRHKNHPDKPVTSSTSSSQHSKPHIPSGQPILFLSTSTSKKRGIKKELKCPPPNPPHSWLRSPPCRRHTKASTSRTTSPCTMPATPSSVNNGCAA

SEQ ID NO: 34928 - protein, 169 aa, A.fumigatus
KGPLCSFLKLLSLPEMHFSAPTRLSLPAARQSPPLSSPQAPHQHRKTDRPEPARHGPKLAHSRPLLRQSRSSHARQPFPCQQPPAPHTRPHERTVAQRAAPAPWGSPAPAPSSPYRLGFEPVCKPQHRSRLSTQPGVSLQLTQVTTVPPEPPGPGLVRRRLCSSGVLRL

SEQ ID NO: 34929 - protein, 484 aa, A.fumigatus
  UNSURE (26),(74),(75): Identity of amino acid sequences at the above locations are unknown.
TASVNRLCYEDDSWPRGDINSGSFRXLIPAIFNLRIAVKKSSTMVYAFALPTTTHLSFQTFLSSSTHPSLPPAXXTARHALRLALKAHKRLPHSPQRDSHLITILDALNGYLPYLAAISHGLSGRPVESGSSTGGEEIEVTLHSELETEWRATLSSTPLSLKSRPINGRVRGQGIDFEIAFVLTTLGYVLSGLARSGILRALYAPTTPTPEQRTAAVQTATKYLLQASSVHSLLASSPSFIGAARQTSTAAAVPDLDPAAQAALSSLALAEATLLAVLKDDSYVAACIQARNPNDKDWMVRAPEIPKVRALLFARLCVRAAEYAEQAAAGMGTVGAHGKTGIDEEVVGYARVLGRVARARACRFFGVDAELAGKIGEGIAWLRAAKGALGLRSASQGEKEASGKSKGGLSRLKKEWAERREERRLEKESGGKDRVAKGELDPGDDAGREEECRVIEMLETKWERMNDTVSLFSAALGHERSLTV

SEQ ID NO: 34930 - protein, 134 aa, A.fumigatus
  UNSURE (126): Identity of amino acid sequences at the above locations are unknown.
PTGSSIMSGPNLHNALLRPPIIQILRAAGFHATRPSVLDTLADLTARYMMILASSVASHAANAHPNDPAPAPVLEDVYQALQDVGALRPQLREWEEDWQGEEDTRGLENFLGWFTGPANREIRRVXGSNLARVT

SEQ ID NO: 34931 - protein, 74 aa, A.fumigatus
VRIDPTRIVAESIKEGQPFLFVSFNYRLNIFSFGDGKEKNLAIKDQRLAIDWVRENIVEFGGDPVSDPTLLENT

SEQ ID NO: 34932 - protein, 280 aa, A.fumigatus
NPTQKHLRDGRVSLSGTTDERDSNGRKEHVATSSSTPRGDTIGDANQQMPRKRRFGAVATLLASDRMLVTLWAYFIVAVALTSLDSVLPLFVQDTFGWKQTAQGLIFIPVSVPHVLDPFFGYINDKFPQARRFVVGGALLITIPLFVLLRLVTMNSMSQKVVLCVLLALIGLCLAFLIPPLFVEASYVVQEKEAESPGVFGKGGAMALAYGILNSAFAAGSMVGPFLAGFIRESAGWSTMSWVIGLLMGVSAIPILLFLGGPIWKPMERHAESQSAEAAG

SEQ ID NO: 34933 - protein, 310 aa, A.fumigatus
  UNSURE (19): Identity of amino acid sequences at the above locations are unknown.
SNLVGLGKTPNGEPNGSGXDGPGHERPSVEDPAGERWQPDGATEGVLKLLLDSGASPNESRQFPRVPLSLAIQYGHDAAVRVLLAREDTTVTLPSAPFSQQPLHFALGRGSLECVLLLIERGADLQQYESTGSRALYPAISSGSHALVEFLVNRGCNPLGCCGYTALSLAAVMGHQSLVRYFLAQGVDPEMRDRTGFTALGHAAKAGHADVVETLLEWGVRRDNVGEDGETALCWAARENHAVVVEVLLRHGADPNSPNPRGIRPIHWAVTNGSVPIFKALVARGAPDRHSPRGRNTPPYRRTAERSAAG

SEQ ID NO: 34934 - protein, 221 aa, A.fumigatus
TAGVIHSAVAGIRRSRLLQSWDTSHWCGTSWLREWIRRCGTVPDSLLSGTRPRRATRMSSRRCWSGASGETMSARTERRPCAGRPAKTTQWLWRCSCGMEQIQTRPTLAGYAPSTGPSPTGPSPYSKRSWPGVPRIDIHLEGETLLHIAARRNDRPLVEMLLQLGTEVDPRDNEGPDSFRCGGGRRPCRHDGALARQRRRHDYPRSRHMRAAAQGPLELSR

SEQ ID NO: 34935 - protein, 196 aa, A.fumigatus
GRRVLAPTRRGSGLCSGRRFPSTHPRRPQSNGPGHAVSPGTRRRSRSAVELRSYPALLVACERFDADNYAIAGMLLRTGRVNVHARNADRRTAIMFATGEDGDPQLVRLLLAHGANPDDQEEDGWSCLERAIGAGNEETARILVEAGANVNARDSYGQTALHLVHSRDPFYAYLLEKGAELCCRHHYHSDSYQLSK

SEQ ID NO: 34936 - protein, 166 aa, A.fumigatus
TFTSREKHSSISPHGGTIGRWLKCSSSWAPKWIHETTRGRTPFAVAAAGGHVAMMELLLANGADMTTRGRGTCAPLHRALWSCQDEAAAFLLRRGADPDFAAADGSRQPILAVRSRMVRVTRYLLEHGVDPDPLSNCGRTPRCLLPVRGSMRITTRSLGCCCGPVE

SEQ ID NO: 34937 - protein, 275 aa, A.fumigatus
  UNSURE (267): Identity of amino acid sequences at the above locations are unknown.
AVRMFTNDRGDQDSGMSVEMDPKYRPDTDPLPVSSEVTIVDWDGPDDPENPLNWSKARKWLITCVALLMTFVALMNGTIITVAHEAINERFGISDAVFPHSYWPVTSWALGGVVFSLLILPIMEDFGIRRTFLLTHLLFILFVIPQGVAQNFETLVITRFFAGGCVTVIGNSAASVIGNVWETEKQRSKPVSLWIWAYLAGSSVGPVIGASVFQFRSWRWISYLQMIWLGVLFPINFLVFRESRAAIILHQRAKRLRAKGQNAPFRXQVLKIRLP

SEQ ID NO: 34938 - protein, 146 aa, A.fumigatus
LPELSSNPLVEHVYRSRPPSASAILPLYLAHSPPRPSLLYIPNITPPVTVFSIVQSNLLFLALSEVDTEPLLALEFLHRVVDVLEDFVGAPLLSSKLQANYDVVAQLLHEMCDAGIVCNTEPNALQEVVEMPGWMGKLLGGVGLPG

SEQ ID NO: 34939 - protein, 85 aa, A.fumigatus
DTRQTGMMSEVDALYIYDEHKYALPLMTSPRLNFMSADCLSFQATRSWSMFIAPVHPPHQLSFPSISPTHPLVRHSSTFQISRPR

SEQ ID NO: 34940 - protein, 480 aa, A.fumigatus
PAYTAYRSSTPILGPSNPLKTPLSSSNIPQGPAIPWRKAGVRHTSNELYVDIIESLSVTIAPSGRLLSALVSGTIAFTAKLSGVPDLLLTLTTPSGPQAVGKKIDLPVFHPCVRLARWRERPGELSFVPPDGRFILAGYEVDLLPIDPNIDQPPTHMEKVFLPAVVEVRKSLGPTGSEFEVRLILNTSFPGYSSFNRPGAGRGGSGTSTPSFLGGGGNSSAPVLEEVVVTVPIPKTVRNITDMQASRGEAIFAPGNDTLEWRIPTKDSGTVSGTATLRCTVVGHQNVEDEIEEDNDGADADANFLQGYYDASTAASYQVAEEAATGTTKRKTKKKKKTTKTTKTTKTTKTKKSSKSAAASALVASDQDSVPQTSPNPSKPQSPAPESSSSPAAPAPAQSSSQSSSLFYTPPRKTKAQINASLMPNSASVSFSVKGWLPSGLRVDSLNIDPRRSRGLGEGVKPYKGVKYLCVSRKGVEARC

SEQ ID NO: 34941 - protein, 63 aa, A.fumigatus
KHIGSAAFIGLGVYSYYTGMNNLRKQEQTIMWSATKYKMGSRRLGIATISATLVGMGIWRALN

SEQ ID NO: 34942 - protein, 677 aa, A.fumigatus
APKEELATSIKRGYPLSSVELISPGMSSNNGIIDTFSPGAASTNTGSRSTSTVRPRTRRLISVDDVTDEDYEGPLQSTRLSTTTLSRDSSAVRSRGATPSPHTSRGTSPLPMRHPSRATESLNLDDLNRFGGSLGGHSQTGKAQVKFADSSRAAVDFLDSSWTSLQSLASSFLGSDIARSAPNGTARTHARKPSRPDPYMRANPKTPSAWGPSTPSTSEIAAGTKEERLAMVQAKKREALLLTDTGSEASRDIRHKRRDSSDRTDHAAVDARQDEEALVYVHHVQPNDSITGVAIKYGCQPAIFRKANGFWPTDSIQSRKTVLLPVTSCSVKGRPIRAPTEIDLLGGDTSNRDSLEDLTGSSIAPAPSSDARASSTEGEAPTEAPLEGEADKIWKHQSWVQIDRFSAPVEIGRVPRKALGFFPRTRRKSLSYTDSEPRSSISGRERTAALTSALPSPTESPSSQASTAQNRSSTDPSGARAISSAKPRPHHQRQRSNIQLVGTGVGTLDRSAMAPGPALDGLSKFVAQHLPQLAPAPAPPGLGRTPSEYAAATASNASTSLDNIGGAVEGWVRKLTTRAKVGLSELQQSAQAYQSNTGARTSRRGMGDLIELDAGLESRDSSGLLPESSRKPNLNRSGSNLHDASLRERFPSPSSSGTSRTRTGGSNLGYGNRVKDD

SEQ ID NO: 34943 - protein, 164 aa, A.fumigatus
QADFHGDGWFLSDREKSNMARRISSLAWLSLLLGALSRALPSSQTQGAIADYPTATLRTSYQSGSKTVFVGRSLPEFDQELFLGIKYADQPIRFTPSSLKTSYAANDSNSGPYDASGTGLALSKGTVLYNATQYGHECPGYGSDETKLVDMGVLHAEAARYCAQ

SEQ ID NO: 34944 - protein, 628 aa, A.fumigatus
EMQICACLRSALSIEELSDHAFSAWSVLVSSLHEEELEPLIDQTFSIVIRYWDAFNYQSKKTAEELIGYILRSHSGLVHTNFSTIPSLASIPALSALESEISKMKEKMDVRSQLSAFGRRCQSENAAVVEQALRELLPCLSRHEEFLHESVLSEQPDPVVAQLTRSLLDCCVKFNAGSDSITLLSAQCLGLVGCLDPNRVDPVKDKKDILVLSNFDRMEETFDFVLFFLQHVLVQAFLSASNTRAQGFLAYAMQNLLRLCNLDSAVTQRSRDVQADEKYRRWSELPETVRNTLTPFLTSKYTVTVGAIRSRCKFPIFSTELTHGDWLRSFVQDLLQRGSGDNAQLIFSVCSRIVKGQDISIASFLLPFAVLNRIVGGTQEERLDLQSELTTILSHPLPEASNRVHEAIILCSQVSVPFVSIRSVHTAFPLLTIGQSVFEILDYLSRWLQGKKKLLHGLKNHASHTGRSHKDSHQDSLSETYSSQVKAVETFLGSIPPEVISKRAVECKSFSRALFHWEQYIRRFKSQSDKNDHTSTELLYQHLQVIYSQIDEPDGIEGISSHLHVLNIDQQVLQHRKAGRWVTAQSWYELQVEKEPDNIDAQWNLLTCLRESGQQGNLQMKSCHQCWR

SEQ ID NO: 34945 - protein, 175 aa, A.fumigatus
LSKLAQRLSVTPAGLFRPFWRTLSITVVKNFQSRPHMAEQLCDLLGMNVDDFLRLTEVHILPYLVLTRKRDVITRVGAAYKHIKTPFDICSEKNNLAAILAFLMSQPWSDPEGMIMSVLSDIDSAFGGRTLAELVRTEPILIACDLLKGLGDSGSEKGARACENQFLFTLSCVLI

SEQ ID NO: 34946 - protein, 109 aa, A.fumigatus
FHRALHLLAALVPRKSTATSKKANLLCHFIEEHVLGIITQFAHAINDFQIRQPLIEKRRNILAIGEMIKVARGHISSALPQVSRCSIPFILSRYFDLRNADMCVPAFRT

SEQ ID NO: 34947 - protein, 291 aa, A.fumigatus
AEDAFERRNEDWRAIVERLVFSTTTTTTSQEEDEEEEEEEERAALLGSSRATGESDGEGVFTGGYLFLAGDLNYRTSNTLPQPADIARFPGLEADESDPLHYSRLLREDQLTREREKRRCFHGLSEAPIGFPPSYKYELGARDPRDWKFVHSRWPSWCDRILYLESSTATVTPYRYDALPLFPTSDHRAVALAAAVVLRSIQAGPSDSESAPATDMQQQQPQPQPQPAPAPAAPFPIDRDWKRKRDEARRKELVVGGLAYLGLTWEGRRYLVGMVIGGLGAWFILRSMLNV

SEQ ID NO: 34948 - protein, 163 aa, A.fumigatus
PCPPGTDGPPRSTPDTPILPPPTPCVGPHLVCVSSPGRSGMGLPAPAPAAAAAAAAAAACLSQGQILNPMDRPGSTAAPPPPPAQRLDGQTSEIEAVHHIGRALPSPSKTPDTGSGRTSWANGCGQTSSRADPAPPVHTCTTAGNRSALQTGRGNTGASLVRG

SEQ ID NO: 34949 - protein, 86 aa, A.fumigatus
CDWSHYKLYYLVMEIRRPSRHGNHPDRTYQRTYKACISCRQRKAKCDLGTGPDGLPLGPPCAKCRREQKPCLFDEKRAWERVKKRG

SEQ ID NO: 34950 - protein, 264 aa, A.fumigatus
RRASSVVTSGTPIRRPNGQILANPAANPKVPTFSPCKRLDIELELAAFVSKSNELGKPVSIDEAEDYIFGVVLMNDWSARDIQAWEYVPLGPFNAKNFATTITPWVVLLDALEPFRTAGLEPGNRESLLPYLREKRELNAYDIPLEVEITNAGGKPTLISRTNAKNLLYSFPQMLAHHTITGCNMNTGDLLGSGTISGKENQTQGSLLEQTNGKNPLKLADGSQRLFLEDGDTVVLRGMAGTEGNYVGFGDCVGTILPALKLEF

SEQ ID NO: 34951 - protein, 69 aa, A.fumigatus
RRCTAGYFIGLGAEIDGYFKIPAFCSSSHLDSMSHLQLTQSEGPVLKAPYRALLEVLSITLQIDLITMM

SEQ ID NO: 34952 - protein, 243 aa, A.fumigatus
SNLTSSLHPTITMEDSTSPKVTLYTYFRSSCSARLRIALNLKSIPYTPIAVNLLKGEQSSPENIALNPSGTVPTLIVEHDSKEPVTITQSLAALEYLEEITLASSHALLPPASNPEARAVVRTLVDIMSCDVQPVTNLRILKRVAPFGVDRAAWSKDLIEDGFRAYEAIAAKSAGLFSVGDSITMADVCLLPAVWGAERAGVKVEKFPTIYRVAQRLEEEDAVKRAHWRTQPDTPEEFRVSSS

SEQ ID NO: 34953 - protein, 124 aa, A.fumigatus
RHPPYQLRNGPTHPIRPGNLMPAPMIKHPPLSRLTNPRKLHPSRIPRILRPINMHRRNPHRKRAPDRPPKLLLIHRPTPRRITHPTRRPPRQYRRRMSLRRQRLPPGPIALLYCVRNLKPYALK

SEQ ID NO: 34954 - protein, 145 aa, A.fumigatus
ILSKSRLPSSTAFTIDEKLSSASTMSAASFATSLPFLPIAMPTSARFRAGESLTPSPVITQKAPRRCIASTIRTFVAGLHLAITRGSCSMASMSASDSSSNSAAAMTTRHDLLSNIGPRIPTSDAIAVAVLMWSPVSICTVIPAI

SEQ ID NO: 34955 - protein, 281 aa, A.fumigatus
HLQFLMHLLISNIAQVILLLIALAFKDEQGDSIFPLSPLEILWANLVTSSFLALGLGLEEGQPDLMYRPPHDLKVGVFTKELITDKMIYGTFMGSLCLVAFVCVIYGAGAGISDLGEDCNNGWNETCNVVFRARATTYASLTFLLLITAWEVKHFSRSLFNLDPDKYPGKLSVVQSIWRNRFLFWAVIAGFVVAFPVIYLPAVNRLVFKHQGIGWEWGIVFGCVAVYLALVESWKAIKRAYGIGSGKNATLTMGDAEMRAGLTLTPCTLLSMSANASVEMK

SEQ ID NO: 34956 - protein, 171 aa, A.fumigatus
  UNSURE (5): Identity of amino acid sequences at the above locations are unknown.
RSPFXKRIYFLAPAVYDRTAWIRGAGVLTVQDTTDPYDPTSGLVQLNGSGWAPEKHCDNPALSTFLTTISLCNMSVVQNEEPSGPSSGRWTAVGEPTEVALNVLALRVGYEKSTILQRAGMQLHTEYPFDSSIKRMTIVYKNSGESMNDVYTNGAPEAVLPGLAISEKENE

SEQ ID NO: 34957 - protein, 222 aa, A.fumigatus
IQYESDMMAGEGLRVLCIAHKRAPLEDESQVSSRAMAEVNLEFCGLVGLYDPPRAETAAAVRKCQMAGITVHMLTGDHIKTATAIASEVGILGPMLDSRSCRVVMAAAEFDELSDADIDAIEQLPLVIARCSPATKVRMVEAMHRRGAFCVMTGDGVNDSPALKRADVGIAMGKNGSDVAKEAADMVLADDNFSSIVKAVEEGRRLFDNIQKVISTCGFVWA

SEQ ID NO: 34958 - protein, 70 aa, A.fumigatus
RRLPAMASVQRRKWYQIKWFADDDTKEERHLIMKLDLLIVPYAFLAYWTKYMDQSNISRSSNEMSHTELD

SEQ ID NO: 34959 - protein, 92 aa, A.fumigatus
TRLIVLADNAYVSGLSDDLNLRGNELVHLQTIYTVGAVLGQIPFAYLFTKFPMSWVIPALDISWGVFTLLQYRVTSYGELMAYRFLVGWFEV

SEQ ID NO: 34960 - protein, 390 aa, A.fumigatus
TTEPTHICHTGSWYRGDEIGRRGGCFYVGLTLGTLTSSLIQAGTSARLDGVHGLAGWRWMYIICAIITIPIGLLGYVILPGTPDKPNRLVLKQADIELAKRRLQRAGHGVQEHFRWKALVSIAGNWKFWALLLLDIFFWNGSINTTTGGYLLWLKSLKRFSTSRINELNAIAPALGIFYTLFICFSSDLLFGPAWAITIAHTWNIIGLVILVVWDVPQSALWFAFATTYSAVAMSSVLYGWVNSQLRYSPVERAVALIILNAVSQSTTAWTPLLVFKTVEAPRFTKGYSFVLGNAICLVILAHVIQFFAKREEYALCHIFIDTSNRPTGEFQKEQEATPTSATQMKRGILNLVIEQSCRCIQRSSHPRRRMIDLADMQPESMYAGPCVDE

SEQ ID NO: 34961 - protein, 219 aa, A.fumigatus
RPSEEMLDLRKEYKSHVKLQGKGINMAKHIRLKLGNSAFGKVCYATALGRWESEAYWANCYYQSSTSRRELLIESLMGRSNSDIREIKQCFRDSRYLDSLEKCMKAELKADKFRVAVLLALEETRQSEREPIDPNLVQRDVRDLYGALMSRHGGETAMIYIIVRRSDAHLREVLRAYEKIYNQNFARAMIAKSQNLVVRISTFSSPSIPQDLLTWLMTG

SEQ ID NO: 34962 - protein, 105 aa, A.fumigatus
KKYRGQINGWAGLIRVDGAVYTWMGMPGSTTANQTAYEYTSTKSIFTFHVGDAVEMKVTFLSPITPNDLRRQSLTFSYVHVAVSSIDGNSHDVQLYSDISAGESE

SEQ ID NO: 34963 - protein, 833 aa, A.fumigatus
TGSFSGSWQHQTMACLHRIQTAEWDTLRAGLCRIPLHFLRDCMLIDRFRLWSVPVNSFPDHTSFGKWYVNTVFSLARFPYMSSENIAMNDFTDGSEYLEFRINHLRGRNATKYRAEYQKVNALFERALILLNKMPKIWEMYLSFLLQQPLVTQTRRTFDRALRALPITQHNRIWKLYKAFARSASGQTAVKIWARYMQIHPENAEDYIELLVELGQYTEAVKRYMEILDDPRFQSKKGKSNFQLWTEMVDLLVSKAKQIRTGPQVGIDVDAILRSGIDRFADQRGKLWAGLATYWITKGNFEKARDVFEGGITTVLTVRDFTLIFDAYVEFEESIIGSLMEAAAVRADKGNVDEDADFDLDLRMLRFEQLMDRRPFLVNDVLLRQNPNNVIEWEKRVALWGDNKEEIVNTYTAAIAAINPKKAHGKFSELWVNYAKFYESGGDLDTARVIFDKAVKVPFKSVAELADTWCEWAEMELRSENFDKAVDIMAKATQAPKKSTVDYFDETLSPQQRVHKSWKLWSFYVDLVESVATLEETRKVYERIFELRIATPQTVVNYANLLEEHKYFEDSFKVYERGLDLFSYPVAFELWNLYLTKAVDRKIGIERLRDLFEQALDGCPPKFAKPLYLMYGNLEEERGLARHAMRIYERATRAVSDEDRFEMFEFYITKSASNFGLTSTRPIYERAIAALPDQEAKEMCLKFADMERRLGEIDRARAIYGHASQFCDPRTNAGFWQKWEAFEVQHGNEDTFKEMLRIKRSVQAQYKYVNPDQHMKSKNMLISIETAPMSTSLLPKQSPAASNAPRKAPGRGKARKQARMPLRSAQTPWQRWN

SEQ ID NO: 34964 - protein, 85 aa, A.fumigatus
LLGNEWTTQLVPSELPTRTPTWLPVEFLTDCHRCERCRARKVKCSGTQPCDKCRNRQQDCVFEEDRKIVVSEEYVEEDLHKKLLF

SEQ ID NO: 34965 - protein, 101 aa, A.fumigatus
RAQIGHAMRMALVEGLHRALPVEQLGEKRVERCTKIWWTVYILDRKFSSLIGSPTSVNDEDVTTILWDLKTCSQEAAALSLHVKITQVITRVLHSKWPADW

SEQ ID NO: 34966 - protein, 130 aa, A.fumigatus
DTAYLVCHNVFLWSRLYLCLLLPDRLYPDLSYRDRGPGPGHADRETCSFLYAFQLDLLTGNDIFYHHGAPHAADRPSEVRHAEGFGQYLSPAQENAFFVRLSPTLSSYRPVLLFSRGALPFFDSTLMRRS

SEQ ID NO: 34967 - protein, 257 aa, A.fumigatus
NQKMAEPPAKRAKRVDSSTMWDLDERKTRSPEPDSDIGRSPRRDAPQKDDRRREGPRDDRRYRSRSRDRAERRRERSRSRDRRDRDRDRDRDRTDRDRDGRGARDRDTSATRERHYDRRGMPYPTDEIDLLIPNALQGYRDRYRSRSRSPIRNGNRNRTRTPPPRGPKGDRRDDRKDNRPYANGVPHSSLRRDKDEMELDPAVPIEEDEMEALMRKTVGFTRFQEHKEYQSAWKQHLRCAEREEDCVQTVHEPCRRI

SEQ ID NO: 34968 - protein, 179 aa, A.fumigatus
RHHRQIYLLGNPFIWWSSTAAIVVYIVFKGIAGIRWQRSWGDYRNVNFKRFDYEVGTSVLGWAFHYFPFYLMARQLFLHHYFPALYFALMALCQEFDFIANRFKSFGLSSRPIIGKGLVAVFLALSIFTFTLYSPLVYGNPWTQDACKKVKLVSTWDFDCNTFYTDVSVPEWQPPRRGH

SEQ ID NO: 34969 - protein, 180 aa, A.fumigatus
LGQYVTQFLNANPIASSTPSAQVNPVPELPVQNSPVKEPPVAPPQQHHQEVHKEAQEASVTSQAQQPRGTMARVEYRDQHGNVLDEALVASLAREGKVSFETRHETRTRLEHAHEVEMIDGRIAPPHPDVEGQNPETVKDQEHQAAGDSPASAAVGERSVKEPSSPEPKPASEAKEATQN

SEQ ID NO: 34970 - protein, 63 aa, A.fumigatus
NLQIFNMSSIAAMASRRAFARQSLFRAAPRRNYSSKLEEATLDKAPKRDPELYVWISYQAPLD

SEQ ID NO: 34971 - protein, 139 aa, A.fumigatus
LDSSLKDVAGSTRCYVRSFSDCWMVNNPPPYRPHSTRKSDCRTRLSLIARWIDADAAYQLFVNRYFGRKPTSVTSESNVRIGESAMPWERDDDGKIYKYQYHPHGDKSQPLRNAPSALNTVIVPNVTLPVVMIPRLSSP

SEQ ID NO: 34972 - protein, 245 aa, A.fumigatus
RSPFFLVSLTDGPLFCQTSQSGIIDASTSPADSKAPFVRGHRRRSTHVSRRDLEKFRTEVLGIVSDPSLWCEEAGGSPASINPSTLDELNTAFAFASMSLNNSSGIPSNNPGSGMFPNYVDNTANSANLPNASRQSMSPAMPSPSTQVNGAGMPGMNAGIPMNAGHQMDLHHLYEMVLELSEVLKNNRETTKSIVSTAEEIMVRLSDREGYTVAPRICCLAVSLTEITEACLFRGDYSQLAAGQW

SEQ ID NO: 34973 - protein, 160 aa, A.fumigatus
KPLTVSTLAARIAELERALAKEKRLVEILKQEQVENTKLIGEYEAAVGTMVEQIRNYCQNNNMNYLAQKRHYNNLLQAERDAHLESRLDRDHWHAQTMKCAEMIRTAYRLRCEEEELPIRIVSGLQNEVRAYRNALGMEPEKPEEEYGWEILKDVPPSVD

SEQ ID NO: 34974 - protein, 553 aa, A.fumigatus
TLAKISIDFPASIVREGGLTACLTYLDFFPTSTQRTAVTTAANCCRNLPHDAFPVVRDVMPTLLNVLSSSDQKVVEQGCLCVSRIVESFKYKPEKLEELIEPEMLRAVLRLLLPGTTNLIGPHIHTQFLRVLAITSKASPRLSVELLKMHVVDTIYQILTGVSPYENIEATGVRMDSVLVMQGLIHRPREQVFETLNVICELLPEVPSGRHGYSADRVLTSSIEDSATFDDKHIQGQESAEKRRSLLMECKAELKRFAMILLPTLTDAYSSTVNLGVRQKVLIAQLKMLHNLDAALIEEALHSVPYASYLAAILSQKDHPSLVSLALRCAELLFKRLEHVYRYQFHREGVISEIFKLAEAPLSTDKHSRDSLDTPATVPMDLSSDSPREPKSVASEDDGYDDSGRHQADDEDNDQDDDRDEENDDISDSESSSSFSGHYNTTRMEDATQDLVIRDARAFVELYEASEGKAMRERAQQILDELQGLAADIRNCYLGDGDGEGLPLFKKLASYFDGDALESITSAELLNSGITKVLLDVFGDLQCKLLLNISCGY

SEQ ID NO: 34975 - protein, 217 aa, A.fumigatus
HDTRCSHSSLLRLLSQDLATKPRTPDGRALLSTPLNPLLSPISSLPSLPEHPLPEKAQFLMSPRITRSAARLAADSPSSAGSGPSSIPAAGSAPTRKRKAHARRDPPLDVPEETNPQSPTRRTKRQRLASPPHPASTVSTSRRGTRNRPAMSQQGYVMGVPRVVIGSDIKLIFCLALVRQQAPRRKPRRSSPHLRHRGESPADIEEKYHKVRHFIDN

SEQ ID NO: 34976 - protein, 248 aa, A.fumigatus
KLMHLGADRPSATQSPLPRRQKKRSSRTNSDVMMKEAEEELDSHERTANRESSPSNDSNDGTTPSGIDDDDDADLFHNSLFGSRSPLGLQSTLRALSGMMSGMSSRLREILCNLRMKEDPSIQLIALQELSDLLLVSNEDNLSGQFSPDPYVKELVTLMQPDQVGEENPEIMLLACRCLANLMEALRGSVANVVYGGAVPILCQKLLDIQFIDLAEQALSVSISPPILVDRYHWVYVDFYIDFGQNLD

SEQ ID NO: 34977 - protein, 167 aa, A.fumigatus
  UNSURE (126),(131),(165): Identity of amino acid sequences at the above locations are unknown.
KWCYVGYRRLSRAITAHKAIYPSDTFTLTWHAFYLNPASPGYPGVDKREYYASKFGEGRAAAIFSRLAAAEEPDGIAFKFGGRTGNTRDSHRVLWYAGLKEKEAGARGGAAATNGDASEEKVGGLXTKVAXQFFRAYFEEEKNITDRKMLVDSAAAAGLDRGEVXNF

SEQ ID NO: 34978 - protein, 167 aa, A.fumigatus
  UNSURE (15): Identity of amino acid sequences at the above locations are unknown.
NTVQLYKQGLGGRGXEGGGGRRRKKERKEGEEEGGRERKGEEEEKKRGGKRGEGERREEGGGRREGGREGGEGGEREKRRKGRERKERERRRRKKRGEREGERGGGKRKEKKEEEGRRKRRGGGGEERERKGREEREKKREEREGEREGRRREKKGRGRREERREEN

SEQ ID NO: 34979 - protein, 170 aa, A.fumigatus
  UNSURE (18): Identity of amino acid sequences at the above locations are unknown.
ANETQFSYTSKASEGGGXREGGGGGGRRRGRRGKRKEEGKGRGRRRRRRGGGREGKGRGERRGEGGGKEGEKEGRGERGRKEGRGERGRRERGGGERKEEREREREEEGRGRRKRRRRGGGREGEEGGKKERGKGEKRERRREKREREKEKGGEERRKGEEEGKKGEKKI

SEQ ID NO: 34980 - protein, 171 aa, A.fumigatus
  UNSURE (19): Identity of amino acid sequences at the above locations are unknown.
HEQMKHSSAIQARPRREGXRGRGGEEEEEGEEGGGRGRRKGKEGGGGGEEEGGEERGRGEERGGGREEGRRERRRGGGREGEKKEGEREEGEREEEEKEKRRERGRERRREEEGEKGGGGEEEEKGRRGGRKREERERREREEERRERGRKRREEKREERERKKGRKERRK

SEQ ID NO: 34981 - protein, 162 aa, A.fumigatus
  UNSURE (153): Identity of amino acid sequences at the above locations are unknown.
IFFSPFFPSSSPFLLSSPPFSFSLSLFSLLLSLFSPFPLSFFPPSSPSLPPPLLLLFLLPLPSSSLSLSLSSFLSPPPLSLLPLSPLPSFLPLSPLPSFSPSFPPPSPLLSPLPFPSLPPPLLLLLLPLPFPSSFLFPLLPLLLPPPPPPSLXPPPSEALLV

SEQ ID NO: 34982 - protein, 163 aa, A.fumigatus
  UNSURE (153): Identity of amino acid sequences at the above locations are unknown.
FSSLLSSLLPLPFFSLLLPSLSPSLSSLFFSLSSLPFLSLSSPPPPLLFLLPSSSFFSFLFPPPLSPSLSPLFFLLLLSLSFLSLPFLLFSLSPPSPPSLPPSLLPPPSSLLSPSPLFPPLFFSSSSPFLSLPPSSSPSFLSFFLLLPPPPSXPLPPRPCLYS

SEQ ID NO: 34983 - protein, 177 aa, A.fumigatus
  UNSURE (153): Identity of amino acid sequences at the above locations are unknown.
DFLLSFLPFFLSLSSLFSSLLFLPLSLLSSSLSLLSLSSLFLPPLLPFSSSSPPPPFSPSSSLLLSLPLSLLFSFSSSSLSPSSLSPSFFSPSLPPPLLLSLLPSSLPPPLSSPLPLSSPPSSSPPPPPSFPFLLPLPPPSSPSSSSSPPLPXPPSLRGLACIAELCFICSCHSKAF

SEQ ID NO: 34984 - protein, 651 aa, A.fumigatus
  UNSURE (404),(415): Identity of amino acid sequences at the above locations are unknown.
VIICFSFVSKNIFTVSTWFLRPDRFGENVLPTNNNAAYSNGISQVSTPSRVRATTLDIPGLTKSKVSPDGRIAQRDLGSKLVIVMVGLPARGKSYVTKKLARYLNWLQHDTEIFNVGERRRVAAGKSPSPAKAMGPRDKRASVHKDLVDSVRRLSVSVGTMNTQPSQTEISPPESATSPPEINSLPPPVVTAKILVNGQEEDPSMQQEGSTIITSIDAGPDNQQTVTEASPEPMDQSASFFDPQNERAVKLREQVALDTLDELLDYILVQGGSVGILDATNSTLERRKLIVDHIRQVAGPELGVLFLESSCVDPELLEANMRLKLSGPDYKGQDPVKSLEDFKKRVALYEKSYVPLGEYEEKHGMAYIRMIDVGRKIVSHQTHGFLSSQVVYYLLNFNLSPRQXWITRHGESRTXQLGRIEGDFEISENGRRYAKALTRFIDYQRHQWEQLQQQKNMLRHFPPRPGDSTPPNPSYIPRDRPRNFCVWSSMMRRSVQTVEGFNEDEYDVKQMKMLDELYAGEMEGMTYSEIREKYPEEYAIRKKNKLFYRYPGPGGEGYLDVINRLRAVIIEVERMTDHVLIVTHRSVARVLLAYFRGLKRDEVADLDVPLGMLYMLEPKPYGVDFKAYRYNPDTDWFDHIPDFELSQAPTY

SEQ ID NO: 34985 - protein, 250 aa, A.fumigatus
FTALLADWLRYSLVLLLTGAIIPIASSLLRFVPFPAAWRVWFRAVFIDPPFVGRRHSSPILDTFFMPTRGQALFIAYLLIINIVLCSIGFHSANPSIWFASKHDEILAYVANRIGVLSFANIPLLVLYTGRNNFLLWLTDWSHSTFLLLHRWLAFICTLQACLHSAIYLQIAVANNEHSTESKESFWIWGVVATLALAITIPSSAWPIRKRCYELFLAWHVVLSFLALLACYWHIWYRYGHQWGYETWIY

SEQ ID NO: 34986 - protein, 130 aa, A.fumigatus
  UNSURE (118): Identity of amino acid sequences at the above locations are unknown.
PERSRLHREQVIGGGIMTAYPFSAVCEHLDWFIVGVSVSMIPPVDPHESWKRTEAGLEASCALVEGKTSEGFKSARFNDLVLKYISDGDQVSVPPSKEEKHDECKDVHRDGVSALVVXRQIEASSTVKGS

SEQ ID NO: 34987 - protein, 234 aa, A.fumigatus
MEAKYTRLAETICQKANAHSKRRFLVAIAGIPGSGKTTTAVAVARLLNTQPSPKRTTLLSMDGFHLSRATLDLLPNREEAYIRRGAPWTFDAARFVQFIRRLRNWADSTPCASAETIYAPSFDHEAKDPVENGIAITDDTEIVIIEGNYLLLDEPEWREVAALVDYRVFVESDLQEARERVARRHVLAGIEKTLEDGFRRVDRNDYLNAITIQEKLITPDLVIHSVTEPTAGYS

SEQ ID NO: 34988 - protein, 103 aa, A.fumigatus
RDSHLYDCRSLVNMSFQNFDSFQNQHPSADAAAAAAPGAPATADTTMTGQTDPTTGSFQGPAPGEPSAAPVAQQGNEGKTTLWYAWPRSSRSCTYSEIRVLFC

SEQ ID NO: 34989 - protein, 70 aa, A.fumigatus
  UNSURE (29): Identity of amino acid sequences at the above locations are unknown.
CQDDPRQVFWVSLWESSCSFEGDPNVGSXSNAGYCFVDFSSPAAAAKALSLNGTPMPNTNRVFKLNWATG

SEQ ID NO: 34990 - protein, 64 aa, A.fumigatus
NANSSPRGTRFTLSRDELLTLPEFVLLSLFPNGLLPDGHMGSFQEGDIYPVDVRQVFPPFPLSK

SEQ ID NO: 34991 - protein, 117 aa, A.fumigatus
YDPTSLQYMLDFFRSVAQSIPSSSPSASTTPELEMSETVLGSPRDILQDRAGIIVLREDLDFYAIPPRPDIDHTEMMEVKRAVGKALLKQDGIFSGLKKSDEPGSTEQHLIEMLTAG

SEQ ID NO: 34992 - protein, 107 aa, A.fumigatus
LRTSNSIKSARILTKCSGFERDDRWGHRAPEPNKAVICSLALAKLRTDVRGDLSNNNAVGMAQKLLLFWRKPARRCWWEGVELESVEGVEGKVKVWIRRVWTLEMVS

SEQ ID NO: 34993 - protein, 85 aa, A.fumigatus
TVLQDPSVASSPIEKRVAFLQSKNLTQEEIDLALSRAGEDTSAAASAVASTQGYQRPTQNSVYRPPPPPPGYGYPPYGQWQAPPE

SEQ ID NO: 34994 - protein, 225 aa, A.fumigatus
SEVWVMGYTPSQRLVICAAVRLASLAMVVTNAFKRYIAPLIAPPTPPQLEQDKQSIDEQFSRAFALIEQLSTDTAALKSAEEARTERLDTALREVETLVADLKTASRRRDDETRRISDEVKSLKDAIPKALEGAREGNETRLKELGTELKSLKTLLGNRLSGSGASSTPVAGRTMSASTLPSVARSAEEASPAATSATTNGVTATPTTQESQLSPAQPGAGSTTG

SEQ ID NO: 34995 - protein, 218 aa, A.fumigatus
APVVEPAPGCAGESCDSCVVGVAVTPLVVADVAAGDASSADRATLGRVDALIVLPATGVLDAPLPLSLLPSKVFKLFNSVPSSFKRVSLPSRAPSRALGMASFNDFTSSLMRRVSSSRRREAVFRSATRVSTSRRAVSNRSVRASSADFNAAVSVDSCSIKAKARENCSSMLCLSCSNWGGVGGAINGAMYRLKAFVTTIAREAKRTAAQITNLCDGV

SEQ ID NO: 34996 - protein, 323 aa, A.fumigatus
MSVPFTCPPMYLNNAARVLTAAFRGATSFVDRIAEHWKSWPKKRQKHTSVVILTVFIFCLGLKLGSGLFYAHYWGRATISSFPVTPYVDYWEWETTSRFSNAHSANETQENSDGDDFCDSFPSYHLSHVQVVLKIGSTEPRSRVDTHLATVTRCITNPIIVSDHESEINGHHVHNILATLPGSFWGDSRDFQAYSALQRGELETVAGSQGWTLDKYKFLPMVERAYEMNPTAQWFVFIESDTYMVWDNMFRLLDQFDPSVPLYFGSPTPGKRPSFFAYGGAGFVLSTPAVQRLVTHKAGANGVYSQLSLSHRYKELVHQDCCG

SEQ ID NO: 34997 - protein, 149 aa, A.fumigatus
DRLNPGKKMYCNDSHGISVGSLGHHIGQVDIVENILVCNTSLKLRYVICHHVPRAGGRSWLVRLESKSGLEQLATPTSTGGSSGWDRNVTYEGMHNYHNDWAIKMTQFYVAPNQTACNEHPVWFASWTYRLGWSVLGFAYCRVYYVHEF

SEQ ID NO: 34998 - protein, 478 aa, A.fumigatus
TVRFYVDHPLSRRQDQRAIMVLSSLLMTIILIFLTLAVGGNGSRINRRQVVRRFNPVRTNLSSTTPIQVGNGNFAFGADITGLQTILPYNILSSWCWANDSLPTEPGQDDPSDFTGLDWWTHGRLVNYDMPNTAEAAISTWLRANPHRVNLGRIGLLYNGKNISLADLSNMSQTLDLYTGLLTSEFVLGGKQVVVQTAGSPSSDEVAVRIDSQLIQNGSLSVFFDYPLTTGAASFQAPFVGDWNAVSNHTTELFVNGHQKAVIQHTLGGTTYYNSISWLPKGNISGPINRTHRYDLNPSGKTTFSFTSAYTPENNAKVRAFYKVKAESATWWAKYWESGSFVDLTATRSSDAEELQRRIILSQYLLAVNCAGRDPPQEAGLQNNGWYGKFHLEMVFWHLGHWARWGKWELLDRSLGVYTRFLPSSLERAQKQGYRGARLGKMSDPSGRSAPGEINALLIWQQPHAMYFAELEYRAFPT

SEQ ID NO: 34999 - protein, 404 aa, A.fumigatus
VTDCGPRLFYHHHLTPPLSRKNVDDHRKMTSNYSISLVAGAIAVFVYTLSVLRRKWTQYRFARAHNCQAPPRLASKDPLFGLDTIYATIQNVKEHKFLERAQARFDAVGHTIQTRRLLQTIIFTRDPQNIKTILSLRFKDYALGHRYKTFGPLLGHGIFTTDGEHWAQSRAMIRPNFVREQVADLAIFEAQMADLLELIPNDGRTVDLQDLFFSYTIDSATEFLFGQSVQSLKKRRSGGRDAHAEDDFASAFNYAQHAIATRIRLGPLAAFYRDRKVERCNRVCHALVEQFVDKALEVRAQGGRVDEKTLEDGDGEKKPRYVFLHGLAQQTGDRRRIRDEVMNVLLAGRDTTASLLSNLFFMLAKHPRIWARLRDEVAPLNGRPPTYEQLRNLTYVKYCLNECT

SEQ ID NO: 35000 - protein, 142 aa, A.fumigatus
LPITPSLSSPGRSPSSFTRLASSAANGRSIALPVRTIAKHPPGSPPRTPYSGWTPSMPRSRTSRNTSSLSARRPVSMQSATPSKRAASCRQSSSPATPRTSRPFCHSGSRTTRWATGTRPSAPSSAMASSPPTASTGRNRAP

SEQ ID NO: 35001 - protein, 228 aa, A.fumigatus
RGSEGPPSESPENTTEDAKLPPVTTIQRGDLPKGKANGTKKSPASAPVDVSSTTSSSSDESSEYSESENEDDDETDAEAETQTGTDQPAQSKADLLRRSSVTPSSQSNARSPAPSQSASQSWGQPINGSRSRATLKTLLVDKKKESAEKAQLAKKKISAAPKRPRNIFSPPSDDDSDESESSSSSSSSSSESESDKDSDSENESHSSADHGDIMSSGTVGKLRAARKK

SEQ ID NO: 35002 - protein, 240 aa, A.fumigatus
ARAGPFRCSRPHHPNAPPPADNHLHPRPPEHQDHSVTPVQGLRAGPPVQDLRPPPRPWHLHHRRRALGAIARHDPPQLRPRAGGRPRHLRGADGRSAGVDPQRRPHRRPPGPLLQLHHRLGHRVPLRPERAEPEEAPLRRPRRARRGRLRQRIQLRAACDRHAHPAGPSGCFLPRPQGGAVQSRLPRAGGAVRRQGARGAGAGRARRREDPRRWGRREETAIRVPAWPGAADGRPPPDPR

SEQ ID NO: 35003 - protein, 179 aa, A.fumigatus
VYSRWLSSHSLDISAHLIADIRRYIRPFFLTPDGAKPLPTKRYYDILSWLVTQLTMSFVVMPFIFLSFSSSIQVWRSVYFYGIIGNIMSIIFFASPAKGYLVRSLSKRNKPHIPRTASMESLQQPTLGLPNDPAREFDDAVQEIKAEFEARRRRGSVVGVPTGEELKAAVEAKLGRKIS

SEQ ID NO: 35004 - protein, 427 aa, A.fumigatus
VGGSALPFIPAVKNLDNSGLNFVRIGPSSNPDSATRSNSLTSLNSMGTVIRHIGAAPWTHGSSEEQSSRSQSFRSTPPYHPSVRSNSNSTRPRGRSHSRSLTSSSRSGPPSVIQAIVDSGVFIQYPTILAPSSSGSWVDTSQSANASDRTVQEFTPDQSSDRFKSHLSTVTSRWSAELDSSFASGADEPSELSAAEPSRPSAALVRQRPGSSSLWLVSDSDRDEHLDHLSSLPARPTNPAVPSSLSSESRKSSLRSNSIKRPGTSSSFVYNILPAWAKMYYGLDGQTVNSALSVIDGTRPPTARPATSNSQALRHIPTASGRSRAPTNETIGSVRWMAPPDPRDPRNHWVKGSETDQLSDANNRLRHSWSPHLYPDKRAVGQEGKPWTAPSMDSRTEPLLGRRNMQVWSFSMGFVFPLGKFTCCREH

SEQ ID NO: 35005 - protein, 387 aa, A.fumigatus
LISVDDVYKKDLNPSNPLAHNGDIAKAYANLLRMLYDEAGQSSFAPRQFKHTIGRYGPAFSGYGQQDSQEFLLFLLDGLQEDLNRIQKKPYIEKPDSTDDMVHDKVALKEFASKCWDIYKARNDSVITDLFAGMYKSTLVCPVCEKVSIIFDPFNNLTLQLPIENLWSKEIFFFPLHRKPVIVDVEIDKNASIKALKELVAKKMGSDPQRLVMAEIYKCKFYKMFDNSASIADCQIGQGDDIAIFEVESVPTNYNPDKRQKSYFSYGRSDYEEIPSFDSPKADRMLVPIFNRHYRPKSNNSGNMQRSLFGAPLYVIISREEALSYDAILRKVLEAVATLTTRDILNEANIKNADEQGGTQEDSDTVVMNEDDAHSADSKIKTSSVEP

SEQ ID NO: 35006 - protein, 268 aa, A.fumigatus
PFSPVVRLANPAAGTTPQSLREKNMPPAKVLSSRHTNFQKWLKQVKGLANVDMSTKVRVWRILGGLGSATASAAITPAASRSASPAPTASLVANAGNNLVLDLNTFLSLSDGAQRELVDNVKDQTNNPNFNGRSTLDRVGLSTSDVVVLEERVGGEWASEVSKKTLDRLGVPSGSVKNGAPAKLKNKSPNNSGRSSPAPEPIRGRRKDGKPRGCTGLSNLGNTCYMNSALQCVRSVEELTYYFLSTDSHLSPLALGYYPLTNLGRRCV

SEQ ID NO: 35007 - protein, 106 aa, A.fumigatus
RNYADLSGPCVSTYPSRIYGWFAFCTANIVCEIPMAIVSSLIYWLLWYYPVGFPTDSSTAGYVFLMSMLFFLFMSNWGQWICAFAPSFTVISNVCPPVSFHHSLQR

SEQ ID NO: 35008 - protein, 182 aa, A.fumigatus
HPQQVLPFFFVMCNLFNGIVRPYRDYPVFWKYWMYYVNPVTWWLRGVISSIFPTGQIDGSPPKTTHFNPPPGQTCANYAGNSITNIAKNGYVLNPDASADCQYCPYSNGAEYMATLYVHDGDKWRCFGIFLAFVIINWLLVYFFIYTVRVRGWSFGMGYLFGGMGLVIDKVKGVFKRKSEKA

SEQ ID NO: 35009 - protein, 152 aa, A.fumigatus
ARIPAVSTVGLPSAPPTSCARSPWPSSRASSTGYYGTTPSASPRTPAPQATSSSCRCYSSSSCLTGANGSAPLRRRSPSSPTYVHPSPFTTRFNANTLNRSSLSSSSCATSSTVSSVPTATTRSSGNTGCTMSTRSPGGSAGSSPPSSPPGR

SEQ ID NO: 35010 - protein, 130 aa, A.fumigatus
DQYTSLLKVSTRTVPSSHKSKILPGDGGTTDFTLRTSKTFSARNPNDKDQLIHKNTAEEWKDRFRVYFPSQTTIEQSRGGPDCAGTICFQSKWYEGPKFPRHVLRDCKSRRPGLLMHNKVALPPSAEVIS

SEQ ID NO: 35011 - protein, 60 aa, A.fumigatus
SAFLIDLPRKVATTSVGSKTVFEEELVYFLRASTLQENIISRLDEFDFSPTSHIMLVHTM

SEQ ID NO: 35012 - protein, 63 aa, A.fumigatus
EGSRQGWETHFTALWNIASSKPKKDNTCSYRQDIQGISGPDPELDCLDCEHGAAERTEPAEAL

SEQ ID NO: 35013 - protein, 579 aa, A.fumigatus
TSHSFAMGVPKFFRWLSERYPTISMLIAENRIPEFDALYLDMNGIIHNCTHKDSDSPTFRMTEDKMFIAIFNYIEHLYGKIKPRKLFFMAVDGVAPRAKMNQQRARRFRTALDAEVAKEKAIAQGIEMPKEDPFDSNCITPGTEFMAKLTQQLKYFINKKISEDKDWQGVDIVLSGHEVPGEGEHKIMEYIRHAKAQPGYDPNIRHCLYGLDADLIMLGLLSHDPHFCLLREEVTFGRQVQKKPKELEHQNFYLLHLCMVREYLELEFQELEQEGVLDFPFDMERVIDDFILMAFFVGNDFLPNLPNLHINEGALSLMFKIYKDVLPKMGGYVNEGGVINLKRLGMLIEALSDVEFRFFEAEYSDARWINAKRNGVANGSEFQEKPKGLTLTPAQKELFKEIKKYVLNRPEKASDSKPLDLSPTLPARDRKFVEQLADDLRLPWTTVADEHGDRFIRLQLPVNEDDDSEEEEDEEASMAVQRVIRRYDNAKVQEISPEEAQKAAEKKYEEKFQDWKDKYYMSKFGWGLDNHEELRKLTENYVQGLQWVLYYYYRGIASWPWFFKYHYAPMISGTCWLLI

SEQ ID NO: 35014 - protein, 466 aa, A.fumigatus
LDVIKGLNADMNFKLGQPFKPYEQLMGVLPDRSKQIVPAAFRDLMTSPESPIIDFYPREFELDMNGKKMEWEAVVKIPFIDERRLLEALATREHLLTPEEKARNGFGVSLKFTYSPEVNFTYPSSFPGVFPDIPSCHCIENIFDLPTMDGLEPYIGLVEGVQLGAAALAGFPSLKTLPHVGQLGFHGVCVFQQESRNESMVITVLDPGSRSNIELAKQKLGKRVFVGYPFLQEALVIRVSDELFDYLLPEGENHVVSIPHTEAQIDQWKKKADKIEGIYSRRLGTIIGPVESMVHVQLLKGLIKTDEGATIKEFADIPGQETDYALQLVVDEVINPDERFIERDALPIEKEFPEGSRAFFLGDFNYGRPVHITGHEDGKVNGLIAAIKGREPEFGRDRAREAERLCPYMPSFAIARSLRLNPLVLAKITSSFSVDIEGQRVNLGLNLKFEAVFTTGLEGSDGGRSS

SEQ ID NO: 35015 - protein, 519 aa, A.fumigatus
  UNSURE (516): Identity of amino acid sequences at the above locations are unknown.
YDLLRQSNHSSHSIPLSTLPGPVLLCYFFGYGVLCTSELLRYQRQSPSIQERPRCDTSVPPHFSAIVHHGSPEEIFQAEKGSSANTADSDETRSPPTEAVNPLQRSLSLNPSRRLDADEQFKSIDKQFEELHDQMQTRPLSSRSHAPTSRASSRFTQRNPRHVDLLEALFSSHRYQVQIANALSPTTPFNEDIAERNMVRFLQGQPRTKNVYSRIISALYQEDVADRNIAKNRMNKRTISRSASSRSQPAAAAPGEVTQREIGSQSLTLANEGKITPACSRPGSSSSSQPRSLRAHKSAPTIMAECTNASGEQSVPNAGGYLDVPPAHKQGDQWSNTPLPDSPTLPVPMTQARKMGPSGGRGTPEVTRSSPSTCSNASSTSPRLNSKKNVRDLSINTELAARGKPKSRISHCAIQPPTPSNHDVKQNPSIAEVINSPLPLRTPTLMFPLPPSNQKAEVVGMFKQALNSSAVTISPHPTFETLQDAIVREINSHEAFRRVPVPAVQAGSLFTPVPSXGVF

SEQ ID NO: 35016 - protein, 186 aa, A.fumigatus
STTEPPIPPNRRFAANIIEFLEPSNQHIISLPLLLKMPLSKENRMQMAISAYKKGQFKSKAAAAKVFGVSRETLRDRLRGIKPRAETRANSHKLTALEEEALAKRLLDADRRGFSIRPQFLRGMAHILLCARTNDPTSVIGVNWAYKFIKRHPALRTRYNRRISYQRATQADRFHTRQLARIQRCR

SEQ ID NO: 35017 - protein, 63 aa, A.fumigatus
LLQCMYLSSCGLMNDPTLIHRSVALVEVPFQVDATLLRSGMTIAYPYRMENFGEMTLSCDLLE

SEQ ID NO: 35018 - protein, 91 aa, A.fumigatus
PKSSVGVIIYKVVGNRYIEKRINVRIEHVKHSRSREDFIKRVKENAAKKRQAKEQGIHLHLKRQPAMPREGHVVEGVAAETITPIPYDTHI

SEQ ID NO: 35019 - protein, 212 aa, A.fumigatus
  UNSURE (203): Identity of amino acid sequences at the above locations are unknown.
QESPTGTATNPIWLVKTRLQLDKSNAENGKGRQYKNSWDCIKQTMRHEGIRGLYKGLSASYLGVTESTLQWVMYEQMKMYLARREAAKRADPNHIYNVWDDVELWGGRICSRGHGETDCCGRHVPPRSCPNEAEASPHCICGGWQSSNEIHRSCAVLQDCVEGGGHGRIVWRSHTAFATCGSISRHHVRNVSIFVPACTDDQXPDIIGLGTR

SEQ ID NO: 35020 - protein, 109 aa, A.fumigatus
PEGKQPSVLIPITYTMSGTMLSCGVVESAPAGMAKLIAAAATYPHEVVRTRLRQAPTVSVGDGKVQMKYTGLVQCFKTVWKEEGMVGLYGGLTPHLLRVVPSAAIMFGM

SEQ ID NO: 35021 - protein, 153 aa, A.fumigatus
IHRIGGMTAATLTSPLDVLKTRLQSDFYQAQLKSLRAAHPLPPSNSLASLPRTAMMHFSETFQILRSIHVHEGWRALFKGLGPNLIGVVPARAINFYVYGNGKRILSDYFQYHDSKETPVGIHLTAAAIAGIAHGNGHQPNLAGEDTLTTRQV

SEQ ID NO: 35022 - protein, 241 aa, A.fumigatus
LSLPNRLSSTGYIVVTIDHPYDAGIVTFPDNTTILAANITTDDQIVDDLDVRVRDVSFVLDELHRPSVISKLIPGQTCGLDTSKVGIYGHSLGGATAAEAMLSDSRLKGGINLDGSFFGSVIHRGLDRPFMIMAHEGKNLTTDATWGALWPKLKGTRRRFMIKGSTHGTFTDLAQAADILGLREEFPTQAAVFLGSIEGGRALQVIATYTSRFFDFVLKGKKVELLEMSSKEFPEVIAGED

SEQ ID NO: 35023 - protein, 81 aa, A.fumigatus
LIHWVTTWSNQYALCSLECAVLLAKWLDKVTVPNPDLALTEQETKLLQFVMERLMETPHGTNREWFLGQQYRAQLACSPVF

SEQ ID NO: 35024 - protein, 69 aa, A.fumigatus
RLVRRLQVGERHKALQPHNDILSPRWKMVKAARTFQCQRCSRTFARLEHLQRHDRSRESHPRSPLLQIL

SEQ ID NO: 35025 - protein, 565 aa, A.fumigatus
VFRDLLTRHERLSHSSPSGNHDTENGDHPTPAPSAPDHVLDGLNILASAVADRTVTTPTRGPPRGPFQHPLSASQGTFSSGRPATADQTPLAGHPIQSAHSPGTAEATVFGETLSGYTTSNAYDGDDFTSFLDSIPLPSHPYSPTYQPLPVFPAWNFDSTSDYDNSVVRTGTADAAVTPSSSVLPRHGTQLPSLQPESPQTSHRARQPKGAIFVTTQCRDKIIAQLADYANVLPDPYIPSRHALSRCLTGYLSGYHDHYPFMHIPTLDIEHVSLQLFLSMAALGARYCREPDTSLSLYRIARTVTMEHIRRTYQFPGTGQFSEKFKLSTTESPESQDLLETVQALLLLHSVSSWFKRNPSHHESLFMRSFMETMLREGGLNELPEQDGSWKSWIRRECVKRTSLIAFCYLNILTIVFDITPLILTEGNQYGSSMQRKGMACSQCRCLDARTQSDIAGTKATRRALVAFHSSYHTKDKHGDLLLFGWIRADPCHSTGYLASSKGSSPASVEKQLLLDGGSLIPRTSVRTMVPMLGAQPGILDRSIQPSWAALFHLHRPPSSRIHPS

SEQ ID NO: 35026 - protein, 246 aa, A.fumigatus
KGPHSLPSAILISSPLSSISHRSSSPREISMDLPCSEKEWHAPNAVAWMQERSQTSPEPKLQDALSSLFTHPTTPKTNMETFSSLGGYVLIHAILQDIWLLQKARRLPLSRNSSFSTAEALSLEQALEQWCQCWERNQESSIDPFNPHGPLSFTSTALLRLAYIRLNADFTSARRLQTWDPSQIAQSLRQNLSVQRGDRLTRAALHCAHALSTPIKLGINYVAHTLGYHLVEPIRTVFVGMRGATG

SEQ ID NO: 35027 - protein, 81 aa, A.fumigatus
TLSILPSSDPLVAQCSTYLRVNDFGHFLQTYGFSLVSTEAVRGFGEEGIGDATHGTDRGAGDAPTEQTSENIAGIGKSGQP

SEQ ID NO: 35028 - protein, 80 aa, A.fumigatus
LPKRHLGSFQPRGKTKAAYGQGTMVALSRREMEIEEYYKLVATGLGCLEAVLKVWIASSPGYNNCFASLWSIQVNFGATL

SEQ ID NO: 35029 - protein, 62 aa, A.fumigatus
ELRYMTELIVELMASCYCNRTLSLFDCIGARSLLQMSKCFYHGRDGRNSFVALSVSHVGDLM

SEQ ID NO: 35030 - protein, 66 aa, A.fumigatus
SAVELRGYGRRVRKRIVTVVRQRHIANAQSMQHAQRADAVGDLMEAFDADQTRDAARTEAAPDTGR

SEQ ID NO: 35031 - protein, 110 aa, A.fumigatus
RRRTGPSETSSSYQYKALFAQHLSPRHLSYADGMGGDAKLLQAAADFFNRVFAAHSRVQPAHLVVGAGCSSLLENLLYDICEPGEGVLIETPFWGAYHRGFRWHRMHGLS

SEQ ID NO: 35032 - protein, 297 aa, A.fumigatus
CIRIGGFETSFVLRSNVTAVHVRPPCHGNGSADLDRLVSAYIEAYERALRQAPCRIKAILVCNPHNPCGHIYPPRVIQALLQFAQRHDLFYISDEIYALSTLDEQTAFTSVLSIDVAALGVDLARVFTLYSISKDLGSSGLRLVYCLISSDSQGLRRTDTVQGFGITQAHPDLRLSLAISNHSRVSTFTSLVITALLHDPEAATAILHQNRAALQRSAKLISDFLAFHQIPFVPPAAGVYVWARLGWRSSSRPGDEPSWDEEARLNDRFEAAGVSVGAGQGYCASESSTTGQKIRVR

SEQ ID NO: 35033 - protein, 143 aa, A.fumigatus
TWRAYSPCTVSAKTSAVADCDWYTVLSPPTLKASAELTLCRASASPKHIPTCVSPSPSRTIPASRHSPRWSSPLSCTTRKPPRQSCTRIEPLCSAAPSSSATFSPSTRFPLCRRPPEYTSGRGSDGDRRPGRVMSPAGTRRPV

SEQ ID NO: 35034 - protein, 77 aa, A.fumigatus
HARMSPSPIEEQATRLLKEVPLIDGHNDFPYMIRGWFRNDINGQDAHLYDMPIGQTDLQRLQKGLLGGQFWSAFVPW

SEQ ID NO: 35035 - protein, 206 aa, A.fumigatus
LTSRTRHTRPKHRHCGFLGHRSSTLILPCRWHTMILTDRSSQPDRYSLRAHARNVTDENLHLLHRNRGVVMICFLRELLASEADQATLAHVIDHIIYAGTRIGYEHVGIGSDFDGMLRGPDGLHDVSCYPALVAGLLERGVSEEDVKRVMGLNVIRVLEEVERVAADLQGAGEKCLCDELDEVWNEDIKEQLTRERKRVKKLGPQK

SEQ ID NO: 35036 - protein, 178 aa, A.fumigatus
YAHRADGSPASTEGTVGWPVLERICALVGVYPNIGTSIIVLSEFSPKNPDKEVGSLEALRQTLQQLDVIHRLIERHPTILQFADSAASIWSSFRAGRVASLIGIEGLHQIADSVSALRMLHRLGVRYVTLTHNCHNAFADAATVSPELHGGLSRKGERLIRELNRMGMYVSARRLGYG

SEQ ID NO: 35037 - protein, 84 aa, A.fumigatus
KYILASAVITRRVIDASILALLALLGLAVHHLGPSYDILALAETQYIYAINYYVADMNSPHHTTHGTKHIRISHSIPIMYGKHK

SEQ ID NO: 35038 - protein, 67 aa, A.fumigatus
SQRSRVCTFIIIAHVAYTNVPSLSHSNPQNEKPPSSPCPFPAVLILPSHAIMVSCDFPFFGRSKLVQ

SEQ ID NO: 35039 - protein, 109 aa, A.fumigatus
  UNSURE (52),(57),(64),(104): Identity of amino acid sequences at the above locations are unknown.
GRAGISRGFDEEVLTVCRMIGIGFSSNKASVERLSRWEQESWAYHGDDGKSXFGENXGQGRPSXPTFGANDTGGCGGKFGNRMRLFSPRMAAFLVYAGRPNIRXMVTEN

SEQ ID NO: 35040 - protein, 309 aa, A.fumigatus
  UNSURE (252),(287),(294): Identity of amino acid sequences at the above locations are unknown.
GPSDAPFVTKSTRLAVGFCSIQRNDDSMTDAPLPPSGGARRAPPLSTSYSGPSISSVPRRSSYASVLSGTALSPPSNSSPPSHPLISNSTTSYPPPYYPDGRLLRPSSSALDADMQLNSPWRTTPGDSLPPYSRKFANLPRYDTLFQNPGSFSDPSLFTPSYLRNSRYIARLEAARRTKLASQRDVPPSASTSNPLSASSSHASLPRIAPSHRGMTYDIIEREPPSDDDHLPPLPSRWSDNDKYSGIELTNXGLEIRYPGPANKHDHEAAAVRADHPMPPQCGIYYXEITILSXPKEGQVFRVDLTRRC

SEQ ID NO: 35041 - protein, 60 aa, A.fumigatus
YGPGLTFSLSNYSQAKAISLVIGTAALFGGLEALLILTLRVCLLDAPVKAASLEQILTIV

SEQ ID NO: 35042 - protein, 71 aa, A.fumigatus
WRGSFQPRGEDSTASNNKSKQETMLAKMFLRMRSWDVSIYSSLVKTGTVWAHLDRGPTIWQPEKSFHSGTS

SEQ ID NO: 35043 - protein, 93 aa, A.fumigatus
  UNSURE (54): Identity of amino acid sequences at the above locations are unknown.
KTLSVPGGQVVGVAGFIVTETRLYTSMADTEHVTVASNILGTIGTVLWCIQLIXQIWYNWRQKKTDGLPPSMMFLWASCTLHLKFCVLPELDG

SEQ ID NO: 35044 - protein, 81 aa, A.fumigatus
GDRVVLEVGIYASHIVWRFRYRKLRKEAKAAGVSIDEMLNMRGNETDWVNDAEKRPGDNESQIAVDQRQVSAEVVEQPELN

SEQ ID NO: 35045 - protein, 73 aa, A.fumigatus
TIRMLQRLKTSIVSILNGARNRNSSDIVFVFAGPETDGKEVLCPQPGTANKESNPARHSYPSPPGPSEPTIHK

SEQ ID NO: 35046 - protein, 292 aa, A.fumigatus
INRGSFQPRGEDSWWLGTYFAFVYIWSLGVIAGIQRSVTAATVSQWYFHRLASPKPTSRQIVQAAFVHSVTTLFGTVCFSKLIALSTRLPLLLLPTRLSRLLNLFVYSLVPSPLAALTDPLTLTYAAIHSQPLILSARGLLEMQSVSLATAVSSLHMRSTSWSHAGSAPLLSYRLSKLFLHAARFMMSLTLGFGGWVSAARNLEVPGPGNGVHGSMYAYVVGLIAGIIGWSILGAAEGVIADIVDASFICWSSEVGTRGGEARYCREAGWLFGEHLANDLRHTSHTHHQPEP

SEQ ID NO: 35047 - protein, 68 aa, A.fumigatus
SSATNARIKQRTASIAVTTASFSSAAVTASLLVCLSAACFNSLPKLQVSGIRPSKLDAQSSGTETQDY

SEQ ID NO: 35048 - protein, 73 aa, A.fumigatus
KKAWIGAADWIYDKTTDYHAMAAFLQTVTIVSFLFLLAFSDLSVSQFKPAGVRRVHFQFALCRDTTVLNSFQN

SEQ ID NO: 35049 - protein, 267 aa, A.fumigatus
RPKRSDRLPESLGTPTISRSPSVSDIYGSYPVAAAQPLPATGSSRYQPVSQYAPSASPEQLRGRSSMDSQRSASFGYPLGQRRGSQEPSTPVDTNMFHGMPMYGSPPVAGYQSTPPQSSYMPLAPVAEDSASGAQQESFSAHSQVSDNAPSHRSSTYAPEPFGHPFDTQAVSTTSQPDQGGYMPPTSSGAYEPPSFESNTESADGAQDESTEEDKPKKKSIMDEDDDEDLAARAAAIQKAERARRDREADEAFRKAAEADGKFQCSC

SEQ ID NO: 35050 - protein, 195 aa, A.fumigatus
LICVAKKPPPATGKKGWFSGWFGGKKDDNSGGGPIRAKLGEENSFYYDTELKKWVNKKDPGSAAPTRGTPPPPKGSAPPSRSMSGSGGPPPAMATPPPTGASGSRPSSSAGAPTSVSASPAPPSLGAPPPAIPRSVSTGAVLPTPPSSSAGAPPRPATSLSNASSIDDLLGAPQARKGPAARGKKKGRYVDVMAK

SEQ ID NO: 35051 - protein, 655 aa, A.fumigatus
  UNSURE (53): Identity of amino acid sequences at the above locations are unknown.
KIKGLSGVDVFGECASGNLPERQSPPKNPYAPSAYTNEFANRGAPVSTGPPIXGMTGVLNSSTEESPFVPPRRSQTQSPSQTLSPRLSVPSLDPFQRPASVHGSTSPTRTVNPYAPAPVPTHNRAPSQVLEFIPPTDGQQLDSLERWKGAPIFKFGFGGAVISCFPKHIPRYSAGQAAPMIKSCPGEVRISQLNDWLPAAEGIVQHPGPLKGKSKKKDLVAWLSSKIAAFENADIPDFDRLSPDASKLREEKTLLWKVIRVLVENDGVLEGSVEAQKSLRNLLFPNLQDSGPNQSLGDVFTPSATLQPLNAPSQPDAVDSRSVDLLRDTLVLGEREKAVWAAVDKRLWGHAMIIASRMDRSVWQQVVQEFVRREVRSATSRTESLAAFYEILAGNIEESIDELVPPSARAGLQMISKVDGHGPAKNSLDGLDSWRETVGLVLSNRSPDDQRALVALGRLLLSYNRTEAAHICFILSRVAVFGGLDDPQANIVLLGVDHQRLSSCAALYNDDSILLTEAYEFATSVLAGSSVSTLPHLLAFKLIHAWSLAERGRKSEAQQYCDAIAAALKATTKPSGYHNQHLFFGVDELSARLRETTSDGGSSWISRPSMEKVSGSMWAKFNSFVAGDDSDAASTGSVKAEEIGPFARVSGNSYN

SEQ ID NO: 35052 - protein, 81 aa, A.fumigatus
PSQFSSLPSSRATNDVYTQASTGKPHPWSRQTDITDSEPIQISEFRAWHRFSFTIFRNRGGECIYVMSVVTALKATEVNRI

SEQ ID NO: 35053 - protein, 96 aa, A.fumigatus
QCLKVSISARLIVCPADVEDTHTSHHTGFMDRMFHDRQDDNKQEQNEQHDQPPEVQPQQGTQPIPPVQEREGKSVEDYVDEERKLLQGGDTYSGLM

SEQ ID NO: 35054 - protein, 80 aa, A.fumigatus
QCHHPIEWIIIRLRQTRLSKQFQIIYISLKTDIAVTSTSRRPFVIATVYTSEIGFCRGWAKAIYNQCLSISGQFTRFHSL

SEQ ID NO: 35055 - protein, 218 aa, A.fumigatus
PTMIPSPPERLRQLSLLGSLSLTLPRRSGRPLLLRFLNLLQDCCFQRLRLGNTSPAPNDLPIGGNQELLEIPLDALQPHKSRHHLLHPCPHGRRIVAVDIQLAQHGKGDAVVDLAEGLDLVVRAGVLAAKLVAGEAKNGEVFGMLGLDGLVEVLEAFKLRSEAAFGGGVDDEDDFAFEGGEVEGFALLCRGIGQQDLVIVFHGVGRGSRKDKTYCRQA

SEQ ID NO: 35056 - protein, 84 aa, A.fumigatus
AFFFNNGLTGLGILTPDQSRLAVNSVTLGDYNRPVQIGKFIKDLFAGFQLLNLKNDILRKRSDGIKYSVSLLYCVVLDRVCSAN

SEQ ID NO: 35057 - protein, 120 aa, A.fumigatus
  UNSURE (1),(24): Identity of amino acid sequences at the above locations are unknown.
XSSFSVPVHVHTTNKIQIKRTISXPLPNNRLASFALQAIEVDAELSPFVRRSFALKSPVQSSTADEDEAVKTVLETTYRDTTNRMLRVAVNGFMESLGVVLGVMEELDVDVLNEEIEEEK

SEQ ID NO: 35058 - protein, 232 aa, A.fumigatus
TDFPALERLPFSSGQWPPRRHSTILSLPTVCFVFATPSPNPVKNNDKVLLTYPPTEKGEPFDLASLKGKVVLVVNTASKCGFTPQFKGLENLYQSIKAKHPEDFTILGFPCNQFGSQDPGSNDEIQSFCQVNYGVTFPVLGKLDVNGDNAAPVWTWMKEMMPGLMGLKRVKWNFEKFLISADGKVVGRWASITKPESLEATILKEIEKAKKEGTAASTRKGEGEATEQAKLS

SEQ ID NO: 35059 - protein, 202 aa, A.fumigatus
  UNSURE (178): Identity of amino acid sequences at the above locations are unknown.
LLLHSTCQLHFLIMGDDLEASKSSLDRKEFPSAEHVEGTTVGIVRAVDPHQLESLPYGPSGFKGIFSSKYVFGAAFLASMGGFSMGYDMGVISIINSMDKFHAAYPRAESAFGKGFMTGMLLLGAFVGCIFMPYLADRISRKWALTAMVIVFNFGAILQTGATNYDMLVAGRFIRRIXVGTLAMVYFLLNRQCFHHKLMGQF

SEQ ID NO: 35060 - protein, 323 aa, A.fumigatus
GAPLYISEVSPPHMRGTLLVLESISITLGVVVAFYITYGTRHMATEACFRLPFGLQMVTATILGAGIHFFPYSPRWLALVNRQDDCMSSLCKLRGLTSSDERVQLEYQQIIAEINFQRAVLAKKHPGASGTKLEVLSWMDLFTRKLWKRTAVGVGVAFFQQFSGINAFIYYAPTLFESLGQTAETSLILSGVFNVLQLIAAIVCFLVIEKVGRRPLAIFGGFGTAVAYIIIAVLSGLYSTSWASHSAAGWGCVAMAFIFILIYGVTYSPLGWALSLGGFSRLRRGLKVSLSPRAPSGCQISLLALSHRPCWPISVTERTSSLP

SEQ ID NO: 35061 - protein, 70 aa, A.fumigatus
DVSHSIKKVYNIIYGSICPQRSKRALSMHNFLFSLSRFPFLALCSDSVSGITFTIAFVIPTLTKSFCFWI

SEQ ID NO: 35062 - protein, 208 aa, A.fumigatus
RVYLLRANAVRIARPNSGDVTHSLRCLQRSPTYRSHCLFPRHRESRPTPPRYLRRLWYCSGVYHHRGPFGSLLNLLGFALGRWLGLRRHGFHLYPYLRSHLFPAGLGPFPRRVFSTTSRSKGVALATCTIWLSDFIVGVVTPSMLADIGYRTYIFFAVMCSLAGIWAFFLVPETGGKSLEEIDELFGDSSAREEWELAQEAIMTGSTK

SEQ ID NO: 35063 - protein, 78 aa, A.fumigatus
LTSVGILYGKPSVIRWSWFSEEISLQSFTTQPKKGVSACLQNQPSYHDSLVHRFHYGISLELPREISVVPGKFTNVIL

SEQ ID NO: 35064 - protein, 75 aa, A.fumigatus
VIPLPPAEFSRFHWRYWSHGETKNTEDTMHRTMSTLEIKLVEPGDISANTELWYITHLAESEDVSRYTRSPAVVE

SEQ ID NO: 35065 - protein, 703 aa, A.fumigatus
PPALPIATPSSPRSRSSRMLGACPMSYERQCRELWECWMSCMPPYERPCRQNLLQKINLSFNLSRKALRWFKVSCHETSFPTKPLMQTESQTVQYGRLRPHITSSMPTISICKFPKHPNGERESDPFSGLVQSPIESLPNIFHRRHQPHTSGGGAIPLTEAKHRPQKAKAQRRSARKELSPAGVRTVKNPVHESEQIVHANSSHHFDKVMADMVEVRPPLAVRRSASHLLLEGINLNMRSPSLRVTKIRDLLRLVINESLHVGGRPDFSLSEATELGERIEVRTRSSNGEIFCKTIVWSVDEALPETLLVDDKDLAKLISCVFLNAVKFTNSGMITVSAKVGSNIGEVFITVRDTGPGIPEAFLPKLFQPFARGDASITRSKDGLGLGLLVAKGLARKMGGDLICVRSSTSGPDHGSEFEISIPVTQSKSSNKPVACMTSSLTPDGSGSSRLGTTSTSSNSRLEQSMLSPLIRRPSPPIQQPSPSLTEEISSQTSTPVRSVSTAKFIRPSINGDAYDEKLGQKHPLTFLVAEDNMINRRVLVNMLKRLGYQDIYEACNGKEAVRIMQDVLAAQKPKASSRLSDCDQLGDCGCKRMKPVDVVLMDLWMPEMDGYEATSKILRLVDDYQRRTLHAQPRSQSNNLLLPLPTVLAVSADVTDEALGRASKVGIKGYMTKPYKLSDLERLIVEFCGEATSPTLDRMNI

SEQ ID NO: 35066 - protein, 73 aa, A.fumigatus
LALLTQTLGTETLCLRGGWRMTRRDFSYFQSYFHDPPMTICKKTTPRTNQSALSRTGQIHLSSQSAGLDTREG

SEQ ID NO: 35067 - protein, 410 aa, A.fumigatus
PTLQMSKDVTFSPVSTIIPRSPPNDPTNPYIRRRRRQTDSAVVLKRTTHGPQRDQHPILARRSIANPDWAADSIPSSFSPTISSVSSRLSLTGSSAGPTKTEDSQKRRQTARHDLDDRQHNQDSGYKSHRDDQSIARTKVFSRQTIMFAAASRDTGRAATLISAGPSASPSVPGTTTTTPANSTSSSASHPYPSSASPPRLPQSRFSFEYQPPRHKQALPTSASFPSEIPSDTDPTPNPQRAFLYDRSRRSVSTFSTSRVRKSTALASPSQLPSPLSISEKSSDLPLPFDANSIDNALSFNASKRRRKQSLSQSQQESQADVKRRMPVSTATYVQGSPQASDRDRAIHDLDQTDQEDGARTPVAEDSKSKNEDIFLNIARSDSKRRDSLGRSEHRRVSDNLCSTTIMTLL

SEQ ID NO: 35068 - protein, 100 aa, A.fumigatus
  UNSURE (98),(99): Identity of amino acid sequences at the above locations are unknown.
SRLGLSNGHLRSPNSRLNEQTSSPGQLRLSTYDTPLHSLNNSPSNPYSALPYSYSASAHPLDDHPRSRHSVVGSSSRSTLGISVFTTGMEESTLNAQXXR

SEQ ID NO: 35069 - protein, 208 aa, A.fumigatus
RPASTPPIPARNHSPAILILTFFPSLDEAFFFFFFGASTSTPNRSSQYAPTRLGSTPSTTGRIPASAPSPACPSACKTAYNIPSNTPTRSVHSCTALPPPERNRCLSMSTWLGRYACSKRVTSAYAVRAYSDGENVCFSFSFLFTFAFPVSFDAFDARPPWIFPRESGARSSNASETASRRHAFSFTTVPAVAVWLSRGTRRCAYARF

SEQ ID NO: 35070 - protein, 142 aa, A.fumigatus
CPHTVRKPIEGLESKMEALSPRSTNHLIRPKISMERKVLDKNAAAAAAAQKAASSKIHAPPPPSLVIEPAEGGERYSTGAFLGKGGFAICYEGTLLRNGRVFAMKVVRSEMGQKKMQEKVCLESHLPTLACFYQPGSNQNTL

SEQ ID NO: 35071 - protein, 148 aa, A.fumigatus
FRTELQIHSKMRHPHIVEFHRAFAFDKCIYVVLELCPNGSVMDMVRKRKCLSLPEVRRFMIQLCGAVKYLHKRSVAHRDLKMGNLFLDRNMDIKVGDFGLAAMIISEKDEKRRKTLCGTPNYIAPEVLDKSKGGHTQKVDIWSLGIIW

SEQ ID NO: 35072 - protein, 539 aa, A.fumigatus
SHDTQRAPTNKYFRSFAMLTGYPPFQSKTQEEIYKKVRNLSYVWPSGTQCANHIPDEAKSLVSSCLNLSENERPDPDDIVEHPFFNMYDGCIPRRLDPTCTVSTPIWLRSDEPRGDRMMLGHSLEYDEKLAGYIEQVDDPTQRYLICRTAFYSLCGVGRKPDGTVRKCVGKNCSKSAFAECVSEEEKGMQPVMPLPEDMVYRYPSDPDGDWSTPSPGLALSKDDSSLDGIRSSGKRTVSMRSNSTSLSRTQAALAAAQQRRKEPQSHAATLRQQAMGARSSVRKIAAICDPPAVVEPDSAAPVMPTGGLAERPIRARRGVAVSYSGSTRDLDRRIVPSTSDPGMLTVGKTRSQSRRLGAESNEARSAPAVIKERSVSSALDNLPTKLRQSSARSVAREEALQSSKRHELEAEEEVKAREVPSGDGRLRTEAAVSRSSNKTASTSSSKRSTLGLYPLLHPDDHCEMMPRTSLEDVNTDLRLMLSNLVPPVSGRRRVSSRRTPHAYVIKWVDYTIRYGIGYVLDDGSVGSSRRAGSKRAAG

SEQ ID NO: 35073 - protein, 61 aa, A.fumigatus
KCLWLSVIINCSSSLDVYSIQPLKCIESCQDVSDLEALFSRDSHSIKADRSMLQPLNPSIS

SEQ ID NO: 35074 - protein, 192 aa, A.fumigatus
AAGTDDNDKPTPRAIRERLVKMRQIVKASGSGGFTIGGSDTSTPKKAKKTATPVETPGSKRKRSGKAGTSADDNENITPLKNEENATSLVKMEAAEDEIDTPTKKKPLHPTLSGNQVQVQSGFVKTEESDEAVFGILTTPTKRSRKASVLPAGMVNYEDDEQGEDDPESSASEFLPDEAGVKMEDMDTMNYA

SEQ ID NO: 35075 - protein, 75 aa, A.fumigatus
PRFRFRSLLATAHSYSNTDKQPSSFRLVSPLLLTTPSFSYSTYPTSSTSPPTKPYVDLATTTLYNQHILLNLQKI

SEQ ID NO: 35076 - protein, 64 aa, A.fumigatus
RLRTDPRAGSATNGDSSTLPTPEKRKRGCAKKDANGDGAEKDKASPKKAKKAKKEENGSAVDSA

SEQ ID NO: 35077 - protein, 406 aa, A.fumigatus
  UNSURE (31),(41),(49): Identity of amino acid sequences at the above locations are unknown.
SQGTIQGSPLTSGTSSSPIQSLIALAFTIIXLAQPRPDHEXMGDEDSMXSCSERQAYQDVPISNGVSLSGVLPVRRSPGGHAGDMIGSSRHPSARSVQQAQIPQSKNFEIVLVTDNESRRQVRRHAMRQYMRQRRLDSIARLETPRLPIGGWVNRQVLSEASSSSIPPSPVEIPVKDTSPEEEKSSLVKDGEPCTPVSWTGPLMPLASKSSKVKTEEPSSPSFPNVSYTLSDPRSSPGHGAVEDPFSCYPIPVSHSDHELIQHCKFFLGSPYSHTDHADLDTSARGASARTILISLSGGLHCKVIVTYPSMMNKFADSVANNPMMEIFRQLALHDNLSFQAMLAIASKHRAGVEGKADSVQSLTHKMRALRLINERIHTDSQGLQDGTIYAVATMAVIEVITFPMH

SEQ ID NO: 35078 - protein, 223 aa, A.fumigatus
IVPRDPSSPVVKTNRALEYGDVIKLVGVARNLDDNTALRKFKNWAEEAHDVPLIAINMGGNGQLSRILNGFMTPVSHPALPFRAAPGQLSATDIRKGLSLMGEIKKKRFALFGSPISESRSPALHNTLFAEMGLPHEYTRLETANVEDVKDFIRAPDFGGASVTIPLKLDIMPLLDEITAEAEIIGAVNTVVPVSDGEGKPQRLVGHNTEWQGMFQSIRKRAP

SEQ ID NO: 35079 - protein, 224 aa, A.fumigatus
  UNSURE (45),(46),(48): Identity of amino acid sequences at the above locations are unknown.
GQAAAAGRSQHGMAGHVPIHSKAGPLGTDVSASAFVFVGGGTSRXXIXALHQMGFSPINIVGRNPAKLESMVSTFPTSYNIQIVEGNEKLEHVPHVAIGTIPADRPIDPGMREILCHMFERAQEADADASRTIEGSPRVLLEMAYKPRVTALMQLAVDAGWTTIPGLEALIGQGVHQVGLIDLLQMDITDGVQFQHWTGIRPLYERARVCCDILLSGRTMLTCS

SEQ ID NO: 35080 - protein, 157 aa, A.fumigatus
PTSRCGLPSPSETGTTVFTAPMISASAVISSSRGMISSFRGIVTEAPPKSGARMKSLTSSTLAVSNRVYSWGSPISAKRVLCSAGERDSEIGLPKRAKRFFLISPISDRPLRISVADSWPGAALNGRAGCDTGVMNPFKMRLSCPLPPMLIAISGTS

SEQ ID NO: 35081 - protein, 233 aa, A.fumigatus
PSSPFTRKRKRITNSLSPSREDPRTASRPAAALSAEKSYSGRSEYLSGSVPFDETLVQSGHDALDTDNHEDMQLFQHQRVFDLPPKPVQRHLIDCFMRYCAPWTPIIDPQWLTAETPSPLLLQAVLLAGSRVSAPSADVSSKDFYRKAKLLYFFGSGNNSLISIVSACLLHWYNPVGPEKVSTDTSGFWIRTAGAMAFQIGLHKEPAAHAKDRGLRRRLWWALVVWTDPIRRH

SEQ ID NO: 35082 - protein, 133 aa, A.fumigatus
QLRQSKGRVPVSLSIVRSSSTDPAARSPANGRESPTACPPPGRTRAPHPGPPLPSPLRRATAAAASISAAVSPLTRPWSSPATMPSTPTITRTCSCSSTSEYLISRRSPSSGTSSTASCGTVRHGRRSSTHSG

SEQ ID NO: 35083 - protein, 303 aa, A.fumigatus
  UNSURE (249): Identity of amino acid sequences at the above locations are unknown.
LYTLSSDPSAAVAEDMHPGTFSILFRNDHFSTVYKHPQRHQLFTLVTDAGYSNHAEIVWECLVDVNGFNAEFFSGDFRPIGHAPPGTVPSGPRNSNNQTNVPPSTSEDRTSELSPQEQADADYAYALSLQYQEEERRERESNNRSRNQRASAPNHPPGAFWGSGSAHQRSASVANGSGSGPTSDGRSSRHGHDPGASNNAEDLPPPSYEQAATSPAHPPRDSHYNTLPQQTRYQRHSLGRRIRPRYCRXRLRRSGQGSKQRLCGHVVPTVYYLTSNPRAHSRASHVWCIPRTLSIFGNASCCF

SEQ ID NO: 35084 - protein, 60 aa, A.fumigatus
HLVTWAYHFTGDSPDWTVDPAWLQRVSDVLDMITSRGLYAIVNVHHGKICFSEIVPVIKD

SEQ ID NO: 35085 - protein, 112 aa, A.fumigatus
EFCQFMQNQAMKGLRVAALVALFRSAWAQAGNCPGTFTSISAADFVSRVHPGWNLGNTLDAVPNEGSWNNAPVQASTFDTVKSAGFNSVRLPGEFHSVLHASTTAKPVADNI

SEQ ID NO: 35086 - protein, 135 aa, A.fumigatus
  UNSURE (135): Identity of amino acid sequences at the above locations are unknown.
EIDSWIWADVTQSGANLTMIEEKFYRLWYQIGTKLGCKSNMVAFESINEPPVNNAQDAAELNKLNEIFLQAINKAGGFNSKRVVNLVGGGQDSIKTSQWFKAPTGFSNPYAIQFHYYSPCNLHHEAPGPRSGYAX

SEQ ID NO: 35087 - protein, 67 aa, A.fumigatus
TRELKNSESVIYHSVNVQTCQSRGIYIKYIASYRIVVKSSMKRCRKLIGFVVCTIRGLPCYVPSDYL

SEQ ID NO: 35088 - protein, 733 aa, A.fumigatus
PGLSPTASRVARAVDEKVLKTSIDLTAPEGVTAPLIVKLAQSGGLADIEMLIESGHGVDARHLSTRRTALLVAAHCGNEAVVNLLIQKNARLDAVDAWGSTALHLAASRGHCDVIQLLLLEPLDREARDAQGRTALWLAAGRGQLEATRLLVAHHAKVNVRAENHTTPLHAAAKRGDEEMVELLISCGADLEARDGAMMTALHYACEEGHLGVMKLLLDNRANINVPGSDRRTPLICSAAMGRCPVAQELLKRKASAHCVDDASMTAVHWAAFNGHIEIVDLLSQKKGVLTATNKLGRTALHLAAMNSRFAVIELLVRKGVPVDARCHDGLTPLHYACLANSLEIARLLLISSANIEAQTEINKQRPIHIAAARGSMNILNLLCDKGASLEARDAKGDRALGVASRHGHAAAVQNLLERGCPLYLAYETRPQEDSPLCLAAMGGHLPVVSLLLQHGASVVRRDESGWQPHHYAAYYGHPDVLALLLHHGPASANDGTRFGLDAAGIGFAPHAIISEERKAQVRQLLNQDSGQFVAQTQIPAFQPPQAIGETLHNRTIAPQLPLTTRSLEPCAEPSAMAPQELPVTLEQGLPPSRSVTPEHMRGGRRTSIGLRSSSSQSRQFEAAVQSSSSGTAPRQPEPSLSHTGSTSEPWFDYSLPYWRGSPVSTVHETGTEVEVLAPQPGRGTVSKLPLLSTFNPVDPVCEPTGIMNSDSESSSSVYTAREKSVVMNRVCM

SEQ ID NO: 35089 - protein, 268 aa, A.fumigatus
  UNSURE (244),(250),(255): Identity of amino acid sequences at the above locations are unknown.
QAIFSILDHSLRRNADQERVIGTLLGTRSEDGTEVEIRSTFAVGHTETTDQVEVDMEYQKQMLALHLKANPKEVLVGWYATSSELNTFSALIQNFYSGQGDGTWPHPAVHLTVSTEPGKDIETRAYISAPVGVTAERAADSAAFIPVPYEIRYGEAEKSGLEAIASAKDAESRATNIFTDIEALERAIEEVLGMIDRVSRYVESVIDEEAPASTALGQFLLNALALAPKVEPADIERDLYVFSXGLLLFXLVCFXPRGRKDPRYAYRE

SEQ ID NO: 35090 - protein, 65 aa, A.fumigatus
AGGRIRKEKDYRAIPTTGEEAFKTVREPGFGIFFTSSTWLKPILSFTLLALWAQWQWGLHQPPPL

SEQ ID NO: 35091 - protein, 193 aa, A.fumigatus
LKKKLCGPATERIPEISGDAQHIAPYIFNYQDVLYGARTTSNSSAMRDILAVHAVNHILKTRDRVLKNNSRIAKEQDADLDLRDQGFTRPKVLYLLPTRQACVRAVESITRFFQPEQQENKKRFLDSFSAADDKSWENKPEDFRELFGGNDDDMFRLGLKFTRKTMKYFSQFYNSDIILASPLGLRTIMDQAE

SEQ ID NO: 35092 - protein, 162 aa, A.fumigatus
ITRNSSIRPEDHSDNESHLNHEPAGDEMDHETQMDDVLSDSDDDEDQQTARPYNELIQLLQVNTEPKGPTRKRRKVEYNGGEKRDFVPAANGEEVDAALQGDDDLQEQEPSDEEEEDHPEEADGNHGSDDEEDGTVRTDPPLFIFISNAVQQTTLLRLISRP

SEQ ID NO: 35093 - protein, 230 aa, A.fumigatus
LPSSVKKRDHDFLSSVELVIVDHADALLMQNWDHVGYILDRLNLQPKEAHGCDFSRVRTWYLDNHARFVRQMIVSASFITPEINSLFSTHMQNFAGKVKVTPVYVGAISEVPLPVSVKQTFSRFDSLTPTKDPDARFKHFTTTVLSSLVRNITSSRDKSSAGGTLIFIPSYLDFVRVRNYFATSSQTTNVSFGAISEYSEVREMTRARTHFMNGRHAVRLTRPGLERNAL

SEQ ID NO: 35094 - protein, 192 aa, A.fumigatus
KRLIYIKRCSRQIKLENLRPLVQLTFIITCRNRRNSMAAINPIPPSARPRIRELLPNLYLGRHRPGTKNSLTDVPGVLVHTESIKRPFTATSHAVNTGVTTILPRRDWFDSGCYAGYFRFNGSGEMTGSHWLDETGLLNSPIILTNSFSVGACYTGVYEYAVREYKDPATGLVDWFLLPVVAETCDLFVFTD

SEQ ID NO: 35095 - protein, 568 aa, A.fumigatus
QQALPRCVNPEGIFWTALWYVPTSAPSFLVCAHCYEKHIQPTPHAGLFEAVWVDEGDTALLCQWNTPRVMAHLAAGDWDAIKAFMIERVNLPNCKGPAGHTGLDGSRWYRMIGAWEIQGFVICETCYQELVAWNQLKSYFATTPTIKSDEHLWTCDAAVVPLIKEGLRRAIASPHRWDELHRLFRRRMEYPSCLETKNLLAGSTYWYACKAVPDLVVCTACYLDHFVLDYASSWELHPLTPEQQQQRFECGMQTLQIYAALGVCKQIGIAANTDEYDGFETLARMILESPPCNAEDMRNATWYAPKDCTVDVYAICRRCLLGFMAPPGFAREFKEVESRRGGNWLCDLHPTTPRFRKYLAKYAAAVKLEDFSIFSKYVVEWTPYPECPRNEACTNRKWYGEGRFTACELCYKEAMEGASLASRLDCALVPNEARCQMYSRRMRNLWRQACENNDLDSFLALANERMDAFLLMNMEKERQLAEMSIRMSQRNTLLLASSMNTGIDGIVSAARGDNGTRWGNSSIGYIWQTSAGAEGRLQFDQAMGMNVVPASSDLARMAPVMQRWAELE

SEQ ID NO: 35096 - protein, 84 aa, A.fumigatus
TITKYSIRYISTTESIKPPSNPGQIHTNLTNALNTFGPSSQQYQNILKILKECLQNIDNDKKERPAAIDPDTLSLAMKFLELGR

SEQ ID NO: 35097 - protein, 247 aa, A.fumigatus
IHYSLADPSQSSLPKRGEKDFEPNPTEFQADVLAASRRAMHNALSYPRLHHPKHRIVGVYAPDGPAAPSIAPVTEGETQNTELKSGKARGTKLGVHQDACVYVANPKGQFFKTMGQGDRWNRVWLLPEEALYMLERGSLEIRWPVSATGCGDAGNAGDSGIPMSLQAAYACFIGRGGLTIDRFTVYTGLKRLGYTLTRAPAWYDDTEESSVGSETQEPVRVGAGLVGVYEQFMKWSHHGAGRIRGGA

SEQ ID NO: 35098 - protein, 80 aa, A.fumigatus
IPFPLTGAAGGNSASKKNWLSLPTSWWRPTWPWARGPSLLVLRTCLSLPPRPGRISAGPSPTQWCLRTVCLARGRKSIPI

SEQ ID NO: 35099 - protein, 563 aa, A.fumigatus
TKMQYHGHCLVDSAATGKLLYANVGLSFWAGVDSQTGEIIDRHHPLHGQSVNGRILAIPCSRGSCTGSIVLIELLLNQCAPAGLIFQQPEQIITLGVVVAKTLLGLSIPVLVLKPAEFHSLKDYRYAAITGPTLQTGEDPLPPPTYEAPSCAPSGTIDLSETDEAILHGARGAAAQKAMEILLSFAQIQGATRFIDISRAHIDACIYTGPASLRIPQTFLSLGARVAIPTTLNSISIDRRRWRELGVKEELAVPADQLVETYLAMGARPVFTCAPYLLESAPAAGQDIGWSESNAVVFANSVLGARTQKYPDLIDVCIALTGRAPLAGGHADEGRTPSVVVEVADFPKMDDAVWPLLGYHIGQLAGGDIPLVVGLEQTKPRMADLKAFGAAFATTASASMFHVRGVTPEATKFEGVRHTAKRMAVHKSDLVRTWEDLNTAQDSSVGLVSLGNPHFSLEEFESLSRLCADRKKDPSVQMMITTGRETYELAASKGYIQTLEAFGATIITDTCWCMIRQPVIPPQTIHLINHSPQYAPYAPRNGAPRNCLWGPWAPCFGGPLPRG

SEQ ID NO: 35100 - protein, 94 aa, A.fumigatus
RSLRWVIKMNCPSRTDDTLLHCDWNQNPPFLAPDLTTRQDFNGITNARVYRSGPGLDAVSSTSWEDSQAMPEQRDTPIGSKSDLRGASLSSPRG

SEQ ID NO: 35101 - protein, 230 aa, A.fumigatus
RVLSRVQVFPRPHKVGFVHGHPLRCVPDSLELGRFRSHPSHMEHRRGRRCRKSRPERFEVSHTRLRLLQPNHQRYIPPRQLTNVVSQQRPHCVVHLREIRDFDHHRWRPSFIRMPTRQGSPPRQRNTHVDQIGILLRPRAKHTVRKHHCVGLGPADILPGRGGRLKQVRSTSKDGPRAHGQVGLHQLVGRDSQFFFDAEFPPAAPVNGNGIQRGWDGDAGAERQKGLRDP

SEQ ID NO: 35102 - protein, 150 aa, A.fumigatus
  UNSURE (141),(148),(150): Identity of amino acid sequences at the above locations are unknown.
QYDPSLCNAVHVSPSPVPLVEHQLPTHLSRRTASGHIAGYGPASPLAQAPGPQDSPGHWSCMLRRGPCCRSVRRSRRKPTTTTGRWPCRCGQKPPSRSPAATIGLPWTRPGRAESRRSRCGRCRRLCILATWCWTGWPWCXSSTWWGXSX

SEQ ID NO: 35103 - protein, 135 aa, A.fumigatus
GAQPSSWPPGIGSTMFPTPPVRSTSPQSCSGQRCRSDSPGIGRPARARTERRRTGSPATCGQSRRPGRFACAKGPPIAACPAWLCATCAPSRRSARKRWPRRRAARRSTMPAARKARCPTSSNLKQPLVRRSGPV

SEQ ID NO: 35104 - protein, 179 aa, A.fumigatus
CSTNGTGLGLTCTALHSDGSYCYIGQSNLYYDNGECDWTCALAYFWVCHEYPYDNYQFGIHLPGMEGQRTELIPSSVLLDDSQNSTYGWATVEQCGWTTNDSLPLYNPGMSKRVVEEQSTTNTLAASTATSTATSTATSTATTPAASSAVTADSGTGSIRMHLDTGMAVWILAFGIVVL

SEQ ID NO: 35105 - protein, 249 aa, A.fumigatus
RSFLGGPPTRNQDRRWNMGTHLITTRGPTDEPGVVSNWRKWGTGPYGLQAWSNGGQLADVATSFLQNDVTVRKSHTAKLGTLRWEVPSRTRIFQVGDFDRKSLGFRYGGAPYEHALVAQCPANLTYTVGQSTTADWCFGQAALGTWSIRFQAAKSSAALLTVSLAGYSSGTTSTILLNGDAASPIGNLTTLPNDPCLYRSATTAGEWRLFQFEIPQGKLQPGWNSIDFAVGKASRWHGFMWDSIILEYL

SEQ ID NO: 35106 - protein, 189 aa, A.fumigatus
  UNSURE (45),(51),(66),(67),(74): Identity of amino acid sequences at the above locations are unknown.
ARHKYAQCPWFRPRPGVVGTGAGFCGHCPSVQPSHSFSFPLFFLXMPSFFXFLLAIGVVPVWSFSXXTPTKYWXYTTASLSSTTSPECKAAYSAHIDCDDFLLALAVSKEDRWWLQDFDSAVFDRTCTATCQSSLSAYVANVEQTCNKARDAACKTNGPENLGDPVLVPVVTLGHILQYVLMRSCAKDE

SEQ ID NO: 35107 - protein, 142 aa, A.fumigatus
LDGAQSDLNWTSAEIYRRGKTNGQDFLDIQFTAKEGDFHWVIFEDLVGAYQYFVNHALPTLGEFRTLWRLDNTSFPNGRTNIKDGALPTLAEIASGTKVQDETWQLADGSYITKYDWTAWIRDQDYYGVYGEFSQRGEIHLG

SEQ ID NO: 35108 - protein, 186 aa, A.fumigatus
  UNSURE (154),(181): Identity of amino acid sequences at the above locations are unknown.
PSYITMESPTYEAPSNSNGPPDKKGGIHSTIDVDHDYGADTDLHRSLSTRHLTMIALGSSIGMGLWLGSGTSLVNGGPAAIFIGYLLSGTMIWAVSHSIGEMAVVYPLPSAFVQWSSIFISEPAGFTLGWSYWFQFFITLANELQVRRPLFCDXVRSDWYKVWSPCSIFGPNNCPTAAWIXIFWVL

SEQ ID NO: 35109 - protein, 75 aa, A.fumigatus
ESSWRISQRYIPSSHRALFQDERLIEDSLDKRYDGIPCSPVTCMHAEWQTGEGYLSSLDDNQHASNGQTKGLIAS

SEQ ID NO: 35110 - protein, 156 aa, A.fumigatus
LIEIMLQPMNVTWIMGYPTGKEQGKFLILDMGGTNLRVSQAQLLGSDRDMESIQEKYSIPQSIKQGTADDLWDFVADCVQKFLQSRLSESERSKVLPLAFTFSYPVIQSSIKVGVLQCWTKDFCVSGVEGHDVVFQLEAAFERKVCTLVIPAGCKA

SEQ ID NO: 35111 - protein, 262 aa, A.fumigatus
KIPVQVVALVNDTVGTLFAAAHRDQEVKIGSIASTGCNAAYMEEVAAIPKIQSCGLPSGALVAINTEYGAFDNSRRILPRTRFDDEIDRTSAHPGQQLYEKMVSGPYLGELLRLVMLELHEAKLLFVGQDVSCLRQPNALEVSLFPTLEEDISECMENARKCLWEKTGLDPAPHELKACRYLAELVGTRAARLYSCGIAAICKKRNIERCHIGVDGSIFGHYQNYRKRAAQALRDIFAWPDDLEDPIVFGVYKKWVWNWRPL

SEQ ID NO: 35112 - protein, 188 aa, A.fumigatus
LLGEEPRRISCTELRCPGVCAGPPGPQPDGYILHQRQDRAPDTHQRPPASLLPADQPQRGHPPGGGRVHRGRGRVPARCDRPQPLPGLPPDGGRHAVEAPVDRPAQARRAYRRSHHGRREPHPRARRPRRGPEPDHPRRAQPAPSRAPRRRGSRSRRGAPQALARAHGRQDLQRGPRCHRRRRPNRAS

SEQ ID NO: 35113 - protein, 318 aa, A.fumigatus
IKDMRLLATGRALRASSGRWSVVTPRRSPRISTSHLLEPLTVTVTRRNLSSTANRKIDEKPETKQKATARPSPPQSLTIEGQTYRTDQWTNTPDTILSHVGRRLYLDENHPLAITRKLIESQFPGPVYGNYSEKNPVVSVAQNFDVLGFAPDHPGRSRTDTYYINDKTVLRTHTSAHQQAYFQQINRNEATRPEEVGYTVVADVYRRDAIDRSHYPVFHQMEGAMLWKRPSTDPLKHAAHTAAAIMEDVNRIPAHGVPVEDPNPTIHVERNPLQAEHHAAEEVEAVAAHLKRSLERMVVKIFSEARDATAAADPTAQA

SEQ ID NO: 35114 - protein, 307 aa, A.fumigatus
HVSLLKVIESYTTPLGTSLARHLTTHLSHQITYLSTCRPLSISQGNAIRALKLAISSIDPSVPEASAKASLSDFIDSFIREKITVADQVIADSAAQKIQDGDVIVTYAGSSIVKQTLLTAHKQGKKFRVSIIDSRPLFEGKNLARTLAKAGLEVQYSLVNGISHAIKDATKVFLGAHAMTSNGRLYSRVGTALVAMSAKERAGGVEVPVIVCCETVKFTDRVALDSIVVNEIADADELVMNEPLQQVTGLPDAAAVAQPEPKKGNKSAANATPSESTVVTPGTSPLKDWKDTPNLQLLNIMYDVTTG

SEQ ID NO: 35115 - protein, 178 aa, A.fumigatus
NAPAGSGRKKAQKQEKGKPARGKGGGPEKSNKLGGCGAGARAPQSPHLGRKGQTRCGGVPVVRGGKDAAAAQSQKGRGYLPRRGSAQAAAGGAEQKKKQEDKNVAVFGHLYGQQRRTTVAGAGKEVHPAVLALGLQMRDYVICGSSARCVATLLAFKRVCFVLSLVFVDYADMFLSSR

SEQ ID NO: 35116 - protein, 190 aa, A.fumigatus
RILFRHSLQSKPQFRMVSPSPTHQNKPHRVTVTNRELQSKDSSPTNIHMHHPRLADYFEEFTRPHTSQTANMTASASASYLYQHGYNHGVTYGSSSPTLVPSYLPIEEIYVLPQYQPPNPEDEDDVVPDQHAAFGITRAMERRREPAWRDLGLEGLVDGGGNGAAKGNGVKVRVKEAGRLMGGKRTVCLR

SEQ ID NO: 35117 - protein, 95 aa, A.fumigatus
QKFAYKPLAAQCNDSLFSQHSLISHPCQTAKMSPNNSFVLYHYEPSLPAAIAFSVLFNITTLAHVYQRVKSGSNYMNPFIVGGFCKSAGLPSRHH

SEQ ID NO: 35118 - protein, 85 aa, A.fumigatus
PDAVQVTGYGCRAASHFLGTSTTLYAIQTLLVLLAPTLYAASIYMILGRVIRYLHAERLSPVPVKWMTETFVAGDILSFILQGAG

SEQ ID NO: 35119 - protein, 105 aa, A.fumigatus
  UNSURE (24),(56): Identity of amino acid sequences at the above locations are unknown.
RFLTGATPAAPSGTGSKCDAPDPXTHGSEKINAHSTPPNHHIHSHRGQQRNRSTPXISSAPIFLAPRKEISETPSDNSPPANNKDIFPLSPHPRFSGPPARLPKT

SEQ ID NO: 35120 - protein, 257 aa, A.fumigatus
VCRPSIQTPLTRRSPSHRLWMPRSIPLPWNVHHALRHPDPSGPVGTNALRSIDLHDPGPGDPIPPCRTTKSRAGEMDDRDFCGGRYPLVYPPGSRLVPSTRGETFVADSTGGGVMSAGSANSHDIGTYIILAGLAVQLLFFGVFVFVAFVFRFRFSSSQGAGTSGNVPWVKSWNGLLWVLYLVSALILIRSAFRMVEFAQGFDGYLIRHEIFMYVFDTALMFVLMVVMNTVHPSGVSSAGKGELVECETLRARGSDA

SEQ ID NO: 35121 - protein, 122 aa, A.fumigatus
  UNSURE (122): Identity of amino acid sequences at the above locations are unknown.
WDRKCVGPGRTAHDLYVPDSLLWKPLIFALGWQFSTGWDLASDDIRVQTWSRRLTESLHAINREKGISSEFVYMGDAGEWQDPFVGFPAANVRRMKAVRSAYDPLGTFSRLNWGGFKLGFDX

SEQ ID NO: 35122 - protein, 248 aa, A.fumigatus
MYDAVSTKYSFTDNGQFPGANNIDNGVLIALSGLNKFTVHNGTIDVGPGMTWYDVYSALDPYGRIAIGGRLKTIGVPGLTLIGGVHYFINKYGFAMDNVVRYEVVLGNGTQVVASANSHPDLFWALKGGANNFGIVTKFTLKTFAIPKISTTLQSFNESGIYDYITALCDLVKLDEPNPIAAGGVFTIDYNVTTKVSSASLIGVQEGISRPPSQFANFTALPGVSKVHNVTTGKQFASGLVTPNQMFR

SEQ ID NO: 35123 - protein, 90 aa, A.fumigatus
TLMFNADGDSVMFSHHTVQPDPETLYSIYQAWKTAVDEISDVKGLYPTFVMNLSPAGAARVGRTNGIGNVWGLDEQPMICTSLILCYGNH

SEQ ID NO: 35124 - protein, 143 aa, A.fumigatus
NQAGEITQNTDLPQILTNLCLLVVGFFLFWLQRLLYGPLRPIETEQLYEKAWFAVTETCLAMTIFRGELGGWFLVMFVCLLVGKVWGWIGEGRVEFLEQQPPANPRLFHTRLAISLVLAVLYDSFMLKYCITCSPRGRKEPRY

SEQ ID NO: 35125 - protein, 596 aa, A.fumigatus
HSPIQKEVERSPRTHQAHRPDYDFPGMMASQQLLFTATRTQTFTYLLAVCPFSIAFLVFVNSSVSFVVTDLIGLHDGEGDAVGTLGFADELLALAACPLWGVLSDRIGVRNVRSVGFIYQYGFKSLITDMPSTKVCVIGYGIIAVSLVVFVQARNVYPQLLLGRLFFSLGGSAVSTMVTAVLPAVAGETPSEQLRPGRESRAEAKSPSSRLAGFVGMCAGSGALISLAIFLPLLARFQSWGYSPSEAIQNSYYLVASVAILVSFCCFMGLRGLASEQGKGWHLLWASPKASASETDPLDLNKGAIQLPYLGQLGTALYLGLQNRDIFLGYLGGFVARASSVGISLFIPLFVNHYYRRSGLCGHEQGEVPESIPRDIKQTCRKAYILASILTGVSQLVALIAAPAFGYLSERSRRYHAPLLFASLAGILGYTVFALLPSPQISGPDGSAGVLVLMGLIGISQIGAIVCSLAVLSNGILRISLDSDGSEIFHTPEDPGSTSTNQVNQDVDEHQPLLQGSPRHRGHQLSHLKGSIAGVYSLYGGAGILFLTKLGGLLFDDLSPKSPFYIMGGFNAVLLLARIGTGAMNWAKDSCNRAEA

SEQ ID NO: 35126 - protein, 301 aa, A.fumigatus
LPYLNHFHPSVSVNASHLLNHHPMSGKPDMTIHTLTHFLDRFIYRTPKASATTRGGSIMQPLAGSDTKDRLVVTAKGSQDLPPNSEEFWKKKTEDVAAEDVFFHEYFSRVGKSKDKAQKKRAKDAGGRGEENAEGLSDAESEIWEALVKSRPDLEDAGDSDDDLDLDDLESAYDQGENDEAAESDGGVIFNDESDEEMEDLDAAAESDAEEPPTRGKTKGKKMEEEEALDEEDDFDMDASDEEAFVGSDEELPSDIDLGGVELPKEDEASGRKKRRKLKHLPTFASADDYAALLAGEDEGM

SEQ ID NO: 35127 - protein, 60 aa, A.fumigatus
DVQLVRDLVIVHPLQGTFSATSNPCRPLPNEDGYDDYLLDPNAHTSSTTPIAAVFAHSPS

SEQ ID NO: 35128 - protein, 211 aa, A.fumigatus
PVHRLSEHIDTLFRITHSSNFNTSIQALMLIQQLTASHQVGADRFYRTLYESLLDPRVATSSKQSLYLNLLFKALKNDLNLRRVKAFVKRIVQVLGLHQPAFICGVFYLIRELEKTFPGIQALFDQPEDNESDDEEVFRDVPDEDDEQQAQPAVPEDKQQKPSTRYDPRKRDPEHSNADKTCLWELVRWTSTCWHLNIRESKANRIYSYRT

SEQ ID NO: 35129 - protein, 68 aa, A.fumigatus
CRYRSCQQKYGNAAGSHTNFDQQETGGSAKSILTDSWRLENSGDDVDDPEANCTFVAMLCSRMIKRKI

SEQ ID NO: 35130 - protein, 81 aa, A.fumigatus
MPPRDESAAYALDDAIVFARILARYRGEPLTDAFRAYEDIRREIVNEAFKSARRMWEKHKDMGLLESRLREWTLPFYIRNS

SEQ ID NO: 35131 - protein, 103 aa, A.fumigatus
AVQGLPGYIKLTDAACDEVFVSVGSTGLVLILIRSLHLLSFALFASLVKSGTCFSFNSTTMKFVATLIACGLSGLALAAPTATVDSLGKRAADDVRLLLECVS

SEQ ID NO: 35132 - protein, 135 aa, A.fumigatus
TEAPPVVLEVPRPPSPPTQPSLLPSPVMRRRWSTSAAPSSRAPSRSRLAATPASSARTPPLCSRDSACTYNLACGQKDTPNENSLVKEKSNVIIRNLGVKKVLAENGDAIGIRKYPFFGQWTQLMNGRILQQCVG

SEQ ID NO: 35133 - protein, 157 aa, A.fumigatus
QLQVTHAADYVTISNSYIHDHWKASLVGHSDNNGDEDKGHLRVTYANNYWSNINSRAPSLRFGTGHIYNSYFENVSDGINTRDGAQVLVESNQFVGSSKALYSTDDGYAVERDNDFGGAKNTALQGTLTTVPYSYSLLGSSKVKSAVVGVAGQTLKF

SEQ ID NO: 35134 - protein, 103 aa, A.fumigatus
MRFLVFLQGETLTGQAAFGYASLNGGTTGGAGGTTTTVSSYAAFTAAVSSDAKKVVYVSGPIKQSAKQVKVGSNTSIIGKDSTAVLEGFGLYVQPCLWTKGHA

SEQ ID NO: 35135 - protein, 149 aa, A.fumigatus
LDDSDSDYLKRDDQYLAFRLQNEEARNKMAKTAKDRDRALAMAKANDLGLPEAEADGDGDTNMEEGAEGTTETLGSKVIVVHVGSQNLRIGLASDALPKTVPMVIARKSTTSESEDHAEPHPKRLKLDDGSLMEPEENAWSGGLSYPSA

SEQ ID NO: 35136 - protein, 544 aa, A.fumigatus
FSSLYTTMAAELKAHMRQNKRRTLPNSKEMVINYNRRTVPETIPEHNDPLRVEWTDITDDAPEYIVGQAALRIPDDSKPRYKLYWPIRYGWCNERDYENKRLLFLDISLILEDTIKSQLGLTSKKDWPQYSCVFVIPDLYEKTYVTQVLEMLMREFSFARVCFIQESLAATFGAGFTSACVVDIGAQKTSICCVEEGMCIENSRVNLKFGGADVTEAFIKMMLFDHFPYAEINLWRRYDFLLAEELKKNVCTLNEASVSVQVFDFHLRIAGQDTRKYSFKAYDEVHLAPMGYFQPSIFDHSRKLEGRRKFITRSVDIYDGQPNDPTSGAQSEILTAIAPPPANGQVNGESQSFTLDVQSTPTRSHQVNALSRVQELDATPRSSVAGSPAPEAIGTPQAGGAGTPLPGGQGQNASQARAPTVEERDDVLPVFPLDNAILTSISHAARSDERKMRDFLGGIMVVGGGSLVSGFHSFLEERLQTLRPGFASEIMVGTPPRDLDPQVVVWKGASVFGKLSGTNDSWIGQLEYDRLGHRLMAYKCMWAY

SEQ ID NO: 35137 - protein, 147 aa, A.fumigatus
DTRRIKRKAAVSRKEELVCPHALVRHQSVTQSIIFQLPDPAVIGSAQLTKHTCALPDYHLGVEVSWRCTDHDFASKPWSQRLETLFQEGVEAADKTAASDDHDSSEEVSHLTFIRSSCMRNRCEDRIIQREDWKNIISLFDSRCTGL

SEQ ID NO: 35138 - protein, 91 aa, A.fumigatus
ACIIFCWLFVQRFRMSTRDPLFIAQEAVCFYPISTIYDSCPRYLFYALLLASCVTRWTGWLADVFLGAAATYAGVAAIQAFILVSSPSSPA

SEQ ID NO: 35139 - protein, 176 aa, A.fumigatus
ITIWLNGGPGCSSLDGLLQENGPFLWQSGTYKPIRNPYSWTNLTNMVYVDQPAGTGFSPGPSTVNNEEDVARQFKSWFKHFVDTFNLHGRKVYITGESYAGQYIPYIASAMLDEKDKKYFNVKGIQINDPSINDDSVMIYGMSIFHDICSLFFRANMSSSTRCQPSEPVPERLLSQ

SEQ ID NO: 35140 - protein, 271 aa, A.fumigatus
ASSMISVHYSSGLTCRVAPAVSHLNQYLNVFSLNDTFVKHINKRAEECGYNKFLDEAITYPPPKEFPVAPDPSKNNCALWDDIVEAAYYVNPCFNFYHLTDFCPYLWDEMGFPSLAGGPNNYFNRSDVQKALHVPPTDYSVCGETTIFAKGDQSVPSALGPLPSVIERTNNVLIGHGWLDYLLFVNGSLATIQNMTWNGAQGFQHPPVEPLYVPYHYGLAELVTSTAPNPYTLNAGAGYLGTAHTERGLTFSTVYMAGHGKENHLYLHVSF

SEQ ID NO: 35141 - protein, 103 aa, A.fumigatus
DFVVAMFHTFEGFENPGASAPAKGRERQQSVGRRVTTLRACTSCRHRKIKCDGEKPCEACRWYKKADQCHYSDPRPSRRYVLFVLSMSSVPSLLSFPWSSRNR

SEQ ID NO: 35142 - protein, 360 aa, A.fumigatus
AERSRHVEKLSTTLDEYRSVLERLFPSTSPEALVSLPREKLLELSGKGPPQPHAQHPASPATSASVEAHVSPISNEDGNLESLQTMPEDPSDSRNQSTSDIANEISDDVNALSLSAKQPSSYLGVSSIHAVLKVIVWLDPGSLSYFSRTPASAAPRESMHDYSTSAEHQNWHIQSSQQRPVTPPKAHMQATDTQLLDAYFTWFQPFVPMLDEQAFRETYLSGHRRDDRWLGLLNIVFALGSIAACPSDDISHKVYYQRSKSYLSLDSLGSSHLETIQTLGLMGGYYLHYVSEPNLAYSLMGAALRMAAALGLHKEFSYNQDASNKQKLSAMDLKRRTWWSLFCMDTWGGMTLGRPSMVVL

SEQ ID NO: 35143 - protein, 351 aa, A.fumigatus
RHHPIAQAVSAFCKGRSEIPVAASDIVEKSGRGMMGTFTISINDPASNSSTTVVYEAAIGNEALLQSLTSAVDTYRLSGLLEEYQSAGKSTAILSLRKIDPTSPDKPSFTPAIVFAATDAIRPQASEIISQLRKRDVDVFMCTGDNQTTAYAVADVVGIPRSNVMANVMPAGKADFVRKVQAGLYPVRNEDDAESQTNRSGSRPIVAFVGDGVNDSPALAAADVSIAMASGSDVAMNSASFILLNSKLDTILQLVLLSRRVFNRVKMNFGWAVVYNLCLVPVAAGVFYPIVTGQKHMMMDGEMVTVNDHWRLSPVWAALAMALSSVSVICSSLALAIDGRTIKKLLGRSMS

SEQ ID NO: 35144 - protein, 375 aa, A.fumigatus
QGILSIEQGDSSTHVRSNTSTSAAPGPRDNDNNIVAQESLNGNNDEPIQIQDNDRGRDPIDEIGIEPIILPANSFTIQLVLDTREVRSSKDRDYIANELSKKGITPEVRALELGDAMWVARCNDPTFLSQYGEECNEVMLDWIVERKRMDDLLGSIKDGRFHEQKFRLRRSGIKNVIYLIEEFAITHDVGSASAMKYQEMMASAIASTQVVNGYFVKQTRNLDDTIRYLARMTYLLQKMYCFSPPTHTLSLIPSRQLSSAQSYLTTLERLRARDPSVTYSVTFSTFSALTSKSDILSLRDVFLKMLMCTRGVTGEKALEIQKRWSTPREFVEAFERLDEKGREDMVFERTKTLVGRKKMGKVLSKKIADIWGTGG

SEQ ID NO: 35145 - protein, 159 aa, A.fumigatus
HDGNSQPTPSRHRPTQQFLDRPPVDCESKTTADNRNAAQRHSQRSPHRTKPPVVINGDHLAVHHHMLLPSDDGIEHARSNGHKAEIIHNSPAKVHLDAVEDAPAEEDKLENGIQLGVEEDEASRVHGDVRAGRHGDTNVGGCESGRVVNAVADEGDYRP

SEQ ID NO: 35146 - protein, 72 aa, A.fumigatus
IKTRGSYRKLFGARRAAQSICLHQILLIRFLNMVPNAPKKSFNSIPATERNTSSMHETTIFNRDLEGLAYAW

SEQ ID NO: 35147 - protein, 445 aa, A.fumigatus
HRYGFHSCSLQCLHSASALYLPTMASNSHNRGHNEDNAPTDQSIPLQDLSGPLERNPSRTSRVGNRFLSRRSLRRGGSLSNYEKVSEESPVEPPPVARRARPQQAGHGNEDEFHIEDPGTFAQAMSAVGLSFDPTHSTTTSARRRESSSDLINVPLDDFGPQEAEHYLSPTDTYEDTAPLTDHRFLQPISGASQNFSGGQDDRGSTHGNRFPSDSRPESRLGDDLPHLESGLGRRRRGSSSAGDSRARSLSPSATGSALQRAGSMMKSMSQRVVNLSNEPEVVERAIMREEQHKNARLEEPPSLPSLSGYAHDAPSVGMSDDQLPRTGTSASKAWRMYNNPLRGKALGILGPNNLIRVWLCDILIHPFMEPFILVVIIIQTILLALESAKSVWDHPRSVRWGSNPMDYAYFVIFVIYTLELVAKILVSGFILHPAEYSTLDPSMG

SEQ ID NO: 35148 - protein, 77 aa, A.fumigatus
VLRLPNAKAKRSFGRRFRRGGGAIACSCCEGAAGRTVCDTLEQVDTHMHAPKGCGSSYWELTLASGKRKPKIYTRPD

SEQ ID NO: 35149 - protein, 115 aa, A.fumigatus
PRLSLLCHSIRTIAWNPTGQLIATGSADRTLRIWNPERPAVKYSTELRGHSAGIEKVLFNPVKDSELASCSTDGTVRFWDVRSKTCVSRLDVGGEAFTMSWSADGRILMAGRKVC

SEQ ID NO: 35150 - protein, 298 aa, A.fumigatus
AVSMSAERHSRCPGRRMAGSSWREERCVERTHALHLGLRNSSTRTRSMSHGKATCRKRTDFFGSQDDTLVPISIESPSSSHILTDGITNFPLTSSPTSKEGTTTYTALESHPQPVQTNATTFSHHIPTPTSPDLHLFATTGEGTVKIMSYPSFDVLHTLHAHTSACLSIALAPTGRYLAVGGSDALISLWDTTDWICRRTVSSSNGGAVRGVSWSFDGRFVCGACDEVGCGGNGLEIFHAETGESVYTVPTGGSSASGIPTVAWHPSRYWLAYSTTADGPGSAGAGGLKIVGAAGGSL

SEQ ID NO: 35151 - protein, 176 aa, A.fumigatus
ADICTHPKTFAEKAAWDFVEKEKPNFDIATINPPLVLGPIVHYLNSLDAINTSNKRIAEMVRGHCKDGLPPTSTFLWVDVRDVALAHVRAIEVPEAGGQRFFLTAGYFSNKAVANIIREAYPEIADRLPPKDSPDDTPADVYGFNNKKSIEVLGIQYRSLEQSVTETVKSLLAVGA

SEQ ID NO: 35152 - protein, 496 aa, A.fumigatus
  UNSURE (437),(450),(492): Identity of amino acid sequences at the above locations are unknown.
ALPLTVLGLACMVQSTFLKLTPHRRDNIEKLQLSPILPMATARLSPTANLLRKSRLFALPSALPLPQQDATSKTVFESNTATLPHPIRASIVTPASSLARGDWGLKRPLPAKSTSEKSSRPVIRLNVLDTFEHVTDFESAADHTVTLEKFQELHMPMSLPSKVNYATSMVPRHQSPFESVVDNTDTSKSLQEPGAKQFRHSGPWLAGQTEAEFNAYLNKVRARKPELLQKLREHFITKRTAERRKQAQDNGEDLEALGPLNVTEEEFQRYIKSLRADPFSLGPVVFELLDLPSPPAVPSDRIGHKYYQSPGTKLSSAEYAVSGPPKTHPSAGLSYTRSHALIYNHPKFGPQAYQRPVQARILRPKGRFKGKTSKAIAGVGGIAVEDLNAMTFIEQGSPAGLGYFDASIPGGAKYWVTPIRASVDSDGKIALASYRAXATAKAPYGIEEYXKPSSNSISPGRSYRTNVLVSQLGPFGKFVLMFGRGKDSSGDXPEKS

SEQ ID NO: 35153 - protein, 168 aa, A.fumigatus
CHWRGPSGSSRLIAFKAVKSNPPFDYVLHTASPFHFNVIDPVKDFLDPAIKGTTGILKAIKAYAPTVKRVVITSSFAAIINPKQHAKEYSEENWNPVTWEEALDPSATYRGSKVCIQPRISHCARLTYAPTPRLLQKRLLGTLSRKRNPTLTLQPSTHRWCWVQSCIT

SEQ ID NO: 35154 - protein, 60 aa, A.fumigatus
LHRCILECGRKVYYYTDLIMDLKDGSNISFQGSKYICIELYFYIMLDLFLLFMPQQPTTT

SEQ ID NO: 35155 - protein, 555 aa, A.fumigatus
RGSQKQGQDSVDASTTTDIGHALINQLRVREKERIIETRMTQLAFIELQEGPEAAVNHSGQLLSLFATLFNKLELQADDQKDRQTEHLVPPKSAAGTVKSLRGSIFGRHKASRASERKAESTGETQPISTSSSIHNEQMLNTDLAPAIQVTQEQNGNAEDPQPPARSDSTRQKLRKRSGTLKKGEGQSSTQINGTEDPTNAVSTATNGSATLQQPGSREGLAQDAVGLAVSSTANQPQSAKQPLRPVAHNMNCKQAPPPTGHPKQPPEQDIRLPYRFDSPTKAITRFPAVQSQKHALSILIKIWLLIAGLYRRASLFEDAQEACEEAAKHVDRVEALVAAQESSARAFRSRGWASPKSSDELWADLHTEQGLLAQAQSRPHDAMELFEEALVRDPDHLKATVCLANLLLDIWERKMPLNRPHTDDLHAEMSTLYLPATTQKSSATLNKIQYQEFDNLDNRPMPSKRQSPPTDVEEDEPKLLNRIAARDRAYVLLSALTKRGTAWDNSEAWFALSRAHEASGDVEKLKEVLWWCVELEDRRPIRHWSNIGSGLYVL

SEQ ID NO: 35156 - protein, 71 aa, A.fumigatus
INVLFRHAWLSYMVDAPPTQDKILQTGLRAWELPEHRPNPTLSRGAYKPYSTLVSPLTGVYYEALLRMRNH

SEQ ID NO: 35157 - protein, 732 aa, A.fumigatus
KPCKDQRNELVEVAYAQCDEVIAKYKAGTLEKYPGCDELQTMENQLSGILSKVRQQAGDECIAQLSKYNSPLIMATSGSKGSSINVSQMVALVGQQIIGGQRVQDGFQDRTLPHFPKNARQPPSKGFVRNSFFSGLLPTEFIFHAMSGREGLVDTAVKTAETGYMSRRLMKSLEDLSSRYDDTVRNSSDAIVQFQYGDDKLDPVDMEGKAKPVHFDRTFIHAESITYDNDERSLLPHEIMEVCEEMLSKERAKLVREDLLGNKLAYMDRSDHGVDQFESARDFLESIQQYISSKADKLISRGGDIDPSDERSQKGLNHTGKLTEKTLRTFITSCLMKYKKAQVEPGHAVGAVGAQSIGEPGTQMTLKTFHFAGVAGMSITQGVPRIKEIINASKEISTPVISCDLVTKDNVIAARIVKGRIEKTYLRDIIHYVREAWTGKEAYLTVKINWETIQNLALELKIRNIVDAIKNHKRFKADDLKFRSTNSHIHIYMDIDPASKASLSKTEIAATSADPFLRLKHLKRILPDIQVLGHPQANRAIIRTDDTSSTNTLLVEGYGLKECMTTLGVNGLRTSTNNVMEMRDVLGIEAARVTIVQEISEVMKDMGIDPRHMQLLADVMTYKGEVLGITRFGLAKMRDSVLQLASFEKTADHLFDAGGAGRTDLIEGVSECIIMGKTVSLGTGAMEVVRKLNFFEGQIGRKKTTFEDVWAEIYEEPVDAQKGRRVRRKIRA

SEQ ID NO: 35158 - protein, 363 aa, A.fumigatus
TACMRLSRRRWSRGLILRGRSAPMTGGISLDGGSMSLWVLRGMSCGMWLMWHRYQRAFVDFFEDELVRHGYDWKKVVADYLFSGKEPLFSSLVADREWLRYLLQEGYADVVRLVGHPLIHLGYAFEMSSREVAMEALGLVATCYSDIHKYIDDSSYSRADSSYHSSSLFEILAKVRADKRFKGVFATPGDHNLETLFRHHEAALLDHWNAWKIEDPVPQFRESQQLAAAVLTATQADPTEKYDFFLVHILTTSHAVRILLSLIPARFQVPLVRQWWLMTLAVYIAQLRPEIDLGRIRNYDPQGRDWKWTAKQAVKSKHSTDAHYVKALRAMREAAATWGDSDGLYLKAAVKFAEEFDGWGGFV

SEQ ID NO: 35159 - protein, 67 aa, A.fumigatus
ILSSAFLQGADADDLNRVYEAESKTLEPWIDSPGEISTYDWRDFLGRREYVSLGIAWDELRNVADVA

SEQ ID NO: 35160 - protein, 243 aa, A.fumigatus
GLQSVMPSSPEKSETDVDASLYLHAELLPNIRHITFYISIPANLGSQNIQPLITLSESRRSVSVSLPAPFDHVADTIKLPARVNEASRRVLATSRQGDAATADNDSGVRRREFSFRMQIDEPDDSLPSKDPLIDDFVPWTAADMSPSTRLRCSGCENVILNNPRCADGSGDTSPAGWTWKDLPSGNWAEMMDFWHCHKPGPSRGPPPCGRPQCSDEGIRRGESGGGDGRDGHRGCGDVSCVGG

SEQ ID NO: 35161 - protein, 107 aa, A.fumigatus
SIELLAMGIFSRFLKLTTIGGAATVGGFFWYTRNDVFVPLPLTDRIFHSARFNALNPLRNPTTHDLCIRRVPLSDIDPTLLEKKGKLVEAFCAGVWSGWGRQAPCNF

SEQ ID NO: 35162 - protein, 163 aa, A.fumigatus
AGTLQLLAHILSYKPTTLTTATSGYAFQRAYLARKYQGPETANQLWSRSELRSSTYEPGTLITDHFEVVEKTPDRIVVRCGASPRVQEVRPSDGLFEMSVEVKPNEGVAEFGLKSCFFQGLGKGGGPADAPAYCLVASAVYEVVDGGGDSECVAVISCLVLYI

SEQ ID NO: 35163 - protein, 143 aa, A.fumigatus
DPTGTSGNRSPRAVSTGSLDDSDTAQGDSEEQGSIASASVAHSTIPVPASSSAAALGGSSIASSFASSRLIPRPTGSSTAASATAIATWSPTAGESASGTAKESATLTTPSEVFFTPGLSNGANRMSVGLSGLIGVMFIAALA

SEQ ID NO: 35164 - protein, 220 aa, A.fumigatus
NLPKNYYTWLTMMNQRGRGKNYGKDPLPDPALGYHHLLPGGSPDQPDPNKQTIIRHPTNSFLEITMILPAESNIRFNAEAAKWDDNPFVHEATRLAYETLHPLITTLSNGRDQTLDVLEVGCGTGLLTLRVAPHVKHIVAIDPAESMIDVLNAKLSDPTEPKNLTPALPLYSPTQEDPPLPPATGPWYSGPPDRGPNRKYDLMAFPTSLLLMAPDLRLIP

SEQ ID NO: 35165 - protein, 95 aa, A.fumigatus
ISLQSPVGTRPVSSHYPRTAPGQSGPHHPAGPCRTPKTNEQWPGTTNPGPCGAPDTRAGPFHTSTAASLGSRSISLAGTRRGREILPRRGLWPTR

SEQ ID NO: 35166 - protein, 65 aa, A.fumigatus
VSVPPRDLLLRGGVSLMQYSDSPDEDFEKAAHLCAYVSFAYKNGGAYVTLYNHSFNPVGDVSFPN

SEQ ID NO: 35167 - protein, 219 aa, A.fumigatus
  UNSURE (67): Identity of amino acid sequences at the above locations are unknown.
NMSRSSPPLARTFGNTILITPFIHAICEAYFQRTGDYWFSAAFFREIESGMPAQPFHRDDATHPLMXYQPLEAPPISLSVIFPLTEFTEENGATEVILGSHRWTEVGTPERDQAVLATMDPGDVLIVRQRVVHAGGGNRTTAGKPRRVVLAYFNSVQLTPFETYRTMPREMVESMTVLGQRMLGWRTMKPSDPNIVGINLIDDKRLENVLQLKAADSPA

SEQ ID NO: 35168 - protein, 211 aa, A.fumigatus
PSAGQIWQLTMERLPLSPAVLFLIIALPILYLWIRYTAPARPHGKHLSLPPGPPRLPKIGNLHQVPRQIPWKKYKEWSDTYGPIMSVQLADTIAVVFSSWDLIKNHIERRNTIYSSRPSVPFFLHATGGLNASILPLRSGMETPAGHPQLRPQTLHDGQVPRRPACGNDAAPARASVHKRLPRLSASMYCQCLSDCGVWGAMCRSCRVGGD

SEQ ID NO: 35169 - protein, 120 aa, A.fumigatus
LWSDSRCPPLCSSSSSPSPFYTFGFDTQHPPGPMGSTFPSPRGLHDSLRLATSTRYPARSHGRSTKSGPTLTAPSCPSNSPTPSPSSSPHGTSSKTILNAGTQSTAADPPCPSSSTRQVA

SEQ ID NO: 35170 - protein, 406 aa, A.fumigatus
MRRFSPYGPEWKLQRAIRSSVLKPSMTVKYRDVQHVETTQLLHELLSTNDFPVCLRRCIASVFLTVAYGERCVDHAGLEAIDRLEELNRAIALHAEALFSGAAGILTQLVLPKALVDRLPVRWKKDADMLHNRLTADLVARTRAALVRPGWNWVKEFSMKDGIGSGDGDGEQGSKVGLKRLAYMVGSLYEASMAASQALRVIILAGLLHPDATRRMHDELDAVVGTGRLPDFHDAAQLPYTQAFIKEAMRWRSLTPMGSPRATSDEDDCRGYHIPCGATVLVNVWAINHDEAIFLDPFAFQPERWIENPDLPQLMYGMGQRACPGRHMGQDSLFLATARLFWAFDMALPDGADPIDQERFLDSGTTLAAFLPDFEVRFTPRSEKYQEVIENSMAVLPDVLSISATP

SEQ ID NO: 35171 - protein, 100 aa, A.fumigatus
  UNSURE (17),(32): Identity of amino acid sequences at the above locations are unknown.
NTIGLFLFCSSRETVLXCGKGSLKAKLQGFHXYFDSQLTFIVPCSPGSTPWLRCRTGGVTNKIPRFFGSTEINFLHWDGNSPAFDFSPKMNPPKLNVYLA

SEQ ID NO: 35172 - protein, 120 aa, A.fumigatus
IIFSVIPLLAATIYVPPTISSSSTLSERLRSMLSVISLLLTAYIMKYHAIERPDPKGKRPITKADLITSAEKYAIPTNAALCALLALTSIMASPTAVVTYFIPAGESRARHYLSDQHVLA

SEQ ID NO: 35173 - protein, 421 aa, A.fumigatus
  UNSURE (1),(16): Identity of amino acid sequences at the above locations are unknown.
XWKPWSLALSEPFPQXRTVSRDEQNKNKPIVFYSVEHYSKLVGDIDGKSMDSKQQLLLKDFEHLFALYTQILLSESFSQDEAEEKDIEYIPLDSNITCSYCRCNIFNRFLTCPWCAGGQTADGEDPYDICMECYVMGRSCACLSRLKWAEQFPWSELTGNYENWRDQICRLNQGNPNGQIFRPLAEERARYGKKTLAEMCQGELKRRPWVDITKPVTRKIEDNLSDPESPARKRRKTRLSHESEKGGRCHICKYIEPKWKLASCDYCNQNYCYGSLFRAFNIQPHETMEVYRWMCPKCQKVCSCAACRRDPSMKPFEPTCTLLGHDTRKIADPRSVESLVDFRQSNLRWLKKAGDNEIERLKKHQKEADEKRQQAMIEYSIQLEDSPRVSAHATEYGDIPVDPVLEELSGSILTPPDSFTP

SEQ ID NO: 35174 - protein, 178 aa, A.fumigatus
GKTFHHLGYRSLHDGCLLVTRLFSAPFSPFTTNLTMALYTAQRRIGVPRAFLFRRHNMPPHRCLIPAPKANSGPLMERRADRELPSINTEKRRWIKTLPIFVVVVGAAMLGIFNYQKSSSSVVSSTLYALRTSPRAREILGDEIYFAQKIPWISGEMNQLHGRIDISFWVKGTKGQGK

SEQ ID NO: 35175 - protein, 362 aa, A.fumigatus
VSCAMPGVVDTPGGPLWPGLGFTVAHQKVELEIDFATKSLKGKTEITIHPHYKELRIIRLNFRQGELKRLNVNGKAPTIKYADPYESLQLYGPHYHQRLSTKIDSLLTTTPEPDLLVTIPKSVRIEELDPFSQEAQDQMTLRASGAGEDTDGPLGSKLAETSLPRFSALTVYIEFTIENIRDGLQFVGVDSGDRRYPHAYTTNSLGYGAASPLFPCVDDPLSRCTWEISVKCPCSLGDVFDRKTRDPSGAHRSKQTPGGSRFISPDDETLDLSVVCSGDMTDEIVDPRDPSKKTVSFACMSPLSAKQIGFAVGPFEYINLSDFRESDQDEQLGQNAIPLHAFCLPGRGDEVRNTWFPHGESY

SEQ ID NO: 35176 - protein, 65 aa, A.fumigatus
LETERQNFYESISIASSYFANFAPAHLDFSPPLTNLYSLTIFPTLFFGRIIGKYYERNGCSLSWT

SEQ ID NO: 35177 - protein, 113 aa, A.fumigatus
  UNSURE (86): Identity of amino acid sequences at the above locations are unknown.
TSPTSVRAIRMSSLARTLFLCTRSVSQEGEMKSETHGFPMAKAIDFLSLTYGSYPFASYKICFVDDAPENTLPTACLSICSKHLLXPEDIIDPMYDSTRALVHALSCQLDRWS

SEQ ID NO: 35178 - protein, 100 aa, A.fumigatus
SSHRLFYKLIDPFSHHTATQDTLTDEILMPLKSYKYQSVDKSYISNHILKHYVLCPLFLPHTIRSRSDGKIVTLVECICRSPPAMDCLTRRADWKVNEPS

SEQ ID NO: 35179 - protein, 160 aa, A.fumigatus
YIAYEDLKTAVKTGYVSEPTSEYPKPDRKPWTEDHEKRFVSLLESELDKVFNFQKLKSEEIVRRIQASEKDVADVVSRLDNANNSRRQSLRTSQPPPSDEDFLLLEQVLSDIIADVHDLAKFTQLNYTGFQKIIKKHDVCSASRALLECFWYNVREANVC

SEQ ID NO: 35180 - protein, 97 aa, A.fumigatus
KQTGWHLKPVFAARLKAKPFFKDNYDAFVVKLSKLYDLVRTKGNPVKGDSAAGGSQQNFVRQTTKYWVHPDNITELKLIILKVCKALSLFVSRQTLN

SEQ ID NO: 35181 - protein, 150 aa, A.fumigatus
VSLCPFLSVQILTHTGIHVPVRVEPKVYFAAERTFLSWLEFSILLGTIAATLLNFGNDYITFVSSWAFTILAAVALIYSLMLYIWRVDKIRKRRDVKRVYYEKWGPTVVGLGLVVIMLVNFGLRVRQTGFAARDGDQGFGHGRGSAGGEL

SEQ ID NO: 35182 - protein, 559 aa, A.fumigatus
QHLPVLVFNPNKEFEEKDAAISSIYFDNTNTWELYEGRLKKTEGAEAIRLRWYGGMESDQIFVERKTHREDWTGEKSVKARFSLKEKHVNAYLSGRMTVESIFEKMRKEGKKSEQEIADLEQLAREIQYRVITRRLEPVTRTFYHRTAFQLPGDARVRISLDTELTMIREDNLDGRQRSGNNWRRMDIGVDWPFSQLPPQDVERFPYAVLEVKLQTQAGQEPPKWIRELTASHLVEAVPKFSKFIHGTATLFPDRIHLLPFWMPQMDVDIRKPATRRFGITRPLASTSLSANETPEDDESDEDESDEAQARTRAATRDAQHSVVDQSDLFEDNDGNALDIEERIAAQPLPGDEDYPLYDSDEESNYSDELEEARRIGGGYYYQKLVEYYIHRMGHALINGLKAIAPGPRPTDMPEPEQNGITVMGNKRTIKRFVAPKGKRRYPCALFCQSKFSRIQASTSPSASNPRSISPPSEPSSPGSNFPSSSAPLLRLYSTSATTTSPSSPRGRLPSLLQWPSSTVSCCISGVSTRSASAATSNESTMRNGALPSSDSVLWLLCW

SEQ ID NO: 35183 - protein, 436 aa, A.fumigatus
GEPIHIVMSKPLSPLPTSRQNSRAFSSGLNGLEIESLVNESGSENVFASPNKTIDGGADTTTPQSGHYPATYHTQESILDVGDLESVDEQPSSPFQYDARDPTVDFRVLGNQQISSGLRECSMTPRKRSYSHCPEDGDATDRSSERSKKGMSRRDMPDIQVYADDEPQMHEREMTGRTGHEIATSMVEQKRNEGMSTVLDVHNNYDDSFSEKENLDMKAADDVMNDDSHDPMDDTCFSTFSAVPNVDMTSFANLRGNSPFKTGRQLPSSPGRMDENQSRSPAPATPDTSRRSQRQSALIDIGTPIASTPRGRERRDMENASETPNLLDLTDQPNFFPRQRYSIQKERYSPSRRSPLRTLRESIRSPAKVSLLDFDIPPIPTPRSIPTVTPRELESLKSGFHSEISSLKATLSGKEAEVSSLKNAVADAERRVGRSS

SEQ ID NO: 35184 - protein, 384 aa, A.fumigatus
AKRADSYPYLFSANGLFGKFPYLLPNLVCSFLLLLSIAGSWLFLQENHPGLQHQNAAGNLDHTSAESPLLATAGATANAGVDLRAESYGTFNQVRLQADEDWFVNADGSKYKTQKQPVFTYRVVSLIIALSIFTYHSMTYDHLLPIFLQDKNGRNTSGFSNAPFSFSGGLGLSTRTVGLIMSSDGIIALVIQSCIFPILAQLLGVWRLFVVVTVLHPLAYFIVPFLIFLPQSFVIFGIYICLIVRKILSIIDYPVLLILIKQACPSESVMGKINGLAASAGAVARTIAPPIAGFLYSTGADMNFTAIAWWGSSLIAVIGAVQLCFMKHKKHTSATIRPAMPCHYQYVPDESRPQKETIHIIVTDTDANADGAGTSQSRRYSFLT

SEQ ID NO: 35185 - protein, 232 aa, A.fumigatus
  UNSURE (162),(165),(166),(178),(186),(201): Identity of amino acid sequences at the above locations are unknown.
NREHLERRMVELESQLSAARKSAPNETGDDGSAQRTTAAEETAREVQDAVEKVARELHTLYKSKHETKVAALKKSYEARWEKRVREAESKFKAVSEENERLRNERDAALSEASRPDASIMAHQNDEHEAEKHVLAAQIKGLQQEMETLKQDNERLHAELKVXRAXXGELVAAVDEWLXMQQNVPQXVRPPRSLPLLIVEYXTPKPEPAPGPSTERVQEKLLAPVDSRGIPAA

SEQ ID NO: 35186 - protein, 107 aa, A.fumigatus
LTRSRELALQLHHAPFQMFPVLLRLLKLSNKPLLLPFTFNNICPNSSQDVFHLLTPPLPFGLLNFESFFPRSFITDFLKSFAQRAVQHLQQHSSGWRLPLLSRSALL

SEQ ID NO: 35187 - protein, 290 aa, A.fumigatus
LVEGLDPLMVQYNQSLPYDRIFWKQDIAGSIAFARANTKSGILTQHEFSEIERGFKQIAEEWSTNTFVVKESDEDIHTANERRLSEIIGKEIGGKLHTGRSRNEQIATDMRLWLRDELRKLDAVLCDLIKVSIARAEKELDFIMPGYTHLQKAQPVRWSHWLLSHATAFASELQRLREVTRRVNRSPLGTGALAGNPFQIDREAMAAELGFDGLLYNSMNAVADRDFAMETMQWGSSFMLKISRWAEDLIIYSSLEFGFVRLSDAYSTGSSLMPQKKNAGEFFSCVYFHP

SEQ ID NO: 35188 - protein, 81 aa, A.fumigatus
RRCRSCVNHRNNHLDSDLSIASFSHFSLLFNSSIPSSTASTMSAPKAVAENMLWGGRFTRVYPLPQLQFLRILLTYLSFDS

SEQ ID NO: 35189 - protein, 175 aa, A.fumigatus
PSTSSPRSSADSSRSPRNGAPTPSSSRRATRISTQPTSADSRRSSARRSEASCTPAGPATSRLQPTCACGCGMSCASWTPSCAISSRCRSRAPRKSSTSSCPVTPTCRRPNPSGGATGYCRMPPLSPVSCSVCGRSPGVSTAAPWAPALWPETPSRSIGRQWPRSWASTVCCTTR

SEQ ID NO: 35190 - protein, 135 aa, A.fumigatus
TRPDSLELLRGKAGRAFGHMAGLMMTIKGLPTTYNKDLQESVEPLLDHIKTVSDSIQIATGVLSTLTVLPEKMTAALAPEMLATEIADYLVRKGVPFREGHHISGRVVALAEKNNVPMDTLSLEQRLHQAAEGQD

SEQ ID NO: 35191 - protein, 341 aa, A.fumigatus
LVWDAMPMTPETDESMTKKSSPPRVENAVCRFQLPLSLGARPLFQSASVICSKIASRRSMAPWMTPRTGGRPSSSQARRALARELARAMSQLTGFTRQPAARSSRTNRAPSAFWFWARSRSPALRERRIRFWAPWSTSQCAIDRPMPPTPPTTRYDASERSRGRGVIPLGRGTTGTTSSGPAGSTTFPMCAPVCRNRKASWTCCVGAQRRGWTGFRARWSTRRVTSPRMRWMSGPRRRKSVGTSNEASEMPREKHSSATRLFVSISFLPNSIRWPRGAMTLRLACRSGPGSELSMTSTPRPSVAARTAGANEASRLLKMRSAGMPYSRVRRSRFSCDPAVA

SEQ ID NO: 35192 - protein, 552 aa, A.fumigatus
  UNSURE (437): Identity of amino acid sequences at the above locations are unknown.
SRVSRSATHTRPTGRPSRFNSSGIVNREEGVVKNWSWGGPSCWPDTWAGRRSLRDSRVAGEARPPHARVRHPCRAHLQQPRRFVCPSGPGRHRGARGRRHAQLAARSTPAGQPQRHRAPRPSDRIRQERDRDEQPGRAGVLLARHLAGLVGCAHALAPSRTRHPPHPGRGHPSGGPARPEARPTPSLCTHAACPGRLSIPADGGTHGKGCAAGGPRGGRSSSPTAQGDHPSTPTALRCIIPGRGRRRRHWPVYRALAGRPRRPEPDPPLPQRRRSRSRPEPKRRGRSVRPRATRRRLPREAGQLRHRPSQLPRQGPPRLRGRGSPTRAGRHPGRHAPARRDLRADDAGRLEERPGAQAQRQLEPAHGVLDARWARLLRHALVCLGGHRHRVPDQLRRGWLLRGCAGPLAPGPGSPRRIDRPWTHLGHWLRFAKSNVXKRCARTETPHARQVNLAPGPQCRLLLPLRTSSRPQLVVGLNSEPGPQWDPAGGSQLGRDARFLHLRPRRKASPHGKAADGGADSSSVSLATQLAGAASPARGCLAHRGCHCLEAG

SEQ ID NO: 35193 - protein, 70 aa, A.fumigatus
IIYRLNCIYSQNPVHCFLTVGDNMAWNAPINQILVICNCSEICFSVQDATEDIYFIAVKCADVPMIPAWF

SEQ ID NO: 35194 - protein, 555 aa, A.fumigatus
  UNSURE (541): Identity of amino acid sequences at the above locations are unknown.
PLVVSSDLQAQGFAAGPLGVSPSRSAIEDARPEKGFGHQDDRDRCRGELHGWDVPRGLDGHWRGRRVQRGAQTHTTDGSQGAASGEGGATLPHHLPRLLDADAPDPGSQGRRRIRDPRADHHDSILAGLSTVRKGWSRIGAGAAHHAGQTLGRDGDLYATAGSQEKRDLLTREYGIPAERIFSSRDASFAPAVLAATEGRGVDVMLNSLPGPLLQASLSVIAPLGHLIEFGKKEIETNSLVALECFSRGISLASLDVPTLLRRRGPDIHRILGEVTRLVDQRALKPVQPRRCAPTQHVQDAFRFLQTGAHMGKVVLPAGPEEVVPVVPRPKGITPRPRLRSDASYLVVGGVGGIGRSIAHWLVDHGAQNRILLSRSAGDLDLAQNQNAEGALFVRELRAAGCRVKPVSCDIALASSLAKARRACEDEGLPPVRGVIQGAMLLRDAIFEQMTLADWKSGLAPKLNGSWNLHTAFSTRGGLDFFVMLSSVSGVIGIASQTNYAAGGSYEDALARWRQARGLPGVSIDLGPISDIGYVSQKAMXPNAAQGRKLPMLDK

SEQ ID NO: 35195 - protein, 265 aa, A.fumigatus
ILLRAPNAACCYRFGRAAAPSSSSASTPSLARSGIPPAAPSSDVMRDSCTCGRAGRRRRMAKRPMAAPTAAVSRWRHSLRGRPPRQEAASLIGAAIASKLADIFMAPVTEIDLSKPPAHFGVDSLIAVELRNMLVLQAAADISIFNLLQTPSLAALAASVAEKSRHVHAAAYTHVLGPGCILTRFLSSYEPMLGRDEEAEYPGMAQARRKEQFNCGAGHSTYFCALCFILFLIGYILRVEGSSTLGRSEFTRPHCSSMDNSIKYR

SEQ ID NO: 35196 - protein, 139 aa, A.fumigatus
IRPRRPPVLNVAPSHWSFPRTSRRRDLLQVLWESLPAEAQSKTHAQKKVSDIKTTETGVVVSCTDGTSHEGSMVIGADGAYSVVRKHIQLMALREQPAAKEERPFLTTYRAFWMLMPLIPGLKVGDAYETHGPTITIQF

SEQ ID NO: 35197 - protein, 190 aa, A.fumigatus
PFPPRGASNYVAKTINPRSRHTPLDKVKVVIIGQDPYHNHNQAHGLAFSVRPPTPAPPSLVNIYTGIKNDYPTFQPPPNKGGLLIPWAERGVLMLNTCLTVRAHQAASHSNKGWERFTQKAIDTVARVRTNGVVFLAWGSPAGKRVAGINRQKHCVLQSVHPSPLSAHRGFVSPASLLRHHSTHYRALVY

SEQ ID NO: 35198 - protein, 99 aa, A.fumigatus
FNNGHFKKCNEWLAKRYGPDGIIDWSLTPKTTGGSLAAVSDQAPMIDQVKTSTSKVLDSNSSEESKVASDKRLDADGLLDEFDDDVDALEVLAAAEAAT

SEQ ID NO: 35199 - protein, 193 aa, A.fumigatus
HFFFFWNLLYYSRSTTPSSFSSCRYQQSSSVHNTQRERVMASPTGLKRTANHLSTPACDAKKPRANGSITSFFGAPKPKHGDTKTLTISSSSSNFNKDKWVASLTPEQQELLRLEIDTLHESWLSRLKEELVTPEFLGLKRFLKKEKESGAKIFPPENEIYSWYNPSHFLHEARRTMLLKRSTPGLDIRPWIK

SEQ ID NO: 35200 - protein, 60 aa, A.fumigatus
PWGTIGQRIEIERLRREIRYTRKSRQLIKDDQLLYILTGLADFRQLRTSRPKTNAPTTKQ

SEQ ID NO: 35201 - protein, 82 aa, A.fumigatus
AVWICGCSESLAAAFQSRFAVLLFPTVSDMASKQGGKFRPTLGFQQDLEDLISCYNLIIPLHVLSIVLPCSDILYICPNLME

SEQ ID NO: 35202 - protein, 81 aa, A.fumigatus
PCYSFSGTLAALTTIGVTATTEMTSSASMISSTTTGGPSPAASTVAAETNTSAPLEPNQLGSRPESSQALQLAVSSVWLPS

SEQ ID NO: 35203 - protein, 95 aa, A.fumigatus
ESCTDHTWRSSACPLFCINLDPLNLNNLAGGQGIKKCPNTDLDMYYCIDYNMGNANYSAQQQVLIFKGMSQPYIGILAGDPIADLVIPSQVHLPL

SEQ ID NO: 35204 - protein, 375 aa, A.fumigatus
SFHPRGEDSKPPTNRIRPMTSTLYKPHPTEQMKAAQWMGTRLIQLDTVAKPTITDPADAIIHITHCTIGGADLHLYDGELSDMLAQGDILGHEAIGTVEDAGEAVRSISPGDRVMILPVIACGHCEFCKRQEFSLCDTTNPSREMESAYGHRVAGMLGFTRLYGGYPGAQAEYVRVQHADFCCVRVPADMDAKELLGLAHVTTAAWHGCELADVQPGDTVGVWGCGPVGLSVQRLAVLRGATKVYAVDKDAGRLQIAEGFGMIPVDVGVHSEVGDYILSMEPRGLDCAVEASGFRSTQKPQHAAMRAIGLEHDSSDTVSAMIKATRKGGHLALLGDFFYRTNDFPIGPLMEKGLTIRGGQVNSQKAFTVADMRVN

SEQ ID NO: 35205 - protein, 135 aa, A.fumigatus
TAMWNATSPTARGPHGLPPNLSPPPSSPSTAWPPASTTANKPTKASKPSATHRATSPSSAPTATPRASAAPQSSSPCPPSRRISSCNASSSPSPPTPSSSRPMKPAPRCTSAPCSSGRPRSWASPRQTHIPLWCL

SEQ ID NO: 35206 - protein, 142 aa, A.fumigatus
SPADTASSARGRSSRCATRRIPRARWRARTDTGWRACWGSHGCTAGIPERRRSTCGSSTRTSAASGCRRTWTRRSCWGWRMSPPLRGMGASWRTSSRGIPWVFGGVGPSGYRCSGWRSCAGRRRCTPLTRTRVACRLPKGLG

SEQ ID NO: 35207 - protein, 168 aa, A.fumigatus
HHLIISHLHLYTSATQFIYTMSFPPPPVDTIDWSNVGFKVRDGKLPFPPSPTSAPTSSRQLTSPSKRPCGMPLLPQHGGHMVSPQICLLPLPPPPRHGPRPQLRPTSLRRPQSLPPPIGPHLHLPPRPQRRAPPPLRRVRLHAPRPGGSLPAMRQARRRRQRRVRPAP

SEQ ID NO: 35208 - protein, 233 aa, A.fumigatus
QDQTNDKHALQAPSHRADESRAVDGHALDPARHRRQTHHHGPRGRHHPHHPLHHRRRRPPPLRRGTERHARPGRHPRPRGDRHRRGRRRSGPQHLPGRPRHDPPRDRLRTLRVLQEAGVLAVRHDESLARDGERVRTPGGGHAGVHTAVRRVSRSAGGVRAGPARGLLLRPGAGGHGREGAAGAGACHHRCVAWVRAGGRPAGGYRGCLGVWARRAIGAAAGGPARGDEGVRR

SEQ ID NO: 35209 - protein, 360 aa, A.fumigatus
  UNSURE (152): Identity of amino acid sequences at the above locations are unknown.
HHLVNGHVECHFSHSTGATWSPPKFVSSPFLPLHGMAPGLNYGQQAYEGLKAFRHPSGHISIFRPDRNAARLRRSAEFVSMPPVPEDLFLQCVKLAVAANAEFVPPHETGAAMYIRPLLFGSSAQLGLSPPDAYTFVVFVMPTGVYHGVHAXDALILEDFDRAAPQGTGSAKVGGNYAPVLRHSARAAAEGFGITLHLDSRTRSEIDEFSTSAFIGVRRDGDKVTLVQPDSTNVIDSVTARSVCEIGERLFGFAVEKRRIGYDEIKEFHEVIAAGTAAALVPIRSITMRSRGEKFTFDCGADGQSGGEICIKLLQTLKGIQAGKIEDPFGWNCLVDQAPPAAWLEGATGQEGDTEGIGVP

SEQ ID NO: 35210 - protein, 102 aa, A.fumigatus
QGGIVTYSVWSMHRREDIYGPDANEFRPERWADLRPGWEYLPFNGGPRICVGQQYALTEAGYVTVRLAQQFAVLESRDPGPWEENLTLTLCSRNGTKVSLRN

SEQ ID NO: 35211 - protein, 402 aa, A.fumigatus
  UNSURE (254): Identity of amino acid sequences at the above locations are unknown.
FSRSQSFLRHVSTFDFSTFDDALLVCMNNHERFQRRDSLATATILWHTDPLGVTLLPRCAFKPCRRRGLIHETIPPKRILDLPGLDPLEGLQQFDTDLAPTLPIRAAVERKLLPARPHRDTPDRDQRRRRARRNHLVKLLDLIVANASLLDREAKESLPNLTHRPRRHRINHVRTVRLHQRDLVSIPPHPDKRRRRELIDLRPRPTIQVQGDAEPLRRGARAMPQHRRIVAPDLRRPGALGRGAVKVFQDQGIXGMHAVVNAGRHHKHHKGICVWRGEAQLRGRPEEQGADVHRGAGFMGRDELGVGGDGELDALQEEILRDGGHGDELCGAAEARGVAVGAEDGDVARWVAEGFEAFVGLLAVVEAGGHAVEGEEGGGDKFGGRPCGPRAVGEVAFHMAVY

SEQ ID NO: 35212 - protein, 199 aa, A.fumigatus
SPTSECTPTSTGIIPNPSAICKRPASLSTAYTFVAPRRTASRCTDSPTGPHPQTPTVSPGWTSASSHPCHAAVVTCASPSSSFASMSAGTRTQQKSACWTRTYSACAPGYPPYSRVNPSMPATRCPYALSISREGFVVSHSENSCLLQNSQCPQAITGRIMTRSPGEMLRTASPASSTVPIASWPRMSPWASMSLSSPS

SEQ ID NO: 35213 - protein, 81 aa, A.fumigatus
VKMRDDEMMSRQKDDDRMRGDLFIPPTVDELGQAGNNTTHPRWHARVPYPSHLMDMFMSTPNSYTVSYLVSSFTNAAEVRP

SEQ ID NO: 35214 - protein, 120 aa, A.fumigatus
SSPTPYRCCHAPAQSPASPHAAVSAYSETHSPRPRSPTLGAPSTGYSPRPRNARRHPPESSQTLRQSASDPRPCQRRTPSSPRAGPPAAAPIARRAHTPKHPRYPPAGRPPARTHATQRW

SEQ ID NO: 35215 - protein, 161 aa, A.fumigatus
LLVRITAHPDLDFLVVVNPNSGPGDLPSPNKDYAREVPKLNAFPNVYTVGYIRIHYCDKPLEKVYQEIDRYASWSACDGLGLGGILLDETPNHYSEAREEYLRACTGFIKGNQGILRDRMVSSLLFFFYFSSFLIFSFLQLSFFLSFYLGFSFHGMAANRG

SEQ ID NO: 35216 - protein, 325 aa, A.fumigatus
SSLYPSMTSSSRSARSPSASPRIFSEVPTPDSEADGLDTLTPVRDGEEYVLVTGGLGFIGSHTCLELLKAGYNVLIVDDLSNSYRHVFSRILLAAKLHCDRTDGHCPKATLYDVDYRDTSAMRKLLDAYQRDPSTRQSRIIGVIHFAAFKQVEESIHTPLKYYRNNINGLVDLLVLLDQYRITTFIFSSSANVYGTLAEHRPLLHEDACTHQPDPGQRFGAFRPAEIHNSQITNPYGRTKLFGEAILADLARANPAWTMVALRYFNPNRLGRVGPPRAKPQGSTPGTSSPPLGRNLTWSTNRSSSSTGVTGKTPDGTPRPGILSP

SEQ ID NO: 35217 - protein, 110 aa, A.fumigatus
VVHNPGTPPDAGLANTCPDLILTCEEPYERYRSDEVQHRLAELPYDRVRCGYMINAVPVGELTGLVRELRDRATYVFATEVEGDFYERFGPTSWKQLMHALKRDSDSETV

SEQ ID NO: 35218 - protein, 148 aa, A.fumigatus
STTATTSTGSSTSSSCSTSTASPPSSSPRPPTSTAHSPSTGPSSTKTHAPTSQTPGSDSVRFAPRRSTTPRSPTPTAAPNSSAKPSSRTWRARTPPGPWSPYATSTPIGWDASGLLGQNPKGPPLEPRPRPWGETSLGRRTEAPHLRE

SEQ ID NO: 35219 - protein, 233 aa, A.fumigatus
PDGRPLSQGDAVRRRLPRHVRHAEAPRRLSAGPIDTAIEDHRSHPLRRLQAGRREHPHPSEVLPQQHQRARRPPRPARPVPHHHLHLLLVRQRLRHTRRAPAPPPRRRMHPPARPRAAIRCVSPRGDPQLPDHQPLRPHQTLRRSHPRGPGAREPRLDHGRPTLLQPQSAGTRRASSGKTPRVHPWNLVPALGEKPHLVDEPKLLIYGSDWEDPGRDPPAGDFIPVTDGRAGP

SEQ ID NO: 35220 - protein, 186 aa, A.fumigatus
ACLTSTEPSTRTPPTSIYLGADGHHFSLRIALTKMETDWWIELESTYKTRIAQRKELYAKHGSSVLGYLPGSELACKELMEMVLQFLCARYPQYFSLESKRIFKNKILDTEQDIKAKHPLEVLLDNVPEDFAIMLRDEETGFYFLRAAVICSALGWNVGLKIGLQLHQIHGPIPDYKEKMQFSMDR

SEQ ID NO: 35221 - protein, 73 aa, A.fumigatus
RTSGGVGIRRSIMNHGSAIRVDLTKICTFVNGGLDAVQTATTCKASEGGDVAGDVNTGYDEDFDEFRPAFIDG

SEQ ID NO: 35222 - protein, 203 aa, A.fumigatus
DFSSIKSMGRSRTIRKRCSSLWIGRSRKLREWQAQEVTDKSSSRFFAKMPTDKPIQRGSWGLEVGQPLYMPPGDPHEKLRLSQDPSLQLADCNLRVDWQTLRRLPLSAAVVFNFKALFTPVSEFRDEPCIPALVAKILKEGKENLMKYKNTWHVEHVVLPKLEEWAKEQEDKGLVDKNWQVATLDESPWFRNWEDKWHRQQGF

SEQ ID NO: 35223 - protein, 426 aa, A.fumigatus
HASRNNVSKNLCQVSQNPLLFAQSYCLNSRAESREYIRMSYWETIKQVRKSTDVPYLFQPTYPSTLQPSYSHPKIVCTISAVDYLYCRISSEQQRPGKMSQLEQLPMELLLGISDYLDPLSVASLGQTSRRLNGTLQRPLARAARQHALADEAEYKKRIRFREDGKGILTRKRTHGVPSQPLVQAIKRGQLNKVRNYLEAGVDPNAYDLDGCRMLSLAVRANDEPIVDLLLEHGANPALNDVCAPYASPVCDATKMSNEMVKKLISIGADYTQVSVIHDLAGRCSLDVIKLAVDKGADFGQTRTYGMTAIHQAAKNTDHPDVLQFLVGRYPELISSQSAGTFFWSAIYKGRPELVKILIIAGVDIAGDITALASLASRCSLDSVQAAIDKGADFSQINPDGRTMIHYAATNTDPPRGPSIPYWKVP

SEQ ID NO: 35224 - protein, 588 aa, A.fumigatus
NWPCKEFPINHAGIRMPRKKAADRVGPVKTRTRSGCKECRASRVRCDTQKPICSRCRDRGLVCSTELVLKWESEFLSRGLAFGRAGVWSKSRPAGTGSRASASLSVKENEWCEYPPVESWGFVNSGVSTFENPHQVNVACDELNGLVVRARDRELVYGGVASPSSVVVADDGWIAREVSSPPASLSLFPNIPESKSHLFDYYLQQVCPRTTASSKLASPFASVILPFCLSASPTLFKAIQALGACHWSRFDPSYSVVGLRLKSEALRGLRHRLATEGSSTCSGDPEVLVIMMMLCLYEIVDNCDQRWTIHLKGAKELIRARRQEQGALARSRKAQDPVSAFAELFFAFQDVMGRTACGEEVLFGTDYWEDSEQKIDLWMGCSPELVSILSSITELSRTRRQLTSDSARAAFALRAASLGRRLETLVQEIDDEEDEMLKSAAELKRLAAVLYLHCALYGSSPSTPLVIGYVKRILRLVSELLDSRSLVSMTWPVFVAAVELDPARDELWSDPTTKTVVYGRSLVLRALAAMAESSVSNVARTRAVIIKVWQARDSDMLKGSPVDAADNHASCNDWEWYVAPVSTAMSLA

SEQ ID NO: 35225 - protein, 293 aa, A.fumigatus
YTDFGDSRTYLHLAAQWSGNDTPQANKHKTDSVTFYYRRFKLHDVSSNLIIERDLESRRAFKSTSMSNLTSSTPPSTLSHSLPAPPYASRLSEQLSQSKEQSEPSTDTDSTGDKASCLGTPLRPSQKSRSLSDAPKPVSASPSISGDTRPSSKDDNSITSTPETPRRSSMHCPNLSLNLPSKLAGSTSVPNRAPLSPKLDSSHIYGSPGSVLPRRSRGLDFSRACTNLHHSIIAESSLDSSPTVGGRGVTIPQRRGSPGSTSMGPFLNIRPCRPNRDFELRVQREHDGVGYKQ

SEQ ID NO: 35226 - protein, 158 aa, A.fumigatus
LSSPASSSSASPQPGVLSSGPSAVSCTPPATVPSALVSQPPLIGPGTSSSPSSLPSSPAPSTLLMVMYSPPAASPPSLLSSSLSTRLRAALSRRSTRCTSCTSSRGRAAAGCRPRVSSEICTPLPRRIRSRTVRVRSSTTSPLRSGSKHLVSTHVQYF

SEQ ID NO: 35227 - protein, 256 aa, A.fumigatus
SAPRQVRGAMVSAFQLFVAFGIFISYLINYGTETIESTASWRITMGIGFTWPLILGLGTLFLPESPRFAYRHGRIDEARKTMSKLYGVGPNHRVVVQEMKEMKDKLDEEKAAGVAAWHEIFTGPRMFYRTVLGIALQSLQQLTGANFIFYYGNSIFTSTGLNNSYVTQIILGAVNFGMTLAGSVRCRALWPPEHSDGRCWLDVHLFHDLGLSRPLCSRPGGSLPHSPGRCCYDCLHLLLHRRLRHNLGSYRLGHLR

SEQ ID NO: 35228 - protein, 201 aa, A.fumigatus
PLPGLYVVEHFGRRNILMVGAGWMFICFMIWASVGHFALDLADPSHTPQAGAAMIVFTCFFIVGFATTWGPIVWAICGELYPARYRAICIGIATASNWTWNFLISFFTPFISSSIDFAYGYVFAACCFAAVLVVFFFVNETQGRTLEEVDTMYVLHVKPWQSSSWVPPEGIIRDLHPAPEENQKQDGQGQVEHNEPTEIRE

SEQ ID NO: 35229 - protein, 298 aa, A.fumigatus
RLARIHVAQPVGGVREAFIPEAVKNLKKYDKNDPNRKKLERDIEEENGGAGVYNIDLKKNYTLADDEWKHDKIPEVWNGKNIYDFVDPDIEQKLAALEEEEEKLEAEGFYDSDESVEDAEDADTRMKADLIREKRALMRNEAKLRKSLKNRAAIPRSAKAKKLSQMEQALDAAGYDVDAAAARARSQSQARGRTTTRSEIDTGDAMEIDGLDPRQAIARAKSRARSQAATNRLVDGVTDTTARSKAERLLKLGQKKMNRMARAGEADRHTTASLPKHLVRLTPPFLSSFLLSVIPRIY

SEQ ID NO: 35230 - protein, 66 aa, A.fumigatus
QRRKTMQQMIYGYKGDTLIIAQYEIHKVFRKSNCQDWKTRAKSKLSSGSKHAAKVNRKDEGTGTQL

SEQ ID NO: 35231 - protein, 133 aa, A.fumigatus
HVFHRLCALTEIMFLRSVSRAAARSSVMPATTTRSYRTVPSPIACLNARPQPQQKSIASQQTRASSEHAISNPTLAGIEKRWEAMPPQEQAELWMQLRDRMKVDWHQMTLQEKKAGMYLSLARMPDIPQWPEF

SEQ ID NO: 35232 - protein, 146 aa, A.fumigatus
SETLAYWIAFGPHGPRAVPPKGESMRIFFKVAQLNLVSLALFYVIHLFAKPKPKTMTKEWQEATNEYAKVRIYSCYGKPLRGSFLNSCVVKYLLTWFYNSVRKSTLSTVSAVRATRARASFRALLPRSKLGDKYLGGTGAAFRHAG

SEQ ID NO: 35233 - protein, 139 aa, A.fumigatus
PNRLRIHTDGRLFCYSVSIADECITAFNDFRMSGNKANKTKFIIFKIADNKKEVVIDEVSQEEDYEVFRSRLEAAKDSKGNPAPRYAVYDVEYDLGGGEGKRYDCLLRSEIRWASVADRICRSKIVFISWVPSDTPTLV

SEQ ID NO: 35234 - protein, 64 aa, A.fumigatus
ETRSVLHFLRKTDSDISVADYQHRQEELSCTSIGGNLMHGTCKSPCCRPQINSKMESLVLCSFD

SEQ ID NO: 35235 - protein, 203 aa, A.fumigatus
TSTPDKEQHYSGGADPANREAVWLSGYSTSATLYSWIASTNKIRKLAISKDSAYITSKVFPVTSSHSTANIDRTTRSTMIPILSLCARAQSLALKSLPSSVTRDPRAVPTPSLSAARATPPAPPLSRCILALLSPWTRAEISPCQWYPACPEFSCPRHGSVGVASAATLSPPRRPPPVPPRAQQRQEQHAQLPQPFRFSSRSS

SEQ ID NO: 35236 - protein, 224 aa, A.fumigatus
NNPFYYDSNTLAMRKGSVAGSQVITVLSNKGSSGSSYTLSLSGTGYSAGATLVEMYTCTTLTVDSSGNLAVPMVSGLPRVFVPSSWVSGSGLCGDSISTTATAPSATTSATATRTACAAATAIPILFEELVTTTYGESIYLTGSISQLGNWDTSSAIALSASKYTSSNPEWYVTVTLPVGTSFEYKFVKKGSDGSIAWESDPNRSYTVPTGCAGTTVTVSDTWR

SEQ ID NO: 35237 - protein, 109 aa, A.fumigatus
SGHSSGIRAGFTVKVVLVWLEILMRAEYEIQKLSLCDIQIDIMYCLMAVTACLSSSNLRSSSMPFICMLPGGRSTHVLNKTLTIHISFIDILIGHYLLGYGEQACPRIR

SEQ ID NO: 35238 - protein, 60 aa, A.fumigatus
AQPSWSFREIILASSLQKHLLLAEDQAITALDFSAIHKAVTSALLGCEVRYGEPYAGDMV

SEQ ID NO: 35239 - protein, 96 aa, A.fumigatus
AVAIDRNTGFQGCIDVLVKNIYVLMIRMNYLVSPKLFRTPISTKCIQNQVYNYLSKRGLAASSLLGLYYSKHITTTPPPSERFIPNYTNPKVAIKD

SEQ ID NO: 35240 - protein, 76 aa, A.fumigatus
PGFGAPLCFPHRVREDDWYRGMLIPKDSIIIIPTWALHRDENVYPDPETYNPDRFLQHPGLAADYAGKGDPMKRDE

SEQ ID NO: 35241 - protein, 71 aa, A.fumigatus
PSVDWIFLEQLLYMFSISNLLCILSLLDHVLLFLFLSSFIAFDLNAPIVSSLVEWKYYTLQPYTCYIVTIS

SEQ ID NO: 35242 - protein, 508 aa, A.fumigatus
PLIALAEVADFSPWMGNHPEDVLNEQTAKQGYYDRTQVSQNESNTARPSLYAQLKHRSGLQILSSVFAAALEKRQGHNMVTAPSTFKPPPRVTLTDNKREAWLRDLANPNVPLRKLSRTIPHGIRGRVLLDQCLTKWVPVGRAVWLAKCVGANEIRAFKRKGTSGALTIGLEAKWVRDWTANVQQFLEGVITSCGVADWKMKMTYAVNLTSRLFFEQLLDHDQYLEWFLTSLEAAPFNTLPVWLLMLGIYWSNILRYRKRGRRLAELLLDKLQLVIKSDSAPSLRPLTDRLSLHIRKLTLEHTSSMVLPQSWEKYKDLLSSCLNLNDNVHRTVFQNLAERNARVQKPPKCEGTTQQPPQQRVIQLFDSICSSHDITSVSAASLRAIDDKAALVLKLLEWAATPFRYGVSRVYTGARLLRKWKIAGVDVDTCIISFLGESQMSDQLNMDNVYHIVSELVRSQTFSVGKYLQWLMAKGVADFSRSSDHQPLSGDLALLVQLPVSRLPEHV

SEQ ID NO: 35243 - protein, 74 aa, A.fumigatus
SIVITQFYLSSGTWISVIVFPLHLYGESACQLLIVVSAYSANHSTTQHFLKNSGYQAIALAPRFQVPTRQWPNL

SEQ ID NO: 35244 - protein, 94 aa, A.fumigatus
SIIRVASGVGEERVGWWLVPGDDFAGSCCSFFGGLLRVTSCCRRMLILTVSYINNSRKIIGVAFSDINNVDDFYFRIASDIFKLSCLRSGHIGY

SEQ ID NO: 35245 - protein, 562 aa, A.fumigatus
KYTMSAHYTTEPPPTASANLHTTFGPIHIALFANQTPLTCKNFLQHCLDNYYAGTIFHRIVPDFIVQGGDPTGTGSGGTSIYEYPEFEYDPEARDPNEKVVLRDELHSRLRFNRRGLVGMAKSEDGTYGSQFFITLANAERELNGQCTLFGRVEGDSIYNVLKIAEAERVEGTERPVYPVKVVSCEVGELGPFAGKLKRRETIATAPAAEEKPAAKKKKKAKGGKTLLSFGGDEGDEDVLLRPSKPKFNPTLVVDAGIPPANDAPKKTSPEAEQQTRKRLRSPSPRRSLSAERKHRPKTPDPLTQLPLPDPESPARSPPQSPPARQSILSRTRAEIENLKASMRRTVATGPADTGRKKSALEAMIPETAIRGRKRPPPGTVNGAGRGSSTNGVTGFSSAAEDETLRMFNAFKAKLESADAKSGPHGKTSISASDTTKYTSQAKSNTEPEDEEAQLCDLHFIANCQSCKSWDDTGTAEEAPDDDDRDWLTHELRFGKDMLGKDLQWKREHPDDVDSLVVIDPREREKEFVGGKRRGLERDRERDRKRERVGDQEWDRRRREKP

SEQ ID NO: 35246 - protein, 195 aa, A.fumigatus
LAGSDSIYFNWARRFILSEAVAAVELKPLICVRELRSQKPTSISLQTSSIYPRNTPCQRIIPPSPRPPHPRTCTPPSAPSTSPSLPTKPLSHARTSSNTAWTTTTPGQSSTASSRTSSCRAAIPPAQAQAAPPSTSTPNSNTTRKRATRTRRSCCGMSCIADCASTAAGWWGWRRARTGHTGASSSSRWRTRSGS

SEQ ID NO: 35247 - protein, 286 aa, A.fumigatus
PQANMQLKSSAVRLLFCSLVSAAPSQPSNACKAPGGPPQINSLSTLLVLKYNNLGSENNGTAAVLIYDRVDYGQAQAQCAAIGASLYSLQHATDTNRTELQHQFNYLIQNGDLQRSDHVWVAKLSSRDCSAYSLSRKETVSIPCHLQLPALCTSKVPPTTDTNRAVVESSKISVMYQGYTLTGYRDARSFRFLGVPFANPPVKDLRFAPPQPYSGPKTLDATKFSASCVQSVSSFGTLGNSGGISEDCLYLNIYTPVLPAHGAHNSLRKPVAVYFYGSAFTKGVRP

SEQ ID NO: 35248 - protein, 614 aa, A.fumigatus
QSAAQKMQCYTELLSPSGVTHALAIPFLSASAENLVVVKTSVLQIFSLLKVQHHSRGETIETKSARPDQVETTKLVLEREYPLSGTVVDICRVKILNSKSGGEALLLAFRNAKLSLVEWDPERHGISTISIHYYERDDLTRSPWVPDLSSCGSILSVDPSSRCAVFNFGIRNLAILPFHQPGDDLAMDDYEFHLHQDDLNQVSDHVGNGLKSKDSTVYQTPYASSFVLPLTALDPSILHPVSLAFLYEYREPTFGILYSQIATSHALLSERKDSIFYTVFTLDLEQRASTTLLSVPKLPSDLFKVVALPPPVGGALLIGSNELVHVDQAGKTNAVGVNEFARQVSAFSMVDQSDLALRLEGCVVEHISDSTGDLLLVLSSGNMVLVHFQLDGRSVSGISLRPLPTQAGGTIMKSAASSSAFLGSGRVFFGSEDADSVLLSWSSMPNPKKSRPRMSNVAEDREEASDDSQSEEDAYEDDLYTAEPETPALGRRPSAETTGVGAYIFQTLDRLPNIGPLRDITLGKPASTVENTGRLIKNACSELELVAAQGSGRNGGLVLMKREIEPDVTASFDAQSVQEVWTAVVALGSGAPLVLDEQQINQEYRQYVILSKPE

SEQ ID NO: 35249 - protein, 74 aa, A.fumigatus
TTLAHAWVWLVYRTMGIILRNYSNAFRDSTLTSNAAGYLQSTISSRDFRSVYLNSLPDTRPNQVTWPTEYIRLR

SEQ ID NO: 35250 - protein, 99 aa, A.fumigatus
FLFQVFSVRAEFGFSAQHGIGGCPKPAWMGGPRSIKTGVMIHKGISEVNMGKQILVGEIPFFKGVDGDLHALEQKVHEIEWGVVIEGVQLAINEIRARQ

SEQ ID NO: 35251 - protein, 240 aa, A.fumigatus
RVCDPSCRYCSAFPNAGESPEKERWVIDPGVLFCFKVSSGAFAEKQSDPSPADDGPHEEENSPLLRPDNDTSTASRPVAAPETVDEKTGLEYYVYMFRHRRFVTGVLGYFVFAILISSFDTTLPLHVRDAFDWDSMPAGLMFLALQGPGIALSPLVGWLKDRVGTQIPTTIGFLGLAPLMWLLGVPGDERFPWANQGQRGPIIYAMDVTAVGIVSVLLNGVGVLEATGKSVTHRSAVCNS

SEQ ID NO: 35252 - protein, 214 aa, A.fumigatus
  UNSURE (211): Identity of amino acid sequences at the above locations are unknown.
SYLHTMPPRRILIVGAGIAGIASALAISKELTPYVPDLKITVFERHDVLSTSGGAINLTPVAQRHLDQLGVLAELDRLGDEGGADVDAIQFFSCRSGKSLGSIDFTRDQGQGFSGYKARRVMRIILSVAMLAVVERTRNIEIVFGKKLARGRRDRRRSHPVLSGRHHRRWEISSWAAMACTPPHARGGIATRLSVPSTRGFSFLAGAFLKXKDA

SEQ ID NO: 35253 - protein, 98 aa, A.fumigatus
LRFSLAIVYKWWQNLQLIACFLCRADFLPGQYFDIRLEVHSPINGSEARAGVPDPDFKFTIARKGRKPVPVTKYFDIEEPELERWNFTWYEGMVLTSC

SEQ ID NO: 35254 - protein, 364 aa, A.fumigatus
LDLFAEDANAPSLVNVTSKAYRRVALYEPGEYEATLTYYGNQTTTANWLVRDLPKKRRAKNVILFVGDGMTTNMITAARLIAHRSINGKYMTKMQLDKFPVLGHQMTHSMDSFITDSANSATALYAGHKTTVNALNVYVDSSEDPFDDPKFENIAEIIRRRYPGAGIGIVSTAFLADATPAALAAHTSDRGEYEHVIDAYYEGLTKYEWTSLEGPDVIFGAGAENFLKSKDASRDYYGLFAEKGYSISWNNTALHAAPNDTKALGVFQISNLATWLDRNVYQSNLQNKTNYPDGSGRDAEDLPGLKDMTLKAIDVLNARHRKDGWFLMSEAASIDKQMHTLDYDRSLGELLELDDTVRATIDKL

SEQ ID NO: 35255 - protein, 106 aa, A.fumigatus
NNLGFFRIIDLCFSSGDSIPFLTMDQQPPVQPQQRPPPSLTNPRFTLELEFVSSLANPYYLSHLAVTYPNLLGISKSSDDSNTSTEGPDPEAQAFAGLHHGAGSIR

SEQ ID NO: 35256 - protein, 333 aa, A.fumigatus
  UNSURE (255): Identity of amino acid sequences at the above locations are unknown.
YAYRGSFDPRGEDESMWNVQLQTLWKTVEGSQKFLPVAPGRHIVMETGQWVELDSATWKPRRPVHIVLLNDHLLVAAKKRKRVDASNHRGPVPTKLVAEECWPLQDVDMIDLGANMGTGAAREEAEERGIANAINVRVGSKTFTYRHDKRDSSDKGELLATFRKAVEDLRRTLRSESDTAIKPTDGFGYAGVKHSVSQKLDLNASDASRDKPEVRIDVDGKQQNLRWVDGQVDELDIDIALQRFEEAVSGIERLXKLARGLKGNSYAQQIINSKVDERAARLASVLSRALADTHSFLNATKTNVTWLTRLGFEDQAREAYLKARSDVISKRVR

SEQ ID NO: 35257 - protein, 63 aa, A.fumigatus
DAVFHPRREDLRFVGNAIQYIGFIGEGSEAIGGTRGAYLNARYESPGKKPTGRFASIFGAKPL

SEQ ID NO: 35258 - protein, 237 aa, A.fumigatus
TYGKGVDISLVGLDPATVRSISGLLERLAVKASPRLILALRPQDNLPDWITHILLLGNSNQILFQGTRSEADKVMHVWKHLPKKAKRFSTLSEEEHKILDNARKDMESGILDQQLLWDLNLIKTSSGRSTAVATHGGEPLIEMEGVRVQYGDKVVLGGWKQTVSDQKKEGLHWTVRRGQRWVVLGANGSGKTTLLSLITSDHPQTYALPIKVFGRSRLPEAGKPGISIFELQSRLGH

SEQ ID NO: 35259 - protein, 284 aa, A.fumigatus
SHEIHAFFPRQLSIRQAIESAFAETFLAKPTLDHERDLDVSAALRFFKAELDPDAAVTTQQEPPAVNFRAMDLFPKIEQLKFTKKNRDFVPTDYDVEYADSVRFGELSTAQQRLVLFIRALIHKPDIIILDEPFSNMSASLRDKCIHFLEAGEMRGNLKSPITKRAANPEATWLKGSNVNPSEVRHRGLSKDQALIMISHVKEEIPDSVRYYMRLPSDPGDGGEPLDFRFGVLQRGSVMSDPKIWDLAWSPPSAFDKAAKQVPQKLSSDKNRRHDENIYEWYTI

SEQ ID NO: 35260 - protein, 102 aa, A.fumigatus
ESREETDWTVRQYLRGQTSLNPLEGEEGGTVRNEELLTQVITDLRLGELLDMPVANLSNGQTRRARIAKALLSEPELLLLDEPFSKSLSTASEHMGRALTSP

SEQ ID NO: 35261 - protein, 172 aa, A.fumigatus
LELPILLSKSMVPCSICQPRNERLRPSHLWLLATIIMQIQTLGNKVNEIYTDFGQRVGMLVYNIDAFLPDSRASLYAAELPGEKGIESIQMVFGPLDAGTCQNSREALLVDVDCVFDQSEIDVGNLEYIEGKIALEDTCPISVSVSPKFKLGVLAMKTYRTRLEITSDRAFK

SEQ ID NO: 35262 - protein, 137 aa, A.fumigatus
LTRHLLQVETGLPAGWEVRHSNSKNLPYYFNPSTKESRWEPPSGTDTELLKVYMANYHSAPAGRPDGTAQGEGKIRCSHLLIKHRDSRRPSSWREAEITRSKEEAIEILRGHEQRIRSGEVSLGDIAVSESDCSSAR

SEQ ID NO: 35263 - protein, 97 aa, A.fumigatus
ISSNLLYPKEDRVNNRLMFTCRTCHVGEPATSYCVYQNKLNSQVGDTAGVTQDVGSDPTVCLPGFCAHCGEEITCFTCGQLPEDTLSDWDSEDSMNI

SEQ ID NO: 35264 - protein, 72 aa, A.fumigatus
YVVYILTMKMQGTMFVYPSEGSASSMMLMRNRFIEENNLYKIQQKQIQENQRMPPGMASQDLMAYWGTVTAP

SEQ ID NO: 35265 - protein, 67 aa, A.fumigatus
  UNSURE (14): Identity of amino acid sequences at the above locations are unknown.
NANSGYKFETLCLXQQPWDPTPRAEIESREDLVVNNNAQYCSVVRTGIGSTRLIIGGEVDAGMLSSL

SEQ ID NO: 35266 - protein, 133 aa, A.fumigatus
HPANWPLLWLKYHNPTSKGMSFSVLIRDKNLRNNPKQEITCFSYDAEHKFHLGDSSLRYYYTPRLPADLNRGFDTFQKLDDTADEHLDALLETIMALEKETGKRCEADIITWRGMMTKVSSSRLLFYPEGGDD

SEQ ID NO: 35267 - protein, 204 aa, A.fumigatus
LLVVKLMLVCSPHSSRMLLAILRGRTKACADAGVLVWDCKPDRKEDPINWVELKTSAEIRNDRDMIKYERKLLKFWAQSFLLGVPKIIVGFRDNHGIVHRLEELETASIPNKVKKLGRGTWDGNICINFAAAFLECKSEKNELECPFYVPSANGFKGLKSTIKEGGTWRIRKLEKSSLIQVFKIEETGTGDIISRSFLDWRSRS

SEQ ID NO: 35268 - protein, 77 aa, A.fumigatus
RDIEGAFEFVFFRLTFEECSREVDANVAIPRTPSKLLYLIGYTGRFKLFQTMDYPMIVAKTNNNLGNAKEERLRPEL

SEQ ID NO: 35269 - protein, 152 aa, A.fumigatus
LMQDLSFAGELRTFLLACRASYNSFVLYHNFRHAIDVLQSVFCFLVHIGALPPYGSVGPNTDSPSSIASLLTPFDTLTLLISAIGHDVGHPGVNNFFLVKLNAPLAQLYNDNSVLEAFHCAAFSQILRRHWPAAFKDRPLRIFTTGPATAHA

SEQ ID NO: 35270 - protein, 61 aa, A.fumigatus
HTYFNHLLTATIGDNDGTTDRVHNITYNVGICMPGQTNFTGFRNHFRMPSAQSGGVENFWY

SEQ ID NO: 35271 - protein, 127 aa, A.fumigatus
LPSQGRTLFTGFIVTPTTQKNGTYPMQLRLAYGGPHGMTVSWNTYSQLPHPTVCFGRSPKLLNRCVSSSASIIYTTSMINSNHVSIAELEADTLYYYLPQHSNATSPYTFKTSRQAGDQTPHTVATV

SEQ ID NO: 35272 - protein, 61 aa, A.fumigatus
LKEEIQGFLPNITIADGAKVYESLLNQNYVELAVITAQEPYMFGPGNHESNCMYLPLAYIF

SEQ ID NO: 35273 - protein, 65 aa, A.fumigatus
RICENCREVWEPLFWKYNVDLVLSGHANYYERNAPIANFNVHPNELNNRMPHGPLPTELQVIIMD

SEQ ID NO: 35274 - protein, 103 aa, A.fumigatus
LFVAKNCAFVEFAEPAGYAAAVAANPHQIGSEQIFVEERRPRGNAYGGNANYGAGRGGAGRGRGDRAGNQGRGGFQRDGRGGFAPRGRGGNVNGKPRNQPQAA

SEQ ID NO: 35275 - protein, 112 aa, A.fumigatus
DLINNLGTIARSGTKQFMEALSAGADISMIGQFGVGFYSAYLVADRVTVVSKNNDDEQYIWESAAGGTFTLTQDTEGEQLGRGTKIILHLKDEQTDYLNESRIKEVVRKHCL

SEQ ID NO: 35276 - protein, 132 aa, A.fumigatus
SIADALAVVKTSGAAAPVVPAIPVAPPKPTPAPAASQPSPAPAPSQPAPSSASTPTAAASEITPEQPTSTDSAGWQTAGHDHKKTQSRAAEEQNVLAYIKNVNEKVDASLLKQTLSRFGKLKYFDVSRQKVC

SEQ ID NO: 35277 - protein, 116 aa, A.fumigatus
QSVKQSESIFLISRSPSAIMSSETFEFQAEISQLLSLIINTVYSNKEIFLRELISNASDALDKIRYQSLSDPTKLDTGKDLRIDIIPDKENKTLTIRDTGIGMTKAVSLLRKPRLQ

SEQ ID NO: 35278 - protein, 138 aa, A.fumigatus
KENLRQTLLSSLRLVAGLAVHVSSTATGSKAATSVALEATTALVASTVTAATTRATTASTVVSIAAISVTARTTFLNEYLFGSDLVRVCSHGSGITGRLRKLNEGAVLCDKQSGQFELSSKRSKSTVNIPSGGSRQNT

SEQ ID NO: 35279 - protein, 102 aa, A.fumigatus
TYSLGHTNTGITNSEGLVLLVGDDVDAEVLARVELGRIRQGLVADLVESIGGVRDEFSQEDLLVGVDSVDDQREKLRDLSLEFKGFGRHDGGGRARYEKDGF

SEQ ID NO: 35280 - protein, 102 aa, A.fumigatus
PVRSTRHLKYSSVLAYGVQPSDISSTWRSFDDHLKRGIVFYLVKASTFSISSNNGEISIINITHPANAARSESTLGLLSTRKLCSPRPFLTGKPARHLLQPQ

SEQ ID NO: 35281 - protein, 844 aa, A.fumigatus
  UNSURE (839): Identity of amino acid sequences at the above locations are unknown.
IDGGCSLLPSIIVFFPHSFGFSRYQLAAMDVLDRLQSGLFFRPDVADITSTVIQPYILSNQVQPTSHYQKNASSSIPAATLTSIHSSTPEVSLPLLSVSADVDIHGRLCTTKVTQQFSNASSSTTQNARYVFPIYDGSVVTSFRCWIGNDRLLEGVVKAKEAARAEFKHAVSQRKVAVLVEELVPEIFETSVGNISAQTTVKIEITYTNLLKVDNSTGGLVLTIPTSIAPRYGAVPKGYSGNESLLTEGLRINVQASMPTAIRKMESRSHPISVEMGAVSHKRFTDFAASASSDTLDYSKGRATLSGRKAVLGQDFVLHILCSSREFSRSQAIAASQPGQPRLSTIAVTLHPSDLFGQNVHMEDFVGEIIFMADRSGSMSSKIPSLINVMNIFLRSLPEACSFNIASFGSQVTWLWPSSMRYSQTNLNVAAKHVESFQANYGGTEIYDALHSVLDHYNERNDVPTNVILLTDGEVWDVDNVIQLVHRTASNGNSNIRFFSLGIGDQVSHRLVEGIGQQGGGYAEVVPESSMGSWQERVIQMLKAALTPSRLQCNVDLGEELARKTSERQIAGYTVQYPQWVQAPHQIPVLSTFSHLSLYYIVESGLDSLPKTINITTTNERGEKLSAQLPIQTVAEQPAIHHLAAKALMNDFETGQSWLHSLNPILKSTNPTGFEKVLEQEAQHVGQTWSIPSKWTSYVAIDRTTAQQHAISVHKADAIEFSQLTRPRHTSIFPDPRISNKGDPFARGCLLSYPRREFLASTSRLSGEDTQPLSPSAPPAAGPYALDTFFEPTYAASPSSFLAGFDYHHNQPSQYQGQPPASPVTSQTAEVCPRSKNAXVVWYV

SEQ ID NO: 35282 - protein, 74 aa, A.fumigatus
RDTRANQTLNLSLPYFPTAQINVPRWLFYCESGTPWTPPQDGLGCLGRPHHVGTAIYQSKNAERTISFVPYGEM

SEQ ID NO: 35283 - protein, 70 aa, A.fumigatus
HLSFRRPHLWVLGIWDAWQWPQTTGQKGLPLAGECIKWPRQRVLVGLYKVPQIARGKPLTLLPFYSTHRY

SEQ ID NO: 35284 - protein, 129 aa, A.fumigatus
RSVLHPSPRSFSGVIGELTESCQDADGKEIIDFICMLSATNLGQCHPKLLQAMTTSMQTSKYRPHEPRRFTLEVPQFDPVGACKLTASTTSHSHQHRHQSGRLGGIHAGHVRPVRLRQDGRDGLRHRRR

SEQ ID NO: 35285 - protein, 263 aa, A.fumigatus
SWSVSTGKNGKLLGELLSRPWPILTTMGHLYNLTSRGASSCQEELSFAIGVRQLCKRYNILIIADEVRMGSGKTGKFLCSDWMGPENKPDMVVMGKSITGGAYPASYIFGNHEVMDLIGGYEPVATFGMAPAAIAATRATLEIIDEEKLVDRATWIGQVWKKETAGWSMPWLDYTTNRGADLGLYLKRTGNPRLTTRRLSMLCLHKGILTYPDGDRVRMGVALNIPEADLLRGMAILKEALLELDDYDEIETGPPMKGVIPEM

SEQ ID NO: 35286 - protein, 117 aa, A.fumigatus
RHQPQATLTNIATKVGDWAEFTRDMCARFGYDKMVGMVSGTEGADAAVKFARKWGIKRKGIPPRDVLVLGVSDNYHGVGSGIWPIMNDMGQASGKYIAFSVLTCSLTPALSLPTDQF

SEQ ID NO: 35287 - protein, 121 aa, A.fumigatus
SPSDCPRKASYSFAILFYPPLLITLHSCLHASRVPVNRFISYPTSATIMTREDQREGKVVRLSSKTKELLEIDSKHSAGGIFPLPVFIKSGKDSILKVCASSLAPFLFRCYWRADGELSGC

SEQ ID NO: 35288 - protein, 442 aa, A.fumigatus
PSYIDRVRVTIIHRRESTMTGNLQWLTNYGHDSLAAGVSFGMPWPKGLYQPGQSFVIEENGREYAIDSREIAYWADGSLKWTAHSVSGHVGYSEGYTVKGTSESKDTDAGVFIEEGDSLTVTTRRGLQVTFAREGTSSLFGSLSLRGHALCSGATLVASINDTEYSAIVKKVEVENASYSRAVIKISGTMAASDSEHLPFDVRVCIYSDAIPIKILHSFVHDLDADEPLASLGIRFSVPLENTELYNRHIRFAGSNGGILKEEVQGLSGLRHGPTVKNRIDQSAGRAVTLKQEEWSKTDLRQGLSYIPSFDSYTLSQLSSDGFTIKKRTKQGCSWVKVTGGGRADGTVYLGSARHGGIAVGMSDFWERYPTQLDLTGLAQREGAITVWLYSPLAEPLDTAPYHDGLGLDSYEKQLHALDVTYEDYEPGFASSPRRMERQRLN

SEQ ID NO: 35289 - protein, 108 aa, A.fumigatus
SPCGGGRRPGTNPSTSWTRSSRPRSSPCAASWPACRLSLLRWRRWYAAGGGTGQRPRCGPCGSATMAIPGRGKCRWPAGWVEPTAAQRGCGRPIRPTCSGTHGGHRSP

SEQ ID NO: 35290 - protein, 61 aa, A.fumigatus
LHFPGFSTTEKDGHPHGMGAEKNHKLLLGEAYKDWPSLASWRKGHATSISSRTKWPLTRKT

SEQ ID NO: 35291 - protein, 283 aa, A.fumigatus
WASPWGVFQTITTTYAAEVCPNVLRPYLTMLVSLAWSIGYLTGTCVLRGFLSMSGEWAYRTPFALQWALPIPLAIGIYLAPESPWWLIRKGRTEDAAQSLRRLRTNAASEEEIADTLAMMLHTVKIEDAMNASSSYWDLFRGVDRRRTEITVFTYLIQELCAPLVAYIVYFLEQSGLDPSSSFDFGIGEYALAIVGVFVAWCLVPRVGRRTLLLSGTCFMTATTILIGFLGIVSRKTHPKIGYGIGTILLIEYFVFFITIGPIIYTIVTEIPSYALRAQSVGF

SEQ ID NO: 35292 - protein, 471 aa, A.fumigatus
RLAVLGFLEKRSCDIYLFADKMAAHQEDVTDPTTVTVIREKDEEHYVVAEDIAKGAQKATDDEHAMGLREGLRKYPKAVFWSIWFSSALIMEGFDHSFVSGFMAFPAFQRRYGVLTTNGSYQIPANLQAAVSNGVNAGEIVGLLLNGLLCDWFGYRWLMMGSLFLMGCCIFLQFFATDIYMYIGAEVMMGLPLGCLPDDHHHICRRGMPQRAAALPDYAGLAGLEYRVPHGDLCPPWVPEHVGRMGLPHPLCAAVGSTHPAGHRHLPRPGIAMVADPQGPHRGRCPVPPPAAYQRRQRRRDSRHAGHDAAHGEDRGRDERVQLVLGFVPGRRPPPHGDHRLHLPHPGTVRPAGGVHSLFSRAVRPRSLVVLRLWYWRVCTRHRGGVCRVVSGPAGGSPHPPPVRNLLHDGDDYPDRLPGDRQPQDPSQDRVRDWHNPADRVLCVFHNDRSDHLHHCHRNPVIRSAGAERRV

SEQ ID NO: 35293 - protein, 427 aa, A.fumigatus
SFFSSPTKTIDITKHNKPDIKAFIVEELKRKGIFQGADEDSQRRKTMVEERLWVRSNNSYLTIQQDLRKVEEIITSGGTEEELHRVLHESSTDPKELVRAEIEGLEAMLKAREIEEINELLVWVIASDKSMLLVELEAALFLRFKTVSLQPLDKKITGKYSKIFTLIYGKYLALKDHVRDCVVAQRDRPRQSADDPKITATISITNGDLKLVQRFFWDLNHYSFLGGFAFEPTSDQTNVGQRKIQVYEADAHLEIVKRTFDILSQPVVDERGKALVPYLMRSLTTHLKALSEVTGLDELQPADKQFIGSHVYEMFNEGDVIERNWDFCYAVRWYERDDEMDIFWEWLDDPVAIAGLGPRDKRWLAELKKDKKHRNSGLLTPAMTMVARNWLQDTKWSTFRVFRWIRGFLRLVCSPCILLFAPGLDLC

SEQ ID NO: 35294 - protein, 98 aa, A.fumigatus
  UNSURE (86): Identity of amino acid sequences at the above locations are unknown.
RCERAVQEGAKVSRSAQNQLCSNLGRQAAEILQAQDPIDKEQLRDVFKTLAEFATDPDYALEYLKEAARLDAEDVEIPCAMLRQCXTSKNEDEARSMI

SEQ ID NO: 35295 - protein, 138 aa, A.fumigatus
MQGAEPQQEDRTTVAEQTGKSDTGSGRIIIYDNDSNVRKILKAEQWCKQLLGVTELDYTWCIRLGDTYADVREYDAASEQYKKVRKFLAPRRINCVLTWDDRLPKFSRLKTPSTRSSCETCSKPSLNLQPTPIMPWNI

SEQ ID NO: 35296 - protein, 183 aa, A.fumigatus
  UNSURE (176),(179),(180): Identity of amino acid sequences at the above locations are unknown.
PDMGSFVEDLWSSIFTPGPTPSLLIATNVTFAALQVLLLALLLATYSIHFVVLSILSAALWWSINWFAQELSQIQAQEAPKELHEDKERRGGSTKPPGSLESSDSDTETEVAKEKSKVTAATGVFTSAAPTAAASTSATLQPPTEPHARKRLSVSGESSGYVFTTGLEGSDAGSVXFHXXFNP

SEQ ID NO: 35297 - protein, 235 aa, A.fumigatus
TDLYKSCFGSVTFSCPFPSRPATSLVLRHNLIVLPSCPLCPYTQYKPGMANQDTALAKDVTPGGRVGFSHHEEDIMIDREPYGPPGLRGLISNPFVFLCAACSTLGGLVFGYDQGVVSVILVMDQFLERFPEVAPNAAGAGFWKGLMTAMIELGALLGALNQGWIADKISRRYSIVVAVIIFTIGSILQTAAVDYAMLTVARFIGGVGIGMLSMVAPLYISEISKWPGHTHSRQR

SEQ ID NO: 35298 - protein, 552 aa, A.fumigatus
  UNSURE (11),(12): Identity of amino acid sequences at the above locations are unknown.
LSNTRNLPGFXXYPPRRPDLQRNVLEMADCLPLVSPATTSPMYGSHNGSALSSPVSITPSHKRKVSDGHSRSGSVSSIDEATLSRYGYPTYRHLPKYTTQAHPSPSAPATPVTPNIVVHRPYSQTSPNDGTPSPIQCQTQMPLVLPPSPFGGYARVSSAQPSPVGLAPHAAVMVPQSTTLLSYLTSPTQAINLVRNVSVIPTRGMHDYFWWDIRNLRSWTSFTLQTFNSINGLTKLLRTAISSDLTPPVAVAPSRLSPDSEAELVNLIRDIYGPRVNAALAVSQGPEHLKLYLAPHLRASNSKNTGGPHFLANYASDTEQTSSGMPRGRLVGIVKSFDRWNTGMRNEAPHRRVEYLNGLAHLQRCMREHSCRYGFIITEIELVCVRAGCDEGDDVPYFGFLEVSAPIPTNIAVNPEERGLQPTSFAQAQSPEASHDCRLAAEECDPTCTFADGLNVPMTASLALYFLLMLSKSVPLPSQPSAHLNVGGPGALTRQRILPEGKDKWIPEPQIGERRDAKRVRGWVWPQDAWHRREGGGVPRGNRSRKNGPSNV

SEQ ID NO: 35299 - protein, 96 aa, A.fumigatus
  UNSURE (89): Identity of amino acid sequences at the above locations are unknown.
ILSKVLNHFGSTQDHPGMSGFDPLLYSRRAIPNADRPNVVEWVCGQVARQVSEPCGRQCTKREKIHMDLIKVVNHNGKPYWWRIRTIYXSPYVTVS

SEQ ID NO: 35300 - protein, 98 aa, A.fumigatus
HILVPVIGIPIQALVNQKCKQNIACCQNSPSDAVSVPLYICSSLLTSIRAVPSLDWVFLALPLVLSCKLLVASAVGALSQHLEIPYGSWGREQGPGSL

SEQ ID NO: 35301 - protein, 883 aa, A.fumigatus
VTWAKFLNAHGLEKRFFFAKLAITHLERTSRPIRIAVDISIWLFQVQAGRGGRNPELRTLFYRLLKFLALPIHPLFVYDGKDKPPFKRGKAVSGRSYGNAPIIRLSKVLIDLFKFPRHDAPGEAEAECARLQRAGVVDAVMSNDVDALMFGSTLTVMNFSKESGSGTSAATHITCYRMCGDGHHPSNVPLDRAGMILFAMLSGGDYLPSGVPKCGSKLAAEIARAGFGGDLLDAIKSDGPELDMKLEEWKERLQYELDENESGYFQTKHKAVRIPESFPDRTVLSYYAKPVVSSPQDIEVLKTRLMNAWDQEIDVLELRRFTADAFEWNYRSGARKVIKLLAEPLVSYRLRLQKSPSPLAGTTSLSGSDVQMLQRIYKSRTSYSTDGLTELQLEIVPIDVVGLDLLAEEPNPPIPSQETTIVSGDEDEDAEVYTEATGQPPTKNRTGKRFDPYAAEKVWIFETIATIGVPEVVRTWKKEQAEKASAPKKSSNRKTGPKKKGPIDPGMKRGSILKYGTLTKQRSDISEFKGAQLFEAAMSATPPSKLRAPELLRAESSPDALMRSTPVYGPYSHKRRLDIQPQKHQIVDDLVDSFTSSCTISSMPDVKRHPMATLSRMGSRLAVVRSGNVEVQTLDFSSAEPVFNSSPSCASPGRIKISYSNVRYGDTADSDLSSHTKSVVSPSSPGSESHQQKKSRPVKASVEPRRGVEVQELEDIMSAVTLSDGSPYEQFDRLAQTPTGLKVRSLSGLKIHEVHALAAEAQIARSSRTKELVSPTAERSIVKAPGVRLPPSAPKTLAMDAGVDDALEPTTKEEKRVESSSKVSRPRQTSSHLESVIVCGGFWTTEAKSQSELASEETERDSSNNDEKRKKKRIPRVSILDLS

SEQ ID NO: 35302 - protein, 90 aa, A.fumigatus
LAADEFSSFADLDVVAKRKTLFDDRPVEISELTYVIKQDLASLNQQIASLQALTLSQHPKTNRSKADQEGEHNDNVRELRVAGLRNANAT

SEQ ID NO: 35303 - protein, 202 aa, A.fumigatus
VVVMLQGKLADVGANFKEVLEVRTKNIQASRSRTENFVSSVSSKSQVLDPQRSDSPLYIPSGRRTPQPGFQGGSSDLLTLDPSNPSPLGRPSFQTDQQLLVMEEAQTNNTYIQARGEAIDAIERTISELGGIFGQLAQMVSEQSEMIQRIDANTEDVVDNVEGAQRELMKYWNRVSGNRWLIAKMFGVLMVRFLSSRCHCGS

SEQ ID NO: 35304 - protein, 882 aa, A.fumigatus
  UNSURE (639): Identity of amino acid sequences at the above locations are unknown.
SVACSQWSLSVDFWTTDEEDARRPLYHLTFSFSGLMRPALLRLLKRPSAVSVLDSLISKSISIDQLESKNKCLRCSLRRVHQNASARHWEVDEPRNETSTHLNQSPTSRPYSFHVYNIQSPQNTGHDCTMRQDNAPTSSMANNDASLRLDLQPDKLEFESDIGHTQDMGSRLVDDPAYRQRMDLWEQLLRYRQRHYGDRGTLDIWIALTDRVDGVDLPVVGEQADFFWHSFVDLGLKREVIMGEIMAYAMELWKETGSRWDKFYEVVVGGYLERGMIQHAIRWHKKLQYPHLSCPNDIMRVFEPALTMINGSTKIVLPTTTTRRSVSPGISAFKSICRLTDGHQIYGRVISQLLNLGRVEDAFSLHSFLVERHDHPQTYEEILPLLECAKELNPRKFYELQAYSKDRFPDRMTSAEGSAPAEEDDKREPSGIAWLQEKPFKDELGARLFATKALAFETTVAGLRMFGVQAIGPQSLREMAVRAQGSQDIIARLRELHRAGISIGDSVFARLIRKLASENRNILLSDLLHSDQHPDVLEDAVMQESLLISYYIARDWRPYNMTLAILTEILDDGSKLSNIHFRKFIASGEWASASKIVDEMTLNGQKLTQESVDFMVKHTLTPRRPGVGPIQGTDVPSSXEVSFVFRVLQRVVPMGTSVSPDLWIEMLKRLGMTNHWDELRRCCLWLARQYSAGPKPSDAVSFIINSTDQPRREADGVARNDGDRMLQAVFSKNVQAAIVAWGFKMRVSPNPDHKSYSALGVENLVPWVRGLVLLRELEHNGIRLWHSWIRRACRHRLAVLFGHSRQSSRHMNRMLRRECPYSPERVIADIDRVWGHPPLFSGQQDDLSQLVNPPSSNMSQRRTGRTLWREARLKGAAFVKTK

SEQ ID NO: 35305 - protein, 969 aa, A.fumigatus
  UNSURE (23),(29),(32),(38): Identity of amino acid sequences at the above locations are unknown.
PILLVPGGSIGPRMYSSMVQGRXLLSFAXPCXIVAHRXYPPTLALFARRFHLTPKWLSSAPSDPSDFRNSPPESVAHDIPSLNSEHTPSKDAPLTSPVAPTEQVVKKDPGPYGSGVRRALRNRRQGKDLIAPIATVPQWFRERNTVLHGVEGQAVAQSQPQVEIKRLETDEKKAEVHAQSHGGDGGNPLPSETQSGTSHRYVLSEALWEELCASAKAGLRLPPPKYAQEPSAQKSHLVLQYPGADGILFLDAVVKRLAQELGADVVTLDAQDIAQLCSEQDMVDSGATSPIRSLGYEVYRPSIAESWQESGDNLNESEADDTDFIDAPVPPRNFRPGLKGAKFITISSASNNGDIPLPSILGLKSLMTSFNGPLDGTATAQSPSDRVEDRRLRLVHELISSPSKRSKQVSETESSSEAPAAAVRDVIVQVQDYGEIQATREGAKFITLLQKAIMDRRKAGTRVLFIGTSAQEVSPDSDSARLMQNAFDDHFSQMLVITPGMESKLVEKTFTEDRKMRTLGINIRHMQDMLRTRLNESSSAVRDSIFENRSWPLSPSLVKESGLDERYWPYSQIHWATTLALGSVGPNEPLGIEHIQRGIEMMLKTDQTKNAWLRERAPRSTLEAGTDRERLLNSLRKTCNSHEKKLLNGVVDANNIRTTFADVHVPPETIDALKTLTSLSLIRPEAFTYGVLATDKIPGLLLYGPPGTGKTLLAKAVARESGATVLEVSGSEVYDMYVGEGEKNVKAIFTLAKKLSPCVVFIDEADAIFCSRTGTSSRTSHRELINQFLREWDGMNDMSAFIMVATNRPFDLDDAVLRRLPRRLLVDLPTEQDRLAILKIHLKDETLDQSVDLAELAHRTPLYSGSDLKNLCVAAALACVREENDLAAKHQGPEPYQYPARRILTRAHFERGMEEISASISEDMSSLSAIRKFDEQYGDRKGRRKKSAGWGFMPLGTEQAETDAARVRT

SEQ ID NO: 35306 - protein, 290 aa, A.fumigatus
QAIPGMNPGNFAPAMAYSALLNLDGQGKRDHVLILCRHTFGTKYPVDTPRSRQVLPIRPRSASSLEQRTNSANVVAQPRNSDDDGTLAVDKGREGAVKVMARFSESGGQEAKTLEEYQRLAAVADPQYNCLLRPLEMKRLPSRDPEREPPLVVCIYESPGQNDLLKFIDCGLTWHHGSLNVDGHDTSSPRCYRDKPMPLSTILGFAIGAAECIKILHSQQIVHGEIWADSFHFSEETGEVKLIHLGAGLRHYHSDLRNATWSALANQDGATARISYEPGADGPDAHSTRQ

SEQ ID NO: 35307 - protein, 399 aa, A.fumigatus
LFVLMKVVFPFLSPFPWPKPNPIKLAGFRKARDVGVTAITLSPLNEDSVMEYVANTLYPFVPLIWPLGALIQSLAGGNPFYVREILSVCYRQKFVWYDYQDGSWSFDLRRISDYFKADDYHEAVLDDFLVSRLNSLPPVTKSILAWASSVGMSFSFQLVRRLLRGDKATSKAGLPEVAMIQELQPAMEAYVIAHTKYHDVFSFTYNRYMHIAASFHTKAKDHVHFILAQVLFQYYSHDDKYRTMLASSIIESAAVIKRSLTRRQPFRKFLVDHAKAANETGFRSTAVDSYACCIVLLQDNMWDDNAEDVSYDETLHIFTAAAECYLYQGQHAKAGCLLQSILSHTRSAVDKAPAWILQSRLLAQQGNLTDAFKALKACLGTLGLGIDDDLTFAKCDNHF

SEQ ID NO: 35308 - protein, 127 aa, A.fumigatus
FTWEPVYGIITPTSEMQLGPLWQTRMALRPGYHMSPEQTGQTPIQPDSRADIYSLGILLWGVLVQEAPFRGRTPMEIIRAVLGEELPLVSSLRPDVPDIIARVIAKATAKNAWERYHSVSGLRHDLV

SEQ ID NO: 35309 - protein, 343 aa, A.fumigatus
LRRLLAAREPDGKDNDERAASTAEELENWKIGSKDVSPFFTLPRIMVGRTQERNAIVEILDRMYQMYQARKGLQLSLLPEGQFDTFDALAFPSDTTGEEDGHHSMDVFPRLLASTNGVRRSYTANTTRMRSPADSRYASFESIESTAGSSDTKTADKRLSTPSIDSASVEGSSRSSDSAGRTAAHCMIVPKGRCELITIEGGAGLGKTRLITSVQIEARQRGFFASSRLDPAAKERLRPVLQLFSSLFEQEFSENTIVPSFLPMLRNHIGFAWNTLHKVLGLPKFLLGSGPDLPDQTSKRASTTSPTSSRHTGTLRVSSDRIVYQVPAARPHPAGYSASFLAI

SEQ ID NO: 35310 - protein, 62 aa, A.fumigatus
  UNSURE (26),(54): Identity of amino acid sequences at the above locations are unknown.
ARRHANDLLPFVSPLTIGTWYYLRIXYSYCKYIQEIEGSISYYNVKNNRKGFHXVSAYTVSV

SEQ ID NO: 35311 - protein, 183 aa, A.fumigatus
PVCWTSNPDNTGLGVTKRCVHPATITFHAANAVCLTESALDDAIAARQDARKQHRAEARLHKSEMRQIEDEIAPRAEPGTRERRMEKRREAALANRAFAESRRGGSPIEAAPDDELMGSGENDLDAIKKAQAREQRKKNEREIRREEILRARAAEREERLQQYRKKEEETIGWLKTLAKQRFG

SEQ ID NO: 35312 - protein, 139 aa, A.fumigatus
RWLSLYLTTLKGIRSPPEELHTMSTRDYRHRERSHRDHDSRSRSRSPDRSGRHKRHHHHRRRHSHHRHRDYSHDRDRHSQSASSAPAVLPFKARELSKRDLTYYAPMFAMYLDIQKGLIMEDLSEEEIKGRWKSFIRKW

SEQ ID NO: 35313 - protein, 94 aa, A.fumigatus
HFQPSISTTPVWQFDKETTNNMALREIKGTPGNHILSDVIEDILNYKQISSDQTRFGRWSRDVNDAETIKRASVPYSLILLLPVITCNLIVNLH

SEQ ID NO: 35314 - protein, 553 aa, A.fumigatus
PWLIVFYRQGVNVRVSNIYKLNSELLAVLSSSPQADAEPISDKSAHTNGPLQAQANVNPSSDPFASTTSRSDSGTSHGSSALWEKLNGSTVSVASSGVPASIVHEGAETPSGQSSGSDEFRLANGMNGADASWDPPLAPARKNRTIQAISGEYPMDPPPKMKPTGIRPRTRTRTEPEDQISAQIDREATNAPRVGDRKRTVSGQVAHPPTSQPTEPGAPQRRSVRLFNQIKPTTSKLSASALGVKDAREVKKAKATGTKGRTTTTTMGRVVSGSRKHASEHHDADGKDGRSVPSAHTHAISKGAAQERSKEIEALTWLLELFSKLASGFFALCRYRCPESIQIFNSLSQGQRETPWVLAQIGRAYYEQAMYSEAEKYFYRVKTMAPSRLEDMEIYSTVLWHLKNDVELAYLAHELMETDRLSPQAWCAIGNSFSHQRDHDQALKCFKRATQLDPQFAYGFTLQGHEYVANEEYDKALDAYRHGISADSRHYNAWYGLGTVYDKMGKLDFAEQHFRNAASINPTNAVLICCIGLVLEKMNNPKSSPRGWKDPRS

SEQ ID NO: 35315 - protein, 167 aa, A.fumigatus
SSEKNGLRSRPTSCSPIARDYPLTDSDPRTLASQHQHFSSSFAYLEHANMSPSISYISGQLRQLIYYHLDNNLCRNALFLAGRLHAYEPRTAEASYLLALCHLQNGQVKAAYDYSRNFGSRSTHLGCSYVFAQACLDLGKYLEGITTLERSKGLWASKNHWSKYSMR

SEQ ID NO: 35316 - protein, 73 aa, A.fumigatus
YTIISITICAVMRCSSPVVYMLTSPERRKRRIYSLSAIFRTGKSKPHTITAGILDREAPTSAAPMSSRKRAWT

SEQ ID NO: 35317 - protein, 134 aa, A.fumigatus
SGVKAFGLQRTTGVSIPCADTCSRPAFISLLSVTDTFPPCALDKHSETRRQHLPDAPAVFCLLGKLWHAHKDINKAVECYVESLKLNPFMWDAFQGLCDTGKLWRINLIHLAMANCVLPPRSQCPRVKHLQVEF

SEQ ID NO: 35318 - protein, 150 aa, A.fumigatus
FQTSSCFSNLPDSRNPHPRIGALINFKLNIPFYRDCLWEIIKRLMDKRKLLAFGRFFKYKFFVLELPPQNRTGFTEELACAWIHSLREDYGGSLYLVQDVVQSLRKPEGGSCTGKGPSSDRYKPSLCREGAGTGMKRLHWIHEHSVRCHE

SEQ ID NO: 35319 - protein, 938 aa, A.fumigatus
  UNSURE (482): Identity of amino acid sequences at the above locations are unknown.
AVIRFGLPGMNRVGRPKGTPNKPKLKKEHLSELDGDAILEQDHLAIKRLKKAQRDEERFRGMSEKEKLEALGLDETWTEYSVLLLERTEPGVYITPRGRRRPAGKRQGRPRISRLAVFRSPKLASLPWFTVSPEGELEDEAASASRQVSRAQSVETPAVPSFTAINTPATTSAALDTPSRGTKRTLRSRIPLDAEAEPDHQRPSKLQRLEDTEVCRQVAEAETSRSQEPLSDEQQTDEPSVDTVPNATSRASKRRKELSPIAPEEDVAVHKSLEGLVSQKAQAPSPVGKRQVGRSQPRQNLETPHKKRRYEPQAERGGETASLLPPTATIKNVAEQAAPSESPKVGDGEHRQVEAEAIGRPLEVTGHVNVVADEVTPAATAELSAAIHNIQEANDIDLKPTYGTPDVQQRDASQTPEGHRPRTKRQDKLGSVAVLRRSIIMDIIEKAGGAYSMGTEIWYPFATAWKRTKYKEKPDMRTVKTXIKHLIDAGKLRQFTFSGRDSKGVMVTKSIVAKPELQPDHPVIKDLQHKMLTTTARYYFPPGVDVDPELTKSSAKSAKSMPSGEPKMAKLPIERGITVHLHQKPAFVLALEKRKGQSIQRRLLQRLQSDTEILRPSGVVRLARLQRGPARDSLERELGPISKKRGKSQQQKRILKHHAPADGAAEEEEADRAPRRLKRLWMPISLMAPYAMFMNPVQTFHSSTGTFSTEAGLVAVRAGALARARAAFRFPKTLDDILDQIKRTPVIFSEAVDPRTSKFFCEAGAILRWELQNEEFIFEKPAEGQEFSFIHQTLDDFPEAVPIEGDIQFEIDQSAYPRVRVPRVRKIREAARRLELVEPEKFPPEETEEAEESEEPSESEVSSDAEDSDDSLDALDLLFSADSRRRRSDYVPQNRRLEKLAAEGPRHVVLPKPSNRPAARRNRALLLFTPRAEGTAQA

SEQ ID NO: 35320 - protein, 155 aa, A.fumigatus
DILRAGFGSFFRRPLENTLARLVECWQLSQPLHLRHLAIVRDTALEKTITHYIHYSTANFQKLVDAGEASWEAVEFVPRNTKAEKISVPPIDAVPDLDENGLPKAVPTKELVKNGNASLLAGILTVNPADYNCTGNDPMPLRLKDNSYGKFSPWQ

SEQ ID NO: 35321 - protein, 116 aa, A.fumigatus
RVREANTAVLTEAIEAERGAEPVTVNAVGLAVIATATTTVLLATITADLDGLALDLAPLMMTDTTALRVALIEKIGKMSDVPAVNASAAQAERSLQSSMRMNVTGVQSLFSSLRHV

SEQ ID NO: 35322 - protein, 208 aa, A.fumigatus
  UNSURE (193),(196): Identity of amino acid sequences at the above locations are unknown.
EQGLRLCTVSDESSCFRDCPASADKRLCRFRDPNQAREALEKMNGFDLAGRAIRVGLGNDKFTPDSSAQRSQSHGANQPNFQGSSFSGQGGRGIQAGGTSNFDRAGGRDSEKGAGASALDDTDVAGVNFNNYSRDALMRKLARTDEPAEPAADDKQKVLRPKTETKPLPVNVNMASRCVLLRNMFDPAEYVIXTFXESYLPCTNQSTR

SEQ ID NO: 35323 - protein, 83 aa, A.fumigatus
GEACIKELEDDVRAECEDKYGHVVHIALHPNSQGDIYLKFDRVQGGENAIKGLNGRFFGGRQITAQPVVDAVYSSLFSRTKAI

SEQ ID NO: 35324 - protein, 97 aa, A.fumigatus
GLQRGHIRYVRISTECARTWGQCPRQIGSTYVSGYDRKTYGSYNAEDKHIKWPPYLPYTFRRYTTKALILETELKISIQAEYLSILNTSHSQNHVLS

SEQ ID NO: 35325 - protein, 152 aa, A.fumigatus
DEDMKSPRSEHGSVNGSHRSRKRSRTRDSERRRSRGDRYGDDYRSSGDYYRGPGRPRTRSRSPYDDRYYRPSGRSHREDREDERRSRRERKRSPSREKSPELNEDERDRRTIFVQQLAARLRTKELIAFFEKVGPVKEAQIVKDRVSGRSKG

SEQ ID NO: 35326 - protein, 119 aa, A.fumigatus
VWLLYLLLVCRLMAHSVGYVEFKSEESVAPAIQLTGQKLLGIPIIAQLTEAEKNRQARNPEASSGHNHAAPFHRLYVGNIHFSITENDLQNVFEPFGELEFVQLQKDEAGRSKGYGFVQ

SEQ ID NO: 35327 - protein, 389 aa, A.fumigatus
  UNSURE (292): Identity of amino acid sequences at the above locations are unknown.
REALSPMSGKESGLPLGAGGQFDRRIPSIPTSRWVREDSVGQAHQLRESNTVCESDQAPHLPIDRQITPGPPQMVSPHAQMDNYLPAGLQSGLPTMDSDSGVFSVDGTFFPDFIPDSLIPSLTRMSDLDPLPVLPQDSIHNVFDHNVDFDFDLTDLDYGLIDLFNSRGAVHHHHHHHAYNSDGATEHGDADSGIAIGAEAYHRSSLSAWKPAREDHAFADQENLSVPEAIDSPEANFRPDRQMVSERLSPSGRDRIFGLVLQTSQRTNLTRIMKSFPSTQLLDSLIQYYFEXQCHDIDSWIHGPTFRMNDETPDMLAALAAAGALISTIPTIRKLGYALMEIVRLQLSDKVRWYLYLPAAKEYQLTLLTCSTRATIPPYAICAPRRRLR

SEQ ID NO: 35328 - protein, 95 aa, A.fumigatus
ICCRDLMKRHAAGHIHPRDTKRRRLSSYPKNGRVSQACKTCAASKLKCDDEKPCRRCQEKNLVCHWAQGVSSIDGSPPSQRQGGCERTQLARPTN

SEQ ID NO: 35329 - protein, 361 aa, A.fumigatus
SFVPVAGPTGLLIRDRLVHHLFLHDAQSAMMLNVNPIISYSELELPLPAPRSLWEAKSATDWKEAYLASGLSSHGRTPSLVDTLQDMSQLSAFQSRIDLQLSTSAVIHGLFTLISEYHRHKFIAKGHSKHWNALVISSRHQELSQAMQHLRMLCFEMSSALGPRIILVSELISMFLHMSLEELQLFAGKEDKNQARRVYQSALEWIGSIDSRRAIWHAGQVIRAAKVMPPGSLTGFFALGVYYASLAFWSYSVVSRAKGSPAAVVRPPSDSHFGGPWPTVYLDGEETADVQRFISLGCGCPALQAPSGAAVITDPGQIMDAIQGILRGDAHHDNIPPLVQGLTQLMCDLGNAARSKTYAPT

SEQ ID NO: 35330 - protein, 73 aa, A.fumigatus
KADNCDMSWSVSTNEGVRPWLDSPLAKYASFQSVADFASHNERGAGRGSSSSEYEMIGFTFNIMADWASCRNR

SEQ ID NO: 35331 - protein, 178 aa, A.fumigatus
SITHFCPSLALVMRISYGSAVAALAAAANAASLADVCTISHVQSVLPSNGTLLGINVIPSAVTASAVYNSTSSGGMGGMGGSNSANYPYCNVTVTYTHPGKGDKVVVKYAFPQPSDFKNRFYVAGGGGYSLSSDATGGLEYGAASGATDAGYDAFSYSYDEVVLYGNGSINWDGLHQG

SEQ ID NO: 35332 - protein, 94 aa, A.fumigatus
  UNSURE (7),(16): Identity of amino acid sequences at the above locations are unknown.
AYSPGVXVCEIGKNNXHAFSYILLVLIGRELLPLPKMSPVGDGLVTPYSNAPLVERYLVNTTPASNSMLIKGSARLMAKLTVSGSHNSGNPYLS

SEQ ID NO: 35333 - protein, 66 aa, A.fumigatus
  UNSURE (28): Identity of amino acid sequences at the above locations are unknown.
NYLLILIPIVMIFSWPFYLRTKSQKGAXMFVSIQRNPHYLTSNAVGFDETHSTPLYPLFIEGLWLS

SEQ ID NO: 35334 - protein, 138 aa, A.fumigatus
SPTSWARRFPPLGPLPLLVPQPGAGTRPPPLPLASPLVRAAGARARAASPGIYPRCSPRHSNRPRSGALPMLSQKAMVSPRPLQWETAIYPDCSVRSGGKRRRIGRQTTSWCRTATAWKDSCAYCACGCHCTASRASG

SEQ ID NO: 35335 - protein, 674 aa, A.fumigatus
KRSSVSCHLCWITQILTASSMDVEGASTEASYYLRGTARGMQHAGKGSSYSRCKRSALPTSGFENLTSSPPQIYANRSISESRRYQELPPSPVEAPQVGAVFSPPIQETQIIPEIAPMRRGRPTRPDHSQHNSAKPSPSPFRAGSSTDPFAALDGTGHKSRNSIEEFSNRFPSLDQFQILNEEKDKFEFEPTVVEKKSEDEDLARRLTNALADDAFAKPQNEERPINQRPQTSSVETKPVEPPRHVPEQPSLQAPLYQPVPQRPTMVSTGTMTSPPPTPGEIKSSSRNIYRFPSSDHHRQPSNPSWLAEADQKSVRPNKAPSPPTLSARPEPHPKTSFDKLASLSSLSSRPSLDGARPNLDVDVPVGRSKSANGKARPVSVHTGSRLEFSRGSESARSSLELSRPMYEGGAPLQHARTDMDMSERANISSDVDFLRAREEELNRKREKRYSGSHKHSKRTSLSTLSLSGTKTLFAGRFGDAFRRFEQSNQDKWPSPTAEDVAKPWPSVTTSEVPHYAAGSSGEESSEDISPEMRRELERRRLSQEEKRVAAAAAEYRRRVAEQGEGGARVVGSDGPRTSAIKSRVQTLLGQSNKPPPHKTATGYGRYTDESSAAALQAKQTEGRPESRPGTRSGATYLAQEQQTARPASASRQETARTVFTTGLEGSAPCVTAQ

SEQ ID NO: 35336 - protein, 162 aa, A.fumigatus
QHRKCPTTRPVRVARRAARIYPRRCGASSSAGGSHKRRSEWQRRRPSTGAGLRNKEREGPEWWEATGPGRRRLRAGCRHCSGRATSPHLTRRRRATGGTQTSRVLLLCRRSRRKADRSRGQAHEAEPRTWLKNSRLQDRRAPPGRRPRARSSPRGSKDPRHA

SEQ ID NO: 35337 - protein, 266 aa, A.fumigatus
WRITSSEGVWPRLTSCESPSPVVGSDRAVWKRVASPDKPALANMRTEVETMKKLKGHRHIVKYIDSHASQLRGGGYEVFLLMEFCSGGGLIDFMNTRLQNRLTEPEIIKIFSDVAEGVACMHYLKPPLLHRDLKVENVLISFQGNTPLYKLCDFGSAAPPRPAATSAAEGRLIEDDVQRHTTLQYRSPEMIDVYRKQPIDEKSDIWALGVLLYKLCYYTTPFEEVGQMAILNASYKFHSYPPFSDRLKALIGELPPVLDYANTDSQ

SEQ ID NO: 35338 - protein, 120 aa, A.fumigatus
AVCSTHKRIRESHVFSTPDICQSLYLRISSLSGTSPLPGGSTSSGGSVLSTYPGNTDNSGNCADASRTSDSTGSFSTQLGETEPVSLPRWFFYRPLCCSGRHWPQVAKLHRGVFESLPVS

SEQ ID NO: 35339 - protein, 82 aa, A.fumigatus
NLCILAMAQLHRNPPFRAEHLGSLLRTKELLKVKTAFEKGQASAAELKAVEERDIKDIVETQKKLGYAALSDGEYCRHSKAS

SEQ ID NO: 35340 - protein, 209 aa, A.fumigatus
ETWKLHVLDWPADILTHTPDFCSEKMLEGWKADPLNTATADEMFDKYVKQYNELLSKRPADLHVGVHICRGNFVGSRHFSEGGYDRIATKLFKELNVDTYYLEYDTPRAGGFEPLKELPRHKNVILGVVTSKFPKLEDKEEMKKRVYDAAKFIAEGNNISVEEALKQVGVSPQCGFASHREGNAIDWDGMINKLKLVREIANDIWPGEL

SEQ ID NO: 35341 - protein, 160 aa, A.fumigatus
FDVRAVFWGSFFPGLEGFEEVTDFDADIFRPYAPDVAAFLEAGHKPGETVICTGKIKHVGSTYVDQFKHLASLVAPEEVKNLKLTLAAPNWYHLRYKNGKAFPKDVYSTEDEYLSDIAKAYQEELQILYDAGCRNVQFDDPNLACKKPGNCTSWTGQQTY

SEQ ID NO: 35342 - protein, 70 aa, A.fumigatus
  UNSURE (8),(37): Identity of amino acid sequences at the above locations are unknown.
RMNLVLKXKYYIDMIAYNPLQSSNKCSAKEMIRYNQXGKRVANFNYGVTLGAFNIFRMSAKPQCYPTLGC

SEQ ID NO: 35343 - protein, 220 aa, A.fumigatus
AQDGSLAVQGARSIAPLINSLLANPGFVIRVASQDYHPRDHVSFASNHPEPNNRPFESVIQMNNPAPGKESETKEQRLWPVHCVGGTKGATIIPEIDSSKIDLHVKKGMDSRVEMYSAFSDAFGNLDPAVHAQSVDVDLKAVLAERGITHVFSAGIAGDYCVKYTAMDAARAGFKSFLVEDATRSVDSGAGWEEARRECEAAGVSIIQSDGPEIAALTAS

SEQ ID NO: 35344 - protein, 113 aa, A.fumigatus
  UNSURE (99): Identity of amino acid sequences at the above locations are unknown.
GEALIHTSHAMSTNMSISTQAATCTTTDENISASTTRLNQDKNLAEKLPYWLVNVPPSQWPAECPPFLRDLPAKSISILSTPDAEYKKQDWETVKEIVXNWGRVGGYCTATCC

SEQ ID NO: 35345 - protein, 286 aa, A.fumigatus
KQCLFSTFSLTTTYISARFLRTFDRSQSRHASPRSTPGWRPFALRPTYLSILGILMLIMLAVLEALRRYTDRYGGLVFYQDTTNLSSPATFAYNYVPVIVALILVTSWSFIDFDVLRLEPYFQLSRPEGTPATTLFINYNFGQSFLTPLTSAKRGHWVVLLVSLLTVLMRIFLPALQSAVFELREISILSDETMRTWPNLVDLDSQARWIVAQEKNNWDFSTLSAGSPFQKTRSAKYAVAPVEIPTDDFRESTVWTLNQTIYWSELSCQDVMVNESLEVFAKETTD

SEQ ID NO: 35346 - protein, 143 aa, A.fumigatus
LPIISWNVKGVQLQQQGQDQRCTLDFQYSNIFFPSSDYVQIRYWEPVWTDNVSQSFFYDSCNPFDLYGILISVNATRATDLDADDMSLSGVTFASSATLFACNIDYRKADAKLQLHANSSITSVDVHPGTTTVLTDDQFNIDE

SEQ ID NO: 35347 - protein, 83 aa, A.fumigatus
  UNSURE (66): Identity of amino acid sequences at the above locations are unknown.
QREDGQTFRSSCHAGFALFYPCCCLTWQSKFFEQVYGLICALSIIFLQSDQKVTQDQLVGVCRVNXWQILGAPKKCYWLLICL

SEQ ID NO: 35348 - protein, 61 aa, A.fumigatus
CWTRTAGDCTVISWMLLARSVGSLNSDITPRCVIFSTQDDKMLLLWEEGVVLPNTVPLDPV

SEQ ID NO: 35349 - protein, 127 aa, A.fumigatus
GHCSSNGHQDQSGRCIPQITDLITYMMSYTNIYAAKGSNLLLLKDIRGPSSPVLSNVDKLGELSPVFCQTVTHRTSKSTSPDGEKPKSLAPIHSSPWPGPRFEQFVGPNDPDGTNYALTLEVHLQLV

SEQ ID NO: 35350 - protein, 262 aa, A.fumigatus
IFLSNQFTYFILCPAIKISIICFYRRLFNTKSFQLVTFALNILIASWGAGIFLACAVQCRPLRAYWDKSIDGHCFDGNKFFIVNQAFNVIMDFVILALPIPMIWGLQRAWQDKLALNGVFALGAFVCFASIYRIVVLFWIKTSDTTFTVYQATLWTHIEPSIGLICSCLPIIRGLFPTLKLSGSRKTTAPYYIRTDYTGSHLATLSSPKSPASAYFKMEEGLMSRATTDTEVPPDDYLSPKDIAVRTDIKISQDAASLRSQT

SEQ ID NO: 35351 - protein, 284 aa, A.fumigatus
  UNSURE (65): Identity of amino acid sequences at the above locations are unknown.
RTSPFFIRSIASLRPSSPICSSPTQVLQALVGRQLKHGQHLLPAAQMTRSDQNSVRDEVLRLDDXAFFLGQTDADPAAMHIHHRQVLGQVEALGGVRAVDDEVEREPVRLFPALLRRGDVSVRTKLARIGLLGPTAGDGPDLRAQRLGEHHAKVADASQADDTDLLTGPGPVADQRRVCGQTGAEHGGDEVGLEGVGDGKHPVLVGANVGGVAALADDARLGPLGAVCVDHEDRAVGLVVVLALLAFTAGVGLSADADTLAFLDQGHFGANANCTADDLCWKQL

SEQ ID NO: 35352 - protein, 153 aa, A.fumigatus
GRLLPLGVKSATPSATTRPCTSTSPPSRTAPRSPSSCTTTPGPSPASTWTPTSSSASRSTPTLSAPSSPAPTRASSPASPAPSTPSPLRPRSLPPQREPPPSRSKTTPTLPLAVSPTSPCRRWCPVARQSWPAAPTSSPVCVCASSPFGARAG

SEQ ID NO: 35353 - protein, 83 aa, A.fumigatus
SLLVITVSGILNQAASMTFAMADTIRLDVDIKVEACGICGSDVHTISGESWVWSKKEIQRIAPLTALFRWLGRAEIPPLRRTW

SEQ ID NO: 35354 - protein, 158 aa, A.fumigatus
RVLRRRQRRDPVRVLHRRRGRLPAPRHPVQLPRGRRRHRHGLRPHHPHLAAPQHCRHQVHLRQHGQAHPRRRRPQRHHPSVPARSHHKESLHQAGRKPPLRCLWRYRRLHPADAGVRWLGNPGRRRQRHPPSVCAHLHPLERGPVDRGHGGAAVAQQG

SEQ ID NO: 35355 - protein, 266 aa, A.fumigatus
  UNSURE (219): Identity of amino acid sequences at the above locations are unknown.
LLPTEIVGRAIRVGPKVTLIKEGQRVGVGAQSYSCGECKQCKNDNETYCPVLMIDTYGAEWPETGIVSQGGYSSHVRTHEHWVFPIPDALETNLVAPMLCAGLTAYSPLVRNGAGPGKKVGIVGLGGIGHFGVMFAKALGAEVWAISRSRAKEADARKLGADGYIATAEEGWEKPHRFSFDLIINCANSSEGFDLSKYLSMMDVHGRWISVGLPEEEGXVIKAQHLISNGVLIGASHLGSRKEMLAMLQLAADKGLKNLGGGAANR

SEQ ID NO: 35356 - protein, 225 aa, A.fumigatus
TLTSTRREECYAVGNDETLYEYFTAVADGSPLPVILYNYPGAVAGIDMDSDLIIRISQHPNIVGTKFTCANTGKLTRVAGALNAITPPSPLAPTTKRASTKPVENHPYVAFGGIADFTLQTLVSGGSAILAGGANVIPRLCVRIFTLWSEGRLTEAMEAQQLLSKADWVLTKAAIPGTKSAIQSYYGYGGYPRRPLARLSEEQAQAVAEKIKDAMEVEQSLPDIA

SEQ ID NO: 35357 - protein, 91 aa, A.fumigatus
NMAFDDLPQLDDSKDRPGLWSAGNSTAVSLQPTDEISGPEGIRSIFIRHFSADINTKYTDLLLIVCGFVSGLVDGLCFNAWGSFASMQTGP

SEQ ID NO: 35358 - protein, 249 aa, A.fumigatus
DFRPGGYSLDLHPALLCRHQYQIHRSAPDRLRLRERPRRWPVLQRMGQFCQHANRSVTQAPSEDNSATDIAEGNTVFIALGASGQPVYPAYLWAKSLAAVAVFILSMIVHIYFSRLLGPRRRSTLILSFSAQTLALMAAAILVETGAVSRRAENPRAPIQWMQILPISLLAFQAAGQIVASRILAYDEIPTVVLTTLLCDLIVDKDLLARGWTSNPRRNRRVGAFLALFLGAMTAGGLSKVTDMAASLW

SEQ ID NO: 35359 - protein, 93 aa, A.fumigatus
SMGRCSTRHNYQLSEEFNTKHSFVDARGESQSTYVQDYPRTILSIEPGKYFGPLSNVALPQILMLKLDSYVYWLPYHIYDISTSKSVRPPPSN

SEQ ID NO: 35360 - protein, 89 aa, A.fumigatus
RQDGAELPERDEKPFGDPWNLSGATEDYFDNYTGYYDGRKGWKTRPGGDTLDITTWSSADRKKASFDGKDPLGKEERDAIKKGLVMSLA

SEQ ID NO: 35361 - protein, 94 aa, A.fumigatus
IPQSLFARLGRWNMYTDMAHKISVNGIMDRLVVDSFQCLLSCRYSYSPIGTLVMIHFLAFLLATISSLDHCALWSWVEHDPAHPVKLLRRIRIA

SEQ ID NO: 35362 - protein, 213 aa, A.fumigatus
LSLVNSYVLDPARIAPSRSDANSNGHFPLSSSQNQTGTPRGFSLANLPPYLANNVNIPGGTHGLPGAAGIPGFMNVNNQAWNANGLVTGEHAANLHHPGVIRRGGGRYNNRSGPYDRRSNRQGASGGHLSPARGMSSMYGAGARMGASGAVPYIPPGHPAAAALMGAGPFPDAMGSGPGQQGMGPREATQGRSIKSYEDLDAVGGAGSGELNY

SEQ ID NO: 35363 - protein, 71 aa, A.fumigatus
FIHTLFFLFFSPVYIITGVVLLSSDWYIFFYHFLLSLVLSFLSIFSRSKDFWDYIMDLTHPLMCTILAAEI

SEQ ID NO: 35364 - protein, 597 aa, A.fumigatus
  UNSURE (4): Identity of amino acid sequences at the above locations are unknown.
DNDXLRRLEVRSLRRPLMDFRVGAYQQWERDLEGGLFDDFTLEGIYKTESDGAGGVIEKEEGETTAVGETLGVLDLLPVRCGDLRDEALSQPALLIKTLAPNVSRAKIEEFCKEHLGEQDGGFKWLSLSDPNPSKKFHRMGWIMLHPAPESAVIERGDGREEEGEEMDHDQGANGTVTVSAAEKALEAVNDKTIHDPVHGDFVCHVGVHVPPSQTRKKALWDLFSAPERIERDLELARRLVCKLDGEMGGNADGYSKIEDRVEELRGKGWLQPPVTGPVSVKKRKPDFDPADIDEGEAEEGEEQEGWDDDEVDDEELLAKKKKLDLMVEYLRRVYNFCFFCVFESDSVHELARKCPGGHLRRPRAGLSSQSKAVARASALGQPFPVKKKEPSEEGEEQPPAEEKRTHRLSKAEQQLQRAFNWVRTFEDKLLQILEPDNVDIRKLGGKPVEEALEEELSKFVKQEDEAKFRCKVPECTKLFKAEHFWRKHVEKRHTEWFENIKSDVSCAITLPYWMVLTANKYNSSLWSILTFSILPELPPRVPMPTAMAISLSAPVKTRPVPLVVSAWPIYRPILQTTSTSLAEPMVSPALLVFQAL

SEQ ID NO: 35365 - protein, 502 aa, A.fumigatus
DHPIIQSELKKEPRTLPDALWKIFRKYGLVRYPKEELYKILQTSETVGLPETVFAYSVAHTLRALLRLDPRTENTNIVFVRCVSDVVDMAYRAERDTLYIHEKWLWPHTTCQGAEQLAIPEPDVFVWQHTVEDLYHRLLAIILNQSEGRRAGQNTRHLLRLAHQKLHYMPRNIQVTVEDEGSLTVSFYTGHSLLYVEQYGACVHYLIVIHRPDCEVRTNILTYDSTNDTCACPRKAVSLASRTARFSGLNGVTWTPTVVRMQGRDNIAKDGSSASTLKAMDGELIGIASGAVSLLPSTTSSHAVTDDDCDVLLSSHCFQSDNAQSVANLASEQSVADAAPVPPKIEGTQERATVSRNVSPQPPADIGHSVAVEGNTCAASNGTLVVESDQRPKDTIPCNLSDSGALIAGPKETLAKTREANDRVETDGIAKDFLRGANAQHSSTFSTCPHPAAAMDNLEACEVQENGQQPCEVGHDSSNHSSTVSTTSFPLHHYLLAQIVVC

SEQ ID NO: 35366 - protein, 131 aa, A.fumigatus
NIKFGSCQVRGEDPKNPSPKLVAYNTSKGIHSTGYSCLGSTNSPLYKDQTLLQIAEKKGKTPQQVLLQWGLQKGWSVIPKSVSEERIGKNFELDGWDLTADEVNQLDNLKGRFKVCGDSWLPVKVFFGDDE

SEQ ID NO: 35367 - protein, 449 aa, A.fumigatus
EVYFNSLTLPRFAYEKALKTFKAKFPEPTQQVSLRLQPAYARIPTRQPISRAAAIRQSRSNRYFSTRTANSFVSSLKNGLRGEHTAYRPSRVAANISRLTSRAPFASTLRPNLTGGTLGRTAGGYAIGAGRIGGARYFSHGPASPAQVINNVSMGVRAFFLSGQKARFDGIDPITGQKRYKAVSALQDQAERKMAAIPRTASGSFIDFQISPAITAFGLQKKAASAGAHYVETLNSDTLCFLSADFARALKDLAAVLNDLERLSSLGDLPISLHDRSTIRVRFPGCDAETVERLCDEVGVRQGRIGQDEDFNLRTGADLALLFPFARSVSAPSDVAEFFFRQETSEGQSPDQVDWQAMMTSEDGTGHSPENPRKSSNGLSFEDSPLFADKNPWASSSSGYSSINVSELGDRAFFPEVSSAGFYESASEDEGVEGIHRFLAECDRAEHFR

SEQ ID NO: 35368 - protein, 69 aa, A.fumigatus
FSDYTYCGLQEPLQLNIEGGVLYINLGGGATPSAYFEGLIMPAIRRAEATNTISEFRKDYTTLTSHVLT

SEQ ID NO: 35369 - protein, 110 aa, A.fumigatus
RRYPQWAEDLPTTLDVDKSTEDYPRALARLKEYLSLPEYGLKVQWSYNSTREIPADWEATLSLREVVNIKYSRMFRFQHSEPGTTYSYEDWKAGRTAHAIVGRRDYHNVD

SEQ ID NO: 35370 - protein, 268 aa, A.fumigatus
LSELWQKSHEIKDPMVHNEILRAKDEVDHQFQTVKLQDEFREKGLQIIVKLGGIELAPDNPSFLGEDWHVDGLANEHIAGVALYCFDLGNVANPRISFAHEISMDADDFSFSYFNWDIPYLERLFGVQNEKPSFQELGSVSIRQGGLIAFPNCIYHRLESFELVDKARPGRCRFLTLWLVDPYYRIRSTRNVPPQRLDWWEQEARSHLSSAHPLPQELADQIITEAGLWLMNLPEAQHHRRERAKEEALAYEKIRSQIERNTICLLKQ

SEQ ID NO: 35371 - protein, 130 aa, A.fumigatus
AWRIGVTPGAKSSGEWDSIHVFEATDRARMSHYKLTSTVILHLANENEALGEMDLSGNMTRQMEVDLPVESDASHVANVGRLVEDMELKMRNLLRMCHICEDLFCLDTSHANMTCDGRGGLLWQGQGCGG

SEQ ID NO: 35372 - protein, 162 aa, A.fumigatus
  UNSURE (59),(63),(83),(87): Identity of amino acid sequences at the above locations are unknown.
LEVFINEVNRINCLDFSDDNMLVAAGMQESYIRVWSMDGKKIQTTYDNVDDAPPSNSRXFIGXIWSSLCSCILPLRQNPSKGXCPPXQTPVGWLSSSGEKKHPKSGSLNFWSGLVFYKAHNHPVGESPWGALWALTCFRGDLNKTLVSWVTNIFLPHAFSSA

SEQ ID NO: 35373 - protein, 63 aa, A.fumigatus
LATAEEVYFGKAKDVVGELRSKPLLCHGRTKAMDADKNTGLAPLSETNKEKAAHLEMIRSMQR

SEQ ID NO: 35374 - protein, 137 aa, A.fumigatus
  UNSURE (26): Identity of amino acid sequences at the above locations are unknown.
STTADPSSPVVKTKTNRDYLLCDYNXDGDSYRSPWSNEFDPPLEDGTVPSERVRKLEVAANEAFDVYRELYYEGGVGSVYFWDLDDGFAGVILLKKGGLCYAMSCEVRALLIGMANRCHTRSEELRRVGQHSCLRGD

SEQ ID NO: 35375 - protein, 299 aa, A.fumigatus
ATLSSLTRAMLIFGQPELRRVLWPLFVYSFLNMVTSFYPQEAKQFFDINKNLFLPEHTDDIRKLEPISLPEHVQDNATAKLYRNNKYRLVLSNPAFSNLMQFLENKSKEGGSVMSAILSSYCTIITKERASDDRFSFAAMLGQAGAGQTFPAEDEGIPGHHPGSAYTGDNPAMAGTLPRLRLGKLPMESTLETDVRGELADEDVKNPPAPGHNSLVQEFDQMIKKEEDEEAPSRADIPYPPSTARDVALEVQKVKENRDRFRIEGRTGGVGPAVSVCMFTFHNTYDGCVMTVSVTGSFY

SEQ ID NO: 35376 - protein, 73 aa, A.fumigatus
RVKTEQIFTDVTHTQQVPHLQLHILNEPTDIGDMARIRFHRKINLHLPGHIAAEIHLAKGLILVRQVQDDRAR

SEQ ID NO: 35377 - protein, 71 aa, A.fumigatus
TSDTCFPLLLPSRLNVLSSGTITHKAVSIGYTCYSGTKPLLLDAGPWTDSKVSFNDLTGNGPGSSNFARPI

SEQ ID NO: 35378 - protein, 155 aa, A.fumigatus
ADRAVEEMDKSRVERNARMTVRTIREDLAQVAQSTRIVIRCLSSGRDAHDSAAKALSVLIDILDCLHRVRDQISWGEEKWLVEPARLNALAEVIVWFGTTLRSIEFYFQPGGVSVYYFRKHLLGGTFLPRLEQYKILLLLAMQPDSRLVALTVLM

SEQ ID NO: 35379 - protein, 796 aa, A.fumigatus
NVPRGCPLGDGKKPWCVSNSDRSLICLAGHFLANRGCPYRFLLAKIHLDLLARYTDKSLLERAVMHLPESLSEAYGEAMKQVVSQNPTATRHVYWTLYAYRPLTVAELKAATQSKIASEDKDELVSFEQSLQTQSAGLLTVDAVTGTVRFVHKTAKEYLNGTAARVFFPSAQRDIAEVCLTAIIPDEVVDDCYYIGGTTPRNSSGGFLSYAATYWGYHAREVTEDEQAIQVLIKTFLNKLLWRRPPIKGLIRNKCLPTELGLGKYPDDWSALHILSFFGISGKFKRLLVQGAQIDANDNSLKITPLHCAAYRGNDEMVDFLLENGADGNATTNNGSTALHLATERGNRKSMKLLLSRHVNVQVANEKGETGLQVAVGTTADEATVPLLIKNKVDVNIRNIRTGDTALHLAVEWKRPRIILFLLDKGATIDMTNEDGFTPLQLAAKLDNCEAVALLLQRGAQVEARSLSGLTALQLAAHEGHWVAFDLLLIGGADINSWNKEGETLLHEEARKSRNVSTAAKLLAQGANIEARTSQGYTPLQCAAISGNLNMFKFLLSKGAKIDVETAKGESLLHITPPINNDCLEILKIALDHGLDVKAISSHGWMPLHHAVYIGTGVSDLAFHKTSDYIILLLSYGADINCQTTSAYAETALHLAVMAINPNTSLVSLLLKLGADINAMTNEGKTPLHLAAERGRESIFRVLIQAGADISLEVPDSAKAIDGRGTGGGNTALDLARKNPFNALWLDDHGQLRPEPKVKRRDSVYTIIEEEFNDDVSEDETCESTLVGSDQPYILV

SEQ ID NO: 35380 - protein, 189 aa, A.fumigatus
LMISSVIIDFLQRTFTSPNVATVFVFCQDEKEKEQTSLDLLQNILAQLVYRKRSLSYATSSLYYSESLTKGRASPKAYQNAIRAEVNRFSKVFFIVDGLDGFSDKERILTRLQKLPEQAQLLVTLREINQIDSDSGYVRVVPSPEDLQLYALSRIQNDPGLKSLCNDGPAGVEMCQEVVRLVMEKSHGV

SEQ ID NO: 35381 - protein, 526 aa, A.fumigatus
LPLTRRVNEDSILAIQIFDQKKFKKKDQGFLGVINVRIGDVIDLQMGGDGESLPIRHSCDVSRLTFRLLLLETEMLTRDLKKSNDNLVVHGKLIINLSTNLSTPNTNQANGLHRSHVQSSTSSGLVPQVAPSSSHPAASGTAPVDPSASNPSLNPQRVPSTTRPSSTAAPASAAGAAVSNSHGSRTNLSSFEDSQGRLPAGWERREDNLGRTYYVDHNTRTTTWTRPSSNYNEHAQRSQREANMQLERRAHQSRMLPEDRTGANSPNLPESSQQAHTPPAGGSANAVSMMATGATTAGTGELPPGWEQRTTPEGRPYFVDHNTRTTTWVDPRRQQYIRMYGQNANGTNTTIQQQPVSQLGPLPSGWEMRLTNTARVYFVDHNTKTTTWDDPRLPSSLDQGVPQYKRDFRRKLIYFRSQPALRIMSGQCHVKVRRNNIFEDSYAEIMRQSASDLKKRLMIKFDGEDGLDYGGLSRYVPCLVLVTDMLTIRLVNSSSFSPTKCLIRSIAFSNTPHTIITPYRLIPIPV

SEQ ID NO: 35382 - protein, 169 aa, A.fumigatus
ICRVSCYLPLPLAAEDDQDKITNGFFRLVTEWKIVKRVEEQFNAFMSGFNELIPADLVNVFDERELELLIGGIADIDVDDWKKHTDYRGYQESDEVIQNFWKIVRSWDAEQKSRLLQFTTGTSRIPVNGFKDLQGSDGPRRFTIEKSGDPAALPKSHTWYVKFPLSILL

SEQ ID NO: 35383 - protein, 75 aa, A.fumigatus
RRSSPQSHMDFVSYYAGNRVGSGFLTICRDNDIEGVLELTFSVDDEKFGERRTIDLKPGGRDIPVTNENKAEYVE

SEQ ID NO: 35384 - protein, 125 aa, A.fumigatus
AEKPGRLAPNYLIHGVTATPKEEWKVHRCGTQRTCPRVHSSLSSSYSRYHRTFDVLSSVIALIEPQKKKNVAILVSPLLPFHSHPARRPSPSSSSVPRTSAHFSTTRDRQSRIHRRLLGPEYIKC

SEQ ID NO: 35385 - protein, 83 aa, A.fumigatus
LLTVIAADGLYKRDVFRKSYILAILLVVRILTSGAFAGFPDPFAVATVGGEQTHTTSVIKKTLNPYWNEMFDLYVALHLLLRM

SEQ ID NO: 35386 - protein, 105 aa, A.fumigatus
YADYSPSEFFFLLSHEMFNPFYCLFEYSAHDNYTLQINPHSGVNPEHLNYFKFIGRVVGLAIFHRRFLDSFFIGAFYKMMLRKKVSLQDMEGVDEDLHRNLTWTL

SEQ ID NO: 35387 - protein, 143 aa, A.fumigatus
IQRAVGEYMQNRQAFKYIVKVKQRQVVWPCDKNALVLTTSAFDRLLFRFGKFECLIHTGDEMRHSSALFHYTASFKHSENVTIGKTTEEYSRPLVHISFHYLGKNLSARSVNASNTMDIEDDILIILWRTHSREGWMYSARAI

SEQ ID NO: 35388 - protein, 102 aa, A.fumigatus
SYTQCAAPSSPVVKTPDLSQAQRDIAGLFAMGVAGNKEDHVLHTVHYIVQRSACSSGLHSYGNSQTLSNEAILRWLNAFSRLYKYSVLSGNICRIVKRSNTS

SEQ ID NO: 35389 - protein, 224 aa, A.fumigatus
ISYISYYIPFFNWIGQYQWSFFRGDLISALTVASIYIPMALSLSSNLAHAPPINGLYSFVIHPFIYAVLGSSPLLVVGPEAAGSLLTGTIVKTSVRQGTSHEDNAAENAMVVGVATAMAGSMILIAGLTRLGFLDNVLSRPFLRGFITAIGFVIFVDQLIPEAGLAEMAKDAGVSHGSTVDKLLFFFRNIRNCHRLTAAMSFSSFAIIMVFRYVLNPPCRVCKS

SEQ ID NO: 35390 - protein, 184 aa, A.fumigatus
LGTLFRTLKKKLEPHYPQVVYFPDRILVVILAAILTWRLDWDEKGLEILGPMKNTGNGVFAFKWPFQFSHMNHVRTAMSTSFIIALLGFFESSVAAKGLGESRGTGIKGMTVSPNREMVALGVANVVGGCFMALPAFGGYGRSKVNASTGARSPMSSIFLSLITLVCILVLLPYLYYLPVGSPL

SEQ ID NO: 35391 - protein, 231 aa, A.fumigatus
KAVLSAMISVVAFSLIEECPHDLAFFIRLRGWTELALMLLIFASTIFYSLELGIALGIGLSVLILIRHSTQSRIQILGQIPDTGRFDNAELHPENVQLIEGALIVKIPEPLTFANTGDLKNRLRRLELYGSSRVHPSFPRMRSPENNKNIIFDVHGVTSIDGSGTQVLSEIVEGYVDQGTRVFFCRLPNRDVFRMFERSGIVEQCGGMTHFVPSVDEALKLAESEEQTVES

SEQ ID NO: 35392 - protein, 216 aa, A.fumigatus
RGSFDPRGEDKNRQPARLLEYDISSGTPKYKHEYAVLLPKYSDYTEKDPSDAAKVASQSEIHKLPTGDFLVLSRDSGFGHGQPESLSVYRHADVISISESTTDLKGTYDAADGSIASSKGVLNSSITPAEYCPFLDFNVNSELAKFGLHNGGAQDAGLLNEKWESLALVPVDPHGHKDRHSKKAREYFLFSFSDNDFITQDGRFQAAFRLLPAQIC

SEQ ID NO: 35393 - protein, 65 aa, A.fumigatus
TQRTTITMSDPRPQESETQPKLPKSLFPHQTPAAASSSTASKDDDVPAGMTKLPNGVILDKEGKP

SEQ ID NO: 35394 - protein, 120 aa, A.fumigatus
QQNSCRLCTSAASWRALTKQAKSQTAAGTTPTTTPSNASASAPAPSPMQAECPPDVKELGRATWTFLHSLTAAYPAKASPEQQIEMRSFLSLFSRLYPCWVCPGGLSEVDGGTQRPEWPP

SEQ ID NO: 35395 - protein, 265 aa, A.fumigatus
EVQDRLAQEPAQEEEVEVAEEDITLSPQKTSKPTKRAKPTSTHTSRKRRKTATLEPKVSDDDETGALSASENDIKNATGRQSKTESERADSADAAKDAADIDNVASESEMSVVLDEEPKPSRKRGKSSESTSAKGKKKVPAKSKDANLDPNEAEIKRLQGWLVKCGIRKVWSRELAPYDTPKAKIKHLKDMLKDAGMDGRYSLEKAKQIKEKREFEADLAMIKEGEKHWGRGSVEEESDNSRPRRRLNRGRQTLAFLESDGEETD

SEQ ID NO: 35396 - protein, 61 aa, A.fumigatus
QCTGECKHLISQYLKCLKLRKGVNDEECRKLAKGYLSCRMEKYVWAVQGPMQTFNLAKNGC

SEQ ID NO: 35397 - protein, 119 aa, A.fumigatus
  UNSURE (21): Identity of amino acid sequences at the above locations are unknown.
TQYLPTPGVDDKLDNCLTLYXDTWIVVTANNIYSVSATHTLLPWMLYDDLLIRCVLTEYILKKNIISPWRTDTSSSLIVNLGTLKVAVANLSFADDYSVTYPREMQLASMLHKFCVNIM

SEQ ID NO: 35398 - protein, 73 aa, A.fumigatus
LLLANTLVTPLNSQIVTRSVTSAGISSSKISNALLCDSLHHGNDKCWPWDYFIYRTVHTPKSDQAWSACSGGT

SEQ ID NO: 35399 - protein, 66 aa, A.fumigatus
GDNHCADPRPPVVKTRMSSVKQTGCMLCLNNTYHLGLKPGQEVLDQVGGAHKLQGWDRNILTDTGG

SEQ ID NO: 35400 - protein, 89 aa, A.fumigatus
TTSLRLPLPIMPEFTRPWERSVRWLDRCIDAHKYPERQNLFCIIQGGLDLELRKQCCAEMVARDTPGIAIGGLSGGEAKEEFCKVYVLA

SEQ ID NO: 35401 - protein, 376 aa, A.fumigatus
FCLSARDLARRVYALLKKVLRNQYQRRNISITMTIQSKDQTSIMSPAAVLPQDTPSQTGTPTPPHNPAHEEHQYLNLIRTILAEGEHRPDRTGTGTRSIFAPPQLRFSLSKPGATPSSDPIPILPLLTTKRVFLRAVIAELLWFISGCTSSIPLSEAGIKIWDGNGSREFLDKVGLGHREVGDLGPVYGFQWRHFGAEYIDAKTDYTGQGVDQLAEVVRKLKETPFDRRIIMSAWNPADLKKMALPPCHMFAQFYVSYPNGLGNKGSLSCLLYQRSCDMGLGVPFNIASYALLTHILAHATDLNPGTLIHTMGDAHVYLDHVDALNEQLKREPTEFPELRIKRNDRGSGVVDGWKEEEFEVVGYQPHKAIKMNMSV

SEQ ID NO: 35402 - protein, 124 aa, A.fumigatus
TWSYGSSAALKWLREIHRVLPLEVYRVVRQRRSFVKCMCWRKCVRATCAYNSRVDTCTGLLPEHKPRYVMGVVSTRWPIRLAVSFIDAAQGYPEDLVVAVALGADMFDCVWPTRTAVRTTSGIV

SEQ ID NO: 35403 - protein, 150 aa, A.fumigatus
QFNPKTKQASCRRQPCCRKIPPAKLAHRLLLITLHMRNINTSTSSAPSSPKASIVPTAQGQAPARSSHHRSYDSRSPSLVQHPPRTRSPSSPSSPPNAFSCVPSSPSSSGSSPDAPPPSPSRKQASKSGTVTAAASSWTKLGSGTARSAI

SEQ ID NO: 35404 - protein, 65 aa, A.fumigatus
FLNRLTIHNVHYLLNLMGSARQAILEDRYPAFLREFFDNLYGDKAKFPEWAVTALRGVGVDLLAD

SEQ ID NO: 35405 - protein, 62 aa, A.fumigatus
ALLVDYKKSVLNAQQQVEESPDYGRKTNAIKKTKVEASPSDDDDNSILKAAIIIKPGLSFGH

SEQ ID NO: 35406 - protein, 115 aa, A.fumigatus
HRPDGNRLGNSGLKISKIILGAMSYGSKKWQDWVLDEDEALPLIEHAYKRGINTWDTVSGRSWAQITRAQPDPLTTGNCIEGRHIIPWPLGRDPRQGSEKIPHPPEHRIVILTKC

SEQ ID NO: 35407 - protein, 171 aa, A.fumigatus
  UNSURE (29): Identity of amino acid sequences at the above locations are unknown.
HLQMAAWEFQTLQNIAARNGWHQFISMQXYHNLFAREEEREMIPYCLDSGVGLIPWSPMARGVLARPWGSRSSVRENTDATLQLLVRSRETEADKAIVERVEEIAKKKNISMAQVAIAWVLSHPKENPILGLSSKERIDEAVAAIKVQLTPEEIKYLEEPYRPKALTALER

SEQ ID NO: 35408 - protein, 212 aa, A.fumigatus
SVCGGCAELPVCPFSGFALPAVFLFFSLFILPHRSLSIGYSPTPNRYFANSTPFLKVLHCIFESFRMNIMRLLPRSKALSSPTAVAPAFRGRGAGVYSPSSQTVYMCPTSAVSLMHCSPCSTSAPLLSSQKSVAQTSANNDSLSDKFSAALAKNKEWAAKCSQDHPELLPTLAVGQHPEILWIGCSDSRLPENTILRPSAWRCLHPPGLLPT

SEQ ID NO: 35409 - protein, 116 aa, A.fumigatus
YVVTPSAEGVAAALGNKGLGILDPWLIPLRQLREQHLAELQSLSRDEAVVRLAELNVKEGLKALTQKSVVLEAMQERGLQVHGLIYDVGSGFLRQLDAAEPEEALKARLTSFKTDA

SEQ ID NO: 35410 - protein, 201 aa, A.fumigatus
  UNSURE (73),(156): Identity of amino acid sequences at the above locations are unknown.
KNTPSPRTQNRHPNQMLIWAFLTKPNDGKMASYLRPATENHGDWGEPRGIPRKHIFDAVDASVKRLGTYIDVXQIHRLDRETPREEIMKALNDVVESGKVRYIGASTVRFFPRLLSELVRNEPYSLTFADGRLGIPNPPEYRRPQRLAPVHLHAEXPQPLRPRGRTRDDPVLPRLRRRSDPLVADGTRCPGPTLGLPLLRP

SEQ ID NO: 35411 - protein, 97 aa, A.fumigatus
IGVVGDLLILYCSAYVNLASFPTPLDSPRLYSFPSWLVDKMTIFDEIKHVQRLAEAEAAGDPNAHNQLLAAIRKLQLAAEKPIDTTSRVNFQVSPMA

SEQ ID NO: 35412 - protein, 68 aa, A.fumigatus
LVGALHASLRIESNTHPNASVRVMRVLTAIGFAIETANQTYAANDTTHFEILPGSIAAVKHQYVFPCS

SEQ ID NO: 35413 - protein, 120 aa, A.fumigatus
DAFPVPTDQTELTSKGARAYFFRQVLHNWSDAKSKQILSHIADAMEPGYSTLLIDDYVLPDTGAELRAAEMDILMWLHTAGLERTVSQWRALFDAVGLELVQIWNTDKGDESVLEVRKRL

SEQ ID NO: 35414 - protein, 279 aa, A.fumigatus
  UNSURE (221),(226): Identity of amino acid sequences at the above locations are unknown.
SILIIATSVRCRFDYNTEQVSIQLQPTMSTLTRAFTKRHKRPEVSAPMPYREGQVKFTAGTIKRGKISGPVELISTTNMLAYNAPDLHSAVSSSSSSLQSPDDSELSFSQRSFGSPITTPDDSPVEPNPLSSYFPKRSATVTSHPRSSTSTTSSTDAPLVPKRALSHTKRSHQELARQRSLSRLSPPPLNSMRSSPSIRTNQDFFKSEPHPFGKELEQVNXMAKEXNSGANRVLDEEEMILLNKGLRKFTANDYLVEIEELYGSIFDDHLGPVATGSWL

SEQ ID NO: 35415 - protein, 66 aa, A.fumigatus
QLLPYQLQIIIKAQTQTQAKEQQPEMERIDCVQHEPEDRVWVGYGSGPGVKVFGNPSKGDVYVLDS

SEQ ID NO: 35416 - protein, 132 aa, A.fumigatus
VVALYRNGSLSVRSRSRFFVGCSSIIAGLLKLMKMAGDKTVEVTPSPRIGIEDSLECLPSIMDASITHGELTQELCLILYLTYSTGGGSLYCLTLTSVAPFPNIASIGGATTQIFCQGLAAPCAEVRASQGP

SEQ ID NO: 35417 - protein, 64 aa, A.fumigatus
VVRLRCLLHIPNAVNSFKPIYPSIGLVHIINQTLLSRLSIASAPTNSTSASYSNHATDIMFEVL

SEQ ID NO: 35418 - protein, 209 aa, A.fumigatus
LFIMAGITSTDGLPPLAVVGFSFKFPEDATSSDSFWQMLLDGRCVSSEFPADRLNIDAHYYPDRNRLDSISMRGGHFLKDNIATFDAPFFAMSAAEAEAMDPQQRMVLETVYRALENAGLPMEKVAGSKTSVIAGSFSDDYFLLQTKDPLDMPKYTAVGTSRNMLANRVSWFFDLLGPSAAVDTACSSSLIALDMTCQSIWSRDADMVC

SEQ ID NO: 35419 - protein, 168 aa, A.fumigatus
QKDKSLWLFLLKFWQGLAIGSNVILTPELTMSLDNLGLLSPDSHSYSFDSRANGYARGEGIGVIVIKRFDNAIRDGDTIRAVIRSSSSNQDGKTPGITQPSKEAQVRLIRDTYKKAGLDMSLTRYFEAHGTGIYSMRLQEVPSQLTRLRDPNWRPNRNKSDRDGFSPV

SEQ ID NO: 35420 - protein, 95 aa, A.fumigatus
VSRAAIIRVSPAWSLRARTTLRHCSGSVKSNIGHLEGASGVAGVIKVILALEKGIIPPNSRNLQFLNPQIDEEFLNLKVWKSIQLESTVLTAFAQ

SEQ ID NO: 35421 - protein, 190 aa, A.fumigatus
VLQKAIPWPENDLRRASVSSFGFGGSNCHVVLDDAYNSLRLMGIEGSRHQTVVVPPSLEVTALVAHGKCGYTTNAGSDQPNDDHPNGLHDEEETHQLLVWSTADEEGIERLVETWKPFLSDKREFSRSQRRQYLLDLAYTLGQRRSHLQWRSYAIGDALEDLGSLADRFTPAIRSTDESHIAFLFTGVRL

SEQ ID NO: 35422 - protein, 440 aa, A.fumigatus
YNLSNSYWLKYLVVTPNQLTAAALVISYWLDTKDVNPGIWITVFLVVIGSVNYWAARFIGPYEFALSTFKILVLFALTVLSVVIALGGGPDHDRRGFRYWRDPGAFASYGNHELVGKLRAVSKTMPSTIFAYLGSELLGMAMLQTRNTPKAAARAIKLTFYRIFIFNIVSVTLLGMLIPYDSQDLAFANNASKPTTVSVFVVAIKMAHLPTLPNILNACFLLFVLSAANQALHMATQIIHGLSQEQKAPSFLSRTDRKGVPVYSLGTCAILASLAYLNIHNDSKVLFGYFVNIITMFSLLTWISILITHISFVRARKAQKVPDSALVFRAPFGACGSWVALISCILFSLMGGLDVAELATHPEAFDYMTLITSYIAVPLYLSLVIGYKVVTRCESVNPAEADLWTATTIRERHESSEPEDTGLLDQNHWLWNRFVAAWLL

SEQ ID NO: 35423 - protein, 126 aa, A.fumigatus
VSEETVYTRVLAARQSSETYPFDPVKFIPRYLAEYQLSWGIRGDNTPEYAKYLGYLDAKELYPDFRPTDFRDYLESVVRGTAKGIYTDRTISRAQQREFPRTESSDSLYTRIFPRAESSDSLYMSR

SEQ ID NO: 35424 - protein, 61 aa, A.fumigatus
PVKPAAILISYTAVGIVVYLTLCALGEVAAWFPEPSTAVDHARSFCDPAVGFTLGWRHGFP

SEQ ID NO: 35425 - protein, 80 aa, A.fumigatus
ISHDPLHSLSPSSTASFSSLLFRVCLAHSGVKVIALLVSTAPMRREMYTCERHMAELNLLSSSQPLHMFAAIPTLQQHCC

SEQ ID NO: 35426 - protein, 398 aa, A.fumigatus
VESLLYIICMLSSWFFDINIFSHSSEVSTAWLQRDTTQFTRSLTQIKPGDSHFQKTFLLAIVTAQLMVMNWTSESFASASTYAPSSSEDNSMMIETSHGYATEAFEHANHPNNSQPPTGLGITYVGMEAQFSQMGLCSVPETLSQPTTDWPDQLMQSVFEPCLDVENLTTGTCYESFPVHHDLSTSPHSLYSPQTLSASPSYCSTLDVGNQGTTCSQTSRRWPGTPCSDNTTPFEGWSHVKQEYDDCPDPLLYSEPSDASGVSTSTTIPQLMVNNTFAVTASPGKEKGDTTLKPDPIFEDSIDHDQTATIPQSTAQARTTISNDNESCKVTSASGLVCTVCGTRFTRRSNCREHMKRHDPSCRKLYPCEACGKTFGRRTDLKRHVDSVSLVGRLAVCC

SEQ ID NO: 35427 - protein, 319 aa, A.fumigatus
LTEEDRHAEPEQVRTNCRQTDCLPPATDFQQVAQMIGSMQVSSQPQAQRPPRTSSHAPPGGHPQRVPVTNAQINKPLPATGPPPASHARPHPLHPSPPPQNYGFGPPPSQPVRNRPSPVSRPPQSPHPPPLSAPHDDPQQLFPLFRAANASHSGALTEMELGSALVNGDYTSFHPKTVKMMIRMFDRNSSGTISFDEFVALWRFLAAWRELFDRFDEDRSGRISLQEFEKALVAFGYRLSQPFVTVLYTTFESKKQQINGGHGPAKDGMSFDLFVQACISLRRMTDVFKRYDEDRDGYITLSFEEFLTGKWRFEAVWSD

SEQ ID NO: 35428 - protein, 292 aa, A.fumigatus
SGWSSRLLQMSSPESPTGISFAGQTVVLTGATSGLGFEAAIKLLNLGVDSLVIGCRNLERGEATKAELELRTNRPGVIHVWELDMSSFQSVKDFAARVNTEIERLAVVLLNAGLWNRSYIASPDGWEETLQVNTLSTSLLAILLLHKLRSSSSAESPSHLRVVSSKLFTRVEADSLRTDGSLLEHLNDPKHFNGPQQYRISKLLMEYVLKTVAQHAREENGSVPVIINTVSPGFCASSLGRQYDRFYERWMMWLVYKLFARTAEQGSRSLVSATYQGVESHGKCWRDDGYVE

SEQ ID NO: 35429 - protein, 213 aa, A.fumigatus
DKICTHLDLSAQPPVEASDALRASVLQSCHSTLIRLGDLSRYRETELVSKDRNWGPAIGYYDLAIAIYPASGASHNQLAVIALADGNHLRATYHLYRALAAQEPHPSAKGNLEIEFRKVRHAWCKRELIRPEDAGIPGRALAPWFVYLHAQCYKGNDFPEHDELESEVLNQLAVDLKERSLEGTLQKFCLINIAAEDFSWTQPHGKSPSCRNY

SEQ ID NO: 35430 - protein, 234 aa, A.fumigatus
  UNSURE (122),(221): Identity of amino acid sequences at the above locations are unknown.
RSRSRCEQCTKCPVYSFVPIRLLTDTALRSQRIPIVLVDDEDKKTFIYKEEGLPSQFFASPSGHHNTLSTASVERYDVHHATKDANHIADSRSTFGGSQSASASMSANMHRIVEGVERLVEXDTYENTPALSEQLAFLRSNNQQSIPNDFFESSLNTTHREANAPTRYPPIAPPGLQFSMPNPQLGPQLHPPVLNFLTYPSGFPRFWTPEWSMKSVDLGSXKPFQGLDTSSSAN

SEQ ID NO: 35431 - protein, 129 aa, A.fumigatus
DMSKRPRISRSPSPGQTPETWSTSPSPAASTPSCQRSKIILQDTNEPAVEAMHCSLPPHREVIYFSSYEDYEVHYTQTHVNRCSECGKNFPTDRFLNLHIEENHDPLVATKRDKGEKTVRQPWDHCFRN

SEQ ID NO: 35432 - protein, 180 aa, A.fumigatus
LRTIPPEQQRLNTVAQIFYHSPGNFAMRLFVVPISTQRALIYSRPLSRDIVRELSVLDRVTNKAAETWAKWEEADKGWKKHLVTWGNKVQQRIPFEEWGLKSIPSLKAQRRLDKSSETKKVDVLFPGNAIKAEKIRSILRKIATERQDLHRKKMWWSLVAAPLTAPIALIPVYSLCLTEY

SEQ ID NO: 35433 - protein, 70 aa, A.fumigatus
SASHRDDLQRKAMVVAETAGQGSVTYTIDDIPESYIPPQRSWGREYMHGVNHVNEVAAYNVPVGWKSSTT

SEQ ID NO: 35434 - protein, 75 aa, A.fumigatus
QCLLTDRCIDPGQASMTLAKLQNSVKSSFDAINDNLKEHHSALNKYSKALDKVLSPSHFYIFGALETDTVAALQR

SEQ ID NO: 35435 - protein, 72 aa, A.fumigatus
VEIPLPPPYLFHSILVCPVSKEQSTDENPPMMMPCGHVIAEESLKRLCKGTRFKCPYCPNESHPREARKVFL

SEQ ID NO: 35436 - protein, 253 aa, A.fumigatus
IRSCLRVISTYLVLSKLTLWQLFKDKPLPSTEHDALSSREHLINRAIAMHLLREGQFSVAATFLSEIAEKKASTRENDMDTDGPDAAKSLLDIDDVPSDEVRKQFATMYHILHEMKENNNLLPAIQWSRENKESLEARGSNLEFELCRLQFVWLFHGGQGPAVAGPQAALEYARREFHVFLPRYLVEIQQLMGAMAFSPNLQESPYRNIFDNPSAWSDVAQSFTREFCSLLGLSADSPLYIAATAGAIALPLC

SEQ ID NO: 35437 - protein, 86 aa, A.fumigatus
QHACICTCVCKYDDQGGDTDDVGTADKQSTNSRNQTILETGFSYIFSAMLSNSDSYNSKDTRQPCWILSLLHLSQMSQFEGRTVGA

SEQ ID NO: 35438 - protein, 96 aa, A.fumigatus
QRQLRTILRAPVLWYTPVRMLVRWALQGYDSSEVVRPLKHRFPVQTSFKASKTSNITILLRSMVVSIANMAIPRPSTPPEAPLEVTEISKRSQSSR

SEQ ID NO: 35439 - protein, 103 aa, A.fumigatus
SPGFHTRGTRESRQGPLHFREVPNSLTGSWMVRKRTLEYAKDEKELFAAQGDKALAAGNGETLTYDELKVLIDFASRKFSEDLAEPKIGKISWLRRKPAPMRC

SEQ ID NO: 35440 - protein, 74 aa, A.fumigatus
SNGSYICPAIVTKVSHRNHGQVRLKAAAEFAESGDIHDTVRDLWERPEDAKKELIVKVDTLPSSVGLQLIILGN

SEQ ID NO: 35441 - protein, 237 aa, A.fumigatus
QWLASHLAKLRRITASESKQPQPEARATPRRWTLIGAMKSRRDSISQPVYLPLNHEMANAFDTTLQSLRNLASTALFALHIDIRCGVIHMLTRTMTGPNPPSNRDSEPTTPSPNSNLNWWHILVNQPTAASPTILELNNDLIAFDTNISSYLGPAEHWFITSGLARFIDQAFVSSTRHIGAMNENGALRLQLDVLVLQQNLKNIIIDPTADKAQDSTLEEPGNPDKVLCTSAKCQIP

SEQ ID NO: 35442 - protein, 67 aa, A.fumigatus
AFNYNKVSLASRILVPEAMSIDLCCRCGSVDICMVVQALKFFQASARFFRQAYDYSLPTIVPERQPC

SEQ ID NO: 35443 - protein, 101 aa, A.fumigatus
TNNMSVRVVARVRPLLKAEREQDIILRTGPSSQTLPPKGDQKSTRGNSAVAKLRDRNTIVRIPNPKNENEEYSFQFNAVYDADASQQELYDAEGSLRASLI

SEQ ID NO: 35444 - protein, 158 aa, A.fumigatus
PPRYADIIPSVAPTVKHLFNGFDVTIFAYGVTGTGKTHTMRGGKSLAERGVIPRLLSSIYRRSRKIEKDSEGETTVKVALSYYEIYNDKVFDLFEPPEKRTLAGLPLRDNGGKTVVVGLTEKPCTSLKEFESLYDHANINRSTSATKVNRHGFGNQDT

SEQ ID NO: 35445 - protein, 100 aa, A.fumigatus
LNAHSSRSHAILCVKVTISSGDKVRVSTASAIDLAGSEDNRRTDNDKERMVESASINKSLFVLAQCVEAISKKHQRIPYRESKMTRILSLGQNNGLTVMI

SEQ ID NO: 35446 - protein, 122 aa, A.fumigatus
  UNSURE (11),(12),(14),(15),(16),(17),(18),(19),(20),(21): Identity of amino acid sequences at the above locations are unknown.
GVRASKIPGRXXFXXXXXXXXAPRRLRLSLTKPLRRRGRLVGIIGATEYVVNTPKLLYRSTPQDCDYSHMTSMSVRSFNLNEGLRIPVSINLIQLLYVHFSRPWNCNPFFHIPPARVQDIQN

SEQ ID NO: 35447 - protein, 68 aa, A.fumigatus
RKTSVFDRIIYTPIIHLLWEVFNYTLQKVESKAFIGFGGNQFLEDTKDTDQLLVFQDELRTTRDNRRK

SEQ ID NO: 35448 - protein, 76 aa, A.fumigatus
LYQNLSSRLLCYGQSMDEDLRWPCMDEHDMTAKQTAVFDLKASWCRGATTWLANIRTIGSVDSVHDNHEHLSEVIR

SEQ ID NO: 35449 - protein, 216 aa, A.fumigatus
  UNSURE (88),(90): Identity of amino acid sequences at the above locations are unknown.
SYQILMFFSITAVKKYFDSIMQVILTRLQNSKTEHLILRFVRFYHFISAHDDKGYSADYFIQVTDKVQAEYVEMNFCIADLKHILTDXSXFTPIYLNIILPETQKLARPLDRKTAVLSFTKTLANSEAFANRYKKGWAFTCEALLKLLELPPLPASKDDIIAEHDVEDMAFGVGFTALNTVRPQPRDPWPDTGADLKAWVGCFVLPGGDWKEYHPP

SEQ ID NO: 35450 - protein, 141 aa, A.fumigatus
LLRGCMLTLRISGSELVSDHASRNLHLLLAKRPEFDQGDYEAAIRGALIDEDAVLLETFNNLTTEPAVSGSTVALCFVNLTKGDLVVANLGDSHVILAERDNRTDHPSHIVSEEGLLIPKGFWLIDALATAFKIPQTGYTR

SEQ ID NO: 35451 - protein, 139 aa, A.fumigatus
HLPSRLLLGSLNMSRALGDLQYKNPINNAGDEYSSSKNRRASASTSAPETRGNFLSVEPHMTGMTLSPDRRYLVVVTSDGVSDNIDDATLIHHVMRLSMRGMRAGDIAQEIATTAAAQKAKEGSDNASCIVALLDGQNT

SEQ ID NO: 35452 - protein, 168 aa, A.fumigatus
VWESLFAHFSVWSSDTPRFAAPANPEKLEQALYPPFANILQGDVQGIVQSERNRGLGTSLSANVCAEFMPYVFQLFAALLEANPSGSLPNYYQNLIAPMLMPVMWESKGNIPALVRLLSSIIPRGSQFILENQQLVRILGIFQKLISTKANECFGFYLLESVVENFPQ

SEQ ID NO: 35453 - protein, 66 aa, A.fumigatus
CRSRPSEKPLLLSKSISNTAVILRLIRLQVQGGRPFQEDRCTFVLPDQFPSQTNDKLTYFAVYDGQ

SEQ ID NO: 35454 - protein, 435 aa, A.fumigatus
  UNSURE (5),(6),(7),(8),(9),(10),(11),(12),(14),(15): Identity of amino acid sequences at the above locations are unknown.
STGGXXXXXXXXKXXPAWDFRGPDPLCAELHGRIQLPMSVNLCRSFGNLLNNIGQETKYDILVSKALQFLTSVAGMPEHASVFQAEETLGQIVEKVVLPNVSLRESDEELFEDEPIEFIRRDLEGSDSETRRRAATDFLRRLAEQFEGPVTKVVLRYSDHYLAEYSKSPATNWKAKDTAVYLFSAIAAKGVATASHGVTATNPLVSITDFFQKNLAADLVVDESAHPILKVDAIKYLYLFRSIITKDQWQEVLPLLVKHLGSPNFVVYTYAAIAVERVLYLADSQGQPIIAPATVTPLAKDLLQHIFSLIQKDPAPEKVQENEFLMRCAMRVLIVIKEDVVPYTDIVLQHLINITDVISKNPSNPRFYYFHFEAMGAFIRYGNHFSLISRFGVLTHPDSLHRPILRSSNKRSTHLSRISFKATFKVLCNQKGTGG

SEQ ID NO: 35455 - protein, 97 aa, A.fumigatus
GDLLDYFLYYIHWPKVCLKGSIRKLTSSFIFNNIPQIVWYAPFTAVVITQQFWVGANGLFNGLYLSRLLYRIHMIFKDYPSTEQQPALCLYVIHLTY

SEQ ID NO: 35456 - protein, 144 aa, A.fumigatus
  UNSURE (141): Identity of amino acid sequences at the above locations are unknown.
RGWRLLKNEYLQYLCQIQANEPHMNRQYSLTISRVEDARLVFCIETSTYIRKSLWYVKHAGNSIIIHYSKMLHHCWPTIDPLLFSHQDRRSTETQWSAKIAMKIQAEKAIVFKSVHICTHPYPYKRDREYFSKKIDWRREXTYK

SEQ ID NO: 35457 - protein, 68 aa, A.fumigatus
SLHFLIRLQNYKRYIAAVDSAPLLKFDGSIALGLPMLSFFSSCLPTKRKEWRKWNEIEGLRPFFFFAI

SEQ ID NO: 35458 - protein, 151 aa, A.fumigatus
TNAVIEEASRLDQFPSWDAPDNLLLMQTFEWHMPADQAHWHRLRHILPSLKEIGVDNIWIPPGCKGMDPCGNGYDVYDLYDFGEFDQKGSRATKWGTKEELLELTAAARDLGIGVHWDAVLNHKAGADFTERFLAVQVDPESMYPFSREVG

SEQ ID NO: 35459 - protein, 210 aa, A.fumigatus
YTALGRNVEISRPKEIEGWVGFDFKGRGDCYSSMKYRWYHFSGVDWDESQKKNAVYKIVGPNKDWANDVSHEFGNYDYLMFANLDYSNAEVRRDLLNWGEWIGTQLPLSGMRLDAAKHMSAAFQRDFVDHVRKTQGPDFFVVSEYWRCDLKELLHFLEIMEHRVHLYDAVLVDRFSKISLTPEADLRGILDGTLVQSKPQHAIVSFLLVF

SEQ ID NO: 35460 - protein, 164 aa, A.fumigatus
  UNSURE (164): Identity of amino acid sequences at the above locations are unknown.
SYYKIKDNPVSSGVIFTGSGEASIQQSVRAAAGFRFSQKPGSSTHTESSGIISTRETASVRAASLLALVFTILTRQIGFIRYGNRRHPSGLACIMSNAGPSQKRMFVGQQHAGEQWTDILEWHSGTVTIDRRGYGIFPVSKVSVSVWVNAQAERRESLKVTCTX

SEQ ID NO: 35461 - protein, 143 aa, A.fumigatus
VPVASFFKPLAYALILLQNKGQPCIFWGDLYGIRGGKHPTKRSCGGRLPILTKARKLYAYGEQRDYFDERNCIGARCLTFGPRFHHTDKTNRIYSLWQPAASLGFSLYHEQRRPIAEAHVRWSAACRRAMDGYSRVALRNGHD

SEQ ID NO: 35462 - protein, 84 aa, A.fumigatus
LRGAMARLADQSVDLNLKLMKWRISPDLDLEKIKRTRCLLLGAGTLGSYVARNFMVRLPIILLNIHSPCCWSIGLGSYEDNICG

SEQ ID NO: 35463 - protein, 173 aa, A.fumigatus
AWGVTKITFVDNGNVSFSNPVRQSLFNFKDCLEGGARKATRAAQALSEIYPGVETTGHVLSVPMAGHLITDTEKTRKEFGILKAIVDDHDVIFLLMDTRESRWLPTVIGKAAGKIVINAALGFDSFVVMRHGVRNDADPTSELGCYFCNDVVAPMNVSHHSQVSCLYATDFFN

SEQ ID NO: 35464 - protein, 179 aa, A.fumigatus
ATIPKCRVFMRLTSLIKSVRDQTLDQQCTVTRPGVATIASALAVELLISLLQHPQGAAAPAALPGDDRGSHPLGLVPHQIRGFLSSFENISVIGRSYDCCSACSINVVNAYNEQGWEFVMKALNEPGYVEELSGLREVSRNKPLLTYPVFLVFHFPCPRQITQPQPEISGTGHKQGNFS

SEQ ID NO: 35465 - protein, 89 aa, A.fumigatus
DLCRAALQFSFDTLRTGGHFICKFYQGVEDKELERQFKALFHRVHRIKPESSRNVRAGHFEYCYKSSRTDLRRNLGKRTLLASTEGITR

SEQ ID NO: 35466 - protein, 91 aa, A.fumigatus
YYIDRIPTNQNLSQTPSIGVYLTKKGPSTMFFSSCPTKTIILEINNTTSSLIFKRHSSSKRWQARQIKDHFTRAAAVQGLKSRAAFKLLQV

SEQ ID NO: 35467 - protein, 154 aa, A.fumigatus
LCQVAATRTQPNGRVLGVDIIPAQPPKGVSTIQGNFLAPDIQAYVREFLRDPCRGRLRSPGSCDGDEHNITTSSSTAGLEQNRECIGQNDAVSERTVDVVLSDMCAPWFQTTGFWKRSLSDPYNRMMNTSGVNFRDHAGSMVLQQMSHLSYIFD

SEQ ID NO: 35468 - protein, 163 aa, A.fumigatus
IHSGLPPHGLRPRGKSRAGPPSRQTRGSLKPPLPRRGCLPHLPLPLRGHYQAQLHQAGGLRAPEAGVPEGNQPLDPAHPRGDRASHLPHRQRRRPHPHLHPHPSRRRPVQPRPHRADHDGPRRVPARQQPAHARDPRARLGGCRRRDPRHGGLSRGPCGPGLA

SEQ ID NO: 35469 - protein, 330 aa, A.fumigatus
RSCGSRDGSLLYVFPLETRGPLIVVSVQNPSIPSTTAPSRTLSPSSTISYRYALDLHDTTASLLTRQKNINDAASDEYTQAFLPTASALEEKAAQALQAGKHEEASNLLCRAAVVYRISRFPYVDITKPNSIKRVAFERQKQAYLKATSLWTQPIREVTVPHTYRTGNDGAHIPIYIRTPAGADQSNPVPIVLIMTGLDGYRPDNSQRTHEILARGWAAVVAEIPGTADCPADPADPASPDRLWDSVLSYLDQRPELNTAKMVVWGLSAGGYYAIRAAHTHRDRLLGAIAHGPGCHYYLDPEWLAKVNDHEYPFEYASLARVQKKNKLTG

SEQ ID NO: 35470 - protein, 207 aa, A.fumigatus
LIAIPTTRSRNSVFLYCPRSVILLSSLTMRTSVQPTSVLLALMAIPFASAEKVLGAYIFARHGDRTPKVLGNTQLTDLGYKEVFLTGSYYHDRYINSSSLHYIQGISEEIVNLNQISVSAPSDNVLQNSATGFLQGVYPPVGRMASQTLGNGTTVEAPLNGYQLIPLALIETGTNSESNTWLQDATQCQNAKVSSNNYYSSALYKDL

SEQ ID NO: 35471 - protein, 83 aa, A.fumigatus
  UNSURE (67): Identity of amino acid sequences at the above locations are unknown.
AADELREHKDIGSFIGNVPQELCQSASFNSTNVKCPNHRAFASINSHPFRITPTIPPVCMVSDPTAXKREFIIGKTSNPMNPV

SEQ ID NO: 35472 - protein, 63 aa, A.fumigatus
CGAMSSQMSPQAMSPVGTSIASNSTDLAGKVKTRLIAKRPSVIICFSSLVEARTRFVQCQVVP

SEQ ID NO: 35473 - protein, 67 aa, A.fumigatus
LLKMARLKQMELSAPFDLSHHFSSTTVRRESSNLKRLYKYYVIPGMGNLSGGMQGELFLIVSLNQCK

SEQ ID NO: 35474 - protein, 362 aa, A.fumigatus
RFRPFSRGCRIGQNPTGGTMSIHRRKEIYALCQRYDVIIVEDDPYWNLQYPSAQRLAARYRNTPIDESLTTQNGNAHGNSSGYPFLDSLVPSFMSLDTDGRVIRLDTFSKTIAPGCRLGWITAQPAVIERITRLTETSTQFPSGFVQAMVAGMILGQQADEDVRGPKSKGKSGWKMDGWVRWLEGLRGSYERRMQAMCITLEEGKYVIKGDGSEPSESSEESGWEVIDKVQMYDFTWPMGGMFAWVKVLFNTHPLYDKYSLETLSKALWVHMTQEPFLCLMVPGDLFAPSQKAMDQAWQYFRLCFAPMPEKDVAVITNRLVEGFRAFWQRKDLDGLDDTEELLQKFRNLQVEGMGHMMGIGC

SEQ ID NO: 35475 - protein, 345 aa, A.fumigatus
  UNSURE (81): Identity of amino acid sequences at the above locations are unknown.
ISVSKATGIMTSVINSLSDTDLAEEIEAINAIYDPDTVTVHFSATSASAATANSTLNLGSSDPGESLNTTVKLQIPDHPNXSFFLGFHASYPDTPPKILGTASTGARGERKIAVDVLEDIVGRTYQPGAVCLFDVINEAVEAFRELSLGGHNSSSNTNQDSEKRGAEAETRATPARVAADIATLALQDPFGLDSPPEWVLSDVVTEKKSVFVGRAAHVTSLEQAQGYLDHLLATDKKVAAATHNISAWRIRQQKPANGKGESAEMIVQDCDDDGETAAGGRLLHLMQLMDVWDVVVVVSRWYGGILLGPDRFRIINAVGRDALIKGGFVKESTGAAEKGRKKGKR

SEQ ID NO: 35476 - protein, 779 aa, A.fumigatus
DSLADMLSVLGMTYGDEEKLETLKYRLLTKAEDLGSWGHEYIRHLALEIGQEYQNRLNAEKDVQDLIDLSLSLVPYFLSHNAEADAVDLLSELEIIEEIPRFLDENTYSRVCLYMVSMVNLLTYPEDQQFLRTAHEIYVRYKELTKAIVLAIRLNDTDLIKSDINATSDPVLKNQMAFLVARQQIWLDMPEEEENTSFMDCLNNITISKHFKSLGKELDILEPKNPEDIYKTHLESSRGAGLTNVDSARHNLASAFVNAFVNAGFGKDNLMLGDDDKGSWIWKTKDDGMLSTTASFGMLLSKDTDTGLDRIDKFTYATEEQIKAGALLGTGMIGSGVRLEADPVLALLGDPEVWQEKSVPVRVAAIMGLGLAYAGSNKEELLEILLPVVEDVSLDMQLSAMAAVSLGLIFVGSSNHQVSEAIATTLMDEERQKHLKDKWTRFMALGLALLYFGRQEEVDVILDILKAVDHPMAKPTSVLASVCAWAGTGTVLKLQELLHICNDLIEENDEKKGDELVQSYAVLCLSLIAMGEEVGQDMILIQFGHLMHYGASNIRKAVPLAMGLISPSNPQMKVYDTLSRYSHDNDNDVAINAIFAMGLCGAGTNNARLAQLLRQLASYYHRDQNSLFMVRIAQGLLHMGKGTMTLNPFHTDRQVLSRVAAAGLLTVVVSLIDAKQFILAEHHYLLYFLITAMYPRFLVTLDEDLQPLTVNVRVGQAVDVVGQAGRPKTITGWQTQSTPVLLSYGERAELEDEQYIPLSTTLEGLVILRKVGLSDDTSA

SEQ ID NO: 35477 - protein, 79 aa, A.fumigatus
AASTDLSSLSFYRPHPNRDQLARYPSEMAKEGERSAPADKGKGKVDDVKDLPGAKKTQNDEKTQANGKKKEEESKEGMS

SEQ ID NO: 35478 - protein, 74 aa, A.fumigatus
DLNLLTDDVNPGVFLHQEPDTTLYAPALDAIKNFIKTSTSSMTAVPKPLKFLRPHYDELTELYEKWPAGAVKVG

SEQ ID NO: 35479 - protein, 62 aa, A.fumigatus
RDLINTLSAAVRDYKQLPRTFLAYLFTVLTQTETNSPGTRQKWRKKARGQLPPTRARARLMM

SEQ ID NO: 35480 - protein, 102 aa, A.fumigatus
FPCTSAYVGFNVLNLLCSFQPKLTALNVKHQITTADIFHNKVHPSFRLETGVKVEKEWMAFLISDQEDTLFGFSALHFIILNDELLLQHLDGIKLLGALCLC

SEQ ID NO: 35481 - protein, 186 aa, A.fumigatus
HSIVSPGLLIFHRVTRFEVSRENTTFSSSDHLATMDGDDLIASVYRKIEREKALITAASNMRQSTDNPLVQQRVDANIRDGRKNIAYLEEKMRELQLRQMKQEGASPTDKRLPPNPDGSAPVPPPKDYAPGYSGHEREYGDASGAYPHGGAGTMPSGAPFADPRPFAPVPKARPNYTKLGRFLLLV

SEQ ID NO: 35482 - protein, 171 aa, A.fumigatus
ICDSLAECGLTCHAQCTHLVPDFCGMSMEAANQILETLIRAKNHNKSASVSSGLSGRTLRPGGPPQAPQDNVALAYPQKPVEGAYGAPQRQPSAEAISAATNTYIPPQSPTAAQRQHIPPRTSSSQSPAAAAAAAAAAATGLRTPQQASGTLDRFSLHHSVRNMCPCLPCL

SEQ ID NO: 35483 - protein, 154 aa, A.fumigatus
VSVYHIFHYISALTYFIAKQLKDRRPFDIGLNRQGAVRQKKEEVHEKQGHKFVTQQFYNIMRCALCGDFLKYAAGMQCADCKYTCHRKCYPKVVTKCISKANYETDPDEEKINHRIPHRFEGFSNISANWCCHCGYLLPFGRKSAKRCTGMSSL

SEQ ID NO: 35484 - protein, 122 aa, A.fumigatus
DRLLTGDRLRIDLIKYDTPYLGPKIQLMLSQLEFKLSVEKQYKAGIEKMVRLYQDEGDRKSRQDAEGRRIESNQKIQLLKQALKRYEDLHVDIESAEAPDGMLRALPLLVVWPLHSAVTDFV

SEQ ID NO: 35485 - protein, 209 aa, A.fumigatus
TDESLSTPNLRKPLTGLLTLRIHAVEDVDHAASSRFSRGPETFVVVKVEDAIKARTKATRTDKWQDEPFNIEIDKANEIELTVYDKSGDRPTPIGMLWVRISDIAEEMRRKKIESEFNASGWVSADKMEHGAAHGRQDAGGAPGSSNRPPSGGHSGGPGQGYAGGAPGGASACPVLIDSWFALEPVGRIHLTLSFGEYLYTTFFTTSAH

SEQ ID NO: 35486 - protein, 271 aa, A.fumigatus
GCLRCPSETAISRGYQRRNQHLYSSSVTHSGSASAHTSANFFLAKPRSRRRRCCCRSHRTAYAPASFRYARSIFLAPLGAQHVPLLTLPLDPNRPVQPPPSSHAHYDPAAYASYQQAIPPQAMQKMGAPYGMPQQQQQQAVAPMQQQVAVKEEIPPQQPKVRIGLDHFNFLAVLGKGNFGKVMLAETKSTKKLYAIKVLKKEFIIENDEVESTKSEKRVFLIANKERHPFLLNLHACFQTETRVYFVMEYISGGDLMLHIQRGQFGLKRAQ

SEQ ID NO: 35487 - protein, 138 aa, A.fumigatus
KKTDAESGEESARDEQRNRSGGGLKDDTKAEDARVDNHTKAASKVIGNRRGAQSSEESASRQQGDDHRRLRGCDIRVVVVRIDVAGGEELAPVWHGKDAADGAGIIAMCSPLVSGCAKVSEAERLTRTESHQTQRTNQ

SEQ ID NO: 35488 - protein, 297 aa, A.fumigatus
YRHHQRHPCHAILAQALLHRLHQSGRQLPGYHILAIVDDRLPVVCWHFLRSSGRRAGCRLLWTPPWYDYQLGRLLLWCHPSDRRHCDSVVRRGQILRRIRRRSSFSDWYVPHHLFVHPGGRVLTGPVPLYQSETAPKWIRGTIVGAYQLAITLGLLIAAIVNNATKDRMDTGCYRIPVAIQFAWAIILVTGMLVLPETPRFLIKKDKHEAAARALSRLRRMDVNDPALIEELSEIQANHEYELSMGTASYLEILRGTIGKRLATGCGIQALQQLAGVNFICMSSFLFVLELTAHMCV

SEQ ID NO: 35489 - protein, 172 aa, A.fumigatus
SESPMMQWAPRLLPSSLVCSLRLVGFCSGKSLGLTDLGTTADQRTAHSYDTGTISGILAMPYWRKLFSTGYINPDDNYPDITSSQSSMIVSLLSAGTFFGALGAAPVADYFGRRLGMIINSGVFCFGVILQTAATAIPLFVAGRFFAGFGVGLLSATGMFLIIFLSILVAVC

SEQ ID NO: 35490 - protein, 155 aa, A.fumigatus
IRAQHGYGKLPRDSSRHHRQAFGYRLRYPGSAAVGRCQLHLYVLISFRTRTHSSYVCLVYYGTTFFKASGISNPFIITLITNIVNVMSTFPGLYMVEKWGRRPLLMFGAFGMGLNQFICPIVGLSPFSKWAKKTGSPWGDFNFFFSRSREPGVGL

SEQ ID NO: 35491 - protein, 130 aa, A.fumigatus
TGSRAEAASSRPRAPLCLQGMSLTDLFSLHLGTSNDIRRLLSRLPVPYLPTAIPHNISSHQDIQTLLQDESPLFYKVTGPPKSNTMSRSCNHLYGARVEWCAPFLLAALGNVRHTVHGDKFPGSRSPVTL

SEQ ID NO: 35492 - protein, 111 aa, A.fumigatus
VDRSLSSASSFSQPMQELVTEAGWGAVWSRPGLDRKSRSLLNTGMLCALNRGAELAVHVRGALNNGLSEVEIREALLQVAIYVGMPAGLEGFRIAEKVLSEIREEQGPGSG

SEQ ID NO: 35493 - protein, 115 aa, A.fumigatus
LAVAIVGYGGAAPWVRGAVVVDLGKRMNRILDINPEDCTCLVEPGVSYYALYEEIQRRGYKHLWIDVPDLGGGSVLGNALDHGVGYTPYGDHWAMHSGLEVVTPTGEVVRTGMVF

SEQ ID NO: 35494 - protein, 143 aa, A.fumigatus
DLFCDPESLEACRHADVNCNLQQSFADLHLRKPIVERATHMDRQFGAAVERAKHTSVEQRPGFAVQAGTGPDGAPTGLGHQLLHRLGEGRCGGQGSVDLGPSGDFGADSEALIEEALVRVGQGGFLFCHDCGRTDLAVASVQN

SEQ ID NO: 35495 - protein, 237 aa, A.fumigatus
TAFYLRTAPPMSQPVAVVTGASSGMGLAVTKHLVAKGWRVAMADIDADSGRKVAAEIGDQVLFCRTDVTSYPQQASLFETAFAWGGDRLDLYAANAGIADTQFLCNNDYRYDENGLRLPVSLQTLDVNLTAVIQGVWLFKHYARRNKVAGGKVVITSSSAGLYPMESDPIYTASKHALVGLTRALGPVLQRQNIQVNAICPAFVPTGLCPKEMLGRFPKEHMIPSSKTMAFLDRLWN

SEQ ID NO: 35496 - protein, 332 aa, A.fumigatus
KPGGSPGEQTCSAVVQDAATASSPSAASVDAGTSQISSTDTSTASLSDEQELASEVIEGHGLCEKPELAALQRPRRNTDKGASEDTPAPPVEGKAPLAVTLGHEPQTQGGSPKLTRPAGTSDVSKTPDDDLSAATPPSARASDSTADGKPSRSAPVTAQSSRKVATGLVSPAREPSLPERARTRPVPVPLSLNTAGQQSFGATSPGSATPGSSGTERAAVQRISRPSTSVASSTYTKSRRSDSFGSHREKRPVTAGSTTSQVSSKLKGLISRQTDSATFLVRSSSETSRASAVTHDSVYDDTSGLDELIQSEETIHYTLTPKTVRDMEVWST

SEQ ID NO: 35497 - protein, 156 aa, A.fumigatus
TYPDGVANPYKSVELDVEIGADARDWSSVQAAEKLKPVETDLRRIEEMVAEIVNEMEYLRAREQKLRDTNESTNERVKWFAFGTMGMLVGLGVWQVVYLRAYFRYVDFPVSWRVDGVVANCCSCCEQVEASYLRSSRVVFWSPLVMWTRLSWLILR

SEQ ID NO: 35498 - protein, 107 aa, A.fumigatus
TRRGINNVVEPPSLIKYTDRTSHNLLCRPIYSSTMGSSPQSSTRALLGLLFLLLVQLSSALKFDLHASSGHNERCIRNFVFKDQLVVVTAIVSGQRGDGQVVNMHVC

SEQ ID NO: 35499 - protein, 68 aa, A.fumigatus
ESTYVHIHNLPITSLPAHNSCHNDQLVLKDKIPYTSLVVPAAGVQVEFQGGGELDKEQEQKTEECPRA

SEQ ID NO: 35500 - protein, 194 aa, A.fumigatus
TRPTTLRSLGPPKAGDYVAAKFTEDGDWYRARVRRNDREKQQAEVVYIDYGNSEILPWSRLRPLSQPQFSVQKLRAQASDAVLSFVQFPVSADYLQDAVSYLEELTYGRTLVANVDYVASDGTMHVTLLDPSVSKSLDQSINAEIVREGLAMVPRKLKAWERAASETLSNLRSIEDEAKQERRGMWEYGDLTED

SEQ ID NO: 35501 - protein, 506 aa, A.fumigatus
VAGNLAPRPAKRFNAGAKEQPGGPFGDEAYQFVEARFLQRKVQVSLLGVTPQGQLIATVLHPNGNIAKFLLEAGLARCFDHHSTLLGPEMAAFRRSEKEAKDNRKGMFAGLVAKGPAGGAAGQDYIVSRVLNADTLILRNKAGEEKKISLSSVRQPKPSDPKQAPFQADAKEFVRKRLIGKHVKVTINGKKPATEGYEERDVATVMQGNTNVALSLVEAGYASVIRHRQDDEDRSPDYDSLLIAEAEAQKDGKGMWSPKPSKPKQYQDYSESLQKAKMEVSILQRQKRVPAIVDFVKSGSRFTVLVPRENAKLTLVLSGIRAPRSARNPGEAGEPFGQEAHDLANKRCMQRDVEIDIETIDKVGGFIGTLYVNKEDFAKVLLEEGLATVHTYSAEQSGHATEYLAAEQKAKEARKGLWHDWDPSKEAEEAEEEAANGSNGAEGETTERRKDYRDVMVTYVDPASGKIKIQQIGTGTSALTELMSAFRSFHLNKANDTPLPWPTQGR

SEQ ID NO: 35502 - protein, 93 aa, A.fumigatus
FFLESDVHYVDDYLFTSVPKVTNYYFTDIPTTQKNQGYYYQRGAFSGILLCHLIRLASTKSNQQPLDGQTTFSDRFPPIFSIANLRYSPYTTE

SEQ ID NO: 35503 - protein, 324 aa, A.fumigatus
ALSNSHCPSTPLAQLTLTHCAFCGTATCPHDCMTVALNRPFVADLRQPGVTGRRCGPTIVEMIGADDKPQALPPYSGPPPPQMHHRIPPEAAHGLVNAPGAYDQPWRPYPPSFEHHHAEQRRASNPPQPSLPPHGYPVIPNRELPQLPPEGPYGRPNSLPAPSLTPTESHAPTFRPMNGASHDSIPHSAPTHPGPPPHSAPSEFRPRMTYPPQEQSSNGETPPAPPPAPHTMPPAQFPTPIPHISHTPAPYEPNYYQNQAFGMRQRKAARAQQVITVFFSNWRRGNKLTFIFFPLSKRPAISVEQEKPSVMKGGLPAAIARRTI

SEQ ID NO: 35504 - protein, 175 aa, A.fumigatus
LLSSVGWLLDTDHQARQEKATQQILDKIQYLEDKLDERLTHFQTVQMEHGMTLSKISNEVGLKEPKILAVKDATRSMPPKQTLDRLLKPSATDILLESESKSGDGMQPLDSNDPPGQSYVEREDGELSIPVEHTTAAHKLLSWPSIRNLLYPREYDEDYVMKRLHHGAGRGSAMC

SEQ ID NO: 35505 - protein, 80 aa, A.fumigatus
MRREHTISHGAPTHRPSSIITPSSDGPPTPLNLPCPLTGILSYRIESCLSYLPKDRMVGQIVCLLLVSPRQSRMRRLFVL

SEQ ID NO: 35506 - protein, 219 aa, A.fumigatus
NGGGIITRLMTDDENGESLGGQVFISREHYIRHVENLLRRTRGKELPGTFNSTIINDLFLEQSKPWEKLTSEHVREVWEAAKAFVKIAVTEVTDMSTSSAILMEVFDPSLDNILKSLEHKTGEMFRAYREGHPITYNHSFTDSLQQTRQDILMPRLSYAIRRFFQVPQLTSSQCLDDTFDLLHLRDSLMESLKADTARFAALQALDCMRAYYEVRRLAW

SEQ ID NO: 35507 - protein, 64 aa, A.fumigatus
EIESKTRGMYHTKGGTINSACNIHWPKLIEHHRTRQANTRICLLSHEYGPLMPGIQSFQVDAVV

SEQ ID NO: 35508 - protein, 160 aa, A.fumigatus
AMRFAYIESLPSVLSNPSHFLTLSCSTLLLLLPLVSIKLYKWLDVLLSVTISISMCVLGVRLVKTLGSMLLMSYSGPGVSDVIKDIEADPSVFGIDDARFWQVHYGLCMANLKIRVSGSEENLVRLRERISSLIKNRLGGGYGTGGQKWEVSLQFTVDNS

SEQ ID NO: 35509 - protein, 85 aa, A.fumigatus
YLPPLGIAVRLWQLGIEMRPILAKESLWVYPLFAGVGGSFGYWLQGVEDRQLKILAQRREAILEKRRRRDEREGTLEAGALAATS

SEQ ID NO: 35510 - protein, 334 aa, A.fumigatus
GLALATPLYPMAAMLTNVNSWTGVREMGSVVNCALTLFNSKKDSKAQFAFEAKEPEKLTAAVTEVEGPKKKFNKLPEIFDKLRLRSPKTVPGLNPECFMPGKYSYDFEMILHSGLPESTFIEGTIVRYHLKASVTCHSMLRGMYKSIEVDAVRCPTNAYVEDSVGGNWALHVDRVLHADIHLRRKGIALEDHLPGSFKYKGYNNTKFRKLQVFLVEDVRYFMRDGTQAGKAPYKKLLIYENSGHRPDVHPQQEEVSEEELNIFEATSTRVPLSSTNSDTPDGDAFPPSETMGFDFELDMPKCISHRGAPDFRYMHYDTKIRSVMVSHFFQVRLP

SEQ ID NO: 35511 - protein, 89 aa, A.fumigatus
DFEDSWLEGTSRAHITSGFILFFHPFDSKMESAIDMYWFHNDTSTVVTQILRDLDEKRKLAIVLELTEPAFSFPRPRATDLLCFGAAAR

SEQ ID NO: 35512 - protein, 98 aa, A.fumigatus
WINTFRRRRVKFFRSTKVPIHFLRLFYPPLSVIVHGGLVAVYIVSARYQAGPDMSDPAHPQPGAPWYITKKCTVAANKNNINYCRQSKALFAFTIIIM

SEQ ID NO: 35513 - protein, 399 aa, A.fumigatus
  UNSURE (282): Identity of amino acid sequences at the above locations are unknown.
SLRPSWFRATMEIAPPESDTVRLNKTYALQHERDTQDTMDVQTAPRSIPSTESSNNYSNAILQDAEPQPSLDATTEQVWVQRALAEMTDMLLLLRRDGTVLYASPSCKWITGYESKQIERDALSRFIHDDDKSVFTRQLEECIATARPLRCQFRFYKPNNTFCVIDAHGHPHIKNENNTCNGVFLVCRPYPTKSSALLDSFLEHKIENIRLNQRISQLRAEEEEDTNASRQAYLKQISGPFAQRQNCLPFGTYDATGSGEENESSDTVNTDDGEPGSLLESXMRQAQDMTHIDGIEMMTGLRYREGERSHGLSTGMRQGCLVNCDIDTATIEQQVQSAQEIDRRKRLKGEYLCTDCGTSDSPEWRKGPDGPKTLCNACGCKSPRRYPCCCSTETDCFPQ

SEQ ID NO: 35514 - protein, 62 aa, A.fumigatus
AQLKIIGTILKELNFVSNYLSYTINEGDFSVIATPGNSDTIHVVVKKLFIRQILSSHKGSSA

SEQ ID NO: 35515 - protein, 898 aa, A.fumigatus
RPKIDHASKLVSQLSPYLPESHIQCFRPSPFLYDLKPSPWEKLTYKLTSSLLSLGSNFPPLRSTTLSAINEYLYSCADAIDAITPLQRYDSAGDKFGSVQEHKRILSLAVSLVGFLEASAQFPSLWSASEKLQIVEHVRSMLSESFMVAIETASSTVRNASLADPTLRDWRRYTRQYAANRRPLGAMLLQQGFMRFVKSCATSLVGAQNLSDEELLDDYMNGVGIARSSDDAEITLIDRITEIIADEIQLLEDGSDYLQLGSPLQKQLTFSVKAFALIGYLNCVILSGNAANSGAFLSWLEDTLADPNQMASLELATATLKSIAIISRMSLASASSGSRSLLRFIIEGCVLGEYTGSVAGKCLAQVLGILSQDAVITTLYSLGNALSPGSGSDKYYHSQLLNENARQADSVSSVPPPIGIGSTVSISAIGDHDNATCRNILRAIVTIAVSSNDEKISALAQSMLLQKIGKVNIAVDALIIRETASLSLSTGQADFQLLLKFYDRAYQDSIARNFSDVTNAVKGAMAYISLTLRRDSPLFRVYLVHLLECIVNKGDAVSESERQKEVVLAPEAISFLLRPLALLISSDEGGAETQQTDVIYDEDVTALFRDAWFNISVHGISTQSAVTRSHIRELRLLAKNSPPLIAESRLEMLESDVELNTILRRGMSPQRLIELKRILMAELPDCESGIKHLNYPKVVFLNASLLVESLRASSGNCTKVLNYFRDPALTTADMASCMSSIADKVVADYLSLTLSADDENFSVPYLSKELAQFFMACCHRIERVQSVAMLCADKIIRECPSALCDKHSLFALLELLTVMWLSCLEEELDEFEWKASYASPMGIVKVDLADDYNARKRTLNTLLERAKAWVAAVIDIAPLDVKGLLQASTFTKAFGIDC

SEQ ID NO: 35516 - protein, 75 aa, A.fumigatus
  UNSURE (57): Identity of amino acid sequences at the above locations are unknown.
VVSRGQRRTESVFLVYKRNVYWDVVLWWFDLRVVVEAGGLAAGKIEEGEGCAEAAVXGACYEDAEATREGDEVFV

SEQ ID NO: 35517 - protein, 165 aa, A.fumigatus
PGSKRAMKPSSMRRVTVPSPGDSKTSLSEVSTFLSPTAQKSNLTHTGGENIYPLEIEERLAAHPAIEVASVIGIPDQKYGEVVGAFLALAADVSARPSDEELRAWTRETLGRHKAPQYFFVFGEEGVDRTIPVTGSGKVRKVDLRKIAASVLERRLAKTAAIKEK

SEQ ID NO: 35518 - protein, 110 aa, A.fumigatus
  UNSURE (48): Identity of amino acid sequences at the above locations are unknown.
TESTAFVHLPHAPPYPSICSQRSQKNMPSNEHLVSLARRFRVLIAGAXYSGLSAALTLLDLSRGQPSRFNYDTEIKPPQHHIPVDITLVDEKDGFCTPLPSTYNLSALTR

SEQ ID NO: 35519 - protein, 130 aa, A.fumigatus
  UNSURE (119): Identity of amino acid sequences at the above locations are unknown.
RRLQFPSTVANANYHFAVGDLAAWSGIKRCGAAMHMGHYAGYNIHQLMLAECIASKPVFQELQEIPPMIGLCLGKTAVSYHPVDGVKDGEDILASMFGDDMASKVCFPPACQGLCLCKXTCCWNYMPAVG

SEQ ID NO: 35520 - protein, 257 aa, A.fumigatus
SEVTEERVQEQRVESRGGRGEDGTRRGARPNRSVPRRRKKWDCSEVQEGSSSAGRLVAGRLMNRRQEEVNVPEDPRQFRNAYPGSVRGCAVANELQASPKPHPLVSTRLTTDSIERLLTTVGKVMLHAKAKIIDTQGHIVPIGQRGELCIAGYQLTKGYWNNPEKTAEALITDSDGVTWLKTGDEAIFDEEGYCTITGRFKDIIIRGIHFSLPDRTKIKSNPHRRRKYLPSRNRRATGCTPSHRGSLRNRHPRPEVR

SEQ ID NO: 35521 - protein, 436 aa, A.fumigatus
  UNSURE (435): Identity of amino acid sequences at the above locations are unknown.
NAGCRTCRIRKVKCDEERIIVDSKKEPQCRRCSVARISCEWKGGPIPRRSTTGNRKSLKSGTHASSHGSMRRPADLQTALLPGCTHDSSLQAANSLVLSGSDRSRLNYLQDSVLVTILGKQWPWSTVSYTYHRVAVKEPMVMSMILATTASEIHRSRLHDSDSTCLYSAAGDFSDIDGRVHYGTALSRLREALAEGVKTSSKLEAVFITLWLMIDYENRFGSGASTINIHLQGIESILHNHILPLLKYEDCSAAAITAESPGAAGLLFDNSAEGASLTERVARSPVDSVAGPSAGKLVYTAVPLFLLWTLYFFTPGALFFGPGAVYEPGFEKVNDDLYRLFRLFLHAEDENTRLNLENLYRISRQSPSKFWGEAYPAKAQLDDLENYPGLALYHKSHVVQFRITELFRQARGTPWNEAPYQQTVVFATERKSVHXN

SEQ ID NO: 35522 - protein, 269 aa, A.fumigatus
PFQIWSNPELAYEEHKAHDHICELFNTLEGYEVRRKAYGLSTALEIEYKHGAGGRVVVFNAEYDALPNIGHACGHNLIATSSIAAFIATCEALKIHCPEGLGYTVRLLGTPAEESGGGKVRLLDNGAYKDVDACLMVHPMPLIPNAPDLLCIAATVPGGFLANDKVRVTFTGKPAHAAAAPWEGINALDAVVSAYVNISLLRQQLRPAERVHGIIVNGGDRPNVIPMSATVDYYIRSDTVKSLKVLTNKVIKCFEAAAVATGCKVDFEW

SEQ ID NO: 35523 - protein, 64 aa, A.fumigatus
SEKIHKSHTSTMQFPVSQQLFIGSVRNAIHKYDAQLKDINNKVSLTTITSVVLANRFRSGRIRN

SEQ ID NO: 35524 - protein, 112 aa, A.fumigatus
IPDASYDCPTDWHVAEPPPHMNNIIADPLHLPTDIMSIRVNNIRSNENHQANGKTTQSSEARHHKGGAQVGMTGRGGFRAFLSVVIAAAAAAAVTVTVAVAVAATAVAAAGA

SEQ ID NO: 35525 - protein, 61 aa, A.fumigatus
TLWPRANFTTGLFTCNTNPQLIQLRKDSFLAFCFTYLYECLTRVNSDETAHISASARLSHP

SEQ ID NO: 35526 - protein, 236 aa, A.fumigatus
TDSSNFATCCLPQTLLAPCSSTQLVSTSILHPNSLKITMRVSAQLIAGMAFVASANAGLYRRAHETSTSTEVTTTPTETATATPVVDQEVSATETNTSATTESEDVATVVSDADAHPTETTSIPLIKATVAVSSSAAASSPAAGISTSASPKATGTGDYVGFVDPNEESSTSSSHSSGSDSDSDSDSDSSSSSSSNDDAKESSKPTTSRHTNLGSTLVVPGLAALGSLAIGLMILV

SEQ ID NO: 35527 - protein, 159 aa, A.fumigatus
PLPQPKPPRPPPLSTKRFPPPRPTPPQQPRARMSPPSSLTRMPIPPRRQASLLSRPPSPYPPPLLLVPPPPASRLVRVPRLLALATTLVSLILTRSQAPAAATAVAATATATVTVTAAAAAAAMTTLRKALNPPRPVIPTWAPPLWCLASLLWVVLPLA

SEQ ID NO: 35528 - protein, 92 aa, A.fumigatus
  UNSURE (57): Identity of amino acid sequences at the above locations are unknown.
SIRDQSPAFLYMNSIILTRLANTCTYGVNDNDSFSICSSKIMTWKPNLPTVTNNPPXLHQLHTCSVNLFHEEEEGEYAPRQGLTIVPTKPPV

SEQ ID NO: 35529 - protein, 166 aa, A.fumigatus
NHSSQHSVWGTGETSSALGVELTITIFQNGGVVRHHQRLGLVSGQHRTFLKLTRLIVLPAYRADQAASVSPAKEVTKVALRLKYQIEQVIPFEIDENSITKPNSRIITDEVIQTARQAGGDDHKDCVVYCLLVCLRWFKLQAEAELWESDLHLRRALACEVTAKRM

SEQ ID NO: 35530 - protein, 290 aa, A.fumigatus
EKRPDLSEKVRANNAFSIESEEDQDSLMKDALLQRYSIILDGEPTTPANVIERAVDLHALRVIGSSGYQKCIKYLWRGWFCQEEGNPTNFVPYHDKDNTDFRIHFHPDRMRAPLYQNACQILFSLIYLLLYTIVINTVNATGDLDVVEGILYVMTLSYICDELTKLWKVGRDYFDFWNAFNSTLYTILAVSFFLRVAALTRSSSVEDEQRKTLNQLSYNFLAMAGPMFWMRMMLYLDSFKFFGAMFVVLRVMMKESLIFFALLFVIIGGFFQAFYGSLHHGAGRIRRWRY

SEQ ID NO: 35531 - protein, 88 aa, A.fumigatus
PILTVPKDPPSNRFRLCTGYIDLSKRRVSPEDVVKCEERYNKSKAVHSIMRHVAEATQTPLEELYQKIGWPLNRKYGHAHDAFKISIT

SEQ ID NO: 35532 - protein, 176 aa, A.fumigatus
DQPVRLHFFDRMTHLINRNPDVWQDVEFPSEAVKKELTQYISKKLTPSPTKVRADIEVTCFGYEGIDAVKNALRTAEANNTPENQIKVKLVAPPLYVLTSQCLDKNLGIKLLEEAIERIDSEIKKAGGGCVVKMAPKAVTEHDDAALQELMDKRERENMEVSGDESMSESDEGVPE

SEQ ID NO: 35533 - protein, 368 aa, A.fumigatus
HETAVKSDNESCQKAMFSNAKLRLLMSLVRFERLGMEDVPGASWVVPSSLNSQELRHTRSIIEQCLTEPVTENSDRDLSQLIRRKSGNNTRRDRDDQMANVDFGSDSEGDDNVPDGPLFPPNPRSRANALEQLKKQRKKRRKQAGEEEEPDEEDLEARRRARLENALARQAKIKSDLYIHASDEETDEEADQEFFRLEEQRRKEQAERIRKALLHGVVEEVSENSRKKSSGRKRQSDQYTASTADSQSKRQRRLQQTEGLDGNDDLVVAGTEARSPDSLGQGSPSLKGANDVEDTLVTSEENELDFDDDLAFSRNRTRDKVLSAENDDSDTEPPAPDTIDEDGEEAAAVAAPPRRRVRAGFVIESDSE

SEQ ID NO: 35534 - protein, 718 aa, A.fumigatus
QRTVELLVPLTWPLEVHSEMTVNHHRHTPYLQQAQVLYKRGILSHGSGSILRTIIRIGLPSMAVPRSERTTRDEGILKLMLYFLRNIAVISPNARLAAEGDEEETSRSATINAFQNQDAFALLLTMCSNVGEDFSLQDVVLLEILFHIVKGVNVEKLFMNDAQRKAKRTDELGELLQKESSLRREYAKNAPTRHGRFGTMIWVKRDDAKVSTVSGQDVLKDSQTTLHKMDQSKKWNKPQIRRRAAEVTANNDFNTPVNINSTATKNLRMFVEEFLDSGFNPLFTHVRKAIEREADRVMDINTRQFFYTVAWFLEAERVRRAHQREIRHLGDTPLKEIEPDSFALVASVLNQETFVFLNRSMQYSYDNKDVEDLTAEMRCFTQILLTVQEMAQSPLEEDQEIADNIQNRIFYEETTHDRIVAIVRGYKDQGFGYLDACTELAHVFLRMLEHYSKENVDMHVRSRRRAKRKAKQAKQADIEGDDEEEASEEEDLMDVERISKERKFDFRRFAAKFCNQSCVDTFIAFTKYYRELNVDQLKRAHRYFYRIAFKQEMSVLLFRLDIINLFYRMIKGPGALDSNKPIFKEWEELVRQIIRRMIKKIDQRPALITELLFSKINSTVFYLEYGHEKQTISASKRPPAELEVEPREAKTIDEKIRIVVHVMVKDEHTDLVKWVSDVLNSAADEREAWESQEQHSGGQKAPNPMIRTSSGFSWLVVR

SEQ ID NO: 35535 - protein, 820 aa, A.fumigatus
  UNSURE (795): Identity of amino acid sequences at the above locations are unknown.
TLKMPSPAKKRKREAPDSTPQRVRSIASFFQGQSNKKAEKTEQIVDSATESAADETLSDEALARKLQAEFDKEGDAPAVEHEVPNHKLIQEPYAPTESDSGPLKKVPKTNTISLQSSVGTEDTISLSIPFDQSPLTFDSTKCAAELQVHWATEGGNASYALLTRAFVLANATTSRIRIVDTLVNFLRVLIEGDPSSVLPAVWLATNSISPPYDELELGLGGSAISKALKKVYGLNPYGLKNLYDKYGDAGDVAFEAKKRQSFTLMKPKPLTIKGVYQSLRKIATSKGSGSQESKQRIVEKLLQDTRGAEESRYIVRTLVQNLRIGAVKTTMLIALARAFLYSKPEGAEFTIRSRQDLTRLKKEELAEIYSRAEEIVKASYARHPNYNDLVTCLLESGVTEELLLRCGLQLHVPLRPMLGSITRDLSEMLTKLQGRDFSCEYKYDGQRAQVHCDEKGKVSIFSRHLENMTEKYPDLVSLVSQIRGESVSSFILEGEVVAVDNKTGELQTFQVLTNRAKKNVEIGAININVCLFAFDLMYLNGEPLLDRPFRERRELLRSLFVEIPNRFTWVKSLDATSADSETVLEFFKSALENKCEGIMVKVLDNAPKTSLEQNKEASTSNGMDVTSGEPLEKAGKGGRRKALLSTYEPDKRLESWLKVKKDYSTSSETLDLIPIAGWHGQGRKAKWWSPILMAVRNPETGSLEAVTKCMSGFTDKFYQANKDKYAEGTPNVISRPAYVEYYGEPDVWFEPQEVWEMAFADITLSPTYTAAIGLVSDERGLSLRFPRFLRVRDDXSIDEATTSDYLALLWRRHAERKKEE

SEQ ID NO: 35536 - protein, 115 aa, A.fumigatus
SNPRGSSITATYAINLQFYLTTADTTAQLAEAQQALLSASKASNDHAEATRKRAEAFKEEQEDIDKRLKAITGSNASDEAAKRFKVSIDKLRRLEISKGYVTLLREAEELRYLRT

SEQ ID NO: 35537 - protein, 60 aa, A.fumigatus
RTMDSSTSASSNTHGEAKYINFPTLPDDAKHEDGTTALNRYSSYITRGHDFPGARVCYPH

SEQ ID NO: 35538 - protein, 89 aa, A.fumigatus
AMLFAAGIPDREAMAKSPQVGIASVWWEGNPCNMHLLDLGKTVKKAVTDQGMIGWQYNTIGVSDAISMGSEGERIQGLRSIATLCVRYS

SEQ ID NO: 35539 - protein, 488 aa, A.fumigatus
  UNSURE (285),(287),(288),(298): Identity of amino acid sequences at the above locations are unknown.
RVFPGMRFSLQTREIIADSVETVTCAQYHDACIAIPGCDKNMPGVVMGMARHNRPSLMIYGGTIQVGYSNLLRKRVNVSTCFEAAGAYAYDTLRQPDDGGDTSKSKDEIMDDIERHACPSAGACGGMFTANTMATAIESMGLSLPGSSSTPASSPSKMRECVKAAEAIKTCMEKNIRPRDLLTKRSFENALVMTMALGGSTNGVLHFLAMARTADVNLTLDDVQRVSNKIPFIADLAPSGKYYMADLYDIGGIPSVQKLLIAAGLLDGDIPTVTGKTLAENVASXPXXPQDQVIIRPXTNPIKTTANLQILRGNLAPGGAVAKITGKEGTKFTGKARVFDKEYQLNDALTQGKIPRGENLVLIVRYEGPKGGPGMPEQLKASAALMGAKLNNVALITDGRYSGASHGFIVGHIVPEAAVGGPIAIVRDDDVITIDAETNTINMHVSDEEIQQRLKEWKPPVPHVTRGVLAKYARLVGDASHGAMTDLF

SEQ ID NO: 35540 - protein, 147 aa, A.fumigatus
YFPLGAKSAMKGILLLTRWTSSRVRFTSAVRAMARKCKTPLVLPPRAIVMTRAFSKERLVKRSRGLMFFSIQVLMASAALTHSRIFDGDEAGVDDDPGRDRPIDSIAVAIVFAVNMPPHAPALGQACLSMSSIISSLLLLVSPPSSG

SEQ ID NO: 35541 - protein, 1172 aa, A.fumigatus
RFILPRRSCRHGGFNWNTTKFYNFPNERGLYGCHDITVTYDQRNPAHPLRNIMKRMFEIREHYPVANDGFYLQTLSQLTKDVYLPGSSNTPTVTGLWSVLRSYFPEVQPEASKGNNSIWLVYHNDNKTVTYGGDCKNRNTALLAPYKSGTKLKNVFAPYDELTLEDGPGDIEVHGTTESYGCARNMTLLPWEYRAYVEADRFVEPGPTVTEFVPGHDARLLSAEDTGETVDIQLGYSKEMDCTGVTRAISLNSTTEKGITPTLDTSSVNCGNITPRTSSHHYVGEVPTVWTWSAKLKNVHHGIHELTVKNVSTTSGVRTNAVDRFLFRMGTPTNPLITPLANYSTSLVHKSDDGSIYIQHEAAGADMFRYSTTFGRTWSNWTTYTGGNTTIEIAPFTGTDAQKWKGTHVRVQYFSRLTGSSDYIQEGDHDWEDGVPRRFPHLWWIGPYNQFGYDAGLDSKMRYDVKEGRWKYDFVYEWPSTGQISVWGVGPDGLPDPTEVYGDVDNASVVQKLPPSYLSSNVINITTPPPFPHLGWTISLNDANLRYEMTPVGSGWVQLVLFVLLWVVPILMGLAGAFIFMRTFYRVKLNTDGTAAKEDKLPLLWRKVRAQFTGADYSEMAISDKAVLPDSAIAGAAAGAPEHRRTVLIATMEYLIQDWKVKVKIGGLGVMAQLMSEHLRHQNLIWVVPCVGDIEYPEDTPAEPMMVTILDKPYLVNVQYHVVENITYVLLDAPVFRQQTKAEPYPPRMDDLDSAVYYSAWNQCIAETIKRFPSIDLYHINDFHGCLAPLYLLPTRTVPVCLSLHNAEFQGLWPLRTQQEKKEVCSVFNISIETATKYCQFGNVFNLLHTGASYLRFHQRGFGAVGVSKKYGKRSWARYPIFWSLDKIGSLPNPDPSDTGAVGDGAETNVSIPSPEDRIRDKLQAQKWAGLKEDPNADLLVFVGRWSKQKGVDLIADVMPAILSARPHVQLICVGPIIDLYGKLAAIKLERIMAMFPGRVFSKPEFTILPPYVFSGANFALIPSRDEPFGLVAVEFGRKGALGIGSRIGGLGQMPGWWYTVESDATRHLLHQLRTAIKSALDSDQETREEMRMNSAKQRFPVLEWIQKLETLQQTAIQIHHTRNKNTGAGPMPQPTDLLGDAEHPGLHGESCWIGAIPPRTAWKTPLSKMEA

SEQ ID NO: 35542 - protein, 144 aa, A.fumigatus
SRVEGDSVIVSIRPGLLDRMLQMNGFSFAGAPLTIEAYGPSANGMTDQPMLSDIAQNGGAPSTADTKSKMTAILSKRYYQQTKLLDLSKLGSDPDLLAMGIFNSTSTESKFFPALMKVWEMSFDNSTTRREAVEIFTTGRDPRQ

SEQ ID NO: 35543 - protein, 210 aa, A.fumigatus
EERSNPSLGEDRWRFSAPELPDGYDSYLNDSNAALTELMTPLPSVPRIGIHTYPSSDSILTSDSLSSIHLPLKVEELTGDNDNMKPYPDRQPRDTSSLHQMQRTCSNGIVASDSCSSQDDASEMVNKPEILSPSAHILPHPSQATESSSGEDIYPLHLPSPHQHEAHFAPLNASTRGSMEGNTPEVQRPRRKLPGIPRPIRAQKDPEGMV

SEQ ID NO: 35544 - protein, 65 aa, A.fumigatus
GTCTRRKAFVSKTRYPREASPCTLMAVGQSCTRGVYPYGFKNLFGQPLQINSVVFLFSYLELLQE

SEQ ID NO: 35545 - protein, 84 aa, A.fumigatus
KWCMESELRARLPWGDPRPEPPTAGEQTSPGEAVELVQGQGAGLNFDLITFRSRGDEKSVPIHPSEKIDGASLHQSSQTVMTRT

SEQ ID NO: 35546 - protein, 378 aa, A.fumigatus
LYFHCRTLVGFGTRSRHIGEGAKTQEMSNLKNTVGNLKRLIGRSFNDPDVEIEQKYTSAAICDVNGQAGVEVSYLGKKEKFSATQLAAMYLTKIRDITSKELKLPVSDVTISVPAWFTDAQRRAMIDAGEIAGLKVLRLINDTTATALGYGITKLDLPGPEEKPRRVMFVDIGHSDYTASVVEFRKGELNVKATAYDRHFGGRDFDIALTEHFADEFKEKFKIDVRSNPKAYARTVAAAEKMKKVLSANPAAPMSIESLMEDVDVRSIVKREELETMVKPLLERVTIPIEEALAEAKLKPEDIDTIEMVGGCTRVPAIKEAISKFFGKTLSFTLNQDEAIARGCAFSCAILSPVFRVRDFSVHDIVNYPIEFTWEQSA

SEQ ID NO: 35547 - protein, 120 aa, A.fumigatus
GRLLPCELDGVVDNVVHGEVTDTEDGGEDGTAEGATTSNGLVLVEGEGQGLAEELGDGLLDSWDTGAATDHLDRVNVLRLELGLSKSLFNGDGDTLKQRLDHGFELLALDDGADINVFHE

SEQ ID NO: 35548 - protein, 199 aa, A.fumigatus
LDAHRGSRVSGKDLLHLLGRGNSTGIRLGVGTDVNLELLLELIGKVLREGYVEITTTKVTIVGGSLDVELTLSELDNGGSVVAVSDIDKHHSAGLLLGAGEIKLGDTVAKGGSSGIVDESQNLETGNLTGINHGATLSICEPSGNADCDVGDRELQLLGCDVSDLGEVHGSQLRRRELLLLAEVAHFNTSLTVYITDSR

SEQ ID NO: 35549 - protein, 169 aa, A.fumigatus
  UNSURE (23),(67),(126): Identity of amino acid sequences at the above locations are unknown.
AEVSCLYSLRSDIYDFVSNVYPXHRAGIAGINKTVAISTIAETADQTYAIAKLNTWVLTEMWFIFVXGSIPVLRPFFVRFSQSIKSVAGYSGSRSRTHTDGDRRGSRPNNETWISLDGQQRSPWIXNGPRTKKGVSGGIHGGSEENILSATYPDQIVVTKRTTVMEEPR

SEQ ID NO: 35550 - protein, 141 aa, A.fumigatus
LRNSRNPSSTFWDFSRVSPQTNCTRGFRLKVDWSSHVVLASAYTMDDKLPTQITSGGIDEDEEALEGYVVDPSRYANNAAGLKTTPDGRYVLIPQPLDTPDDPLNWSSRKKWLIVWIMAYIAFLADYTGGTAIITIIPQSM

SEQ ID NO: 35551 - protein, 236 aa, A.fumigatus
GPYFLTKGLPLMMTREWNLSQATVQRAVVGNLFTIGSCGIIVVVLAGYFGRMPVLLLFQAVMVGTCAWSAAATSFESYMAARIINGLFCSVGQGGALLWIKDLFFFHEHPKVINYIEFFIIMSPYLGPLLTCFIVTDVAWRWAFWLCTCMSAVAFLLVFLLDETPFDRKGRQVPRGSYIARLTGVQQAQLWRERRFLQCAMRPIVAITRIPVLIILIYYLLNFAWVIGVNTTIGIC

SEQ ID NO: 35552 - protein, 202 aa, A.fumigatus
LAIFLLTSSSSSSLSLSLSFPPLFLLFLSLSLIVVLFPLLSATMSTIQNLKNFIRHGKQARLVTPHAEPTTDVSPVHAEQQRQPQGSYPPAADNLDAIDSKMGHAHTHQQQSEPPQSQPQKSPENKQVRTAEIEQIVAEERSSRTKMPKYPGLERYILLEKMGDGAFSNVYRAKDTTGEHDEVAIKVVRKFEMNSHQVGSQP

SEQ ID NO: 35553 - protein, 62 aa, A.fumigatus
VLYNHDSFRPALIAVTGLMVMLCYSWEFSDFAGEKGVASGTAEGDFIGPCDCSDGTPQALIL

SEQ ID NO: 35554 - protein, 325 aa, A.fumigatus
TIDPRDTNDLFERMYRASMFYGRKGLPVAVISVIDLALWDLLGKIRNEPVYKLIGGATRTRLHFYCTGPQPAAAKAAGFIGAKVALPHGPDEGTEGLLKNVEYLRKQRESVGPDFPLRVDCYMSLNVPYTIELVKRCEAEGINIDWWEECLSPDDFDGHALLKRAHPTIKFTTGEHEYSRYGFRKLVEGRNLDILQPDVMWVGGMTELLKISAMAAAYDIPVVPHASGPYSYHFVVSQTNSPFQEYLANSPDGMTVEPVFGNLFVNEPIPTQGYLDVSILDKPGFGLELNPAAPLISAAAILTPAPKKSLTLPAEDEKLANGATH

SEQ ID NO: 35555 - protein, 73 aa, A.fumigatus
EHSLGTSYDFIARLYGRHENRWNNLDFTQKFSAFGHSLGVSGPFSYILSLIVHAKGTTGVAQALKLRLLPVNR

SEQ ID NO: 35556 - protein, 69 aa, A.fumigatus
QVDSSYLFYAITHLAQSARMCEEGRSNSVKEPHIAVAFEKKIVCLYCAAWEGDLEKHPPRTFSSQISVC

SEQ ID NO: 35557 - protein, 70 aa, A.fumigatus
  UNSURE (25): Identity of amino acid sequences at the above locations are unknown.
AALGFQCYTISAENFEMNPNTTYPXISPSHVEQRGQTMAKVAQLNSRLVKGRSNYSEADACNTYQGKAAW

SEQ ID NO: 35558 - protein, 182 aa, A.fumigatus
SPAASRRRRSSESSSDEQFVRNNANKRACAKQGVRGLYNLGQTCYLNVILQTLLHDPILNAYFLGNGHQSHDCTLQDCIGCAVAEAFADFNSSDKAEGFAALNLLLASWRASPVGGLLTNCYHIIILTHHRLWQVTISRTRTNTTNSSSTSYIRAPKDTWMTTTKGVPAFFTKHFMASLKVV

SEQ ID NO: 35559 - protein, 254 aa, A.fumigatus
TLAGYHQQDAHEYYQFLVDKLHTSTEGHVDDHDQGCSCFFHQTFYGKLKSSVMCDNCGNITKTEDPMLDLSLDVQVQAKKRAMGGGVGPSATPTLNGCLESFTSPERLMAGVYNCSECGGTPQKATKRLRIKKLPAILCMQLKVCLFSLTTAVDLANMTCSALSIAQQCPRKLRAGSISLCRSTCSHIQHIGTGRISTNPNSFMISLLQLSTKANWTLDTTTSTASRATRFVYPLSSGLCLVSTIRRQRSTLLT

SEQ ID NO: 35560 - protein, 79 aa, A.fumigatus
TFTFVHFTIYDSENISRRAAQILGLYHVLTKEDRRNTGCPPLSAEITRFNPAKQHSYFVESIMRKLLQSILGITKLCLG

SEQ ID NO: 35561 - protein, 126 aa, A.fumigatus
AGEQAHSHPSRAPAPDEARAIIGKCILRSPVPLVTDGVVCQTEIKSVLRQCISLVMVVKDNIMQLCRFFKAISSTIDVVVEHTVNDFIETISSGASDVQMSNFTLSVLQKSVSPKDESATLAASSH

SEQ ID NO: 35562 - protein, 112 aa, A.fumigatus
PMVMQMIYKYAVILRAYFETFGDIATMWKELSEENIIPGLKMIDGLSVELTKDQMATKVAELSSWSQNASANIVSIGSAKRKEIEGGDGRGSREHCTVYAESPAYPPAKKPI

SEQ ID NO: 35563 - protein, 91 aa, A.fumigatus
APLMATTEDPAVQIAKTNAKSAQAQAGLAAAKDRLHTTQQTFLSTQKIYQEASSTLIEQENKLTAIQAELQRQTKLEPSLVSASFGVQYHW

SEQ ID NO: 35564 - protein, 93 aa, A.fumigatus
PPSEAVETEAVRVKCPIPEKTDLDFDKAEAIMLSTLSASTGIIKDKTPTAVDVDAEVKQWKEEFGDEVATKLEMMVHDAMPDYEYLRSRRITV

SEQ ID NO: 35565 - protein, 60 aa, A.fumigatus
DALTKNTLDFSLTNHTVSYQWYWTPKDALTNDGSSFVWRWSSAWMAVSLFSCSIRVDEAS

SEQ ID NO: 35566 - protein, 63 aa, A.fumigatus
RATQLGFVNLHTYTLEPADNLDGCRFQPEIMCLTDNIKDDSTYTSVHFPGELGIGWKNILRRR

SEQ ID NO: 35567 - protein, 77 aa, A.fumigatus
RGMGVIVVESICLTGNVINVFDAEVMESESETVSSLHRFWCGFSTGNIPTVTKGMENPLTDLDNKPPNRIIKSYIYS

SEQ ID NO: 35568 - protein, 1333 aa, A.fumigatus
AAGWLVSPEMAYFLPSFFQKRLLRYALSRLELVDTEALDLDSLGIRWGQRSTVELRDIGLRLEVSFYRRQISHTTRQIHPPCALRGRCITNNYDVSKQKLATLLQLPASSELLSAKVQFLKITVPADIYSSGIICEASGINVHLQLPSEESFSTAKDGNPNSRSPSKAGTHDSSSDHILPTPADLAESFLDAEPKEEKEELQAAITSRSQMLQRTSASISDDEEELGLGNEGVSLPSFVAAFLKGVAERLQVRVDNVSIRVDMEMKQEGVVKREPENKPDNVTGLLTVREVSVGAVSSATSSSEQEKLFRNRPIVISDINMALISEPIVFSNYSRFAPPASPTTPVQPKSSEPSSRIPSPLPGHTPDADSFLAMTRSTILETQQEHWIQDIEEPGVGRMEGSAYTYDGRFSDADTDAEDRSDGYLEGAQQFLDNDKLLDNPAYLDSVIDSQLHDDDLEPPEDLVPQDDQFPPSSATPRPPKPEVHMYRETSPSGIDTEQTAPFSHYGDGFFMDRSPHGSQPYLGPDHVATRNASHSASSPSGSLPSREISNRQTAPPSESGSIGSSDFANGGELSESKLFSTEEAQSMYMSAISHGSSRSFVPNVPGAWDLWESTVAQDMHAGTQLTDAADAKQDVQDETSISTPKLTAQAASAFTEKRSFGEQSECLSEAREPDLAPLSPTLSKLSDVAKRFLRIDRISISIPVGEDRRHTDETVHSSDLNLASDSPKDSTVHSGHSSAESEFLSSTMYASARLRSDSINSAPSFEGTLPRSLPRQGKKADHDPISKSQPGDIAVEISAVDIRFDNAVGWLVVKIGQRVLHAFRDGGNVSSGKPAPESVQTRHSLALTLHDFSIKYVDHIPGQTYALNDYDPHSSSFFGLPHEDIILRAEASGLTARYLADKSATKFSLDVSKFVFGFAWDDLISFSESLKMRESTRDVLAPVNGDISLSLTKSSDSASLTITTLPLRLHLNVQRLEEIFGRVGGLSTILELGSSISSASTGFSTAKNMQRDSPRRARGVHFESSPPPENILPANPQLSWKVNARVGGIVFDVVGETHYLRLKTTAVKVVSRFEGIGVQIDKAKLSGPLPLDDSRDAPAKINLSNIRVEFLYSPKEPDLDRLLAIITPSKDKYDEDDDIMLDTLFRQRRQGSVLRTTVADAKIIISRTSDLESLSQLEEELGKLSTVAKYLPEDDRPGILTLTLIRELECQVYLGGPVGNITTHLRNAEAAYISMPSLIAAQLGTIKVVRNGSEELVGEALPASGSQGQNQSQLPILMARYIADEMDPTIKIKSHNLRVEYTIPSIIAFLGLSEDQTTGDVAANMANSLANM

SEQ ID NO: 35569 - protein, 86 aa, A.fumigatus
KTVIGYLECFCTRILTVGVPLSGRGVVNNMEKASEPSQTQPAPEEPVKSIEDDGKGDSSSTGGVTDEQWRSMMDVVLAIYEFREEE

SEQ ID NO: 35570 - protein, 490 aa, A.fumigatus
IPHNAQTYNRPNSQAYEDALVIKVRTTRKDFDSISVGEYRGADPLSPYKDVFIAEFEKLVKQGIITAEEAELPDLGEIPEADPLPEEEDEEDEDDDDEDDEDDSDDDGRRKKKRGPRPGWKRDAGKDDGHKSADPELRKKRGRPPRVDTPMEARIKAVLKGIRKLKGPLGMLKVRHFERLPDKATYPDYYVEIKEPIAIDIIKRKSKRKKYNSVDHFMRDMDLMFNNAKAYNQPDSQIYKDAVDLQVEARRLAEIEKRKPDSEYLMEDGRLPLPDGILYKGELWKVGDWVHIQNPNDVTKPIVAQIYRTWQDSEGEKWVNACWYYRPEQTVHHFEKHFYPNEVVKTGQYRDHRIEEVVDRCFVMFFTRYNRGRPRGLPPDKEVYVCEARYNEEKHKLNKIKTWASCLPDEVREKDYEMDLFDVPRRIKKIPSPIKHLLKSDAKETDDLPKPTWGADNAPPIVGAVHRRPRDENVSISTPSWSGSFVRRPF

SEQ ID NO: 35571 - protein, 343 aa, A.fumigatus
LGFILLSFFRQESPPPEPTPSPPPSLPQPVLSTVPPRLPAITQPSTRPSVGSPGSAPAVGAVPVPARSPAAPIPPTQGSPLPAPPVAYQQPQVPPVQVYQPALQRRPSAFVPQTPHSPAYQPSPVPHPYAAAQPTPYTPYQAGRVHVPPASVYNPNAPRPIEVFRLSEAANAAIPEDIREQFHCDDSGHVLFFSAPPLDIVSSLQQKLGHSLKYLAAKAERRKLVEQRKRKDDLERVEREERVKRLRADEETSLAAHVEALTAKAIEIMTSHVMIGTEKIYDHLYSNQAETAKQADADARARRITADHISQEKTAQIQAYSNKATTVSLKGSAMYMDDIDPTI

SEQ ID NO: 35572 - protein, 107 aa, A.fumigatus
LSSLYSGHDPSRLFQRSVNKRNVPDYYEIIKEPMALSILKQKINKREYKNFAEFVRDCALVSFAPFLLLWNHLVITFTHAVIFSFRSLTMRRHIIGQIHKHTRMRSS

SEQ ID NO: 35573 - protein, 185 aa, A.fumigatus
SGYVALSGKRSKCRTLSMPRGPLSLRIPFKTALILASMGVSTRGGRPRFFLSSGSADLCPSSFPASRFQPGRGPRFFLRRPSSSESSSSSSSSSSSSSSSSSSGRGSASGISPRSGSSASSAVMIPCLTSFSNSAMNTSLYGERGSAPRYSPTDIESKSLRVVRTFMTSASSYACEFGRLYVCAL

SEQ ID NO: 35574 - protein, 201 aa, A.fumigatus
LHTYSGLARVHKPRRLLLKVGRRGAVQEALLILENMTDPNRPPFFSYGSYPSSSDFRENEPVYSDWTSSQFPQAHFGPQINYEPSPSYVENPAGPRVGTAERSVNSKVAIPRSANPSSWTSSGRVSRACENCREQKAQCNGHRPTCQRCQESGIRCSYGDRKREKMAKCVFFFFFFFFFFFFFFFFFAILFFVLRRSRRFS

SEQ ID NO: 35575 - protein, 89 aa, A.fumigatus
TPKLPSPGQRTPVVGPAAGELAGPAKTVVSRKPSVTVIAQPVKDARSRVSVAHMATASERRWQSAFFFFFFFFFFFFFFFFFLPFSSLF

SEQ ID NO: 35576 - protein, 145 aa, A.fumigatus
GVVGMTITDDSDEGKVASADDEAIADECSSPAGVGDADISVVLDVPLSAVARELSAADEGKGISVDTNGVIVPKYPSAGSIDDAGISVELDDPLSTVARELIPVDEAKVASGDNNGATVPKYPSAESTDDPGTSVEAYEACGTVV

SEQ ID NO: 35577 - protein, 610 aa, A.fumigatus
IFKMQLMHFNNAFALFAITCSAGPIAQFAHKLRDLEQSSQSPGHIAYSSLLPLDKHVLAALDEANGGLDVIPITPSVTADGTQTTVPQASYASTEVPGSSVLSAEGYLGTVAPLLSPEATLASSTGISSRATVDSGSSSSTEIPASSILPAEGYLGTITPLVSTEIPLPSSAADSSRATADSGTSSTTEISASPTPAGEEHSSAIASSSAEATLPSSESSVIVIPTTPYSHSASHPASTPSVYNSTTSTSIHLIKHRPTAEPSSRLFAFTPISIVIVSPSSVPASTPTTTPSLTVGVVGPLSGVWTASSSPPATLFATALSETPSLTPTVTETATSSQTASVVEPQPETDTTMSSSSSTASTSSHPDATPTEAAGQLRTTSSAESTPTTTQSASTAESSSTRPSLSSATPAPFIGEFTSSQLQSASHTTSTHSHITPVLTPVIVLITPGAEPTAPATTTTTTRHPDPYANANANANGDLTSSPASGPTEGAEITTIHATATITKSVVVFASSIPTAETLAPAANTEESESGVGSRTALTTATVTSLPFAPYRDPGDAYLSIVPVTPGVMTVTSTKTETETETVTKTERETVTQTVTETLTEKETVILRGS

SEQ ID NO: 35578 - protein, 75 aa, A.fumigatus
DISIANTCRGRAFVRDCFVVRRSYFTLIGVICDCHSDHPLLTFGVPPSVNSECVQFYNLNLDPSYQAQTDGRTFI

SEQ ID NO: 35579 - protein, 82 aa, A.fumigatus
AFRIYTHFNRYRFTKLGPSKHTHHDTQSDRWCRWTIVWCLDGQLVSSSYSLCNGSVRDSFFNANGDRNRDVQPDCQCRRTAT

SEQ ID NO: 35580 - protein, 520 aa, A.fumigatus
FIAILFVSFCVMRLSRRLTVDFKRLVEHPDSIEGRERQRERDVAREREWVGDSRSSPEPDLRSPIERFRKPPNKAFSVTDLISPAWCELQYWYTLTKHGRKRRTPAMKQGSTIHKTLEDEVHTTVPVEITTKEDALALRLWNVIQGLRTLREYGLTRELEVWGLVDGELVNGVIDQLSYECPDPELEATAATYYADVEASRAVMPEYQMSLTDYLLAPSQGGKRLSEMTWKDEPDEHVEDAPSTESSEAFNIPRVYLTDIKTRASGSIPTIKSTSFRPTLLQLQIYYHMLNHLTTTDEVSIETLASRYDLDPQRTFTDAFIAEVGGLNDQFFDALSASEFDPDFIPSPEDAARRQSIRSSGSLPSASQDSTSILLEHNNLSSLWKFMKDQLRLTFLPSPQPSVSVAPSIPSEFQPSMLEPYPTIISPLLTARYLSSAPTADLHTRVLGSRSFLFDPTSMSSYLSDQMDWWRGNRDPRGVEIMEAWKCRICEFREECSWRQEREWSIARRKKGSKGLDATV

SEQ ID NO: 35581 - protein, 258 aa, A.fumigatus
  UNSURE (34): Identity of amino acid sequences at the above locations are unknown.
HTFPGKITPSHVSAKPATRHCPKTIHWGFLLTPXRGPFPGDPQGDLRGNSSQENLALMFEKPEGEYYLFAGAIFLAGFWRLEDKFGMRLSEIHTSGDVPGFKTKLEKGMMNFFRRIRPEDPVLRNNYFIQVDNELAWSHSIGSEDAAVVSWNTAQKNKAIEHHYFRSERQSLRRLPRSGAVVFTIRTYFEPITEIVKEPYVPGRLASAIRSWDADVARYKGREKYEEVLLEYLDKKHAEQVAAGLDLDREDEVRSYPF

SEQ ID NO: 35582 - protein, 137 aa, A.fumigatus
RDVELSTNPVTMDRKSANMISWFPIYFPLKVSIHACLRDILASNNGLLDAPQCTRQWGNCCHYDQADRRPESMVRVDGRSIRSGTHCRCTGNRIAHHERRTGGVSSCRRCPRQRQWHRQATEIWKAQRFPTSEGWNE

SEQ ID NO: 35583 - protein, 317 aa, A.fumigatus
HFSSYPQAASRNLREALSLAPENPTVQAAIIKIQQEENNGHYLLDLCRRYTSGKDENAGKDAAIYLRTDGLNPSEEVALESVKLILAREPSSLSSLQDDIISGLVRQNASVRQYFSDRLQVSVTTFFDEIYDRGDGAAVCLDTVVLDHAVWPSEDTRLHCESELFQLFIAKLMESGHDLDGRSLKGIARLLAVDAVKLQHLVDDEGLDVILASLDIRLPLEVRNQATLATVKYLESSKQTGQERFSRLLSTKVTNARNDDHIVAFSALAAVFPVVPDIAASLFLSESFISSLTPFTSKNLNSRNVETAILELPIAPA

SEQ ID NO: 35584 - protein, 316 aa, A.fumigatus
LPLPLRTRTPRLEWSCPLELCLTILWFRLLSRLLSQLKTRLQSRLLSRLKTRLLSRLQSRLKTRLLLCHLQRLSQRVSPARTLLLSHPPGPLLSPTALFLPLCSQFLLPLDSLQLLASLLSLVSPLFLASLLFPASLLFPASLLFPASPLFPASLLFPASPLFPASLLFLASPPFPASLLFPASPLFPASLLLPASLLLPASLLFLASLLFPASPLFPASLLFLASPPFPASLLSLVSPLRLSSLLFLASPLCLSSPLLLSSPLFLVNPLPSRRRQLRLLSLALLPSSSLPPVSWLVSGLSCSCFRASIDGLPYSR

SEQ ID NO: 35585 - protein, 125 aa, A.fumigatus
PAFCPWSALCSWPAFCSRPAFCSRPAFCSRPALCSRPAFCSRPALCSRPAFCSWPALRSRPAFCSRPALCSRPAFCSRPAFCSRPAFCSWPAFCSRPALCSRPAFCSWPALRSRPAFCPWSALCA

SEQ ID NO: 35586 - protein, 365 aa, A.fumigatus
ASLGHQDGNVLDHNLPRYDAPPDLFKRMCLNTIIAVSHTKVTSGTKTLTIPITLTSTITVTTTTVEDSNTETRVVVPTGTVPNHPLVPTSVPTSVPTQNATSIPTFVPTQNATSVPTSVPTQNATTIVPPPKVVPTGVPGQNTTVVPPPRPAPFTNSTVPPPVQPVPVAPGQPTAPSQPSVPGQPSVPGQPSVPGQPSVPGQPSVPGQPSVPGQPSVPGQPSVPGQPSVPGQPSVPGQPSVPGQPSVPGQPSAPGQPSAPGQPSVPGQPSVPGQPSVPGQPSVPGQPSVPGQPSVPGQPSAPEQPSVPGQPSVPEQPSAPEQPSVPGQPTAVSPPPAETALTGSASQFEPAAGLLAGIWVVMLML

SEQ ID NO: 35587 - protein, 182 aa, A.fumigatus
AECAGSVDGRRKHACESVNNGFNQLKTQGGFTVPQAVLEGPKAEFESERVSNGETIDQIKSTYTSSFPSNFGPGSAKSSKTGGYILDPHSAVGVRAALRSIERNPGVKHISLSTAHPAKFASAVDLALGAEDGYDFTEVLPQEFIGLEQRESRVTPIRAGAGWVGVREVVKAEVEQELQGLR

SEQ ID NO: 35588 - protein, 164 aa, A.fumigatus
EQSQLAAARRQWVDQEQRAAQEQRAAQAQRAGQEQKAAQAQRADQGQKAGRERRAGQEQKAGREQRAGREQKAGQEQKAGREQKAGREQKAGREQRAGREQKAGRERRAGQEQKAGREQRAGREQKAGREQRAGREQKAGREQKAGREQKAGQEQRADQGQKAG

SEQ ID NO: 35589 - protein, 271 aa, A.fumigatus
QKCAFPACMAASHLEYGRPSMDALKHEHDNPDTSQETGGRLELGSRASESSLSWRRRDGSGLTRNRGLLRSRGLLRHRGLARNRRLLRRRGLTRDRRLAGNGGLARNRRLAGNRGLAGNRRLARNRRLAGSRRLAGSRRLAGNRGLAGNRRLAGNGGLARNRRLAGNRGLAGNRRLAGNRGLAGNRRLAGNRRLAGNRRLARNRGLTRDRRLARSCRLSRGNRNWLHRGRNSAVGERSGPGGWDNSSVLAGDTRWDNLWRWHNSSRVLSRD

SEQ ID NO: 35590 - protein, 74 aa, A.fumigatus
PSEAQQWLATWWEGCDQGNQNDPITAMSVSSMQKVREARAGYAYLVIALVWHNATQGWPSQSQKCNARVDHFEN

SEQ ID NO: 35591 - protein, 154 aa, A.fumigatus
LQLIWGPLCFFVAYLILDQHSLRHPLQLIVCMSHLYGDTLYYATSLYDHYVHGRSYCRPEAYYFWIYYFLMNFIWIVIPFCKFQHLGVEAKTRSFRSQITFLRVSRQFPMPSTLCSECLQKKRLDNARHCRTDGLPVEAYDYSWILIRSEYGWM

SEQ ID NO: 35592 - protein, 904 aa, A.fumigatus
VLLDPGVDTIATILAILRIGAAYVPLDTRSSDAVLSDILQESQPGIVIHHSATAPRSQILFKASAKTKLVTLNAVPQKTIRKIQDVSVPEGLAMILYTSGSTGSPKGIPLTNANIRTPILGVSERVPLGREVVLQQSGQGFDAAVYQIFIALANGGTLIMVDNRDDPAKVAALMAQESVTCTTHIVSEMQALLKYGYDELRNCSSWRIAMVAGEAFTVHLLDQFRALNRPDLKVINAYGPTEASICSSLGEVSFNRISSSETSIPIGKAIPNYGTYIVDQHCKPVPLGWPGEVAIAGPGVASGYLNLGELTQAKFRSTATLGEVLGSDCLYLTGDRGRMLSDGSIVLSGRVDGDDQVKIRGHRVQLGDVARALVQASRGVFADAAVILKGDDTSNPQLVAYVVFSRTSNIQDQQTYLRQLNQDLPVPAYMRPAITIPLDTLPVTDRGKLDSKKLASLPLPSISVDYEEDEQLTPTEARLRDVWKNVLGDIASSIPIRRSSDFFSVGGNSLILLALKAEIAQVFGVGLSVSELFQASTLELLAARLDGTSLLAQINWEEETAPDETQFTIPPPINGINGHGSSNGHAQGISVLLTGATGFLGGHVLRQLVQLPSIEHVHCVAIRPSKVDVRRQLSVESPKIIRYSGDLALPNMGMSESEFSDLFKSIDVIVHNGAEVSHMKNYRSLRAANFLSTVGLARAAVSRGIPIHYISTGGVARLSVADEQPEASLAAFHPPIDGSDGYVASKWASEVFLEKVQRRFQGQVWIHRPSSITGDDVPDNDIAHSLLKFSRELGAVPELTGSGFFDFINVETVSNNIAASVVRSSEKSGGGLIYLHQSGEQVIPVGDLQKYVEELEGRPLQVLPLKEWVDLSIRKGLDEVLGSYMLASKGVVRAPLLQRGPHVE

SEQ ID NO: 35593 - protein, 138 aa, A.fumigatus
GERRQKEKQLPATFYCEEPPFFSSFSLAAKSSDCVCSALSPSFSASTASLDCFSWLFEASNFASSVSSISSMSFGVVTPFSSCLLFCSFSSSMSSCCSLITSRRCLLVAAPSALWTSSSISWNNSSGILDSTDLSASI

SEQ ID NO: 35594 - protein, 379 aa, A.fumigatus
VFCYPCEVTLVASTHTLNNQLQRTVKDLGRLIPFSMFVIIPFAELLLPVALKLFPNLLPSTYEGQKAREKKALNLSSTRQEVSTFLKNTLRESGLPVTPAAVKNEEFGEFFKKIRTTGETPSTEDVIKVCKIFKDDLTLDNLSRPQLVAICKYMNLNSFGTDAMLRYNIRHRMRQIKRDDRAIFYEGVDSLSVPELQMACASRGIRTHGISPARLREDLAMWLDLRLKQGVPSTLLVLSNAYAYAQGGKEAEMASQIEALKSVLSSIPEELFHEIELEVHNAEGAATNKQRLEVIKEQQELIEEENEQNSKHEEKGVTTPKDIEDIDETEDAKFEASNSQEKQSNEAVEAEKEGDKAEQTQSEDLAAKEKEEKKGGSSQ

SEQ ID NO: 35595 - protein, 60 aa, A.fumigatus
LLVMYCLDRYQEVRRRFDHWGGSLRSGPLPYLFYIMIIFMAPSLPFLFLLINFVDLLKSM

SEQ ID NO: 35596 - protein, 161 aa, A.fumigatus
ATRTHMHRAARRQRWRLRLKRSSLCCLVSLKSCSTKLSSRSIMPRALPPTSSVLRLSRSSKNSSRRKMSRTASMKRRALRPQRTLRISTKQRTQSLRPRTAKKSNPTRLLRLRRKAIRPSRHSQKTWRPRRRKRRREVPRNRMLPAIVSPSVSSPLTFCPR

SEQ ID NO: 35597 - protein, 216 aa, A.fumigatus
PYFAAAGGHLVSQHRGYATETSTSTSSPSNPLPPPGFNAEQAKKPIPKEDVSRLAADNGNTQVAPKSETPLASENSVDVQKRAELEAAKKGLADDDKKVTEAKKEQKKLTIGQKIKKEVQHYWDGTKLLATEVRISSRLALKMAAGYELSRREYRQVGLLLPLRSNASGLNSHTEQSASTNGERSWPVDPILDVRHYPLRRTATSCRLEAVPQPAA

SEQ ID NO: 35598 - protein, 267 aa, A.fumigatus
GSSLCEGKLPLEDPELAYIGQSGKKYFLISYMDPLDISPDTCAVQSTQILSLLAKSTYQDITSFVAEPESENGQAYATMRSLFDHTKKVYSSKESFLSPTELGLTEPSQVDIIRKANLASFVSSIFGTQEIGFAELNEHFLDVFVPEGGRLLKVQGALFLELKTQAFIASMNNTERTRTELLYDLFPDDLEQRLLDRRPGTRQLAPSEADFVKRAGSRRDILLNDINNEEAMKALPDKYHWEDFLRDLSSYITKNFDAICHQQVCFL

SEQ ID NO: 35599 - protein, 88 aa, A.fumigatus
GAGVGLGENVRRTGRRDRFFAGSRKRSGGTNQMGETVNASTLWVYSVCSIINYSFDKVNYYGVLFFNRQGKLISVTNLDSSCLTNRRQ

SEQ ID NO: 35600 - protein, 777 aa, A.fumigatus
RPSTNSTYLAIPGSVAFSHSRGRAIAASIGALDVRAQWIHYVHAERPLDAQQQGVLEQLLRYGDITDVPASFGPEDGSFDVFYVFPRTGTISPWSSQATGISHVCGLRQYVKRIERGIKISCLREKSQEFKPGFEDVLHDRMTQLLSQTEPDLHLMFSEHAPQPLETIPLHGSDKSPKEVLQEANKRLGLALEQSEIDYLADAYGPNGPLARDPTDVELFMFAQVNSEHCRHKQFNASWVIDGKQMPNSLFSMIRNTHKKHPDHTISAYSDNAAVLEGPNAAFWAPDPFTGEWNHTKEVVHFLAKVETHNHPTAVSPFPGAATGSGGEIRDEGAVGRGSKPKAGLAGYCVSDLLIPDLKQPWELDVGKPNHIASSLDIMLEAPIGSAHYNNEFGRPCTLGYFRTLLTQIDVGNGQTEVRGYHKPIMIAGGVGTVRPQHAIKKPEAVKPGSYLVVLGGPAMLIGLGGGAASSVASGEGSADLDFASVQRGNAEVQRRAQEVINACVAMGENNPIKFIHDVGAGGLSNALPELIHDSGLGATFELREVDSADKSMSPMQIWCCEAQERYVLAVGEEGMNKFTAIAHRERCGFSVVGRGEGGSEEDKRLILLDRDSTEYPKPIDLPLSVLFGKPPRMTRTVDSRKLKLPAVDASLTSYLPSLAPNRVELISEAANRVLSLPAVGSKSFLITIGDRTVGGLTARDQMVGKWQTPVSDVSVTATALVQGMKTGEAMAMGERPTLALISPAASARMAVAESLMNIAAADLVDRLNHVKLSAKS

SEQ ID NO: 35601 - protein, 166 aa, A.fumigatus
SPPFRTRYVPSRRLRLGRKLDMVQAVDQVRRSNVHERLRNCHPSRCGRRNKSKSRPLTHGHGFPSLHSLNQRSGCDGDVGDRGLPFSDHLVPSSKTTHGPIADCDQEGLGAYSRQGKDTVGSLADQLDAIRRKGRKIAGKAGIDGGEFQFAGVHSPCHPRRLAEED

SEQ ID NO: 35602 - protein, 99 aa, A.fumigatus
QREVDGFGILGGVSVKEDESLVLLRATLTTANDRETTTLTMSDGGEFIHAFLANCEDISFLGFTAPNLHGAHALVGAIDLTKLKSGTESRIVNQLGKRV

SEQ ID NO: 35603 - protein, 329 aa, A.fumigatus
EPTGTDVVNELDRVVLPHSHASIDNLLSSTLHLSVASLDTSEVQVRRSFTGCDAGRGASAQSNKHGRTSQNNEVGAGLDGLGFLDSMLWSDCPNAASNHNRLVVTTNLSLTVADVNLCEKSTEVPQRTGTTKLIVVVSAANGSLQHDVQAARNVVGLANIELPRLLQIRNQEIRNAVSSKTGLGLGASADCTLIPNLPTRAGGSAGERRDSSGMVVSFNLSQEVDDLLCVVPFASEWVRSPECGVGSLKHGGVVTVGANGVIGVLLMRVADHGEETVWHLLAIDHPGSVELLVTTVLRVDLSEHEQFDIGRVTREGTIGPVSISEIVNL

SEQ ID NO: 35604 - protein, 78 aa, A.fumigatus
ALPMGASSMMSKLLAMWLGLPTSSSQGCFRSGIRRSETQYPARPALGLEPLPTAPSSRISPPEPVAAPGKGETAVGWL

SEQ ID NO: 35605 - protein, 185 aa, A.fumigatus
VLAYAVHRHVLHSKKYSVAKYHETWYHSLRAPFPLTAHYDHPTVYLLANFIPTYAPAMLFRLHMLTYLIYLSIISIEETFAFSGYSVMPTSFFLGGIARRMDVHLLSGAEGNFGPWGILDWICGTTVGDGEDEAASTVDDAQSQLSASLSQDGDLDEKIRRAVEESTRRFRDGSRRRLRRKRRDE

SEQ ID NO: 35606 - protein, 127 aa, A.fumigatus
HGCAFEQVRKAIRPTKLRESLQPGTILILLAGRFRGKRVILLKHLDQGVLLVTGPFKINGVPLRRVNARYVIATSKRVDISNVDQSVLEKVSASDYFTKEKKAEKKTEEAFFKQGEKPEVCGFCRST

SEQ ID NO: 35607 - protein, 79 aa, A.fumigatus
SVTLQSNNHPLLTTTTPSYILFRPPSSPVANMSDSTVGQTKQFGKGQRTVPAQKAQKWYPVDDEPQPKKVSTPYTKRNT

SEQ ID NO: 35608 - protein, 252 aa, A.fumigatus
SASFGPILGPIISGFASPSYGWRWTFWIASILAGCAWICLLFVPETFGPVLSRRNAPGLGDTVPKNTVNVVQIVKRPLAMLLFEPIITFTSIYIALAYGLVFFYFQAYPIIFDGLSPVLLATLCMLTSQVSTASMCRLPLLLFYLVGISFPVPCATLIEIVGVGAASTSLVALYWDMTYDKAKKHNKPWRFGAELHRLPISCLGAVLLTASSFWLAWTSRSAVHWAVPIASGVVFGFGYQTIFVSLLTYVTD

SEQ ID NO: 35609 - protein, 309 aa, A.fumigatus
QIQGTPESRQACSRQSKFTSPNDWPVHKKLAIVVASFLSVINSGIGTSLPSNAVPYIMQEFHVEDATQSNLPTSVFLIGYIVGPLAFSPLSETVGRRLVLLPTITVFTLSTVACALSPNWGSLLFFRFICGTMGSAPQTVVGGVYADMFFDLRERGRVMAFYMAVCLWWFVQLNGCVSADCASSQLVSDPFLVQLYRGLHLPRMAGDGHSGLLPSLRAVLGSAFSLCLRPSGRFCQDAMHLDWGIQFQRTLSTLFRLSSDLWPCCSSSPLSPSLRYISRWLTVLSSFIFKLIRLFLTVCLLFSWLHYAC

SEQ ID NO: 35610 - protein, 207 aa, A.fumigatus
FFRSVSPVTVSKPTPYTFDLGYLMANDPNPLELPRSEPLNASLKAPRTSGHPVPSSTSSSILARLQCSAQSGVLLTLPPPATVLPRHKPLPTPKPPSKWELVARKKGIGKYSNKPGAALADKERRKKLVYDEEKGEWVPRWGYKGKNKSDDEWLVEVKEKDWKKEEEAAAKGSSIRGLSRAERKERIRRNERKMRSNERRSRKSGGG

SEQ ID NO: 35611 - protein, 279 aa, A.fumigatus
CRGPVSSEVKIMYLNYKGCEEEGLYRVPGSGKEVKHWQRRFDTGKLSWTSVHISLANCAELDINLFDEPDLYDINTIGSMFKAWLRELPDELFPKETQAMIAEKCEGATTAPQLLKDELSKLPPYNYYLLFAITCHLNLLHSYVDQNKMDYRNLCICFQPCMKIDAFCFHFLVCDWKNCWQGCWTEKEYLQLEREMDEKEKAASSKTGDVDHSSLPYSDANERAISSSGSSQAAAEDEPAYRPETAKSRKQKPKQIETSHTRSISQLPELGPPLSPIQI

SEQ ID NO: 35612 - protein, 469 aa, A.fumigatus
SRTGSDVCSNLSTIMSSEQLAQSQKPTGEYRQYLPDLSLKRFQVMRGQDAHEYAHDFKTLRQPPWLHALYMHWLDLLQEPFKGVTTDGLLALMYLVGLVLMLTDCQETCAPVCSHYKTKASPSTRSSLRHSRCSPFLTDKQRQSLSYHIDSPEWRTWSNPEFLLSHKGLRLDEVTPPIRDAIMHILETTLSPEGYDKAVKAMRINHFLGELVDSPRIMNEFSYNFVLFGRPSPDRPWGWSFYGHHLCLNIFLYKSQIVASPWFTGAEPNEIDSGPYAGTRIMQVEERLGLQLMQSLALELQAQARIFAQMHDPAMPPGRWNKDDQRHLCGAYRDNRVVPYEGIPAISLTEPQKQLLYGILEQYLLYLPARARQLKLAQVRQYEPETYFCWIGGFGDQDPFYYRIQSPVILVEFDHHSGVFLNNEEPKKFHIHTLLRTPNGGDYGMALRPLIPAVEGLNGKEITWEKSAL

SEQ ID NO: 35613 - protein, 187 aa, A.fumigatus
GGSGSPVVKTMGVERRPGERPLQAKYPDLPADYYIPKDSWFIRARLLKQGVTAPGRSASVQSSKSDLDELRRRFNVSSLSQSAEEKNPLTMENVTGSGPSSATPSHVPGRIFHGVWVFVDIQLYQLEENNYMVDFKCDGYQNVIRAEGETDWHPISKRYFNKEKEITSPYPFLDVASDLVAQLAVAS

SEQ ID NO: 35614 - protein, 80 aa, A.fumigatus
PTSSASPSATTSTRLNGAHGPTPNSFSATKACVSTKSPLPSATPSCTSSRRRSLQKGTTRPSKPCASTTFSASWSTPPAS

SEQ ID NO: 35615 - protein, 172 aa, A.fumigatus
TSSSTSPRSSPPPGSPAPSPTRSTAVPTQAPASCKSRSGLACSSCSRSPLSSKPRRASSPRCMIPRCRRAAGTRTTSATSAARTATTASCPTRASPPSPSRNPRNNSSTAFWSSTSSICPRGRGSSNWPRSASMNPRHTSAGLAGSATRTLFTIGSRALLFSSSSITTPVCF

SEQ ID NO: 35616 - protein, 472 aa, A.fumigatus
SETPVITTRRPKLVSITSRLVAGGCRRSLAHFFSTTTAIMTPRETRILSVRRLNKEDPGTRSLAEWWASERSQKTPESSAIEEAAHLLRTSDIPVAFPTETVYGLGADATRSAAVQGIYKAKQRPSDNPLIVHIDSIEMLERLLNPASSSPTRTTRTAKNTIPAIYQPLIERFWPGPLTILLHNPSGSLLADEVTANLTTFGVRMPASPLARLLIHVADRPLAAPSANASTKPSPTAAEHVYHDLEGRINLILDGGPCGVGVESTVVDGLSKLPAILRPGGVGIEELRTVPGWENVQIAYHDGNLDVKEVPRAPGMKYRHYSPKARVVLFCAGSSEEEIAKYVYKDLEDTAIRAHMIGVVRTRQWKRGLGLVSEEDIQKTLKPIPSLVDDLVCFSVPVKGRINNREIARAAFDCHLGDNIESIARGLFSALRAMDEMEVDVIYVEGVSDSQGDLAAAVMNRLRKAAGTVLKL

SEQ ID NO: 35617 - protein, 270 aa, A.fumigatus
KEANRIFKQTANGVPAPVKSASAKKAAPAPAKGKKGKGKRGADKYAHQDEEERELAFRLVGAKSAKAEKAAAAAAAKAQREREAEAAKKRRKAQHERAAEAERRRQALFDEGAADDYNEETAAAEAADLSWIPALIGTPRPEDEILAAIPICAPWAALVRYKYRVKLQPGTVKKGKAVKEILGRWVAETTTGKVKKEQAEEAGISIADAEKLRAREGELFKAWRDTEIINTVPVPKVRIMTGGGATGSDAKGKGKGGSSGNKGGKGGKKK

SEQ ID NO: 35618 - protein, 110 aa, A.fumigatus
TMCQSPLHDFLHGLPKCEHHVHLEGCVTPELIFQLAEKNNIQLPNPATHPAYASVEALRARYAEFTSLNDFLDFYFHGMSVLHHQSDFEELAWAYFQKAHADGVHHAEVF

SEQ ID NO: 35619 - protein, 72 aa, A.fumigatus
FLNPDSAWPQYGRKFAQPVDNRTLHSYPTGATIEYQIDPPLKVMINVFSRSRRGLRRRISRRSRERPVRNMD

SEQ ID NO: 35620 - protein, 474 aa, A.fumigatus
TVIRPEPLQVSKWELTYSLADGRPLQTLVGEFEFSLRNGTNIGCTAARITPDIGAAASAAFAYLPAAILLLVGMASWCRQTQQRRRSVSAHGTTPTAPDSVRKIVVDVADYVRYLQFIFLTGSLTMQYPGFYQPIVSQLAWSSLLFWSGPIDHGFRYPGIEDGIYAVNGTYGLEYMAQNLGFPSMLDIKFDALINLCIVVSAIVVIWLVGWLLKCGSWHGVSLDAVLVQFPAACHSIAGVTLLFFSLPLLAYLAYPFALVPHLPSYNICLIVLMIGVLVGSNLFVARYQTKQKPRRSDHNSSEASPRFDTSMEYIAHYLLYCLPLIQGLAIGGLQLWGWVQLLLLGGCEVITLAHLIIQRRTKFMLSKSAWCTAVRLLTLILGVAFVCPSREITRQWIGYFILVLHSVVIVFGFLFISVWHIGRFAVNRSDRRVADDRWVGSSNVPVSVESALRHYSATYWCPAFQFRRALKPQ

SEQ ID NO: 35621 - protein, 248 aa, A.fumigatus
  UNSURE (15): Identity of amino acid sequences at the above locations are unknown.
GVCGIGGFLPSSEVXDLVEKGSMNFIFGGNGFFGYFFSTSSSIAAHRDSPHHVSEPGDLLAWWSTYSVDECPDPNMLDMDDVLQQLQKRHEHWGDPVVQKVLKSARVKSIYPTWTSPQLPTWERDGVVLVGDAAHALPSSSGQGSSQALEDVESFAKLLSYFLGKADDSDSSVRECKEAVKLAAKQYMDLRRPRVQAILDDARKRQSKKRDMGVIEEYLMYSIMWIMGMYAVGFGGLANMELQASFRA

SEQ ID NO: 35622 - protein, 66 aa, A.fumigatus
PFATTTDHVHWRLISHAWSRIVHTYKETAVLAFEISVRNYIATPDNVAEEILVETLENMQTIRPNT

SEQ ID NO: 35623 - protein, 287 aa, A.fumigatus
GEVSICRSGSQSTSFCSLLLCIRSVSMKSLLRATFFATAAIAAPDSRRCRCQPHEPCWPSPREWNALNRSIDGNLVAVQPVAAPCHINPNSTACQDVTAQWSNSVWRAAQPGAVQWENWAAWPEHNESCYIETAPDTCKQGRISLYSAVVQNARHIQEAVRFARRHNIRLAVKNSGHDFLGRSAAPNSLQILTNRMKGLQTVDDFVPKGAPKHKGEGPAVTLDAGISLQEMYAALAKQNRTVVGGTAHTVGPTGGYIQGGGHSFLSPWKGMASDNALEFSVVTASVS

SEQ ID NO: 35624 - protein, 226 aa, A.fumigatus
GPGTDPLQGDLVTANAYQNSELFWALRGGGGGTFGIVTRVTVRTFEEIPVVVTTMNITTAGGDPAFWTAVADFHAVLPAVTDARGGGYYFIIPNLPWENNQTLSVLRFYLFHTNTSNTTEVGQMYEPLMKKLNATAGVYTQYMSLPMSSVHEALSKLMLVGDSDETGSIAVIFFRLFSKDLLTFKDGPARLASAMSKFRYTPWQTGVGMVDGGGAVAENAAKSTGH

SEQ ID NO: 35625 - protein, 189 aa, A.fumigatus
  UNSURE (189): Identity of amino acid sequences at the above locations are unknown.
IQLLVLINETAMASRQLARARLLRTPALSPNRVVRPSQTLRCLPQTQSLLPRASLTAALQSISTVRHYANGRPHPPGGTHRMNLGGEPEKSALEQFGVDLTEKAKKGKLDPVIGRDSEIHRTIQVLSRRTKNNPVLIGAAGTGKTAILEGLAQRIVQGDVPESIKDKRVIALDLGSLIAVFTHSAGRIX

SEQ ID NO: 35626 - protein, 69 aa, A.fumigatus
HLPSIFILYFIETYDRELNSAARPNKRNRHGIEAARSSPASSNARSITEPCSPSIPDITLSPTNTVPSP

SEQ ID NO: 35627 - protein, 62 aa, A.fumigatus
DSSGAVCEDSNERAKVKGNDTLVLDAFWNIPLHDSLSQSFQNRSFAGTSRSDEDGIVLRSPR

SEQ ID NO: 35628 - protein, 136 aa, A.fumigatus
LTCQNSDAPSQADVVTFKAFSGAPDAEKYPHVARWYKHIASFEPEFASLPGDASKAYTAYGPESTELPTNPKDKPAEDDDDMDLFGSDEEEEDPEVVAQREARLAEYKKKKEGKAKPAAKSIVTLEVKPWGMFDRS

SEQ ID NO: 35629 - protein, 60 aa, A.fumigatus
DSHLSGCLDKMYPKHKLHLDCMMKTNWSVFRRRLKTPPDDYTTIARNRVSDYEEESACYS

SEQ ID NO: 35630 - protein, 103 aa, A.fumigatus
RETNCARLDDETNLDELLENVKAIEIDGLVWGAYKWVPVGFGIKKLQINLVVEDEKVSLDELQQRIEEDEDHVQSTDIVSFNPEFDGDTIDADIPSQAAMQKL

SEQ ID NO: 35631 - protein, 320 aa, A.fumigatus
LASGWNNTQNRDTVHFTFPVETTIPELSTAMPIASESSTTTTTMTTFSAPVTVPMSMPNNQSALAASFTNFLTVSIHQILFLRSVYPRATFLPVRAYNYPVRQSRHPKVCDYINDASIAVGTEILKGTITAVSIIISSLRTNQPLERYAFDLSGFPRVSAGDVNTTFEDRSEDSSKPGVPVPDRGSAPTTVDLEAQFRACLARLASACARLTPLPRDDEFSFTVCIEVREDALPPAGTTKEEQTWIVAEPGKIHLRSCTAPYSVSKSKNGDLHQLPPKVSNGRAKTVPVRRVEAGELRLELWVEEARQKFNEPVDSEHPP

SEQ ID NO: 35632 - protein, 114 aa, A.fumigatus
IVPDMVVKHIQRKLQEKSDKHSAELQKLEMIASEEQLSANVFLMPQTPQFISMNTILQDPATEQVDFVFYFDRLACLLIEKCVDPYVPAPEKFKFGTDHNIGLIGPWTVLGINR

SEQ ID NO: 35633 - protein, 79 aa, A.fumigatus
  UNSURE (11): Identity of amino acid sequences at the above locations are unknown.
RHESSLSSYFXATKKRYYSPPWADLSIIGIAGSSGSGKTSVAMEIVKSLNLPWVVILDMVLRTRSNIISIDISHFRASS

SEQ ID NO: 35634 - protein, 82 aa, A.fumigatus
RKKANIPVYSFAEHQRQPQTTTLYSPHVLILEGILALHDPRIMEMLDVKVILLSPTYYLKILIRPFSDFCRGRYGCLPWTQK

SEQ ID NO: 35635 - protein, 165 aa, A.fumigatus
HRINRALDCTRYQPVKVETPQGMNYNGLHPEGLVSAVAILRGGSCLETALKRTIPDCITGRLLIQTNERNEEPELHYLKLPPGIEEHATVMLLDPQMASGGAALMAVRVLVDHGVAEDRIVFVTCAAGKVGLKRLSTVYPEVRVIVGRIEEEREPRWLEKRYFGC

SEQ ID NO: 35636 - protein, 155 aa, A.fumigatus
KMLTLDCLLLADPRFANIQTDPRYRLPSKRQTHVKLDKRFAHMLRDKDFSRNAAVDRYGRKLARDDTKKQLERFYQLEGDEEGDKDEDEDEEGDGMVADDDDEVRKELKRIDKAYDPARDGGFSSSSSEEESSSDEESEEEDDEEEQSIEELDFP

SEQ ID NO: 35637 - protein, 85 aa, A.fumigatus
HYRPSKCNPSPASTLSMYNHLIQHGPVKNLTSEISLLQPSRLSLLFDPPYNDPDFRVNGAKPLKSNLSSGTGHKDNSVFRDSVIN

SEQ ID NO: 35638 - protein, 81 aa, A.fumigatus
IDSGLPEVISKYITFLGDLTALTLWSLSNLTAPSTYQIIAMRKKGFIPLVFLTGLNIHQTRIHHNVTWSNILFIKSRHVTS

SEQ ID NO: 35639 - protein, 78 aa, A.fumigatus
VTCFRRQSQTTFWIWLTVCRDRRPLGSLIYFTYRYTCRLSPLQYNTGNHSPSVSPVFDRNKSLVSTFLVLKLTTSPLR

SEQ ID NO: 35640 - protein, 77 aa, A.fumigatus
CRLAAGNKAILRPTGDHIYTDLEPRATGDIIAPVVSTTDYTSPAAAVWSGTACRSPQSSHRSSTSAGRGRAAAASQQ

SEQ ID NO: 35641 - protein, 88 aa, A.fumigatus
ANRLDQLINRHLHHPVGIIESWFVASSYDPSFGFSFGFLPLAASVESNELHQNGSEWIIVQSYQHCLSKCSPEGCLVVYFRYSCTLDG

SEQ ID NO: 35642 - protein, 321 aa, A.fumigatus
RPCRTLVGYPDERYNLLGGFLLLTLAAHVVVKNTRTRGSLANSARAQRGRHLDALRRRRAGGKEENDAALEQDSDAEHSDEAGPDDEPDSEAESQVRQQQFRLQEGSDVESIVAEDEDLDQYEDDFVLEDDNAELGVPSSLEDLPFEFSRHAYKQLKEYFQDAVEWMVNNKINPAFPRSDPLYEVAFMKLEDEVKGRTGSQLVSSVWNVKFRRALLARPHVETTLYPITDNHPCDACYRSKHPASFDMKLYGHAYSLVDTPNNCPMTIPTTTNKSIAPKETETVTAFPNDDTRFLLGRFGFPSYLSVSPFLLVDPLNAHWQ

SEQ ID NO: 35643 - protein, 457 aa, A.fumigatus
  UNSURE (32): Identity of amino acid sequences at the above locations are unknown.
HDCSFGILNPQLSLSYYCSNPMYCQQHLIALXYAFLAYFVNVTESLGQLPEKSLSSQTYEPEYCNQTLINFSGLNYSDAEVDELGYAVSLGRRLCWTDPGAIRGRNISIYSQSSEGGIQTVVNLTVTLTISVGKEASMQLRKRLLTRPHNSPEALITLGEIIVLDSRLEHSNPQWERRSKARNGQLEAASGSDPESASQRGKVRTETQISEDTLGFGSGSDGDAHPHDKNGPVRKNSHSRRSVCVDNFCEGFDLKNTCAPGGKIPAKEEICALCYPGRNLAVIERHCSKQEVSGRQAFYSVCVLLGCFVVVAVLLYLLRSFYRGVQRRYRIFRGLCSAQTSRSPATRSGSSSVFQVNSLPSLFPGFSSPTKLEVLQRESVTGTDDASDRTLPFSTLKQKWRQLGAFRRDSRGRIQVIFDIESLDTEHAKGGQSAHKTPVLPRAPNASIRRYCEETRS

SEQ ID NO: 35644 - protein, 99 aa, A.fumigatus
LSSHNMVTHLMITSIDYLHAAGSIEVILTNYPAYVQFRPFTNTCARSQIRPVQPYATRGDGLLSGEKFNRGYIGCMLPRVCLQILAVCPRAPFSLAVGR

SEQ ID NO: 35645 - protein, 114 aa, A.fumigatus
NTLKDPLIMKKQAGASHSFSAPTVPPSSPRTRVAPIHSRSSLYPWDRQSPGPQTHWPSARDSSAADIPPPAPYTGPPCPLSHPVAPPLAVPGDGPPRFPHPVAETPSSRTARHT

SEQ ID NO: 35646 - protein, 251 aa, A.fumigatus
SKSFANSPSNPEFQQARAELEATLTDLTADLDDLVESVRAIEQDPYRYGLEIDEVARRRKLVDEVGDEVEKMREELQRVVTTADTAGGTKAHTGSTSGLPNPSDFDNVLSPSDDRGDDYYTALEQQRQMELMHEQDEQLDGVFRTVGNLRQQADDMGRELEEQAVMIDEVDTLADRVGGKLSNGMSRIKHIVRKNEGKCTLSVRRKGFRRTYSKQSNSQLIIFGSLDTMSSFCIAALIFVLVLLLILVIAL

SEQ ID NO: 35647 - protein, 62 aa, A.fumigatus
LSRLWDVLYCSLGYYGWKMSEIGVDIQPRAMLFEIEVRNKSGLNEKKSTINGRATTATKVRL

SEQ ID NO: 35648 - protein, 99 aa, A.fumigatus
  UNSURE (1): Identity of amino acid sequences at the above locations are unknown.
XPAGYREQLEAIEVVFGQYNAPYFPQPEFSRPAAGSPKGLGPANGKGAGAGMMQGPGGVVSLRVTDEARQLWEGWRDMEEYAREVFPVEEEANGLDWML

SEQ ID NO: 35649 - protein, 392 aa, A.fumigatus
ILTICSIDCFIPLYPSSLTVLLYSPLFSLLIAPHPYRSSWVPKTVRNRSLSALRCLGSPWRLRESLRSSSRDLSALRPTAVSCPRHLSAFGVTRPPHEHINLTRLVRRSTVENRPLWEKRSEIISKVQDDFWIRVLSNAPAEIDEYIQHSDAAVLGSALKDLTVERFEVDEKGNGEPRSLRFTFVFRTGEENPFFENEKLVKEFYWRKKITKTPKGKRRTWEGLVSEPVRINWKKDMDLTKGLLDAACDLAEAEKKGGDRKKLPEFEKLAKKMEELEAAAMEDNDEDEEDLPTPAGTSFFGFFGYRGNVVSAEESKEAQKEDDERFERALKGEKFDDEEDDDDEDDDDEDSFDEIEIFPDGEDLAIALAEDLWPNAHKYYGKTPCYRADATV

SEQ ID NO: 35650 - protein, 481 aa, A.fumigatus
KVTIRSIRLHYSEMLRRFKAFVLSTLRFLWCPESPSHPQMAALRDVIARGEFPTLSNTEAIHLFASSFPTELSHLRNASATVESGSSTPPGCLEGKTPSAVIYGADFAEVNRTLVSMLALKWTLADDYESFTRGQSEGKLTLETFKRMREVIIRNLHDPGDIYALLVAILIDDIGKDSALATTAEAEAEANHSELVYHAAQGDRIPALAGVPNRGREAIMRSLQIGSKLNLSQLVQGECAPASLSVLRSIDKGGCGFEMRAIVTLLDVAGAGAHRDARGCALMTESVCRAYLRTIEVVGEFIRGNIPTERACYDRILTDRAELLHKKGFALLSVENAEERTLLRLLCMGRGDSLESAEMFQAAFQILPEPTRRRLVDGLSVAGIGDGVAIVPYYAPGLLAEVLRSVYHKERSSIVAALSAFLRFLARVFDGPRPNTDGIQERDLSFVQDVIKSDRFGDDPSILDTVRLPWIDLSDTIDPRL

SEQ ID NO: 35651 - protein, 69 aa, A.fumigatus
TERFDRTEYAFYYAITYQRNMAMDMVMRPAGKSVHLSVEVRTTEYNSSPPLSGPLSPLFANYHYRIGHS

SEQ ID NO: 35652 - protein, 139 aa, A.fumigatus
VFLLVLSSLVSVLIAFDAADQELQRTLQSLACAKYRVLTKKPKGRDVNPTDEFSFNASFTDPKFRIKINQIQLKETKEENKKTHERVAADRHLETQAAIVRIMKSRKQISHAELVAEVIKATRSRGVLDVAEIKNNIEK

SEQ ID NO: 35653 - protein, 290 aa, A.fumigatus
  UNSURE (1),(5),(7),(9),(10): Identity of amino acid sequences at the above locations are unknown.
XPSVXSXKXXVLAQSKRFFVSWAQRESSGYLATFVENGHNLIAREVKRCELFSLNRSTKQKLSELLDRVLVADQESVLLNEKDVLGLLRTGNKTALEKLYTLLERRQLGTKLKPAFKNYIVEEGSQIVFDEEKEAEMVVSLLEFKAQLDDTWVNSFHRNEELGHALREAFATFMNKSRKSESTGGTDNVKTGEMIAKYVDRLLKGGWKLAPGRNMADVPLADEDAEINRQLDQVLDLFRFVNGKAVFEAFYKNDLARRLLMGRSASDDAEKSMLARLKTGWFRYAPSFFS

SEQ ID NO: 35654 - protein, 156 aa, A.fumigatus
AECGSTFTHNLESMFKDMDVARDEMAAYASIQRERRKPLPIDLNVSVLSASAWPSYPDVQVRIPPVVAEAIDDFEKFYYNKYNGRKLSWKHQLAHCQLRANFSHGQKELVVSSFQAIVLLLFNDVPEGGSLSYAQLQEGTKLCECFYSSYHPWYPY

SEQ ID NO: 35655 - protein, 79 aa, A.fumigatus
GTPLDDNYTGAILQTLHCRMVVDTWMSGITGTGQIANCGSALYIAAHGAEYGVPKKGADVTGVPYEDNRWAVAESASTN

SEQ ID NO: 35656 - protein, 191 aa, A.fumigatus
GRSGHQIRTVWNTCLKCDKYTYSCGRFERAVDPGLVKVNPLSEHLTTVDVKIQIVEVPRQVCMTKDNVTLNLTSVIYYQIISPHKAAFGISNIRQALIERTQTTLRHVIGARVLQDVIERREEIAQSTSEIIEEVAAGWGVLVESMLIKDIIFSNDLQDSLSMAAQSKRIGESKVIAARAEVESAKLMRQV

SEQ ID NO: 35657 - protein, 232 aa, A.fumigatus
QCQPPKFPQRLASTTIHLQMSNNILIVGASRGLGASLRHLYASQASTTCVFATCRSSAPPQDSAESRVSWIPNIDVSQPNVGETLVSQLPSSTKLSRVIITAGYFGFETFDDPDWEKEVRMYTTSAIGPVFVVHTLVKAGLLDKGSKVILVSSESGSITLRHEKEGGGNYGHHASKAALNMVGKLLSIDLKENGIAVGLVHPGFMRTEMTKSVGYDKYWDAGGGKRPLTCLS

SEQ ID NO: 35658 - protein, 81 aa, A.fumigatus
AADILSSAPAMQIRYLEAMQAMAKTANSKVIFLPAVNQTVQQQLAAADNAGEGPSKYGAGQPVQADDGFQRAINARVVEDI

SEQ ID NO: 35659 - protein, 409 aa, A.fumigatus
WGPRRTNKSKRMSLYARAWCQPCACLITFHTCRRKRPGFLRPSLARTKAQSFQLGMAKPAPESQAPPFKFQTRGTKTSLSASTSLEDMFGESPQRERPIARNNSSTLLNNPRLRPPLGSGSNGSHARGNGSPSAASIRKSSHPLMRPRKQCRRSLSMFEHPEEVIAEKEANYTTNAPLQSITDVDTTPSLQLPHFIPEDSADTLPRIDKTILVDLMDGKYNDRFDHIMVVDCRFEYEYEGGHINGAVNYNDKEYLAAQLFADPKPRTALVLHCEYSAHRAPIMAKYIRHRDRAFNVDHYPHLTYPDMYILDGGYSAFFAEHRSLCFPQNYVEMNAKEHEFACERGLGKVKQRSKLNRAQTFAFGQHSPQMEDSPTGRCRNNPGERTRFLDSPFEGTPSSRGPGRRMLSY

SEQ ID NO: 35660 - protein, 71 aa, A.fumigatus
RPPLPSSSPAPIMDTMEMSPLPHKPPFIAAKEIELNPPTPGGSPIDSPMMSAAPSPLQESPLMGPKEDKQE

SEQ ID NO: 35661 - protein, 462 aa, A.fumigatus
YLKLANQLPNGTNTHTKIVAEKILCRHPEYEPFHNQSLNPLDVIKALADSGNVGSEALTAIKEGLECCRSINRPDNDKQLSEANSCYVATKAGVSGNLEKDFTTKGTQGSLRCPFSKPNNKPSENEGFNGIEDAFVTQNDDTCGHEDLDPIKAEKNDRRSSLTTSAKSSSTRCPVSRCPIRFMDKHSPEEIADYVERHKHEIPRSHAICVQRYQKDSQTMRQLDAKYGNLISMIQGLSVKHQAFLPGHSQDGAPASSSSAERVEKWAEDVGMEAPEQETPNSANRQEAQGADDDDERKGRFDRPLREVRVGESPSRPWGIPVPVSQPSFTPTMPSPPTPLSDSTKQPLKEPSDIPATAEPAKVPSGTRTGQCPFGHDAPKANDPRRDLEIEPIRQETSKSETADTPRPPHGDGADGYFHAGQINPTSSAKVVFNGPVFFGFSPEQTASFLHELGNTVPSKPS

SEQ ID NO: 35662 - protein, 85 aa, A.fumigatus
SQAIRANGQLFISGQIPADASGNLVEGNIGEKTQACCNNIKAILDAAGSSVDKIVKVNVRYSSVPTVLKRVGLVLTLSPFTGLPH

SEQ ID NO: 35663 - protein, 230 aa, A.fumigatus
SRIRPPRGEESWRAWWKEVLATIEGLLVPPLSDKPSHQKPLTMQEVDIVSRWLVLLLNFFHAVDEETGEAHGVSLDILKSPKYHEIQTLNFFYFEPTESLIRTSERMASATISRQQVSKNRVSAPPHIGSGGTGSILGVPNTRRVKSIMLSRNLGTMKKMKEERRREAQAEPNDDMILRILRMRPEAAGYLRDRSRQKERLAAAAAADAIVKQSLMAGMGGRMAGTLGRR

SEQ ID NO: 35664 - protein, 75 aa, A.fumigatus
SCLLLSNFFLRLSFCLQFCILASFDHMNFMILNFVCLASFRCNYVYFAGLMVLNMKPRQQTYNEDLIANENEIHR

SEQ ID NO: 35665 - protein, 66 aa, A.fumigatus
NVIVFDFLWFPGKMNPSYSKVGVEFMRFAYTHGLIDPLPWYLDISLAASSILPLGLPEGHMWLQPR

SEQ ID NO: 35666 - protein, 257 aa, A.fumigatus
QSARNSDGLLYYLNLNTSFDTAISNLTALFGNISKAGGIANNIAPTYRDGAMFTNDNELYLYGYFDSLFTNSRLTICSGLLRLTDSQDPPAGNTVLGYERYQYGPDRESWQPGFIIDNLDTGVTRYVTNGAGVSAPNENLGFYFSGMRGKDWGPIYADDKSANVTSDCMIKVDMSSMRDNKWSNLSLPAHVPARANGELVWVPVAESGVLVAIGGVINPATIFSSDGLTSAQQNASKRVSPGLMETVSVYDVSGDKW

SEQ ID NO: 35667 - protein, 130 aa, A.fumigatus
RHCRTTLNDIISHSSDQPYTFEAFVDFLARNHCLETLEFISEVKHYRESYNLSLARFSVSGKDPKEREDSYLFREWQHIKDAYIAPNAPREINIPGWMRDALMEIAPEVSYPPPILVFTTGLEGAGRSKG

SEQ ID NO: 35668 - protein, 180 aa, A.fumigatus
AQGLWRQCLFTMSAVINGEFLDQQNSRLLIENRYLQNTTGDIPPQLTQFCSIHASAQDGSSHNIYIYGGYDGLSMENTPSDDVYVLSLPSFSWIKLYSGNTTHGRSGHRCVKPYPDQMLVLGGVHLDPTHCLDGGVIQVFNLNTGRFQNTYNPNVWNEYKVPDLITTVIGGEYVSKFAKQ

SEQ ID NO: 35669 - protein, 84 aa, A.fumigatus
  UNSURE (70),(79),(80),(82): Identity of amino acid sequences at the above locations are unknown.
QTTPNNSEQRKVIRSTQLSTKFAHDFGPKNIAPKMSEVVPIEGFVAQALNRLAYKHRLLHRVFTTGLEGXTAGAIGNQXXNXGP

SEQ ID NO: 35670 - protein, 96 aa, A.fumigatus
VCQQFLCRNSANEAIPATGIVQLFQHLQPGFEQSRICIKIPSTWEGMMACRALEMAGVRTLATTLFTMSQAILAAEVGCTYIAPYVNQLKVHFEPG

SEQ ID NO: 35671 - protein, 130 aa, A.fumigatus
LQIDMAVATLLPGSSLDAVKQAVHSTSTCCNATVLSLQSLLRGSIKPVSDVESEPTKKTNRTKKAVSASSRRSRATIKTNVSAKGATTIAAVEYDAPRLSCQEKVSLATEIFNTTFEDTWQKHQKSSKTS

SEQ ID NO: 35672 - protein, 120 aa, A.fumigatus
QIARFTDPNKLLPLCVSIQKHYKSINAKTKVLPASLTSTDEIYALAGVDHITIAPYLLQQLSQPSSVPHTESLFDSDVPPAISVAQESFVNDESAYRIAFTRDLHGASEEKLTQASLDEG

SEQ ID NO: 35673 - protein, 142 aa, A.fumigatus
EFACHSSDCFSYCSSDLKGKYSEDLAKYSESLFFPLALPPRHFLNAYLIGVGRSLVPYSTRQRNAIAPPSTSGTCLFVTSQLFAAYCCQTLSSFEEKNTPQKPTCGSLIDLGLSTYSSLSQFPHTIGYSCNVVVFIYLTDSC

SEQ ID NO: 35674 - protein, 892 aa, A.fumigatus
HSSIIPRDRPNLETIKMSTSDPFAFLEKEPRPVAVKKPHWREKLFSKGRERDKEKNIKPSTTDQQIEAFLSPVRSKSVSHALNSANGTARGYQKPRLDTSHRWPSAQDVLNATSPISKPASATEIYPPTSFPSPPRKTRARKGLKVRFSDKDPEVIGEGGDETEAPTIEISLNRGRRAEYESKAPQLQLDTSLGDTDGVSQARTPQRKDTSEGINTAERKPLLVQSPQDSEFLLTLNLGGAGSRLSFRASPESNSFAQRVRAKMQAEEGRALQHGCQDYPSSPEEDGPLAEKKSTAASPESPNSLYETPPVSETEPSHPALTLRIPANSSTHKQGGTSPIELNLPAALTSGPELRSLSPPKPQPIPRNPVQNHPVSRDARDTTHGGQLPKASLRSLASQVGDTAFTDLKAYVAQYSPSIRVAAETGKPSMEISLAEWIRAAVWWFLRGKKKLEVYARSRSSSSGGRTPQGSSLGAAKQAVVDLGKALWICENVVPQHSELSRYGTRGIDAIIAVASTTGNKHLADCLSLHQAIISHLRSLAMSIRRNNILSELASEGDAAVQPDTNVWVGYPVFAPDVSAVLSGAATRSVLVDNSGKGPSIIQMMPLGDTSRYFSYGSMFVEACISSQEDDSQEQFSIPCALSILRDRGDWYVFAAITSQSELVNVMIQSDRKKGPTWDDVEWHVRSHSMRVRLPRGFELDVSFQDEDFKNLWNIVHYTLKTEASLQPEAGETVIFEYTLKNFQYMDSGTPKAFPTEPVERCRLRLFERSETVTEGTGSRSAHRGFRLTVLTSPKVKTLSSVRHIIGHGAPIIFGLLRGEDGAPALMLKVKEDGRSRSMVMTFQEVQDRNTMHALLLGMTTSDQEFKIPDISLQAYSIEQPADKFNGQPVKV

SEQ ID NO: 35675 - protein, 337 aa, A.fumigatus
FSFLTSVVRLWCIADLLLYRGNTPLEKKIAIRPTSETVMYPYYAKWIRSHRDLPLKLNQWNSVVRWEFKHPQPFLRTREFLWQEGHTAHLTEDAARKKVLHMLNLYARIYEKLLAVPLVKGQKPKSRKFAGGLYTTTVEGYIPATGRGIQGGTSHGLGQNFSKMFGITVEDPSAKPDEKKPPLHVWQNSWGLSTRTLGVMVMIHSDNRGLVLPPRVAETQTIIVPVGITAKTSDEEREKLYAEIDSLVSVLKAAGIRADSDKREGYSPGWKFNDWELRGVPLRIEFGPGESVGRYVTAARRDIPGKDGKSTIPIDELSTAVPGSAGNHPQGSLQARR

SEQ ID NO: 35676 - protein, 69 aa, A.fumigatus
KLLMRRQPASYFIWEEIQNWFNAEIKKVGVKNCSFPLFVSEDVLQREKDHIEGFAAEVAWVTHAYDFPF

SEQ ID NO: 35677 - protein, 261 aa, A.fumigatus
STVTTAVWSFLLALLRLRRSSFLSVSLPRLPTRSVRSCTRRSTALSPCSRLQASVPIATREKAIPPAGNSTTGNFVVSLCVLNSVPVSPSVVTSRPLVVTFPVRMASRLFPLMSCPPPFLALLETIHKDLYKRADDEFRAHRKLITNWDDFTPALNEKNICVIPHCLTEECEDQIKELSARKAEEDSGVPQDARAPSMGAKSLCIPFDQPEGIVHGQTKCVNPKCTRMAEKWCMFGRKLPPYAFALEGIEQFTDNLRAGSY

SEQ ID NO: 35678 - protein, 76 aa, A.fumigatus
DYRNGRSHHGPRTSSRKHGLKHFLAASLLWMYSTSPADVSWSNSDPNSGDRANGLCLWLGKGTVSLGMSLTSVDVL

SEQ ID NO: 35679 - protein, 150 aa, A.fumigatus
  UNSURE (146): Identity of amino acid sequences at the above locations are unknown.
HRFPTYAIFLQSSIVILLPTVIIILTITMTATLERSLSRTSSMSIPISSPLLSVRHDVTPPILSEPSLSQIHDRLNLLDSRVLELRSTVLTKDGYVDRRNREDEHIRREFEANRSISNRIDLNVVALRTDVDQLKSGVFQLKSSIXQAGN

SEQ ID NO: 35680 - protein, 138 aa, A.fumigatus
EGESTQVKPFADCFHPVVIVLAIVSVVFTVKVLFIVAVFFNADFPFLVIALILVSSIGSGPCIASPLDADFAAIAIITRQRDLSEIPEGVVFEVYGFRSGHNIAVTLALVEVNGESRRCGTTVTWSRIREDCCGEERG

SEQ ID NO: 35681 - protein, 471 aa, A.fumigatus
LLLPIILTSTYTFLRMKLYLLSLLPSLFTTTVLSYPAPSNSGTTSPRLAIDFYKRQCDCYVVSGSETVYFENYAFWDFRKIPLPRYDSNGSKVRIKRRSYTRSRADRTDKDEGDNEEGKVGIEENGDNEENLNGEDNADDGENDYNGMKAVGEGLDLGTLPFSHTAFARDWKPQEWHRKSNKYGPLPIINSPENIFFASNTLYTNDAESTHLVLRTTRFPNHTATAELEYHLRNIFHCSLRVRMRVMTVGSVNREPMLYGRPVLKGNPTSQSVVPIGACAGIFTYRSSTCESDIEILTSDPTNIVRYANQPDYDPITDAMIPGAASIGKLSQPWTNPTTHRVDWLHNITNWYADGEIKASNTYHVPDQPSMMAINLWSNGGEWTGEMPVGQSAYIGIEWIEVAYNTSTEVNDIPSDTVPFPSHKHRPFARSPELGSELDHETSAGEVEYIQRRDAARKCLRPCFLDDVRGP

SEQ ID NO: 35682 - protein, 165 aa, A.fumigatus
FYTVILEYDRAMSSFFTLPASQRKRKRDDRAAAPASKKRGVDADGDSGAKGKGRTRERDQSISGSDLDDDDESVASAVSEEESGSESEDGETAAERRLKLAERYLENVREEVDDYGFDAAEIDRDLIAERLKEDVVCTVSLFFFINPPILRNMCQMDQMADARKG

SEQ ID NO: 35683 - protein, 113 aa, A.fumigatus
ELARLQVSLLITITISLHPLFSSSIIFISPFQNRLLLICEIGIHLFPRGHALTVAFREVLLGITGKDFVILAASKAAMRGPTILKAEDDKTRQLSQHTLMAFSGEAGDTGTLR

SEQ ID NO: 35684 - protein, 87 aa, A.fumigatus
LRIVQFAEYIQANVALYTMRNDTELRPNAVANFVRGELARSLRSRNPYTVNLLLGGVDSITQEPHLYWIDYLSALARVPYAAHGYAQ

SEQ ID NO: 35685 - protein, 196 aa, A.fumigatus
HVCTFDLSRLLQLSLGEGFGIPAPSPRHLNPIDNFTATMSKRPAELSLEDEPAVGSPVSKKARVEDELEEGDPRNGALPLRRASGQEMEEHERKGQNILAAADHEEEEMEEAIPENEEAIPENAEVPESSDVDEDRPVIKAPKRQSEPMEGYSDLYLDTINREILDFDFEKLCSVSLSNINVYACLVCGKYFHGPG

SEQ ID NO: 35686 - protein, 266 aa, A.fumigatus
PPQLAGSSLFVVKTSCLPFPSIDAPTFGLVQEQLAHDPFRLLIATIFLNRTRGGVALPVLFQVFEHFPTAQDMSTAEFSKLVSMIHSLGFQNERARKCIDLAKTWLERPPTKGRRYRRLHYPRKMDGKDVGRDECIGDDENDTRVAWEIAHLPGVGPYSLDSWRIFCRDELRGLAKDWKGNGAASADFEPEWKSVLPQDKELRAYLTWMWLKEGWIWDRHTGERKRASEKMMRAARRGGVAQEQDGNFVLEMSPVKKVANGLTAWS

SEQ ID NO: 35687 - protein, 447 aa, A.fumigatus
TKHTTPVEQRPRRTDGTALSSSISSSIHPTPVLPMSDLSHPVILFPLRLNDRDSDRDRDRKPSSSSSTSSRPKQRHHRSSHGRPSRASTKDRDRDIPTGHSSTTSLSTSISASRQQRRFSMPGVDAASRSATASLLESRTSLPYPTFSKAHSREAVGKPSIPTPDPTDLTENKESGDADNKHRTDSRHAPPSPPLTSLDQGTSGKGSTVGDKEEKAAEEKNAKPKDMKTKIRIRAESTKSSSSLRSKRDETSKSSKTARPETPKPNKDKDTPTRVASKKSSKAKIADEDKLPKRSSSRGTLSPPRSPATVREVGSGSANGSDATIAPHQPSITSRKPQTPPVKPPSRNQTRSSMLHSFRPGSGSPVDIAFDYGRPPTTASSTFGAPPPPPPPPEVPVSIPRVDYLLQNGGLDHRVPKTLLPGPEHPDLPQQQWHPVFTSGMTGRKVF

SEQ ID NO: 35688 - protein, 119 aa, A.fumigatus
MTEIATGTGIESHPPHLLHRQGPNNVITARPTDGPPAPQPRIETVTSPRVTRPPHRYLLPSPPRANSVGSPCRASTPPAVPLRPLYSSREPACPTLHSRKPIAERPSGNRVFPRRTRPT

SEQ ID NO: 35689 - protein, 137 aa, A.fumigatus
RVRRRVRPSAAAVRASFAEDRPCQGVDQLRAVRDQRARGGGRGGRRRGGGAAGQRRGQAAGTRSVRTGPQGVQGEGNEGGGELLALMSGDDVTNAVTASGTAQRLAGLRTHTRISRGHQEDRGADAPAGQEATQAGR

SEQ ID NO: 35690 - protein, 252 aa, A.fumigatus
YPTDMIVPKPPVKLEGHCSVIHNNTLYTYSANGFAAIPLGRGTWYKLPMPPGEPVSDAVCVTGGIDGKEDQQALYVIGGTSSSSNSPGLQRFAFGSQKWTTIQTAQRTMQNRTSHGAVYLKSSSTLLVYAGSQTDSSNPSSDTFTISTVPPYILDAHSAQYPSSSPVLLPWSDGEAALVGGATTPKEVHLFSVSDGWHSSGVFLPQPLSSDVKCAIVHGSDGSKALEAFNLSVSPNTMSSIALAQIPVGHPT

SEQ ID NO: 35691 - protein, 268 aa, A.fumigatus
DAKPLGMCPKDKLFRGYIDLERQLFEFVRCRTLYEKQIEWNPANSQSWIKYAELERGLDDSERARAIFELGIDQPMLDMPELVWKAYIDFEEYEGEYDRVRQLYERLLQKTDHVKVWINYARFEINVPEEEEEEEEEEEEERPVSDEAKRRARAVFERAHKVFKEKEMKEEVSYWRLCPATMLLTQLQRVELLNAWRAFEHTHGSPEDIKKIEEQMPRRVKKRRKLDDDRYEEYMDYVFPADDQAAASLTKILQAAHRWKQTGGQVVP

SEQ ID NO: 35692 - protein, 67 aa, A.fumigatus
SWRKFNPANNNMMQTDLIRNRVGDSRRRLLNRKKGGGFRMLVAYKNEIILLMIGQSTDTPYSRNFLG

SEQ ID NO: 35693 - protein, 349 aa, A.fumigatus
LCTRLSQLALFSSIWRIGNRREFLFMSYGNMSPSNQKTHFRLLQRFKPDYSPSEFVQYESERTGMRVVVIDQKGPKVTGYFVLATEILDDSGAPHTLEHLCFMGSRNYRYKGFLDKLATRVYSNTNAWTATDHTAYTLDTAGWEGFSQILPVYLEHVIAPTLTNEGCYTEVHHIDGSGNDAGVVYSEMQGVQNNAAELIDLAARRLMYPPGVGFRYETGGMMEQLRVLTADRIRAFHREMYQPRNLCLIITGEVDHDNMLETLDKFEDTILDVIPSPDSPFKRPWVDSKQAPPLEKSIVKTVEFPEEDESFGEIEIRFLGPDCTDPVQSESPSLHHSSDSSLMCTSRCS

SEQ ID NO: 35694 - protein, 116 aa, A.fumigatus
KSGFWVPIALILYKVSPQVFIILVIRRLCVQAGALNVALLYLAGSSASLLENILVEKEQLASAVYYATEDHPSVEIRFTLTSVETAKLAQVEKRFFEVLDDALKKNLDMKYLKECI

SEQ ID NO: 35695 - protein, 87 aa, A.fumigatus
GRRDTMGQGYSLTTLSTGSAGIDVPELSDLMYEKSMGGGRFMKSIRARQRNGLVLVKVIMKPYPSMKLESYVKAIIREFILPCNSFE

SEQ ID NO: 35696 - protein, 65 aa, A.fumigatus
NIPVSLTPIGASQDIESGTISFKTGIYAQQFVSVYSRRWFPSMKKLVRRTKLPKYGFKLTSEQIL

SEQ ID NO: 35697 - protein, 145 aa, A.fumigatus
VYFALQQLRIDSDNVLGERKLLSDVPNALSHQRILETGTGGYLVRQYIHSSLYDRMRYASYILSTSKFSDLGSTRPFPEEIEKKWIAFQLLCALRDCHSLDVFHGDIKTENILVTSWNWLYLTDFSSSFKPVFTAGLEGSVQSET

SEQ ID NO: 35698 - protein, 66 aa, A.fumigatus
CDFIRHVPSAVWGPIVTGYADQHIGKLCPRAMITSKILMEDVVAKGFKALVDERGKHVKILVEVST

SEQ ID NO: 35699 - protein, 128 aa, A.fumigatus
LTRVRGSAVPSSPVVKTVLAASPRVAEGEDSHAGPVELVTPPADAPAGTRIGFEGWFDGEPEKVLNPKKKVWETFQPGFTTTDSLEVAFDMSAVPAVQGQEGKPALGKLVAKTGGVCTVKSLKGATVR

SEQ ID NO: 35700 - protein, 188 aa, A.fumigatus
PINLAVHMQPLFKPLTVPWHAVSRASFRPEDTVFVVGGEPIGLAVIQVLKARGVKSIIVSEVSSQRKKFARQLGATEVFDPRTDDIVASVRAMTAGGGAAIAFECSGVQVGLDTAVQAIGARGTVTIVSLWEEKPKIDALDMVLHEKHIIGAVICDDGDFEAVIDAISSGTFLLPYGARLLLVMLTSI

SEQ ID NO: 35701 - protein, 74 aa, A.fumigatus
YNHLAQFYRYSIFSLSCTLMEAKTRTSEVKSTTTSRGQKTQTLIVYGVDIGVLRQVALTPLSPLAHLTSLYPVE

SEQ ID NO: 35702 - protein, 93 aa, A.fumigatus
RRLLTWHIDLHEYLAGPITVPSTPHPITGGSVPVTLGHEFSGVVEEVGAGVSRLKVGDRVAVKPNLYDGTCANCIVGRRNCCQNLGFIGYSSE

SEQ ID NO: 35703 - protein, 70 aa, A.fumigatus
LVYTQWSKFWFSSQHLGFVQIVIIPIYSYCINLTFGFSFPFLPFFCPLLSIVIIQLYIRWSGPTTALISY

SEQ ID NO: 35704 - protein, 167 aa, A.fumigatus
SLESLGHHVLHQDLACDHRSRAELSYMLVSITSNNRAPYGRRNVPDEIASMTASKSPSSQITAPMICFSCKTISSASIFGFSSHSDTMVTVPLAPIACTAVSKPTCTPEHSNAMAAPPPAVIARTEATISSVRGSKTSVAPSCLANFLRCEDTSETMMDLTPRAFRT

SEQ ID NO: 35705 - protein, 97 aa, A.fumigatus
YPPTLFRRPPRGGPAIRPTMLPVPIYPKASPRPCFPATSFRRARPATSTMAADAPCKSRAMMYIATDRATVKRHIDAASRTRPPRNGALRRPVRSTQ

SEQ ID NO: 35706 - protein, 348 aa, A.fumigatus
EALFFISVNRPTAGCTLKYIKSILQKRYSRVMLPPLETGRFFFPPEWHPHIATILGFPSQAATCGELYLQNCREIVDLAAAIAEFEPVRLYARPEDVPGVQQLVHRTVDDPSRVTVIPTSINHCWVRDTGPVYVHDASGELDPKQRLAISFEFNEWGNKNGWEGIDGDYRYANPSMSPEALQENTDFARNVIESDTAPSPVQVVKSRIRTEGGGLVVDGEGTLIVAESYMVCDQRNPGMSRDEIEAELRRLLGVEKVIWVPGRKGLDITDCHVDAEVRFIRPGVLVWSRHHPSVPQVWLDMSQEIRNILEDETDAKGRKFELHAIDEPGPEDLGIQEHDEFVSGLRHF

SEQ ID NO: 35707 - protein, 242 aa, A.fumigatus
HFQRQEVYWTSIMLVAETAAAFFTCPVFGYCVDRTGRRKAPFLGGLVLLAASMCLFTVARSVAMYIIARLLQGASAAMVEVAGLALLKDVAGKQGLGEALGYMGTGSMVGLIAGPPLGGLLNKVGGYYAVCALGFAIVALDAALRLAVLEPGEVECGDNPARYRAIPSTDPEDHDVASEGDTTNAPSGSNVQRDDAFASLKLLKQPRVAITLWALAVDGIIIGAFDAVGAHSASSKRGRFLT

SEQ ID NO: 35708 - protein, 222 aa, A.fumigatus
NIRPCPALWKSCSDGTRLQPVWSFSSWRHRRFWNHCLVSRQLRPVLLPTKGQNANSSVGRLCDRFGVRLMAVIGYSLLTPSLVCLQFVSHDSVSQKILFGVLVAFCGISPDLGQPGLYVESQMVIEEMEQQSPGIFGAKGAVAQAFGLQTMANYAGLAIGPILGDALFDNYGWKAVAWALGALSAATVIPSFWLSSRTYSHETEETEEEDLTVAAGVPYGTI

SEQ ID NO: 35709 - protein, 142 aa, A.fumigatus
SCGVFADEIQNYYCAYVGAFGEFSCNPRTLGSTHLNRMISLEGIVTKCSLVRPKIIQSVHYNERKDRFVARRYRDQTMTTTGITNMNVYPQEDDEKNPVCDRRKSLYWTGIADSFVFVFLVDHRVRILDIPGSPNHFYPRNA

SEQ ID NO: 35710 - protein, 212 aa, A.fumigatus
  UNSURE (56),(62),(82),(89): Identity of amino acid sequences at the above locations are unknown.
GKFLMMNAARGERSRRSTKTLNPANRTPRMDNTSANTTATPRSSRRSGTMRTRSAXTRSTNXDEMDADGDVVSEDGDGLYFXSLRGQRXRSSQTSRTQTQTDSQSRMSVASSQPASQLIQSQTDDSQSQNAMSSTSSSQPIQPARLTVFRQALGPLMGTRLFTHGDTADVEELIGAVNTAVRESPSLGAGHVFQRAEAIEALKAMNERNELM

SEQ ID NO: 35711 - protein, 482 aa, A.fumigatus
LITEYGYSTYLDHQTISIQEMPERAPAGQLPRSVDVILDDDLVDSAKPGDRIQLVGIYRSLGNRNASSGSSTFRTVVMANNIIQLSSKSGGGIAQATITDTDIRNINKVAKKKNVFELLANSLAPSIYGHDYIKKAILLMLLGGMEKNLDNGTHLRGDINILMVGDPSTAKSQLLRFVLNTAPLAIATTGRGSSGVGLTAAVTSDKETGERRLEAGAMVLGDRGVVCIDEFDKMSDVDRVAIHEVMEQQTVTIAKAGIHTSLNARCSVLAAANPIYGQYDPHKDPHKNIALPDSLLSRFDLLFVVTDDIEDARDRMVSEHVLRMHRYRQPGTEEGAPVREDLNQTLGVGLEDNQDSNQPTEVYEKFNVMLHAGMANSSRKGKGIEILSIPFIKKYIQYSKSRIKPVLTKGAADHIVATYSALRNDELSGNQRRTSPITARTLETLIRLSTAHAKARLSNRVEERDANVAESILRFAMFKESS

SEQ ID NO: 35712 - protein, 573 aa, A.fumigatus
GSFSLEFVISPDCTENEAWKTRQPKNINKPCFAANSRSFSTHSRHIFTKPPFYTDSRCIYLVRMAACFVYALAFGLFLPISSTTATSTRASTTVQPLDTVPVDFRPVYHFVPEQNWMNEPNGLIKIGSTWHLFFQHNPTGNFWGNLSWGHATSTDLVSWTHQPIAISSGDGIQAFTGTAYFDSENLSGLGSPSNAPYLAFYTGYFPSTGVQDQRLAYSLDHGTTWIKYAGNPIISKTQEEPHDITKGLETRDPKVFYHTPSGRWVMILAHGGQNKVTFWTSSDAESWTWRSDFNANSIPNLPGGINGWEVPDFFELAIKGTTQKKWVMIITPATGSPAGGNGVFAVVGSFDGAVFTADPVDPIAFWLDYGRDFDGALSWENVPASDGRRILASVMNSYGGNPPTNTWKGMLSFPRTLELQQFNSKLRFLQLPVAELSAYTWLIANITNQTIAPGQTLLSDIHSRTLDIEMSFTPSPGATLSLSVRKGGSQQTFIRYAESAQQLSVDRNASGNISYDPAAAGVHTATVQPDASGEMHLRVLVDTCSLEVFGGQGEAVISNLIFRLHAAAGNITS

SEQ ID NO: 35713 - protein, 455 aa, A.fumigatus
IGSRRLSYILYLTDPDTPWQSEWGGALRLYPTTTKKDINGEDVLVPSPDFSLSIPPAFNQLSFFTVQPGESFHDVEEVYHPKEGEDKSAKRVRMAISGWFHIPQKGEDGYEEGLEEKLAERSSLAQLQGRGDIYDLPQAKPVVCEKEPEIKGKGKAKMEEEPSSEFSESDLNFLLQYIAPSYLTPDIAEEMSDTFSNESSLNLDRFLSDKFAARVRAYIEEQEKQELPKSSDEIQAKTEWTVARPPHKQRYLFQQHGTATSDQKTPIQELLNDLFPSLAFRKWLALITGAEHITSYDLLARRFRRGQDYTLASGYDGEEPRLEFTLGLTPTPGWEKETDEDEEMEDEDGEAQEKFKKETASADEPAVGGYEIYMAGDDGDDGDAAIYKSAAADEDDGILFSTAAGWNRLSIVLRDSGTLKFVKYVSAAANGDRWDITGEMGVDFGDDEDDEDDDE

SEQ ID NO: 35714 - protein, 180 aa, A.fumigatus
SSHPRGEDLYREAHGVGASVPFPGTRQGYYSTHSDTLQDIVSQLEIYVALHREKCVNGSSFNAADGQTVSWAQVWPGLCAYFGLVGCEPQTSPQTSMEDFVNGHMDLWKRLAEVHELKSDTVENQNWGHTHFMLVDFDFNREYSLEKVRSIGFMERIDTVEGYKTVFDRMVTAKLIPSFR

SEQ ID NO: 35715 - protein, 73 aa, A.fumigatus
  UNSURE (27): Identity of amino acid sequences at the above locations are unknown.
LNRSSLLFSRTYWPRFAGRGLLAVRSXLLWVGYFNSRSNQSKHYLKAGYWKTPAYYVSLLKKRTNGVDGLPKL

SEQ ID NO: 35716 - protein, 86 aa, A.fumigatus
PWWATAEKWGYYIPDTKESGRNENGGGSKGEALADLNWLSAGIVVKTMAAHAYIIPLAACTLPFFSLQGGYLIAEDFTTSEVHQRH

SEQ ID NO: 35717 - protein, 990 aa, A.fumigatus
SQDSPADADNQAKELPHPEEEFQAEATHAQELPEDTEIINKTDDLSSGIDPSGQAGGDMVNEAASPEVWHDALASSPEDKNGEAEQADLKSNEPQNEGKAPVSELPALDKELSEISERPAEVDAPADTPLVDSPSTDQVEAADSGVQNEEPTPTAAELETPLSRKNSKKNKKKNKRKNTAETPVQNEAVHTADPISSIEGVPEPGPEATTTAVEEPQVTLPDEAVDENKGESRDVQAVKEETSPENAAEVANDSQPSTFEEIHLAGAEQSAPDAIAEIMGESQPAEPQDVLATAPEEPIDGQPKKKAKKKKNRKTANVSESQPESEAEAKTEKLQSAELAENPQPHIRDEVAGDSQVPPESGASEAPAGIEDVTPISAAEAVEFDLPVEKDETNGGEPHVSELNKQLNNETVPGPETGSEPVPEAGEITQSGKKSKKNKKKKQSLSLAPDETPASDPSTPAGTADGNADLPAAPEDSLKTDQEPMPEEPTVSQPIVDLVAETLNLSMAEEAVPMTAAQKKTKKEKKKKRQSALLDEPTATESIEEANAKDVTSEGTQMPLEVPSEPQSSGPTLDAIEHAEAAAEHSQEQPNKDVTLHADHSPNSDGEFVLVPEHVPYGSNDEHKTQPGSMELDVTQVNTELEKEPSTQEGVLEANEATPAETPSAADQHVQEESSPTPAMEGGAAAEELVAVEPDVLEGSQDKITEDNDTPDDSLTAKEPQTELVNAETTQKTEQGDVVLDVEAGSEGLVRDDQPVAPSKKKDKKKKKKRQSLTIDDEQRSSTKEEPTAEFSSDHVPEPSAVDESATTPSASEEQQKPETDITETVTQTAAEPTPSSASEEPENIAEAPSNESTQEPAAEEAQTAKSKKKAKKDKKKRKSVSFEIGEPLTQQSEPGHPTATPGETVTPHEDPKPGDKPTSPKDSSEEFQSGEAVPESPQDSAGIVTQPEQPEPTAEATVVTEQHKQVTEPSLVSINEESHQAGRRSEQCA

SEQ ID NO: 35718 - protein, 562 aa, A.fumigatus
  UNSURE (25),(36),(39): Identity of amino acid sequences at the above locations are unknown.
EERNSGGEAVSVRLPASNSSSSAPXTGAITTGNNSXATXVGPLVSKAPGMTSILQDWHIEFSVDDKPVSSDTTIYRAVHHNREHADAGSRNVWSAIHTVKFRRVPGPPPPEPSTVAPHLEEELSGNGAEMPSSLSKDSITAPILRLLRSLHEMNVTLDDILADTKELVALKPEPLAQFINTKLTAKLNRQLEEPLIVASSCLPSWSEDLARLFPFLFPFETRHLFLQSTAFGYARAMMRWQNSQNADDSRSDHRRDDRPFLGRLQRQKVRISRSRILESAMKVMELYGSSPSVLEVEYFEEVGTGLGPTLEFYSTVSKEFSKKKLKIWRENDCHNDEEFAFGKRGLFPAPMSEEQANSESGKKQLSLFKTLGKFVARSMLDSRIIDISFNPAFFRIADSSSSVAPSLGTVKAVDQDLANSLMLLKRFANAKRAIDRDRTLSAAAKSQALQNVEIDGVRVEDLSLDFTLPGYPSIELIDNGSNVPVTIENVDTYVDRVVDMTLGSGVQRQVEAFRTGFSQVFPYSALRTFTPNELVMLFGRAEEDWTIESQLPSIFDNREAVH

SEQ ID NO: 35719 - protein, 126 aa, A.fumigatus
HWVAACNVKWKRSGLGSRRSSRTLRFGLSPPTSSSCFSEELKKIGLLRVSYLPYLITEKLFTNIMALALMDSIKADHGFNMDSKSVRNLLQTMSELDTQQRRDFLQFVTGSPKLPIGGKHHLLSLF

SEQ ID NO: 35720 - protein, 71 aa, A.fumigatus
LSILLLGFKSLTPTFTVVCRPSEPPYTPDDYLPSVMTCVNYLKLPDYSSLEVLRERLSVAIREGQGAFHLS

SEQ ID NO: 35721 - protein, 66 aa, A.fumigatus
SQRRQRRSNRNNYSRWSSREYIAKGYDAVTRYRTNMQTENAVLSSFFLFLFMIRQLLHKFFLHFRL

SEQ ID NO: 35722 - protein, 104 aa, A.fumigatus
TIYESISVMHDSIIYSLVFSPYFKNALQVQLISMTPSSLSHKQRTVSVCSPLQKLIGAHHHNVSPNLHVPSLYTRRTEHIFSPLLSRQTDTKNQTLGMPIFLSK

SEQ ID NO: 35723 - protein, 282 aa, A.fumigatus
LKTAMSWLARPFRCLSRVNPATRLVAPVSTCRSSQRCIQGASAVAQDHHSSHTSSTVDDGSSILLNQTASAAQRPRPQTNPIDDLISQTPIVQALRRDPAYTESRPHLAMNPSLRPNHFVAGPNSGPGKISVPPYVWMAKKPHTATGTTTSRMVSVFHIGVQLCGHPGFVHGGLLTVMFDEAFARCVSTSFRSGLGMTANLNVDFRKPALPDRLYVLRAETVKVEGRKAWVEGTLTSLPPVGDTSEPVMVAEGKALFVEPKFAEVCCNHKFPQDDCHTDSAN

SEQ ID NO: 35724 - protein, 86 aa, A.fumigatus
KPTVTMKFTGIVASLAVASSASALAIPQTPVDATLSKLNNALNNVEGLVGGLLGGVCEEVDLTQVQTGMSFTEGTSETCKSIVWPR

SEQ ID NO: 35725 - protein, 112 aa, A.fumigatus
SQFCALELITIKGQLTKLVPVSATKRDVMSTANNVATPVTGAAGSELDNVEGAVKPVTNVAGNAVNTVEDVAQPVADVAGGAVGTVKNTVGGAVGTVENIASGPIDTVTGSM

SEQ ID NO: 35726 - protein, 840 aa, A.fumigatus
LATGGYEFLAFGNSQFREHGAYFFAPLPSLTAANIRAWMGTFNDIRNVAKHAARLGQCFSTTRAIAGCPVQIRLIDDVVRNGYTFSDGVGRISKFLAQMAASELKIRTPSGDPPSAFQFRLGGCKGMLTVSPEAQRQEVHIRKSQYKFASVHNGLEIIRWSQYSMATLNRQLIIVLSSLGIQDSVFHDKLRAMLQSLNESMESDSQALCWLKKYVDPNQMTLVVSQMVLDGFRSSREPFVTSIMRLWKAWHLKYLKEKAKIVIEKGANLLGCMDETGILRGYSEWIPAKGASDEEKLAALPEIFVQIHHPDTGKCEVIEGVCILARNPSLHPGDIRVVRAVNVPQLSHLKDVVVFPQTGDRDIPSTCSGGDLDGDDYLVIWDQDLVPEDWFRKPMKYTSDKAQDLDQDVTVNHITSFFVLYMKNDFLPRIAHAHLAWADRLEDGVNEEKCIRLAQLHSDAVDYNKTGKPANMARSLQPKVWPHFMEKKHKPKEMIYKSNKILGQLYDAVERIDFVPSLEMPFDERILTCSLGVSDDLVQFARDLKADYDAAMHRIMAQHEITTEFEVWSTFVLSHSNMSKDYKFHEELGLISSSLRDMYRKKCYEKVGGRSFELLAPLAVAMYRVTHEEMTSALEKCRSENHSDGQLFHKPTPKIDQLPFISFPWILYNILGKIALGHYEDSEPGSAPTVIAPATASVDPLDPVPGQAVSVHKENSNRTEPTSDSLNGIHEDPFGLFEGDQESRPSSRPSREAEVSATQNRRESIPSLDQLLDFGLVELSLPISSDRLHLSAQAPDGFNLLELNDNTALDKPTEGRAEETDLATQMSLVFTTGLEGAAST

SEQ ID NO: 35727 - protein, 67 aa, A.fumigatus
LFTVANGCNVKFSTYIANSFLSSLNHCALTAKSSGLSGPPGLSGLSGLSGPPGLSGLSGLVYIEFKV

SEQ ID NO: 35728 - protein, 241 aa, A.fumigatus
VLLLIPLWMAKVNTVVPDPYLDEVFHVPQAQAYWDHRWFHWDPKITTPPGLYIWSYILCAAALVLRGSPKELNAGALRATNVAAAAVFLPWRLQTLLDALRKVRNTRPSGAWLSHTVLNICLFPPLFFFSGLYYTDIVSLLAVIEAYNCDIKRSGGSWSLLKTAVFVATGLTALVLRQTNILWVAIFLGGLQVVRRLRQSSKASQASSLLQIIQSGFNNELYDPLVSEASFFGECLSWPPG

SEQ ID NO: 35729 - protein, 328 aa, A.fumigatus
PRLCGCVTDDVLGHKEFHTAGLHLSQMLYIWPYFMFFSWPILIFPVINLVLPNSVIPAFFDYGFTKKQKGLPRIWTALVIIPIMLAVVHFNTIIHPFTLADNRHYIFYVFRILRSHPAIRYAAVPTAYFVGGWAVISAFGFSTTKPQPQFVPITKSNELAAAQKGQLKEAARKKEKSERKSKSKKASQVTASPPAQDQFSPEVLARIQEHLAQRQKQQQEVPRASFVLVWLAATALSLVTAPLVEPRYFIIPWVMWRLHLPPQPVPLVYRQQRPRDEREALHADLATNFSLFMETYWFLAINAATGYIFLYKGFEWPQEPGKVQRFMW

SEQ ID NO: 35730 - protein, 204 aa, A.fumigatus
GYSTGGYDNRVQENVQYHRELDQLATSLGLQTATSKTVISALSIPDSIDVLFLLSVPTAFRDTLLSQAKLLLYTPINEHFGIVPVEAMRAGIPVLASNTGGPLETIVEGETGWLRDATVVADWTAVMDRVLYEMDQKDLDRMSAVSKARVEKEFSLTAMGDRLEEEITDMLSKERRPFSGFHQLILVFALLGIMSSILAVWALK

SEQ ID NO: 35731 - protein, 687 aa, A.fumigatus
VYLKHILNGGCHVTSCKGQRGPIATRVRNCRNVAAASDKPSTNPQPRCASTRKMPEVINLLSSTPPPPASQPRQRFVATLPSDPPLSSAPRPLLSDDIESLFAYDDIDKPAKRRRLSEEVESPMDVYAQLSTTNLFLFSDDDVALASDGPSTLGIPARNEESDPIVFTSPAPVPGARSLTSHQTNFIETNTITIDDDGDDDGDAHVDICKDAATGKDHIEDFSDQLAIPDIDELMRQARETKESGNENSLFSSRTASLLAGLKERSKATSSTGSRPRSRAARPSKKSKSQARNVLDLDYDLSEVVVESRRPARKTTTLTAAEKDARAIERESAKAQREYEKQLEKERQKKLREEKAREKQLAADLAEVNKLKVDKRESTPEMILDLASSFRETSVGNQSIELMKRLGVEHTFFTSSIPNLVKWRRKVTARYNEAAGHWEPCPHHIREEDHVLCLVTAQEFVNMAIAPADPVTGTTELELHLSHIKKAYPRHKLIYLIEGLTSWMRKNQNSRNRAFQAQVRQQLVPDDPSSSTRRRKPPAKTAESTPPVDDDTIEDALLELQVTHACLIHHTSAASESAEWIKNFTEHISTIPYKRERMDGNDSAFCMDTGQVKPGEDKADTFVKMLQEVNRVTASMAYGIAAKYPSVVELVRGMRRHGPTMLEDVKVCYVLSGLSNLMQVSSYANLF

SEQ ID NO: 35732 - protein, 261 aa, A.fumigatus
PSAAWDKMQSRGHRVTIYTSHRDKSHCFEEARDGTLDVRVRGNSLFPAHVGGRLHVLMAVLRQLHLTVSVLREIATSEEKDNIFIVDQVPACVPLLKTLGPRAARSSRSRQRILFYCHFPDQLLARRNEGGELLRLAKTLYRYPFDWFEGWAMSASDKVVANSRFTRGVVSEVFGKEKLGDVRIVYPCVDTKAGAPVGTEEGPLWGGKKIFLSVNRFERKKDLALAIRAYHGLGQEKRRGTKLVVAGMSSSKWVPDGESSY

SEQ ID NO: 35733 - protein, 88 aa, A.fumigatus
TNLQRVWFCHLKTFEVRPPKGFCWRYMLTFHVAIVEKTAGYVARNGFVFEGALSVYVDSSIFMFHFKLTVLFQNVCAKKRKTTRNSPF

SEQ ID NO: 35734 - protein, 487 aa, A.fumigatus
ANSTLPERVREKEKNNPKFSFLNPGDAYASFYQWRLNEIKEGRGTAVAAGRPGESTAAPEPEKPKGPAQPPEFHFSARMPIINAQDLEVVKLTALYVAKRGKSFMTALSQREARNFQFDFLRPQHSLYQFFTRLVDQYTILLRAEGIDESTSEKRRIAELENNVKNKFHILERAKQRAEWVKYQEQQKQKKEEEEEQERIAYAQIDWHDFVVVETVLFTEADDQADLPPPTSLNDLQSASLEQKAMMSLNPLRIEEAMPTDQGAQVYYNAYPPTQPEPVAHPAPPSVSPYPPQAPVPQPYPMASAAAQEEEQRIRERMEAREQAAAAQAAAKAGPGQQPMRIRSDYVPRAQARRLNPSGATALCPNCHQQIPVAELDQHMRIELLDPRWKEQCAKAESRSATTNLSTADVVNNLTRLASQRSDVFDSSLTAGLDPEEEARKQRMAYENPPGAGPTPPMVGPAGGPPNPQSLNIEEQIRQIHERYKQG

SEQ ID NO: 35735 - protein, 377 aa, A.fumigatus
CTNDFSCMQIIYPALFFAIIGAGGVFMGSNSRSQPQELEHILHLADPKLIITSRDALPNVLSVSAARGMLSSQVCLLDEYAPNHIAQLLLSGPQALVPDNDAVYLNFAQLLSYGENDWVRFNDPEIAKSTPAAMFSTSGTGGLPKGALLSHHAIVSHHLSINYDVPYVVTRLISLPMFHLFGSLWTHIFPIRYGQPLFVLPRFELTQYVAAIYHYQITETYMVPAMIHVFNRSAPPIADYMRTLRYVGVAGAPIDGPSMEQFQRLLHPHARATQLWGMTEVGVVFQTRYGEQGNPGSIGRLLPGYEVRLVGQDGNVVQGESRPGELYVRGSGVLMSYKGRNDAKDAYGWFRTGDVAYVQNGQYFIVGRTKELIKVRG

SEQ ID NO: 35736 - protein, 134 aa, A.fumigatus
SGNRWQVAPAELEAVLLKHPGIEDAAVTGVTSKDGSTELPRAFVVRAKGPAANRLTAEEVYQFARRQLASYKALDGGIVFVEEIPRTASGKIQRFKLSQMNTYRDMVSSLLARFKGAASGLGGLGLVHKGRVAV

SEQ ID NO: 35737 - protein, 60 aa, A.fumigatus
KLPKKRSIFSEYELLKANGQWITGILAVGLWITSVLIGRTNMFCGTQHNYSGKFEMVPGP

SEQ ID NO: 35738 - protein, 84 aa, A.fumigatus
KMTLSLLMVGCRCSGPTRLSSVLRFVGRIRAYRLAGSKLIFFDIFQDGHKVQVMCNIRKLDGVAPDAFKRFYRLLRRGDTFCML

SEQ ID NO: 35739 - protein, 173 aa, A.fumigatus
PSPVSLPETERFSIAVTGNPHRTGTGELTVLATELPRLLAPCLHDVPVDAEEHETSPYPRHVQFLADQKAADIIRARSAIIQFLRQFFLDRSFMEVSTPIIGSIAGGAIARPFQTSATEFPDRQLSLRIAPELWLKRLVVGGFDKVFEIGPSFRNEGKSGQILDRWIDMDMSD

SEQ ID NO: 35740 - protein, 260 aa, A.fumigatus
YAATGLDKTHNPEFTTCEFYHAYANLEDLMSITENLLSGMAAHIQEFNKNASLKPPEVDFSAPFRRVDFTTGIEGKIGRRLPDLTTPDALDQVSQLFRDLSLPIPKEPTLLRLLDELCGTYLEPECINPTFIINPPECLSPLSKSFIHPANQQRVAARAELFIDGREIVNTYEEENSPFEQRRKFEDQVRYTKGTDEPAEIDESYLEALEWGLPSTGGWGCGIDRLCMLFTGTKRIGDVLPFGNLRAVTRRHTGLSRSTN

SEQ ID NO: 35741 - protein, 100 aa, A.fumigatus
GLPVTAMENRSVSGSDTGDGYMSQHTESIAAAKETVKSLESIGSYSVQLANVAHNLDFVPILEDIEEYQLAPGQSIGTYSSYKSKYRGQPSRARTAATYH

SEQ ID NO: 35742 - protein, 68 aa, A.fumigatus
ATGLMILHVPDETEVLNPDAIYDRGRYVRLTAFIAEKEETHPDPRIYVEQRFYQGNQEILHHGGQDPR

SEQ ID NO: 35743 - protein, 113 aa, A.fumigatus
IYATAGSEAKVDYLVHNMGIPRQRIFNSRDSSFLPALMRVTQGRGVDVVLNSLAGELLHASWKCVAESGKMVEIGKRDFLEHGKLDMDAFCGNRAFFGVDLIRLGEKPGFISR

SEQ ID NO: 35744 - protein, 359 aa, A.fumigatus
IGGTGMQRSHDTGRCRSTRRCQGRNPTQQPPHWRRAATVNGASGKFNAKRSRQTQRVANLAKDHFIPAMAHSDWKEGLSAKVAGTWNLHEALTGHDSRLQFFVVCGSIAGVMGNAGQANYSSANAFLTSFTQYRLRAGLPASVVNLGAVNDIGHLAVQDQKLRDRMFAGHVRLLSEQEVLDAFEIAMLECQPSSKPANESSDEILRVRNDVIMGMRSTKSLADPSVRPLWGRDARFSVYANLRINKQPLSKDLETIEGLQQELAACEKNPDRLKDPAFPKRIVREVIRSIREYSNFARGQDYAQVAALPIDSLMTVEFRNWSRRYFNLNLPLTAIAKAGTVEGFAELVVEWLRSKYLKQ

SEQ ID NO: 35745 - protein, 213 aa, A.fumigatus
RKRGIRLVAQAMALYEEGRITPVRPLEVVEATDIHRAFRLMQLGYHMGKLVVKMPESPREVVVSKSRLKLTLPDDVSYLLVGGLGGVGRALATMMVERGARHFVFLSRSAGKSAQDQAFRGELEAQGCSAVMIQGDVGVLDDVKAAIQHSSHPIGGVLQLSMALRVSSMPREADKLNGLLIWQRITLSQLWRTLTGRKVSPQKWRALGIFMKH

SEQ ID NO: 35746 - protein, 74 aa, A.fumigatus
LGGGKADPPGRCLTVCLLVLSGSGEIVKVLCSRLIGDVDKPDKQMDDSPDSIAMMQEHKVTLYSLINMVVVVPE

SEQ ID NO: 35747 - protein, 378 aa, A.fumigatus
NINKKTQHPAVAEYIIFIPRPKMHLLSEPDVSRILRNLTPEQCHILLDALSEALVTVSSETTKPEGERLIHQPLRTTIATKDQNLSLFMPVSNTANTSIKIVTASQREGIIGVINVFSPEGRLLGLLSAAEVTAFRTALATMTLFTRCTTIPKKHILIFGSGRQAEWHARLALLPAPSLVQRITFINRGRRRLEELEREVIAELRASHPKIVFETLAKEGTDDAEYEARLRAEVASCDVIFSCTPSTEPNFPYKYLLSSTSAAASKQRFISLIGSYKPHMCEVDSETVLSGGGQIYVDSREACLEESGELIKAHVGGEQLVEIGELFGRLGKSEPVVVPEGCNVVFKCVGMGIMDLVIGKKLLDIGVEQGLGMNVDGF

SEQ ID NO: 35748 - protein, 225 aa, A.fumigatus
EFTKPSNLKYQQENTASCCCRIHYFHPKAQNASSLRTRRLSYSEKPNSRTMPHLTRRSERSAGNRLIRDHKTRRGASHPPAPPHHHRHQRPEPIALHACLQHSQHEHQDRHGLPARRHHRRDQRILAGGPAPRPAQRRRSHSLSHRPRNHDAVYALHYHPEETHLDLRLGTPSRVARSAGAAACSKPGAADHLHQPGSPAAGGVGEGGYRGAASFSSEDRIRNAG

SEQ ID NO: 35749 - protein, 106 aa, A.fumigatus
FHDCHGCSYPGIAGESEASPRFGGKPQKSCESVRSILHAPHNAAFCLLLYFERFRIIDFRRCDGCRRVKEKCEGGVPCRRCLRYRRQCVFTHPDHAEKLARSSSVS

SEQ ID NO: 35750 - protein, 67 aa, A.fumigatus
HTSNSFSLRILPPTTAMVLDYSKWDALELSDDSDIEVHLMSTSAPSLEQSRLRSISNGTSAVWRLRL

SEQ ID NO: 35751 - protein, 145 aa, A.fumigatus
DSLINSITTKDHQAATLFRNDVNETYNKIKTRAAELAKDSSAANDPAGVEQIQLHAVDPNTKITINIPPADSNDPAVIEARKIFESFSEDMQKALASESLDEVNKVLGKMPVNEAEEVVEKLGAGGLLSLEEAIVDLYHRVENPR

SEQ ID NO: 35752 - protein, 304 aa, A.fumigatus
FGHRGSPNVDKRSFIRAKQAQIHQQRHQRRMEIETLKYERIINDGLLSRIDKLLALLREHEGSSRDPEELVFQAVMESASNPAEDQAPVPPEGVHTHEKEQPKYSQMLSSLVDQVKKEIGESSPDNRYQAYIKGVEGHQDKVQGLQKELLARLAQLEKEESSKITSDMLHTGFDTSYISKSKDKGKAPATAKSETVELLNPRAVQDDAPKADDNEQVDPDDVKASDLAKKFARINRNDYRALLQFISEHPEIVAEKETDGLLVEAFNSQMEGKEEYARQCVHQGLLLQYCRSLGRDGISLFFKR

SEQ ID NO: 35753 - protein, 472 aa, A.fumigatus
IPVQFRIFSPNFQMRGIRSLPCWAPGLSTKRIPPRELFADLFPNACVISARHSARNGLIRQFSGCSGSISNSCNPRPYRSAITSLLSANVCSKGVSAVQPRFLSTVRLFSTSQRSLEPKSNVKSTGGQVVRPELHQDQEHEDIEKGFELSERAAQAAQVNLSAKLAKDGAAGKKAGFKEIWRLLLIARPEAKKLALAFLFLLVSSGITMSIPFSIGKIMDTSTKATTEGGNELFGLSLPMFYGALAGILTLGAAANYGRIIILRIVGERIVARLRSKLFRQTFVQDAEFFDANRVGDLISRLSSDTIIVGKSITQNLSDGLRAAVSGAAGFGLMAYVSLKLSSILALLLPPIGLGAFFYGRAIRNLSRQIQRNLGTLTKIAEERLGNVKTSQSFAGEVLEVRRYNNQVRKIFELGKKESLISATFFSSVRNCPNPSAYLRSNFCLDRVCWQHDHPGIAVRRRRHGPIRCQNA

SEQ ID NO: 35754 - protein, 624 aa, A.fumigatus
KCEVCGKSEDRPSILVCDSCDQGYHRNCLDPPLTNIPEYDWHCPKCLVGTGEFGFEEGGVYSLKQFQEKANTFKKNYFASKMPFDPVLNTHRRESEDDVEREFWRLVESLTETVEVEYGADIHSTTHGSGFPTIERNPLDPYSTDPWNLNVLPFHGDSLFRHIKSDISGMTVPWVYVGMCFSTFCWHNEDHYAYSANYQHFGATKTWYGIPGSDAEAFEEAMRQAVPELFESQPDLLFQLVTLMPPDQLKKAGVNVYALDQRAGQFVITFPKAYHAGFNHGFNFNEAVNFAPADWEPWGAMGVERLQAFRRHPCFSHDELLLTAAARDTSITTAKWLAPALQRTCHREVAERAAFIHRHREIAPHNCALGSLDSSASGECQLKFVIEEEDLPEDDYQCQYCKAYTYLTQFRCHKSGKTVCLLHTETFDCCGDSSSQRLLGPDHTLRYRMSDDTLKAVVQKVQERARIPEAWGEKLDKVLENEPKPQLKVLHSLLSEGEKIPYHLHGLQDLAAFVQRCDKWVEEANNYITRKQQNRRKNEKAWRKSTSKAAQLEERDREVRRIENMYALLAEADKLSFDCPQMAALEEKTREIEKFRQDVNVALMNPHIRSIQEVSSPRGWKDPR

SEQ ID NO: 35755 - protein, 346 aa, A.fumigatus
SATADPSSPVVKTDSGTRANLNYLDQLAKFHKQHGTNLNRFPSVDKRPLDLYKLKKAVEIRGGFDQVCKMKKWAEIGRDLGYSGKIMSSLSTSLKNSYQRWLQPYEEYLRVVKPGVQQQLELEHGGPYTPSPNQSPMAKKPVLYDHTTPSTTPQAPPGIPATGGPHGTPKEIEATPDKPTPPAESAAPRPVTSGFTPVNAGGGGFTAVNRSPSFVAVNSGPVVKKEAETGSLTPQSVAEHPQSSTPVTNGNGGHPMKRAISHESGSPTEGGETDASGRRSKRLRKGKHVFSQHSSWLDMSDVLLDAPPPTVAGSHMSLLRPAPPRARKSDSRKIGDVSKKKSSIVM

SEQ ID NO: 35756 - protein, 275 aa, A.fumigatus
  UNSURE (72),(74),(90): Identity of amino acid sequences at the above locations are unknown.
KTTSLNKYQDMTSPSDSWPAILTTAKHTPRTSTPKPDLPSPQQQSLIDSLRTLPRMNQDVEADAAQSQAELXSXIADILSEYQDEDERQXQQSCTSTSNENKTTIEEWENLHAFLAFITKERIVRLEDVGIHVLRVALERGEPHQHQHQHHYSHRRYPETGTKMEMKTEQGGNRKKMAVFVSCAAIWAVVMGEELWERRHETDECPVGLSLSPAQRASAAAAPTAAGEAAAATTVSKSRWQMWIDRFQFLSLAEDLDIKTRELAAEAAAVMRRVT

SEQ ID NO: 35757 - protein, 338 aa, A.fumigatus
ADITSLLSSLNLPGSLQALEKPLGLPPTLVAHAEEMRQQNGLHRLRRSLEDIAKVKANDKAVYNEGVELLAAEKAEDEASRRKYGTDRWTRQTSEAAAPKLYTTSSEISGYFTSAQSSDNLVEQKLRDSETVFRVLTGTNRDLEMYVPSSRRAAIPPEVERELIRLRGCLSEVSRLESRRKRRAQALKEKARADDVTQALLKETARLEREFPMQPIQASQFEDLFEDQLHLYDSDLEMVAQEQHDQDQIAAQVREANRAFTRAHKGDASTKEREKALQELENGYLKYKEIISNIEVGRKFYNDLAKIVGRFRDDCKAFVHQRRMEASQLERYFLLSSA

SEQ ID NO: 35758 - protein, 331 aa, A.fumigatus
APDRCQVSQNNLRFELANILFNLAALYSQLAFSVNRTTSDGLKQACNYFCQSAGVLLHLRADILPDLRTSPPEDMDEMTLQSLEQLLLAQAQECFWQKAVKDGLKDASIARLAAKVSDFYAEAGDCAVKSNAVSPEWIHHMTAKHHHFAAAAQYRQSLDCLEKRKYGEEVARLRDSEACVNEALKESRWINRAVLGDLNGLKSRVSEDLKRATKDNDVIYLNPVPPKSELKIIDRACMVAAKAPSQVTDAISMLGENGPLGQPLFAKLVPYAVHIAASIYSDRRDRLVNERVIGELETMTDKLREYVLATLNVLAAFFKWIKLTLLVCYHR

SEQ ID NO: 35759 - protein, 65 aa, A.fumigatus
YRHSIPVTLSFEQATGKNVLLLPMGSSTDAAHSVNEKLDKKNYIEGTKLLGAYLHYVAEEPASEV

SEQ ID NO: 35760 - protein, 210 aa, A.fumigatus
RSATIIVRLKNQGDGAFMPDDYGKSIIIERHFSKNGTSGFKIKAENGRIISTKKAELDSIIDYFTLQFDNPMNVLSQDMARQFLSTSSPADKYRFFVKGVQLEQLDQDYRLIEESADQIEEKLRNREQDIKILRDLKDTADRRLEKSDQQESLRSRIRNVRNQVAWAQVEEQEKASHTVFRASIPMSKKQLVERLPGGRARADRQRDSSG

SEQ ID NO: 35761 - protein, 207 aa, A.fumigatus
PGSPAVKKSKLVDPRGNILIPGIMDLVAPLTEEENSLYSKISYTMDNLHESLGSKTNIHETKERTLMARWRYPSLSIHGIEGAFSAPGAKTVIPAKVIGKFSIRTVPNMESDAVNKLVFDYIKAEFAKLNSKNTLDVWLQHDGKWWVASPKHWNFTAASKAVKQVFGVEPDMTREGGRYVNYLSLLSRFDYLHRDTSANIDIAFLLL

SEQ ID NO: 35762 - protein, 193 aa, A.fumigatus
LQFHDQKLIRSLMMASAKRLQASQDPESFNDESNGTSLTSTSVRLPYMLCIQQVNLVIQRKRIRRSETSRSEEDNESSDAETTRSCSITEALDDDEDELELRATQAIQEKYSFVNEEPNIPAEHGILERVECYNFMCHDHFRVELGPLINFIVGKNGSGKSAVLTAITLCLGGKASATNRGQSLKSFIKEGKE

SEQ ID NO: 35763 - protein, 75 aa, A.fumigatus
ILVDEDAPVPSKKNWIYPREKNPTQDTIEFLWRLLFVELTECWATLDATFKYEECRVHAATKKDRTRDIRVSSDL

SEQ ID NO: 35764 - protein, 212 aa, A.fumigatus
SSVFLAYANIPLKLSTAVYQHSINKLKLMTRSALVGLIHDKTMKSPSIAYDNGEATTLMSTDADSLDRIAEMVHETWAQVIEVLIGIGLLASEVGWIWPLPLFLIYCKYICMTFLLILRCVVCSYMSRFVAKHLQPHQKAWSNATQSRIAATTSVLSAMKDVKMLGLQHKLTHRIQQLRDGELWAASKLRWIMVYYNASGVSGALNEVERYV

SEQ ID NO: 35765 - protein, 61 aa, A.fumigatus
MAHPMGEIMRLFAALTTEDVFCWNCGAGQLYQAQDLHDSVRLDVLTMIYVYKLKYIMISMS

SEQ ID NO: 35766 - protein, 770 aa, A.fumigatus
  UNSURE (5),(6),(7): Identity of amino acid sequences at the above locations are unknown.
PRPIXXXRVPFYHGGVERARKLAQEHELFSQGEPDLRCHVVVTSYETIIDDASRRVLMKIPWAGLVVDEGQRLKNDKSQLYESLSRFKFPFKLLLTGTPLQNNTRELFNLLQFCDPTKDAARLDEKYGTLSKENIPELHNMIRPFFLRRTKAQVLTFLPPIAQIIVPVSMSVVQKKLYKSILAKNPQLIKAIFQRNNNSEGVKQADRHNLNNILMQLRKCLCHPFVYSEAIEERTANSAASHKHLVEASGKLKLLEIMLPKLKQRGHRVLIFSQFLDNLDIVEDFLDGLGLLHRRLDGRMTSLEKQKRIDEYNADNSPYFAFLLSTRSGGVGINLATADTVIIMDPDFNPHQDMQALSRAHRIGQKNKVLVFQLMTRGSVEEKIMQIGKKKMVLDHVLIDRMVAEEGDGRDLESILRHGAQTLFNDDDSGDIQYDSESVDKLLDRSQEEQAKMPDESAPESQFSFARVWANDNQNLEGQLQDTEDKDEDPAISNTLWEKILQEREQAAAEEARRKAETLGRGKRKRAAVDYGIDTMDVSPVNVRHKADNHDEYKADEVIDSESDNDPGMDSEGVDRSSKKSKGNAAPCLSTGFSVLTTRTVRPFKRIAAEEDGVPAYGATGMDGNAEARHPPCFVCTKHHPVGSCPLKHAGVEHCGLCGLAHYGIARTCPHLRSETQVARMLDALRHSTEDGELIEKAKKYLQGIRGSLAQRRRILASRAAASQISNGVPGTTNTGSTGSPVIDLTSYPARNGTTSFGPSQPGQKFPTSG

SEQ ID NO: 35767 - protein, 469 aa, A.fumigatus
SMIIVPDFRSTDGLFKSLQKKHNLKASGKLLFDAAVYQDESLTASFQDMVRSLSEEAAKTCPTAFHHMLARLAQEKRLTRLYTQNIDGIETSMPPLATQIPLNVKAPWPRTIQLHGSLDKMVCQKCRHLLDFDREMFNRPDAPECPECSKNNQFRIETGQRSHGIGKMRPRIVLYNEHNPDEEAITSVMNADIRSRPDALIVVGTSLKIPGVRRLVKSLCSVIRTRRNGVTMWINNEPPAGKEFEDCWDLMVKGDCDEVARLAGLKRWDDDSEDVFDECNSSEVERVKKEQGAVSIVIRTPKKKQKTQTGILTPSSSHDEESTELRHKHPSNGGSLHNPASRGRSLKDVLHKAKGGEPTKAAPKKSAPKKRGKKVEPAHNAKITAFSKVTKTARAATGDAGKSVKLEKDDAKPMHPLPPGAARNNGPLFPNLVGKGNTSPCGGFWSNPDTISPKSVPKGMKDLLNPPSP

SEQ ID NO: 35768 - protein, 197 aa, A.fumigatus
QLRLVAESIRRVNDTSSSNNSSVYVVLINQYSLRSLMSPLKQSNFLCLSQTKPALQLRPRSRLIFAFCVICSIRIHRSPRSRIAIQIFYSIDVLFLCLIFILLLAIILILLLVFLGLLLILQARFLFLLGVIVIFLLLMPLLSTRRTPLNPLHPLHLTYRALLVIYLCFLDSPGLVTDPRPRLPPLPLPSLHLRKRL

SEQ ID NO: 35769 - protein, 179 aa, A.fumigatus
GSFQPRGEETSSTTTASSLTTSTSSSSSQTSTVSDERWNPKFMDDFDLSELSELSSPPASPQSPPSFIPSPPPSQDAGESSSAARGQDGLSPARKKRRVATPKERTTQHLDLSRDSGLSFREQQAQVDLLVKTLRRHRKIVVIAGAGISTSAGSMHSLQPHGGRQKNRHANWLIYDYSS

SEQ ID NO: 35770 - protein, 194 aa, A.fumigatus
SGWVDADECSANEATLKRTVAPADVFSALSELEFEAFRPRLEKELEAFTEMKAGKRKGRKSGAGVGDEAGAVQKTQVDDEESAVREVKRVKRVEGGSSSAQEGHEEEEDDDDTQEEQEPGLENEEEAEEDEEEDEDDGEEEDEDETQEEDIDRVEDLDRDSRPRRTMDPDAADDTESENESGPGTQLQSGLGLG

SEQ ID NO: 35771 - protein, 635 aa, A.fumigatus
RKHLSNWLTISPLLNVPFRRSSWICLARILHGTPFRPLGCPESRLPPMPSFAKDFAPQELHSDAEIALALHTLGSFDFSGHILNEFVRDVAINYVENDNPEIRKAAALTCCQLFVHDPIINQTSSHSIQVVSEVIDKLLTVGIGDPDPEIRRTVLWSLDRKFDRHLARPENIRCLFLAVNDEVFAVREAAICIIGRLSSVNPAYVFPPLRKLLVNLLTGLGFASTARQKEESAQLISLFVSNATKLIRSYVDPMVTTLLPKATDANPGVASTTLKAVGELASVGGAEMRNYLPRLMPIILDSLQDLSSHSKRESALRTLGQLASNSGYVIDPFLEYPHLLAVLINIIKTEQTGSLRKETIKLLGILGALDPYKYQQISEIEPDVHHINEIQTVSDVALIMQGLTPSNEEYYPTVVIHTLMQNILRENSLAQYHSAVIDAIVTIFKTLGLKCVPFLGQIIPGFISVIRGSPPSRLESYFNQMAILVNIVRQHIRAFLPEIIEVIQEFWDSSYQVQATILSLVEAIAKSLEGEFKKYLAAMIPSMLDTLEKDNTPRRQPSERILHAFLIFGASGEEYMHLIIPSMVRLFERAQNPQSIGQSATDSLTKLSRTSNVSDFGILNESLLGSGWLQATTGT

SEQ ID NO: 35772 - protein, 326 aa, A.fumigatus
YSMISNPTDWPPEKFLEFYNAVSQRIAQLVVTGSDAHERIGGLLALDRLIDFDGVDAAQKTTRFASYLRSALRSNDNAVLVYAARSLGRLAKPGGALTAELVESEIQSALEWLQSERQESRRFAAVLVIRELAKGSPTLLYGFVPQIFDLIWVALRDPKVLIRETAAEAVSECFEIIAARDAQVRQLWFARIYEEALLGLRSSNVDSVHGSLLVLKELLLKGAMFMNEHYRNACEIVLRLKDHRDHKIRAQVVQTIPILASYAPVDFTETYLHRFMIYLQAQLKRDKERDAAFIAIGKIANAVGAAIAQYLDGIIIYIREGLALKA

SEQ ID NO: 35773 - protein, 72 aa, A.fumigatus
RLTSNVHPGVWLTNMAQAGPITDITQRLFSELKSKNEETRVRASFELYDNVLAISRGNTSHFGRTPNLANIQ

SEQ ID NO: 35774 - protein, 126 aa, A.fumigatus
KRKSLCSQLMESELTFASRNRAAVNEAPMFECISMLSLAVEQSLSKYMESLLDPIFACGLSESLTQALVQLAHYIPPIKRTIQEKLLDMLSPDPSWDTLPSPRLPREQATSHAVFRKGLRSTRVAL

SEQ ID NO: 35775 - protein, 78 aa, A.fumigatus
SMILPVPLSPTFFRLLDLEDGLRASSKPVYGLIFLFRWREDDPDKQEASCPEGLWFANQVCLLICLILISLDLSCKDG

SEQ ID NO: 35776 - protein, 106 aa, A.fumigatus
SVVSPCYRHFNSHLKRRKMDILNSDLQLKVEATSKRSRSGKDRHDEFETDAGFHFIAFVPALGKVWKFDGLERQPQALGKYASICTNEGRHELIIIQGNMRPTMTG

SEQ ID NO: 35777 - protein, 134 aa, A.fumigatus
SFCFVGEKMILINRKQAAQKGFGLQTRSVSLYVSYSFPLTYLAKTASNACASVALLNIVNNIEGVDLGENLRHFREFTMPFTPALRGDAINNFEFVKRIHNSFARLVVCYTPTPPLVLLHNPSYHRVIVTSTHI

SEQ ID NO: 35778 - protein, 66 aa, A.fumigatus
RSTVDTSSPVVKTITYFKDYRFKELFIADYPFRSLHIIISLQVSPCAYSQDIITTTILRTQDTIYG

SEQ ID NO: 35779 - protein, 77 aa, A.fumigatus
QKWLQLMSSRLMWMFSRPQLRKTDSQQTICYVITILNTGCRFRQHGTSLCLELISSRHTMYIEYKHMIYFIEDPYLL

SEQ ID NO: 35780 - protein, 104 aa, A.fumigatus
PQLYLQYARCGVNSQISVLAYDPVQSLMAVGTSDTQFGSGQIYVFGQRRVSGVFSLPRKASAKFLQFCADKMISVDSNSEITIFSLETQKALVSYAPPSHATAL

SEQ ID NO: 35781 - protein, 280 aa, A.fumigatus
ALLAGDIIAYDLDRESLTPFRVPNLWAERNPRARLCPVFSLAFSPRDIGKILVGYPEGAVTFTFKQNVAQKYFQYEIPPGAVGGNSEIPSQDTRRPKLTRALWHPNGIFVLTVHDDNSLVFWDSKDGRKILARTMENTHIDEPGASPNRRFSTAEAIFRDPITQVAWCVKANGEDSGLLIAGGRPKAESNKGLTFIDFGATPNYQTSTWPMITNYFENPKQVQNIPAPPGAEVIDFCLIPRSSPFYAGAHDPIAMITLLSSGELITLSFPSGHSITPTIM

SEQ ID NO: 35782 - protein, 314 aa, A.fumigatus
GWCSADASCRLVKIRRESVMEGKRSATVSFRDEVSPYSVGFACSCTPPVLRDGLFVDSGSKALTKLCSFERPCSSTSASSPDIDSPLSSSDSSSLSSLSESYSSDSSGSACFFLDAAAFSFSSSAVFRSQAVVRSMASSPRSSSSSISSSSSSDSSTSSSRLISRTRLDFFGFGFDPALVVELPRNVKPSKRSSSLVPKASSLSNSSSSSLSTWPNLHLCPSPSLPALLLSSDSSSPPNRRRLLSGPSESSISRLGFRLRLEGSWILPKRLRLTPNLSVTWLSAIDSAFSAFFPVFFLGAGFLEDGSLSFGPRN

SEQ ID NO: 35783 - protein, 105 aa, A.fumigatus
CRPACTTFSQPQQRPHPRRLHLSHYCSAASHTMAMFKPSQPMMARLRLTTKQVNGGYYKGNRTGSMGYFAKNGSYVIDWKKVRTYVVPENLADFKVRCLTLAINI

SEQ ID NO: 35784 - protein, 80 aa, A.fumigatus
LLALEITSPNQLTPFVTKRMAPTKGKYTREIEKNGRTVIVERAFGAKDYLDMWASDNGQEVLEQERLEQESAASETASRQ

SEQ ID NO: 35785 - protein, 90 aa, A.fumigatus
PATNPRVVDVPKSDTSAISDLRVYYMYSMSVGACCVAAESAVFQDIITSYVNGGYCSGRFSISPGVYFVKRRNLVFGILQDMSMVHCYTS

SEQ ID NO: 35786 - protein, 71 aa, A.fumigatus
VDFAHAFGFLWFRFRPGIGCRASAKRKTLKAFFVACAQGLVTVQLFVVIAVNLAQSPSVSFPVTAGITAQF

SEQ ID NO: 35787 - protein, 346 aa, A.fumigatus
VATFSVSHIYFLTLVLIGFLDFLDYTMPRRQTQLRGPKDKDPSSKKPAPKKNTGKKALNALSIAESQVTDKLGVRRNRLGKIHDPSKRKRNPNRDMDDSDGPDNKRRRFGGDDESELSSNAGSDGEGHRWRLGQVDSDDDEELDSDEALGTSDEERFEGFTFRGSSTTNAGSKPKPKKSKRVREINLDEDVEESEEEDEDMDEDDDLGEDAIDLTTAWDLNTAEEEKEKAAASKKKQAEPDESEEYDSDSEESDDESDEESGLSMSGDEAEVDEHGLSKLQSFVNALEPESTNKPSRRTGGVQEHAKPTEYGLTSSRKLTVADLLPSITDSRLIFTRRQEASALHQ

SEQ ID NO: 35788 - protein, 61 aa, A.fumigatus
  UNSURE (2): Identity of amino acid sequences at the above locations are unknown.
VXCGPFVSAWLYIADRDEFDPRLLEGEDAGSKDTQAAEAKKRKLNTAVPARHGLCGGGLCG

SEQ ID NO: 35789 - protein, 362 aa, A.fumigatus
TQSTLPSHRILSSKGLAPSFWGPVSDVKGRRTAYICTFIVFFCACIGLQETKNYTTLIVVRCLQSAGSASTIAIGSGVIGDITTRADRGGYMGVFQAGLLVPVAVGPVIGGAIAGSLGWKAIFWFLAIYSGVFLCLLTLVLPETLRSIVGNGSRKPSHPVLRYPLNLYQKSSKMPWQQPQDGLSTAEAKKKIDLLGPLRMLLSNHAAPIILFLAVYYAVWQMSITAMSSLFKSRYGLSELQIGLTFIANGVGSMVGTLVTGKILDADYRRVKTKYEASFDNEHRDAMSQTAREENFPLESARLRLVPIFSITQCVSIILFGWTIQYPDKVPIAVPNVSTLYHRVDRVLHAVSDHDIFGDLFP

SEQ ID NO: 35790 - protein, 136 aa, A.fumigatus
  UNSURE (52): Identity of amino acid sequences at the above locations are unknown.
TMTSWDRRVKFALFGLGRLGVLRARILAFQQPRIELVAVCDVKPGTDKWAAXNLPTSVKYFSDPQECLTNSGAEAILICTATATHAPLILQALDLGLHVMCEKPISVDVATTKAVVEKSVSRPDLKFLVPFTRRCQ

SEQ ID NO: 35791 - protein, 169 aa, A.fumigatus
VDAGRYLLDVKSGLSNPKKQVNRVIAFGQVAVYGDLAKYGDADNAWGLVEFANGKILKTYLGRTLTSGFEDTTRLCGTKGHLIISATSNVEIRDHLGIRTQSVPDAFTLFDATFLADLAEFADAVLDNKPLTCQPEDAFEAGKICAALQYSFRKGVPVYFDDNGLPIMD

SEQ ID NO: 35792 - protein, 401 aa, A.fumigatus
HSPLSSSKPMIMPHSEMSAPVVVSKTPSGVPPTVEEVSSLMNTIFTAETSQQSLDAAYGLTNLLIQSVGTFGLQRYNILPEIKRAATDKKSGARRESAMLIIGALFERFPREHPLSEVVFLLQDGGVLNLALDSLADKGAVVRDAAQYAIDALFDCLKPESLVNALIPALSAYLNKSSGKWQGFVGAYALLEKMAIKAQIGMGTMEEERQKDLLRSAMGKTLKELIPLVESGMHDLKNEVAKQASKTMTALTTLLDNDDVAPRIPLLIKTMEQPSEQTLQNAIHALSQTTFVAIVTSPVLALLTPLLERSLNAPTTPQETLRRTVVVVENLTKLVHDPAEARTFLPKLKPGVQAVKDRASLPEVRELATRAMNVIDKALGDSSLAAGSLAKTTGEDVLTVP

SEQ ID NO: 35793 - protein, 261 aa, A.fumigatus
  UNSURE (9): Identity of amino acid sequences at the above locations are unknown.
TASSHLTNXVRAFSRELAEQSHLPQHILDLIKSFPRSMHPMTQLSIAVAALNTESKFAKAYEKGLSKADYWEPTFDDSISLLAKIPRVAALVFRPDEVDQVGTQALDASQDWSYNFAELLGKGGKENQDFHDLLRLYLALHGDHEGGNVSAHATHLVGSALSDPFLSYSAGLLGLAGPLHGLAAQEVLRWILAMQDKIGTKFTDDDVRNYLWDTLKSGRVVPGYGHGVLRKPDPRFQALMDFAATRPDVLVLAAGARKYAS

SEQ ID NO: 35794 - protein, 115 aa, A.fumigatus
TARLALTNSRRYSTAEPDLKTALKAVIPAKRELFKQVKERSDEVIGEVKVANVIGGMRGLKSMLWEGSVLDPEEGIRFHGKTIKDCQKEFPQGHIRHRDAPRGHVLAALERPVPI

SEQ ID NO: 35795 - protein, 140 aa, A.fumigatus
  UNSURE (75): Identity of amino acid sequences at the above locations are unknown.
LVRSRSPTSLAACAVSNPCSGRVRCWILKKVSDSTARPSRTAKRSSPKGTSGTEMLPEAMFWLLLNGQFPFDQPXPRVLSRAGRAVPPAAAYFGPDQVLPPVHASHDPAVHCRGGPQHRVQVRQGLREGPQQGRLLGAHL

SEQ ID NO: 35796 - protein, 94 aa, A.fumigatus
PGLVVQLRRAPGQGRQGEPGLPRPAASLPGASWRPRGRQRLRARHPPGRQRAQRSLPELQCRSAGSRRSTARSRRAGGPALDPGHAGQDRHQVY

SEQ ID NO: 35797 - protein, 274 aa, A.fumigatus
GFQRLGQPPYNPSKGPPRPSWNQPFSFCKELFVGSPFCDFHQHVRKAFRPIMVSECKRVLRPGGYMKISVLDLDMVNMGIRNRIAVRMLKEKTYLADPNISLKLASDSLQKLLGLQGFDGLRRCMVRIPVTGVIVRSSASSSSTTSSNPSTSVARGTPSTAFSALTNSSTSAQQPKVYGKSPSNDTNLSLGDLLSDPSPSPSNDESIRKIVAKVGRWWYTRCYEIPVLPNGDASSSIWADKRVLRECQKRGTGFRLLIAYAQKPSEVKRRTASV

SEQ ID NO: 35798 - protein, 306 aa, A.fumigatus
VPSWVHLPCGSLGTRRWRPLPFRLGACPRGTGLAVYISIERRRNGMERLDRPRHRRPSRPHQEPALRVRPSCHASRHHLDASPVCGLRLADGPHAERAEPVSRYLGRSWKKLILRRWTFMLPLTTGIILYPFGKRPTTRKLGIYPQYILGASSALTILPAWASVYGDSVAPPDLLAKCLPLCVFLFLWTIYFNTAYSYQDVKDDSRLSVNSSYVLAGQYVHGLLLLQAVAVVMVIPWILHENGSAWLWFSWLGVWTAALAEQLYLFDTKDPSTGGRVHRRNFALGIWNVLACFVELLLVSGSLDMF

SEQ ID NO: 35799 - protein, 142 aa, A.fumigatus
  UNSURE (22): Identity of amino acid sequences at the above locations are unknown.
FSPINPNHRLICRRSPGKKTLXSPPPPPLSKEFIPGLPTPNRSPVGSIFLAAASGHADGVHFLSDWVLARAGLVLRYTYLLSGAGMVWNDWIDRDIDAQVARTKNRPFASGRLATRAAIIWMLVQYAASVWLMDRMLSGQNL

SEQ ID NO: 35800 - protein, 167 aa, A.fumigatus
ITDGNCLSTCAYFVDRMQRQGVRTVAFGGRPQYGPMQAIGGTRGGQNLAYGGIYSYVETAHNLIRKSLRNGSTPLMSFQEWAQFNRSIPRDPDEFPFVFGGGVNLRNEYAPGDDATPQQFTYQAADCRLFYTAESWFSQEEVWRAAAVALFGGKSSCVRGSMSNARQ

SEQ ID NO: 35801 - protein, 401 aa, A.fumigatus
HGYKVVWPCSAELPAQTDKDRIIASWYQMNQDSDFPSPGAGMPSDMYAPHQRVIGRDASSKQTLLRGAIEGHVLVKNNHSALPLKSPQLLSVFGYDAKGPNALKQNFNWLSYSPAIQENHTLWVGGGSGANNAAYIDAPIDAIQRQAYEDGTSVLYDISSEDPEVDPTTDACLVFINSYATEGWDRPGLADNSSDTLVKNVARKCANTIVTIHNAGIRVVGEWIDHENVTAVIFAHLPGQDSGRALVELLYGRANPSGKLPYTVAKKAEDYGSLLHPSLPETPYGLFPQSDFDEGVYIDYRAFDRANITAQFEFGFGLSYTSFDYSGLQISNPKQSPQYPPSAAIQQGGNPHLWDNIVTVSAEIKNTGRVAGAEVAQLYIGIPNGPVRQLRGFEKADVSGR

SEQ ID NO: 35802 - protein, 189 aa, A.fumigatus
PIHHLPGKRNLQTGLIPRRSQGQTNGVRCADCSWGATEPYSPVPHARWASVRTVRVDYCVCKLGPKSPGPLGERVLFSVCSGSYLLAAAGVLDGLTATSHRLGLGALRQLGDEYKSRTPGAKGMEVVPENVTGTVHYVDAGMNASQVRIVTSGSITNGIDAALYLISLRSGRPDAVEVASFMGYTWREM

SEQ ID NO: 35803 - protein, 86 aa, A.fumigatus
  UNSURE (8),(28),(69): Identity of amino acid sequences at the above locations are unknown.
AKTLDVVXKAGTRIPKLGRRRSKLAFQXDRSGYVMTDWGAQHAGFAGANAGLDMVMPSTETWGANLTTXISNGTMDASRLDDMATR

SEQ ID NO: 35804 - protein, 121 aa, A.fumigatus
AILSNLRNILRQLLSSKVETLICGIILSRCRRRSKTLDVLPVPRWHSCTSASPMVLYDNCVDSRRLMSQAGEITQVQFAWNRRDLSTWDVGAQQWSWQRGRYRVYVGRSSRDLPLTGSFTL

SEQ ID NO: 35805 - protein, 66 aa, A.fumigatus
DPSYPLSASDTCPTRYNREYNMPTVFVFVYPSVNTLDINGPVGSYSRAATPRSSPPMTNSPPPRKT

SEQ ID NO: 35806 - protein, 146 aa, A.fumigatus
YAKCGSFQPPWVKTAVTILLSLINIGSQVALAAIVSLTITSLISAYILSIGCVLLKRIRGEPLPPRRWTLGRFGMAVNIAALAFLIPIFVFSFFPLTKTVDTKTMNWSVVMYLAMLTFASGYYVLWGRHNFIAPVALVKRQGGYCG

SEQ ID NO: 35807 - protein, 381 aa, A.fumigatus
LEIFESRSDRSFTIVHAVLPPMTSSTKDSRFSHSSNGDYRTIPVSSTSHPDNPVPEEPRTRSLSITDTSFNGSSPAQETEGSTDLDTPPTPLTPLDEEQPDSRDSRKEFTDSGNGHQRRASTVLISQNSEDMRRVLESVGTAGTQKVQPLCCGGGCCRSQPLTKLGPLPSANAVTPPDNEAFKKLNLNIEYLTLDSELTNIVPVPEKTVSFSAVAASALDLKLGPADHPPTFVQPHPPYNVFRAPLHHARELTKPGAEKRTFHFDIDVTDYPAESGDVDFVVGGAIGVCPKNKEEEVDDIFNQLGIPKSIRDKKITLHTTKGRWPTIWGDDQPRDLITTRRELLTWCSDIQSYPPTKPLFRLLAEYVFTRRRDPNRWLEGA

SEQ ID NO: 35808 - protein, 66 aa, A.fumigatus
TDLKQLSSTPYLISPAPQLYPVKFIVLGSAPAAKRIILHYPTTKSDNDANRQQLNGQLQKLSSQQC

SEQ ID NO: 35809 - protein, 462 aa, A.fumigatus
HGLLSFRFVGIIRVVDWVRAEEHILGLVAISPRASPPTPDEVASYRRLLRIPESIFDMWRYWDRRGGLHSASVNRLVGTDADPDTRELQMRYNKQSKTPVWRRMAWGTLPTYNKDGKAIGGIPGEEVWAGVKTSVLLVAGESDAVTKPAELRKLLKFFGEVGPHADVGADGSAIIPDASETHDTVSAAYDRFAHEEEYGLEAQTSEKTIIDDCRASCEKKRAVKTVILPAPASHALLYDRATYRTLAGIIQDFLSQHIDERLSLGWQLQYMNTSGKWDVKNLAKWKKVTPVSQRIAGTFVALKMLREVDEEHNPVLFSQKYRDQIYAVIDISYENPVYNPASLEKGGIHYQKHPTVSKIPPTADEVRDFIALVDRLQNEISEKMKMSGNPDGPRPVVGVHCHYGFNRTGFLIVSYLIERLGFRVQDAIDEFERQRPPGIRHGHFIDTLFVRYCVGLKRAPTL

SEQ ID NO: 35810 - protein, 73 aa, A.fumigatus
EYWVSGTYRCISKNIYMSMIRTNHLVSPKLFRTPISTECVRNRVYNYPSERGLATGGSLGLCCSEHVTITLMR

SEQ ID NO: 35811 - protein, 64 aa, A.fumigatus
WSISTKLDAHDCLNFFSLDLVQICGIKGLGLSQEFSLRQGTPGQVFIPATLHEGTSILNLQKKY

SEQ ID NO: 35812 - protein, 335 aa, A.fumigatus
SKIVISKLSYPILIRLLLTTPVSPTTNPAKQPPTNNKSPNYGNSSSPTTAGPTATSWSLSLNACPGQKISMCFRPRTREIHLLPQDHAREQETWTERCERSLDALIALARARGVFPRLGKPRDERFPIIGAQFPVSIERSAISLFGIVGRGVHMTVYTRTKSGLKIWVPQRNPKKSTYPGMLDTAVAGGVAAGERPMDCLIREAEEEAGMEESMVRKAHAVGTVTWFNISDDRAGGEPGLMNPGLLYVYDLEVGPEVVLNPVDEEDVCAFHLMDVREVLDAMAEGKFKPASASVMVDFLVRHGLITAEDDDDYPEIVSRLHRLLPFATSPTAGRT

SEQ ID NO: 35813 - protein, 269 aa, A.fumigatus
LVVLLLTPLSQKPLIIARVRKDSDIPKPYPPGMNTGPWDGNIHWAIKGYSIFESQQEEAAAFSYRPNLLSRQPISDLWIFQYGLRYIPDGRESNVFRTVRIERLASNVTLNQVLPSVPGEIYSASLCNTSPITGYNTAIVVFVLEKDALDFVQKSKEGLPLGFCVASVFLVNTPTYPMTFQMSQFIFHQGYTRCLVISHLRRSLRGEIHRVLKRSAYYNYIESVEEGPVVGDIYVRFYSVKMAAAAYDLFQGHQSFERCSTKFLKKAAE

SEQ ID NO: 35814 - protein, 74 aa, A.fumigatus
VLDIKVFAVCSILLFLIHSTMQLTIEPFCTSVPVKYFSQGSYISIIFPVDLLSKRKSNSDHRDIAYINNSLRHL

SEQ ID NO: 35815 - protein, 201 aa, A.fumigatus
FFPKMEGCVTLTTSSIVSLIVLFSLLLCLFILFRRLDAVVLAMAQASQASKPLCSPANKETQHGVNNTSAEDNNNTASENVSPKSFSLSPVYFEKTAVVVLNPRKCSNILDSHLDDISVPTLQPRTPQKRLHPAAAYLNQLRTVSLQRTDSDDLLDAGIEDLMIPVLEPERVSSVNEIAGCAASDTSFPETSDHCSCTQGF

SEQ ID NO: 35816 - protein, 117 aa, A.fumigatus
LLIQLSQFAGKATSLEPWFPPHLQRDIYFSLLHLDPPASTSSKEKKAPAVPETVLKAALLRRATEDIKRVMALRNQKQALAMLLQRGSVGDDLWQRFQRAEKEMEDEVRDVVTEVCF

SEQ ID NO: 35817 - protein, 213 aa, A.fumigatus
RPRFSGAQQRISNALWRSETRSRRWLCFCNGAVSGTICGSVSSGRRRRWRMKSGMWLLRFVFEPCFILSLRGWEGALLMSVLFLQANAYVPNWGQTIFQSANEMLNNALFRERLQSYQNKLAEEREWWDKKKASIQEGFMKELDAESSAATKSEQAVSTTTTTSSTPGTKTPESSAAPSTAAPSDDEAVLVEAADTVAGGSSGAGKKKKKGKK

SEQ ID NO: 35818 - protein, 261 aa, A.fumigatus
MMDSIKDTKSSTPWVLSILDVVLIRVQKGRDGKPYIRRSPLMALFEFTEENSGYAHGPRTRLSQSQQGLNKQDSHGAKQKDTSPGESDAAEEDGAASDISADPAAAGYFTFMLMYHFFNAAAAERLAGTRSLLFPNEILSLIMDFSDMRTYLALAQSSAFCHELSHHKLRLNDEYAVIGSGEDSETFVLEDLHSGKKIHSKLSMYQKNWLGHPIADGLKLSPVIGVTNTKRLSIMDDVTIQLSDVTPKDPVWSEAEEGSSQ

SEQ ID NO: 35819 - protein, 289 aa, A.fumigatus
PHHSVGCGGLTMLIFLNFKGTGKMFLSFKEDGNRFIPMRNASAQARAVAPASQQTETTVNLTPIQSQMFKTMTRSLTIPHFLYADELKINDITALRKKLASDPKDPKKVTFLPFVIKAVSLALNEYPLLNAKVDLSIPEKPKLIMRPKHNIGVALDTPQGLIVPNIKDVASRTIMEIAAEIKRLSALGKEGKLTPADLSGGTITVSNIGNIGGTYVGPVIVPTEVAILGVGKSRTVPVFDDAGQVTKGELVNFSWSADHRVVDGATMARMANKVREFIESPELMLLNLK

SEQ ID NO: 35820 - protein, 370 aa, A.fumigatus
EKHHDSGCCAHSLTHLFSLDWLNSMREMYSRSAQKFEDQILTVDVKIEQDDLTISERHAMSYLAIDDRLIYAPIQTIMDRFSNDLIIEWTYTIDLDREMFAVDDAACFKLFNIPRGGRWIRYLAEDAQRRRKLSDNTPKDIIADISWKPNINPNLRVLGEALNIELLSLTDFAAETMLRLDLDTTVDKQMMPVRINFLMTTFLQMCRVYRKILDRFVLAWEPSCFMFREMAFAVLSLAAGEVFFEFSEVLDAKYRENGYYLLPDSRTPKYHTRMLPRFIHESHLPGIEPGSAPKSTSFWFHDVLVHLNSRLDLDDVEEASVVAVVNDGLDQGYEEFYAMGTLDSRRCSDPRSEGTGWKAIHQKVSAHGSV

SEQ ID NO: 35821 - protein, 114 aa, A.fumigatus
TNRTCDQLFLQFDGPTKILLQTRGPRINDIMSAREINEIADTPRGLTFDPTNPAKQPRVDGEEFKNVAHDAVHAGPGPSRTIEELENEMKGISQSIATLTREGKVIIEKIAEKK

SEQ ID NO: 35822 - protein, 61 aa, A.fumigatus
TQQPGYYPDFVTDLLNDGFRRQMLRILPMSVCFTKLKNMALRVNIAQVIVFMSILRLKYTT

SEQ ID NO: 35823 - protein, 875 aa, A.fumigatus
DVLSCSHYTALITNRFQADSIATRFPTTGYLIAIISVLGFAIMPRAKFIQMMLLDVLAVCVATAFALLMMFCSVKARQNTQSAADAASISNLDPTANEYNSSASAVSGVLLFFQIYLVHSFRAHYQQFQFPVIIYSIIANITASYAPRLPTMAAGIALVRTLFEACLIGLGLCTGVSLFLFPVTSRHIVFKQMASYIGGLRAGLKAHTKYFESLERDDMFGRAETYDETVEKFSKKGKVYSPEAEAIRTAVQKITDLHGKLHADLTFAKREFAIGKLGPDDLQAIFRHLRQVMIPVVGLSFIVDIFQRLSDYNKWNEPIDPLAPDMATNIRSRVVHEWNEIMKAVHDPFASIIETIDSGLEHISLSLQLTKPPKTSLGKKDAPLDGASDLEASAEKPPSPGEAGFAAYYERKLSDFKVAKRLALRTWSEEKGITLPPDFFERPSSDLPDLDEFLLDKSSVGRDRSRRQLFLFLYVGAKATSSHFRADMPNQMEQLLYATGHTVLDFIHFTDEKVKSGKLTRSHLIIPGAKRLLKWLRSILQAEDTHEDDHLGDIHTQSHILQLGEAYRHRKDPEHLPPETIIQKIGDKIRVVPWLLRSSESAYGFRVACATMTIYVIALLHQTQTFFIHQRLVWAMIMINISMSPTAGQSIFGFVLRLVGTVIAMALTLLAWYIPGQKTPGVIVFFWLFVACGFYVPIKLFRFRIVGIIVIITTSMIIGYELQVRKVGQQAATSNGQAYYPIYLLAPYRLAIVAAGIAVAFFWTFFPFPISEHGVLRQSLGASLYLLANYYSIIHESVSARLRGDEGDLALKTSAGRRLQKARGKVFSKQMLMLNGLRTSSEFLKWEVPIGGRFPKKRYQAIISSVEKYSPISLP

SEQ ID NO: 35824 - protein, 61 aa, A.fumigatus
TLDPTMASRVSSRQSTSSSQYSQNDEPDNKKQHEKWNLFRMIESGWSSLDLDRRTVILMMK

SEQ ID NO: 35825 - protein, 147 aa, A.fumigatus
KSALAAKVQAKYGLKGNDTNVASQKPTRPRRIAGYGSPDSGDGQIPREKGRIRTWLLGGQHRAALRNKLSFQAGGLMSSGHGVGSFVLVDAVTANTLSGTLTSLYSTNSTAFLLQNVEFYNIEKAIMAERRADPILAGGGGGERRAH

SEQ ID NO: 35826 - protein, 191 aa, A.fumigatus
IISPADSHFRVGGAKGSHLQASECPKKQFPLIKQAYIAASLLLRITSSASAYLENVWAWTADHDLDVKSQDPIDVFSARGILVESHGPTWMYGTASEHNVLYQYQLPGAQKIVMGMIQTETPYFQPLPAAPEPFKPGQFPNDPVFTNCGNSIAGCAMAWAVRIINSSTVYILGSGKTFRAFSIALCVNLWI

SEQ ID NO: 35827 - protein, 129 aa, A.fumigatus
PSVVGLYSWLAFYTQDCLETGHCQEQGFYVEQSTNTWVYNLVTKGITESISPAGETPLYARDVQNGYTSSLLAWLHTGTGAIGKRKFPGFYLWDGEMDRDVLSRVSSTCQTSSKRWVECHDPIYMLRGL

SEQ ID NO: 35828 - protein, 138 aa, A.fumigatus
PYFLQQRDIQLFTRRRPQYADIGHSQVFDVTSHGAKGDGVTDDTINLNSVFTVAVNLSSIVYIPHGVYKVTDTLKIPKGSRIIGQAWSQIMATGPKFQDADDPHVAVQVGHEGDIGIVEIQDLLFTVSGPTAGAVLVE

SEQ ID NO: 35829 - protein, 64 aa, A.fumigatus
NIHESSQGSAGLWGEFSVLDLFVFLVIKSFPLQIPTSGLEAQRAPICKLLSAQRSNSLSSNKLI

SEQ ID NO: 35830 - protein, 62 aa, A.fumigatus
NLRADLIKGSWRRRSSLGRIFCFSCCFKLSYECESLDITHEYPGLYAALFISLSNASLRFFE

SEQ ID NO: 35831 - protein, 80 aa, A.fumigatus
FKRAKMKLSALLSLPPLASAATTLIPSTCFDSHCSLEQYFAYLYPWGSDHNGSARMVGNSTNHEYVSVNSGTTDSGCQTS

SEQ ID NO: 35832 - protein, 77 aa, A.fumigatus
ELHLKPWYQMCADQSPLQTSSEVKALDVKYPSPRDFQKIKAEIRDVNGKDVSVNVYLDGKLITTQYGRGYIGKPMHL

SEQ ID NO: 35833 - protein, 497 aa, A.fumigatus
  UNSURE (431),(438),(441),(458),(463),(473): Identity of amino acid sequences at the above locations are unknown.
PRMIYFDVTVLVCWSIYVLAEIVEIRVTLCWRNNSMTKHNITQYPSDLLFSTLPSLAIPKFETPIGAKTAIALPSKMVLNDTSPQSESGTSSASSQNGSELYSSGYIPIPGYPLVLKTECLSRPDLFTLYFGFFGQSNWLHKNSAHVRDRIESCKVMINRLPTQEELDAFVYHGSKYIYHQRLGAPYSGAIGTAYLYWRVRNSGVVAHLAPGLKPGQKPSPAQVLAAVKLYSTIEPANFRQLMVWGSFRWLFWVAAGSVVTGVWGMFHDLKETMGDPRLKQFFAEMRDKDPEEVRKRKIQRVVERNKAANEAAERRAQGLPPVKVGMDQGASAGGGYAESQKYGQGAGPYGSLDSYSSSSARESAPSASWDKPANLGRLYGDRSSTEAMRGVTSVDQNKGTDFFKSDDASPVAAEYRLGGDSQGSACDRIXQQAGQDXRLXSAWTPSVNEKQQREHDXGPCSXWSGVSSTPYXEMRHLEHAQVQYDACYMPIETCRP

SEQ ID NO: 35834 - protein, 125 aa, A.fumigatus
QAYPTTPTEQTPVQRKKSKNPKTHTAQHPGHTFGFQRNPLPHWHPDPSQPLQAASPAPAVPPPHWPLYFSPQPSGSSACAPPLDPCRASPQRTALALDHPLSPSDHGTSPTHPSPPNPPPPRRAT

SEQ ID NO: 35835 - protein, 72 aa, A.fumigatus
MDKTGQKFFYCYLFVLPMATISIINYMQLCQVTPAHSSNERVSARISSALQAMKRTDMNRATRLHNELHNSS

SEQ ID NO: 35836 - protein, 141 aa, A.fumigatus
SIPTFTGGKPCARRSAASLAALFLSTTLWIFRLRTSSGSLSRISAKNCFSLGSPIVSFRSWNIPHTPVTTEPAATQKSHLNDPQTINCLKFAGSIVEYSFTAASTCAGDGFCPGFKPGARCATTPELRTRQYRYAVPMAPE

SEQ ID NO: 35837 - protein, 789 aa, A.fumigatus
SNAPQPNIKLHVATVSQTAFIVIDQSVLLLSLGSYGDSPTSQLLLDSGRLPSPFNDHITFRSGADYKLLGSGCEDETGEGSSSACLVMVRNFGVIRIAVRPRQSAGNEIEDAQITAKTKIEQAVFYGARPGNPLDLTDKGGFDFSPQEIEEAALEICGELLRSTSHYIPATSVTLEQNLKLRAKALDDLASLLLQHKKPLHRQTWYELLWGAEKLAAQRALWKSEDKARRAMGQGNTFLAHVIGSMNEKFRTKSEDYEDKDNVRDWFLFDTFRMEHIIPWIFKALKLQKGISTKQGRRVLEEIVQASELSLAVLETAFRFRDEHARQYGLEDEHIEDGVLSSGYDGLSEFWTSRDIVFLETGHLLDLELDTCRAWTQQATTSLDLREQKLVRQIAENSARQLRVLSLMHYERVRWLSSQDNPKSVDEGIELEQTYTKQRRWQLFKLAGIGQLEDAISLAEKFRDMSALVELIIELQDQTLADSEHAENVTNYESEQLGRRISTYFEKFGEPWADAFFTRQISMGQSEILFTMRRFQPFINRFLHKNPTYARLCWINDAIGEDNYEAAARSLETLALERESDLWCHRVELSLSKLATLAAWEESSAAAKPIFGNEIKRLEDLAELDAVQEVVYAYMMPALQGAIDQKAETELAIDQFGRFVNDTPSLHEVLSALLTKVISRQILRVDQLVDLLTLIDGGQVSEETQNEFIGKEFYLALRVIRLNSSTQEGPLYCIPLQKLVWRRCMIRDDWQLEKNADNTDHEPGDHMHCVSLLRTLTLCLRDSKHISQV

SEQ ID NO: 35838 - protein, 84 aa, A.fumigatus
VCANKCQVYKYMSKSLPLEWPSTLLGFLSIIFITPIYIFYWNGPKIRERSKFAQILASDRKKAGRRVSQCGSGDAGPEEYYFDP

SEQ ID NO: 35839 - protein, 71 aa, A.fumigatus
APLRIASLVLTLRQYSIYMATIDYMIASYGPYSASATGGNALARDFLAGIAAMYSVPSKTSTTDENYLGVC

SEQ ID NO: 35840 - protein, 64 aa, A.fumigatus
KLNKSKIGRQYPMYALSLAGSYISMSLATNSPVGLPLLPTFLLWVRSSWVGKRIHISLHSPNAV

SEQ ID NO: 35841 - protein, 191 aa, A.fumigatus
IRLMALHSVVPYSLISRNSIISIYTLKTASSVSQSTGLFPKFVKMARTNAAAWLSEEKKHPFEIKESPLGKPEANEILIRNHALAINPIDGLIQTKAFFPLHYPIILGQDVAGEVISIGDKVTRFKPGDRVLGHAVGLMAGRNEACGFQTYTILQDNLACEIPENISYEQAVVVPLVSPVFTTRGEGSALS

SEQ ID NO: 35842 - protein, 66 aa, A.fumigatus
CNRHSAYNSQASRIYNVCECESIAAFRIFLSLCLDCFYQQDVMERENNSQLHEINGMCPLYHHSSS

SEQ ID NO: 35843 - protein, 153 aa, A.fumigatus
DQRYVSPLSPQLVLISTDVQSHHCQSHETIQQPSHDRGAIQYAPKQYSLTGSNRPPPYHGGVYLHPDYMHYNPNYGQPQNAPVWSLSQPLPHVMRSGMKRGGDQDAKATDKRPNAHQEEVPAADEPPTEHPAHNADFDAEKNQPEARVSQPDE

SEQ ID NO: 35844 - protein, 279 aa, A.fumigatus
VTNPRIPYTTTASGKTVKDWDTVEAIDVPFMVAALSYIRQHGRLPPRLKSKEDLNEASDSGVSDETITQLQRQVSDKLRQFGPALAGDGGEGKRTVVFFEGFLLFSPPEAEVREHVLRPVHEQLDVRLFLPSPYESVKERRERRSGYVTIGPAPVPPLPHRDSAASKDAKQQVDLEAEDNAPPQNFWTDPPGYVDDIVWPRYVRDHAWLLLPESGLDNDRYQSTRNSDTDELIRIVGQGTNVRTDAGVAVAPGKGTLPMVDVLKWAIQEVMKPLEMAEQ

SEQ ID NO: 35845 - protein, 68 aa, A.fumigatus
MRHSNHPHHPAGEKSPVAAPERQNNYIHAGPVTHYNKYNPYKTTWQEATIVHRKESYVPMQKPYSGVE

SEQ ID NO: 35846 - protein, 81 aa, A.fumigatus
LGIPTANIPAEGLEEYPDLQVGVYYGVVALDPAKFQYQEGQGSTSTSSTGGAEAAVLPAVLSIGYNPFYKNKTKSIVRLPR

SEQ ID NO: 35847 - protein, 664 aa, A.fumigatus
SPTFQHVDQLRGVRSNSLSSSVNQQPPSTTVSGATQSQNPFAGPFFDPSDPALFNFDLSSMNFENRYGALEFGMLGHMATGAGDSPTDSATQRGSIGRSGSTQYSTTPLTGAPGFGESPGNQQPFLFGNDPLLNEWPNSQAPNQGHLNVSGVYPQGGMMHMAKSDAPHAFAIESGPASFSSPSATTSPHINSGHDESSLSNAAVNKSTGLTANGQRPAITTPSLKHQSLQFGVKRRQRNPSTVYESVKEPYAYTNRFHNLTAFIQRRFSPQKTLQIAKALASIRPSFIATTKTLNRDDLIFMEKCFQRTLWEYEDFINACGTPTIVCRRTGEIAAVGKEFSILTGWKKDVLLGKEPNLNVNTGGSSAPGSGNTSRGSFTPRSSTLETATPGRPQPVFLAELLDDDSVVEFYEDFARLAFGDSRGSVMTTCKLLKYKTKEDMELAQSDDNQRWNNHLRKGGIAGEAGMNQLGFKDGKVECAYCWTVKRDVFDIPMLIVMNVSGQCIWTSRHMLISTTVLTVHMTESHTCWWFAHGCPWNALDVLLIILCLFFFFFFFFFFFLISYPRMDKSFPPGRLFMSMFIILPLNRAFALVHNFLCGVRLLLLARLSYKGCTCCNVLLGQREYNCSASPEPQLETSLLPDDVDGLNVAFKYMFIFSCLRLSS

SEQ ID NO: 35848 - protein, 82 aa, A.fumigatus
NEQTEILRPSTLFWFPIVILVSEKYSTVTWHSTESAFIHSWDEVAFPPLLPLTHLEATTTYQRCSGALLGNSPPFRQINLTD

SEQ ID NO: 35849 - protein, 140 aa, A.fumigatus
AARSCDIGGDGPRVMETFYWAAITYYSTMVYFHLCFDRLLPDNLQTVLMPQEKAVSLVLELSLKLHRSRPHLMVRITWPLFMAGVATADRIYQDWVSIRLRELGRYGQNYSRISQRFDEIIRGSDPFAYSQKQLPYYNAD

SEQ ID NO: 35850 - protein, 167 aa, A.fumigatus
TIAVIAGLQDKTTGSFMGDEWGELDTRFVYGAFNALSLLGLMDMVDVSKAVAYIQKCENLDGGYGICPGAESHAGQVFTCVGALAIAGRLDLVNKDRLGSWLSERQLDNGGLNGRPEKLPDACYSWWVGSSLAMIDRLHWIDGHKLATYILRCQVCSPRCLPECRQN

SEQ ID NO: 35851 - protein, 153 aa, A.fumigatus
RRDELEYWLTEHLRLNGVYWGLTALHLLGFPEALPREETINFVLSCQRENGGFGAAPGHDAHMLYTVSAVQILVTLDAVDELEKRGLGGKQKVASCMILLPTLVITFRSHLAHTKQSQSSQGYRTRRRAPSWATNGVNWTPVSSMVPLMPCHY

SEQ ID NO: 35852 - protein, 78 aa, A.fumigatus
LTDCTGLMAINWLHIFCAVRCARLAVYQSVVRTDSMQDPEAGGFGDRPGNMVDVFHTNFAIAGLSLLKFEGVQEVDPV

SEQ ID NO: 35853 - protein, 246 aa, A.fumigatus
  UNSURE (183),(197): Identity of amino acid sequences at the above locations are unknown.
LNRVDRPGQDSLVDRLYSVHGRIPVRLVSTPEYAMDRKLMHVGYDTGVISAVLVSLGTDLGKKLSSSEQELITSITSGGALIGAVLAGLTSDKYGRKLGIYVGCVLFVVGTVLQTAAYSIAQMTVGRLVVGFGVGNAAMIIPLYIGEMAPARFRGRLIVFDNLCVAFGQFVSYALGAAFANVXHGWRYMVGIGAIPXLMLGAAMRWCPETPRQLISHRPWRKMHGKCRKGSSPQATDPANRCKNPG

SEQ ID NO: 35854 - protein, 63 aa, A.fumigatus
IRSIGAMDSDADSTKLSLDGKAEAVHQEHLGDENPDDSIELTDPGKTVWLIACTVSMGGFLFG

SEQ ID NO: 35855 - protein, 110 aa, A.fumigatus
SWMILRKSIHNLLLNSDLKHYISSPSTPNFVNEPSTLESDQKHDAKQLYATEAPGFPALIPQTPCFSAFISGHRQSTSDTGVACGNEFSSRKQKPAFSLVLLAVATLFAG

SEQ ID NO: 35856 - protein, 503 aa, A.fumigatus
VKPDITRQKANWLGLRRYPNFHPFSGMSAIPFMVLASRGFRSMELLNLHRKHPVLRTGPNTLSYGDVRAIKDIYGHNTKCIKDPSYIVTAGTHYHLADVVDKPDHARKRKVLSSAYALKNLETWEYKVSDKLERLIAHFDPVCTKPPSAAVAEGKAAPDPADLTVDFRAWTNFFTLEAIADIRLSEKLGFLIAATTCARPHRKAGTTYEVHLREALYPTARKQSLILWNYEWYPVLNKLVNIIPFFRRMQRSSDNWENIVWRRASQRLRRYEAGEKLDDFFQALMEDKNGHPNNLEWGEIVAEVNIMMNAGSVTTAIAIANVMYQLLKNPRCLAKLREEVDAVLDEEDIIAPYDKVKHLPYLRACLDESLRIFPPTSHGLPRQTPPEGMEILGQWVPGNTSVSISALVAHRDESVFPQADQYIPERWLGEEGKALQPYFVAFSAGARSCIGRNISYLEQTKAIATLVHRYEFALPHPGWELKRLETMNLILGDMPVKVWRRQT

SEQ ID NO: 35857 - protein, 208 aa, A.fumigatus
AATKNPLGRSPVFYVAHGKHDKAQSALRRLHGSSDQYLHIRYGAIVHALDEERKQQSESASWPELFKGCNLKRTITIGFIMFSTSAIGVPFLTQNIYFLITVGLNVTSVFDIGIGGFFLGCLFVMLGWLSNEGIGRRRLWLWGLIGNFLCMVTIGALGFSTTKASQLAIAVIMSVLPRSKLPRRIYLNVVFLPTGTSSSRTVSMPRLV

SEQ ID NO: 35858 - protein, 152 aa, A.fumigatus
GPSASTAGRLFSRTAAAYRVTHLAILPFVCASNYGYDTVSNGSSIAMPAFIMSFGAMNHATGSMYLPSIWTSLWTSMTNLGQALDSLIAGFLAERIGRRWTAVSLAILSIVGTFILVFSSTRGMLLVGKTMNGAVVGGLMAIGTTYAADVRH

SEQ ID NO: 35859 - protein, 136 aa, A.fumigatus
TTPENLSKCRLSAYRNVLISYGVYATVGVAWTICPEISSHRLRQYSQSVAFIVGAVGGWLFNFITPYMYNVDSGNLGAKTGFVYAGLTVVVAVISWFFVPETAGLSVEDIDRAYEMGTAPRHFKSAKATVSAESGH

SEQ ID NO: 35860 - protein, 261 aa, A.fumigatus
  UNSURE (2): Identity of amino acid sequences at the above locations are unknown.
IXYGITMAPVALRDLAESPELEGTEVVSMKARSSPPLTPPSPPCLVTDYIRHQVESNPDAPAVQCEQEQPYSYAALWQLVEHIAAAGQFRAGRIMPLCMDPSVEFVATVLAILRAGSAYVILDPEGSAQRNRVIAEDCGCEPVIFHEKYAPFFDHSVTIESIQLIQNHGQLDLPSITPSDLAYLIYTSGSTGTPKEVLLSHRAVSHGIDQFQLNGRKRWLLFYNPIFSAAQRTIPGHPVQGRLSLPHQARPTCNCIARGVE

SEQ ID NO: 35861 - protein, 789 aa, A.fumigatus
FILLAQLVPPRKSSSATVLSLMASTNSNSTAASDGCSSTTPFSPQRNGPSLATLSKGACLCLTRRDRLATALPEVLNNLQIDALGITPSALALLSPGETPACLQQITTVGEPLSQSLVNKWADRVHLRVSYGLSECAQLNFSRQLQPGDNPRNPGLPSDTTTAIVLEPGTMTRLSVNEPGELCLYGPQVANGYHQRQKETQAAFVKAPKDTHGTMMFRTGDLAVQREDGTFEILGRIDHQVKIHGQRVEPEEVAAKLATVKGVASLACVGCYINERMSLVAAIVPSPEADWGTLVQYLRDHARQSFPPYMVPSYWMSCTEFPTNQNGKVDFRAIRRLAESTEVSKMLGHSTSPKDGATAGLSETASKIAQVWAAVLNLPASSIIPSDSLVALGGTSIDAIRAIRELKGHGIHVELADMLQAHTIEEIADTVQLDSSPTHVSNEPAAPFDYISDAVLKADLLADRRVVDAYPVTALQEGILASTLQGSQDYLYQRVFDVRHLDLVRLQLAFQVVFWRTELLKSTFVAAAKGFLQVVRNDFNLPWSEVSLSLSEYLEQDKNNGVTLGEPFMRVAVLDRSILVVSVHHALFDFWSHRFLFDDVARVYYGRRPEKRPEWKSFVGLLHTRDTKASQDFWREHLGEAVPTVLNYAPVTKTSTARRTVSQEVRAASSALRAPLGAIIHAAWALVLSSHIASKSVTMATAVSGRELPVPGIEALNGPTWACVPYAIAIESGTNTSAVGCTSVITTSLGKVSQPLSSSELRKSPGPLSELPWVLFSFQHEVLYLCSLR

SEQ ID NO: 35862 - protein, 90 aa, A.fumigatus
SKATTLTRHGRKLTLKSYRLGAFGFLTSNELRRAGYNANNGLRDQKVAMRWVQKHIADFGGDPDNVTLAGMSAGGGMSGSSLISTTLQAY

SEQ ID NO: 35863 - protein, 154 aa, A.fumigatus
FPLHYRHTDTLLACVTYHLDSDEQLFKRAIVMSGTCLLIQPLPYELHEQNYQQAIAALGLTNASSEERIRALLETPGDDLVAKIPPTVLAVPAIDGTMVTSPVTYAQVADKNSDFPRGKKWCEDLMIGDAQMDVSCHETLSNRLLTATLSLFPG

SEQ ID NO: 35864 - protein, 77 aa, A.fumigatus
QIRHDLSPLIPQADSVQVRAPRAPRQRELNHRLDLNPQILVKLLSLLKFFIKCLFRMSPWVVDNSKVLCPSTSLRDL

SEQ ID NO: 35865 - protein, 100 aa, A.fumigatus
TNARNPSPTALSPLFGCDFELGHIQHILPKKELPQSDLKCLNLNITVPAGTTAASKLPVFLFIHGGGLVLGANSWPQFDYARFVRLSVEKNFPIVAVSMK

SEQ ID NO: 35866 - protein, 211 aa, A.fumigatus
PRLCLSSQASIMAFLMSHTKKDCASKFVTAIETILSSKLDVAQQILDKYNITREMTDDEAFPAILNYVNDIAFFAPVLTFAKGWKNNVYVYHFNEGNPWDGPWKGRASHILDLAYLFQNFREFMAPDQQQLAITFAEDLFKFCHGVKPWPSVAHDDVEAGFTARVYGPAPNAAQVNGPYYEGSLRRSVLFDHTDQASLDEFAQVLALFRTL

SEQ ID NO: 35867 - protein, 62 aa, A.fumigatus
EFQATALLPALRAAIALNCDIQPVSRFDRKHYFYQDQPAGYQITQYYGSFLSHSVDADYSLT

SEQ ID NO: 35868 - protein, 108 aa, A.fumigatus
RLMLSRAPSRAPSGIALYQPHLIVALDRYRHRLQNPRERIPLLKQLKQDAKVLKAQKSQKRASEEASRTKWELTVGIEIHAQLNTETKLFSSASNLCCRPFLAQNLQF

SEQ ID NO: 35869 - protein, 114 aa, A.fumigatus
LSFSLGRCRLQSNIDIEPFAKNGYVDLFPHDGIAPEDGDHVRIGIKQIQLEQDTAKSQEYPPSTQLLDFNRVSHPLIEIIAMPQIHNPATAAACVRKDSGRSTILQRRDNWEWN

SEQ ID NO: 35870 - protein, 82 aa, A.fumigatus
SKVNLQRSVQISQNSKLSSVLLSGYSSVTCHMSKCSTSAVTQTLHLFIEQVGQHGFKMLDSFKSVVVQGRMSTSQSHQILIH

SEQ ID NO: 35871 - protein, 75 aa, A.fumigatus
  UNSURE (8),(10): Identity of amino acid sequences at the above locations are unknown.
TLISGKKXNXKPWQVLPLDRPFARQLALRLCYNGDILGCDALANFGRAFQFANRREVKTHAYITVKQNSGQYSES

SEQ ID NO: 35872 - protein, 228 aa, A.fumigatus
GAPPHFPGGWKQIRWSFRGISPSPKIGSPNEQIIFRGSGGETSPNGYSEYEQGQTRYLRWLRNNLCHRTRVRLSMYLQIVCRHISTGNIMEGMARSDNVLNTGFCPMPARDNLDLFSRALTFKPHSKEEVILPRKKSDKGLNGKTDEYAPAFSEFNVLATCLGPGETETHKAILGPSLMIVVKGNGHMNAPGDKRFDLKEGYTYFIGQGVALDFYTEKGIAVYRPYTE

SEQ ID NO: 35873 - protein, 80 aa, A.fumigatus
TEPSSAPCQITDHPYRSRRPFQDAGKISPFARHSKSVIRKGAKLSPALLASTSALRPASFIADCAISTSRERIVSLLSSQ

SEQ ID NO: 35874 - protein, 91 aa, A.fumigatus
LVSREMTILAVVLQAKEAMLVRYQSHTRNTEKNLDRLPSLSINAVGSFFYDDRKEENIKPCHIDKLGSDHGPLFQNHEFKAMLGVNNAGLQ

SEQ ID NO: 35875 - protein, 104 aa, A.fumigatus
VASVHRSRAQGNALSACPINDSNIGMFPRSPSDQGRGFYHTAKVEWNLRGLGIALNNGQSLRKQFAWIDIISCNVIERDDCSVRRESLSESQELARLGSLFHVN

SEQ ID NO: 35876 - protein, 897 aa, A.fumigatus
RFVMSSFLPASEKDDRRFYLQNVWGQEMLSGALCAAAERCVAPTESESKIIDTCEKAVHYYLSKLKAAGLLDQWADKNPGLRSLMNEIEARVTSIPEQSDLVSMLGEVGEHIDLVLVRTIGESLLNSPSEGLGPITPSPMGALISRWHHEGLGFAQLQRHFVSAAKQISHQHANLRILQVGPSSPGLVRSVCQELGRSLERYTLVDDSEQTIEEMKSALAADQLRVDFTTASVENGIDAVNHLTSAGGFDLVIVHKAFTKQVTALKTVRNLLRPGGFMLMMAATGAQLRFPFMLMSTLPSLDDERLAQTKFINATRAETHDLLRQIGFSGVDSIALDNVPDKHTFSVVVSQALDDHIAFLRSPLTSPSPVPLSGNLLVVGGFSADIAKLATAIQSLVSTVWHGDIINVRTLAELDDEASTVEAVLSLTDLDRPVLEDVRAPTFRGLQRLFSEAKTVLWITHRAKADNPYHNATIGLGRSFQSENPQKVLQFLDVDTLDGVESAIAETFLKLIGGVNMRNSNPADPTRLWTIEPEVSLENGKYLVPRLFPDTERNDRLNALRRKVQTQVSVETQPISLSRSAQSDQVAYTAEAVHFHRDLADGATDPVTIQVELCSTEPVIPNIDNEDLFCFVGRTSEGARLVGLSTSNSSVVKVPREWTIPVDKHTSHDQGAFVLELRNEIQSLVIAKSIPPGSTTLIYEPDPHLAASLQRPGRPATSSVSFRARSTWSIPGSHILIDPHASRKDIQAKVPPKTRMLIHMEQGPETCEFLALRQALPPYATVVAFNDIAADDVNPRELLAEALSIIQGDSQSTKVPFDLSSVVKASALVAGGTREHANVAVVDWTGAQSITLSPRPVDTRNLFSPNKTYLLVGLTGHIGQSICRWMVQGGARHIVVT

SEQ ID NO: 35877 - protein, 131 aa, A.fumigatus
ILGIISGSLHTTAVKYGYGLPDATVPEPVATTGRKFYIIGLASLILCSAVGRAAFVLYLLAILGGQKGRRIILTALAILEMVFNSVSVILIFATCTPVSMVWDYAAEGTCTATSIQVNFGYFQSSTSTSHN

SEQ ID NO: 35878 - protein, 322 aa, A.fumigatus
THGHLQPRTRAKDLSEAQVRQVAHDLDSALDVLFDDNRGRLGEKLVNLLEGLVLGLGHEEDLVEPTQDGDTSVETERETDTSHRIHHRGKVVGADEGAQEEVGVRSGHAVTPEISGEDLGGNDPGQAGIGAEEPHVKDDTGQIETFSRGRIGLVVDGVACSHEHQTDEETRKHNVGPVASTEPLHVQHCGNSTDQQGSTSNERHIDTGTVIEADLRHQNTHVVHNCVHTRKLTEEYHDVGVDHGAASPAIPEKVQPSPLLRVGLFFVLRGDSLTHAQKFLLGLVRVEAANALPHTIRLDRSSLVHQVTGALRHEEHTDQKDG

SEQ ID NO: 35879 - protein, 281 aa, A.fumigatus
ISPGFLLPFPRLKCSSLRRPFYRRLTSSYLEDCLCRERQVLPFPLSTLGKTSIGEGLLYTYLPLATHLLSNHSPSPVMAVKDVEVPLDDHKEVAEEMDDIQNDLKSEAFNEAAMDAELQQLEAQLGSVKQSRLELTFANPAYFTYVLVAFASMGGLFSVLDQSLISGANLTMPKALHLSASQASLVNAGMPLGAVGGALILGPCNEFLGRRMAIIVSCILYTIGAGLEAGAINFGMMFGGRFVLGMGVGLEGGTVPVYVAESGMLPRFASIFGEARLLTDI

SEQ ID NO: 35880 - protein, 368 aa, A.fumigatus
YLVPGKIRGNLVSLYQLNIAFGEVLGYAVAAMFFGVAGDWRYILGSSLVFSTILLVGMLFMPESPRYLMHKGRPVEAYGVWKRIRGFDSYESKEEFLGMRQAVAAENEEQANTKKWAWLDFFRNGRARRAMIYANIMVFLGQFTGVNAVMYYMGVLMTKIGFDDRTSVYMSLVGGGSLLIGTIPAVLYMERFGRRYWANVMLPGFFIGLVLVGAGYTIDYKTYPATAEGLYLTGIILYMGFFGSYACLTWVIPAEVFPTYLRSYGMTTADANLFLCSFIGTYNFTAMMNSMTRIGLTLRFYGGIAVLGWFYQVLFMPETKNKSLEEIDELFSKPTSVIVKQNIKSTVEIMRDLSHLRFRKVFSPSPRL

SEQ ID NO: 35881 - protein, 82 aa, A.fumigatus
DRFKIFKYLWYIASILQYKISCLYTLPTIIRNNSDLNLLPNPSRPLLTTPTRLHPIETISTTEYTINTCPIIGPIPGRQHPT

SEQ ID NO: 35882 - protein, 287 aa, A.fumigatus
  UNSURE (277): Identity of amino acid sequences at the above locations are unknown.
LLLSGMLGCIVESCHTWACILVWGTSGLLASAAVCTHLSVRTSYKESLPCHEKEPKSVVWSSQLLFLPVSRRFIIMVLRKLSSPSLEALCSKEQIELLDSIDHLRLQGINHYISLPQIIVCGDQSSGKSSVLEAISGVSFPIRSSLCTRFPTELVLRKSSQVGVCVSIVPHRSRSESEREALAQFHEELDSFEGLPQLIENAKSAMGIYTYAKSFSNDLLRVEVSGPDRRHLTIVDLPGLIHSETKQQSAADVELVHDVVKSYMEEPRSIILAVVSXTRPGLEGNAI

SEQ ID NO: 35883 - protein, 130 aa, A.fumigatus
VEFCPSEMPFMSSQKMCLEANVYLVHHVFLPPKLPQEDDYDPEYELVLLEKCIEALEQFKGYVSGPEADSIAAAALMITRLARIFGPHGDVDEKKFRNALAQLYTEGKCADSNGYVLYIDRVQVEFCQYM

SEQ ID NO: 35884 - protein, 231 aa, A.fumigatus
GGVSVRRDGAYLDWGWKGHNKGAMGMVLARVTMCPGSAFMILTLGGLATPYSFGRDYPRSMRKQMGARLRSFTPRELDQLENLAPLNAFYGMNHYSTKFARALADPPADDDCTGNVAELPTNSQRRAIGPVSGMSWLRVAPGGFRKLLNWVWNRYKRPIIVTENGCPCPGENQMSLEEAVNDEFRITYFGLYLDAISRAIYEDGVPVEGYYVWSLMDNFGKFLPPPTDSIV

SEQ ID NO: 35885 - protein, 353 aa, A.fumigatus
SDTLTWYSINASVIANKGFVARFATEKSQNGSPALASSILSAWSSIMSCGQIVGMASVPFLSSRYGRKITMYTYWLILVGSVIAECTTRSWQGWLVAKLLAGIGVGCVQSTVPAYISEVAPTRIRGALLMAYSFWWTLGSFFAQVALQHLSRSDRTDYLTPVYTQWAQLGVMLLIYLLVPETPAWCVSAGKLDRAKKELLKLHRGVKDYDADHQLQVLVLAIEHERAVAIEQRREKWYAIFRGTDGLRTIISLWTNLSQQFIGLTLFGSFGTYFFQQAGIDDPFRVKVITSSIQIGTVLVLVAVVDFVGRRYLACGGTTLSWLSCVAIGIIGVTPRVKASTYIFVMFACFWSK

SEQ ID NO: 35886 - protein, 96 aa, A.fumigatus
PTVSDVGLAANGATGWGYIGEISSQRLRPYTAGFGAATTCVVGVLMNVLVPYMTNANEWNWGLKTGWFYAGVGFPFALGMWFLIPETAGYVSYLGY

SEQ ID NO: 35887 - protein, 193 aa, A.fumigatus
GLRLLWRYRLGERSTPGGRAANVGSPSALWLERSPSLTRNLFASSRTKFVPCDAGHWDDQVRLFENAVSLSPNGRIAYVVANAGIHRPDEVFEQPHPDQEPAKPDLTIVDINIKGPLYTAKLAAHYFIRQNGSTPTLGQEDTCLILIGSGAAFLDCPRAPQYSASKWAMRGIMHSLRRTTYYYGSRVNVISPW

SEQ ID NO: 35888 - protein, 418 aa, A.fumigatus
CPFLTQLPESQGSRHDDNVPHGASVARAYLHRRVPMMYNDGVQPPACLFIPPVEPCLDPETKSFSPGPQPSLLVFIEQVTRRKTMKVPTALSLAALLCAGSATAQNLSYGADNFYRSDSVTLRPITFKNQFQMTVAGNLFVPRSQNLTGSGDVPAIIVGHPMGAVKEQSANLYATKLAEQGFVTLSLDLQFWGGSSGEPRNGVSPDLFAEVFSAAVDYLGTQNVVAVDRQRIGAVGICASGGFVISAAKIDPRIRAIATVSMYDMGAVSRNGLRHSQSLAERQAIISNAAQQRWVELEDPSQTQYTGGTPNELTPSTDAVSRELYDFYRTSRGEVTPPGSTPELTTHPTLTSSLKFMNFYPFHDIDSIAPRPLLFISGDQAHSREFSEDAYARAVQPKEMLWIPAAVFTTWTASTALT

SEQ ID NO: 35889 - protein, 78 aa, A.fumigatus
NNHLHFQACGLSEIPTGHYELLIAYKNAGGTIRDTIQEIVQQWAGTSKIEVYYTTVCLSIVITQRVGLWCFFNYQSNS

SEQ ID NO: 35890 - protein, 84 aa, A.fumigatus
  UNSURE (1),(4): Identity of amino acid sequences at the above locations are unknown.
XKFXRDTHAMDTTAAHWLAPVQNDDQSETTPSEANYGMKIMEFEKIVNSPGEGDEVGPNWERPPTITSGFWFTKICLCRQKNHL

SEQ ID NO: 35891 - protein, 195 aa, A.fumigatus
IEFTVDPSSPVVKTPPHYFARIADSGNMWCESCRRQPSSEISYKYVNVDVLIRSTRMLVVLCTKTSIARKMTAKLVLPLLSVFALYAIFYFAEINGLNHLAQGAITAKTLPGTNEPLRTIYTGIEPVDNVLAALTTFFWPATDGSNPTLTLHSIAFSGTFGAAWTLVTLESWRRGNAWTVAALSVNLSRIYNTRS

SEQ ID NO: 35892 - protein, 261 aa, A.fumigatus
QEGSPTMFGLLAQVLTFAFATPLYCAFQLRNSVTARKPNAENIRIPRAVLNAIPLVFILGFMVPTLLMILPVSEHVTVDMKQIFIASWHPWPAYVAIALTIINFVFGPDVSNDGSVERERANLRSLRFVYAFAFANAALTHLISWIMSLATVLTPVIFEKRLLAVLHPFKVFQIALPWSKPVLQVSDIGEGVHVFLRWDYLIGSAGVLFWALSLYNAAHRVVYGKVRWLDLLKKAVLLVTLVGPVGAAVELMWERDELIIP

SEQ ID NO: 35893 - protein, 382 aa, A.fumigatus
KMRNLKNVRLAEVHLQNELPLTATAWDTASDAVICTFGPTEANPIIELRRKHQDSYFTDPVGAEVFECIASWDAPCPLPDLRCDRVLSLHYFADNLTACLVLEGGDIVVVREDPLPGEEKIEIVGSVDVGISAAAWSPDEELLALTTRANTFLYMTREFENVAEITFTPEDLKVSQHVSVGWGKRETQFQGKRAKALRDPTIPEKVDEGRLSSNDDGRTTISWRGDGAYVAVNSIEAGFRRVIRVYSREGALDSVSEPVDGLEGALSWRPYGNLIAGIQRLEDKVEVVFFERNGLRHGEFSLRLNEEERASWASDIHLSWNVDSTVLAVLFRDRIQFWTMGNYHYYLKEEVPVVVDPDYPHPFAFKWHQEKALRSVACGSGT

SEQ ID NO: 35894 - protein, 199 aa, A.fumigatus
FAKETLKLTPLKLSGVPPPMAHNDVPVDSNVVDVAFSKSGTRIAVLMKDCFSIYMWSLKTRPVPSPILESSHPLPDNLDNRPRQIAFLNENEVYILRNSGPNSTCIQKTTLETRSTTTVYQTTDSGQILTIFPAVGHEALWFSHVPQPGRPIAYCILKASPEEDVQVDSWDQSPAVDTHWARAVHLSDDEVLFSLLTID

SEQ ID NO: 35895 - protein, 115 aa, A.fumigatus
RPLLKKTSKLTPGTRVLLSTLTGLGLSTCQMMRYYFLCLQLTEPWLTALKRILISLSRTGALYANNQLLAKNCTSFLVTQAHILFTTSQHLLKFVHLTKAEGLLSITISSPIPSG

SEQ ID NO: 35896 - protein, 119 aa, A.fumigatus
FQAAEMEVPADTPETDERCRSIERGSKLVSVMPSKFAVTLQAPRGNIETIYPRALVLAGIRNYIDRKDYRSAFLACRSQMVDMNILHDYAPEQFLENVALFLDQVKRVDFIDEFLSRLR

SEQ ID NO: 35897 - protein, 90 aa, A.fumigatus
PVLSEDDVSQTLYKDTLKTPREVQTTTQPEGTASFKPTTKTSKVNRICDAFLATLEKRMDTNLHNLVTAHVCKSAPDLEAGLQLVARLRV

SEQ ID NO: 35898 - protein, 63 aa, A.fumigatus
RGGHTNNPIMRHKGPELTAKCMALNPVDHVSSVAGTYSDGASSINVLDALILLQIFKTSLRSV

SEQ ID NO: 35899 - protein, 76 aa, A.fumigatus
SNSLRILITHSSLVETPTWNIVDLVTLTESPNILSASRIRNIEFSKAQVDVIWFDSTGNRRIHTWVIKPSKFNPRQ

SEQ ID NO: 35900 - protein, 67 aa, A.fumigatus
  UNSURE (17),(27),(28),(37),(46),(48),(53),(61),(62): Identity of amino acid sequences at the above locations are unknown.
LGQSFESQNSIRPLGPXRKHMERWVKXXSLMAFEGIXSSSRGRLTXHXEISHXNEQQHEVXXLLSQN

SEQ ID NO: 35901 - protein, 134 aa, A.fumigatus
HCFQSRALLLLRLTQQGALGLDKLSKILSKLLRWVALYRSERGFKYLEQNESIQYIDTARSVAVGAGHGGYMVNWIQGHALGRKFRALVTHDGIVSMTSPLANNRQHSVEEIGGPIWETPDEWMKLDPAQLTVS

SEQ ID NO: 35902 - protein, 62 aa, A.fumigatus
ELNYKKVIADELAALNVLQLKSVYSALLVFLEEREPILNPEDNLLWYCTVINWMKKYSDQKS

SEQ ID NO: 35903 - protein, 822 aa, A.fumigatus
  UNSURE (822): Identity of amino acid sequences at the above locations are unknown.
LSLSLIENPANRPASKGGGGESPNPGPSNSTAQLALSRSSLREPLFVVPAGFHPNATFVGMTRELDILHARLYRAKKRAERLAAVLICGGPGAGKSHLARQYVWTQRDCYPGGIFWVDAKSRESTSKCFWDIAQAASLTDELEFECPDFKAPQKYVEMVRNWFQAREEWLLVFDGLSFNHEDDLNHFRQFLPFNKQCSIMYTSVDRTLRKKQRLYEPYCLQVPPLSVEDACKLLFKDLGIKRPTKEQVRKATELVMHYECLPLAIHAISHRLSATSKPIERYHINSHLTDEKLAEPFLSIMHDLYRMGHFEALNLINLLSFFGHHVPLGLINLGKSVLETWNVDILTSSRPGERGDIDTTLGILIRYGLIERTSDAYVLKDLSPQSEKELILDARAVVPELSESQTESSSQEASFSIYQKAGSIDVIKIHSVVQEFCRDELKIMDEEQRKQSSRLEARRGSAAGSGPASGTGSGVVKAEAGFYESWLVVAIRLLCKSYENAKKRMELVDDYGLVKDYREYETHASRLIENFPKRAAKGKIVQEARNELKQLMRSISSEIERLSPHSSQDSIRKHRSVFDRSSSSSSSVPDSDESPSRQLTWDLGDESAKVESPKELPATAHGFNLSPFLPHIFRESSSEQEAERANKEKMEASSLSQTSQATEKPSIASSPPRDDHGWQVVEKPQKISKPGKERQLKQRPKFPTHIHGSKPAAPVLKVFPVEGRSASSSSMEKGRSSSSVSATEALTSVQSASPRRSEEDLPAGQTNRTWAAVVAKANRVAEARRTPSSSPKQRPSSSPEETDRPGLPVPKLLESKSSGETX

SEQ ID NO: 35904 - protein, 512 aa, A.fumigatus
KLRPFYPPLEPLQSVNLRAALSRVLSDLKKNGDLGRETIFRKSMLDDCKGEKVDELLAVFSTAVLRKVLASSMDGLPNPAVRLSMAKGVTPDEYQLMLPLILAHRVSLATMDGRRSRIMDVHKKFSQLLDSKKAQLDGRSKEGPPALSKDVANLDALARELKENWMGSEEWADTLLQGGARSSSDAFLELPFGAAWSKANETTVEDLTVSTTPDLLVDLESRIARQRNRLQKWREVAHSMREKDGAGGQMSENTADKAPLAFKDHQTLTVASISKAVRQPLSRAAPRQDDQALLQSMNEALSRIDGKPRSSGRTAPPLRVPAMEPTTTIPSDAESAKPSISQYSRPSYCKELNENEAVPSPDNQSAGTSSPAVQITPDPDSEPKLDPRLNTFTLVERTRKSMSLLPPPSSRPPQQPRRSRKSRVSLPVNQFETPEKLPQTRASTPRDELFEEEADYNSVFKSRPRVALSPIASPAVHVAPVEVSDPDAYVDSVGDLEDMDLNASPSARGRRI

SEQ ID NO: 35905 - protein, 214 aa, A.fumigatus
LLVVLSTLPHPPEENSASPIPFFHLLERLKTTKREGWRRFGISTGESISDHMYRMSIMTMLAPPTLASRLNLPHCMKMALIHDMAESIVGDITPVDKVNKAEKARREAEVMDYIAKNLLGGVPGGMLTGEEILKVFNEYEANETLEAQFVHDVDKMELLLQMLEYERTHKVDLSEFCHVAGRIQLDEVREWAATVLKEREAFWKGMAANTNGTA

SEQ ID NO: 35906 - protein, 121 aa, A.fumigatus
LLSHQHGIISKEEVRYGLIVHSTSPLSHYSHHKGVLGATGSVGQRFILLLADHPFLELHAIGASNRSAGKKYKDAVRWKQTTAMSERLSNLVLRDCRADQFSDCDLVFSGLNSDVAGEIGT

SEQ ID NO: 35907 - protein, 356 aa, A.fumigatus
AIAELRTTLGDDAISTDEDDLKQHGYSEWSSVNADRLPVAIAYPTCTEDVVKIAKVCHKYRMPMVPYSGGSSLEANFSAPYGGLTIDFAMMNKIIEIHEDDMDIVVQPSIQWMELNEKIKHTGLFFPVDPGPSAMIGGMIGTNCSGTNAVRYGTMKDWVINLTVVLADGRVMKTRRRPRKTSAGYNLTGMFVGSEGTLGIVTEATLKLAPIPEQTRVGVVAFPTIRDAASTAMQLIRKGIPVQCMEILDDVQMDVINRAGGTGRTWKTLPTLFFKFSGTKAGVSDSINLTRELAKSNNAASFEFARDDRDAHDLWSARKQSLWSMMSLPKERSEVWSTDVAVPIFRLPDIIGWTSR

SEQ ID NO: 35908 - protein, 291 aa, A.fumigatus
LVRLVRDTIISRLNCGGAALTFAEMEFIKAEIPVFSNAKNYRKHPLVPLVVPTVNPQHLDLIPHQRKEFGLKKGFLVCNSNCAVIGVVIPFAALQAKFGPVEEVEVFTEQAVSGAGYPGVPSMDIMDNVIPYISGEEDKLENEAQKILGSLNADATAFDEQKGLTVGATCTRVGVTDGHMAFVSLRFKNRPGPSAEEVKQAMREYQSEAQKLGCPSAPREAIKVFDEPDRPQPRLDRDISKGYTVSVGRVREAAPGSYFDLRFAALSHNTVIGAAGSSILNAEVAVIKGYI

SEQ ID NO: 35909 - protein, 94 aa, A.fumigatus
  UNSURE (75): Identity of amino acid sequences at the above locations are unknown.
IGIFKGRSSTTWVGSPSILGHIGDGNFHSSIMYDRRDADQMERVEKLFHDMVDRALEMEGSCTVSITKRLSVSTXKLTWTDRANTAWGWARKHL

SEQ ID NO: 35910 - protein, 67 aa, A.fumigatus
SALQSRRTRLLSLSDIAVVCFHLTASLYFLPAERFDAPMACSSRKGWSARRRINRWPTEPVAPRTPL

SEQ ID NO: 35911 - protein, 204 aa, A.fumigatus
  UNSURE (4): Identity of amino acid sequences at the above locations are unknown.
QTPXCATDSNIELAWRPAPYEPERCWDVYAALKTSTERELWRFAQENNPAFVVNAVLPDFIVGPIIHARQNGSTGRWVKEFFDDPVHYSKPLQTFIPRHFVDVTDVALLHLAGLTHEDVQSERLLAFAGPFNFNSWLHVFRQIDPAKPWPADDPNQVHDRSTVDTRRSKELLKRYSRLDFTSFFDSVRDNCLNSDPEWKRSNFP

SEQ ID NO: 35912 - protein, 202 aa, A.fumigatus
GWATFGIWVYYAAVFVMELNHVSPVLLAAWYSPVIPSGLGAALAVGKLLGRVSAAWVMVIGMVAYLIGSILIATMPTHQIYWGNFFWSVLIICVGMDSSFPAATIIFSDAVPPKYQGIGASVVMTIVNYSISLGLGFAGTVEREISHGGHTDDDRKKGYRGAFYFEVGLAGLGLILSLAFLVKDHFRKKAKQAAAAYEDRSA

SEQ ID NO: 35913 - protein, 149 aa, A.fumigatus
ADSKTLSPVDRVTYFQETVAKESKPFSEDDMKDLVVRYVYVITFPAQSHADTCLARYINRSVPEIEQLQSERRKGRPPSKREEALLQRTEVENKEFKTGFWMPDLSQEAVIKGLASWNGDWSSLSMMKFIRITKDGGKQPSAFPPKGLS

SEQ ID NO: 35914 - protein, 71 aa, A.fumigatus
MTEILIDYAGLHGLLKSIQKPCHVKKFKGQTLGVDAYGWLHRGTVACAVDLVLDRPTTKYVISQGVSRWHD

SEQ ID NO: 35915 - protein, 608 aa, A.fumigatus
FLSRHVEFVLNRVRMLLYFGVTPYLVFDGDNLPSKSSTESERLQKREASKALGLELQRKGRMAEAYQELQKAVDVTPYMARQLIEELKKMEVQYVVAPYEADAQLVYLERQGIINGIISEDSDLLVFGAKRLLSKLDQHGDCIEIDRADFAACREVNLIGWTDADFRRMCILSGCDYLPNIPRMGLKTAYRSIRKYKNVEKALRMLQFDGQFHVPAGYLENFKQAELTFLYQRVFCPKAGKLVPLTQPEKDVNLEELPFIGRDVDAEIALGVALGDLDPTTKEQIVLKPPAPGKMASGITRRQTLGSAAELKPKKPISAFFTPKRMPLAELDPNSLTPSPSQQRLLERHANSSWESSPAPSRPDVTRSASALGSSNRLSSPLVRSVERTSFLARAAKASTFQPAKRQRLCADTEEENLPERADCRSRFFAPCTNSSSPSGSKAARTKRKSTLEVFSDEVAEQIMTYLPDPAHRSSDSKEGVDSPRSSMSDENDGKPVLSKYIFKPQSKESTSGASRNPTLSTLSGPFPRRRLTPLQRLGQTALARPRSVNALPQTKAFVHPSLVERSATTSTQGSEDLIVPNTDDEDDGDDTNKTQDPVNLEQFLYAR

SEQ ID NO: 35916 - protein, 71 aa, A.fumigatus
RIESLRDYFSQFGEVQECTVMRDSATGRSRGFGFLTFKDPKTVNTVMVKEHYLDGKIVRRIFCLFCRMHQK

SEQ ID NO: 35917 - protein, 436 aa, A.fumigatus
QIDPKRAIPRDEQEKTSKIFVGGVSQEATEQEFKEFFTQFGRVIDATLMIDKDTGRPRGFGFVTFDSEAAVEAALSRPLAICGKPIEVKKAQPRGNLRDEEDRRNRRGRDFRDGGHGGVDGSQQQQGMQGQAGMPAGLTPQMMAQYWQRMQQYFALMQQQMAVAAAQGQGMGAMGMGAMNPAMMQQMQQMQKMQQMQMANNQQQQPQQQGSLSPPSQSPTPQMQNMMNPAMMQQMQNQVQGNNMGAMQGQMGNNAGNMNMGANYPGARGGPGYNAQEQLAFEQQKYEQQQQQRRAMESRAFSPYQQGGPTSWEGMYDEVPQPNIPTGPQGMNRAGSIGRGTYSFDLVTGITPINGHLYPLHTANVKLQEQHHSRLPAPRLPTPQLALKMLESPVRTIVAAVAEAIVVSILTLVDRIGARSLSILTCLFAFFLVSSL

SEQ ID NO: 35918 - protein, 440 aa, A.fumigatus
RSAFPSSPGGEDGDVMGWFHSMATNGMLSVSYPPIYRSFTKNFAFSTGLIPWGDMQTAIDNFRAATGGNLTENSYEFLRNATLTYSDGTSANTTSKVKRGLSLIVGAVDLVTRDLSGSFSSDTTSSNSTDGDESAFHKAVSGIEAYAEQLTIPQANTFMTVLLIFAIVVASIAVGILLLKVILEIWALYGSFPDKLKDFRKDYWGLLARTITNLILILYGMWVLYCIYQLTTGDSWAAKVLAAVTLAVFTGVLMFFGLRIMHLARKYKKTEGDTSALYEDRETWRKYSLFYDSYKKDYWWLFIPAIVYMFVKGCVIAGANGHGLVQSAGQLIVEALMLGLLLWNRPYVAKSSQWINITIQVVRVLSVVCVLVFVEELGLSQTTKTVTGIVLIAVQSTLTGILAILIAVNAIILCVRENPHAKRQREAGKSIVRNSFTLVG

SEQ ID NO: 35919 - protein, 208 aa, A.fumigatus
GGDSKIPPPSAFCGFTNINHWTLSAPLHTAASSTAANRSIVQLNPERLSPVYTVFYRSPKYLFSIFGRGPLFSVALTIIDRLFEGTLPESVTIITMSARPLSQALRARCLFRGPQNTKGFSTRNTLRAADHGNHYDPPTGWLFGVKPGQKYVKEGWENIWYYGFIGSLLAAGVAYIFKPDTSYASSPLSAIHGRPFPSERLYHIYLII

SEQ ID NO: 35920 - protein, 101 aa, A.fumigatus
SPNAEQALFLPEAADYIASSPAESISLVRSVQDSVFVQGLQREARQANLHINVGIHEPAPNGKVKNTLIWIDDNGIITQRYQKIHLFDVDIKDGPVLKESA

SEQ ID NO: 35921 - protein, 127 aa, A.fumigatus
AHNLTYYLQLRFPEISLALKRQNAQIITYPSAFTVPTGQAHWEALLRARAIETQAYVIAAAQSGPHNEKRRSYGHSMIVNPWGEIVAKLGDEYREPGIATAEIDLNLLEKVRREMPLLRRTDIYPEV

SEQ ID NO: 35922 - protein, 185 aa, A.fumigatus
ELLHLISVMMTWMRVFSPWPKPSEDPFLELTRPNNYTNPMNAQAPVESTMEQRRRQLGTLGDSNHNARVSDSGNRELSFDKALNSDEFDDDFDDIEDLLAECDGTAGLIPPGPTASEKLLANEQPCIKQNTKRPSETEGFNGTSKENLETSSGDEFDDDDFDVEAIEHFMQPGRNGSVKRWSFTP

SEQ ID NO: 35923 - protein, 69 aa, A.fumigatus
EYWPHGSDALKYEINNAEKYIPVSLCSFESKADDKQSLLVRCLCCNNTCYLAGVELTNCFMSRSSTPKQ

SEQ ID NO: 35924 - protein, 181 aa, A.fumigatus
GAICLDTLSSAWSPVLTIKSALLSLQSLLSTPEPKDPQDAEVATMLLRRPKEFERVAREWAVIHAGAPRKHAGEGSGGATDETLRQEELRAKAEQEREDLSKYVTTQVPCFVTSRESHLMHVNRYDGYNKDLIDRFCSMGFDVDRVVAAFKFYGIDRMNGEDYELDEAYMGDITARLLGEP

SEQ ID NO: 35925 - protein, 169 aa, A.fumigatus
RKSISLGIKKIYHLIIAAIQFFLLLAFFPIAHVRGAERSSSIKSRMFEDDIYRTSSQYKLWSFTEASLRSLRENTNAVASQRVRAALRRAREARQSANPSAAGTATAGTTADGKGADENDIDCLTPEEETELVRFYCEKAVELADTYKPPLPTTVRVRISSDVEAHDRE

SEQ ID NO: 35926 - protein, 323 aa, A.fumigatus
QATAIQYIRRFYLSNSPMTYSPKTIMPCALFLATKTDNFYMSLRQFAEKVPGDTTAEDIIAPEFLIMQSLRFTFDVRHPFRGLEGGVMELQAMAEGLGQPAPHLPHQTSEDLRRGLLAVPPPPNAPQSSSITDRIARAHTTTRELLKTAAQMTDAYFLYTPSQIWLAAFMLADRPLAEYYLDTKLGGPTAESANAQAGNPLYELRVKLLRTLNQCAALLQSYKPLNSDPEQMKNLKRIGKKFYYCQNPEKISLAGQKRIPAAAAAAAASAGEGATSESEVERQAKKRKLEREQRDREARDIFGGELVAQRVKEGQVGQQQHPS

SEQ ID NO: 35927 - protein, 63 aa, A.fumigatus
KQSKIGLASIFPKAVKPHAPAALFTQSSKWHRDLLSEIKNSTTPNYNYTFAKTHRRVLMASTC

SEQ ID NO: 35928 - protein, 84 aa, A.fumigatus
HYFQAGPHMHRHSEMCSKADSSSSICISAKALFYLEALLYRHSIMLDESAMSSYDAPHDSLKQARKIVYIVKYIHTYIHTYIYI

SEQ ID NO: 35929 - protein, 163 aa, A.fumigatus
DSTFSRKIASFKAVTSPLLTVHAGRLVRLIPDSPPNSERAAIKTLFNHRLPSDAVAAHGAWQSIVDGTSELWKTITPAKKELIRSFFNVLNLEILKRARPPSSTFDFTSASVGNLFLTGARLFSGSFESAIYLLGSICGVQSDVVRVIPAINSYSPRGRKDPR

SEQ ID NO: 35930 - protein, 394 aa, A.fumigatus
  UNSURE (312): Identity of amino acid sequences at the above locations are unknown.
ICKLTIISQFKGGNDDLRQDAIMEQVFEQVSSLLKDHQATQQRKLGIRTYKVLPLTSNAGIIEFVPHTIPLHDYLMPAHQRYFPKDMKPNVCRKHISDVQTRSFEQRVKTFRQITDHFHPVMRYFFMEKFNSPDDWFSKRLSYTRSTAAISILGHVLGLGDRHGHNILLDERTGEVVHIDLGVAFEQGRVLPVPEVVPFRLTRDLVDGMGITKTEGVFRRCCEFTLEALRQESYSIMTILDVLRYDPLYSWTLSPLRMKRMQDAQEAGDGPPMISGAAEDQRSANEPSEADRALTVVAKKLSKTLSVTATVXELIQQATDERNLAVLYCGMSLELLSLTRLKANIIFRLGRICIGTQKCVAKPILPVRYVYPPRPFSTWRPCCIAIPSCLTNRQ

SEQ ID NO: 35931 - protein, 79 aa, A.fumigatus
AQVTMSTVSPNRGIVVFSGGSAANNLVDVFGRIRESKDCLLSYIIPISDNGGSSSELIRIFGGPGIGDVRSKTQHSQER

SEQ ID NO: 35932 - protein, 442 aa, A.fumigatus
  UNSURE (416): Identity of amino acid sequences at the above locations are unknown.
SIMLITNPALLGILASLVPLALGAPNQPIQARSRKCVIPSSYASSHGTADDSPAVASAFAQCAENSVIVFQEGVDYNIFHPIKATNLSNVEIRVLGNLHLPQDITAVQNIVKSGQSTWFTFQGPRVDWTGADDIKNGWINSYGQAWWDANPANSSSFPNRPHLMSYKTSQASIKNFRSRKPIAWNVKLQGDDITVSHAIVDATSTGGFPFNTDGFDVEGTNISITDSVMFNGDDAIAVNTPSHNIVFARNTIGYQSHGMSIGSLGKDPTDFANITNLRFEDVTVIDALYAARFKSWSGGRGLVKNVVWKNIRTFNVTFPIFVTQSYSDQSASRSGTIDPFSSVMMEDFTWSDFSGTINTYHPGDGSCVTDPCWYNVGLPNLKHTEAIVLECNTESSCKNFRTEGIRLHPQSKDSPXVICMKATAELNPKLGFECKNGTFVPH

SEQ ID NO: 35933 - protein, 78 aa, A.fumigatus
QGYKSATAQQQPGPPSNPTSPSSAPAYRQSNPSSPTCARACSLRARARARARATVNANANAKKTYPLSTRSVSITRSL

SEQ ID NO: 35934 - protein, 92 aa, A.fumigatus
YLTWVTGSTQSQRIMASTSASPSLSSNSTPNISASDAVLHLNSATRIDAPLQDVWNALIDTSTWPRWNTFVPRVTIREQPDTLDASPDALSP

SEQ ID NO: 35935 - protein, 234 aa, A.fumigatus
RAHPAATMGSNDTTEKLFHILLTTSHLQKNPNNVVEKVRIPGTYTTVQAAKAAAYRCLFDAGYEKEWFTTYETKPEIFENKDLPERSGLAVFAVAPDGTEFRVHIITTPKDDKLLDEVIEGHVTKPLYYVVQANVEYSADEGSRVRDIDIEGVFLTYQEARDLASRVLLSKENAVTKESFAEYTEAAATEKDCGYGENVVVRAVSEYGTNYLISVIKNQELEAVHLAEAAMRIL

SEQ ID NO: 35936 - protein, 275 aa, A.fumigatus
ETPAFDRHPLTLHQSQFEFQISPSLRTKPASIGDTFQSGDSASPKGFGPGSDIANTDPNLVITIINHTHLLVINKFPVFRPQLLLLTCDSYRRQHEPLTVEDFAAIQSVLSSSKERHLVIYNCGPIAGASRNHKHVQILPRPAHLFPDDPNCDPEWIPFRYGLRYLGGPDFEDPEYPSQLSASYQELLAEAKGSPGSSADSNNAGYFPHNVALVREWIIVIPRCSNNFKAISANAAGMMGSVWLKSEEELDRWKQVGLSKALAGLGYPRESEKTS

SEQ ID NO: 35937 - protein, 266 aa, A.fumigatus
WKSSASGHPLISPALSDNIWPDLTCGIALALSTAYTPPLVVMAQDQDNFPQTTSPPRKRRRPPKSCDPCRRRKVRCDREVPCGPCQRARTSLHCFYRPAVTARSPSTDEDCRLTASCGPEGHTPPPQAVDLQTKIRPAAPTAQSQPQGPNYDQTKIIQDLQNRVRRLEEQLFDLPLSKGAIGPNPSVSPSQALRHLHDRVRGAEQQLSDASRPSPSVNGWTIPATLPRLRIAPNNTKLFGPSHWLHTAEKVWDFGVTSLNLQESCR

SEQ ID NO: 35938 - protein, 411 aa, A.fumigatus
WSWHRIRTISRRPHLHLANVADPPSPVTRAVVAKSVVTGRFLAAHASVRERRCTVFTALQSLPEAHPQTKTAGSRLLVGRRDIHLLPKPLTCRRRSVQQHPQRNRSLRVRITIKPRSSRICKIAFGVWRNSFSTFRSLKARSVPIPASLQVRLCATFTTGFVEPNNSCLMHLGPVLRSMDGPYRPRFLVCVSPRITRSFLAPVTGCIPLRKYGISELLPSTYKSLVADATSTHQFQVIGKFDAKEVEPSLQDVDTRSEFASIFKDCRQLRQAIKDQESVRLNHPVPDLLGTLPTQAVCDVLVNAYLRTFELIYRVIHIPSFWKEYRQLWTQPQSTTTSFLMKLVLILALGTTFHPDRNNRVHLRRLAHTWIYAAQWWLVGPSEKSTVNLDGLQVGCLLLLARQTNSLPATS

SEQ ID NO: 35939 - protein, 77 aa, A.fumigatus
SRSPCLPTRFSFTMSDARLENGPAEPATEASKAIRKCPRRVPLGMAGKSLGHLSLCLSPWAGSTVLVSCRLSTRGTS

SEQ ID NO: 35940 - protein, 118 aa, A.fumigatus
VRGEPAEGLFELGCILNHIHGMYVTVQCTCVLLLAQLTIPVFFMPFTSPLAGKWFDCYGPHLPITIGSGLHVFGLLMASLSHKYYQFTLSQSVMSGIGSSLIFIPAMSAVSFKRTNLR

SEQ ID NO: 35941 - protein, 143 aa, A.fumigatus
VGTAPNKASENAAPDLVPSEGPIVGGLAVAGSSLGEVIFPLMVQHLLPQVSFGWTMRIIAFLILELLVIASLTISSQFRHAPKPRPFSVMHYRGPLWKLNLDLLCVASFFMYYEYSTPRLKKGMLQQITNYSFPMRELFIPLD

SEQ ID NO: 35942 - protein, 193 aa, A.fumigatus
RIIFPLFFVASPFSLRLNLNCLVFLIFLNYGNEDLQLEQPDVYATGHLANRPLYPAYCWNRSLHKRSPQRRNAQKITSWSKLWLPSHPQLFKTLLLPTTFVKVALLQPLLHSPLDTPFPFLTQHRKPRRISIPSFNHHMLPKDPLKGKPQSQRSPSGRRIQRITLPLHAAEPQIVNRVLEGKVERLGSDCRPL

SEQ ID NO: 35943 - protein, 258 aa, A.fumigatus
IAKLITQNCNRTHLITTIMSHRPLGPVVALPPAQLPSEVTLIGRTVALTKLSADHAAQLFPLVGGDDATKIALWDYMADGPFSDPITFQEAIAAKSRSSDPFYFAVIDIRQNPDPEKGHAVGYLSLMNIVPQHLSIEIGNVLFSPTLQRTTVATEAFYLALKYAIDDLGFRRVEWKCNALNAPSRRAALRLGFTFEGIFRQHMVIKGRNRDTAWFSMLREEWEGGVKGAMEEWLQESNFDESGGQQKSLEELRMGRQP

SEQ ID NO: 35944 - protein, 497 aa, A.fumigatus
RHFTGTNPTTIEQASDEWLEHFITAAEAPEDGPVKEILTDLRNSCRKSLYMQDYSYFRKAAGLDPTAVIKCEFDEAGKKRHRYGCASVCLFYLNDQGQLYPLAIVIDWRGKAETSVTIYNRELIKRKDLRAGGEKQDQKHKVTDEAHDWAWRYAKTCVQCSDWLRHEVTVHLTNTHMIEEAIIVASHRQLDPDHPVMLLLYPHWQKTLALNAAARNTLVPHVIVDLIGFQASEGFAFIRHAYENFDFKGRYVPTDLRQRGFPPEELDSPKFHNYAYARCINSMWHKIRSYVQDMLALAYPGTDADHKVRNDQCIQAWSDEMRSSDGARLPSFPTISTFEELVDCVTMCIHIASPQHTAVNYLQNYYQSFVVNKPPCLYTEPPTSLQSLLGYTEKELVEALPMNHPREWLLASHIPYLLSFKPGNKESLIVYAASKFRVYHNKATEKDQAIAAATGKFYTALAESQEEFKRYGQATDDWETIEYEVLSPEWNAVSILI

SEQ ID NO: 35945 - protein, 100 aa, A.fumigatus
VPRPAVHSLVQTLAAELVGVQVRVNAVSPGFVRTPTMGVVGASREELVEFEGQGVKSTPMGRIAEPEEVARAVAFLGFEATFTTGEQVVIDGGLATLRLH

SEQ ID NO: 35946 - protein, 63 aa, A.fumigatus
VPFTVPIADKHRQPKMKPTLFVLALAGVALGAKTCTPSFDYCAKKLIADKGTPFLAHFHDGIY

SEQ ID NO: 35947 - protein, 60 aa, A.fumigatus
RTVDAGFTEADLEVVLKAEDLETTDLKNVLFHCKNPGDVGHAKVCPNGCTDPATEGSHGC

SEQ ID NO: 35948 - protein, 100 aa, A.fumigatus
CNRNVANPPSITTCSPVVKVASNPRNATARATSSGSAILPIGVLFTPCPSNSTNSSLDAPTTPIVGVLTKPGDTAFTRTCTPTNSAASVCTNECTAGLGT

SEQ ID NO: 35949 - protein, 250 aa, A.fumigatus
KVRSNPGGWRRIVMNLLGNSFKFTKSGFIEVTLARKMEGTGGTKRVYAHLTITDTGCGIAPEYLEHKLFQPFTQEDILTEGVGLGLSIVDRLVTNAGGQIDVKSTVGIGTRFEVYIPVEFVDTLDEGAPEQQQPQSVSVSRVCLVGLNVFSSMKTSSQRLSVNTKRRLSVRSALSNAILSQPGWTVSFADTLSQAKGDIGIIEESSLAEKADLEQITTDLTRLIILGQYGSGPSVDPATKKLDVVYVPQP

SEQ ID NO: 35950 - protein, 117 aa, A.fumigatus
RSFLFLPMWNWKSSRWLAGALLWTCDIQRSFEQTDLFYVKAYGDAIVSEAAQMDWQATEKSKSDLLSSVSHELRSPLHGMLASVELLRTTDLQPAQLDMLTMIETCGLTLMDTLNYL

SEQ ID NO: 35951 - protein, 62 aa, A.fumigatus
  UNSURE (50),(52): Identity of amino acid sequences at the above locations are unknown.
RLDFTKINNLTSADAKNDTETSLVDLACEFNLDTLVEDVADNPVCSHRSXIXASQVGGRVPA

SEQ ID NO: 35952 - protein, 250 aa, A.fumigatus
DSMVVAHPSILPRKSWMWSTFLNRKQHQSLSKSETNRTDRLTPRKLIGALHTLSNLPEAREQIGSSDSMPHRQRSLSEAFVLAKQTESPPVVEGLELGEFRGSTPKASTTTDRHVLIVDDNDINLKILATFMRRIGCSYEAATNGLVALEKYQQAQRQFNYVLMGRLPLLGVMVQLTAIDLSMPVMDGIISTSKIREYEEENSLPRAAIMAVTGVASATMQQQAFAAGIDDFLVKPLSLRDLKRVMMNIA

SEQ ID NO: 35953 - protein, 101 aa, A.fumigatus
HSSSRQIRPPIYSLKQSKLRKRRVIRFAILYFGMLILFLVLLIAPLVVRSMGLVKTPNLPFNLLQPLDKDNNDTMVTYTGNNIPAGFEPVESASSVATATS

SEQ ID NO: 35954 - protein, 799 aa, A.fumigatus
QRGSFQPCGEDEKLERELERMARRKFKIVVSMQRYAKFNKEERENTEFLLRAYPDLQIAYLDEEPPVNEGEEPRLYSALIDGHCELLENGMRKPKFRIQLSGNPILGDGKSDNQNHSIIFYRGEYIQVIDANQDNYLEECLKIRSVLAEFEELTTDNVSPYTPGIPSTNTNPVAILGAREYIFSENIGVLGDVAAGKEQTFGTLFARTLAQIGGKLHYGHPDFLNGIFMTTRGGISKAQKGLHLNEDIYAGMNAMIRGGRIKHCEYYQCGKGRDLGFGSILNFTTKIGTGMGEQMLSREYYYLGTQLPLDRFLSFYYAHPGFHINNMFIMLSVQMFMIVLINLGALKHETITCRYNPDLPITDPLRPTYCANLTPIVDWVNRCIISIFIVFFISFVPLAVQELTERGVWRMAMRLAKHFGSVSFMFEVFVCQIYANAVHQNLSFGGARYIGTGRGFATARIPFGVLYSRFAGPSIYAGARSLLMLLFATSTVWTAALIWFWVSLLALCISPFLFNPHQFAWNDFFIDYRDYLRWLSRGNSRSHASSWIGFCRLSRTRITGYKRKLLGVPSEKGSGDVPRARLTNIFFSEIIAPLVLVAVTLVPYLYINSRTGVRDNPEPTDAILRLAIVAAGPIAINAGVAGVFFGMACCMGPIFSMCCKKFGAVLAAIAHAIAVIVLLAIFEVMFFLESWSWPRMLIGMIAAAAIQRFIYKLIIALALTREFKHDQANIAWWTGKWYNMGWHSMSQPRREFLCKITELGYFSADFVLGHVLLFAMLPALCVPFIDKFHSVMLFWLRPR

SEQ ID NO: 35955 - protein, 953 aa, A.fumigatus
PVLSSQMLGSNEAPPVENWRTIRRLIGHDNDVQDLGWSYDSSILVSVGLDSKVVVWSGHTFEKLKTLSIHQSHVKGITFDPANKYFATASDDRTVRIFRFTSPSPNSTAHDQMNNFVLEHTISAPFQNSPLTAYFRRCSWSPDGMHIAAANAVNGPVSSVAIINRGSWDGDINLIGHEAPVEVCAFSPRLYSSQPVSKSAVDNQNHAMQNVTVIACAGGDKSLSIWITSNPRPIVVAQEMAAKSISDLAWSPDGKCLFATALDGTILAVRFEDGELGYPMAMEENEKSLTKFGTNRRGAGIAETTDGLLLEEKSKAGEIKDVEGRMGALMGDGHATAESMVNGKTAPLPSNGATPARGPSPAADTQKAQPNGTAATPAAPEPEKPDPYQAKLERLKQRPTYTKDGKKRIAPLLVSGAGAAESSLPQARLMASVSSQVKADVPQSIVDLSKPFDGLPKGGLSALLFGNKRKLAQLEGDEDGHVEKRVALASQNGATPILANTPDGLLPAQPQPAPTGQQPTPEFIRPAVTNPCMAISQLRLAVPKVRSQIVRAIDSNGRPTEPPSATGEPGKSRADVVFEARNPSPASLTGRAVDREPVRLTLFRGEQPLWQDFLPRTVLLVTGNQSMWSAACEDGSVYIWSPAGRRLVSALVLEAQPVILECNGPWILCISAVGMCYVWNVKHLSSPHPPISLQPVLDAAIHTLGAHPSAAPAITNARINSEGRVVVALSNGEGYSYSPSMYTWQRVSEAWWAVGSQYWNSTEAPVGNLQSAGPQQDKETTAAVSAGIIPFLERNTTNETPLRGRAYFLQRLIKVLLSREGYESFESSVSIAHMENRLAAALSLGAKEEFRLYLSMYAKRLGAEGLKMKVEELLKGLIGGLFEEEDETGAGRRLQANEKEDRNWQESSDTLCGWPREVLLKEVILALGKLQGIPSSSLDAHMSLTLLFLCAIR

SEQ ID NO: 35956 - protein, 698 aa, A.fumigatus
IPLQAEIPCQSIHQSTQQRHAEAPSQRMASQWFSPCASSNPDLIKEGFVIPFGPDNFRLIVVSQEYAGDWDSKEKWYGTEYKVGKIPEDFMADIREALDTTPETRLSDLHMPHKNEFVPTRLSVEKKEVSEPAKTPKLIRHDDHVRLWFKKDDRFWVPKGTVHITLRNPLAWATPANLVKSKLYCELVKDALVEYSYDAELAGLDYHLSASVFGLDVSVGGYNDKMAVLLEKVFTSMRDLVVNPNRFHIIKERLSRGYRNAEYQQPFYQVGDYTRYLTSEKTWINEQYAAELEHIEAEDISSFFPQLLSQNHIEVLAHGNLYKEDALKMTDLVENILQSRPLPQSQWHVRRNIIIPPGSNFIYERTLRDPANINHCIEYYVYVGSITDDMLRAKLLLFAQMTDEPAFDQLRSKEQLGYVVWSGARYSATTIGYRVIIQSERTAEYLESRIDNFLIQTGETLENMSEKDFEGHKRSVINKRLEKLKNLSSETSRFWSHIGSEYFDFLQNESDAANVRALTKADIVDFYKQLIDPRSPTRGKLSIYLNAQGGAHTKLEGKDQQSRLVSLLGKQLEGAGFAVDTSRMSSVFESADLSASDADQLLAVLKKFLLSEMSLSEQQTAPVLEQARQNIGLHAKQLGIETVEKGSKPVTNGVGQPKTDRKVTYITNVPEFKARMVMSAGPIAVTDITEFEDFDAKL

SEQ ID NO: 35957 - protein, 245 aa, A.fumigatus
KYGSEFIKFYQKHYSANRMKLCVLGRESLDELEKWVEELFSEVENKDLPQNRWDDVQPWRHEDLGIQIFAKPVMDTRSVDIYFPFLDEETLYESQPSRYISHLIGHEGPGSILAYIKAKGWANGLSAGVMPICPGAAAFTISIRLTKEGLQQYREVAKVVFQYIAMLKEREPQQWVFDEMKNLAEVEFRFKQKSPASRFTSRLSSVMQKPLPREWLLSGSLPAQVRTPILSRKALSYPSALTTSG

SEQ ID NO: 35958 - protein, 347 aa, A.fumigatus
HYKIRVAKFSERPAAGCSGAVTQSRKSLLDWWATLPEETDCRDLNPSGPLFRSNVHLKLDYCLTRIFIGRPFLFSNMKSTNPAGFQGPPFKATPGLSKNWSTLVTDCVEAALEIIDLCRLLRDESGLARASFTEFSSCRAALLVILAQSLTKRTERLREALEKGMALIKIMSMGVGSARSAVSVIEALERAIRRLEEWSESQAQRNAGVVESAYDRFKNWEMLWKTGPISPGTTVTFPEQYTPARPGTGIPAVPVTPMTGTEAGNDAIEGDVASTDLASSSDFSAPHAFSQMPPLGFDHFVSNFPQELGEFTAIPCFETDPQQGLGSDMKASQGCPPDTRWMQFMSE

SEQ ID NO: 35959 - protein, 375 aa, A.fumigatus
RIRQSLNFQATAEKYLFKQLVKTKRIAESPVFLKFKERKNISTEGPRSTAEANVTARLYKSNPVKNVFPGIMDGIRQLLGLEAAAAGKKNVSEQKKGSTDQRKSESKEPSLDGGSELEEESDADSRKTASKAAARSAKVASEEADREEGSDVDMDDAESVDYSHFDARLASDSGSHSDGESDAEEASDSDNSNISRSISRSPSPEKPTKKSKKATSTPATSTTFLPSLTMGGYFSGSESEPEDLEGTAGPPRRKNRMGQQARRALWEKKYGSGANHIKKQKENEWKNRDSGWDARRGATDGTEGPRGKRGLGQGRPWQRNNNSTGGDRPQRGPPGGSNKKNVKDDKPLHPSWEAARKAKEQKSMAAFQGKKVTFD

SEQ ID NO: 35960 - protein, 142 aa, A.fumigatus
GNLSQSAFRPWWCLLRRHSRSGEPRWDTVTSSHDRPTWAKSVEWAKADLLQPDTYKPFLRDADVVVHSMGILLEADYKGVVRGKEPVISGLQRAFSSSKLGSQNPLTRRDGERLEPKERDGQLTYEIMNRDSGSYMLGLSIR

SEQ ID NO: 35961 - protein, 151 aa, A.fumigatus
SCGADSKLETTAIALAKESSSEHVPTFVYISAASGAPILPSRYITTKREAETTIESKLPELRSIFIRPPFMYDSSRKFTLPIALGGFVASQLNALLGDRLRFLGAMVDKPFQVDLVGEAVVEAMEDESIRGAVGTKQIENLATKAWRKSML

SEQ ID NO: 35962 - protein, 271 aa, A.fumigatus
VTWSQPSTDPPFLPTCLPTVVHMLMLKQKNAAERNLKETAAETQRLATDPALLSSLSRKHAFASHNLLKADTEAAGEDFERKRAWDWTIDESEKWDRRMEKKQRHRDDVAFQDYTQDARKVYKRQLRQMQPDMAAYEREKLAAIEKAAANGDLEIVETNDGEMIAVDKNGTFYSTADTIGFTENKPDRAGVDKLVADLRKAEEVRLKKRRERRGDEEPDVTYINEKNKQFNQKLARFYNKVCPFTKTSAFRTELMPFSTLRRFATVSNVVQ

SEQ ID NO: 35963 - protein, 1006 aa, A.fumigatus
YRFSCLVSMGVTGLWTVVQPCARPIKLETLNKKRLAVDASIWIYQFLKAVRDKEGNALRNSHIVGFFRRICKLLYFGIKPVFVFDGGAPVLKRQTIAGRKKRREGRREDAVRTAGKLLAVQMQRSAEEEAARQKKGASRQDEEEVPDNPVYDEETYLTEKEKRQGRAFRKTDAYHLPDLHVSLEDMGAPNDPRIMSRAELEEYARQFHQGEDINLYDFSKIDFDSPFFLSLPATDRYNILNAARLRSRLRMGYSKEQLDNMFPDRMAFSKFQIERVKERNDLTQRLMNLNGMNGEEAFYNSGQRIAGERGREYVLVKDNAVEGGWVLGVVGNKGEGHADRPIDVDRYGQKDVTYDHEEASDGDDGAFEDVPIEGLNRLPKLNFPQKDAFNEPIEKPVTSVSRRRDSLFQETEDNSLFVQDGDLAGALPHQRLHIDDFPGGTVDSEDEDLQRAIAMSLEPSASRIEDMPDIPLNRNDVPAAPPKETSPGLAESDDDEMDFAAALARSRRKERKPYNSVPRPVMDHPFEGPFPFESIRLNPSKAENPPHEELDEEGVGFEKESAKKEESLPLPPWFSGEQLNEEFVADKIDNTSLEAYRDRAMNPDHLFQKEHRSPDVIDVDKIPGPEEVIDLEAEPKAEKPDVAVLSRPENAQVHLDDIAVPKFSGKDKAVEEVTCEQRATGGKTPLTETKKNVAHASPSPEPEFEDVTIQTETKPTEVTVTRNQPQIFDESDQAHVVVEDDDDFSDPEDEELMRQLAAEGEEHVRFAATLNNNVQQSSTFDYEQELRQLRSQQKKDRRDADEVTQVMITECQQLLSLFGLPYITAPMEAEAQCAELVSLGLVDGIITDDSDIFLFGGTRVYKNMFNQGKFVECYLTSDMEKEYAFHRRKLISLAHLLGSDYTEGISGIGPVTALEILTEFSSLEEFRDWWTQIQTGMYVPETHAAFYKKFRKTATKIFIPPTFPNPQVDKAYLEPEVDSDPSPFQWAFPTYMGCEPSTDGDERIRV

SEQ ID NO: 35964 - protein, 70 aa, A.fumigatus
ITHIGLLKRSLLQRRFWIMKGIFVANKAFSLQVFMNIVLDEAFEEKQGGEKVAIGMVVRCANWRTAVSEG

SEQ ID NO: 35965 - protein, 463 aa, A.fumigatus
YSDHFYVATLMQSLCHAMLGKVESRDVDIDDFDMERMLEIQAEEQLEKDAIAEFDRYRRMDEWSSSFQNVYSRAALRCQMQLMRAKILDVDIMQFLPYTRAGTYDLLRADAFECLVELDIFKSPELVKWFMFTMSSDSSLWLRRRLHDLFGKALAPVAFGREPENEPSATADSLIIEQESSTKVRQADLARKQTVTGAIEALKGEISGDQNFKECLWAACNSPGIGILELSVFTDLCKVLYDSVTSVMVKLKYPRYWQVKHLGKVIPFQSWISNLILIASGPHAFLTVQPNQDYPRTLKRFLHKWEAQTRRETDASTWAPYHIQAIEAGLKHPLSKSSSNLATHSEAAHPKTLRFAGTSATEDAGCSIDAVDTKWWRRRAQTETQIRAEAEISCLPAVVFYRNFFTSVLFTSHLFETWRGMVEQASRRMVGRPVSNDLYMLTFIIFYDGAACSLALGFIGFFV

SEQ ID NO: 35966 - protein, 250 aa, A.fumigatus
RSRMCLNARMGDIPNGAITSSQFQKICERLGHAKLDTFFQQWVYGAGCPRFQATQRFNKKKLVVEMMIKQVQADQPSTRDLDKNTFMRDVKEEIRGVYAGNIQPVFSGSMTIRIHEADGTPYEHIVEIKEGVTKFDIPYNTKYKRLKRNKRQKERAAAVSGGDPNAETQEDVLLYCLGDVLQTEEEMQEWRLADWSKEDEDRMGQESYEWIRMDADFEWICKLSLVMPGYMYLSQLQQDRDVVAQLEVSA

SEQ ID NO: 35967 - protein, 149 aa, A.fumigatus
SLQYMAAQREHPLISTIFVRTLMDRRYFYGIREAAARALVKHAKEETNWLGLFHLERAFQELFCLPGSPMTRSNDFSDRAAYALQLAIPEAISKVRDNDGKTPLRVKRFLYDKLKFNDNSNNEVSKSFYKTLTIRLHFISIPIISTSPL

SEQ ID NO: 35968 - protein, 141 aa, A.fumigatus
SRWYLLDGQPAKRRGPKPDSRPALTRRQELNRQAQRTHRERKEQYIRSLEIEVSRLREAFTQEMSAANLAVVQHREMLQTVNDENAILKELLTAHGIQFEAELERRRAERRSAGRGFQSSPLAGSSVVSQAPAALVFTTGL

SEQ ID NO: 35969 - protein, 398 aa, A.fumigatus
VFLGSLDERQLGSRTSSAVLPDTVAKESQLTVPTTAPETTIPEATAAEAAAPVPVVTDANAPVSEVPAETALPERLKEKDTSPAELTAASPSESVDLTGHAKRPYESSLFHKDEEHKPPKMAKVEDSEAAPAATETKAGDLQPEKPSESTVQPLVVPGLGAESADTSQKVESAEAVAPTTAPSAAQAAASTTSPVVPAAVATAGAESEADAEARQKQEVKESIQAFTGEGQAPPSKEPQQEPQQEPQQEPQQEPQQEPQQEPEEKAKEKAQETAPVKATPETPTKAKPNVAAAAAAAAMRGKSAASPAPATEAAEKTAAEPKETQPDTHDQVPTETPRGEETAAKETQQPETAEGRKSHEEAQTAVDKAQEAAKAEAAKADKRKSGFWSWIKRKVKGT

SEQ ID NO: 35970 - protein, 201 aa, A.fumigatus
LAMQSAHTRAASSTRTRSTSLPRWPRSRTLKPRPQPQKPKLGTCNPRSQASLQCNPWLSQGLVLNPQTRLRRWSLQKLLPRPPLLQLPRLLPPLHPLSFPLQLLPQVQRAKPTRRPDRSRRLKRASKLSPARDRPPRPRSPSKSPSKSPSKSPSKSPSKSPSKSLRRRPRKRPRRPRPSRRLRRLPQRPNPTSLPLLRPQP

SEQ ID NO: 35971 - protein, 156 aa, A.fumigatus
VSLGSAAVFSAASVAGAGEAADFPLMAAAAAAAATLGLAFVGVSGVALTGAVSWAFSLAFSSGSCWGSCWGSCWGSCWGSCWGSCWGSLDGGACPSPVKAWMLSLTSCFCLASASASLSAPAVATAAGTTGDVVEAAAWAAEGAVVGATASADSTF

SEQ ID NO: 35972 - protein, 277 aa, A.fumigatus
DVSADSAPSPGTTRGCTVDSLGFSGCRSPALVSVAAGAASESSTLAILGGLCSSSLWKRLLSYGRFAWPVKSTLSDGDAAVNSAGEVSFSLSLSGSAVSAGTSDTGALASVTTGTGAAASAAVASGMVVSGAVVGTVNWDSLATVSGNTAEDVREPSCLSSKDPRNTYLVPHHLLRPTIRPDPPSKPGSCRRRPSGYSHSLRIRQLLLYPARKTACGVPMRHPDAPPTRTSWRCRDPKPALLPRWMSRHCQWFPRLTCLLRLCSFSPQEPRTRAKRK

SEQ ID NO: 35973 - protein, 205 aa, A.fumigatus
PEATLALVRLGGFGFSCLLSFVNGRLCLLMRLPALGCFGLLGLLCSRLFSPWSLGGDLVMSIRLSLLGFGSCLLGGFGGRCRRSSRLSSHGCGRSSGSDVGFGLCGSLRSRLDGRGLLGLFLGLLLRLLLGLLLGLLLGLLLGLLLGLLLGLLGRGGLSLAGESLDALFNLLLLSGLRVGFALCTCGSNCSGNDRGCSGGSSLGS

SEQ ID NO: 35974 - protein, 615 aa, A.fumigatus
IWALTRSTGIRQFKDFLTSIGQTEKEGEKAKKFRILKAYCDTQISRNGAGDEAICFPDLIQTWSFADSSNNESLLTVVPSVLAIFLKTISTQLDLRDFGLALCKHLMHKDQLRLFNRGLTALKTKEHLISPCLRLLTEIVSFDGGAVARHVYMARYITFKRLDVFLTPNKAQLEEADESHKSTLRRNAQKYVLANLRVQHVNAKTDLVEQHKVIKAFLEFVRKDPRDVVLEIIKSIDRDIIQDTTLPRSAKKKFFSRWNLERLVTLYGYDRESEEPNPAGISIADEVHKILMNICTDPALGVLLPETGWYPNGTDPETLPTEDDSSIELGLDSALYVDKYKESVPVRNSTLSYLIQALRPDMDRLQIELLIAIFKKTPELVADYFTKKTMFISDPKPTSSWMAESALLYSIVSLPIPLNCGWNDKLPTLPPPVSVVIENILPRPLTQKIMTRCLNLNAEIVTLFAVRILTIAFNKLRAALKIFNADHGSSQPFWTQAAGKLVAEFCRRCPVVKDVVVLFRRTSKEDLQQQEAVSELLACYYEIVPDAAFDENFDVSLVLVDILERLESSNLQAEDGESLLSQLQNVLKIAQLSASMRWWQQPGKQRRQRHLKVLH

SEQ ID NO: 35975 - protein, 280 aa, A.fumigatus
QHPGSMQYSAFTSILKVLIKTSDKESSKEIENLLTTVLKENSIIRNSSAFSSLRSSFDATESESIGYQLAFFDNCACRIAKKPVHYDDLLASLTEGENQPTSLIVAAITEQWPFVAKNGNAAAELAVCTWIARVFGRLKQAGDDPKTLKAARDNVLQTIVSKQIKSTLKKVLKDTDETTDKDGMPQDGVSRSEPNGTKDKAAQVDLREIFGTLPTESKTHNELHKWEKEELEIAVEQGRISDLVLCLCSEHEEIRRQAFANLHRFMAKLRVCFSCTINEE

SEQ ID NO: 35976 - protein, 120 aa, A.fumigatus
LTRSQESKYAEWRSVYILTGELLETVRLTGFESPVPWIVGECATCCLSVLTNPMHKLYGKVNKFLQKAPSWEVGKIPSYWIDKVLLHEPELDDGYFEETSWLLDLLIKGLRTERVSEHFL

SEQ ID NO: 35977 - protein, 108 aa, A.fumigatus
LLQDMDIYRRANVFERVLSFYDSPTVGVSAKRKILHLLYRSTQVGGSTTLVTRAGVVSWIQTQLPVVNAKEAATFAAMADTLHLTADQDRVTKWSDGAVAQDIEHIAG

SEQ ID NO: 35978 - protein, 77 aa, A.fumigatus
  UNSURE (59): Identity of amino acid sequences at the above locations are unknown.
YTLGAFNPFGALHNGEHTFCGPKDFFHPELSFFARKIEWPPSFPLNKFLPVNNEMLFIXSSYPHYPWTCAGQTNPKT

SEQ ID NO: 35979 - protein, 78 aa, A.fumigatus
CVGFTRSADPSGPVVKTLEFGINIIISEHLPGVNYYGVSGSTFMKLTVYFMPFCLLGKIAISVDAVWTVPRFCINASE

SEQ ID NO: 35980 - protein, 60 aa, A.fumigatus
WALKRFLNPVMVVKNNLINLQPLAQHFWDKDALPKRDNPPGILAQREPKQSSWTSGNGIS

SEQ ID NO: 35981 - protein, 338 aa, A.fumigatus
INFLQYGLTLTEPNTKVTAVSMVVWSRQDERILDMDKISFALDSVSCTDGMTLKFKNKLFYLAAKFAWEWVNYNDMRSFVMVSSWEGCGTPRERDPWVVSNAVFDDKASTAKLAATKSTWQKVSNTTVLDFGDIVVGHQGTKDKRFLDVSLNKAFTLDVSSSFPTEIVNWTMNTPFVDASLAINCVNCGTTGTLAFAGHVEASLFGGLEKFELSATPRNIAANLDLSLEFKGEVDFDGLPAPGKEWTLVELPLPSGWRVPGVLTFGPNVKINAGYTIEYIGGEASVTTGISARVPDSSVAKVNFGQQEPGDHLGMDSRNRNQASRDRGANPCESKTLH

SEQ ID NO: 35982 - protein, 114 aa, A.fumigatus
PGMHKNKLTKVAEHIYEGNWVRDFIDYLVTNYYPATIEDPNVQDNTKCKGAINTFGIQRDISTPNPTVAFNYSEALMQNLGTVHTASTLMAIFPNRQNGMKYTVSFIKVEPDTP

SEQ ID NO: 35983 - protein, 140 aa, A.fumigatus
AVSVFREADDLLDLIIVPTRSASDGSRSEIRRERRDADSDDLVKMRTVVLAGPRWELVFSFSSVPDDIDTSDDDSGPSLDELPSSEESDSDSSELDSSELVSSELVSLESESSESDPSELVSSELDSSVSEDLEKRSAER

SEQ ID NO: 35984 - protein, 98 aa, A.fumigatus
SEYLSCQGKSNGTTNVVCRFNEEMMTAGHHVKKGDEIGLFQFGGSSILVAFERDRIRFDEDLEKLSHQQIMVDVEVGMSLGKATQKGHTATNAVTASL

SEQ ID NO: 35985 - protein, 672 aa, A.fumigatus
RRQPRRRMTVRITGAPTGPLTAEPVIAQGLEPLPQPEQITEETEKPNYSSLPAWLANPVREPASKRARFSELGINSNLLRVLEDHGYKEAFAVQSTVIPLLLQGLRRHPGDLCISAATGSGKTLSYVLPLVTALKPTPAPRMRGLIVVPTRELVKQAREACELCATGSGLRIGSAVGNVAIKDEQRTLMRVDQCYGPELSKQRQTVDLTGEDWTNFSLMNYLAEAGELSESLPGYVQRAEPNIDILICTPGRLVDHLRYTKGFTLEHLQWLVIDEADRLLNESFQEWVDVVMNSLDARKAPKTFGSSGKFMAELGLPIQSREPRKVILSATMTRDISKLNSLRLANPKLVIIGSAEPTATEEAEHDGVPTTSDEQFTLPSTLKEYSVSVGDGSQKPLYLLQLLQSHINLDTQNQRSAERFSRSSDTEESSSDDTSSDGSDSEDSDSSDTSSDDTSSDESSSDESESDSSEDGSSSSDGPESSSDVSISSGTDEKEKTNSHRGPARTTVLIFTKSSESASRLSRLISLLDPSLADRVGTIIKSNKSSASRKTLTAYRRGKISIIVATDRASRGLDLVSLTHVVNYDVPPSVTTYVHRVGRTARAGKEGSAWTLVAHREGRWFVNEISKGSDGKITRSAKVERVNVKLDTSAEIKSRYAAALDTLEKEVKTGGK

SEQ ID NO: 35986 - protein, 90 aa, A.fumigatus
KDSPGDSDDSSERKEDKPGKALQSTKDSKDERGTNSAKNNFSGILSKFERSAKLKEAAKAKNDSAHNGGTYWATYRRTRHCTGLRASSTT

SEQ ID NO: 35987 - protein, 206 aa, A.fumigatus
RRTRCSWPAHRVAGASTLRLTQGEGEGGTGAAGTSIVVIGELIGLSAVDIAGGAGGRGAAGVIDGDAEAGGNEGRIGGEIDGGEIPEESLAGLGVLKLEDGGEVGGGGDLDGDATAVGVDAPGLDVGGAGLDGLHVAAGVGDGPEIDILAHVVDDLDAAAGGAGSEREGRSSEGEGSSEAEELGERHDDCGVGGSDICCCEGVTTV

SEQ ID NO: 35988 - protein, 207 aa, A.fumigatus
HFGARLILHCPLLSTVTLCRSDCCHSFTTTNITTTNTTIIMSFSKFFSLAAAFALTASALPLAPRAPSGGVQIVNNMGENVYLWSVSDTSSDMQTVQPGSSYVETWRINPNGGGVSIKISTAADLASVLQFEYTEAGETLFWDLSSINLSPDSPLIAAGFGVSIDDASCPTASCAPGDVNCAESYQFPDDHNTRACGTGAAFTLTLG

SEQ ID NO: 35989 - protein, 262 aa, A.fumigatus
SSTVLYFQLSLSVDQTVVTPSQQQISLPPTPQSSCLSPSSSASLLPSPSLLRPSLSLPAPPAAASRSSTTWARMSISGPSPTPAATCRPSNPAPPTSRPGASTPTAVASPSRSPPPPTSPPSSSLSTPRPARLSSGISPPSISPPILPSLPPASASPSMTPAAPRPPAPPAMSTALSPISSPMTTILVPAAPVPPSPSPWVKRSVLAPATLCAGHEHLVRLYTHFLPLEDMKVVRNTSRQALFLRVMTHTAHDYAEDGLYQR

SEQ ID NO: 35990 - protein, 626 aa, A.fumigatus
SYSPRPGSFQPRGEDLRSAYIDKPPSRYQLRSALSKILPTDEMAAETRRFWSSELQKYSELDAPAWPDLTGKRKPETAVQEHNLISEQMRMTEPLEKLQSISAELGVSSIASLIRAAWGFVSLSYLGVPAAVFAETVSDRILHADLDNGIGPLISVVPVPFDPEGTAREVLAEQQRISTQSRKYRHIHAREVRRMLNRPRGEPLYPAVFAFHPAGAEADGTTNPGLWHELEDRIGLHVEHPMAFNVLQNADSSLVLEVFSDASLMSHEHLSIFVRQVDSLVSAMLANPDKELRELINHLPPSLRSKSSQHVSEAVRNSVTLSPTHWLELNAREHPEWTAVEVASSISASGIEKQSMSYGTLNAAANCVAAFIASVGYKNRMIAVCAGRNLPSYPVIVGVFKSGNTYLPIDNNLPNDRKTFLIEDGNCPLVFTETAFAATFSDVPETCRVLCIDHPSFVDSLAGMPTDNRAYASDPQDNAYLLYTSGSTGKPKGVMVSRANLSAFIESFSEFVCRVAPSTLELGGRGRYLAQASRAFDVHLLEMFFAWRHGMASVTAERTMLLDDLQLTITKWGITHASMVPSLVDQTNLRPELCPELKYLSVGGEKISKRVLDTWASSPRGWKDPR

SEQ ID NO: 35991 - protein, 244 aa, A.fumigatus
SKQKVILYGLENCQGKALQALVILALDLVGSSNGPPGWKLLALITRSVVQLGLAVESKSSLIAPVYPSIYTLRAVILPEPGSWIEDESRRRLFWMVYFLDRYSTIATAFDFALDDKDIDRKLPCKDEYFTKNEPVETRWFQHTSERPDYLNRAENVGSFGLYVEILGIFSRIHLFLKRPVDIGSLSDVEEWQTTYRKLDNELTSWEFNLPPEYAYENSSRLFNGSKHSKSLHCDWVQLHSTFQT

SEQ ID NO: 35992 - protein, 188 aa, A.fumigatus
RLPKQHCCIRDQISRCGIVRAIKNDIVIFENTRSFLRREVCSIRYVCRVGIQPETREATSQCLNRFDGDHHCTDSRRYSIALSTLNVPTFLLLCRTCRCRFEFSTVSPSTRPKVPTPAPARYSAAGHPSPPAPTMRTRAARSFNWPAQVIRSISNVIITKPTQRIVVFLGGSMHIPCNPSWGTIICLP

SEQ ID NO: 35993 - protein, 210 aa, A.fumigatus
TSETAGKAPEFEVIYLYIRYWLFMENLEQTCASLRAQIAATEAQLAGLKRELEIAEQAAEVKAQSTTRTITAEDGKTNETREWPLLSEEYKRYGRQMIVPQLGLQGMCIEPPRKTTILCVGLVIMTLLMLLITCAGQLKLRAARVLIVGAGGLGCPAALYLAGAGVGTLGLVDGDTVENSNLHRQVLHRSKNVGTFKVDSAIEYLRESVQ

SEQ ID NO: 35994 - protein, 379 aa, A.fumigatus
KQECWNVQSRQRDRISPRVSTMMIPIESVQALTGCFPRLRLNPHPTYVPYRAHLTPQEAPGIFKDYDIVLDCTDNPATRYLISDTAVLLGKPLVSASALRTEGQLMVLNYPPRPVGDKSGGPCYRCVFPKPPPANSVVSCADGGILGPVVGTMGVLQALEAIKVITSPAVNPSASPPSLLIFSAYSTPLFRTIRLRARRANCAVCSADASVTLETLKNGSTDYVFFCGVAGLEATLSPEERISPLEFKKRHPKEVPQDGGRINKEPTIIDVREKVQFDICSLENSINIPISTILSSASSPTNVDANAQPSLPFWLPRELASADSTDPIYVVCRHGNDSQIAVRRLKELGLDRGGQRYVGDIQGGLRAWREQIDPDWPEY

SEQ ID NO: 35995 - protein, 169 aa, A.fumigatus
NFAGSMMSINLTISDIHALGKDQAFDILAQIARIEKKTFPANEAFPFGEDLWKKKPNTRVLYAVSTASGVPRRLVAYAVYVRQKGVALLHKVCVVEAFRRQGIGMQLMNYIRQRLQKEGCQYIQLWVDKAREPARSLYNRSGFEEREEIADYYAPGRTGIRMVLDLKRG

SEQ ID NO: 35996 - protein, 733 aa, A.fumigatus
RAMALIALVVLALLVAVNASLVSNYPVNAQLPPVARVSRPFHFVFSPGTFSGTETETQYSLQSAPSWLHLDSSSRTLSGTPTSRDMGPNKFKLVANNGPDSANMEVTLVVTAEDGPKPGKPLLPQLEAIGATSAPSTIFVHSGDSFVISFDHDTFTNTRKSTFFYATSPGNTPLPSWVQFDPSNLEFFGTTPNTGPQTFTFNLVASDVAGFSAAIMSFEMTVSPHILSFNQSTQTLFLTRGKHFNSSHFRDILTLDGRQPENGEVTSTEAQAPSWLTFDRDTISLSGTPPANAMNENVTISVRDTYGDVTRMIVTLQYSQFFTDNIKECDAVIGDDFVLVFNSAILKNDSVQLEVNLGQQLSWLRYNPDNKTLYGHAPSDLQPGRFPITLTAREGTAEDSEQFIIRAVRGDRQDGGEAKLTNTNNGGGGHGKKAGIIAVAVVIPIVFVMVILSLFCCWRYKRKAKAAAQEEGQFPTEKDSRLTPRNLPPCRPYETIKPNDPPIIFRSPSLSSSKPPKLELRPLWSEKSLEDSRQARNSDDKENSLAHSTIEWDFAPLTCHNPQEEKQTDDVSPQNKRLSFQSSPSLHRRTTANSTKREPLKSIQPRRSLKRNSAASSRSRRYSRRSSGISSVASGLPVRLSGAGHGAGGFGPPGHGVVHVSWQNTHASLQSDESSVGNIAPLFPRPPPRGRNSVEFRILDHPRQLTVRAVEPESPTISESDSLEAFVHYRAKM

SEQ ID NO: 35997 - protein, 88 aa, A.fumigatus
FLSYRIPNTILYYPVSTILKFRYLIYLNITIRTGPDSVIIKRVPKFSLFRPVISLGTAFIFPRIPSFLINTRFIKLPITPELIITLVN

SEQ ID NO: 35998 - protein, 87 aa, A.fumigatus
KTAFRIKFRHFKYLVILFRLTNTPALFKRFIKEVLYKVLHYFIVVYLDNILIFLENKNKYIEYVKEVLQELQKVNIRLKLKKCEFYV

SEQ ID NO: 35999 - protein, 75 aa, A.fumigatus
SLGPSEYPISPVLFSSTNKSPFPKPRNDVYGPYNPSYLQTSGPKSHTQSPAVTGTSVVAVKFGGGVAIAADNLGT

SEQ ID NO: 36000 - protein, 237 aa, A.fumigatus
RSNSVEELQSPLITWVRKMGDLLCSTRTTDPKNLSIASYGSLARFSDVKRLRVFGESAVIGFSGDVSDMQHIDRLLESIDIRENYSTHGNTLNAKNLHTYLSKVFYKRRSEFNPLWNQVLVAGFDGNNQPFLSSADLLGTTFSAPHLATGFGAHLAIPILRRLFPEEKPVEEITKEEAVNALKECLKVLWYRDARSLDKFSLAVITKEGVEMHEDQKIEKQSWAFAESIRGYGAQVN

SEQ ID NO: 36001 - protein, 254 aa, A.fumigatus
LFKCLSISSLSGQRLIRFLAKDGQVYYGDAILPVGVSDLAKVTKAKVIQGDIFGQHYVTDQVSEVQMLLAPLARKDIRTVRCLGLNYEQHARESNLPIPKYPVLFYKPVTSIAGPRDDIPISTMAQEGEGLDYECELVIVIGKEAKDVPESRALDYVLGYAVGNDVSHRDWQIKRGGGQWGLGKGFDGWAPFGPGIVSSRLIRHPNALHISTRLNGQVVQSSSTRDMIFSVAKVVAFLSQGTTLLPGDLIFTGT

SEQ ID NO: 36002 - protein, 78 aa, A.fumigatus
CRLDLSRALPTSAPFMASEDLAARQGAGSNVPVVRSRGASACEKCRLRKTKCDNRRPSCGFCLKRRVTCVYQDDNNAG

SEQ ID NO: 36003 - protein, 222 aa, A.fumigatus
LCGVSMVNTRAPNSSGSRVVDIPIGAMLNGLQTFPQWRDTFGQPTGDFFGFMNAVCPVAKVIGLFPATWIGDRYGRKKVLYTGFALLPIGAAVQAAAQNTPMFIVAGFLIGFATSFLSQPSPILVTELAYPTHRATATALYNTCFVRDLIFEAGTILISHLSTSGPSSPRGQHSELSGCSRRGPGESHPYSNKPYRPFKLLLSSGSQSLLGPLSLHMPRLHY

SEQ ID NO: 36004 - protein, 371 aa, A.fumigatus
SPTSVPRGRPRRVVNIRNFPAAVDVVLENPILTPTSHTGLSNCFCLLGPKVSSVRCPYTCRGSITNKTRWLMANKKEEESRRILTKYHAGGDENSPLVEFELNEIAQALELEKASEHAPSYFELVRTGPNRHRTALAFLIAFFTQWNGCSVLSYYLALVLNTIGITAPAHQTLINGMLQIFNWIVAVCGGALLVDRVGRRSLFLVGTSGMLLSYIAWTVLNSEFAKTHDQRLGSAVLAFIFIYYFFYDISWTPLPVAYTAEIFPYTLRGRGMTINFVGTYFGLISGQFLNPIAMKDLSWRYYIVFCAILFVMVLAIYLWVPETKGRTLEEIAEVFDGPRSHLTAGAVDENSAKGSGKVPEVEFREDVATRG

SEQ ID NO: 36005 - protein, 151 aa, A.fumigatus
ARTHANMNESHEAGKNSSTNVEEREEEVLRLARQFTEQSRYSTAGQTPFAAEAGSALDPNGERFNARAWCKAMLQMHIGDKEAHPLRTLGVAFSNLNVHGFGSDTDYQKSVGNVWLKTLSLARIAFGQKQRKVDILQNLEIFTGSARTTLS

SEQ ID NO: 36006 - protein, 84 aa, A.fumigatus
SRNIFPHIIYPMNIVPILRLVSDLVAKYQSKEFGLPYNKVCFRPDYSSSGSYSAQVGETDASDEGSHLASNFEGEEAVDRETEE

SEQ ID NO: 36007 - protein, 140 aa, A.fumigatus
NMFSDRSVRSTKSKEKCYTCRRQRIVCDAGKPSCMRCISRGVECLGYSATPIRWVAPTSTLSSEAPTPSNISHIKGQERRKRGRPKLFLMQAAPRSSKDGSDPQRSDEELESQKGARRGSTSRTAAVLPSTSSPRGWKDP

SEQ ID NO: 36008 - protein, 705 aa, A.fumigatus
WSKPLAAPIVVNSKDLGPSGQPPTSSITVAPISKSFPPSGRLNGQWGMPPLSAYTPFESLLFFQSLATLGTRPINFASISDILRNNTFVRENVAFNADRLSPEALEELYTTLMREGLDGARAVSLPEQNGVHPEGAQPTNPLKRKIASPRPEVLVDNGRSHASFLPELVSHLYARYKELATREIRNEERRYKEISDEIERLQKEERQNPSQSAPVPTSVQASTVRGPQTKKDFAPEPMDLDVKEERPAQQLRQEPSRPAVQPPLDSKVKQIEQESPRNDILPSSTREELAQPTGPSVSAAATQQPQVLSTQPPAQPHQEQPRPQQQQQQPQPQPQPDDGHAPSAVQQAQANVPPTASLAQKAKNGPAVHSQQPAAAPSPSLGNLPTFTAVSWQAQHDVHKPTPVPAPAPSPSPAARPVEKKGALGATSVSAPQPPTPQPIVQQWPLHQPPQTPQPPPLADKSAMVERTSTNPLQHAPKPEPEKPFQATPRTPVPPTPGPGSAPIVSTAVNGHARGYQTPVGAAQGLFSEAQNVHRPQLSADTRSSTPWKKTPRLSIPPSPRSPIRPRPEDVSPISERAPSPIEFPEPLLEETESRQNKRRAVEEKGARTIQEPSLPQDLELKGRLKPKVEKATGSAAAKKRDRSTTSSRSRGRSVVSRDEESVAEVGNVPLEKIKHELPGTPTNIQEPPELEGRASGARKGAAAL

SEQ ID NO: 36009 - protein, 71 aa, A.fumigatus
LIPLHPATFHHHILNPSNICPFHQIQTFQVNFSLILKHYFRPYSYWAVFVGFWTLVSLSRFFSLRFSALMV

SEQ ID NO: 36010 - protein, 138 aa, A.fumigatus
KATEGGAAESLTVSTCADVCTGIYSTRTTNKKRLCAGAHGLGCQGGEARSATSAGTQPARSPATVGFQGQANRAGIAAQRYFTLFNARRASATDRAVGIGRSDTTTPGAIHSTASSTASRTAPTAAAAAATATAAAAG

SEQ ID NO: 36011 - protein, 513 aa, A.fumigatus
  UNSURE (4): Identity of amino acid sequences at the above locations are unknown.
VLTXIDDRRKYSRSPSSSRSPHSRRRKSFSEQALGAFGLGAAASSASRHRDYSRGRSYGHHGRSHSYSPSRSRSRDCHRRDKSEQRIAQAARAALTAAAVEAFRVRKEPGEWTGEKGKRILTAAITAAGTDGLVDRNPNKHSKRHIIESTLAGLAANHFVNGPRSKSRSKSRGRGSDSKLKNLAATGALAAVGKEAYERFKSRSRSRHRGRSSSRDSYDESDSPRRHRSRKRSKSVSEFINQGMEALGLGDKDRDKDWDDRRGRHRGRPSRYDDYSDSDRDSEPGERRARHSRDVGRPRSVYATQAPSSAITTTSGARGSHADDGGYHHSTPDSESSSDLGDSSDEKKQRKKLNRQALMTAGLATIATVHAAHGLHQNMEKRKQRMQMVKDGAISPEEARRLRIKANLADAASIGLSALSIKGAVAEWKEADEKRRERAEFRKKCEQRRQKRQERMRSKSQSAAGSPRFSWRTVDPDKIEENASSSGYLHSHAGKVRSPSVGADFRYRSSYWS

SEQ ID NO: 36012 - protein, 332 aa, A.fumigatus
RAAYQGLCQANDKDRLSFQDQGMEPLARSAYPMAKSAAPLASTSVDSLAIFSGRAADEKTPRTAGGFPGHGPKSSPLKPSPLTTIQSSGDWTPSSTNSAGADKAVEAQDMTLGDKPRGDRTTDEGWGKYFQNNNGTNTNLANTPAIAAPRSNAEDRISAWPGAPLPQLNFGFLEEPAPLGRVVTGSPTTEDGPKINQMLKRAESQSARISTASSLSAASDTDDDHDHDHDRRDGASTISGPAPDPQWRGAPHHSWIGRPPSSTYSRSFYNPSGRERDTINTRGSSVLIPDALEPMPMPMPTTPFPGAPAPAPANPRNNANSDLSWLNLNADR

SEQ ID NO: 36013 - protein, 270 aa, A.fumigatus
SVNHLSQPFTSISTHIQIMHRMTHCRSASTKYLNPLKNRPLTIDTVNHHDDGCPCPAQIKHLASTLPTKGPFDFSFLPTLPQPLADLCRSIEACQHPSHKSNPDLSPPLVDLSDAVLSLCHAACTTYHLLDDELGSTTSNGNGNGTTTTTATSPPTQTGNANPPLTCTKSPMSLGKLTLQAEEETLLARQVVYAVLERLSTLLRGVYARGKGAAGGGPAIGATATATVVMDLDLGMALGTRQGLYGREGDEPVSQCLSRGLALLGKLFSE

SEQ ID NO: 36014 - protein, 197 aa, A.fumigatus
QGYATIVGQNGIKLSGGQRQRLAIARSIVKEPKILILDEATSAIDVRGEKIVQAALDRVSRNRTTIMIAHRLSTIRRADHIVVMKGGVNVEEGTHEELLQREGGVYRDLVNAQRLELLAEEDSHTGNAVLELQDEAQSPTMSVQEKVQDEDNTQDKNRGFIRTIGLVLYEQRARWPLYVAVLISTAGAGSKLISDAS

SEQ ID NO: 36015 - protein, 252 aa, A.fumigatus
NVADGYRYGGQLLASREYQPTSFFVIFMAIIQGGQSAGQFFSFASNFAQAAASANRILNSRPQSDELGAASIEKQQLVRSGDLTGATVEFHDVSFRYASQDVPLFTGLNVSIQSGQFVAFVGPSGCGKTTVISLLERFYSPSQGTITFNGEDIRTLEMTSYRRELSLVAQEPRLFEGSIRENITLGLDQSEFTEEELIQACKDAEIHDFITSLSEGYATELGIKAQTSLSGGQRQRLCIGALHCSRKRHSYF

SEQ ID NO: 36016 - protein, 229 aa, A.fumigatus
TDRVFCSVMIVVSVLGNIASPLIIVSKAASAAGSFFELIDSEKVDSGGLREPDASAHVDIIFRDVRFTYPTRPDVPVLKGLDIRFQNGKTTALVGPSGSGKSTIVALIERWYQLAMSPEDQNQGSIYAGPHDINSLDLKWWRSQIGLVQQEPFLFNDTIFNNVAFGLIGTQWEKEPDSVKKELIEKACREAFAEEFIQRLPEVCLSVEYRGISDCDRVMQPLWDRTVSN

SEQ ID NO: 36017 - protein, 244 aa, A.fumigatus
RISEACRKEYFQNILAKPIPFHDLSENASGSIVSRLATDPKQVQELIGLNGAFPLISTFSMIGCIAIAFSFGWKLSLVTVFAALPCTFLAAFMRIRYELQFEAMNAAVYAGSSQFAAEAIDAFRTVSSLTMEDAILDRYTQLLREQQKKAFRKARYATLIFAFSDSVELCAMALTFWFVSLCDSYTRMLLTVTGMVASFSPLESTNRPHSSLYSWLSFKADNRPASFLVSHQTLPKPLRLRTGY

SEQ ID NO: 36018 - protein, 186 aa, A.fumigatus
TITTLSNTVQQSISDKLAILFQSLALLLAAFIIAFKYSWALTLVTSSALLFVVVGCSVTLPFMTKIQQKIDKADEKHSSIAAEVFGSIRTVVSLGAQESLSKRYTTWVEEARKRGNGLSLIFGIHFALVFFALYASFSLAFWFGLKLYREGHIGEINTVITYVYPPASIPQLDQLLIKPTECSARS

SEQ ID NO: 36019 - protein, 280 aa, A.fumigatus
LTSSPSCADEDRHVQRPPRTLFIQYQPNSPNKPSIFVLGVIFILHFLLNRHGGRLGLILQLEHRVTCVAVLFCQQLKPLSIDKVSVYSTLSLEELLVCSLFDIHASFHNNDMICSSNCGQPMSNHYGCAVSGNPIKGCLYDLLATNVDSTRRLVQYQDLWFFHDAPSDSKALSLTATQFDTVLSHNGCITLSQSDMPRYSTDKHTSGKRWMNSSAKASLQAFSISSFFTLSGSFSHCVPIRPNATLLKMVSLKRKGSCWTSPICDLHHFRSRLLISCGPA

SEQ ID NO: 36020 - protein, 86 aa, A.fumigatus
ISLVGHLIIRLEKPSYEEHEGLNGNASNADQRRQDLGQYPSGRGSKKATDPADYHGVETLGMERSEVRQIPAYFINREFSMTTAGF

SEQ ID NO: 36021 - protein, 83 aa, A.fumigatus
LDFHRCRNQGREGQQTAAYVFEPPPASTLGIGSDVHTCLPYLRGLLILAIANLSSQSIGKQRKNRSKKFRGTAKTKGPKKNKD

SEQ ID NO: 36022 - protein, 67 aa, A.fumigatus
PRRCLRRLVKTCSCRHRTQYGGGKSTGFALIYDSHEALQEVRASQLTGFSSVPQPRSRRPADSSVCF

SEQ ID NO: 36023 - protein, 67 aa, A.fumigatus
IFIPENYPKSRIFPVCIIMGHDKGRNSMRHRNHRYYHIQQGQPLAASSAPRSESTSNSFHQGQAECI

SEQ ID NO: 36024 - protein, 74 aa, A.fumigatus
SLFIYQPYHINLNIFIKMRFFATVLATLAVGAVASNAVADEEYSTVVVTEYSTYCPSATSVPEASSSAVRLCYI

SEQ ID NO: 36025 - protein, 137 aa, A.fumigatus
NMLIPPLQAPSITVSDGVTYSISRPLITSTITKCNKWYVLSHCLLDESPEWLKMMILTTSSPSSTPVIYTPTPSSSSIVVVPTSKPVIPSGASPETTSVPPAASTPVTPLATGAASRAAVCAGAGLAGVFALAAYLL

SEQ ID NO: 36026 - protein, 165 aa, A.fumigatus
SRYGGSGLGRPPVINHHCPRRRMLGQELLKHLDDARFASLASKKQSFQVPQSPAACNLQEILVVRIVFADCPNGRRCRGEHLDFVLLDNAPESACVGCPHWFSFEQDRRGTHQQRCIQNIRVTDHPADIRGAEHHIPWPVDVKQILDGQMESDCVAPCFSEDSFR

SEQ ID NO: 36027 - protein, 437 aa, A.fumigatus
FNDADVWVGTTGLPKGVFREAGGHAVGLHLSIKYLFDIHGPGDVMFCASDIGWVVGHSYILYAPLLVGATTVLFEGKPVGTPDAGTFWRIVEEHKVKVLSTAPTAIRAIRKDDPDNKYFLQVARRGGLRHLKALFLAGERSEPSIVQMFQELLTQHAAPGAMVIDNWWSSESGSPISGLALNSAAGLVDQWQPNQDSKPLAVRPGSAGLPMPGFDVRVVDDEGREVPRGTMGNIVMAMPLAPTAFTSLFKDDERFYRGYVKRFNGRWVDTGDAGMIDEDGYIHIMSRSDDIINVAAHRFSTGAIEQAILSHPDIGEASVVGMPDPLKGHLPFAFIQPRGSGPLPARPSAELFHAVNQLVREQIGAIASLGGIIQGRGMIPKTRSGKTLRRVLRELVENGVRGEFDAPVNVPPTVEDAEVVEVARERVREYFAAKARL

SEQ ID NO: 36028 - protein, 149 aa, A.fumigatus
MPLSSRAQGSTNSYLQQVSSQGKNTGQTRARTDGSARGGTGRQGSDGGAGGGGDAGGLGACTGGDDRLGSRDDDDGAAGGGGGVNDGGGRGATGCQYHHLQPFWRLIEKTVRQDIPLVALGDGRGDQGPGDGVGHAVGDGDGGSLQRRD

SEQ ID NO: 36029 - protein, 299 aa, A.fumigatus
VAELRDGIRHPHPLEATPGTEPNPRAVRPNSVHHRAGHLEREARPLLDTPAPRIRALVRRILGELINKVPVRAMDLNTIEARGDGIARSLRVVANQGVDLLLGESARRRRLLVRGDVAARHEVEAAFSLEDFGVGDPAQTPQLHVDVGPLRVHGVSHLAPLSDLRLAPDPRHVGVAACARRDERRFGDEKGAGDDGALFVVLLDYGEGDVVVVHTESGHGGHGQAVAEPHAPDLDGGEEFRHGGSLHLDLGITPRRDDSATYTLYGTDWGEAVRGGRPLAFYPTSSGEHCALKTTLQRL

SEQ ID NO: 36030 - protein, 287 aa, A.fumigatus
IQMQRTTMSKLFSPIQVGRMRLGHRLAMAPMTRFRVDDDHVPLPIVKEHYEQRAVVPGTLLITEATLVSPRAGGYANVPGIWSEAQIAQWRQVTDAVHAKGSYIYMQLWGLGRVANPEVLKREGGFDLVSSSDVPTNEKAPAPRALTEEEIHALIGDYAQAARNAIAAGFDGVEIHGANGYLIDQFTQDTANKRTDAWGGSVEKRARFALEVTRAVVDAVGADRTGIRFSPWSSFQGMRMADPVPQFSYLARKTAEMKLAYVHVVESRISGNADTESTFSPRRRRST

SEQ ID NO: 36031 - protein, 585 aa, A.fumigatus
ASKHHYWKPDQRWVRTRRFMGPAEETTVKRSGLQLQNGSKSRPQDTINSERSRHESESHDRFPPEASLMPQEAVAEQAVEEQVTPEQAKADEGTQQPTRTPEVPSEQHIASEMKELQPQRQKRARGRPPASSRKQSAIGEPSERNGGDELEKTAAPDDPSKRLRGRSTRNARGTPNAPDTENAVPNSSLGRGQDTAQPDMDGGDTAARAQDVEQSVSVKQNEKKKGRRAGRVGMARHVEAEQDKSDESNERIPQEEQLQPGREQEHKPELQPEAEPAPEVASRAESPTTQEASPRPKKRRGRPSLASRRDDNTATQPEERQATQQEVDAEDSKPTRKRTRQPRSETVPVTVHRLVNVASLAPGPSGPDSPVEDGDSADELAARGKTKLPRRGGVNPADVLSQICRETLEKTLTTLKNGIANETNPARRAEWTRKKKAVEAYETELEGRLFELSEMLDSNFVLGVQLKKAKREMMDLRGRLYQIRKEREAVALRMDAVRSKHAEEESARMVSFGLVPKSISTFSMCVWLVADVSRPAFLSTIPCIASSLLLNEVRIAHPPMLTTQNRQMLHPQLAWSLCSVALQKQ

SEQ ID NO: 36032 - protein, 523 aa, A.fumigatus
LELKASNASTCMSCSTLIVYFICWWQSRPEAESIILTYPAIPLHAPLNVISPSSSYYWDEMTSESVQPGLTPLSHLKAVPTTSSSKPLAFKDSSVLQATPQLRHRSRLSKNVNRDEPVSATSDKATVALIRRVLCSQAGNQSGGASTPQPLEELLPPLTSSNEVDLQLYALIAIIIKEFVLSWYSKITSDQNLVKEVIQVIAHCTRALEQRLRETDIAQLIFDEIPGLIEAHIICEISPYSSWLVFYTHARNLAYRLARDESTLSGLSPSVRETYHALHPHPSLSPIPDSSDMRTIEKQRENEAIYRQLLAHGMLAILLPTEDLENVPLRTIIGDILADLILGNAVSEKMCQGWFLWETTTKLLSTAERLDEHEEDTADSHQQDRLHKFGLLTVNDDPKSDQSSSQTQSFGQAWLWNILQYLYLTYIVLQFIVTGLFRVMTNAKANVSSAAITPEISETEKSAPMGGTSTKRPILNYRIYSMVLQMLDIPRRMPWLAGFLSLFQYLTLAGPGKLGETGSVLDR

SEQ ID NO: 36033 - protein, 216 aa, A.fumigatus
ENWKYNTLGRVQYLCAYINIASDFPIASNLIFGQQCDPEASKSIFNNPTLAPKTTMIGLDLTHQVLASRSVQNRILHGSSDSTKTPSVLRRMMHALLVFFAQTYDSVFGLSSGPPLHDPLAVAVAISNLNPTFAKKHPDQALKFNDKNGERFAVDVVTDGIHSTNASETGQLGRTLATPMGGHGVAIPRGVDLEAFWNLILDCLTRADECNATRKS

SEQ ID NO: 36034 - protein, 169 aa, A.fumigatus
PLPLHNSASRNETLRANVVINTGDSGLDGTDLLPKAPRLPVIDKNPIVAMRDALMAQPKGTAWVIATGALTNVGLLFATFPEVAAHIQGLSIMGGAIGGGFTDAPMSRLPGEHERIGNTTPWAEFNIYVRISTSRRISRSLLTSSSVNSVILRLPNLFSTILPWHRRQQ

SEQ ID NO: 36035 - protein, 118 aa, A.fumigatus
SAVSRTRCKYWTLKHNLTIGFMRILAKTKMSQDAFAILLAAHHPSLHLLGITTVHGNSSLENTTTNALRVLEAIGRPDVPVYAGSRKPFCRPAVHAPDIHGTIHDPSPCIILPAEMRR

SEQ ID NO: 36036 - protein, 907 aa, A.fumigatus
FQGLGPRLFRVMLERAAGCLENAGRRFFRDSKGALRSRRSWYPHFAQSNGTSADTVHLSHSASTTSDRQDSLISVSWRARSATADTWTPVLDFLYPPRTQEFAASLLLRPSRRLAVRRKKKPIPALTRAYTSVAASLYKPVIPDKPVVDLDAKKADQLERFRAKEELRSILNQSKPGVYGDYDRAWELYETARRPKDVTPAFLAHLSRSTLLRNNLRAQWVFRRIYPRDRSPEDYLHLAKSYLAVGKPDEIIRICKDAKGGGGDVLCWAFAFSHFVNKADWDSAEKFWNARPPSSEKVLLNAVASELNDSNLPTKLFDLAEVLRSQETSMSWSGLVHFLLDYAFSNSRIAADVSTENILLLLKEYNLLGFLTAQHYFRLIRALQSSDVRSTFTKSIVVYRNLRWQMEQEVPPADLLGAFLRCLARFEITTGIHYFLGEYARFHGQPSIDAYKNALIAFSRAGDVENTNTVFEQLVKHHGKPSSRRLLTPLLYVHARLGDVTATRRQFERVSKEFGLTQNTVCWNILLTAYANADDFGGAFATFDKMLEEGVQPNSHTFGALMGLCANRGDIDTVRQLLELAKRSPVRITTPLLDTIVEAYCNNRELEKAESVAETCLGLDVKGSRVRMWNVLLWNYAFRMDLESISRIRSRMDSAGVQPDAMTYAALMLSLVLRGQTDPARRILRTLHRSNHMYATEFHYAIILYGYVKDRNRDMVHIIFREIKERFKRPGFTSRLLVLRNQLQRDLELIKTGGRAGSGANVRLENAERFLAETIADFDKANMASKEPLPGAGRLPITQAFPAMYYEYLITAYGTRGVFHRVKELFDQFLRDRKSSTSERPAYDVAPLRLVSALMLTYLKSEQYKKVEECWQITFPRVVKMAYSSPWEPLWGGKFGKKILGGGPFLG

SEQ ID NO: 36037 - protein, 109 aa, A.fumigatus
RCPPTHPHSRLSILIPSDHGFRPPLYFCGGLLSVNMEITDFVFREREDVLLAGDYNAYRAHTTRRLHKLRKKLGQTTPKGRKYTAKPPVSAEDISNNVAYVSPDMLGCG

SEQ ID NO: 36038 - protein, 203 aa, A.fumigatus
  UNSURE (24): Identity of amino acid sequences at the above locations are unknown.
EYHLEVAYCCSGRCTISQALASAXAAESRLKSGLADVERESVSSKDKAAAYDSVIIASQDAVDATKTAIDDLANEGVEPSDKRMQSLQITRTAVNYALVGWRIGRNRVLCGTNDGMIFETDKAECLKRGKGASREESTGKKLTRLREKVVLYDSILQSIEFILELPGVAADTTFVQELEAKRCYFRALRYEYPVLLAITIQAN

SEQ ID NO: 36039 - protein, 485 aa, A.fumigatus
NWTYKNNTASTFTAMPLPLSPSPTILIPHLPAKTLVGIDLVTFTSTPNFHGIRDLPNGWHFLYTGTTESLSLRSGGWFYVGDISVFDESHNGTIVTASSRSLGSDIFVWKWNSETESLELLRASSDADRQEAMRHKANLGAVWQRGGLFRYRSRVSSSRTSQSQSQSQEHQSPVQEDIDEEDEEEGRKDWTDLTNNISPRLLSRIVGDPELDVDGRPRWMVTSGSTAERDSDKIPGLPDINSENLAKVTGEQETAFSFLPVDLKRTWREGAIGRERTEAAQDRSWALGDLIQRHSSGGDRGEQTGEAQILGELQFTFLMVMTLMNYSCLQQWKRLLELVLTCQNAIKDREPFMVSVLRLLLLQLKRCDDVEGGLFDIDGVDGGEFLRKLLMKFRRTLYEVVDNPGPTLKAEFDKLATWVKDEYDWELDREAFVRRGIIQLEDGEEVELEMEDDGDDETGEYAPLVVDLGEGNTTQDPDMANVDTP

SEQ ID NO: 36040 - protein, 93 aa, A.fumigatus
GSFFDLRSFRPCAIDTLEERCALRSPLRQGTNMVLFNSGRETICRVTGGMKVNADRNESSPYAAMLAAQDVAARCKELGINALHIKIRATGGM

SEQ ID NO: 36041 - protein, 67 aa, A.fumigatus
CPSSHDSVLLLLKTNYFTDPPGYGTDTMVHLMIDYLSLTDNSMLIMANVGVFMVYIRYPSTIDHLPH

SEQ ID NO: 36042 - protein, 64 aa, A.fumigatus
LTPRLSKGQGQGIPDTFPADYLKLLSQVRSCNTTQAWDDGLQEAHYLTAGKVMPHKGAWLTAAH

SEQ ID NO: 36043 - protein, 247 aa, A.fumigatus
  UNSURE (227): Identity of amino acid sequences at the above locations are unknown.
VRRMRFSVTILLTFREGLNKDVFPLGTLTYPITRNIRVELAVTVIVAILGVVSQLRLWKVIRDKRRKEEAVKKEEEKRKEEAETEVARRLEENNMRERQAWEAQYADAEAKLMPELGDGTQCAADKEDLEKRDGAEVSSISSSSQVSYRCSDCRKQEGSGASFSDVTRATGNTEIERHGDATEKTADGAHPMPFRVFDGAGAASLMDDKESDVTAMAGSDTATVRSXRFSGITIREENGLSEPPEDC

SEQ ID NO: 36044 - protein, 92 aa, A.fumigatus
IIRFCSIDTACWSRWNPATWRFRSPRRIANYDDIRESSSKRFSDACSKCDSRSELYGHVKHQRSGINDNPVAQQIDSFGKWVHTPSLRHSES

SEQ ID NO: 36045 - protein, 87 aa, A.fumigatus
SLMLIISCFNITLVYVEGDAPMRSYEDSDGKKTHALNIVASKPTTLFMHLYVRDTILMHCRGPGKLNVLQKPVPRPNATESGNLPPH

SEQ ID NO: 36046 - protein, 156 aa, A.fumigatus
AIHAIETSKPSFAWTLTSNAARLCQNLGYHRSSSMSQFSDSEKVKALSLFLCVYCLDKSLSLRLGRASSIQDFDIIITIPEDLGGPRVDEPWRTMYHLWVKTAEIQGKVYEQLYSPAALSRPERERLFCARQLASEMEVAVMEPFKVGIPWRSSLP

SEQ ID NO: 36047 - protein, 237 aa, A.fumigatus
LSPAGAFIFHRVVKTCECDGVDVYQWHAADGSEWRRGSICPVAGDGRGLDCGFADCQGIRRERFVVMLTQFFFGIRLTMSVIITSSSDEKLEQAKKLGADYTINYRTNPNWNEEVMRVTNNHGADIILETGGSETLSKTFDCVAFGGLIDCIGYTSGKQQNPNDTLNMNVLTLRKNLTIKGIINGPKDRFEEMVQFYEKHQIHPVVNRIFPFEESKEAFKFLASGAHFGKVVIKVKD

SEQ ID NO: 36048 - protein, 105 aa, A.fumigatus
TKPDIPSLAHGMHFEMDVIEFSKIKRQLSAGGTDTSGDKRTRFEDRHGIQGWTSRSIIQGTHTPVEQCLCNTDNDLDMLGSETAQCDVCFGEVGAARHPAVVYPC

SEQ ID NO: 36049 - protein, 79 aa, A.fumigatus
QQLAWIYYSWVTRSSYLSKAHIALRGFGTEHVQVIVSVTEALFNGCMGSLYDRTASPTLDTMSIFKASPFVSAGIRASR

SEQ ID NO: 36050 - protein, 70 aa, A.fumigatus
CSSIKGIVTLINRYRRLSSPRMWIDTWALLSENEIKKLNDYKIRPVRVPWYTKEGKSIYYFGDEKYMQRT

SEQ ID NO: 36051 - protein, 222 aa, A.fumigatus
RCGGTPSRISSPTIHSSSSIFSSVETLFTVSKHYVYQPRPNLPPCGNNPVHSPPTTPRAKPSSTRNSPSSGAPNEGGALGMGFAYRTSEFPGTLNNEGDIKTHGKLMEKNTLGLVNPAGPVCRFVDFKPGGEPFMHRTQSLDYGIVLQGEIEMILDSGEKRTLKAGDIAVQRGTKHAWRNPSEVEWSRMVFILQDIQPIVIGGVVLEEDVSGSDEIKPSQGD

SEQ ID NO: 36052 - protein, 428 aa, A.fumigatus
RRHTIGGMIELGLGRISRLLQQTPLSWKAIHIAGTNGKGSISAYLSHMLTAGGVRCGRFTSPHLIDRWDCITIGESVVQESLFRQIEERVRLRDQSLGIGASEFELLTATAFEIFNHEHVEVGVVEVGMGGRLDATNVLSDVLVSVIAKIGLDHQAFLGDTLELITREKAGIMKPGVPCVVDGTNAPEVIRTLENRVNELKIDAVYAHPDTICSQSPCLGRIFRELDLQRHQRANMSCAVSALRLALAKVRPGLEVDMLLPSLKNVEWPGRLQKISLSPLTARTEPVLLDGAHNSQSAEVLGEYVNKNLRPQGKITWVIAASRGKDVTALFHSIIKSGDKVAITAFGPVDGMPWVKAADTEDLALCIQSIPGVQDVRTFDGDVLAAINWACTEAGDCPLVIAGSLYLVSDVHRLLREARKSAEIYRGH

SEQ ID NO: 36053 - protein, 75 aa, A.fumigatus
VANAGTLKQLGDCLGRGAFGSVYRALNWNTGETVAVKQIKLADLPKSELRVIMVWHLDLTVWCQERPYWPFTQWS

SEQ ID NO: 36054 - protein, 152 aa, A.fumigatus
RQPGYHDTIADDTAMVLDDDDLEGFIAQPANLNDLDEFINAIGGDNSDNGDNGDNGDNGDNGDNGDNGWNPIDLLMLPADRNRLTAFTNQPSYPSAANTADPATDPFTIDPAQLIPQPGDYPQVARPTTTLATADVPGDSQNGGDNDGFQQN

SEQ ID NO: 36055 - protein, 88 aa, A.fumigatus
ADGTAIYKSIQLERTLIRSTRIKHTLFPDTLKYYLTLVFKPLNSSHSFFSLGLKHPDIMRFTFFAALALLGTAFAAPTAPTTSTATVC

SEQ ID NO: 36056 - protein, 61 aa, A.fumigatus
CTVIKIFCSLGISLRSIVEQATSSGFSNFFAVYTFRHSQGILTTFGGEMNQSIPSRTVLSN

SEQ ID NO: 36057 - protein, 61 aa, A.fumigatus
SSGSIVHNNSMKTALPLTYLLLCVRKVLFVYHTRLVFTHSIQEISSFYLWLAIFWLRHQVG

SEQ ID NO: 36058 - protein, 1117 aa, A.fumigatus
LRRKRNQLNPESFPVFSSQLKRRLTTHENLKSELSVPNTRGRSLRFVCSLRTNKSRATNATVADLLKELAADEVKYMRELKTLVGGVIPVLLTCVLSRSDSAIAAGLFRPSTDPKDELNFTKPIVDMGVAIERLKTLHKRIPQDNSDSLLTWAQGAQRVYREYLRAWRLGFRDVIVNLAPLEEGEVAQNADTKSLDEGMARDENGDVVNSEGEKVDVAYLLKRPLVRLKYLAKTFKGINMLAPSAKAEEIALIYQNLVTEARRRAREERARLEDESAASIDSTRARDPATLEALTDVTIDKTRRVRARDFFNLSLYHSTGQVVDCRAELLLRDNGPGNGAGGDLLICEIDHADRWLLFPPMDVACVSARNGDLKGEIVVMLRSPPGQTKAWQELLSLRIDEEDIAFEWVQLLGVNPPPPALCRTQSFIERAKQRQRAQATPSSDVPPAQKGPPSPTSVDIPIGERATFRTARRSSTPKGSLSEPSTVCETTSAIESSVYSAITRESDYASTSQSPPSILHARESRKTPLVDERTSAGLKRSKANRVHLPVESSPSSLQKDALSDREQASATSHRDRQEDQKPVQSPVVVHEKKPDTEQRSPKTPIRDTVDQGSPRISSVPSMDLPSIPKIRKGSSQSYITESLAAVSDDEEYAPVDSYSLPGSPSKSKSHSRSNSDSSQTNDEQPPPPPPHSRSPSSTGPSLSNTPVLSPTNVRQRRRGSSPLKHEYEPSTASDTYSDSDTSTVRRYDMDWDSDDYTASDTSDGDSDDELASSLPPADAQNLANSTLAASSNSSLSPSNSASQGGYRSVPSQPTKSSTAVASVFAWSEKGTWEAIAPTDCKIVVSPGLIEAYEISSKAMPDMDDEEHRGQGLLLVALELTPLVPIRRGTAIDISVRSPPTEKSKIDWSNNIMFRSRNADECEALYGLINQARINNPTYIALQNARGPFANQPVPMERSTKTGRWFGWPQRRKSYRASNSPRSLADHSESSVGTMSSAFSALKKFGSGSKMFNLSRSSITSRSAKDDSLHSSSAGSGSHHSSSGIGRIAAAMKDADGIGLSNAKIRLYVRETQSKWRDMGAARLTIMPARPAPRRPGTSSSRRSDTSVGADERSPPTS

SEQ ID NO: 36059 - protein, 90 aa, A.fumigatus
SHCLSKQKKDATAVRLPLSTMFPQRNILRAAQQLRSAPARAAFQRRLNSTDNKLPWMVDNAFNRERAAVKHHAAATSGSYTPIGPKKFFG

SEQ ID NO: 36060 - protein, 76 aa, A.fumigatus
RSRLRFPRIYRTLYSPMPSAVIPCLILGSINAYNLWNEHWEHWEHMPPLEERTEYPYQNVRVKNFPFGDGDKVSFI

SEQ ID NO: 36061 - protein, 213 aa, A.fumigatus
KGFVHYRLPTYRVWSKKNPSTERDPVDINLLELNLDSTSHLAQVAYGNIEMQEEGGIYVSTKDVERLLEFQIGELQSTQTSPLNVRIHDAHLLTECRTWRKSPRRHEGAARTYHGVWRRNTQPDLLPKVRWSSRTNPPSLTISDSSMHGELETTLHPSTIFTDILTIQCIVVTGAHINMRCSTSQSFRLISDAMEKLFLQCKKLSPLPESPTI

SEQ ID NO: 36062 - protein, 167 aa, A.fumigatus
GEMELANKPAVANDLRFLDAWRAGDYPSSFDNLHRYFDYTMHSRDRSSYQYALLNLAILQADFGCYGEAVSAMQEAVSIARESHDMNCLNFCMSWLYHFGKAFPEQMKDVQNTGMLGNEKEGLAFLKAKAKETEMWSLLSTTLLSEAKLELQNVSIPTHRCSFCIQS

SEQ ID NO: 36063 - protein, 260 aa, A.fumigatus
GGTSVGMFPLGAMKKWLLIMHRDDKVAADYLLSQLQAIQLPDNDASLLLSFLSIEYKIRQGDYGRALEIVEQTAQSMHQDNFDIHSQVKLLCFKARIFEKTGHPQRGFSLAMRAASLAHRSRLLPGLWEAICVLGGVLLSLHEFEAVNEMVESIMPQVLETDDCDLAARAYSLLVDANMGMAGKAWSQGQDTPAKKEHMNRALGYLDCAYDQYEEIEDIKGQCEMMAKKATVMHLTGDLVLANDYAAKYLDLQKLSEKGV

SEQ ID NO: 36064 - protein, 73 aa, A.fumigatus
VLTAFHGDTRNITKGGSSFQLLDKYFSTPIIKQYCRPVSTSAHIYIISDQNASIHMIRHTLMSHVVAAVVLDR

SEQ ID NO: 36065 - protein, 60 aa, A.fumigatus
ELIQLSSITLATGGRQEVILIQYSADSGFCLFSNKATDVYQSTLATNVTAKLHKSSGVTF

SEQ ID NO: 36066 - protein, 457 aa, A.fumigatus
NTHREMLKLHVANSLDRIGIVFHFQNQVERLLSWRKSSHTFSFLFIYSFICLDPNLLVVLPITVILLFIMVPAFAARHPPPPSMSTSSTTPYYSYQGPALAPAKTIKPASETSKDFFRNMRDLQNVMADFSDVHDATVSLFAPITNFSNEKLSSIVFLVLTITAALLFLTAHLLPWRFILLLGGNAAVLSNHPGLQEFLQNLLGDSSGAVKADLQAERAEKKKTLDMYGLSMQSNPSAAVSLLDSLADISLDSYPEEREVEIFEIQNRSLAPYSESEWDHFIFSPVPYDPLSPSRIAGDRPRGCRFFEDVQPPPGWAWKTKKWKLDLDCREWVVERMITGVGFEIPGAGPEGSMANEEIGGWVWDLPSQSASRDEDAVATALGYQDYGSSSKPASIQEKKKTQKGKQKSSSRDWEEQGHSGFNGMGEWRRRRWVRVVQRASVSSETDKEKPSNQGKT

SEQ ID NO: 36067 - protein, 60 aa, A.fumigatus
SDLLILGGRLNCAQLRSTVWSAYIEGLSNHSGTSILFWPSYSKWGLNRDIIVNCMNWCRN

SEQ ID NO: 36068 - protein, 155 aa, A.fumigatus
YDISLAAQVRRVIIKGLPSAWSTPAKVLSLIHGGMVESIHITPTGNQAHILFCDHEACKTFFDKYPNGIDIDKEKRKTVFVEMGKEVDVISSQLSFNLSIGSTRVVRAVGVSMNINMGELLKLAGANNRKVEKIVDSCVPGEVSWCGHPQEGLVC

SEQ ID NO: 36069 - protein, 143 aa, A.fumigatus
AVSMFSWLANVFDTALRLPETMDLKQVSDMIINAFDNVMGKDSQGLQESRHAPKKEDKAKELKYSQQVGPPFVHFSVLGSVRFGIVFCAPGHIGVFAQAGHAHIVRVKLIAFFQHQTVLPGCPRQQNLTYLWWTFFSFQHPPP

SEQ ID NO: 36070 - protein, 114 aa, A.fumigatus
HRSDYEEAPHSRNAEGFGDFETNTDNNNASLMPGIEEDAGASKAFASGFRDDATEFIMQDTPVAASDNAVVEEGRGNLTTFKSWGTPVTRDKPGMKSIFLIPLGGLVYANMTSH

SEQ ID NO: 36071 - protein, 69 aa, A.fumigatus
IIPAQTLQKLQAQVSFSGVEDYVYMQAAPQLSVDVLTMPLTAHFLLVLRRYRRNVLPPGIIPLLGIAHF

SEQ ID NO: 36072 - protein, 132 aa, A.fumigatus
RSLFCQHRGDQFAQRAKAIYEASLPRLKAPTLVYLQGLITLAFYLYATEPDSQGWLLIGTCARLAYALELDKLDEDSEAVQAQMGLPEEWSMQEERRRAWWCIWELDAFAAAIACRRPTIDKKKHASHAASI

SEQ ID NO: 36073 - protein, 77 aa, A.fumigatus
NHVSKKQLGGLDTYYVAGVRSLTQCKSVCTLASDINTSIGHSSFADSSMLERHVDHYQTLSTAFSPFWLRDLNFKLA

SEQ ID NO: 36074 - protein, 77 aa, A.fumigatus
GAPNVNKAAHEYLFPSCSAKDDYAREEDKGGVRGGGGGGGQVFATASDMQDTYCPSTTLDYNALLYGISSAVFPGTC

SEQ ID NO: 36075 - protein, 172 aa, A.fumigatus
VFLFMAHTIPHPRMSLRPLLSRLIPLPRPVPPLADTPRPPRGSRKDVGPPRCRPCRTREGGSRTDPRSKNPDPDPPRLPSNYSHPGPYPPHPRPAAKTPQTSQPQAPRHLLQGRPRPHRPRRLPHGLPAALRHRRRPLLRPAPLRTSRPHLLDRHFLRLGLHHGAGRAAPLK

SEQ ID NO: 36076 - protein, 123 aa, A.fumigatus
YTVLFEKTIDKLNRMDTGVIGPVTVMDSFVSKFGSQSATVHGLIVSSILIPAAISSFFAGYLADKLGRPTGISIGALIFGIGAAIESAAARLAMFIVGRCIEGIGEGLYLGTLVVYVQFPDHK

SEQ ID NO: 36077 - protein, 212 aa, A.fumigatus
NRYICEISPTSVRGALATGPQLLITLGLVVGFFTCYGTARLESSFSWRTPYLILACLSVLFSAASFLFLVPSPRWLTLHGRHEEAARTWDLLGVGHAEREKVEVEQTREARTQIQILPACPATTLTPDLTPHTPAPPQRPLKLASHKLLDIFSKDVRARTALAVFLMGFQQLSGIDGVLYYAPLLFEQAGLTSSTATFFASVFTTGLEGPRH

SEQ ID NO: 36078 - protein, 61 aa, A.fumigatus
QTRFKETFPKEDNEVAMPFLNFNKIFLIQALALRVFWIEMPNTDALTDPLSLINHCMELLR

SEQ ID NO: 36079 - protein, 91 aa, A.fumigatus
CRLSARYLDERVIIQASILCPSFIFLFLLDLQSSSSKLNSFMKHISKSISFLRSFSYLSAFTPSARTSNFTPASQGDSYNTHNGNRNGKAP

SEQ ID NO: 36080 - protein, 135 aa, A.fumigatus
ASSDLFLICPHSPLRLERAISPLHLRATLIIRTMATAMAKRLEGKTIVITGASSGIGRSTAKEFARTSPKALKLIVTARRLDSLKQLAEEIKEEVGDGVKVLPVKLDVSNPEEVKNFVPSLPAEFQDIDVLVNNA

SEQ ID NO: 36081 - protein, 81 aa, A.fumigatus
LLYSELENTAPRIQSDYKPEHGDLIEAQKRKRLRKERRIKRIVTVIAGYAIMAWMAYLIVVTARTAPKIWDPYEILGISRV

SEQ ID NO: 36082 - protein, 942 aa, A.fumigatus
MAKMADNNAGYNLFEQSNNFTSSESSPDAEMEDESYHSGSPDAEGVGGYSATDSSEKGSSPSSIGNSSSSEIKRGIKRKSSSLSESDFIRQNPDLYGLRRSGRARTTRQVVQSTSSESESVVRVSRTKRRRPVASQRSSKRPSPPASQSSYSAESDDDEYGGPSRTSKAKRRRMLQPASNKEPSHAEIRFSTRTASRRVSNYNEDDDDDMFLDEADEVMDNYQANTVEDDRPAVDVVLNHRPKEGVSPGDSDVNEHSFEFYIKWQEKSHYHATWETYKFLIDNCRGTRRVDNYIRKVLYEELRMNHDGDAPPEEREKWNLDRERDVEAIEDYKQVERVIAMRDGDEGTEYLVKWKRLFYDSCTWESESLVSEIAQREVDRFLDRSSHPPLSDKTEMNPATRKPFEPIKGTPSFLQNGELKDFQVKGVNFMAFNWVKNRNVVLADEMGLGKTVQTVAFIAWLRHVRRQQGPFIVVVPLSTMPSWAETFDNWTPDLNYVVYNGNEAARTMLKDYELMIDGNPRRAKFNVLLTTYEYVLQDSTFLSQFKWQFMAVDEAHRLKNRDSQLYQKLLEFKSPARLLITGTPIQNNLAELSALMDFLNPGVIDVDVDMDLNAEAASQKLAALTNAIQPYMLRRTKSKVESDLPPKTEKIIRVELSDVQLEYYKNILTKNYAALNDGAQGQKQSLLNIMMELKKASNHPFMFPNAEAKILEGSTRREDVLRALITSSGKMMLLDQLLAKLKRDGHRVLIFSQMVKMLDLLGDYMESRGYSYQRLDGTIPAASRRLAIEHFNAPGSSDFCFLLSTRAGGLGINLMTADTVILFDSDWNPQADLQAMARAHRIGQTRPVSVYRLVSKDTVEEEVIERARNKLLLEFITIQRGVTDKEASEIQNKMARSGISVSEPNSTEDISRILKRRGQKMFEQTGNQQKVFTTGVEGQRWS

SEQ ID NO: 36083 - protein, 77 aa, A.fumigatus
SIELIDQLPFTNYTHKHLFTYQTDCKTGLPEECAYLLCPLPSCVRALPGPLDIAHSRSTFHILIYPIALWVLVILQA

SEQ ID NO: 36084 - protein, 677 aa, A.fumigatus
YSTRSGTLKLNSTSRINFVSLTGGCPLLSHGETERGTKGGHRTAQQQAGGHLNNSGFPDSTSSIHRSQTIYIPQPTTFVSPVPPFYSSSCDTRPGRSPRGLVSMHAVFPSSTASTATSQLADPTPNPDSNNSNDPFASQVSSPPPPPPPRPAVSVSLPENEPLPRRIKSKSSLRSIRSLGSSHQEDEGYDSQDQSGLDKSLVRPSILRRLSPGLAARVKLLDGSSRVSTPSRSPGNVGRIPEEQIKELDNLHHQNLSIKVERKGRSWNALQIAGKKQDTQQTPSEASEILQHGSVERSGTPTDPQPAAPVVENPKSHTSGPLENIDPDHLPAAAVASPQEDSQEDSLNEEAVDQTPAMSAVEQSQMPLAIGSATASETPDQTDFERYIQSTSDNEAQSPRPSPPPKDSPPLSSSSSNVQSYFNPKGLQRTESIYSFSRASFSNQLSQLTSITLPQPSSLAASIAGISNAPAAVKALTGAAEQIQIWIKKASDVLSGLDAEDDVEWAAAGGREGLEGVDKAITRFESLVHVYVNAIEQVQLRQDIGNVSPDSLKTIVVQMDSIIQSWAQIKGRLKGVKEQVELAMEWEELWANVLGDVGMEIESLSRLIFEMEEKRHFTMANEQEGTSNGLDINELETIVEETPSNGDMASKRFSMGPFFSEAPPLGMPIIQTSSPRG

SEQ ID NO: 36085 - protein, 192 aa, A.fumigatus
SSLSIPELNLDLSDLSSLFNWNTKQIFVYVYASYSSSDKKSSLIPNSESIIWDTIISAPESPYSFNALLQRFFPTKSSSSPRKNQKRSVSASKKTSASKKETPAPGVLRLSNQRAKYQISDITGKLAERKNVTLSVGWNVQPWVGALWWSPGSGAVPRTAGTVVSSEAFDFPPVKGSKASATKAAASGAQTA

SEQ ID NO: 36086 - protein, 88 aa, A.fumigatus
DKMASTASMLCLILVTLFSKSPVALHYTDEFPSIRRSLVCLIDFLQAVSARKITPLTWIWFQVPPLGVLMISGCSVDFFINILLTILG

SEQ ID NO: 36087 - protein, 263 aa, A.fumigatus
RISRRVIAEQHLALTETFSSPWHFPGSQDRTDMNADFVGEVFLKCNAKEVIERCGKLAQDMMRQSSGTDKIPEILVQGHLDATFPYILSHLEYIIGEFLRNSIQAVIEKYKESFEKPPPIEVLICEAPQHVIMRVSDQGGGIPREVMPYLWSFDKGPLSKSRLQNLKQVPAMAATMQELTVSKERKHADRETYREGSLDSLTSRPPNLRLGIGLPMSRVYAEYWAGSLELHSLEGYGVDAFLQISKLGNKNEQVTTRASIDAV

SEQ ID NO: 36088 - protein, 290 aa, A.fumigatus
RPPSLPVDCRELCCIHLAMASQSPNYLGLSGRALHWAQVALVGAPAFIVFGYNQAGVGPLATLQSWVKTFPQIDTINTTGSLEAHNSTSKGAVIASFQIGALIGALSCTLISDRLGRRKTIFLGSILTIIGEVLQVASYGLVQFVIGRIILGMGVGQYSVAVPVWQSECSSAKNRGQHVIIDGIFMCLGYSLCNWIDFGLSRIPQSTTQWRVPLALSLLPALVILLSVFLLPESPRWLVQVNRAEEATHSLASLKGLPANDEAIRAEISGIESSLELTASSTTGAGRTRA

SEQ ID NO: 36089 - protein, 161 aa, A.fumigatus
AQSRMLPARGENCIFRGTESPLRRCKTGDLDWVIIRENSEGEYAGQGGRSHRGKAWEVATETAIFSRHGVERIMRFAFETAQKRPRKLLTVVTKSNAQRNGMVLWDEVAAEVARDFPDVTVDKMLVDAMTTRMVLKPETLDTIVATNLVSDLPDSDSAILP

SEQ ID NO: 36090 - protein, 122 aa, A.fumigatus
RWDNLQHADILSDLAAALAGSIGIAPTSNLDPTRENPSMFEPIHGSAFDITGKGIANPVATFWTAAEMLAWLGEEDAAKKLLNCVEDVCEMGILTPDLGGNATTREVTEAVVGQIRKLAAAQ

SEQ ID NO: 36091 - protein, 136 aa, A.fumigatus
LPSLNLFSSDRILNIIPSLLCSGQLPNLPHHGLGDLPCGGISPQIGSENPHLTHILDAVQKLLRCIFLSQPGQHFRSRPKRRDGVRNALTRDVKCRPVDRLEHAGILPRGVQVRGRGNPDGPSQRCSEVGEDVCML

SEQ ID NO: 36092 - protein, 137 aa, A.fumigatus
ICFRQTAFSTSSPAYCAAANFRICPTTASVTSLVVAFPPRSGVRIPISHTSSTQFRSFFAASSSPSQASISAAVQNVATGFAMPLPVMSNADPWIGSNMLGFSRVGSRFEVGAIPMDPASAAARSERMSACCRLSHR

SEQ ID NO: 36093 - protein, 375 aa, A.fumigatus
GLQHARETVNTFGVFQTFYEIELLKDQSSSNVSWVGAIQAFLLLVVGVVTGPLYNAGYFYVLGTTGSVLIVVGFMALSVCTEYWQVLLAQAFCVGVGNGCLYIPSVAIIPQYFSSRKAIATAVAASGSTLGGVLYPIMFRQLQPQTGFGWAARVLGFLVLGTTLFSPSVMSVRQVPKQRRTLIEFSAFKKVPCTLFCVAMFFGYIGFFNPIFYIEAFAIQKHAMGETLAFHLISILNATSVPGRIVPGLLGLRFGPLNILLGSAIISGILSLCWIAIYNAGALIVLAVLYGFSGAFVSLLAVALTTLNPNLQTLRTRMGMCSLLCGFGSLCRAPVAGAILDNTRSYLGVQLYSGLTIGTTGVLLFFANHLKRRTN

SEQ ID NO: 36094 - protein, 178 aa, A.fumigatus
CFERKPATASYYDWYNTNPGPVGYLHICSPFALGTFSRFTRQNIKLTNGTEIPTGTPVMVTNDVAGDAAIYPDPEVFDGYRYLRMREGADKARAPFTTTGQNHLGFGYGKYACPGRFFAATEIKIALCHMLLKYEWRLVKDSPHDMLTSGFASFRDPRARIEVRSRAPDPQEVVLTIK

SEQ ID NO: 36095 - protein, 212 aa, A.fumigatus
PIIIQNLLHFISIPHPFKDKTAAAMDGWSDLSSAPPQYREVAGIADWALLAQGLGWSINYLAMIYHSYKDRTYGMAILPLCCNFAWEFVYSVIYPSHNSAERAVLTTWMILNLFVMYTAIKFAPNEWQHAPLVRQCLPWIFPVAIAAFTAGHLALAATVGVSKAANWGAFLCFELLTSGAVCQLMSRGSSRGASYTIWSVLFALLILRQPSN

SEQ ID NO: 36096 - protein, 216 aa, A.fumigatus
PGSFLDWTEVTLLPSMLGLIARVSSLIFVGEPLCRDPAWLETVVNFTIVRHQAILALHMCPAVLRPVLHWFLPPCQKLRREIKTARSLINSALEELRKNPPTDRFSSLAWVDAFASGKKYDATMVQLRLANASIHSSADLLAKVLINLCEQPGLIQDLRDEVISVLEENGWRASTLNQLKLLDSVLKESQRLHPITTGTIQILGPSDTCTFAHRLL

SEQ ID NO: 36097 - protein, 81 aa, A.fumigatus
RASQSPVFGVVTDLGPKLVVSGAFIEDFKDEKLLDHYRAMVEDFMAEVPGFESMFLGNLHNTVLRDVISVITRELGDCSPL

SEQ ID NO: 36098 - protein, 965 aa, A.fumigatus
PLRRMNQMHLAMTTLSTLLLSLELLVNSPVQRLCSNSGSSSEQEAQWWGELLEGRIALDKKSLRKPPREEPLRGNFLSRAGHFDHGLFGLSQREARYMDPQQRIALQVAYHAVESSEYFRSGIKDKNVGCYVGVGGSDYDHNVCSHAPTAFSFTGTARAFVSGRISHHFGWTGPSMTIDTACSSSAVAIHQACKDIRMGECRMALAGGVNIISCPNMQQNLAAARFLSPTGGPCRPFDAFADGYCRGEGCGFVMLKKLSCAVADKDEILGVIVGSAANHCDGNDAITVPKSHSQIDLYRKALSLAAMQPKDITYVEAHGTGTSRGDPVECRSIRQVFGGERPTLHFGSVKANVGHTEAASGIAGLLKVLLMIRNQRIPPQANFTQLNSSIPPLEPDNLSITTNELEWKATFRAACVNNYGAAGNNTAVIVCEPPRLKPSAGNNHILSGYPFLITGQSGRSLKMYCTALGEWLENTDAPLSDIAFSVTRRQNRTLRRRITFAARSLKDMKNILGQQARLDQQSSPSPKPKPVVLVFAGQTGNVVYLHKDAYEGSSLLRSHIDECDKILREMGLRGLIAFLFDQQPIEDVVLLHCLFFSLQYACAAAWLDAGLPVQRVIGHSIGQFTAMCISGVTTLADTLKIVAGRARLIQQKWAKERGCMLAIEADRQGALELARSVPGHKIEVACFNGARNHVLVGTEVAIQTLEAKTSCKTRRLKTTHGFHSELVDHWLDDYMALAQSITYATPIIPIETCSEGGSWKEFTPEMLPRHSREAVYFFDAISRVDKELGPCTWVEGGVGSKGIALVKCALGTNTSGHSFHRLQLDSSEPLASLTDTTIQMWDEGVDVQFWLYHDTEKITFDSCDVPAYQFDETEFWLLRSDQARQSDLQRGRVISDRYKPLVYLLRDEGFRGEPRKLHFGVNQYHPDFDRYLHGREVLGEVLCPVSVFVELAATFSPSGKAPHCI

SEQ ID NO: 36099 - protein, 211 aa, A.fumigatus
VYISVELDNRSITVTAKQSQVSLLRGDLAARGAKLTRIPIYGRYHSRTHAEILQDLLEICSNDESLRFPIISAPIVPLRNNTTGGLITSAEKLHELALKCMLTEPADWYSTMSETVSSLMLQPVINEHPLILELGHVSCLPRSLTASANIRAFTPLLTLTASPNEPDASRYDYPEHSIAVIGAACKFTGAETMQQFWELIRAGGTMVGGTS

SEQ ID NO: 36100 - protein, 78 aa, A.fumigatus
MGFGPDKTRVNDSDLVQPPKFAQTQRQKLFRFKCSADPTTWRLKPSLTISAEMKDTFARNTLADIDCQSNTILTESAR

SEQ ID NO: 36101 - protein, 236 aa, A.fumigatus
HLWFLANFVSSSVQVRQKVPHKRTFLYLEQLILKHNAHQDTVNIKEAKDGLDFFFAQRNHAEKMVDFLSSVAPIKVKKSQELISMDIHTSTKSYKFTFSVELVPICKDDLVALPIKLARSLGNISPLALCHRVSTSVNLIDPNTLQTAEVPTAVYWRAPFKNLADVTELVEFIIMDIEPVGRSNGRFHLAEATVARASDLGSNNQTYFTRTHLGGILHVGDSASSTTGSRRYAHAL

SEQ ID NO: 36102 - protein, 151 aa, A.fumigatus
TSADSCVSRILCCNCGAPIDGTTSAGALCQDCVRLTVDISQGIPREGVLHFCRDCERWLQPPSGWVSAALESKELLALCLRKLRGLNKVRIIDASFIWTEPHSRRIKVKITIQQEAFQGTIVQQAFEVEYVVHTQQCPDCAKSYTHNTWRA

SEQ ID NO: 36103 - protein, 209 aa, A.fumigatus
RRFKMEPYLVDLLVGAGGTEAVETKLLVRVALPTHGGQSLNGQDGNAVGKDLESVVLGLSIEDLEARDGDNTSDDVVLLLEVCSGLDTDADLGTGGDEGDGGVGGLDDGVGTLQSSLNGRVLELRQVLTSEGKDARSVLGGDCGVVGSAGLVAVGGTPNHAVREGTEVGQSFDRLVGGTVLTQTDGVVGSDVDDADAGEGGQTESTGGI

SEQ ID NO: 36104 - protein, 104 aa, A.fumigatus
QLDSITPGHPEAHDTPGVEVTTGPLGQGFANAVGLAIAQAHTAAVFNKPGYDLINNYTYCFFGDGCAMEGIASEAASMAGHLKLGNLIAIYDDNHISIGEFLQN

SEQ ID NO: 36105 - protein, 470 aa, A.fumigatus
LAYFYLDGDTKCAFTEDVMKRFEAYGWHTVWVKDGDNDLEGIEAAIHEAKKVTDKPTVIRLTTTIGFGSKLQGTGGVHGNPLKADDCESVKQKFGFDPKQSFVVPQQVYDLYHKHAAEGAAKEQAWNQLLEKYATEYKAEHADLVRRLSGKLPEGWEKSLPTYKPTDAAVASRKLSEAVLEKIHAVVPELMSGSADLTGSNNTRWKNAVDFQPPEYGIGEWSGRYIRYGVREHAMAAVMNGLAAYGTIIPAGGTFLNFVSYAAGALRLSALSRVRVIHIATHDSIGLGEDGPTHQPIETLAHFRALPNCMVWRPADGNETSAAYYSAITAKHTPSVLALTRQNLPQLENSTIEAALKGAYPVVEAPNAAITLISTGSEVSICIEAATYLKEKHNIVARVVSVPCFEVFDAQPKDYRLKVLPDGIPVLSVEALSTMGWERYSHEQFGLNRFGASGPYKEVYKVRLHFKSSS

SEQ ID NO: 36106 - protein, 61 aa, A.fumigatus
SDLSEQRANHIIQVDATFKANSGHPGAPMGMAPVAHVLFNKFMNFNPKNPNWLNRDRFVLS

SEQ ID NO: 36107 - protein, 356 aa, A.fumigatus
SNLTLGAQAEKKQINELNQLLRDQNRSHESARNENYSDEVVTTPDRQWKSSISAESPDAIVGDRVSRGETFQKSILFPSSESPSAKDKVVEPDMLDHMPTKRQSHILYKGFMSGVHAISPVIHPPTILKLYNAFWDWYDYSSYSGEPCPDPSFIPLLYAIWYGGSVTISIRMIKAEFNVSSRSALSKTYHDEVTRWLTEISFPRSPSLQGLAAYLLVQTILSREEEPLTSSLFISLSMRVAQTMGLHRDPANFGIEPCEAEYRRRIWWHIVHMDGVVAMSSGLPPLVSDEKYWDVQETSEVKDTLLGTAEAEQYERLVTAGLRPRDNPDDPTICGGPSMVNVYYLSARGKYIMARK

SEQ ID NO: 36108 - protein, 353 aa, A.fumigatus
  UNSURE (83),(98): Identity of amino acid sequences at the above locations are unknown.
KTLIEGSALRHCHGFMEKFISLATDPDFQPFQWSWPGNHQPMHATMIMLIDLYERPYSSEASKSRAFIDKIFSLSGPDGGCRXRRGWHHDSATFKDGXREAWDMIRRLRQKAWQKAGLDPQRLWTEQAQIRAGVPSTPPEYSPVSNAYPTQASGNPSTIPPLTSRKQLTDFSKLFYNMTRSHLAPRPSPLRYQLPPPVPSAVPASPRVVSDLRFSTSPATSIPTIEPTFTGSTISPPASIPPLSSTKPFAQPTFTSSSATLPYIDTSLPASQPGAAPTPPSMVDPNLNFDWAEWDAVFGQHLPVADELMELDPVSGFEFADLANTRDVGDHTAAGKTDTGMSDVRDPEWFSYC

SEQ ID NO: 36109 - protein, 364 aa, A.fumigatus
YSITPLKSASPSVDMDPRRRRDSTVDDRHRPYRRDGSRERSRSRRRYTPRFDDDRRRERSRDASSRPRDRNPDDRVAIRDFRANRYGDRSYRPNRRSRSRSTGRGYDRDRDRSRGRDRSASREKDRARDRSRLTDERERDRDHRTRDRSRDRDRERERDRDRDRERERDPNRDYRPRSYYSRSRSRARRGRSRSVSRARDQNQDLTRAARDRDRERDRERNRDQERYRDGDKEQDRLREGDRKDERGRSRSRIPNPSRRPSRSRRRSPSTLDIDHYVPPTSHRSRSPRRRVRSPHRPERDDRRGFVEIDRYIPGSEREREKARDGEKEKENEERKDKGAELPDREADDRGIRKLSASQRRSRSR

SEQ ID NO: 36110 - protein, 209 aa, A.fumigatus
AGRNLGKISAEPTNDDRTTIERHGMEDGVRKRLRADGTLSLSSFDETSPSRRAKARIVPTYRNDDKGLPTYSSAAEHYSTEPENPSKVASTSSESEDDDDDDDDYTSSSGSDDDSDSAGDGEDEDQNADYSSERASRAGSSLPRVSAQQKPRIHRMTKEPDLLSRLSAFLPKLKSAYEDLPREIAAGRGKDLQLDEVDQEEGQYIEMVG

SEQ ID NO: 36111 - protein, 202 aa, A.fumigatus
RHEYASWITAPISQPFATHPKLQQHKMSAPKLHFNNDQSPIKDESSPTQKAMECPSSSTRKSLHQNILGKLRPLPLQYHWTVWYDRYSESTDYDNRLYVLHEDVADIATFYRVYNNYPWDKIRLRDSVHIFRKGVRPVWEDPENLRGGCWKFRVPKSKAQEFFHEIAILCMANEFQAALEKGVRIRSSASASIRVLRADCFP

SEQ ID NO: 36112 - protein, 82 aa, A.fumigatus
LLPLEHDHVLGVSTSVRFNSHMISVWNKMGTNERSIKILEQTIIDRLSPELRPTSSGSHSYFYKRHDENDGYQEAVAASSSH

SEQ ID NO: 36113 - protein, 369 aa, A.fumigatus
LITFICRIFTQFRLASYPKIIDFFFFCFTLHFACVYLKMEELLAKHRKEQKDLQARITQKKKAATKKTRRGVNEECERLQRELSDRHQAEIAALSGEPIQPVDGFEELSLRDPDVGDADTGEKSTSDDMQGTDSLPEPSKTDSTPTSPPASAPRTKKPNRQKARLARRAAEQAAQSALAAEEAAKQVDHRGNEKGVMEAVFKRLGLKEVEINPDGHCLYSAIAHQLEESGLGLRPDPQRVVIQPQTQSRLDTVASPKHDGYRAVRAVAADFIVEHKDDFEPFMEEPFDSYTRKIKLTAEWGGQLELQAIARAYGVNINVIQGDGRIEKIEAGDMDGIDEEERNRRVIWLAYYRHTYGLGEHYNALTKQS

SEQ ID NO: 36114 - protein, 85 aa, A.fumigatus
KYPVRDAEIGQGKITYVQGDFFKDTWLEKLQLPRNSFDLIYDYTVCGSQKSFVQSTRPGFCLLSQEKSPVSPHRSTVRLSLNSCG

SEQ ID NO: 36115 - protein, 115 aa, A.fumigatus
GKVVLVTGGAKGIGRMISEGYVTNGATVYISSRDAKACEKAVQELNAIGRGKAYAIPANFYKEEECQKLAEEIAKRESSKLVLGGPCSGGRLISCSIRASCPREQLRVKLGCSLR

SEQ ID NO: 36116 - protein, 117 aa, A.fumigatus
SHALSELHVLVNNSGSNWGAPYDEYPSSAWTRVLTLNLHRVFDLTKLLTPLLEKAGAPNDPARIINIGSIDGLRVPALETFAYSASKAGLHHLSRVLAHHLGKRNITSVHLMLVTCL

SEQ ID NO: 36117 - protein, 72 aa, A.fumigatus
DQDEFDVPSFWSVFWVLRWVSWSASSRKGSNASSVETKFANLQTRNNAPSAPSPGAGSAVTVEALQFWSHST

SEQ ID NO: 36118 - protein, 298 aa, A.fumigatus
MIILIRHAQSEGNKNREIHQTIPDHRVQLTPEGHRQAREAGSKLRALLRPDDTIHFFTSPYRRTRETTEGILESLTSDSPSPSPFPRHTIKVYEEPRLREQDFGNFQPCSAEMERMWLERADYGHFFYRIPNGESAADAYDRISGFNESLWRLFGEDDFASVCVLVTHGLMTRVFLMKWYHWSVEYFEDLRNINHCEFVIMKLNPDNGKYVLQNKLRTWSELRKEKENERQRERTSKDLGSATSLTPASTPVVIRRKWGGCPDAVTTASTENGPYGLHGRLEVTPPVLGVETQSSTKK

SEQ ID NO: 36119 - protein, 243 aa, A.fumigatus
AGYVEWLQNWRASTVTAEPAPGEGALGALFLVCRLANLVSTLEALDPLRELADQETQRRTQNTDQKEGTSNSSWSHGHQTEKFLKRYIEIFREQSFAIVSLYKNIFTPDQAESESVIAGLRGIDSRVKTNLSQPTRPDDPLQCLPPALATFPMHLVQLLTDTLRTYLPNVQDKSSRESLLTQVLYCAASLGRLGGDFSMILTEMSAAYEWEEVTRKHRALAGRLDQLTGTASRVTPRVTSPLH

SEQ ID NO: 36120 - protein, 78 aa, A.fumigatus
LSLRLVSSSFLSSRCYLNTVGSRSRHNNGSVLKPTLNAVPGGFRNIRTAISGAIIAFYLPVSPGLIESLAQGFHHFCR

SEQ ID NO: 36121 - protein, 328 aa, A.fumigatus
TINRMLRMMIPENTLRGSRRSILKGRRDRSRGSSKRSWRPSQGPTGTDEQKTATDSEARDNPKPETKPKVTLRLFAFLSCCSSSGVDPDDSAIPPKKTTRRPSAPATQPTPEKADLNANHSNRTESEEAKLFGEEKPNLTVTSHQPSREEEKPARTSEEGAQLDANLSSSDKVESSHEPASQYGQVDTTRTGAPQNAQIPVIVATETEKANDLEIKPEEPMGSLPLPAIEDSSTSTEAQPTSSAVEHNDVKSSHEEETTLPAKIPPPPPPQVPMGKQIQIATPERPQQWLLPPPLPHLRNRKCLVLDLDETLVHSSFKVTRQPLSPFM

SEQ ID NO: 36122 - protein, 70 aa, A.fumigatus
DLSQVGRDLRETIIIDNSPTSYIFHPQHAIPISSWFSDAHDNELLDLIPVLEDLAGAQVKDVSLVLDVTM

SEQ ID NO: 36123 - protein, 82 aa, A.fumigatus
ADSRNQPTYSRRAVEWYLFILRASVASSPNTTLVWCCHVTSPASFMRLNFIHHPSTSILSYHPTLNLERVSLFLHIAGCVVF

SEQ ID NO: 36124 - protein, 92 aa, A.fumigatus
  UNSURE (80): Identity of amino acid sequences at the above locations are unknown.
ALSCKELHVSDIPPQVLERADFTIPVEIEGQYHNIYVIKRPGVDQFMKRVGELYEVVVFTASVSKVSSPIPIALYGLSLXWTKVRRSSTRST

SEQ ID NO: 36125 - protein, 388 aa, A.fumigatus
ASIILTGSHPRCSSSLWYVDPGCKDDSDSPPQFKPEAAVWWNIPEFDLLAHNVTVPGASPVYPDVYCTADYSICQLITGEGEINAAVTVSSIAFSSLFDLTHTYFLIAGIAGINPKVATIGSVTFARYAVQVALQYEIDIRDLGPNYTSPYIPQGAYAPDQYPGSIYGTEVFEVNAELRSLAASFARAAQLADSDTAKAYRAKYVTNNGTYAAGTQTPSVVECDVSTSDVYFSGTILDDVFDNTIRVLTNGTGVYCSTAQEDNATLEALLRAASHNRVDFSRIIIMRTASDFDRPYPGQSAIENLLYADQGAFGPAIQNIYLAGIKVVQGIMDGWNKTFTAGVKPSSYIGDEFGTLGGRPDFGPGRTIARKEANALRKRGVAKRGRRL

SEQ ID NO: 36126 - protein, 190 aa, A.fumigatus
SPRAQRHRAWCFACVSRRLLHCRLQHLPAHHRRRRDQRSRHRLLDRLLLPLRPHAHLLPDRRHRRHQPQGRHHRQRHLRPLCRASRSAVRDRHPRPRTELHIPLHPAGSLRTRPIPGEHLRHRGLRSQRRAALASGLLRPRGAAGRLRHRQGLPRQVRHQQWHLRSGHADPFRRGVRRLDQRRLLQRDDP

SEQ ID NO: 36127 - protein, 140 aa, A.fumigatus
AIPSFKSPGTAALTAPGTRTCPSLLGSYPGRQQASHSRREERPGHAGLPSDVWKHQSTNPLACSHADPCSNSDLIFSVPQLVSFLSQGTTLPAGTIILTGTPPGVGAAKNPKEFLTAGDEFAVELLPHVGTLITKIEHQQ

SEQ ID NO: 36128 - protein, 119 aa, A.fumigatus
YVSHAAEMKLTIPNVPTLFLKPSTALADPWPAPTILPKITQVDNTGDYESEMVIVIGRDAKDVSEAEVLDYVLGYTAANDVSSRTSQMNQSQWSFSKGFDTSCPIGKLFRHSNHREPLR

SEQ ID NO: 36129 - protein, 60 aa, A.fumigatus
PPLVQGPVLVSSALIPDASKLHIRGVKNGRVMQDCPLTYGNINLRIHLLVLTLTRARIVI

SEQ ID NO: 36130 - protein, 229 aa, A.fumigatus
PSSQINGGQFILYLFFGPETRYIGGDENPKEPAWKREYLSLRRIDLTPFMWYEFVKPLTMVMQPCIAIPAAAYAMVFCLSNVLATVEVPTLLERRWGLNPEQLGLQFLGPIIGSVLGEQLGGRMSDLWMRQRERKTRKRPEPEYRLWLSYIGYFLSIVGLIVFLVCTQLSGNRWEVAPIIGIAIGAAGNQVVTTVLITFAVDCYPEEAGSVGVFITFVRQIWGFLGPFW

SEQ ID NO: 36131 - protein, 230 aa, A.fumigatus
SRPMKVQLLMRHFNSIAEDFGVSINKASYLTSLQIAILGGAPLFWKPLSQRYGRRPIFLLSLMCSCVCNIGCAKSTNYASVAACRALQAFFISPASGKSCVDAGEEGSRLTTVTAIGSAIVMETTFKKDRAKYMGIWTLMVTVGIPCGPFIFGFVAHRAGYVWIYWVLAMVSWTHRPHSSPAAIDLHHRSMAVSSFCTSSSGQKPATSAATKTRKSPPGNESTFLCDESI

SEQ ID NO: 36132 - protein, 359 aa, A.fumigatus
PWGALFRWTDDSTWRILTHLDCADDDGLHHRRFFGSNAEGPKTAPKKQTTLSFSSKKDKKSDVVDEQAEARESSGIPEAKSEPANSEDVKMEDLSETEVAHMNGSPGSKSLKREKSSDEESDSDVQPLQKRRRKSSRGAEAAPTIRRESPSPMISEISKAEVKESSPPAILKKASGEETPEKETEHSEEEEVATASEEEDEDEKPEVMKKTMEKVQATLKATGTEPYPDWKPGEPVPYAALCKTFSLIEMTTKRLIILAHCSLFLRQVLRLTPQDLLPTVQLMINKLAADYAGIELGIGESFIMKAIGESTGRSLAVIKADQHEIGDLGLVAAKSRSNQPTMFKPKPLTVRGVQSSPRG

SEQ ID NO: 36133 - protein, 111 aa, A.fumigatus
GTGSPGFQSGYGSVPVAFNVACTFSIVFFITSGFSSSSSSSLAVATSSSSECSVSFSGVSSPDAFFKMAGGELSLTSALEISEIIGDGDSLRMVGAASAPRELFRRLFCNG

SEQ ID NO: 36134 - protein, 60 aa, A.fumigatus
RETRTDHVLYHYFSEMQPEEAYIAIRDFRSFNGQITTTDGTVIASSNITRGLRRFAMCVF

SEQ ID NO: 36135 - protein, 241 aa, A.fumigatus
CSTADTQCRASWQNLHSQSKMKSYLLFVAVLLQAVLVRTAALHPSSRRTCQTSLRNCPEGTVIVSKSHPKAHFSTVQAAIESLPNDNSKQTILILAGNYTEQLNVTRSGPITLLGQTDSVTDASKNKVTITWAQANHDNTGQSVDNVFSSVLVVAPTLEASYTGSGPTGYPVPEDTPFGNTDFRVYNIDFRNTWADYSDGPAHALSFSRANGGFYYCGFYSYQDTVRLFAHASSRLQGWTN

SEQ ID NO: 36136 - protein, 288 aa, A.fumigatus
TMSFPACWSLHLHSRPATPAQAQRGILCRRILRSVTPISGSTTSIFATHGLITPTDRRMLSASVAPTAASTTADSTLTRILYVSLLMLLVGCRDGQTDHAQVYVGKLGNAYFYKNIIAGQTDFLYGFGTAWIQSSDILLRNCGGGITAWKGTNTTFENQYGVYIVDSTVRAANAFIAPVIAGKCALGRPWNSLHRSIFANTYEDGSIEPSGYIDWVVSGVSRFTNQTVMAEYKAFGPGFNATGRAEGGVTIVMDKKQYKRYDSPAKVFQSPDGKTGNIGWIDFHADRV

SEQ ID NO: 36137 - protein, 63 aa, A.fumigatus
  UNSURE (7): Identity of amino acid sequences at the above locations are unknown.
AILRDRXPVGPSSPVVKTAMLVSPVDIRQCLRFKHCQPRGYSPGLFYPGFCSPQFLQISPEAQ

SEQ ID NO: 36138 - protein, 77 aa, A.fumigatus
DSHAHSLSSPSTSSSPFPQTPAAPRPTGASAPGTPPRCQPTHGTPAPSTRRLPSPDPLPAQSDNRTSHSTLPPSPST

SEQ ID NO: 36139 - protein, 329 aa, A.fumigatus
DLSQVQFSRHVLSLFSSNLRSKSVKMAMDAKEIELKAKALTKAATQNEPAANIVSLLKELQSGVKATEDLLRSTRVGIIVNKFKQHKSPEVARLSSEIVSKWRNEVNKHKASGSPSVSQRSSGSPRPAQNGTASPAGTTPSDKLSKLSVPPDKRTWKADGVDINQTSNKIRDSCIGLMYDGLCLNSTESPRAVLSKASAVEAAAFNALGPETKEQYRTKIRSLYQNLKNKSNPTLRVRVLSNEVTPEQFVKMSHDELKSDEQREQERRIQKENMDKAMVAQAERSISTSLQCGKCGQRKVTYTEAQTRSADEPMTLFCTCMNCGKSWRQ

SEQ ID NO: 36140 - protein, 206 aa, A.fumigatus
KKLSVIMTTAKTYTRSALVQPTLALCDAFASAAPVPVLLSHFTADPLPMVHEHGLPVLAPFLGRTFTGTDGVCRYFELIADLLSFEKMSFDGEDEWIVDTVSMAVSLRGRARFTWKETGEGWNETFCYRIGLAEDQGKGGGGLKVQEYRVWADTGAAYLARTHQLGEVQREFAERETKKSMERTRSGHGNLIGEGQRVYSGGSGTA

SEQ ID NO: 36141 - protein, 107 aa, A.fumigatus
HRGGVPGADAPVGRGAAGVCGKGDEEVDGEDKEWAWESYWGGTEGIFWGKWDGIDEYIASCDIDSSIWLDISKLRQAVSVKLDAIRVEIDPADVARLAVRRLEYLRW

SEQ ID NO: 36142 - protein, 470 aa, A.fumigatus
SIDKADSGHTAMALQNVIDYLELIKASELPSVLEEHWRRVQAGYILSQSLAVSPCDSRAVSGSSSPSNSRRVRQIVPTDSLTRQIIEIFKGKSTVSPKYHCQSKVKIGNRTLAEWLDSTLWMHDDEQKHIELLGALAKSKRWVQPGMGSASKLVQELSWGGRMFGAFTNDELDALIAWIDLLDPENSSWLYYRFTLRAPVASRDVVGGLQDPTCHHLTLPARNADETIDGAFMEKLPDCRLDTECPDQKTPLNTPSKTQLPDIVALWFAHIGLLENIINVPARTATSLYSGILLALRAQAGFAAEAHVPAGMAEVRRQPACSLVDIGLEIISRAQWTRDGNPSCLKDVFVLARKQGQSAESIKLSDNMLRWANRPNENFGILVGLALAFLGLKEAIAGSHELLSEESQAALKAIIKREQKGLFSCMQEIKSTGDGRYKDIEKGYCLGRSALEKLLGKTAGVENTLLMRTA

SEQ ID NO: 36143 - protein, 179 aa, A.fumigatus
TNMALDGRSPSPSISDLECACLYFAYGSNMNLTQMAQRCPESVIFAKGALCNYKWQTNSRGGGNVIQGNTEDVVHGIVFIISSSEVEALRRYEGVDKQFFVEKKLVIELEAISDPRFSRQKTADVVKVLATKDSDYGKHTILATKRPTSSDEICQVETRLSGTLTLKRWDLVDILTDHA

SEQ ID NO: 36144 - protein, 540 aa, A.fumigatus
YRLTRTIMAPAAGPRTGKHAKPQRSKTLKRKRGQEELSSLIQRVEDLDLKGIFKSFSDLPLSEPTASGLASSHYKTLTDIQSRAISHALKGRDILGAAKTGSGKTLAFLVPVLENLYRKQWAEHDGLGALILSPTRELAIQIFEVLRKIGRYHTFSAGLVIGGKSLKEEQERLGRMNILVCTPGRMLQHLDQTALFDTYNLQMLVLDEADRILDLGFQQTVDAIIGHLPKERQTLLFSATQTKKVSDLARLSLQDPEYVAVHETASSATPSKLQQHYVITPLPQKLDILWSFIRSNLKSKTMVFLSSGKQVRFVYESFRHLQPGIPLMHLHGRQKQGGRLDIVTRFSQSKHCVLFSTDVAARGLDFPAVDWVIQLDCPEDADTYIHRVGRTARYEREGCAVLFLDPSEEEGMLKRLEQKKVPIEKINIKANKQQSIKDQLQNMCFKDPELKYLGQKAFISYVKSVYIQKDKEIFKLKELKLDEFAASLGLPGAPRIKFIKGDDTKQRKNAPRAAAHLLSDDDDTDEEDGEKKSKKKEEPQ

SEQ ID NO: 36145 - protein, 198 aa, A.fumigatus
  UNSURE (3): Identity of amino acid sequences at the above locations are unknown.
RTXYDRMFERRNQDVLAEHYSKLINDDGTMVAPNAGAGADADEDDDFLSVKRRFDAGDKDLGSSGDEDDESEKGNKKNVKVVHIDGSTPLVIDSKRREKLLKSKKKLLKFKGKGTKLVYDDEGNPHELYELEDEEQFKARGDAKDQQAKFLAEEAERTRLADMEDKEIAKQKRREKKEKRKARERLHTRALEGTAIGV

SEQ ID NO: 36146 - protein, 279 aa, A.fumigatus
SFNKHRVTEACGIRKAEFTMSSDEQDALDALEKEASDFIKVCESCPSHNWRQTDICYDVGCGNRSHSKGFSIRCVSIILFLLFLDTFYAFYGLPTDNFAIRYAVLDLQPGVPESDIKLQYRKKSLLIHPDKTKNPAAPDAFDRLKKAQTTLLDEKARAYLDECIADARRLLIREHKYTVDSPELQTEEFKKEWRQKTVQVLLEEEARRRRQLKAKLQEEGREKRKEEEELEARKRKRELEQAWENTRDERIGSWREFQKGQKKGTDGDKKKKKKMKVLG

SEQ ID NO: 36147 - protein, 174 aa, A.fumigatus
LRLPPGIPHPMASTHPLHPYFPLMKARFDNDMYAHLNNTVYAMLFDSIVNSWLIAECGMDPFNRNKSTTSTGASDDDGAVSQQVGIMVNSYCDYFASVSYPDVLDLGLRVARLGSSSVTYEVGVFRRGEEDVKVVGGYTHVFCARETMRPAKGGMEERIRRGLEKLVVREGAKL

SEQ ID NO: 36148 - protein, 240 aa, A.fumigatus
QHRRLSPIIFFQPLRSLFEVRPSRWISIYDLAVFLSHFSNHKSSATERFLSNFHSSSPFSLIRPLPLFVIQISNTMAPNLFICLRAVFCPTYWFQRGERIQGSIFQEEHWESPVPGIYKYIPGRGWHLVQRDDSEYEEKVPVPLVYCRILHRYIFEHEMEDRCRWQSVTLHEGAKPERLLFFLLDDGYTWVAGWDAKGTFIPGPYQKWHYDHDTKTMQRVVSPESSNVSRCSSIVPTKMG

SEQ ID NO: 36149 - protein, 288 aa, A.fumigatus
YPCDRQARGRPRPRRRPVPLQLDRRDPALAARAGVRPPALQSPGPPDLRGDVHREAPQGRGRHHHQAEAAHRAKGVHRARQGPLPRRGGRLRPAHHVRQPQARAQPRARHRQGRKDQVPPASVLSTCLARPGTRRGRSDRQRRPARDAAAAPRQRIGRLQHRALPPADGAHAPDPRAPAVPGPPDHQRPDLLQPAGLRPGPRPQRNHRRARPRDHGPAVRNGQDRSCRYDHVPHAPDDRAARTAGHAPVRRRGDHVARARGRRARLPQAQGRAPLRRGLRRLRHGALL

SEQ ID NO: 36150 - protein, 83 aa, A.fumigatus
MNHSFAPSLTTNFSNPRRILSSIPPFAGLIVSRAQNTCVYPPTTFTSSSPLLNTPTSYVTLDDPSLATRSPRSSTSGYETEAK

SEQ ID NO: 36151 - protein, 425 aa, A.fumigatus
  UNSURE (404): Identity of amino acid sequences at the above locations are unknown.
TRSLMQMQVQALADGKVTVNGKTAAPDTVIKNGEVISHTLHRHEPPVTGHEIGIIHEDNDILVIDKPAGVPVHAAGRYHYNSIVEILRSQRGQEFVPRPCNRLDRLTSGVMFIAKHPKAADAITIKLKQRTVQKEYIARVKGRFPDGVVVCDQPIMSVSPKLGLNRVRATGKDAKTKFRRLAYYPPASPAPERDEDEVTASGDRPATPPPLLANESEGYSIVHCLPLTGRTHQIRVHLQFLGHPITNDPIYSNRRVFGPDLGRNETTAERDQEIMDRLSEMGKTEVADTTTYRTHLTTVPPVPPGTHPSVVEEIMSREHEAAVHDYHKRKGERLSGEVCDVCGTELYSDPGVHELGIFLHAVAYSDLEGQWKYPYKMPSWAMPPNGLDGPREAPDWVPCPRKKXDIVFGPDARFPRGIVVQAFLN

SEQ ID NO: 36152 - protein, 180 aa, A.fumigatus
TCILFFYYRYVYNEIIQLLAYVLSRSDLPATLIYFLIFFFGGYFLPSPGHSRTRTHTITGSSISPLAPSPRITAYLLRRGRIPASSMAVVPVDTTLKVPPPDPVEEPPKVAVTPCDPWPIPYYFEGGLRRVKPYYYTYNTYCKERWRGRQLQEIFTSEFRDRPAEYYVGRQPVNEIERGR

SEQ ID NO: 36153 - protein, 127 aa, A.fumigatus
  UNSURE (108): Identity of amino acid sequences at the above locations are unknown.
RPCRPYRRARTRPSSRRSCRASTRPPCTTTTSARASASPARSATSAARSSTLTLASMSSASSCMRLHTLIWKASGSILTRCPRGLCRPMGWMGRVRPRTGCPVPGRRXILSLGQTPDSPGESLFKPS

SEQ ID NO: 36154 - protein, 277 aa, A.fumigatus
SFSLPSCKASSTMTLPTNNAEWGAVISSYKDQLPEVYPVYQTPLPSSVNRYIDHTQLSLDATDEDIDKLCAEAAKHNFSAVCVRLRHVRRAVTNLQGSPECTVACVVGFPEGTHDTMEKEKEALDAAELGASELDMVINWPKLKEGQYMDVYTDVLEVRKGAPSPVKLKVILETSQLTKDEIIAGSVISSMAGADFVKTSTGFKGAGANVDDVAMMRAIVELVGRGTKVKASGGVRSAEDCIKMLKAGADRIGTSSGVNIINQLAGKETQPTTPAAY

SEQ ID NO: 36155 - protein, 193 aa, A.fumigatus
IPACTYTRLAVMHAWPACRHFSAISWSRAWSRFASSNTMKGQFPPSSRVTFFSPSAQCAAISLPTRVDPVNVTFLTSGCLQSASLSEGVFSRSVVSTFNTPAGKPARCARCASTSVVIGVSGLGLTIIVQPAAKAAPALRRTMAMGKFQGTRAAATPMGCLTVKTRRLGAEGTLTVPWMRSASPANHQVKPVA

SEQ ID NO: 36156 - protein, 159 aa, A.fumigatus
SHANAPSGKLTQFSTTYKNLLVLPFDSQGSSFGDQILVDSHLFPTLLAVSRLLDAAKRRLRSRRITRVHANHARLKILQHPPHTVNILGKRVAGQAHACIVGHAHGLLLRLKPVQRRNGCKCLLARHQHLLLHPCQDGGLEEVPFLPRNLSAAEDDIRT

SEQ ID NO: 36157 - protein, 157 aa, A.fumigatus
PARIFDLLPRLVQAPRCREGAHSSALLRAVADDQLLRAFLEHLCEFIVDPCLHVHTVGSDARLACMPPFQRHQLVQGLVEVRIVEHNEGAIPTELEGHLLQPLGAVRSDQLADARGSRKCHLFDERMLAKRLTQRRRVFQVGGQHIQHACWETRALR

SEQ ID NO: 36158 - protein, 175 aa, A.fumigatus
VRQHECRDRSLRARLDDHRAAGGEGGACFTQDHGDGEIPGDQSGGHTDGLLDREDATVGRRGHAYRTVDALCLASKPPGEARGVVDLPVRFGEGFPRFVGENLGEVGPRRPYESVPFHEPLGALPGVGLLVGFECFMGGLDGGIHVFHAIGRTTGPGCVGTGVYPDVTVDSIRGE

SEQ ID NO: 36159 - protein, 467 aa, A.fumigatus
VYGNIRIDPGTDTPWASCPANGVEDVNPAVQAAHEAFETYKKTNPRQRAQWLMKWDALIRAARSDLAQILTHETGKPLAESYGEIDYATGFTWWFAGEAERIHGTVSVPSAPNRRVFTVKQPIGVAAALVPWNFPIAMVLRKAGAAFAAGCTMIVKPSPETPITTLVLAHLAQRAGFPAGVLNVLTTDLENTPSLSEALCKHPLVKKVTFTGSTRVGKLIAAHCAEGLKKVTLELGGNCPFIVFDDANLDQALDQLMALKWRHAGQACITANRVYVQAGIYDKFAQMLKERTEKLVVGHGAQEGTTMGPLTTPRGLDKAREQVEDARRLGADVILGGGQVPGQKGYFFQPTILTGMKEEMLVSREETFAPIAALYRFETEEEAVRMANNTSMGLASYAFTKNIDRMWRMLENLEAGMIGMNTGNASAAESPFGGIKESGYGKESGKEVAVNEYLITKTGTLTIEGQY

SEQ ID NO: 36160 - protein, 97 aa, A.fumigatus
SQIFASEQRKIEGRGRAHHSVSRTEARSKEANRPEGANGRTITREESKKRIESQERKQKEGRAGEEREEEEERSQSKSGDHRSRGKIPDDRYRSYPP

SEQ ID NO: 36161 - protein, 168 aa, A.fumigatus
RGTGEKKGEEKEKADSHRYSQVNKGRSKAEEGHTTAFPERKHGPRKLIDQKEQTDGQSQEKKAKSGSKVRRESRKKEEQERREKRRKRGVRASQETTGAEAKFRMIDIDHTLRRMEQLLNKNLLEKSASKAEAAKKEQTEIKRHRKNENHRAGHHGMGKMRPHGANWP

SEQ ID NO: 36162 - protein, 131 aa, A.fumigatus
SPKFNMPEPSLEAQSLTPDAVRSAYALIQPYVHRTPLLTCQTLNNIASTPQSAESLVGTPFEGQTPANPKFRFFFKCENYQRIGAFKPRGAFHALLRLLAEWGEEEVKRRGVITHSSGTQIYPTLLKLRVS

SEQ ID NO: 36163 - protein, 282 aa, A.fumigatus
GFHDADNRIGNHAQALALAASTLHVPAYIVMPSISTPSKIAGTRSHGAEVIFSGSTSTEREAVVAEIQAKTDAILIPPYDHFDIICGQGTTALEMEEQYRALVADKPHLSAHAGGAEADSGSRHLDAVITPLGGGGLNAGVATFFSGKPTRVFGAEPSFEGADDCRRGLEAGQRVESVKTLTIADGLRTPVGVLNWEVISDRSKVAGVFAVTEDQIKATMRLVLERMKVVVEPSAVVGLAVCLFNEEFRRLVEKEAGPDGWDMGIVFSGGNTTVEAIGKLFS

SEQ ID NO: 36164 - protein, 228 aa, A.fumigatus
  UNSURE (7),(29): Identity of amino acid sequences at the above locations are unknown.
SPRARPXNFPHGFSPVFKELTKVDVPKDXDVIFVAPKGSGRTVRTFFREGRGINSSIAVYQDVTGKAKEKAIAMGVAVGSGYLYETTFEKEVYSDLYGERGCLMGGIHGMFLAQYEVLRERGHSPSEAFNETVEEATQSLYPLIGANGMDWMYAACSTTARRGAIDWSSRFKDTLKPIFNELYDSVRDGTETKRSLEYNSQKDYREKYEKEMQDIRDLEIWRAGKAVR

SEQ ID NO: 36165 - protein, 709 aa, A.fumigatus
VPLVERWYPRTLIVCPGTLIQNWISEFNRWGWWHVDTYHGDNKELALQAARSGRLEILITTYGTYLHNKDAVNMVEWDCVVADECHIIKERSSETTKAMNVVNALCRIGLTGTAIQNKYEELWTLLNWTNPGKLGPVTTWKRTISEPLKIGQSHDATLYQLSKARKTAKKLVENLLPQFFLRRMKTLIADQLPKKSDRVVFCPLTETQASAYENILDSDIVQYIKTSSDKCDCGSGKKAGWCCRQFLPSGGRWQNYVFPAIAILQKLSNHLATLIPQGADSLEKQEKDKEMLEIAVPDQWEQLYRTRDSIVNYANPEFCGKWKVLRKLLKWWHANGDKVLVFSHSVRLLKMLQMLFHYTSYNVSYLDGSMTYEERTKVVDEFNSDPKQFVFLISTRSGGVGLNITSANKVVVVNPNWNPSHDLQAQDRSYRIGQSRNVEVFRLISVGTIEEIVYARQIYKQQQANIGYNASSERRYFKGVQEKKDRKGEIFGLDNLFEFKTNNIVLRDIVNKTNVAESKAGVQVMDLAIDESDTKTTTVDSSSETKNQDDQVMSQLAAMIRGDADDAALQAQAAVTAQKHDPIQAILAGAGVEYTHLNNEVIGSSKVEERLSRRAELADEKLGEVQVFGSSQDRTEQGGILDKDGRPIRYKFHPPREVMKRQFCSMAKRFGFASATEFALVVEGMTQAQRRACLERWYTERREILLGRR

SEQ ID NO: 36166 - protein, 222 aa, A.fumigatus
KMEAHLRLSTAPSPFPVISFGTGSLVRLPGPSITQPNVYNFNTTSYSQMYDELLAKDERLYRNNGLLNMLDRNRNLKWGPERFQDWVPGMPRVDHVSKGDKGALGTEGGTVDVIITCEERCWDAVVDDLMNKGAALNRPVHVFNVDIRDNHEEALVGGKAILELATRLNDAATQERKIHGAEGWENGNGEARRSFDERVPEILASWQEKWPNLPALWTLAWL

SEQ ID NO: 36167 - protein, 78 aa, A.fumigatus
YTNITKQPNKCCFVNPTPTKQKGISQTKPPIRSEAVFQSHNIISGLEVSPVARYTTAPNTPVSEPASYPPPQVQTQWH

SEQ ID NO: 36168 - protein, 74 aa, A.fumigatus
ARSCKLLLKWTDCPEDYTEFASPFKEVSIAEWIERALQAGIDSLITGYLEAKVIKGETIRFPSMGDTGRLEDLA

SEQ ID NO: 36169 - protein, 102 aa, A.fumigatus
LLRHCLGINPTKNSWLPVHQVQVCGRGFALSGKYLFPRFPTVHNTGFSAHAGSFKPTVASSNSPKYRCGSGTSIADFPVLRFHDRGWVAYPTFMSRCSFSAI

SEQ ID NO: 36170 - protein, 424 aa, A.fumigatus
  UNSURE (315): Identity of amino acid sequences at the above locations are unknown.
LVDSVSPFRMKFLQRSCLSLLVSLSSSLSLPDGHGRHDIIPKTVVIDGTRLVENKLRLRAGDASLTAALGHLTAEADRWLSQGPWTVTAKTQAPPNGTIHDYASQAPYWWPSNTTDGCPYVNRDGERNPEVEKYPDHSGRDSMFRSSYILSLAWYYTGQAKYAQRASLILQTWFIDPATAMTPNLRHAQIIPCRNDGRSIGIIDFSMEYSNVLDAAVILASTNAPGWTRANQRAFMNWNRQFLDWLVNSPFGKEEASHENNHGTFANMQIAALALFTGNTSLSRKTSQGAKSLIDLQIRPNGSQPMELARTRSWXYSNFNLGAHVRFALVAKKVGVDLFGYKGPDGQSLFGATNFLLKAAVEGKSAWEFEELEFKPYAATDNVHAAADAGDSRAKAAVPRLHPPPTGDIYLLRPAAEQLDNIAG

SEQ ID NO: 36171 - protein, 279 aa, A.fumigatus
SRFNWSRGPKRKYTRTDLQFSSRHLQDFFNASDQVGDFESGVDVVTEDSVLQSLQQWATNTHSQMLAVGGSPPTTFPNTVALFSACFATFARQARLPVISHFCSLPTQSTDALTLFQQGLIALAYSLIRQLIDYLPPVVESHEACDLCLERFTSLNGTLSSWKTLLSLIDALLHYAPPLLVCVIDGLDKLQDESTDAHIRELVRTLMIHTRHRVDDTADGSWNQKVLLKVLFTVADRPSSLVETMSENQLILSEPKGADEPIPTDTTPASGVGVVMMNA

SEQ ID NO: 36172 - protein, 199 aa, A.fumigatus
RTTPTPGCASSPSPGSAQPTASQPKSTSSTPAARPRNPTATTTSASRPAPPPPASRAPCTSPRSISRCKGPSRTAICRRAVGRPASSPSASALSLGTSRGGAKSSGRFSRRTTLRCRWSSGTGCFSTRQCFMRRGRMRWHLRMGRAGVSSARRTCCRLVVRLARQWRVLIRCRLWRGVGGIWCGGGRRPEAGWMRSSRR

SEQ ID NO: 36173 - protein, 467 aa, A.fumigatus
LPEHVVGVVSICGVQFHLFPAVLSTMIRSSEFRTEAEIGLKSPTSSRSVVHPDDLFRTSATTLCEMNGNHLATSRLFETTPRIEDFKEICSQTTDKASYPLSSRIEKNIPIYDITTLDHLNGELTTCLQDEWHNALNTGPGIVVLKGMYHPTHHGPTLTATTEAFAHIIAQERRTATKKGDHFAASGKNDRIWNSFSKHALLDPRSFVAYYSNPWLRLIAESWLGPAYRITAQVNIVNPGGAAQESHRDYHLGFQAGTTTARFPRTLHLASQYLTLQGAVAHSDMPACSGPTRFLPFSQCFEPGYLAWRREEFRAFFQENYVALPLELGDGVFFNPAVFHAAGANEMAPEDGPGGGFQRKANLLQISCAFGKTMESIDTVPIVERCWGDMVRRWEEAGGRLDAELEALVMAVADGYPFPTNLDRRPPAPSGMAPESEQEIVLRGLKEGWGVDRVVEELKQMKKDSSA

SEQ ID NO: 36174 - protein, 154 aa, A.fumigatus
AYDRYYQTSNMLLIYQRYLLSDPRALPSAHSAGWFFKKLIYLLGPRLPIQRQIKHLNPSSSVSTPPPPCPPPIPPSTLGEQSPARSPVPSHWEPAASYLDSSETDTHPQQPSLAPRAPHPTGLRPPPTAAPYPPNTSPQSAPYQYSPLSCQTHN

SEQ ID NO: 36175 - protein, 64 aa, A.fumigatus
ELSIIPRVAASFIFKPSMIATMLLPARFDSTYFSENECSEEGWKATDSMCQSKSDMADIEKPIV

SEQ ID NO: 36176 - protein, 210 aa, A.fumigatus
PKLPGPAKTFSSLFSGTSSAGDATAHTVAPHNPFASISSPFMPFKTPVTEQTAPTLPAVSSSHQPTSIFSTGTYSLTPGKPDTAPASATSQLKAPNVFQPYTTPSASPFGLPQTPSISRPDQVPGPTAAQPSINIFNTGKPSSAPQISSSVFSLTGQNALLGKSEAENRQPSLFNSAKTTSAPSPFAQASNLFAPAKDGTFFCPTASLSV

SEQ ID NO: 36177 - protein, 110 aa, A.fumigatus
LDCPEIHQSRRQLCTILSIIKVHRIFHVGLLQRRFASSSLTRHLTTTSAVERARKAITLSCLAQVSRLQHRGMRIATLQFAPKVGDVEGNIKRTNELLNSGYATGIENLN

SEQ ID NO: 36178 - protein, 330 aa, A.fumigatus
DEQLLSDIRTPKQFFQSTNILIRYILGGPEPLGLMHKFVWDRTRSIRNDFSVQQLTQEEDVKIAVTCLERIARFHIVSLHLLSSPANEEPFDRHQEREQLNNTMLSLMYYYDDNRGRITFPNEDEFRAYYIIFSIHDQRPDLEARVQKWPAELRSSPRVQVALELFAAAGNTWEYQGTLDAKRPNAIAQGFYERFFNLVDSPAVSYLMACVAETYFNHMRQTAIRSIWKGYCRYPASQQHKNEEWTVDELTNVLHFDDESQTIEFCEEQDLQFAENAHGNLYLNWGNRPVDSIGTCALDNTIAFFPSFTALFRPIGLRQSYYRLLNIGHI

SEQ ID NO: 36179 - protein, 98 aa, A.fumigatus
CLAGWCLYGVSRIGFKPAQRIHRTFAEYNKRRSGTYAKQPDFFDCTNDQYNPNFRGRPRPFLPCSLALVQPVTQRRTQLRLITHLPAYHRRLCHSRRR

SEQ ID NO: 36180 - protein, 61 aa, A.fumigatus
NNPCSVGRVNFRLPEPKGRTYEEPDLLFEQEVSARKFRETVVDPYAGEEEHVEVREEHHKD

SEQ ID NO: 36181 - protein, 138 aa, A.fumigatus
  UNSURE (14): Identity of amino acid sequences at the above locations are unknown.
SMPSNTFVWREGFXHRVALGLMLAPRVPPGRVYFKSIDAAHRQISQIPSSFYLHTDHHHHHHHHHHHHHHGLRTHLRSPPAPPRRAISHQHRQSRACPGRAVLQLGLSPTVNPKTLRRGPAEMVLIRLQSPDCLCPCA

SEQ ID NO: 36182 - protein, 138 aa, A.fumigatus
QIEKIFEVACTLTDVMACLSTAGLRSSGFNLGPQDYLKHFFSLVNTLPGGRQRFLPLLLTKVGQTLPSMLQPVTQHLNLPAATVETLVPPEKAEPEAFGDTWPDDQSYSDFNYAEMSRIGDKTPEIDEAFMQYLQSSP

SEQ ID NO: 36183 - protein, 214 aa, A.fumigatus
VLCWPHGSLLAVFILNQSMPLIVKFPKFHPLSIYTLIIIITIIIITIIIIMASGLIFDPLQLLRVAPLATSTGSLVHALVELFSNSAFLQPSIRKPSDAVLPKWYSYVFNRQIVSVLALNLTTISTGISNILLSRSRSALPLSRTTFYWAGVAGAVAHLFFVPFVAPRIQRIVEDSNANGPTVDMEDWLGFHRIRMLVADLPAWLAFAGAVMVV

SEQ ID NO: 36184 - protein, 499 aa, A.fumigatus
ELRPPLHCLDTGYSWRGMTRKTSTFSPFFDPPHNFSQIIATSNQTCKMPRDTQMVKQACDACRRRKVKCNAQRPCSQCRSAGLSCRTSLVRQKKGRQGRSANVLSELRTQNAQGNEPPDPTIASLTVAASIVSPPGGRCRFARKENVLPRELIRDCSEYFFARMQGTVPILQAETFQRHVEQMDHCIHAYCLVVAFCAFVMMQTGYSSAQAAGSRWTRSMDAGRELLEEATEARKHLDPLTVPVRQSITIAFLLYGCHIALGNQRHAYYFLREATTLYTAGMLDTQSDAEEGEEKLSSGKLFWLLLISERYFDWMAQVEIVLIRNRAHAIRRHRPVTLQVTANSPTLEDPSPDDTSCIGFRCLADLYRPFDESFLGLWNGTHATCSRESLILLDKHICDAVPPDLELPDIPMADLRVSQQWLRTMIWQLSTTVGFLSSKASHPCMEFRYPLQIARDLSLATWKLSTQSMETHGIGLVGEPSPLYTKMLINCDRLRKSSR

SEQ ID NO: 36185 - protein, 118 aa, A.fumigatus
  UNSURE (52),(62): Identity of amino acid sequences at the above locations are unknown.
RREEFSRRWSSSETAKSSSAANQTIFFGIQPTGVPHLGNYLGALREWLRLQXAAKEGTRLFXSIVDLHALTVPQDASQLRNWRKETFATLIAVGLDPNRSTIFYQSAVCSMNMGCKVY

SEQ ID NO: 36186 - protein, 154 aa, A.fumigatus
RLSIAPAKRVMSLKEPTLKMSKSHADRRSRIILTDSPAEISKKINAALTDSELTITYDPVRRPGVANLIEILSHFDGRTCDEIAMEYRSASLRALKEHLARTLSNHLEPIREKYLSLVGDQTDYLDSIAEQGSEAARANAELTMEQVKVAMGLI

SEQ ID NO: 36187 - protein, 64 aa, A.fumigatus
IRATHVPVGDDQRQHLEFSRNTANSFNHVYGPIFPSPEAIICKWFLLLAERSCVGKLTAINSAC

SEQ ID NO: 36188 - protein, 219 aa, A.fumigatus
RANMRHIFSLLSIVCLMVKHGACLTLHQRDVPAVVSLDIKRSIVSDPVVRDRVRRKRDKTIGQTLDNAVSNVTHRKLTFRFISRTMLTVNQETLYFCNVTLGTPGQALRLVLDTGSSDLWCNAANSTLCSDSNDSCNISGSYDPSSSSTYAYVSSDFNISYADGTGAVGDYATDILHIGGSTLRNLQFGIGYSSTSSGTPTTALDLANVCSTCTCIVLV

SEQ ID NO: 36189 - protein, 73 aa, A.fumigatus
SPPCPCTCILVIQSAEACLNMLTTLYGFAKQYGLNVRSPQITTLSHGYIPVESLGSHAILGDTQITYWSGSST

SEQ ID NO: 36190 - protein, 226 aa, A.fumigatus
MSLYATTLKSANSCLLTDQGCKVTAYDLRPFEVPDTIGESYARLNIQRGDISDEESIRSGIALAVKRFGPINILIANAGITDESHDYPIWELPLETWEKTYSVNVRGTFLTIKHFLRAARTAQQAMGRELENLAIVVTGSETGVFGQEGHAEYASGKAGLQYGLVKSVKNEIVRLNSRARINAVAPGWVDTPMIEGRLDDPKELWAEAQATYVLSTSLERLSLTKS

SEQ ID NO: 36191 - protein, 388 aa, A.fumigatus
FYSHILLTWTRQYRRTAHMNTTHRRRQAFYALPSSHWQMLAEPPFSLLDNFNRVDDAIDVNADIADSILAAGLASFGLPADPDPNDPRQNWHGTATSSDVNKAHSTIRQFYRDWSAEGRAEREICYEPVLRDLRDEFDTRHSDRNEIRVLVPGAGLGRLVFEICQAGFAAEGNEISYHQLLASSWVLNHTRGPQQHALYPFALHFSNLLSREQQLQKIMIPDKHPATVMMEAQAEDSSAFGTMSMSAADFVVLYNNPSNKEAFDAGATVFFIDTSPNLIRYIETIRHCLKPNGLWINLGPLLWHFEDGSNKGHGSGSDHSQGIGEPGNVELTEEEVCCLVDRMGFSIEKQLSAENRPLCGYIQDPQSMLHNLYRPSHWVARKNTEIQN

SEQ ID NO: 36192 - protein, 73 aa, A.fumigatus
YVPCNATVPASTFIWKFEDIESFCLVITFSIFSISFPVKGTAIDSSPRHGYGYPSPTQSLVASIVMYCTLPYI

SEQ ID NO: 36193 - protein, 74 aa, A.fumigatus
GPVQVVQHTLWILDITTQGSVFRRQLFFDAEAHSINKATHFFFCQFHIPRLPDALRVITSTAMAFVTTVLKVPQ

SEQ ID NO: 36194 - protein, 92 aa, A.fumigatus
  UNSURE (89): Identity of amino acid sequences at the above locations are unknown.
FHSLPAFVPNDDMHLITSNKSMTYDSAILPVRSYQLCLYSSPSTEEYTSRVAKILARRMSLPVYVGCSIDPRAPQLAVEEEIEGLSKMXDVK

SEQ ID NO: 36195 - protein, 396 aa, A.fumigatus
FPGCKTDEQLRTAPRPKTGFFHSLLSLLSLGRSNNGHALQKFEDSRRPPNSGNIDWVRLGDNQQSNKPHNSAAHDRKESESVSSLADGDGFIIGVQDWRDPDLVPARTISLPSPSSVASSAKTESGNSAKSQKKTSNSPKGGSITPGSGEYRSVDRSSDNEEVPSRDGSPVNSAGNAGSDKGWFFKRFFAPRRTEGANLYKPANNKMRRNTDQNAKVTEHEGLWVTLTPTSMSTSPFFDTLLVLVVSPLLTLTVVYALLLIRSRIRRRRWRAPKSIVERLPVRTYHTIPTPSSAASSSRSSSPGPVSPTSPLLGSRSRPELAPSRSSFLRSGTAEAKKTRNMDSAKGEKSGSASSVWRRKYTGRQVECVVCLEEYIDGQSRVMSLPCGHEFHAECM

SEQ ID NO: 36196 - protein, 211 aa, A.fumigatus
HIMQGILFFSYHKDLWRPFISRAVQTIGLGLGVTTAMFFFTYVPQAAIMTFTSGPLAPISAALLVLSESSTITNLLARSFVLADALTDTFDGTLVARGHTELVAKGRQIKASGGGAVSRLGRLLNRPLERMRPSALVRSLMLLPLNFIPVIGTILYVYMQGKKTGPVAHLRYFQLKGWDERKREEWVKKNQGGYTGYDSAWLLCYAYEIAN

SEQ ID NO: 36197 - protein, 98 aa, A.fumigatus
VDTCCLRASAPRSTISTNPPLFSQMLPPLARIHSPADTIPVRHLHQSIGKSKKPITVVRWTPEGRRLLTGGHTGEFMLWNGTAFNFETVMDVRLLPLD

SEQ ID NO: 36198 - protein, 470 aa, A.fumigatus
SFEQAHYDQLQAGVTSIAWSHSHDWLISGGQKGDIKYWRPNFNNVETIDDAHHDAVRDLAWSPSDTKFLSASDDTTLKIFDFTARTADTVLTGHNWDVKSCDWHPTKGLLVSGSKDHQVKFWDPRTARCLTTLHSHKNTVTTTRFSRVNSNLLATSSRDQTARVFDLRMMRDICILRGHEKPISSLTWHPIHSSLISTGSEDGSLYHYLLDEPNLPSGQVPTIAPYDSPDPANTPAQVIYPAHRIQYAHSATIWSLDWHPLGHILASGSKDNFTRFWSRARPGETSYMKDRFHIGEEAAEAQGTWSRGFGRRQMREEEEQEAQDEAESLVDQKNTTAQSLPGIQIAPPGLGSLQTGSGSLLPGIGAPQPAPQAGMSASMPQMDPGRLAAILSQQNPSQPQNFPSATGIPGFPMPPAMSGTPPLNIDLAELQKQLLSQGISPQNFASLAASLGSAGLPGLQSSTPDNTYRR

SEQ ID NO: 36199 - protein, 62 aa, A.fumigatus
TAPSLKSISLDLPSEIVEVTYMRPKYTPTRRSFNAPMQRTPTYGKQTFNSNLRDTDNHDGRG

SEQ ID NO: 36200 - protein, 65 aa, A.fumigatus
  UNSURE (52): Identity of amino acid sequences at the above locations are unknown.
SQASREYCAIPNRETSRHAGINARFDTPHVVSTEGQEQKYIRLRQSLLLLAXTICIANMPSLRKH

SEQ ID NO: 36201 - protein, 101 aa, A.fumigatus
RPNLGLMSGKRLAMQWRRWPDSTPITVCPTSWVVKKSSISNERSSLGDQWPELLGVLFQASQSPEAGLREAAFRIFSTTPSIIEKNHEDAVCRCVRQGFQG

SEQ ID NO: 36202 - protein, 109 aa, A.fumigatus
RAINMSLLPPEVHSALSQLLRALTTPDNAIRTQAEEQLNNDWIQNRPDVLLMGLAEQIQGAEDTVVSDTSSVRRHGDRVWCRQRDSLEAFYLLRLEPCCRALLDSTDFG

SEQ ID NO: 36203 - protein, 136 aa, A.fumigatus
VIQVLSGDMGTVSGVGKETALKPSTYYDLSPVAAPCWIRLILVNLDPQTRTFAAVLFRRIATKTRKDPVTNEAKELFSTLSGEQRLVIRQKLVSCLTTESGSDVRKKIGDAVAEVARQYTDNGMPNFMGGEKEFHI

SEQ ID NO: 36204 - protein, 661 aa, A.fumigatus
VRIAAMEAFASFFRSISKKSQPKFFGLVPDMLNILPPLKESSESEELSSAFLALIELAEVCPKMFKAMFNNLVKFSISVIADKDLSDQVRQNALELMATFADYAPSMCKKDPEFAQEMVTQCLSLMTDIGVDDDDASEWNASEDLDLEESDLNHVAGEQCMDRLANKLGGQVILPATFAWIPRMMSSSAWRDRHAALMAISAISEGCRDLMVGELDQVLALVVPALQDPHPRVRYAGCNALGQMSTDFAGTMQEKYHSVVLNNIIPVLDNAEPRVQAHAAAALVNFCEEAEKKVLEPYLADLLRHLLQLLRSEKRYVQEQALSTIATIADSAENAFDQFYETLMPLLFNVLKEEQSKEYRLLRAKAMECATLIALAVGKEKMGQDALNLVQLLGNIQQNIVDADDPQSQYLLHCWGRMCRVLGQDFVPYLPAVMPPLLSVAAAKADIHLLDDEDQIDQVEQDEGWELVPLKGKIIGIKTSALEDKNTAIELITIYAQILEAAFEPFVLETMEKIAVPGLAFFFHDPVRVSSAKLIPQLLNSYKKAHGVQSPGFAAMWNRVAEKIIEVLSAEPTVDTLAEMYQCFYESVEVVGKNCLSPQHMEAFIESAKSTLEDYQVRVKARLEERADAEEGDEEDLDYEYAVEDDQNLLSDMNKAFHTIF

SEQ ID NO: 36205 - protein, 97 aa, A.fumigatus
NQGTTFLPSWQRLLPFYDAFITSQDPTQRRWALCIMDDVLEFCGPESWNYQDHIMQPLAACLRDENAANRQAAVYGVGVAAHKGGLALKRLRRCQHP

SEQ ID NO: 36206 - protein, 111 aa, A.fumigatus
KTMSMVFFLFRTMPVERFSFIPDIFVDNVHMELSLWDTAGQEEFDRLRALSYEDTHVIMLCFSVRLLRHLEGRRLETRPDHVLLLCRSIALTRSKMWRRNGLMRFARIAPA

SEQ ID NO: 36207 - protein, 76 aa, A.fumigatus
AYNSICEWEMLDSSLFYGRLIYSAVGPQSISDVSKKAQTSIFHVNTMYKFLSSPQSESTKIEPGKLTISKLQLPEH

SEQ ID NO: 36208 - protein, 90 aa, A.fumigatus
PCPSLVQVDSPDSFENVATKWIDEIRENCPGVKLVLTALKCDLRKDDELNDNPNAITFEQGLAKAKEIGAVKYLGERLSPMMSRRSPIDA

SEQ ID NO: 36209 - protein, 263 aa, A.fumigatus
RCRSSVFGSRLVLTKTDYFQAVEHYRELLTYVKSAVTRNYSEKSINNMLDYIEKASDDDRAFQCMEEFYSLTLNSFQNTNNERLWLKTNIKLARLWLERKEYGQLRKKVRELHRACQREDGSDDPSKGTYLLELYALEIQMYAETKNNKRLKALYQRALRVRSAVPHPKIMGIIRECGGKMHMSEENWEEAQSDFFESFRNYDEAGSMQRIQVLKYLVLTTMLMKSDINPFDSQETKPYKNDPRISAMTDLVDAFQRDDIHVF

SEQ ID NO: 36210 - protein, 88 aa, A.fumigatus
YLDTYLDSLLSTAALFTMSDDDDFMQDSGDEEYATHILHATSAVLVTDDDLGMILNTKTQTKMSRGTSESRTNTTMPNRSRSTIRRRL

SEQ ID NO: 36211 - protein, 138 aa, A.fumigatus
YCIFPQVLVSLSNLQAAVSDLTRAYINHTNTVLNPSLSTLDLGHASNITAALLENGLLGARSSSPGAKSEVGEKKKRKRAPPDPNAPKRALTPYFLYMQHNRPIIAQELGPSARPKDVSDEGTRRWAEMPEAQKEVCL

SEQ ID NO: 36212 - protein, 157 aa, A.fumigatus
HYRQVWKKLYADNLAVYKEKVKAYKAGKPWTEDDNTKAASQLQQDIAGASASGGEKSDEQEQEEEADEDEETEESSPEPVKEPTPPRNNKRRRSEVKTPSKRNESPEKKKRTSARKGNEKDKDDEPPASTRKAAAAGADASAKRSKKKRKSEVGGDE

SEQ ID NO: 36213 - protein, 251 aa, A.fumigatus
FPRRYVTGTCYRRHTSTSAVKSALTILHPQLDKLVISQLGFLAQRRLARGVRLNHAEAAVWISLFSHCAIHLGGLSRLIPVQALISSNLQEVSSPHPSWKLDIMVAYSQQLIRDGHYSVADLMSIGKTMLGRRHVLPSVVHTLVELQVEGTFPTGTYLVTVHHPISSDDGDLEKALYGSFLPIPPADTFPDPNPDDYLPEKMPGAVLPVKNERITLNDGRKRIRLKVMSKGDRPIQVRSLPFHTHTRNKGF

SEQ ID NO: 36214 - protein, 371 aa, A.fumigatus
  UNSURE (370): Identity of amino acid sequences at the above locations are unknown.
VGSHYHFIETNPQLHFDRLRAYGYRLDIPAGTSVRFEPGDTKTVTLVEIAGNRIIKGGNSIASGKVDISRAEEILQRLQVEGFAHVPEPAPTADSALIAPFTMDREAYARMFGPTTGDLVRLGLTNLWVRVEKDCTVYGDECAFGGGKTLREGMGQSSERSATECLDTVITNALIIDWSGIYKADIGIKNGLISAIGKAGNPDMMDGVHPDMIVGSSTDVIAGENKIVTAGGFDTHIHFICPQQVDEALASGITTFLGGGTGPSTGTNATTCTPGPTLMRQMIQACDGLPINVGITGKGNDSGGKSIEEQIRAGAAGLKLHEDWGSTPAAIDTCLDMCDKFDVQCMIHTDTLNESGFSYTDGARRKRVNXL

SEQ ID NO: 36215 - protein, 366 aa, A.fumigatus
PPVLVQLQAGRSGTNLLLNTLATAVITLAGDPHVDRETVARLNHLAHERGSRRAGRRVRARRRTGPSAQKCGDARSKRFVHLLRADKVNVGIKSTGRHDLVFSSNDIGRRAHDHVRMHAVHHIGIASLADSRDQPILDTDVSLVDSAPVDDQRIRNDGVQTFGCGPLRGLAHALAKGLAAAERALISINRTVLFHPHPKVGQPQSDQVPGGGSKHPRISFAIHCERRDQRTVRGRRGFRNVSETLDLQALQDLLGSTDINLARSNGVAALDNAIACNLDQRDRLGVTGFESYRSPRGDIEPVSVGPQTVKMKLRVGLDEVIVGSDLFAVKNPCCAYVCGKATNEPGLGDRPCSSPSVGCACGHRSE

SEQ ID NO: 36216 - protein, 193 aa, A.fumigatus
CFLPSFSFRQRSTHGRTGRPPESWHLLRAMLPESCLVMRGGHSRRYLRILCRVMLCISRRAINSQQMSALSRSRMMHALTDRYSPPSVVRSHVSQACCLRTAGESLPINGTVDPTDENYLETHNVGLQGTHCVSGSVTGIVVSTGDATVFGRIAKLTSEPKTGLTTLEKEVLRFVALIVLIMLTMIIVIIIVW

SEQ ID NO: 36217 - protein, 103 aa, A.fumigatus
HVNRATWLRRDHPGWINVPTLIVECVSVAIAFIPEGLPIALTANLTITANLMSKNKILCKSLKTVETLGSVSVICSDKTGTLTKVIMHANRSNTPILAPRILR

SEQ ID NO: 36218 - protein, 90 aa, A.fumigatus
TAESTVVGAQPEKSIWLVVKASSMDDSINNVVSFQQKENKVADKVPSQLNHWVEFFFELREEGFIDVSGSLNWYLSHHRHSCWLKSYGYR

SEQ ID NO: 36219 - protein, 182 aa, A.fumigatus
ISDLSHLDWHTIAVEELQKRWQVDISQGLSPNQVQERLHQYGKNALSPLPHQWFWQIFGYFFKGFGAILLVGCILVFISWKPLGQPPALANLALAIVLLAVFFIQAAFNAWQDWSSSRVMASITGHAARKLSGHAWWSLPSISPDIVPGDVVHLKAGNKLPADVRFVEVSNDACFDRSILTA

SEQ ID NO: 36220 - protein, 154 aa, A.fumigatus
LCMLTDRILRSWPQESSADCQQNRMLVTDCAVSISTFTLDGARDEMVLKGKASAIHQLRAVAGLCNAAEFDAATMNLPVHGRKVIGDATDQAILRFSEELGPVAELRSMWKKTYDLAFNSKNKFMVRTFDLVDRAGLGHAMSPAESAQFGHDDT

SEQ ID NO: 36221 - protein, 77 aa, A.fumigatus
CVVLERGRPNSSRKNRFFELLALLMVGDTGETDFANVCLLSDRGWSMFMTTLCEVDPSYMGMIYVSNRCELFILLMT

SEQ ID NO: 36222 - protein, 68 aa, A.fumigatus
DSRVKVRSGYRCRKHIILKQLPVSRPDNSEDQWVRYVTVMRRLHDLGGDGYGTVAFMLTNAECGGQIF

SEQ ID NO: 36223 - protein, 65 aa, A.fumigatus
QKPPLWRRHLPIWVRLLLAKIIILPRDNYSSKIMIEFVRRGDLIHCRNSTHLQNSDRYGRFTLRL

SEQ ID NO: 36224 - protein, 326 aa, A.fumigatus
LSCSRDEFLQLYQQSQILVFVGETGSGKTTQIPQFVLYDDLPQTQRKMVACTQPRRVAAMSVAQRVAAELDVKLGEEVGYSIRFEDMTSSKTCLKYMTDGMLLREAMHDHDLTRYSTIILDEAHERTMATDVLMGLLKEVVQRRPDLKIIIMSATLDAQKFQRYFNDAPLLAVPGRTHPVEMLYTPEPEQDDVEAAIRTILQIHATEPEGDIIVIMTGEEEIEEAARKISLEEDEMEREADAGPLKVYPLNGSLPPHMQQRILEPAHPHRRPGGRPGRKVIVSTNIAETSLTIDGIVYVVDPGFSKQKMYNPRIRVESLVVSPSLH

SEQ ID NO: 36225 - protein, 126 aa, A.fumigatus
LNSSAEAISFTVVTPLICRTQIAMVDSRSDSEDRSRAKRQKMDKSETDPRNNPYLAHMYADASTNGNSSSSGTNPAFAKLKRHQTTAALAKEVEDGEINPLTGRPFSSKYFSILQTRRDLPVHQQR

SEQ ID NO: 36226 - protein, 66 aa, A.fumigatus
  UNSURE (44): Identity of amino acid sequences at the above locations are unknown.
PTALSLPKQLPPMSVQSRWHSEPVHLLTMDANTFIKNQKGYPVXSKAHQALISKFMRLRTPPWILL

SEQ ID NO: 36227 - protein, 406 aa, A.fumigatus
DVGPIPGVEASETSEATQSNLSSSEYPSLSQAAVSSKKFIDPTPHLSYIRNLQQRQPPRSAIERFGMGYQDYLQAPLQPLTVNLESITYEVFEKDPIKYEWYERAIAKALSDWAEQKKPTSNPDGRVVLAVVGAGRGPLVTRAIRASAETGVDIDLWVVENNPNAFVLLQRHNEELWGGKATLVQSDMRSWKGPQRAKDSGLPPAAVGHSLGIEDSLLYKPEPDQKGNTPAPESVKSMASSDLSSGMIDIVVSELLGSFGDNELSPECLDGITHLLNPVHGISIPASYTAHLTPISAPKLHAEVVNLSISNPAASETPYVVMLHAIDFLSTNQSSAGTTSGDSGNSYISQTRSSISTIPVPESTTPYVQTAWSFSHPNRDIPPQSPYTSIISNSHLPDGAWKITRC

SEQ ID NO: 36228 - protein, 226 aa, A.fumigatus
YDMLTTPITTPHFHSRVLSLLSGHLSKLRAVSSDPNGTLATTENTRPVIIPPLGPSDTHLTPNQTMSQLMGVTSPWIDLCSPDPLIADISRQVLMLEVAYAAFCGIGYVLIPGPKLHHGNLHSEGLVFYARAVQDAINLGPYIQFHIWLRIVDNPDLEVDSMGDLAPLARDEFLWGSDDGQSLKVDLFGTWDAWDVIRRTCKYHTRLFVGKNLFPVSAALDAFLHL

SEQ ID NO: 36229 - protein, 122 aa, A.fumigatus
NSSIVVYKDWGVADVLCCDEATKAQMKYFKILLGLLPTALADSIYVSPTGSSSGSGSITSPLNSIQSAVDLAKPGDTIYLRGGTYSPTSNIQITKSGTSSKPYILRAYEGEKVIIDGEALPG

SEQ ID NO: 36230 - protein, 71 aa, A.fumigatus
GNENRTPAPLDASLPNEDRGILHIQNANYWQFYDLELIHGPYGVYARDASNNHYERLITRDNYETGIGHCL

SEQ ID NO: 36231 - protein, 155 aa, A.fumigatus
LCRWGFSPFEGDGNGFKLGGGDAADKGPANHVITNCIAFGNVKDGFTDNSQPGDFTLRRNTAWNNAKVGFKFNTAVATLNGNVAAVNGESATALSSNQISSGNSWDGSASWSNSSFKSVDVSLVQGARQADGRIKASDFLLPKSGEAMGATTVWE

SEQ ID NO: 36232 - protein, 109 aa, A.fumigatus
  UNSURE (13),(21),(24),(27),(50): Identity of amino acid sequences at the above locations are unknown.
IFAIGFARHKTGXLSEVAQCXSQXGVXHLVHTRIAHHVQQPFIKNSFEYXDLPLEKKLEIEMFNSKHFLGYSRLGAETTASKTDYREQFDVSSHLLQSPRHALSRLTVG

SEQ ID NO: 36233 - protein, 262 aa, A.fumigatus
FATELPAPGPDEPVYRNIRGPNQWPAEASIPGFRKAIEAYLAEISPLAEAFKSLIAEALDLPSNALYPFFDHPPQHKLKLIKYPPPRSASQAQGVGAHKDSEFLTFLLQATPHSGLEVQNKSGDWIPAPPLDGSLVVNIGRALEAVTGGVCTATTHRVNLRPENFIDAEGKPLGPRFSFPVFQGMSLELCADDIHLDIPAHIRELVKDEQVRSDAEATFNKTFQGKTGEGTLIHRITSHQDVGRRWYPELLDWALKERQGSH

SEQ ID NO: 36234 - protein, 192 aa, A.fumigatus
LRDWYWPLPVDLQQTLLTRDLGFQLQGASSNNKVLYLDSYGNRDPRKNGESADGFACKEGSGEGNLLKGARLWNNVDDGLDLWEFKSAVTIEDTISWGNGYNRYAATCSLVKGNAADFVDGVSPPSKATATGSNSAAETQRIRALRTMLLPTALPLATSRTASRITRSRAISRSAATRRGIMPRWASSSTQL

SEQ ID NO: 36235 - protein, 62 aa, A.fumigatus
  UNSURE (11): Identity of amino acid sequences at the above locations are unknown.
IGVCSRDQTFXFAENPGSFPFSGPLSFTFSSRIIIIIIIIIIIIIIFPFISFTQRGTERKEG

SEQ ID NO: 36236 - protein, 987 aa, A.fumigatus
RIVQALALLRIAQHIKPDLGLDIPARAEGDGPGHVGIPAVPVEKEIGRFPVPGQFQDQLVCGRLGEKAAGHFGHHVPIQRFSRQLQHGGIAPATEALLVVVAVLGHIPFADLGVVGASDVLVPGNPFGGDGPQAEQQQSDEDVEHNEVDDHIVMAPVGHDRRDEQDGDAGEDGLAAREELGARVAETGERGEDAEVEGQGNQVEVEDDAGPGAFDGRHDDESHQPHGDREGETGDESDKDKHVGGGKRHGDQVVGPAAGDPGARRTRQEQRDHQRDGRTVHDLLGHVAGEVQAAAIQRQQQNVDQGGHRKDTEEGEALVPPHGLDLVVRVDIDLCPGIRGRHLRSAVDPVRQFPVLVVSSESTREQLPEGAGREVEVGFAARPKRKRLGEGGRLIGLVVEQGVAIRDFHVDLVKGAFAGGAEEGEREDIGIDVDPVFLDQLAQGVGDLSQIALAAFSEDAREDSVRFLEQGQARGRGRRTAPLIAVPVDAGLDQGLWREGSVEVRDGVELLELRQGRGIDELPADVPADRLGQFTLGVRQRKMLQQEQSLLGTQGVHILDEPAGQSDVFVHVLGPLRQSRLGFEADMTGETSRGEERVQHGAREALRAFRGKHFESVRVGLVDGPEADVGALAQTGVEAQIDAQGILGGKIGEVLDRRRQRGQVGPVRHGEFIVESSQEGAQLLDFVRGNRVQQSQRLQPLLGLEDLDKGHGGGFGSQGETAELLVFHAGHGDGQRAALRPDLGHPFRRITNRDRRAVHVRGGLSFGRGEHVGKRGKVLQQSGPCVSGPDLLLLEVQIGAPDVVDFHDLGFLQPTKGRQGLGNLDVERGIVQGRLAADPGDGAVEVAPLQRSLDDRIGQVSVVVDRLPGHDHEVAHAGFRHERFDGGLHLDHLKVVAFLAVRHDGGIADDETGDGIGLQSLMVLEEVRGRCLQIHGQAKGMESLGQYPDGGRVEAALPVGQEHAAERRAIEPAECALDSVDSRQSRP

SEQ ID NO: 36237 - protein, 1131 aa, A.fumigatus
VLIGLLLGSVVIGCSYLLYAGLSRARKWYQVGIRSMSSVDALEEIADILQSRAQSAVVPRNVLDRLDRLSRQQLSLPNVQWAKKPSSFGVYLGSFDASPTRDQSRLLSQWDLLIVDPAQSGVVEALSRAERKQFLGRVDVGSGSGSTLAAIDRIESALSRFDGAPFSGMLLANWESSFNPPAIRILAEALHAFGLPVYLETAPPDFLQDHKTLQTDAIAGLVIRNASIMPDGEKRDYFQMIKMQPTIKAFVSEACMRDFVVMAWETVDDNAHLSNAVIQRSLQWCNFYSAITWIGRQAALHDASLNVKIPEPLSAFSWLKEAEIMKVHDIWRANLNLQEEEVGPRDAWTALLQYFPTLSNVLTSSEREPPSHMDSATIAVRDPPEWVAQVRSQGSPLSISMAGVEYKEFGCFPLGSEATAVAFVEILKSQQRLKSLGLLHPVPSDKIQKLGALLRRFHDKFAVSHWPDLPTLPATIKDLANFASQDSLRINLGLDSGLRKSADVRFWAVYQSDADGFEVFASKSAQGLAGTVLHTFLSARGFPRHVCFEAETALAQWSKDVNEDIGLPRRLIQDVDALSPEERLLLLQHLSLTDAKSELSETICRYIRRQLIDAPSLAQLKELNTVAYLDGSLPPEALIKSRIHWYRDQGCRSPAPAACLALFQETDAVFTRILRERRESDLAQITNALCQLVQKDRIDVYADILTLSLFCAARKGAFDEIYMEVTDRNPLFNDQSDQAAAFAESFALGSRCEAYFDLSPSAFGKLLSGRFRRYYQDRELPDWINGAPQMATSYAGAQIDVNPDDKVKPMRGYQRFTFLSVFAVPALIDILLLTLYGRGLYLSGHMPEEVMHSASIALMISLLLSGAAGTWIACGGSYYLISMAFAATNMFVFIRLIACFAFTIAVGLVGFIVMSAVKGPGPGIVFYLYLIALTLYFSIFASLACFSYPGSKFLSGRKAIFACIPVLFISPIVTNWSHHDVVIYLIVLYIFIGLLLLSLRSVASKWVTWYQNIRRTDDTEIRKWYVSKYGNNDEKCFGGRSDPAVLKLSREALYRDVMAEVSRGFFSKPTTDQLVLELARDWEATNFLLDWYCRYADVPRPIPFSSGWNIQTKVGLDVLRNSQKGQRLHNA

SEQ ID NO: 36238 - protein, 188 aa, A.fumigatus
SSPASTGTAIRGAVLLPLPRAWPCSRKRTLSSRASSENAARAIWLRSPTPCASWSRKTGSTSMPISSRSPSSAPPAKAPLTRSTWKSRIATPCSTTSPIKRPPSPSRLRLGRAAKPTSTSRPAPSGSCSRVDSDDTTRTGNCRTGSTALRRWRPRMPGHRSMSTRTTRSSPCGGTSASPSSVSLRCPP

SEQ ID NO: 36239 - protein, 1155 aa, A.fumigatus
PLLKTPSAVIRRWVQAGGPGDEIRSFDVLTSLNPFQLSRKEREELYQVWTKDVTNLVYDKVMKLCSTHHMAKANLDNVRDEVDLRCLADADVIGVTTSGLARNLNMLRKLQSKVVMCEEAGEVLEAHLLTALLPSVEHAILIGDHLQLRPQVQNYELSRENPRGGEKYSLDVSLFERLVESQSAMGLGLPFSTLETQRRMHPSIAQLVRDTLYPQIKDAESVSSYPEVVGMRRRLFWLDHREQEADAANTGPLASSHWNEYEIQMTMAVVNHLVRQGRYHSGDIAVITPYLGQLHRLRQLFSQHFAVTLGERDADQLDSAGFGAGETDVTPAARATLLKTLRVATIDNFQGEEAKVVVISLVRSNSQNRCGFLRTSNRINVLLSRAQHGMYIIGNSETCAHVPMWAQVIDILRHSGNIGSQLELQCPRHPDTPLLVSTPHQFLQLSPEGGCNLRCINRLPCGHACEQKCHSELLHNAAYCPQPCPRPRKGCTHPCVKRCGDPCPVRCMVDVYKEDRKLECGHSMPNLPCWQDQDLSTVRCKVAVTKTVERCKHEIAVKCHQDVSLATFKCTAQCNALLACGHACKRPCHHCVQLLDREEVRIDHGRCQQKCGRKHSTCAHFCSAVCHGDEPCPPCGEPCDVQCGHSKCTKKCGEPCTPCAEERCFSRCPHSACTMPCAAPCNHIPCSKRCDQKLQCGHQCPSLCGERCPSDKYCQTCASEEIKHQVVDFILGETYENINLDENPCIFPRCGHFLTMESMDGQMALQEHYELDEQGRPMSIKDATRPFSMNDIKTCATCRGSLRDLARYGRLVRRALLDESTKKFILYLNREYVPLEEELARQVKVMQETEVANRKGPVWPDHLPLEGSIQQNIRTMTELVHHTSPGRWKDITKLRSKVVAYRKRVALDEQPYDRVRSMVENAKRRKKTDGDFDFDDTILQSKGLLLAIALNLRLDIALLTDFLSVKDRASSQTGKITVSISLQDARDECATLISLAGSSGRIRQQAEGYTFLAHLHALERSQASSPQAAETRLREGREAAAHARSLCVQHPTPTRGLLPDIETIDRMLRDSTFYAVVTNEERMAVMAAMAREFHGTGHWYYCRNGHPFTIGECGGAMEQTACPECGEPVGGRAHRVAEGVTRADDLEMAFGRMHL

SEQ ID NO: 36240 - protein, 176 aa, A.fumigatus
FVGINALIYYSPTLFETMGLDYDMQLLMSGVLNVTQLVGVMTSVWTMDSLGRRVLLLWGAFFMTVSHVIIAVLVGLFSNNWPAHRPQGWVSVAFLLFYMLSFGASWGPVPWALPSGTSTRPSIPTPSRSQVELTNNRGLSFLPPRQGCRPLHLLKLAKQLYHRKLPIICTASLTNS

SEQ ID NO: 36241 - protein, 84 aa, A.fumigatus
GLITPPLVENTGYGAYVFFAVFCLLALVWTFFFIPETKGRTLEQMDHVFKDNSSEAEKARRHAIEAELLRAEYEYQNAYANAAP

SEQ ID NO: 36242 - protein, 169 aa, A.fumigatus
RACLHRRVEKFCIVLGIVIAYWITYGTRFMAGEWSWRLPFLLQMIPGFVLAGGVLALPFSPRWLAAKGRNEEALQSLSKLRRLPPSDKRIRQEYLDIQAEVRFHQELNAEKHPTLQGGGTRQSFLLEMASWADCFKKGCWRRTHVGMGLMFLQQVSPPAFLALSPFGPH

SEQ ID NO: 36243 - protein, 82 aa, A.fumigatus
ARGDVCIQITSGQLSCNQIYKVYNTVTYSTMHQTKKISAKLVQIHELSKYKTTRLKRCLDMNPISLGSYIFQHERSGPFKLQ

SEQ ID NO: 36244 - protein, 137 aa, A.fumigatus
RHSLALTQLLDFNGPDTQPPTYILNHLQSYMNIWTDIVTELAEGTEGDPNDPRSGDYLIYWNNAPNAKYDGPEPPENERRRHWETSDVIHKINIRDFVRQHLHSLIVGCGGEQRFQEEWLLNVDREVVAAFAALGLF

SEQ ID NO: 36245 - protein, 284 aa, A.fumigatus
SIFMVVSGEEMLLQVACEAHMSPETAPGSQNGFDNSGRKGPIAWQQGDTVSQTVDAFRALAERYLPQSDVVTAIEALNEPNIPGGVSEAGLRNYYNQIADVVRQIDPDTSVFLSDGFLSTESWNGFKTGEDVVMDTHHYEMFDNYLISLDIDGHVKSACDFGKQIEGSDKPVVVGEWSGAVTDCTKHLNGKGVSTRYQGEYANNVKYGDCANTTQGSVADLSDQERTDTRRFIEAQLDAYEGKNGWLFWTWKTEGAPGWDMQDLLANGVFPSPLTDRQFPNQCA

SEQ ID NO: 36246 - protein, 176 aa, A.fumigatus
IVSFHSKCWIRFADCKSRRVVSRASTFDYNGIVRGVNIGGWLVLEPWITPSIFDNAGDAAVDEWTLTATLGQDQAKAVLSQHWSTFITQDDFQQIAQAGMNHVRIPIGYWAVSSLPDEPYVDGQLEYLDNAISWAREAGLKVVIDLHGGKWRRNVVASRMRSSYVPRNSPRIPEWL

SEQ ID NO: 36247 - protein, 380 aa, A.fumigatus
QVMTDRFARPAGSSDAPCDPERYCGGSWTGIIDKLDYIQDLGFTAIQISPVVENIPDNTKYGEAYHGYWPKNLYALNEHFGTADELRRLVSEVHRRDMYLIVDVMINDMAQAVNGSMKDDPSLKIDYSQLFPFDDEKYYHPFCAITDWTDPKIYKNCWFAVETVALPDLNTGDASVATMIGDWIKQFVGNYSIDGLRIDAALHMDDDYVEGFSKAAGLFTIGEVSNGDTSLVCKYENLVSSVLNYPLYYALIQAFTAGNMLGLAESIRAVQKDCKDFTLLETFVENHDLPRLASLTNDTTVGLDDCTRHFTSADRYELVGKERDGFQHTLRWHPPRHVPRHDPGGPQAALIDTTSIPRPRAAHVGQLYAFQPRRPLDNEL

SEQ ID NO: 36248 - protein, 102 aa, A.fumigatus
  UNSURE (54),(89),(91): Identity of amino acid sequences at the above locations are unknown.
TQPVYQGQEQHMSGNYTPFNRGALWTTNYDTTSPLFKLTATLNKLHNHALSIDXHYVTNPSIELHSDNSNVRHQGKAARDCRLVSVLPXPXAPMVGKLPTCR

SEQ ID NO: 36249 - protein, 495 aa, A.fumigatus
EYLGFLSWATPFLYSISFSLKSPSARFPTSSNNDMTEPTHIIDTEGEVIIFLKCPESPFAPWNDDVAEPEPLKSHGDVQKRDNGDNATQEGFNKKVTKKRLKKKNKRGNPMPLQSEMDESADNPAGTPEPADTAMVSADETVDDSVTESANGPTTEPLEEQLQEAQPNASLDGPRENGSEIDCEGALQEPASDVHMRGDCFRIQVSAKHLTLASPIFKETLSGRWKEGLRLLKEGSVEIPIRDWDLEAFLILMDIFHCQAQNLPREICLELLAKIAVLADCYQCQPLVRFFAEIWIGQLRRKIFPTIYSRDSMLWVWVSWNFRQLFEFEKSTSIAISQSNGLITSLDLPIPAKVISKCQALYPREPIITAPVGEMNRRRNDAISAVLSSLAELRDAFLDGSRGCCFECSSIMLGALTKHMHSSGLLSPEPAAPFPGLSYCQLVETVRGFRSPQWHSDSGYSRYSWHTCGEASFSSLITVPETYVKGLSLIAFSFP

SEQ ID NO: 36250 - protein, 76 aa, A.fumigatus
GRRAGSSSDGDDEEGAGCGASLHSDHHANLAFTWKEQGRIAEALALMNDCVQLQSKILGVDHPDTLILCYIDRLAD

SEQ ID NO: 36251 - protein, 151 aa, A.fumigatus
MRNFPQESMRIGCSVKYFSRMQTSAASQRPHERDSLLEWAAVCKAAWYDMQKGNGAEGERLSVKAMEALTKHLGPEHEDTLESGHMVGLIYTLEDRRKEAEELQMQVMKMRKKLLCVEHPDTLVSMGNLAWTYRNQGIKGDGMRQKSWEFK

SEQ ID NO: 36252 - protein, 554 aa, A.fumigatus
WPGDIGSQEGSSDDEMEDALRDADEAGNDNDADGDAEADQDAESPSNTSHASEGPGIASQANPDMPVTSPDSTNIISDLTSVFHPPVRPECLTASTYDIVPTTAAPHSTSINAVTATADMRWVFSGGSDGYVRKFNWVDSINSKLMLTVAQRHPFVDSVMKAGVLMTYWECMDGNAVSPVYSLASHSEGLWLLSGLESGSIRLQSVRHDEGKEIALLQQHTSAVSVLQLTPDEKSLLSGSWDKRVFDWDLNTGQTRRVFGASAGQIAAIEIRPESTIPVPTDTLELPQTNGTYSSNYHASGTDSFNFMDTSNDLGEGGAAANLQAGSPADSLFGAADSLFGDADGGGGEGGGASGNAFGIDEDDEFGKALANGILPDADADADAPGEPDVMDQQNGTTEGNASADATMTNPKSESLDTSINAPSQPVTNGLPHAEELKPPSQAQESAASTQQESSVVTDHTFLAASIDGTIRVWDRRQADPIARITPYNSPPWCMNACWSPDGNYIYAGRRNGTVEEFSLHKGLREPERTFKFPQGSGPVTALKAMPNGRHIVW

SEQ ID NO: 36253 - protein, 81 aa, A.fumigatus
HLLTICSSASHDILRLYDLKHEQVSRHSTVPFLIIPGHRTGTISQLYIDQACRFMISTSGNRGWEGNTTEVLLGYEINVPR

SEQ ID NO: 36254 - protein, 273 aa, A.fumigatus
  UNSURE (262): Identity of amino acid sequences at the above locations are unknown.
KVFDLKPPNLLIADLRHVASPASPLTFGLVVGATIDKSPSWHSLRATPCQPQLVFLLFIKLPSFSSWATLKSIFRFFSTSRPLVLMRVPFWDNRGYSGPLVRGVNPATLFEKAVRDRITDSYYWKEQCFGLNAATLCDRAVELTSIGGTYGVAEEPTPFLCLAFKLLQLNPEREIILEYLNYTDPGSDGETEATAEGQARNGVLGQRGDCKYLRALAAFYVRLTFDPVDVYKTLEPLLLDYRKLKRRVRATFVLTYMDPFVXLSQRRRIRAIC

SEQ ID NO: 36255 - protein, 385 aa, A.fumigatus
SCVAKIHVPLSFVHLRNIKPHYHAHFKLHTIMVLLTSSTVSVILSTGVVCLFTLLLFLSGYVLQQQSVRSIQSALRPPGVPDPVTGHGSAGSSFQKREQSTLSNLIPEEQQKHVAHHAQPGAGGNYAYLQLLSSPNPSDICSAILFFKQLATKGTAINDRLFMYPRDWDLLSSDKVSDSVRTALSLLRAASIKYNVWLLPIDMTAVTSAGYEPTDTKLLRLGQIQFMQYDSVLYVRTPGLLLDTGKLDEMLLSRPLPLKYDKDRPESFNNEAWIPMPLRADRDANLPPVYLITVNNVKNGQIEARGHIPNVALPGFGGLLTSPRGVHTLENKGNDPADEPGYVFFEQDGEGHVQWAQNPLFGAWRAQQHEVCEGVDFDEVAYDHD

SEQ ID NO: 36256 - protein, 244 aa, A.fumigatus
VVSPFQAILDYEIANNIPKGWVNFSISRTSPNGSWHRLERGEIKLDADFFKAFNRDLRNPYLWKKFHERLQKKQTTGVPISAPPLPEIDAEWLFWEMMRVSRTPDPYMYPALQKLKASGQFIIGALSNTVIFPDGHPYNSDSNGVKSQFDFFISSAHTGLRKPDPKIYAAALREMDTLAKKRGLQGVEPSDVVFLDDIGENLKAAKNAGLRTIKVNLGRTQDAIRELEKITGLQLLDTGDKAKL

SEQ ID NO: 36257 - protein, 74 aa, A.fumigatus
YFSNVLPTLRSVVYTGYFVVVVPPLVANLNLRWDAATLSETIHKVSPQNFQPLQSSSAANVDNSVFNLRQQSRW

SEQ ID NO: 36258 - protein, 301 aa, A.fumigatus
NHHLCVRRTNNLYHSRYQTKYRRRREGKTDYYARKRLITQAKNKYNAPKYRLVVRFTNRDIITQIVYSEITGDKVFASAYSHELKRYGITQGLTNWAAAYATGLLLARRTLKKLGLDEQFTGVEEPDGEYKLTEAVETDDGTRRPFKAFLDVGLVRTSTGARVFGAMKGASDGGIFIPHSENRFPGYDIESEELDAETLRNYIFGGHVSEYMETLADDDEERYRSQFAKYIENEIDAGDLEEIYAEAHKAIREDPFKKDEDEKPKKSKEEWKAESKKYKKAKLSREEKKARVEQKIRELAA

SEQ ID NO: 36259 - protein, 139 aa, A.fumigatus
RVLPTVVSSSPTPRTASPVTTSSLRSSTLRPSATTSSVATSLSTWRPSPTTMRSATAASSPNTSRTRSMPVTSRRFMLRLTRPSVRTPSRRTRTRSPRSPRRSGRPRARSTRRPSCLARRRRLALSRRSVSLLLKCVSV

SEQ ID NO: 36260 - protein, 561 aa, A.fumigatus
TSWAKVVYRFLMKIGTPSVGQIREKMPQFSHTKRAINVSAQDVHARAVAWYNLGWAEYRAQRCVQVHSGTKGKKPARRFLKTAMRCFKRAIELEAGNSEFWNALGVATTSMSPKVAQHAFVRSLHLNERSAQVWTNLGTLYLIHNDIQLANEAFTRAQSTDPDYSLAWVGQGFLALLFGDPLEARGLFEHAFDISNSSSTLPRRQYTLTLFDRLLSDSSASNEISQLIQPLFALLQLSSQDPSNLQFMHLTALMAERIGELSDAETSLHVVCSGVEAEYEVSESSSSLSRYAQSNADMARVLLARQEFEQAVEKAEVALTLSGEEDAEKFDPEANRKLRLSAHLTAGLAHYYLKSMDNAIDMFRDALQEADNAPEVVCLLAQVLWAKGGDEERTVARQQLFDCVEEHPDHVGAVSLLGAIALLDDDKDVIEAVASDLQNMIMRDDIDIHDRTRLTKLLTAISTLGLTEDSQIPEDVRRLGEATAAVMRSPGQPQGWQELAAASQDLYPAEMAVDRALRSVPPRSNLDAVDLCEAYAQTGKAGDAIKAIMVAPWKQMWMGRA

SEQ ID NO: 36261 - protein, 320 aa, A.fumigatus
LHLLSFTFLPPTVISFQKSLWCLSLATRKFCTAFIMSTLSSPRPSIASSRAHSPTPASSRRPSLDTLNSNVGGGLSASSTPSTVRAVSPSLHPRRNRAALRDYYNLRPSAADPLGNGSNFRSRSIPRHTDAGDMSSPSSVVATGTELDSPDFDPQRYVNHLLATSSLATVLKAENTLVGDIKTLDSERKALVYDNYSKLIRAVETIGKMRRSMDERGAPLTMTKTLGPAIAFVAETATGLIQEGEEQQRRMREAKATDGTDRRKAEKETVKWVLGAPSRLEKLLSEGKDDEATNDWEEIRNMLDKWQGVKGVAKVRQACE

SEQ ID NO: 36262 - protein, 74 aa, A.fumigatus
CNRALINIKLSTEQEAALIKYINILIKLDIPLWLKAISNIVNLILFYRYTNLITPPPLISMHWIKYFLKHYPEY

SEQ ID NO: 36263 - protein, 314 aa, A.fumigatus
FSGHLGWCGSLAVEPNNEWFASGAGDRTIKIWNLATGALRLTLTGHISTVRGLAVSRRHPYLFSCGEDKMVKCWDLETNKVIRHYHGHLSGVYTLALHPRLDLLVTGGRDGVARVWDMRTRSNIHVLSGHKGTVADLKCQEADPQIITGSLDATVRLWDLAAGKTMGVLTHHKKGVRNLAIHPREFTFASASTGSIKQWKCPEGDFMQNFEGHNAVINSLAVNEDNVLFSGGDNGSMCFWDWKTGYKFQSIDTMAQPGSLDAEAGIMSATFDRTGLRLITGEADKTIKVWKPDDEATPESHPVTWAPTLGRQRY

SEQ ID NO: 36264 - protein, 528 aa, A.fumigatus
PPMLLPNRDVRKLLLRRRTRGMDSCLNLWGKVDKLLNRIVVKKPLEFTPLGTRVLPPSHFDSPYRQARTLLHVSTVPTSLPCRKTEFDTVYNHLSAAIMEGNGTCIYISGTPGTGKTATVREVVAQLNAAVLAEELDDFIFVEINGMKVTEPHQSYSLLWEALKGDRVSPSHALDLLERDFSHPSPRRVSCVVLMDELDQLVTKNQSVMYNFFNWPALRHSRLIVLAVANTMDLPERTLSNKISSRLGLTRITFPGYKHTDLMEIISTRLANVPGNIVDADAIQFASRKVAAVSGDARRALDICRRAVEIAEQSSETAKIEDMDAEQNGDETESLPPTPSKTPARRQKPTSKHTVKLESPQKNAAQKQTAGRVTIATIKQAIQEATSTPLQQSLRSLPLSAKLFLAALLARVKRTGITESTFGDVIDEAKRIADAAAAGASTGIRDFLLAGNNGARVRALGFAAMELMNSGVLALENGAGVKGPLGGSVIPSRGDRSGKVRLRVAPEDVRAAFREDIEAKGLGLGMDQ

SEQ ID NO: 36265 - protein, 235 aa, A.fumigatus
RVLNSFFSFNAESRPELANPFPLTPQLKEMAVASVDEHESTPSRRRSARQRAQLWMTKGGLVRDDSDDELGDEDLPWHWIYDTEEEDTENKETTSATDEAETKSARRRAARPSVKRRRNIIGARMGSFECRLGQVVLLKSPEPGKDWVGIITEFLEEDDEEAEDGVVKSANIMWFASPDEFMSTKNKRRADALPNEQYLTADFNVNPLTSINGIATVMSKDVLFAKYPNGTPPKG

SEQ ID NO: 36266 - protein, 72 aa, A.fumigatus
EELAEFNKCIICRRGVNQLQGRYTDEFIWEDVYREDKIHDLITMVKDGLRAAKKRKQVDDDVSFSARVRNGC

SEQ ID NO: 36267 - protein, 303 aa, A.fumigatus
RAFRKFDMGSISEVEVMKPALNVPLDSQAALLRDRTERPGAVPGLRLNTVQHRQRISTADQIDFRVKLLRSLRLGWEKDDTEAKFLKLVDMVESDGCALFGGLIDPAIFENLVAKYDKVQSRSGNNAFMHSYVNLATEHDFFLGGNYIEAFSHPLLIALVSYLLGGSIRIVDFRGKDNDPMSINAQDNMLHVDNTPFKEEYKVLLNWRRGQVKGPSGQNFTFLPWTHKGNRDVLVDEEGLPWSTERDSLFVSHDAIDGLLNFQKEIKGISRVVEAKHPDQPLAVLFPAGALVHHRYRTTEGDP

SEQ ID NO: 36268 - protein, 143 aa, A.fumigatus
IFLSRGGPVFELRNGNVNFSPIGQGVNYAEMEEIQRYDKAHGIRKKMIEALETRFSDLELKYAIGGQTCFDAFPVGWDKTYCLRHIEAEKDRSGIVYKEIHFFGDKIYEGGNDFELYEDERTIGHFVKGPEDTMRQIRELFDV

SEQ ID NO: 36269 - protein, 928 aa, A.fumigatus
SGIGVKGKVHTTVEESMMVSSDSESESESEDELDKELFGPKARSQPDAIKAYEESKKLSLKQQGPVKKIKQVRSAKDMRARLAPDLSSLHRTILAWDFFANGDLPPNSGRTDYSLVSNTFKDPLEYQKTFEPLLILEAWQGFNSTKDEGTFRPFEIKVATRLSVDSFVEVSTVLPSLEVKDLGLSEADIVLLSKSSRPTSDSSAPHCFARVAGINKKRGTVEISYRVNPGSPFINSLGPGVTIWGAKITSLTPLEREYGALMALQYYDLCEEVIKAKPSPILHYSDASLKPIADNYNVNPAQAKAIKSALDNDAFTLIQGPPGSGKTKTIVALVGALLSKFLGDKGVTISRPTGVTNPRVPGRTTTSKKLLVCAPSNAAVDELVMRFKEGVKTIHGRHEKLNVIRLGRSDAINTNVLDVTLDELVNARLSQNPRKDSGERDLQTIYMEHKAADTAFKETRAKIDQCRAQGLPVPEELEREFDLLKKKKTQLSQEIDTARDKNHSAARDADLNRRRIQQEIINNAHVICATLSGSGHEMFQNLSIEFETVVIDEAAQSIELSALIPLKYGCSKCILVGDPKQLPPTVLSKVASKFQYEQSLFVRMQANHPKDVHVLDTQYRMHPEISVYPSAAFYDGKLKDGPNMAKLRARPWHQSELLGPYRFFDVQGLHQNTTKGHSLINLAELRVAMQLYERLITDFREYDFSGKIGIITPYKGQLRELKTQFAARYGNAIFNMVDFNTTDAFQGRESEVIIFSCVRASNKGIGFLADIRRMNVGLTRAKSSLWVLGNSQSLVQGEFWNGLIKDARRRNVYTDGDILGILQRPQFTGYKNIDMMDAESLNPTASLKAAGSEPASRPTSASFDRPTSESSISTSVSRRGTPTEPPPDLPSGGPNGLDDTRTCGYCGSFAHMTHNCDNIDAKEASRGT

SEQ ID NO: 36270 - protein, 152 aa, A.fumigatus
  UNSURE (120): Identity of amino acid sequences at the above locations are unknown.
YRCGRSGHTRVVCMAERCLQCGEFGHDAQRCQSARELSKKEKSRIAREEHQHAQMKKQRTERQRQKQLGGHDPKVPVLQVSSDPPPREDKKPEKRKPDQSNAPGKRKRTGSESPDTSKVXKPRSSDSVPNPPKGPRRKIDANVPTNTAVGLD

SEQ ID NO: 36271 - protein, 78 aa, A.fumigatus
GEDSFRTSLTSASSVSFGLTQQTRSFSASASLAGKRATYNPSRRVQKRRHGFLARLRTRGGRKVLQHRRAKGRKSLSW

SEQ ID NO: 36272 - protein, 172 aa, A.fumigatus
  UNSURE (50): Identity of amino acid sequences at the above locations are unknown.
MNAVEGPIWVAVRGKGLAYGTNFAYNIDTGFVNFDVYRSPNAHKAFESRXKQIVEDHLSGAIPFDPLMLEGAISSIVVSFANEQSTIASAAQGSFIRQVIRNLPSDYKEKTLKQVRVTGVEDVKAALREIILPLFAPDKANLVVTCAPVLEEVRVPLHVQNEVVSYSYLLSI

SEQ ID NO: 36273 - protein, 67 aa, A.fumigatus
TIKQGLEAARFTPVVQPLKDFEDDYGLKNDGDDDEESDEEEDDDDDDNDEDDDVSESEEDEESDDNE

SEQ ID NO: 36274 - protein, 101 aa, A.fumigatus
LSPSLNHDEHRNNADKSGEDRDCIVSISTETCHPARHSPRRFPNESLENHDHRKKENNHTTSSETSVPSLSGAGEPFSLPSSATAQETHGDVSALYARDCR

SEQ ID NO: 36275 - protein, 607 aa, A.fumigatus
KSPCQLIISPFLKHSVRYFFAVCTMAMALAVGAPSEQRGNLPYNTLKDGPTVDSMKATTDGKNGQGESAFWDTCVHTVFREHCQRAPNSPAVNAWDGSFTYAELDSLSDAIASVLILSGVGPESIIPIYMQKSRWTTVAILGVLKSGGAFTLLDPSHPRSRVEEISKEIQARFILTSEKLSKQCLEMFSVLVVEHLSRACLPRPGQAGHTRSRPENAAYIAFTSGSTGKPKGIVIEHRSYCSGARSHLKVFGIDSTSRVLQFASYAFDVSIMETLSTLMAGGCLCVMSESERSDPNLFVVSYKNLRISHCFMTPSFARTVPWTECCNPPPTLIVGGELMRPSDARAYKEMGIRCMNAYGPAECSVNVSVQSRVEAAVDPRNIGYTTGATAWIISPENPEELMPTGTVGELLVEGPIVGRGYLNDPKATRQAFIDTPAWLRRHRKGTSYQHRVYRTGDLASLDSITGALLLHGRKDAQVKIRGQRVELPDIEHHLQLTLPNDNAEVIVEKVTFSDDGSEKLIAFVLVRPSNTDSVIGNTGDRLFLAPQSQIMEQFAISKKHLQTHLPSYMVPDIFIPISTLPQTASGKTDRKALRTRAVFTSEWTDSA

SEQ ID NO: 36276 - protein, 60 aa, A.fumigatus
CVRPLLSSGFQTAKRLPNWDARQAFPRVQTLMIDIRLSLEDICFAYFALRVSPCGAHQHF

SEQ ID NO: 36277 - protein, 63 aa, A.fumigatus
HLGFDYDQVNASRVTLLTLQNKLNAGKPNYYWKSLNNNNNCDCSSSTPSLDRQMSCAISSSST

SEQ ID NO: 36278 - protein, 200 aa, A.fumigatus
SAGWKCCKTRVLTFEEFLTIPPCTTGKHSTVDDTPAEPEKESDASSVLEQQVAAASPAPAPPRPAVSPAIAPPSNAATPAVEDTEEDDPALEIPANATCRRRGCNKGYDPSISRDEEKCVYHPGQPIFHEGSKGWSCCKRRVLEFDEFMKIQGCKEKTRHLFVGKGKPAGEEKVETVRYAIFYEPTTISRDKADGAVVQE

SEQ ID NO: 36279 - protein, 71 aa, A.fumigatus
FIYSIKMGSAGEMKDETLLPLRFIPLSYNHADSQASALRLVLTLNPQWEGPDNKIEFVRFTDGITNTVCFF

SEQ ID NO: 36280 - protein, 139 aa, A.fumigatus
ERESPLVRRRSRRSGMQSSTNQQRFQETKLMVLSCRNDFYQTPSTVNVSLYLKKIDKDNAKVTFSSTSVEFDLPTTDNKRYKDTYPLFAPIDPEGSSFKVLGTKLELKLVKADGTSWPVLRSDDKWTGERIQVGQAGRA

SEQ ID NO: 36281 - protein, 65 aa, A.fumigatus
LYIFLSCGFYPDLIYSCWIGASIAGQFMLLTTFCEDNHPLGARLLIVTEYKGAGTKCTGSSPSVA

SEQ ID NO: 36282 - protein, 102 aa, A.fumigatus
YARGPFSLAECDLLSRYALSIGETTSHALLASRGLAPSLLARFQNGLLYRFIRGRPATHLDLVKPPLWRGVAQRLGQWHAVLPINGHSASSSSAKELPLSHQ

SEQ ID NO: 36283 - protein, 64 aa, A.fumigatus
YNSPLVHLQSLTCRIYLYTCASIALDVKKGTRHQNYKAYTLVRLGTHSQQLHVILNHVTLGPAK

SEQ ID NO: 36284 - protein, 60 aa, A.fumigatus
SRDASPNCHHVSLHTLTLTKTHLGILTSPEPASAKLLITYKKTCSAALLLFPFLFFPHHQ

SEQ ID NO: 36285 - protein, 106 aa, A.fumigatus
RQASDHLQKDLFSGASTLSFSFLSSSSVEVYIDHVNFNPGAQSKYCSLKVILAGFFSLMGFLPFPALESSVDSLCVRPSFSLHNTWLSEGFFRKVKAPCAYAVEGA

SEQ ID NO: 36286 - protein, 71 aa, A.fumigatus
TTCTSSQRSSPCLSIHIRNPTYKIYFSVLTPGGEKITVCYPQNALPPNNDPNPIHPPKRPFQHPRPNHRPA

SEQ ID NO: 36287 - protein, 183 aa, A.fumigatus
GPFTLNTLALLQFLTYAIIIVPINFSWQKYLEARWPGFPGRKGRSTPTAVAGAEAKTGAVVVTVESADLLPVKEKVEEKQRVSAARPRPRSRWRWRSRSRLRSRSGLGNFLMKFVLDQTVGSVMNILLFIVLINVLKGVGWSRIGELIYEVRLVHFVIGPFHGEKMVIEVMRVGLWADHGCAA

SEQ ID NO: 36288 - protein, 198 aa, A.fumigatus
PGLGAAGLFTGSILIIAQSVPLQKRPIYTGVLGGMYGISSVAGPLMGGAFTDHVTWRWCFYINLPIGGVTWLFVLLFFKAPKSYKDNSGLKDQVSRLDLPGLFVFLPAIISMLLALQWGGTKYNWGNARIIALFVVFGVLIVIFAARQHWAQENATVPPRILKNRNVWGAAFYSFSVSAAFMLFVYYVRVQIDSLALI

SEQ ID NO: 36289 - protein, 262 aa, A.fumigatus
LPIWFQAIKDVSATKSGIMNLPMLLGTVLMSLVSGFLVSAIGYYTPFMLISSVIMTIGAGLLSTLKVDSGHPAWIGYQALTGIGIGVGLQQAMIVVQTAVQDTDVPSATAIVMFTQSLGGALFVSVGQNVFQNQLFKNLAIEAPSVNAAQVAGTGATMLRHVVSEDVLPAVLVAYSNAITESFYVAVAMAAISIIGVLPVQWLSPEGKEDRSTPCLDLIAARGYRLFIASKLIAELMQALAWGRDTCLQGGCLSLSFRWPVA

SEQ ID NO: 36290 - protein, 174 aa, A.fumigatus
PQSFRKDNTILATAIPKITDQFNSLDDVGWYGSSYLLTTCSLVLPYGKLYTFYSTKWVYLTAIAIFEIGSLICGVAPNSVALIIGRAVARFGCCWIIYRFDPDYRPVRAAAEASNLHRCAGWYVWHFQCGWASDGWCLHRPCHLEMVFLYQLAYRGGDLALRPFVFQGAKIIQG

SEQ ID NO: 36291 - protein, 170 aa, A.fumigatus
QVTGSNFPCKGYQTNTPWRATAQYTAGQTYNMTITGSATHGGGSCQLSLSYDNGKTFKVIQSMEGGCPLVSKYNFKIPGDVANGQALFAWTWYNLIGNRELYMNCADVVISGGTGTPSSFESAYPDLFVANVGNGCSTVEGRETVFANPGDQVIYGGTVTPSSPAFPICH

SEQ ID NO: 36292 - protein, 63 aa, A.fumigatus
PSYRGYRFKMLISFKSPFSCTALYKSNQTKASASHESKANGDKYDKSLGQNRNNDSRSFMSST

SEQ ID NO: 36293 - protein, 446 aa, A.fumigatus
SGPPRRHPSIFGAAAAPFSTRKLYGLVLTELNMTLDDFEKSLVEDQERRRERSGREKHQHRDRDRDRSKERSRHHRHHHHHRRHSSRSREREPGRPRESHADEENSHRHKRSRHSTDHSDDRDHSHKRRHRRESKDNESESTAPVKEIVQEEPKQLRRDAWMEAPSALDVDYIHRRDTTRLEEEPKAKMLQADFELKIHDRELNQHLRDLKEEKGLAEVEEKPVQHEVDYTFGDAGSQWRMTKLRGVYREAEESGKPVEEVAIERFGDLRSFDDAREEEAELDRRTRYGEGYVGKEKPTGDLFQERKLEQGVHREPLEHHRDPEQKLAARGQGQKIDTAPPSGATQHLDLTALNRLKAQMMKAKLKGSAEAAELEERYNAAAAAMANRKESDVVVLGVMENRMLAGQRNEAKPVETRRGRERGQLEENEDLTIEDMVREERRTRDQ

SEQ ID NO: 36294 - protein, 398 aa, A.fumigatus
CHFTLGSGKTTFMQRINAYLHSKKKIPYVLNLDPAVYSVPFESNIDIRDSINYKEVMKQYNLGPNGGILTSLNLFATKVDQIISLLEKRTAPNPENPSAKPIEHILVDTPGQIEVFVWSASGSILLETLASSFPTVIAYVIDTPRTTSTSTFMSNMLYACSILYKTKLPMILVFNKTDVQDAEFAKEWMTDFDAFQQALRDEEESGAFGGEGSTAGFGAGSGYMGSLLNSMSLMLEEFYRHLSVVGVSSMTGDGIDEFFQAVEEKRQEFERDYKPELERKKKEREETKAAQRELELGKLMKDMSVSGSSRKPRPANEAETVSEAEEEEEEAAAAASKGDLEFSENDDDTDDDEGGVPPAGDEAGLSQRYKEALSESQGGPNDADLSFARYLRSSNINR

SEQ ID NO: 36295 - protein, 188 aa, A.fumigatus
TYQRQVLMASCSVGQNPARQCALGAGLEESTICTTVNKVCASGLKAIILGAQTIMTGNADVVVAGGTESMSNAPHYLPNLRTGAKYGHQSLVDGIMKDGLTDAGKQELMGLQAEECAQDHGFSREQQDEYAIRTYEKAQAAQKAGLFDEEIAPIQLPGFRGKPDVTVTQDEEPKNVSTSIRRTMFMSD

SEQ ID NO: 36296 - protein, 171 aa, A.fumigatus
LNPEKLRAIKPAFIPGSGTVTAPNSSPLNDGAAAVVLVSEAKLKELNLKPVAKILGWGDAAQQPSKFTTAPALAIPKALKHAGVGQDAIDAFEINEAFSVVALANMKLLGIPEEKVNLHGGAVAIGHPIGASGARILTTLLGVLKAKKGKLGCAGICNGGGGASALVVELL

SEQ ID NO: 36297 - protein, 400 aa, A.fumigatus
  UNSURE (35): Identity of amino acid sequences at the above locations are unknown.
GTRQKWSWKIRILDGKFNSRFLHDDFLGYRIPGHXLLILPGIWGTGVLIATAFVHLLPTAFVSLTDPCLPRFWSETYRAMAGFVAMISVFLVVVVEMFFATKGAGHVHGSEYDHLIGSVGRGSSESVRDDANYLRLGRHHSTENLRLNLIQANIYADGAQEQSSSLSRMSTDGVEQSRSKKMEPYGETGDAEFGGIDSLDNHSHSPVSDSHPRYLPSQQRDLHPKSSPVLPMQSPQRQLLQCLLLEAGILFHSIFIGMALSVATGTSFVVLLVAICFHQTFEGFALGSRIASLIPDLFSPSSPKPWLMSLAYGTTTPVGQAIGLVLHNLYDPASTTGLLMVGITNAVSSGLLLFAGLVELLAEDFLSESSYATLRGRRRIEACIAVASGALLMAFVGAFA

SEQ ID NO: 36298 - protein, 61 aa, A.fumigatus
LNHQSTSSAAAVTDASTAKFSFLGLQNTEQGGQNTRTTSTDRVTDSNSSTMKVNLFLRNAK

SEQ ID NO: 36299 - protein, 139 aa, A.fumigatus
GCIAPFPSSSKSDKTVDESHEKAEDHSISAYQAHVLYVSATQVGNIRIGASILHPDNVLVTTRSGSNHSSIYINAKPHPYYTLGDVKFERENTVHGAIQGSIGVFSSIAQVGPRQLLPYQQEISFQDGQCLWHSAKRTG

SEQ ID NO: 36300 - protein, 75 aa, A.fumigatus
  UNSURE (63),(71),(73): Identity of amino acid sequences at the above locations are unknown.
RGPTMQVDSPGRAEGEPDPVSDRTGEREARRWGRTRSGCLNCRKKRRKCDEGKPTCLFSTTEXAKDPKRSXCXRN

SEQ ID NO: 36301 - protein, 237 aa, A.fumigatus
GARCNRQCHPKHRPKRVPFLRHVFFGVIAANSKTSSSEDWLNTGITTTGWKPPFLSIDDVYTISLQDFYNGIGSACAQYDSYFQSSASKYGVNPVILAVIAMQESSCNANAGGPTPGLMQVSCDNYPNGQCTDSIQDNVDAGTHYLKSQLDASGGNAIKALGAYNGWFTAGSGLNGNRGLTKDYPCSAEGKAHGMPQNLDYLHQVLNGWMMGLDVYGKDNWIGTYHCDQSCSDGSLC

SEQ ID NO: 36302 - protein, 105 aa, A.fumigatus
VFFPVSLKWDQDNYYLTSKRYPFKMASVYGTQQNGQGEVGKQHCYAIGSIKSNRLVICLADRLRTIQEKYGVKKRYICNGRGLSQYPGQLKGDIFVNCYSLEDPG

SEQ ID NO: 36303 - protein, 159 aa, A.fumigatus
ITPQKTAREIMAVFKSITLTSLALAIGATAQSANPGVGKNPKAQGATDNVTPSTGPNGYRSFATYFLESLLLTVKHLAPKTGSTPASPPPAGSLPSSPSTTSTPSAFKTSTTALVPPAPSTTATSKAAHPSTVSTRSFSPSSLCRSPPAMPTREVPHRA

SEQ ID NO: 36304 - protein, 65 aa, A.fumigatus
VSQRRIIPMQHKDISNATKSEQSVDIKQRQGVETLSTMIEYIYTFFYQQHTGWLYDFEPIGSFSF

SEQ ID NO: 36305 - protein, 344 aa, A.fumigatus
QLQFCYHLCPDAHMLSNKLAIASLSLGQHPSHHLDHKIQAAAEAGYKGIEIVYFELEAFSQAQHISILEGAEKIRLICQKLNLDILSLAPFENYEGDRSPLSDRLQNARHWISVARVLNASYLQVPSNYKLDAIGDKDVVISELKQLADIGSAEQPVVSIAYEYLSWGTHCSTWEVALQYVNGVDRPNFGLCLDTFHEATKLWADPFASSGRFPDSDRSLRESLNRFVSTCPVEKIFFIQLSDGERFDPAFSKGHPWYVQGEAPQFTWSKHARLFPLEHDHGAYLPITEIAEAWIHGVGFKGWVSMEIFDRRMRDRRTQPETAAMRGLRSWRTLRRELEPVSKV

SEQ ID NO: 36306 - protein, 97 aa, A.fumigatus
  UNSURE (50): Identity of amino acid sequences at the above locations are unknown.
SCCPTDEPHTTHQNLPLLRPAPLDYPIHNRPGTNPSFLLLQPSPPAAPTXKLPLSTPTPPPPLPSSPRAAPSLTPRKLASLWPLQKTCPPPFPPSNF

SEQ ID NO: 36307 - protein, 572 aa, A.fumigatus
GTGADLDIYNSLTPTPMLSSGLLPRRFVGWITWRDNCVCIMSCGWRINALRGSCWLWWWWHRVDIHDLLAGYFQAQMDKAGIPMRSSTEFSDTLAAPLASEIDELAERSESLEQRIASLNDSYETLKKREVELTEWRWVLREAGGFFDRAHTHTDEIRQSFDNDEAPLLRDVEHQPSRGPNGDAQAHQSFLEMNIGFVAGVIPRDRIGAFERILWRTLRGNLYMNQSEIPEPIIDPTTNEESHKNVFVIFAHGKHIISKIRKISESLGASLYGVDENSELRRDQIHEVNTRLSDVGNVLRNTKNTLDAELTQIARSLAAWMIIVKKEKAVYDTLNKFSYDQARKTLIAEAWCPTNSLALIKSTLQDVNDRAGLSVPTIVNQIRTNKTPPTYVKTNKFTEAFQTIVNAYGIPKYSEANPGLYTVVTFPFLFAVMFGDFGHGALMAMAASAMIFWERKLQKTKLDELTYMAFYGRYIMLMMGLFSMYTGLIYNDVFSKSFTVFPSQWKWPDSIKKGQTVEASLTNSYRYPFGLDWNWHEAENSLLFTNSMKMKMSIILGWAHVSDILLLVKWPG

SEQ ID NO: 36308 - protein, 68 aa, A.fumigatus
SSLWWKEPAAGSDAFTMAPRDTFFRSSDMSLTQLYIANEIGREVVSALGELGQVQFRDVSCTVPARGG

SEQ ID NO: 36309 - protein, 166 aa, A.fumigatus
MTYALCLQYVNARHFKSKVDIIGNFIPGMIFFQSIFGYLVLTIIYKWSVNWEARGQSPPGLLNMLIFMFLSPGTVEEQLYKGQAGVQVVLLLLAVVQVPIMLFFKPFYLRWEHNRARALGYRGLGEHARVSALEDDTDMNGGVSRPRDSMASDGEGVAMIAQDLGD

SEQ ID NO: 36310 - protein, 1016 aa, A.fumigatus
STIAFPLKSILKPTIPVSPVRNIPSFEETRKHTPARGAQQDGVHGDNKDKGKGDLLVDIETPAQPSASGPEDPANPFDSFNASSAIAAAREQEEKERRERERQIILEKREARRKSMGKSASSSEIIPLAKTCLRKANRRVSFAPEATLHTWNVVEIPDDSTSSSASNSTRRASSLAENQAPTPAAIQREPPSTPDTVAESDIAFSPVEYPDLQELRNRSFSAYDEHATSQDLSSSPFSGGSADGLEDTSLQDVPREGDDDDDDDNSSGSGFDGESTAMSMDNMTVHSTASARSDRSSSSTSSSARLNEALRQAAKEAGTRGIDYDEDGEMSMEIADQEITGAFQPWIKKGQRQSFEWEDISALHDQENINPSHNSIQSSTVPNDSADIADDDLSMEVTNAIGRIIQPSRRQSTVRRKSMSEETNYDEQTMEFTNVIGGIKQSASPTRSAGGESNASDEEMTMEFTSVVGGVLNKPFQTQHSEEANTGGWNDEDDGGSMEGEADMEMTGAVGGILSATGTRDGQDEDQTVGMELTTAMGRILPATVDQNQERRDANSESENEQPQSSPFQENVRQSPSKSPVSFHLAAIASESGSPSLASVRPRSTRQSLSRRMSNTPSAHSPHQSPVKNTLTSPKDSTPQASQSMTPSKTPLSMTNNRSASPRKLFQSETHLSASKDKSLGRKSLFGSTAVTGEAVPLFVLRPHEKRRSSGLGIDKEGLGSPRVAAMLDKRRSIGEDAPRFVPQEQPKSGVRFEDPLKLQEEVDMEREEEEKREDGHIPPLQLDPTANLKDMISSLTPKKNKLRGRKSLHVGAARGLLGKRPVELDQDDEEEADNTPKRLKGRNASPVKSIKLPAPPTKDETVGHLKRSPTRRSVVAPPIEGSTTPSQEPKTSSLSLTPAKDVSESFNSSTESTSTEEGNVAPQDSEPEFEPIQLQDFLNMTNIHFMELTTTKRRHTTAPGSVSKRTARLSAESKAATASFEDCVAAGFCTVPMLELYQHVSCLLSVRPRCLLTPS

SEQ ID NO: 36311 - protein, 233 aa, A.fumigatus
SCRELKSYISEGRQVIRSIEAETYAENPPLFREYATAPPDIRLLMDNQFRNVKTHARLQSKATWYEWRMKLLEGLKEGLYRHVDEMKADGDLLTKYETLLDGIVPALVEKQSALQEEAANLQQLTDEMESCDQDELRNAREKLSSLEDEIELKKKQLQELQGQVQEKTNSLESGAELKAEFLAQIKEAERVKEECHGWSAKEISELTGKITRSLEYYACSTIAHNLDRIRSEN

SEQ ID NO: 36312 - protein, 69 aa, A.fumigatus
  UNSURE (49),(66): Identity of amino acid sequences at the above locations are unknown.
RERQPASLSEIPPRKRRQVDGTSAAAVSYRLAKSQISSEAPQNLEHKTXPISSKQFLRFISMPGTXGSA

SEQ ID NO: 36313 - protein, 70 aa, A.fumigatus
DTRCIAALKLAAFGIDSQWLTGFPSPGFRNTLAAHPADNSLGPKPSGFHDSRIRTCHSCSRTDAFSSMRC

SEQ ID NO: 36314 - protein, 540 aa, A.fumigatus
MISTAMTEQHKKGSLDESSGGHQDTQTTMDSPRKDTIQNDKVSTQPKRTLFVRSLPTSATTESLTEYFSQSYVIKHAIVVNDPETKLCKGYGFVTFADLEDAQAALKEFNGSVFEGKTIRVDYAQPRHREIDENLGKSVPAPAALELKKQRQQQKTSTQPPKLIVRNLPWSIKEPEDLAVHFRSFGKVKYVTLPKKGDKLAGFGFVVLRGKKNAEKALQAVNGKEVDGRTLAVDWAVEKEVWENLKKESEKKEDTQEEAGSSDVEMADDAETTSDNEGVESDDDDEDEDMDDDDEEDEEDMDEEEDEDEGNEDERQEKEDERNACTIFIRNLPFSCTDEALYEHFTQFGPLRYARIVVDPETERPRGTGFVCFWKVEDAALCVREAPKQQDTLIAEKDKGKKSSTALKHSILQNENSDPSGRYTLDGRVLQVARAVSKSQAAKLEEEGVSKRLVRDTDKRRLFLLQEGTISPNSPLYHKLSPSEIKMREDSFKQRQNFIRKNPALHFSLTRLSVRNIPRHVTSKDLKQLARQAVVGFAKD

SEQ ID NO: 36315 - protein, 66 aa, A.fumigatus
SEYSSINYSTSVFPKSRKGCANAFTHFLLIGLPWSVDFWGSFFRIHPTPLSRFRKVQGCFIFVSRI

SEQ ID NO: 36316 - protein, 213 aa, A.fumigatus
SASSVHEKGRFRMKIVQAFRSSSFSCLSSSLPSSSSSSSSISSSSSSSSSSISSSSSSSSDSTPSLSDVVSASSAISTSLDPASSWVSSFFSDSFFKFSHTSFSTAQSTASVLPSTSLPLTACSAFSAFFFPRKTTKPNPASLSPFLGSVTYLTLPKLLKCTARSSGSLMLQGKFRTMSFGGWVDVFCCCRCFLSSRAAGAGTLFPRFSSISR

SEQ ID NO: 36317 - protein, 352 aa, A.fumigatus
QHYRSLEDCAKMAKDIDTNNADPDHGLPERSATPRAAGGTPNSATAQSTAPKVQQPKPQALANRTGPSAILVSTRQKGNPILNHIKLLPWEYADIPADYVVGATTCALFLSLKYHRLHPEYIYSRIKALGGKYMLRIILVMVDIENHEDSLKELSKTSIINNYTLMLCWSAPEAAHYLELYKSSENAQPTAIRTQQAQSYKESLVEFVTTPRSINKSDAASLISTFGSLQNAINAQPEQISAVPGWGEKKVRQWTNAVREDFRVENAKKAKAPERNIEHDQNPSGLGIVSQTGPSNTADEDEAALYLSEAGQRSGVDAKKGAPEVDTPRQSNQEEMSEGISAALARLRENGG

SEQ ID NO: 36318 - protein, 256 aa, A.fumigatus
PSILRVTIVDPSVGHVVSTISAENVFELGFSPLGTYLITWQRPSKDANGDAVKNLKVWKVIETSPESNGDEHTVVGSFVQKSQTGWNLQYTFDESLCARVVTNEVQFFQSDNLSKVWNKLRVEGVSDFALSPGKNNSIAVFIPERKVGFLFFRFDRGSFTKIYSRLTWFFASRVNQQRSRCSTCLSSERPSPRRAFSRVTRSSSSGTAMERLCWCLRRPRSIAAARVTTEKQLCTCLAPMVALIRVWTLVSLSGVS

SEQ ID NO: 36319 - protein, 274 aa, A.fumigatus
RVLLCYRGTPNSGTTSLSALSTTAIKDGHQGQPLPHRRHAHHSSSASATSTSTLEAERADRISRLAGLERVATARAGGVPQSNLMFATAHGPGYFDGGSGFKERSTVGSASATGSVGARTTWASGSDALDADKMSEDTNDDDETSSVGNISEGDASLVAFGEGASTISGPISHPTLNRMSSGGRPSSLGAGSPNMSRANPLTSYQPGVEDSAAVSSSLSPAGSNMPEQMHDARMLDGVTYDSDVVDTTVRTPRAGPPHPAMASLPTGTMTREGN

SEQ ID NO: 36320 - protein, 72 aa, A.fumigatus
LHRTDKEGPIHDVSWNPNSKEFGVVYGYMPAKTTIFNFRGVAKHSFPLAPRNTILFSPHGRFVLVAVFTTGN

SEQ ID NO: 36321 - protein, 191 aa, A.fumigatus
SWIFHKDLQPTYLVLCVQGQPAAVKVFNVPQFGAPISQKSFFKGDKVQLKWNSNGTTLLVLAQTEVDRSGKSYYGETTLYLLSANGGFDSRVDLGKSFRCVLAHRTFADSTVQTRKVRFTMCPGIPTPRNLALCMDICQRKPPSSTSGEWPSTVSLWHLATPSCSLPMDVSCWSLSSPLGTRTIPRALIPP

SEQ ID NO: 36322 - protein, 165 aa, A.fumigatus
SLVISASICSLSLRMTRAWRYARGIFVSRDNLKIHSCPPVRSCFRLQPSSRSPPFSNTNRRTMSSSSLRVPHALRSFPSSGFELIDHSEKIEEETLPTYHAEKYYPVHIGEVLNNQYQVLAKLGYGVTSTVWLCRDLRYTEANLLLRNLTNYVSKKKAVNPNMWY

SEQ ID NO: 36323 - protein, 127 aa, A.fumigatus
LCVKKKSSESKYVVLKVNVSGVERNHEISVYDRINLVETNHLGKSFIRKLLGHFHIEGPHGRHICLVHQPFGPSLDQFLSFFPERVLSLEDLKPCLRQILGILDFLHTDAHIIHTSEISVPKNSHCF

SEQ ID NO: 36324 - protein, 119 aa, A.fumigatus
FCEDLQLKNLLLPADDPQIFSAIEEAEIEEPSPREVLDDSRTIYLSRLLLPSNGLPLLSDFGEARFGDEEHNEDIMPNVYRAPEVVLKMNWDYKVDIWNVAMMVRKQTCLTLKFICVLH

SEQ ID NO: 36325 - protein, 69 aa, A.fumigatus
  UNSURE (52): Identity of amino acid sequences at the above locations are unknown.
RNASILKEMSTSLLVMSTTMFMLWPVFLNNIYGSSQQLFLHVNYIWIFYVFXVRAAAFPRFSTCSKALY

SEQ ID NO: 36326 - protein, 1005 aa, A.fumigatus
  UNSURE (30),(57),(753): Identity of amino acid sequences at the above locations are unknown.
QGMGALKVTGEEPPQTCDPSHLLGKTPTGXLTAGVSKDLWQPISSSSPIERQDSLNXAQNPQKIHAPSLNDQSAFAVPKSPGLLLSPRPEDRPIGSPLPRMPREVPNSLAHLPMSSENSLAGLALSPRPTNHPNPSATGASKPNDTSPSHIDAHRHIATINHGPRKDTPRSHWSPAREIYQGLMSEDYPGLLLPPNALPLIRVKVSSSRLRPSRNSYLAPKPSEEEPVFTLGVFSRSENLELWRVEKVVAALPQLDQQIRQSSALWMKLPDRSIFSGHSPAKIDARRAALNSYFEALLDTPVDERAALAICQFLTMDAIEPRDDESSLLKGNCKAASEVLPGQDRKPQKEGYLAKRGKNFGGWKTRYFILYGPELKYFESPGGPHLGTIKIFNAQIGKQSQPANNTNNPLSGPEDDSENQYRHAFLILEPKRKDSSALVRHVLCAESDEERDAWVEALLAFVDGQSDNEGTENASPQSQVSTQARHLSQSTSKPKLFAGGSKKSGKGMNNADADLTDTVQGFSYDDAVPAEPPLLGPPSEKQPPRSPMSPLEAAMEPSDTNPASDHVQLSSKVISGPTNGTVIQDAGAWGNKTVTTTKEKKRSIWGFRTRSSYDLASQLQASQEPSSAQAVVNPSTERKDLVRPVFGIPLAEAVQHCAPHGIDVDLPAVVYRCIEYLKAKGAATEEGIFRLSGSNVVVKALKERFNTEGDVDFLAGDEYYDVHAVASLFKQYLRELPTTVLTRELHLDFLRVXRACRCFPSFLHLFQGTILMNSYLELDERQKKILAFNSLVHRLPRPNLALLRALVQFLIIIINNSDVNKMTIRNVGIVFAPTLNIPAPVFSMFLTDFESIFDKMPEGCSEPVKLKVDRPALPEDIRSPRHQMFSDLPTPAYSQTTFRRPTEVVDDSRHDTGFISIQPTYEQSSHNLVEHYNQQPDSAAMNRMLMPSVDSSRSAKAKRRESSMLFMEYNHQDSGLPAMRNDQSKSPPITPELSHRLQTDLRESR

SEQ ID NO: 36327 - protein, 171 aa, A.fumigatus
RPFFLSIFSIGSHIVYASNLRRFPIVKLSDPLFILSCVLVGLNHWLWFRHFSKPLPSSRVGANWRQPYQVDIEDIPTFTEVASYFGLCVWLVPFALFVSLSAGENVLPSMGSEYATGEHVPTGGRTRIALSSEGKMKNKGMAKAVVDGVRDWISENGALMGFWRSERTRRF

SEQ ID NO: 36328 - protein, 124 aa, A.fumigatus
CDGLMTLEGKGICSGKHAIADYLIEHQEFKLLELNNKHYPRITDDPEDDLRLQASELSNKRNSEFTFDSVESLLDFATKRWKERWVTTDILDTATIERFLQRPFFLLVSVDAPVSLRWKRFTDR

SEQ ID NO: 36329 - protein, 213 aa, A.fumigatus
CFYSVSRCRRRQLDPPPLERFVIWNDRHLYDKDIGRAYLTDRAQVRLFNSCSSLEELHVALEALNLADERRLRPNWDLYFMQLASLAAQRSNCMKRRVGCVLVRERRVISTGYNGTPRHLTNCNEGGCMKPPESLQLSLILSCCSKRDSHRLGPRCNRGEGGGVGLSTCLCLHAEENALLEAGRERIREGSILYCDTSDSPAPTCCFPDVDDP

SEQ ID NO: 36330 - protein, 68 aa, A.fumigatus
YLVGESTHSPGSFFLGIFGIRVLVLQYPVACAVFLISVTISFPLTGLIDVYIYNNSERLHDVGLADKK

SEQ ID NO: 36331 - protein, 161 aa, A.fumigatus
ARDATVEKEEVLAYRHVFAFMRKRTLCWKQAESVYAKAQYSIAIRQIPRPLLAAFQMLMTRRCPCLTCTVKIAQVGISEVVYSQGYNMDQEVCLNHHSLVNAANRRQSAAILKAAGVCLRQFSPVSYTISTGLDKEGLHKYSLETASSISKILRPFLRIYP

SEQ ID NO: 36332 - protein, 67 aa, A.fumigatus
PNKMQYAPFASDIELPFYTALATLKIDRDKLDDSARKVLGLYEVRSTDAPKNSCRMQIHGNALTSDE

SEQ ID NO: 36333 - protein, 101 aa, A.fumigatus
YSGKILDAIEDGSIYLCPSKLSYFMILSFADLKKYKFHYWFAFPALHSTPSWTPVPYSEEIVGDTPVEPINRSPFKALSTLESSTLVEAVQTWSGSVEACF

SEQ ID NO: 36334 - protein, 109 aa, A.fumigatus
SACSFFYFSFAFSYSCLILKNARPLEENFFFSRLMREKSRLKIKDLFVDKIEGFSTTFDPHCIIYYFNCISDRSILLSSWSPFLFALLFSLFVLVILFLHTIVWSPTPS

SEQ ID NO: 36335 - protein, 70 aa, A.fumigatus
IFTNPLEIVKIRLQVQGEIAKTVEGAPRRSAMWIVKNMGLVGLYKGASACLLRDGKDKPTRSFDFCEHAF

SEQ ID NO: 36336 - protein, 188 aa, A.fumigatus
RFRTIVPLYAIYFPTYAHLKSDVFGESPTQKLGIVQLLTAGAIAGMPAAYLTTPCDVIKTRLQVEARKGDVRYNGLRHCAATIWRDEGFRAFFKGGPARIIRSSPQFGFTLAAYELLQKWLPMPGSHPEVSPTGQVEPGVGLQSAKAPLPYLRSRNALKLLLDLDENIGRVYIPQADKWPKFLQPSKQ

SEQ ID NO: 36337 - protein, 128 aa, A.fumigatus
FLELTLTDQRHGECFVLDDGGEADLDLGNYERYLGVTLGRDNNITTGKIYQHVIEKERRGDYLGKTVQIVPHLTNEIQNWVERVAKVPVDESGREPDVCIIELGGTVGDIESAPFVAAISQFVYWTSG

SEQ ID NO: 36338 - protein, 456 aa, A.fumigatus
QHKIKREHYGLLFRVADKRRAGRLTLSDWATFENLLTKPDAEYEIAFRLFDLDGTGTVKWETFKNIYNMNKSGDSIPFDWNSEWASLYSGRSKARHDMTYPQFAQMLRGLQGERIRQAFHIFDKDGDGYIEPEDFQRIILETSKHKLSDYVLENLPSLCNISAGTKISYATVRAFQNVMREMDMIDLIVREATQKSEDGKITRADFLNEAARITRFSLFTPMEADILFHFAGLDAPSGRLSQKDFAKVIDASWRVPLAVAGQAVSTATTTAQVAAEKTRSVLHSVLESVHHFALGSLAGAFGAFMVYPIDLVKTRMQNQRSTRVGERLYNNSLDCFRKVIRNEGFLGLYSGVLPQLIGVAPEKAIKLTVNDLVRGHFTNKENGKIWYPYEILAGGTAGGCQVVSAVELSPHWKTVLISPLIRYSQIPSRLSRFACRFRVRLPRPSREPPVARPCGL

SEQ ID NO: 36339 - protein, 319 aa, A.fumigatus
SDNAGILSHEFHVLVQVISLPVKPLIHVHLVAAGRCSRQLERFGKMSSPVILLPGDHVPSDKLPSNKSAPLRLGPGLRLLSPAIPSPSSGHVIASTQAGLLSTDYKKNAVSVLSFPNRRYIPTPNDLVIAQVHHSSAEYFYCMITPQSPHVLLGQLAFEGATKKTRPMLRQGDLVYARVLSIGLGAGAEVELTCVNPATGKAEPGGLGPLNGGMVFDVSTGMAARLMRASSSTSEQEDGVDGLVVLEELGRKLEKVGGFEIAVGRNGKVWVDCSNGGDAAVKATVAIGRCLTAIDEHDLNQTDQRKLVTRILREMKVES

SEQ ID NO: 36340 - protein, 277 aa, A.fumigatus
ESRYALHIVPFAKDHIRTFERITALYFEPDYYYLQDMNEERDAVGSPDSPTTSMKGKLETQVGETATPKRKRKQTVNDTNTGMPSKTPNQSQESPLDRAGARPVKRTKIVPSTTNTKEARRPEKNGSREAIPSPETPVVANISEMTEAQRQSTGMQPLADVAHTNETASKKPKKSKAKTTQQDEERDLSAPPQNPAETKPIRMASANPSLADSSTDQKDLTDTSAVRGPRKGKTDKMIGFFAPSEVSALETFKLQFCNQHAISSEKCPHHGAGRVPQ

SEQ ID NO: 36341 - protein, 253 aa, A.fumigatus
TRRNSVNYVITLDINTHICILLLGLHLGDSIHVVLVSDLAHAFPESNHTGFHTDGLQLRTTELISTSSQFGPVDGVVHSHLAGVDLQDVCPCLLIGEREFDLAVQSTGTEQSRIKDIDTVCRSQDLDTIIRSKSIKLVQKLQHGPLHLTVTGLLGVETLGTHGVEFVNENDRRGLLLGKSEAVPNQLGAVTNEHLHQLRSSKLQERRVCLCGAGSRKKVLPVPGGPYIRAPKEEEICVRMLADDDGRTGGKNG

SEQ ID NO: 36342 - protein, 475 aa, A.fumigatus
TGKSALEPSIFLRMFHLLPSLRHLCISSFDADAFADSALLCLPPLESLRLERLPGITDTGLSQYTSRPESGSLKSLALIEQNIQSLLVISKILASLRNLERFKIVQTGHCPTLNADGIVFQPLFASSSLKHLHWDVACPNPNTALTRLDCAPFAKPPKHVDTPNSHLAQSILCSGFPCLETLRAPSDIEPPGILQAVCQPIPRGQALINSDRYSLPRSSHGSVNTRPLALPAGNNLTSARIRAQTFIDMAAKDTETGMQVLITDHSDSYVPDNALEDASDDEPDPGMGQYGSLSSGRAKEEPNGPVTVFNFRMPAYMGRVGSRTTEKDVSIPRFILRPDLPGQDADGGLIGWKHILASNQSLTYAAGVGVNCFGSKGSLIPPPPPEESPPSPASTTVTRFGWGSIGSRSALGTSPITPTTPSTPMSLSSPTGLPWDKDTCTGSWNYSHKRGRDWWFHMERDRPGSVEIVDVKGLF

SEQ ID NO: 36343 - protein, 164 aa, A.fumigatus
FSCPTLLMPFRRAIIPASTQTAFSCAPPNSSVLRANSAQLTASSTAILREWICRMFARASSLGRGNSILRSSRPERSRAGSRTSIRFVAARTLIRSSEANPSSWFRSSNMVRCTSRSPDFSESKRLVPTASSSSMKMIEGAFSLARAKQSRTSLAPSPMNICTS

SEQ ID NO: 36344 - protein, 146 aa, A.fumigatus
GPASFRNVAFVSAAQARARRFYRYQEDHTSEHLKKRRYALECWPTTTEEPGERTVKIPFGALIPIFVNRSASFIGHTMASTISSICLSKPPMSVYFSVGFSSTSMAFTRLSYSAGSVSKIRYESLLTPIRSPGFSFSWSTRPMRGR

SEQ ID NO: 36345 - protein, 156 aa, A.fumigatus
LSDSHINLVTMSTLEDLEDLEREERDKKKDQGDGDGQQPGGDGDAEMKDADAKKKDEEDDLLDEEILNSSTADIVKRRRMLENELRIMKSEYQRLTHEQNTMREKVRDNQEKIENNRYDMLVTLVTSSLPYCHRSPDGRSGGDVANLSSGFVWKPV

SEQ ID NO: 36346 - protein, 69 aa, A.fumigatus
RSISRDVGTAADVVWSELEHRQDSFNPPTFYLDLPSFLFSPITHPQYSFASQIQLAFRLAHQPCHHVDP

SEQ ID NO: 36347 - protein, 207 aa, A.fumigatus
VSGWPERWRCCKSIIGICLETCIITLTDTCIYRQLPYLVGNVVELLDLDVEAEAAEEGANIDLDATRVGKSAVIKTSTRQTIYLPLIGLVDHEKLKPGDLIGVNKDSYLILDTLPAEYDNRVKAMEVDEKPTEKYTDIGGLDKQIEEIVEAIVWPMKEAERFTKIGIKAPKGILTVLSPGSSVVVGQHSNAYLLFFRCSDVWSSWYR

SEQ ID NO: 36348 - protein, 207 aa, A.fumigatus
NLLARACAAETNATFLKLAGPQLVQMFIGDGAKLVRDCFALAKEKAPSIIFIDELDAVGTKRFDSEKSGDREVQRTMLELLNQLDGFASDDRIKVLAATNRIDVLDPALLRSGRLDRKIEFPLPNEEARANILQIHSRKMAVDDAVNWAELARSTDEFGGAQLKAVCVEAGMIALRKGMSKVGHENYVDAIAEVQAKKKDTNMGIYV

SEQ ID NO: 36349 - protein, 120 aa, A.fumigatus
DASLIHLRICHRALFLPLPKPLMALKSVKALLYPNPKHVVQFMQQPYSGATQLDKSYYTEGANRSWNFAMVEEEIADLVDGKDFDDLTSNIPWFLAKTLYRTRFSTRKPNVPDITAANGT

SEQ ID NO: 36350 - protein, 88 aa, A.fumigatus
AASCACCSSSGPLLLPVSPSARIRATNSKSSTIFRPCIARTEATIEKGEGSIFSGACAAEKEIDYKLMRTQKPCVMLLDPVHRDHLGH

SEQ ID NO: 36351 - protein, 351 aa, A.fumigatus
WVMLSSGSRLPPPSRPTGWFTRSSWKPDCPRTSYSSSPAMPKKSPTPYSTTANSLPCISPEAPPCSVPCTEKSLRGSPRANTAATLASSAKLVARTSTSSTSLRTSATLPCRPSAERLSSRDRSAAPPPARTSHPPSPISSSSRLCPKQSSSRSASHPTSPTSAAPSSTKPPSTSSLRSSRRPRATRNSSSSSAVPMTPPRAGTFNPPFTAPRTPITLSSPASSLAPSWLCTPTTTPQRPTSPRSARRLTRPVSTVSQAPSSRRTARPSGLRRMLSATPRVTSTSTARAPVPWSASSPSAVPVQAAPTIRPAVETCSRGSSACARSRRNSSLLTRLSTLAMRKLGMTCACH

SEQ ID NO: 36352 - protein, 148 aa, A.fumigatus
HTACDCRQGGSFYQVNNLLNQETDNSQIKSSQTFTQSNPASRAPVATYSNATASDVQAAIDAALEARKSWAATSFADRASVFLKAADLISTKYRYDIMALTMHGQGKNAWQAEIDAAAELCDFFRFGVKYAEEMYAQQPVHHAPGVWK

SEQ ID NO: 36353 - protein, 75 aa, A.fumigatus
IRFLPGPSVQTNFTKMHSSLLPRMRAQQFAKCRPLTSSFVRPNRAMGTYATFKVPRIDNEPNVSFSTLVPSRNGF

SEQ ID NO: 36354 - protein, 439 aa, A.fumigatus
PCTDRARTPGRRRLMLPPSCAISSGLASSTLRKCTPSSLFIMLLESGSKFTLHLRSRMTMANQRSRVEYRPLEGFVYAISPFNFTAIGGNLAGAPALMGNVVVWKPSPAAIASNWLVHQILLEAGLPKNVIQFVPGDAEEVTNTVLNHREFAALHFTGSTAVFRSLYGKIAQGVAEGKYRSYPRIVGETGGKNFHLVHKSADIRNAAVQTVRGAFEFQGQKCSATSRAYVASSIADQFLEQVVSETKQLKIGEPSDFTNFCGPVIHEASFNKLAQVIEEAKSDSELELLVGGTYDSSKGWYIQPTVYRTSNPDHPLLSRELFGPILVVHTYNDATEADFSKVCEKIDQTGEYGLTGSVFAQDREAIRVAEDALRNTAGNFYINCKSTGAVVGQQPFGGARASGTNDKAGSGNLLSRFVSLRSIKEEFVPSYKVEYPSNA

SEQ ID NO: 36355 - protein, 254 aa, A.fumigatus
PSCRNGFAAGTPLRVRPQSSSTCNRVTQVNDINDKKVGSSDTPAEKITTDRNQIVSDLRELADLLAKCNMRLAYENWCWSTHAPTWKDVWEIVKAVDRPNIGLCLDTFQTAGSEWGDPRTISGRIDDMDVDELNRRFAASMDELARSIPPEKIYLLQISDAYKPTRPIEDKVINGLRPRGRWSHDFRPMPYDGGYLPIEEVARAVLKTGFRGWFSMEIFDGGNQGKGKKYDMIPYAKNAMESMQRLLKNCSDDR

SEQ ID NO: 36356 - protein, 157 aa, A.fumigatus
TKPSRGRYSTRLRWLAIVILDRKCKVNLLPDSRSMMNRLLGVHFLSVLDAKPEEIAQLGGSINLRLPGVLALSVHGQGHNVIAVLGRNKIGSLEEDTCTVCERCSGPRLASLQRCVNSRLNIGGGGVGVGGHWGTRGRVGLCEGLRALDLGIVSLLI

SEQ ID NO: 36357 - protein, 297 aa, A.fumigatus
CKLVDSQGQVCRGFSSFARHTVKRKTNLCRMSFSSAKLSLSMTGTDGKDGGAKVDLPRGHTSKRFGPDSSHGGRSNPFNALSPLSGGVSSPSTNASSAFGLGSGAFASFGTPKTPGTNASDLNSSKALGEKRETASEQDSAADVKAKASASSLTGPKEHSLKSTWVIWYRPPTPKYSDYEKSTIPLASISSVESFWSIYTHLKRPSLLPTVSDYHIFKKGIRPVWEDDANKKGGKWIVRLKKGVADRYWEDLLLAMIGDQFAEASDEVCGAVLSVRSGEDVLSVWTRIDGGRNIKIR

SEQ ID NO: 36358 - protein, 106 aa, A.fumigatus
  UNSURE (51): Identity of amino acid sequences at the above locations are unknown.
IICYFDEPCCLYMPLLGTISEFLAPLISPNRRSNRQNPIPAPPSDVTSDEXQRTQVSGVSDAPHLGSLASVIQSGIEPSIQARNVSWNYALSIVLVSSPIPSRVHF

SEQ ID NO: 36359 - protein, 285 aa, A.fumigatus
PLTMDDPPPPPPPHGENPNTTHGFKKGSGLPDGNYDIFIIPPHSSGSGFLYLPSLQTHRNSFLAGAASALAVVYIWQTLSPIVKAWYLATAANGGGMGVAVLLAIVGIAGWGFGAYQAHIAGSNRDSGGSSQSRQSGPGARGGPGGARFGGHGAAGGGGSYHQSSGAGPGPDYSRGPNFGGPSPGPQGTYGSGGNYGAGPGPGGPYPGNQYGAGAAPPPPNAGTPPHTPPNADPGPEKPEPTSERSESKSKSGEDWERAREETRRKEELRRKSFHQAADGSEQRT

SEQ ID NO: 36360 - protein, 93 aa, A.fumigatus
DVNTPESFTDSWNSNAYYPPHSHSGLTTHLIRRGTLTITYPDDNSKLHNGEVKKETFGVGARIDVPAGKLHEVLDGKDGCEYVIGGFKFPISF

SEQ ID NO: 36361 - protein, 92 aa, A.fumigatus
  UNSURE (13): Identity of amino acid sequences at the above locations are unknown.
VVQALSDNMLGDXGMNTNDYNTGQTMFFLCFLFAELPSQLISKALGPDRWIPIQMVCWSLIAAFQSLIKGKSAYFACRALLGLFEGGLYVEL

SEQ ID NO: 36362 - protein, 78 aa, A.fumigatus
VSGWVRHECLYPINDAQIYRENDKPYYRTGNKVLIALAVYSLVLFVVARFYYEWRNKYVFSFPCFKRWLQKLICVVCR

SEQ ID NO: 36363 - protein, 63 aa, A.fumigatus
VTDPTTPKSSRIRYFHRVISSPDWTDLTLDTGKFNASKEENDPRKDANTTSCQKSSLCSGNFG

SEQ ID NO: 36364 - protein, 310 aa, A.fumigatus
ALSHRSHKTDFLPPHSIPDTILFLSFWYKSKELPIRLSYFWVSYEATAIVGAFLAFGFLHIRDSDGKGGWRYLFAFEGLITGIIGIIAAFWMPASPTQTKGGFRGKNGWFNEHEEKILVNRVLRDDPSKGGMHNRQAITPKMLWQALGDYDMWIIYLLGLTWLIPNTPATSYITLQLKSLGFKTFETNLLTIPAYAIFIANLLFWTWISERFNVRFLLGVVAEVWCLVLLIALEVLPAEASPWARWVILILLLGAPYIHAIIVAMTSRNAGTVRTRTVASALYNMMVQTSNIIANNVGVRLGQTRVSISY

SEQ ID NO: 36365 - protein, 149 aa, A.fumigatus
QGDQVSVWIVLQPVWKLVCFFFFFFCYLFHPLLNSTKTLLGLANPNSGTGDDFCQAGCLSDYGECKGISVTDSWRRALKDGKTDEEAGGQYYWDSTVNLFWTWDTPAIIDRKFKDIVNAEKLGGIMAWSLGEDTLNWEHLKAMQKGLGK

SEQ ID NO: 36366 - protein, 305 aa, A.fumigatus
LMVDIDWEYPGGNGDDYKKVPNSQKTSEIETYPLFVQAIRDAIGKDKILSVAVPGKRGDMIAFTKEQGPKIWSAVDMVNVMSYDLMNRRDNVTNHHSGVAGSLDTIKAYKEIGLDTAKMNLGFAYYAKWFMTDPNSDCAQQPIGCAVVPLENPDGSDPGKSGTLTFEKSSMAAPPDNLRTSTDGTCGYSKGTKCPSGSCCSQYGNWCVSSFSSFVIFFTPYSTLLRRFWAWLIRTAAPAMTSARQAVSQTMASAREFPLLIPGVVRSRTARRMRRQADSTTGIAQSISSGLGIPLRSSTASSRIS

SEQ ID NO: 36367 - protein, 255 aa, A.fumigatus
PIRRRDAARDRDGGCHSISKYLNDAETSTPPRVAQSSLRGTGPQGEQHGVFIFLSSTTRAAAMRLVYLLLPLSLGLPITIPVDGTEVYQLQHPEHHRQQQQQQQTILAQNRSDQDQPQIQPSSSSHGSFINLNLTRHKLKPNHYHQKNTTNQSTDKILQAYLHTLHTSHFCAHTLSQYAPELLALALFSLLPLALCILALSERIARSWTVEAYPERGRSRRRFLGRERRCLMQARREREKRAALDTVWWIAERER

SEQ ID NO: 36368 - protein, 107 aa, A.fumigatus
  UNSURE (12): Identity of amino acid sequences at the above locations are unknown.
AYDSDTTRLISXGSDQTQGVTHAIMAFAPSKQFNSDSSFTPFDTVNNMRKRFAPDTKVMIAIGGWGDTAGFSEGAKDEASRTKYAKNVATMINNLGFDGVGKFKIAG

SEQ ID NO: 36369 - protein, 514 aa, A.fumigatus
IGSTGRTFPENNTTSSTLPSYPPERRDLYDRVSNHATTPLYRRSIPAPRPTGSGRSNPPRLGRRDSGNMSFVMLTESQVGPPHTSSNNNGEGQSWANKRPSGVPNSEREPEEGSFSDQVERSNRLFEIISARSDIDHPICVECTEMLVDGLQKRLVSATKERDAYISFLRDLNSSAPTAEEIEAAEQSLKETLAAEEAAFEELVALEKEKAALDEEIAALEEESRQLDLEEEKFWRDRNAFALTLSEFQNERDALNMRYDHDSRQLERLQRTNVYNDAFCIGHDGYFGTINGLRLGRLTNPSVEWPEINAAWGQTTLLLATIAEKLGFQFQGYRLKPMGSMSRIEKIEYPRTSPAQSALGGGNAETSPAAKITTLDLFSSGDLPLNLPWLHRRFDAGMVAFLECLRQLGEFVEKTPAPVSSTRRGHGNAPVAGLKLPYEIKRDKIGDASIKLGFNQNDETWTRACKYTLTCCKFLLAHASNVASAGSSNSAAVAAAAVAAGEQARLATASPTRK

SEQ ID NO: 36370 - protein, 544 aa, A.fumigatus
TSIIMERPRKRPRLSLGVHGEDPDDIDLQEARAQNDLRLKSIFERIFEKYGKDFTDIGDEIDLQTGKIVVNNGHLQRMSSEGDTGEKDEAGWFFKEDLPTSTVQISKATLPGSVHDLEVATETGHDDTTDGVQLQRTLTSPQPLPALRLDRAYDEKRPPETGEADLDDDSRSVDSLLDCALIVPNDSDKPDSQALPLESEAFPTKAITTAKPPVQSQQTRGVQANEPVESIWRVPEIKGGFSTPVFYRSRPKLPLTAVRSVSPPKAGSLWALPGQSRCNTDGRKGKRRKKPGVDQRKYKLQSSPVLHDWSFAETPDGNESDDPLQEDYQPSPTPKTPIHIRAKSHLENTPSRTKDERRRLPPQLNPGSQPTINALHGATEPRIANSAASQLEPETIEKRADQCLSVDTHISAAKQHADPAIAQVSTPTRAKRTLMTPDEAKLIIRMRQIEGKKWKEVHEHFPQRKLISLIQWNQTHWTERHDKPRRISKPWSKEEVDKLQAFKDQQGLTWSHIRAAVPGRSHAEIEFALLRLWAELGQSTDVQY

SEQ ID NO: 36371 - protein, 947 aa, A.fumigatus
MVRKLEAQILKVHQRLSQPVGTSARVRLENELNNLESRNASLENDLKEIQKRIDDRHEGLEAGTQATGTGRMPNESRRDYLIRTGKITPFSRMGTGPNEGPLASLHDALIDAEDERDEDEALEQLKDRSAVSHRNLVRPGFDFDHESTDTSIAQTRPSKRRKLEGDARRKKAAIKQEDSDSIAADEGIEISEDNDESADYVASEDQESLLGDEEEFFPDGKPERPLAHKKGKKPGDEMEDFSGLDDGDERLYQSRLQSWVSRRSAARKRASKALQATEGHESTIDEQASTEEDEWFLPHPTVPDVSYDNGYRLPGDLNPYLFDYQKTGVQWLWELYQQKVGGIIGDEMGLGKTIQAIAFLAGLHYSKKLDRPVIVVCPATVMKQWVNEFHRWWPPFRVSILHTSGSGMVNIRSESSREDALLSQTYSSNSRGITSNQKAARKVVKRVVEEGHVLVTTYSGLQTYSHFLIPVEWGCAILDEGHKIRNPNTSITIHCKELRTPHRIILSGTPMQNNLTELWSLFDFVFPMRLGTLVNFRNQFEFPIRQGGYANASNLQVQTAAKCAETLKDAISPYLLQRFKIDVAADLPKKTEQVLFCKLTKPQRMAYESFLKSEEMESILKGRRQILYGVDILRKICNHPDLQNHKMQSHQSGYGNANKSGKMQVVKSLLELWRDTGHKTLLFAQHRIMLDILEKFVRSLSGFNYRRMDGTTPIQNRQTIVDEFNNDPNIHVFLLTTKVGGLGVNLTGADRVIIYDPDWNPSTDVQARERAWRLGQKRDVSVYRLMTAGTIEEKIYHRQIFKQFLTNKILRDPKQRQTSFQLSDLYDLFALGDEKPGATETSKLFQDAQVTFHGDGDGNTAQPTKAEDVSSDMQAEKNDISKVVGVSSVERYQGESEQPSDQEKGPGGVNSESRIMEGIFARSGVHSALEHDQIVNGKRVVRADPKI

SEQ ID NO: 36372 - protein, 114 aa, A.fumigatus
HVISSYSGAVMNCCDNSGARNLYIISVKGVGARLNRLPAAGVGDMVMATVKKGKPELRKKVMPAVVVRQSKPWRRPDGIYLYFEDNAGVVSTPFFCPFFLERRLRFVLVIAGYE

SEQ ID NO: 36373 - protein, 79 aa, A.fumigatus
NLKNIKPYVTSRMPSKRQQQLQYTNHKHTNIEDDSQCQYDPSPTASVGHGNAFDTRNSHQQTISHLSESRRCCYSHLGQ

SEQ ID NO: 36374 - protein, 571 aa, A.fumigatus
CVSPSRAHPRAGEPSQLSGSPYGMENGPPTSSEDWQERGAAVSVRQEIDANGKPVARYIKKGVRDFSFGQTLGEGSYSTVVLATDRQTLKEYAIKILDKRHIIKEKKVKYVNIEKDTLNRLTEHPGIVRLYYTFQDERSLYFVLDLCKGGELLGVLKRMTTFDEECTRFYGAQILDTIDYMHKRGVIHRDLKPENVLLDSQMYIKITDFGTAKILNNQKKTDQNSSGMPPLDSSEIPEDERASSFVGTAEYVSPELLTDKNACKASDLWAFGCIIYQLLAGRPPFKAANEYLTFQKIVALEYEFPVGFPTVARDLVERLLVLEPARRLPIEHIKNHEFFQGVNWGSDLWTRKAPRLRAYVPPPREPIKLNGGGDNDSFPPVISTAPSNAPNSNARVVPRLVTELPPPSQLDIEWSPVLTKTNERILKLGNWMVLSSPAGHSPASKNGSSEVEAPKKFSRFFGGSTTKKRQRLVMITSSGRIIMAAAGGDDKKAKMEISLLAPGTSYRSATDSKGFSCWIVDTVCSSLLPFKSSSAKFHAYSATNISSLKIQSHHQVPWVRPPCLSKNGWIR

SEQ ID NO: 36375 - protein, 247 aa, A.fumigatus
VLVRLAWHASGTYDKETGTGGSNGATMRFAPESDHGANAGLKIARDFLEPIKAQFPWISYSDLWTLAGACAIQELGGPTIPWRPGRQDKDVAACTPDGRLPDASKDQRHIRDIFYRMGFNDQEIVALIGAHALGRAHPDRSGYDGPWDFSPTVFTNEFFRLLVDEKWQNRKWNGPAQFTDKTTKTLMMLPADLALIKDKEFKKHVERYARDSDAFFKDFSDAFVKLLELGVPFTSKAEDRYVFKTSE

SEQ ID NO: 36376 - protein, 80 aa, A.fumigatus
TPSHLHTGTPDTSTVVPPHRPSPHIQDPPNQLPRDLYETLPPRPCPPSPPSPAQVGGHDHIPPAGQGQKASCKLLLSRRW

SEQ ID NO: 36377 - protein, 77 aa, A.fumigatus
RQIRGTDQNGKNCKITGDEMWQAYQDIRNIGGCGKCGTKHFGNGCMVSVDYYYGCDNRDKGVQVMAAFAETNLTDSM

SEQ ID NO: 36378 - protein, 93 aa, A.fumigatus
DLRISSLLIHSSAMRYLPQPIGSDDDSDTSSDIPDIFSDSVADDISESASKLDSSDDDSDDSNDDLILDDEEGQELSALHYLEEAKSLNVSQL

SEQ ID NO: 36379 - protein, 65 aa, A.fumigatus
NLSLSLVRNPDGGRPWLFIYSTPEFTKTFLGEKDDCHAVFDATSTTELNCAYIHKAISSAPHLYP

SEQ ID NO: 36380 - protein, 184 aa, A.fumigatus
GRPFSRGTPFFFSLLFIIVLLQRTGSCGITVGPAVMAPIQSQGADVEVCPGDPSLRDDGVSKKPITAEEAMEIAIGESNTVEYTIDSDNSPYLEVRANVPNTDDPTLPINTFRMWFLGVVFTLVGAVLHQLSMYAVPTDLGIDAGRHGCQPILLDALSECYHHVPCGAAGQLPCRVLFRKGTAD

SEQ ID NO: 36381 - protein, 155 aa, A.fumigatus
ASAIIQAQRVFLNMPTPVGYQILLALSMQMFGLGLAGLSYRYIIEPPQMVCRALMQEEEETDHLQIWPSTLANAALFQTLHSGANPIADGWRISRYRFFLYVFIGSFCWYWLPGYIFTGLSTFAFICWAAPSTSSIPPNEIGDFSNSSLCRQQST

SEQ ID NO: 36382 - protein, 61 aa, A.fumigatus
VNDSAVFSLNQSNPKLAMVIAVIRLSTVLASDYDRAWYLAPPGPSITYRLWLDLVDKKWFD

SEQ ID NO: 36383 - protein, 186 aa, A.fumigatus
VQFFISYRCTLSLLTWVLMQVGTGVNQFFSMRYPSVTITSLVAQLVSYPVGCFFAKVLPIKKVRLFNRWDLVINPDHHFNIKEHAVITIMSNLSFNQSWVSDYRPWTKGVPLTKSRQVLSFKHKESSSICQPQLVTKSCSLCLCRCSALAWLDYHIDILLNPRRWYAEHSCRKRKKLTTYRSGLRR

SEQ ID NO: 36384 - protein, 194 aa, A.fumigatus
VIFLTVHFADNKVLNNLFGMTTGLGYLPTTFDWSQIAYNTSPLVMPFWAQANVFAGWFCVYAVIAPILYYTNTWFTAYLPLTGSDAYDNTGNVYNSSRILDASGVIDETKYREYSPIFLPVTFALSYGLGFAVLSCLITHVLLYHSKDILSTFKGNNKKDIHARLLSRYPDVPWWWFAVLTVSSGVSAISPGKG

SEQ ID NO: 36385 - protein, 106 aa, A.fumigatus
VQAFQQSPLAKADPRQVIVVAVAIMTQYIWHTGLPFWGLFITLALAAIYVIPVGTVYAVANLNSNVLTVLGEIISGYTLKGKPLVLLIFKVKRSLHHGAGRIRGGD

SEQ ID NO: 36386 - protein, 198 aa, A.fumigatus
PSYRAYKADRHGVWHPHSATSQINTTSLSFLTLIVFLKSSISHFRTLQDKVMAVTKSSSLLIVGAGTWGTSTALHLARRGYTNVTVLDPYPVPSAISAGNDVNKVISSGQYSNNKDEIEVNEILAEEAFNGWKNDPLFKPYYHDTGLLMSACSQEGLDRLGVRVRPGEDPNLVELTRPEQFRKLAPDGVLQGDFPGWN

SEQ ID NO: 36387 - protein, 554 aa, A.fumigatus
IALCCTVKDWYKDDHSVDVKNTVIHPPPVFHPPPVQGFRKRDDGGSHIGTPNSHKQGKAAEGDKSGASAKHGGVTLIKGPSGNDGGNSAEIEFDSKYASAVEDHYKDDHSVDIKNHVVAPPAVPKGFRKRGSDPVLLGGPSGDDEGNDADFVFDDDYSSTVDDHYVDDHSVKAENWIVHVPPPPSPPRPEPSHPQKPSFVPPYAQGPPPQATAPPFAGNPEPPQGVDPAASEPCTTSTFIETVIKTFADDPVATKPAAPYSPPEHSQAHVPQTYAPSEPSHGFEPTHPAEAVPTGGFPPHEVEPPKDHEKPGPQKPEPTHPSFTTSKVEGHPQPTGASPTHEVEPPKEYEKPGPQKPEPAHPSFTTSKVEGHPQPTVPSYPPQENLQEPPEDSAPTDPGPGQSEGDAFPCPSGKPGGHQPEHAAHEYQPHQTQGVDPQEAPKHAPTAVEPLTSITSTITVSYTSSFAVVPVYMDSSHKTSCTSGAHQRPTDVDAHNSHHAPSSAHSQAVKPTHHAAPSPTHSQTLFTGAAGRITPAAGVVSAMCGLMAVLAFVL

SEQ ID NO: 36388 - protein, 153 aa, A.fumigatus
NKLRIDMSSDDAHTGGNLAEMAEHGTTMPNDAGLQNTLPSVPRPDQRSESHQFDNQGLAEPSLAFAADNATDLPRSTKEMGASGEVVTGTGDAFPVSGESKRINPGAMDPGARGNARTIKHANLNRSIFDRLAREDGNAHEFIREHEFRNRDE

SEQ ID NO: 36389 - protein, 153 aa, A.fumigatus
PPSRPPSPSATPPPSRSFPFTWTRATRLPARREPTSDPPTLTPTTVTTRLPRHTARPSNPRTTLLRRRRIARLCSLAPPAASHPLLALCQPCVVSWLFLPSCCKLSFVPLIAVAFVFLINILFSRFSYLMSFISLGLDFALTLALLSVFVSLQ

SEQ ID NO: 36390 - protein, 185 aa, A.fumigatus
  UNSURE (18): Identity of amino acid sequences at the above locations are unknown.
TSTGTHLVTAGQDARIRXWDASTGANTLVHFGPRVRNGVSSHLAERAPLIVPRGLMAPGQETFLWANFNEHDDRGEIFMFELREGTFIKRLKVPGLMAGRQQIRGRSNALSAARINSLAWRGNGGSGEGLEMFSAHGDGTIRAWVSRQPEGEPDEAEEAEQADRKRKRDILDEIYRGFVAPSTPA

SEQ ID NO: 36391 - protein, 66 aa, A.fumigatus
KQHELHQVKPTCAHHPFAIFANSNTLTSFFELEILQQLYAIGILGVIFQTALSPPCKPFGKWSSGV

SEQ ID NO: 36392 - protein, 538 aa, A.fumigatus
LWCCKGTYKPQIHTHYLPQLSLSWARHTDALNTTFLLLSSDYSKSIHLQSDRSLEFHTPSGCHYGTRLPRYGHDVVYDRQSTEALVPAVGVNQDGMGEVFRLNLEMGRYMRSFEVDVGGDDFTSTGGGTLQGGIHTGAVNTGAIAEESHNLLAFGTSMGTVELWDPRAKGRAGVLLPPNQTGPDDGRSEITALEFHRSGLTFATGSSNGLIHLYDLRSPVPLLKKDQGYGFPVHTLKFLQPSTFAREQTMEPKILSSDKKIIKIWDPRDGKPWTSVEPAVDINSVAWCKDSGMLLTANEGRQQHAFFIPQLGPAPRWCSFLDNLVEEMAEDPNDPNAFSTGQTGAVYDNYKFLTVPQLKTLNLDHLIGRTNLLRPYMHGYFVAQRLYEEARLITNPYIWEEERAKRVKEKIDKERESRIRGKKKAAVKVNKKLAEKLMAIEEKNERRQAQRVLKQGGDENMVEAPRTEKPATGLFGDSRFAKMFEDEEFAVDETSREFQLLNPSTIPEPVERKERGLTAVEQEEVDEVPGSSSEEDDD

SEQ ID NO: 36393 - protein, 127 aa, A.fumigatus
SSASDAERRVRSRSPHSGKISTSSYKRTNRPPPQMRVSSSTTSHSTRDRSFASRAQNMRTKTKRARRGGVVGEREFTFMPQDKSKQKKAPAHTPASSDYKSKERRSASGNTFRKSEFTRQGPEGMQY

SEQ ID NO: 36394 - protein, 267 aa, A.fumigatus
CRQTRQGPFIYPDSSVRCHRDPTEFGSGRLAQSSVSCIRIVIVTCPLSYRLSPPKLFFFYQRAISLESGNNFRCGGRGNPSVPSIVGAVTEQNMKLSNQSEVPVYTISGSNTARPLPEWLARRRKRSLKNDPEYANRIELLQDFEFEEASQCIRVSEDGEWVMSTGRFYLVKFMLFSLSLATDYGVVKEHTSLKFILTTFPNCLYLGRGIQMRSIRRSSFCPLITQSRSICNPIVRWSSIHPQAAITGRGFPDMVTMWFTTGSRLRL

SEQ ID NO: 36395 - protein, 65 aa, A.fumigatus
IYFLNFDIKAQRDFEKSTLDQIASWEASLDIFRWFSVGGEGLPLESVNQDDWLREIWEEDEWYRC

SEQ ID NO: 36396 - protein, 99 aa, A.fumigatus
LSLVTCSTMTPFHRLSRCFRQAPSPPRAPVSSNFPILNSVMKIEEEQMPAFERGLFYPVKLGDVFCSRYQVLSKLGFGANSTVWFGRDLQYSMALLPQQ

SEQ ID NO: 36397 - protein, 133 aa, A.fumigatus
YGFANLQGSHHCYIALKIYIRSSEGNWEVQVLKHLSSVKTHHPGSSLVRKMIEEFKITGPGGSHQCIVYEPLLMSLLYFQATLNPQSLPEDLLKGALQQLLLALDYLYSEAHVIYTGLCLSKPHTVCPELISC

SEQ ID NO: 36398 - protein, 107 aa, A.fumigatus
DIQAKNILISSKDDSIFREWDTSEAAEPGPRKLDSSHVIYQSRPFHRKKGWRGFGMPLLSDFGEARLGDVHNGLIQPDIYRAPEVILGMSWTSKVDIWNVGAFVCEG

SEQ ID NO: 36399 - protein, 70 aa, A.fumigatus
EPLVSLPAFAMPSIVRERRRSSQWFKECRTQKSFAGVPKLEVLIREFLAVDRLSTGTYKSNTVSTFAVTN

SEQ ID NO: 36400 - protein, 116 aa, A.fumigatus
KSLETFFGVGPQVSARLLARFHIHPTCKVGELANKQVLDLTAALSDMKIENDLRRQILDDIKRLKESGSYRGRRHALGLPVRGQRTRTQVGYPFTFAGLIRTRSCYELETRKGGAY

SEQ ID NO: 36401 - protein, 66 aa, A.fumigatus
PGTGLQLLVATFGGFVFDLSTFDDLDCLRRFVARTLGNIFDLFDDLVALKNLTKNNMATIKPTSST

SEQ ID NO: 36402 - protein, 160 aa, A.fumigatus
LVGTGGKSIYGEKFADENFKLRHTRKGLLSTALLEPLTRTSPFSNYTRHGKRWQGYQRLSVLHYHRSYSVSLPSVICLPVYTNRQLIPHVLLVGLMVAMLFLVRFLRATRSSNRSKMFPRVLATNLRRQSRSSKVERSKTNPPKVATRSCRPVPGQSLLL

SEQ ID NO: 36403 - protein, 61 aa, A.fumigatus
RSEQDPADGLYDGEPSEISTLSESSAYSLRNVAFLSIFIAMVFIAVKISKKAKQFNEKSEV

SEQ ID NO: 36404 - protein, 102 aa, A.fumigatus
AWQTLARIPTALSSSLPPFLLREFTFCDLLAGLYEPPTNTSCTASWLDGRHVVFGEVLEGYEVVEQIENVPKGPGDKPAETVKIVKSGEIKDESTKGSHEEL

SEQ ID NO: 36405 - protein, 64 aa, A.fumigatus
PGVSTGNDWTIFMEHSNIPVLPSTQKDVFRIRTTSGRSGLVQLWANATNIMWTGGRYYRVALCG

SEQ ID NO: 36406 - protein, 209 aa, A.fumigatus
VCCVSVSVMPTNLFSFMTASNGIALLVVGHVIAGLCVSITSAMVPVYQAEVAPKEIRGRVISLQQWAITCGILIQYFIVSDQLFLSKWRRFLTIDSNMVPATSTEVPITRLKVLLPSAFPGVSRWCLALSSSSACFSTPSRPVGLQAKTAGTKRWRYLPTFTEMETATIPRFWLNIKKLRRPWLWSVSRRLLAIRNWSSLAFSSVCSLV

SEQ ID NO: 36407 - protein, 151 aa, A.fumigatus
HYNSFLVILPSVSQRVVNNSNLVLVDASVMQPRPDSVILTMQSALKLPIGLPVRIDPITLDLFNRGESGNSTFAKLYLNGTTISGNTTLGVTSQFTPLNVDQWTKYVRGVVFEEHAPLSLKGTTMSYLGKLKSRVTMDKTIKQNSKRTSYQ

SEQ ID NO: 36408 - protein, 179 aa, A.fumigatus
GTTVLGLKSGDLVIGNATIDNLVLRPGNHSNPVRGRLDLKTVLKNLGPVLQSQKDSIRNGYLSLDSVTKTVVYEGVEVPYYTNVMKDLTLTAKIPIGGLLVNTLRGIFNKNGTNILDQLNITDSSSSESTSSVLSELQHLNLSSLGGSLSSKLTSRSLAEFLDRPDDKLLLVDVLKAFL

SEQ ID NO: 36409 - protein, 318 aa, A.fumigatus
QYGSSNVDGGPDNPTQSTAAFRIPWGIQMVPGFILFVGLFFYPKSPRWLASKDRWDEAMEVLANLHGNGDRNHPKVLAQYQEIEEALALEREQASTSYQELVKPRILKRVFLGMSLQMWSQLCGELIVPFSMRQRLMAAAIGMNVMMYYIVYIMQSTGTGSPLLTASIQYILNTALTLPAIIYLDRFGRRPAILIGFALQATFLYIEGGLQAGFGKPNPHDDPKLDAISWVVSDHPNVGKAIIALSYLFVCSFATTIGPTSWTYPAEIYPAKVRAKAVSLATASNWIWNCLLALFVPPLLWSINWKMYMIVRTCMENL

SEQ ID NO: 36410 - protein, 155 aa, A.fumigatus
  UNSURE (155): Identity of amino acid sequences at the above locations are unknown.
TIDLLHINPSHPRQSTTPTAAYRNIEPNTMLIIGLTGSIATGKSTVSALLASPPYSLPIIDADLLARQVVEPGTPAYKAIVNYFGPSTPDLLLPPSDGDATSSQPPLNRPALGRRVFGTSEERKRDRMILNKIVHPAVRWEIYKALIYYYVRGHX

SEQ ID NO: 36411 - protein, 180 aa, A.fumigatus
RLVLMAGARYIIDNYEHLPDVMLVIHSQRFQWHNDDPYYDGVPVLRRFQVSYLQKQGYVNLRCAWTLGCPAEIHPHTDTHRDDVHAGEYFKNGFMELFPGVDVPDEVGVSCCAQFGVTNWKVRERPKSDYVRFRKWLSETPLKDDLSGRIMEYSWHSMFPTPLPLRHSVFIKQCGANSHQ

SEQ ID NO: 36412 - protein, 98 aa, A.fumigatus
ASVAKGADESKSTTCFISTVSRSTTCPKNQFLPISTSYLLLLTSLTILGMTLNSNRKYYKTPSTIVASLLKIYKAADYILLNKYKFNHTNARYCINGL

SEQ ID NO: 36413 - protein, 101 aa, A.fumigatus
APDALAEETTGQSYVNGDALTNSAYAMVIFNHRVFLAGEYVTAEKSKPEIESRLPPRIRPWTCQLSRQDVEGLPSGPVTDFLENPDNGNNSSREVGIFSSW

SEQ ID NO: 36414 - protein, 77 aa, A.fumigatus
EQNATIQLQAATSGWWILGPSTINYLSRDETLIRELHGLIYTIYHEEKMPTSLLELLPLSGFSRKSVTGPDGNPSTS

SEQ ID NO: 36415 - protein, 184 aa, A.fumigatus
QADRAPSSTLSPTLTGLSLPMVEPMRMTSTMSRALPRDQWPTEPGKTVKLQEFTDPSPFSIPAKTAMSRIIYSTTNANGTLVPASAYILWPFQPKALRRKTQNNSGLSSAPVVLWKHGTSGFYANGAPSTHRGLFYADIVPFALAEAGYAVVAPTMPASAWTSPGTEVTFRTSTLFAKLVLTML

SEQ ID NO: 36416 - protein, 90 aa, A.fumigatus
AKISIASKCVASSSGTSIPGESRVILFSALVSAEGESSTDCTRLRYSAGALFRKLMMIRRSICGDSIEVTLIMYLATHGETLHNPPPDFG

SEQ ID NO: 36417 - protein, 175 aa, A.fumigatus
  UNSURE (94): Identity of amino acid sequences at the above locations are unknown.
SHDPSEIFQVYFACKPISDRLSNACKGDIVEEKHGFAEILSGAGWQMDDILEALESADDFYCERLGVVKMDCWSRGRVLGDAAFCPSATTGMGXTRILVGVYILVGEIGKQCKRSFGGDIDGSTTKDALSRAFKAYGIFRPFLDQVQRGLLDGYSFSDRLPSTSLVLLFSILPSL

SEQ ID NO: 36418 - protein, 278 aa, A.fumigatus
LWTPSSSKLLSVPLKMNSQRIAYFGATGGCTNACLALSLRQGLKAVALARTPKKLHDMLLSQGISEETISANLIIIQGDITDVAAVKKTLMSGDERKLVDKIVSGVGARPSFQLSVTTPVKMDNPHICEQAITTIIKALGEIYAEYPDERLCKPVITVISTTGVDGPDDVPFGFKSLYSVLLAVPHEDKKKLEELVKSDELKDASSRVFGGAVIVRPSLLVGDHQIASIGAKKLRVGTEENPPIGYTVHRARVGQWIFEEVVTKSKVDWVGKIVTLTY

SEQ ID NO: 36419 - protein, 160 aa, A.fumigatus
  UNSURE (137): Identity of amino acid sequences at the above locations are unknown.
HMLVTMRLSRSIAVFTLVTYATGLPSLQVIPRGEPQLPLLDPSMTIKEAARKCGDKAQLSCCNRVVKAGDYTSVYQGIGAGLLSNLAGGGSGISSILAFDQCSRLDAQGEHPNRISSAREMTNSRSPCGPFTYPGSXEPALQAKRGLLSEEPRRCGMYLT

SEQ ID NO: 36420 - protein, 122 aa, A.fumigatus
TTTLPLDCVYPYGLPRSNLRKSKMPHLNPPSNEGKEPSTGTRPTGSAGYASLDALSTREGNASGRVFGTGTGGTVTSPEYSTALNSDVMQNAESDRAMSKEEADRMHEQRMEEEYAKREGGA

SEQ ID NO: 36421 - protein, 73 aa, A.fumigatus
DTPTAAYRSDVVATAVTHSIHLRLHKQIAGCHKAIWVYITRLVQSSEPLPFLLIVSIHTDYLEAISANQRCLT

SEQ ID NO: 36422 - protein, 223 aa, A.fumigatus
ILFTFPSNFFHLSLLSFQRALSCNPLKTYPSHTILTFSTTLLLALTMQYKTLPLLIMAATALAAPEARPEAAAEAAPEAVPEAAPAASPEDVGKRQYEYYSSLMNELNSLSVYPQKASKLNDTNRSCGYRADTSNWDKFLTNIDYNQYLTNTEYKQYLTNTDFGGIPTNTAADNVPTNTKLGGVPTDLEGLPSFSMPTAAFTYDGMPPPSISSRRPGLERTAL

SEQ ID NO: 36423 - protein, 73 aa, A.fumigatus
KKKLDTKRLGRMSSLRCELEICYSGMISRKPMGLILTGTDRKSCQSQSWTVRAYNTEKYTTHCPRRVWSDKFP

SEQ ID NO: 36424 - protein, 87 aa, A.fumigatus
SCPNNIFPVHIAMTTFYPGVLYLAFFFNDLCGIIRPHALFSPYMNVMSIFSLGRRRQHMKMGVPWFNYSRHNTKLSRGWREWALIVK

SEQ ID NO: 36425 - protein, 134 aa, A.fumigatus
SQTPVELTQTVNMTKLSLLPLLTLASAVLAKQDAFQAKCASFGRKIKLPNVHVNFVEYVPGGTNLTLPDNDVTCGASSQVVSADMCRVAMAVDTSKSSQITLEAWFPREYTGRFLSTGNGGLSGCMASSKPLQK

SEQ ID NO: 36426 - protein, 394 aa, A.fumigatus
SSVMANIIIGIQYYDLAYTAGLGFATVGANNGHNGTSGKPFYQHPEVIEDFAYRSIHTGVVVGKQLTKMFYKEGFDKSYYLGCSTGGRQGFKSIQKYPNDFDGVVAGAPAFNFVNLISWSIHFYSITGSNTSDTYLSPESWKVVHDEIVRQCDEIDGAKDGIIEDTDLCQPVIETIICKPGASDKTNCITGAQAKTVRNVLSPFYGVNGTLLYPRMQPGSELFASSVVYNGQPFRYSTDWYRYVVYNNPDWDATKWTVEDAAVALAQNPYNIQTWDADISSFQKAGGKVLTYHGMQDQLISSDNSKLYYARVAEEMGLGPEELDDFYRFFPVSGMAHCTGGDGAYGIGNGLRTYNGAEPENNVLMAMVQWVEKGIAPEFIRVPSLTPPAGRSAS

SEQ ID NO: 36427 - protein, 477 aa, A.fumigatus
QLTIRIQLDDRPLDLFPIHVVVLPHGNRRERQNHNRRRRDTLILLTLRPCMVDCIPGRTAGRVHHLRRRAPQVDSRRIAFQVVREPSEQRLWEGVGVDGPGNRVADRPAETAGQADHGDHHGHAVAVRGRHDGHLVPDHERAAAKGDEDLAHHEIPDLALGAAEVDHEAGAEEHQRGAEIQAGFLEVFGLADPDAEEDGPEGRADAVDLCHVAGVGGVQVVDDLEVVVVVLVPGVIVEENDRSQNAGPEHRPVLEELPLDESGRGEESLPYREDGEEQHADDDHADKGGRGVAAEAVRLEAEGQEKQDKGSHEEKGADEVELAKVMPEGLERRPAAGVPDKHARLLGLALVELEDQRERHKGEEDDDGETAVGPPPRGMGIERLRSERANKGCTDGRGANECVGKCPIAQPGRVRDKDNQDEVDGRVANPVQRVSGCEAIGAIARGDHDNPDDQDPDENQKALGSAPEIEGFGDRQL

SEQ ID NO: 36428 - protein, 491 aa, A.fumigatus
  UNSURE (40): Identity of amino acid sequences at the above locations are unknown.
QRLLMDTVNRIWVCFFISKPAVFHQQQYDLLRLCGLLIGXPDLPGVYSLDYHRGSATAAYRQNPQSLGPSRGLSGFRRGLDRRDYRDRLLQWPQWLRSRIHAVLDWLHGRQLHPGCLCRGRVRAAQSGICLRIHWHPDHLYSLCWPARCAGVLCPFHVAVGLRLFRHRHLLHLCASRAGLQVLPAQGREDGRVCPGPQRPDASPVLPALLSRVRPRRRLSPHGCLCPVSLALQPRDVRLQRLLLGHLYQHGRHRRAALPRLRDMGEILRPDRFHQVAALQEPDGARGLHFGCGHFLQLLHLGPVLLLLPPGRLQPEHRQHRLHDTDLQRRLDPLGRPLRHLDPPDQTLPENLPVFRRPADAPRRRPHDPLPRRREQDRVSRDVPDLHRLWRRHARDRGRDGRHGGRGPRRRAHDDRHDQPGRQFRRGDRLRGCRGHLRQHLPTGAAPRAPGRPERRFCDYLPGGLDGAGDVPARQCGPECNQPCMDGESEV

SEQ ID NO: 36429 - protein, 517 aa, A.fumigatus
  UNSURE (32): Identity of amino acid sequences at the above locations are unknown.
TGSGCVSSFLNLQFSISNNMIYYAYAGFSSAXQISQAYILSTIIGGVLQLPIAKTLNLWGRAEGFLVFVGVLIVGIIVIASCNGPNGFAAGYTLYWIGYTAVNFILVVFVADASGLRNRAFAYAFIGTPTICTAFVGPLAAQAFYAHSTWRWAYGCFAIVIFFTFVPLALVFKFYQRKAEKTGVFVRDPSGRTPLQSFRHYFREFDLVGAFLLMAAFVLFLLPFSLETYGFSGYSSATFISMVVIGVLLFPVFAIWERFFAPTAFIKWQLFKNRTVLGACILAAVIFFNYYTWDQYYYYYLQVVYNLNTANTGYMTQIYSVGSTLWAVLFGIWIRQTKHFQKTCLYFGAPLMLLGAGLMIHFRGAESKIGYLVMCQIFIAFGGGTLVIGDEMAVMAAADRDGVPMMIAMISLAGSFGGAIGYAVAGAIYANTFPQALLRGLPDDLKGDSATIYLGGSTAQVMYPPGSAARNAINHAWTESQKYECITATAVVVLAFPAIAMWKNYNVDRKQVKGTVI

SEQ ID NO: 36430 - protein, 71 aa, A.fumigatus
TMAATTEKDLTARTTANIEAASDTVSLEEKSEREILERPNEITQDAQIGVQKAEATALVWSKTALYATYAW

SEQ ID NO: 36431 - protein, 228 aa, A.fumigatus
SPLAMAPMASQPDTRCTGLATRPSTSSWLSLSRTRPGCAIGHLPTHSLAPRPSVQPLLARSLRRRSMPIPRGGGPTAVSPSSSSSPLCLSRWSSSSTSARPRRRACLSGTPAAGRLSSPSGITFASSTSSAPFSSWLPLSCFSCPSASRRTASAATPRPPLSAWSSSACCSSPSSRYGRDSSPRPLSSSGSSSRTGRCSGPAFWLRSFSSTITPGTSTTTTTSRSSTT

SEQ ID NO: 36432 - protein, 97 aa, A.fumigatus
PKQNSKLGLWDFSLGISCFLSFSGYLVHAQLSMYARALLYDHGSDMYTGTNRDHNAITDPPMSLFSHLPQSHGSPSHAPSAATSDSLSLHIDSLFQF

SEQ ID NO: 36433 - protein, 475 aa, A.fumigatus
PTHGPRFRSSLAVIMSRILVLRKKPQLIGILEEEVLRPAKKLLEGAREGKKTSPGIPDMPSRATSVASDYDGQREYVDRESMPPPPTPSTVSPATGTRRGRSRMSTRASTADIEENNVPSTPSIVTKKKVPKSENKHARAFDRELHDDGPVTPVARDMVTPRKSTTRKLRNSEIAPSIEPEPHTVYVKSEPKEDSVFTDDNPFQSGSSPASRSISRDVKRKTSSRLSTASPAFSHGLRPRKSETPYDLDGDISRTPTRSPVGSPVFPREEVEMDGKEDESELSAGEEFTPEEQLALEKQQAELMYPTAPRIRRRAAKQSTANKAAPWILIFSLLCGFGGWWRKEKIEIGYCGIGKPTWSLAETRVPEWARVLEPQCEPCPPHAFCYPNFEASCENDFILKPHPLSLGGLIPLPPTCEPDSEKARRVKAVTDKAIEELRDRRAKFECGERLEDGEDSDVSGNERSGSETGDCTETA

SEQ ID NO: 36434 - protein, 215 aa, A.fumigatus
QRPQRNHRPSDVLVLSSTSIARLPLTCAFRRHIRLSLLAYRLPLSILIIMVLGLVYTRAKILARRSDLARVPELVATTLDRLATQAALHARGEAREPYIPIGQLRDDVLRSELHGKRREELWRRVRNVVEGNANIRAAVREGRGGDVARVWEWIGGIGGVHGNALESSAIRRESNRQLSYSSPSSEGNRPPGDQQQLTPRSPGELRRWDEGRPVY

SEQ ID NO: 36435 - protein, 98 aa, A.fumigatus
VGQLAVTLSSDSAALESIAVNTADTPNPFPNPRNISTPALADRSANVGIALNYIANTPPELFTSLAMKLRTEDVVTQLTNGDIRFPRLTASMKRCLCR

SEQ ID NO: 36436 - protein, 81 aa, A.fumigatus
EPSQSIGGLRLVSCSLPMKCLTQAMTDSCRPRIVSPVREPAKYGSLEKPSQLRPPRAVRPRGPTTGPRATLTPLRLNSAPM

SEQ ID NO: 36437 - protein, 83 aa, A.fumigatus
IAAISRSCIPWLLVLKIASIDSSTLVSSEGKMKLTVPLLAAALQLAGIAAGQEDAAIAANLEKFWSYGRSEPVYPSRKCDRES

SEQ ID NO: 36438 - protein, 495 aa, A.fumigatus
  UNSURE (28),(34): Identity of amino acid sequences at the above locations are unknown.
LTVRCSTAETQGLGDWNEAYAKAKALVXRMTDEXKNNLTYGYKSTTNGCSGNSGGAPGVGFPELCLQDAGNGVRGTDMVNGYASGVHVGAAWNRDLAYERAHYMGAEFRRKGVNVALGPVVGPLGRTARGGRNWEGFSNDPYLAGSLTGETIRGLQESVIACVKHFIGNEQETNRNPPMLWEGSYNQSVSSNLDDKTMHELYLWPFQDAIKAGAGSVMCSYNRINNSYGCQNSKALNGLLKGELGFQGFVVTDWDAQHSGVAAADAGLDMAMPDSVYWENGTLALAVKNGSLAQSRLDDMATRILASWYKYAEIEHPGHGIPVDLRKPHELTDARDPKSRSTIFQSAVEGHVLVKNTGNALPLHKPKFLSLFGYDGIAATGNTMDNVTFGRWVFGLSNTLNYPNGSAIDTKIQRDMFLSSYDPAAEGPGVALNGTLITGGGSGATTPSYIDAPFDAFQRQAREDGTFLAWDFASQKPIVNPASEACIVFVNELAS

SEQ ID NO: 36439 - protein, 183 aa, A.fumigatus
PERLSVVYRSQSLPVSSTSSAMSKRPTVTLRCFGRAPTTNPSRRTWTTRPCMSFTCGPSRTQSRPVRDPSCAATTGSTTATGARTARHSMACSRVSSASRALSSRTGMLSTQGSPLPTRVWTWQCPTPSIGRMEPSLWPSKMARWLKVVWTIWPPGSLHLGISMQRSSIQVMGFLSISGSLMS

SEQ ID NO: 36440 - protein, 577 aa, A.fumigatus
KRHRSSASHAWRASPGRSTQHLQSVFAAPSVNEGMSSAAMQTVPQYTPARSTATYVSLPHPIPASTSQYDYAQQLFNDLPRSTQPSWRSRDPHTAVVSTALSSQQPSSPPTTTYSSAMSDPHEQAPPLSTHASPSLNPTLPTPGQNSNRAPVYPDLQGAPPIPPPRTSSTHRTQHGSSTTSSSGERVSSSRRNKSKPDDRSTGHRERRGDEPRSHCSAAHSSEEPTREPSGKGSRRVQTGSSSAVDSRSEEVMETIPSLGTLVKESSTVINQVVVSDPSVDIMREQARQAEASISPSSDSAPPSGLALVGSEGVDDGGRGGLRSRHDFNENTIKRKETTFGQYILGQTLGEGEFGKVKLGWKKDGSVQVAIKLIRRESLGSNPNRLPKIYREISILRDLHHPNIVRLHEMVETDRHIGIIMEYASGGELFDHILNNRYLKDNSARRLFAQLVSGVGYLHKKGIVHRDLKLENLLLDRNRNIIITDFGFANTFDPSDELGEEIEYNLTNKEFVKRMRLDKPNAKGMRRGDLMQTSCGSPCYAAPELVVSDSLYTGRKVDVWSCGVILVSWHRLSLSSG

SEQ ID NO: 36441 - protein, 316 aa, A.fumigatus
RVFACCVSHHEQYNQSCGHCRHDSSSWSVFPHALLEPDANLSSCFAESHREAPALARSASVREPPKAYQSSIPTVGGLVHQSGDISQEPSVDRSKTSRDTKRRTVQVEYVAPQSQTARGESPSAPESPNAKPSEVLPAARPGSRDAAANTQVGALPSGVHMEQRSIRAGEPKAPAGSVPPTPGHLPRSTSDSTALTGTHTTMPPTQATRPTTGASMASFNTGRLPSRGSYGQPVAPTVAATNAQGRLAQPKSKQYVISAPIPQNSSQHAAMSIGRPSTQALPAKFNTTPRQEPLKGHKRSSLHHGAGRTAMVINIT

SEQ ID NO: 36442 - protein, 223 aa, A.fumigatus
YAMLAGYLPFDDDPANPDGDNINLLYKYIVSTPLTFPEYVTPHARDLLRRILVPDPRKRADLFEVARHSWLSEFSHVVSHITSSTTKVADIADTTVPPGQCSHTRSWSLTLTYRRVLQKAIGKPQRWLAVPPSESLRKHTRARYLRLEGLCINPETSPKSRQSIGQRLLGTQNGERYRSNMSPPNLRQQEEKALPRQNPRTQSHPKSFQPQGPAVEMRRQTHK

SEQ ID NO: 36443 - protein, 117 aa, A.fumigatus
  UNSURE (70): Identity of amino acid sequences at the above locations are unknown.
ISLYPLGFVCNQNEEEWAISALQDYLFEFSSSSQIFPTQLGNSTGRRYFASRRNGDREDRQTRAGKDGVXPPRRDRTHPLNYQAAPVMGLKAEGYQAHTLNTGERIDEMELSLRRGP

SEQ ID NO: 36444 - protein, 396 aa, A.fumigatus
SMSCRIGNIIKRVRDRLANQHPWWRQDSQTSDDESNYFTSAAPRATSPRAARSRKSRRHITDRSGYIPTPPSSPKYSLTIKNPSSLMEVLSQLWTTSGPTSPWKATNATFIYSLLLPTLNTFIRSLLSAIVGLPEEDIASSMTADILTSTSPFATLVLSFIASSLSAMLLSPIDTARTFLILTPATHGPRSLLRAIRQLPTPNCMIPSHLIPITILHSSLPNFITTTTPLFFKTYLSIDPVLNPSMWNLLAFLGSGLELAVRFPLETVLRRAQIATYTSPSIRQKYAATSRSNTSAATEETSVVETIVPVPQTYRGIVGTMWGIVYEEGVSAPSSDAERVLGKPISSRKRQGQGIGGLYRGWRIGMWGIAGIWGAGLLGSIGGGGDEEVMVSGGRF

SEQ ID NO: 36445 - protein, 106 aa, A.fumigatus
RFQKHNVSHPPAPSSAQVFGSSARDLLPDLDYSEYLESSPSLSEWIRDAMDAAIWRYTSVLTAQPFDVAKTILQAYVVPNSQDGQRPADERRRSGRMGSFDESDEV

SEQ ID NO: 36446 - protein, 112 aa, A.fumigatus
VTLSRGPCRPVVKTEGLAALSAGKATREERIAHAKEGKDRSEYKSVTARRKERKEAQGKSTTNKEKARRKNLFMTLGKAKSKNKRSLVETRNILRAHQQRQKRGGRRGNTGS

SEQ ID NO: 36447 - protein, 292 aa, A.fumigatus
IAGTLHSTALHGVLQIHHHPIPSKMSLAQNSNLDSKRRRFQPPITTFFSPAVSDSNGTDAACSPHLSHNHYAAATHSPTPIVPAKIQSSLLSVGMRVRKSVAEGYKTKGVKMFDTPTSTISLSAKHEHSTGRGFPTVRGELAPFCGLSKSCDYTVEPHSNTVYELSETRGYNVDIVTDDGDAFSLPPSSQESVYSANNGQKRSYDPYADEDASDFEHSVFVTTDTVPGRTILCPSLGRQRRRFVALQSQAIQQGTMQVDDFEEPVFLRRREEVDADYMPARMGDCEVKMGGA

SEQ ID NO: 36448 - protein, 260 aa, A.fumigatus
  UNSURE (227),(228): Identity of amino acid sequences at the above locations are unknown.
PPHCVTFHARAEELDGDGADATTSEFRAKLKSLKDIVNPALRRKQENANRPARVQLLQDSLKNSKTILDILQKQIEQDEELYSSSLSSATSTESKESSTSTTSTASSSESSSTTADPLDDFEKDPYTTPASETTSTTSTTTTPKPTGPKYSIFHPSDLSSLTKVYESTNTWLETQLALQEKLTESDDPALTVAEIDTRLKELERTMKRIYEKMGAAAAKSGKSSGEXXEENGKGNSQKPKKDKGKKEKAEKAKAPPKDEL

SEQ ID NO: 36449 - protein, 115 aa, A.fumigatus
PTNEQSALTAFSNNIGQIAYLQSEKHQVKHIYFGGSFIRGHHQTMNTLSYAIRFWSKGEKQAYFLRHEGYLGAVGAFLRRQPENWGRRNSIHDASSAIQAAKEAIPKKDEGLSST

SEQ ID NO: 36450 - protein, 63 aa, A.fumigatus
RGRLRTQLFPNALDDKISEFLDDKGNRLIEEVYQGVSRYFSATYFDVHNTTTWIHQYTSGYKH

SEQ ID NO: 36451 - protein, 128 aa, A.fumigatus
LCQILGVSTRLCRLQQQTSSSLARARKATYPAKATNTAKVTFKLVSYRSGAIHAFPLDECKYGKDLFDKARAFFFRLLDRNVDVKILSCQISSERAQHFLFGSEGEFELLIQHAKDSKRQKMEQLPLK

SEQ ID NO: 36452 - protein, 407 aa, A.fumigatus
NPIARRWKKLMGMATDPDNYTDTETFLDHLQRNPRVGPYDFWPLVADSTVIVQHVCSVAIFVCCFVGIVQERLSPVSVVCWGSVGTAMGWILWDSWVWREHHAEQAPNAGRIADGDDGSSSSSAVSSVNPSSGATSRPVGPKDGQNEVHGLGLTISSGEPDGLLRRRSTGFSGEAYGPCEPGSPSHQASGGLSNMHLHHGSQETDETSLLSSRNRQRLSTVKSAFLIYFSLLGLSPILKSLTKSTASDSIWAMSCWLLIMNIFSFDYGSGEGAGATKFPASLSTNAAVMASTVLASRLPSTTHVFSLMLFSIEVFGLFPIFRRQLRHTSWTGHVLLTLALVIVAGGAVGMTLRGGWTAAVVGSFLGSIMTAFAMGGCSWWLISLQKYKNVVTGPWDPARPIIRRQWD

SEQ ID NO: 36453 - protein, 98 aa, A.fumigatus
LTRRWALDDNGVLGRQASNQCNANWNLDIAHIEACKSNNFLDRWTGLEYFTYEEIIHDRMKGHVQFLQEWVCLFFLKHLFESSTRYVTARRDIQFLKG

SEQ ID NO: 36454 - protein, 342 aa, A.fumigatus
LAIELETDDFHKIFASMPALNSVNLRFAGQIKDRVFEYVIDRDLQIRQLQLDAANLVSDTYWRRLFQKLGSQLESLKLSNLDFSFDDETVETLCRNCTALKRLKLKQCWKIGSDSLRTISTLPTLEHLSLDTIQDLEIEPLLQMVNTLGPNLHTLSLEGFHNADDRLLDLIHDKCRLLSKLRFSDNALCSDRGFVNLFTNWANPPLRFVDLSSTRDVDNANPDGPVEAIGLASHGFIALMNHSGSTLQKLNISSCRHISRAAFEEVFQEEKTYPFLQELDVSFHTVMDDFLIRKIFQSCPAIKKVVAFACFNVRDVQVPVGVALVGGLTAQHSIVIEGPASG

SEQ ID NO: 36455 - protein, 270 aa, A.fumigatus
SNNISAAQIHQDYQRRVRQAEREVAANEPADELEEEDEYEDNDGETAEQRKKRKRKEAATLAKIKQSKEFARRKARRTGKPDDDDDVIAREMMYQKSRPMPGQLENCELCNKRFTVTPYSKTGPNGGLLCAKCSKDVADDERKSKAKKRGPRSGRRQNQSNLLDGIVQQGALSLVEMCAKVNILEQSFDKSCWRTDRIQKVADNHNDIEEFGDLPSRLLRRLSQIFSKRRILTSRTLNLFLRPELNFIDIYDAASMSLLVLSNFQRINLP

SEQ ID NO: 36456 - protein, 99 aa, A.fumigatus
  UNSURE (77): Identity of amino acid sequences at the above locations are unknown.
SSKLEHGTFHRLSFYASLLEVNTAQLQWNAPVASCLSVDMPIGMHYTHLPHISSTTSGLAKNCSHQPSDDSQPANDXTKVEYQGPWKPEDVWPSDEIPH

SEQ ID NO: 36457 - protein, 791 aa, A.fumigatus
  UNSURE (60): Identity of amino acid sequences at the above locations are unknown.
SVGGQHSSIAVECPRCLMSLGRHAYRHALHPSSTYLIDHIWISEELLASTFRRFATSQRXYESRVPGPLEARRRLAKRRNTALAGIAGSGPLEDIACLFGRNGREHMKWTDREGRNVHPETHGKNLLPCQSFEKMYRIPNCTKDSPPFPLRPPEPRLPFYSESVAPIELDTLDGTRGFPDASHKTSREQALEEFLRSRPSVTAIGIFVRQLNFDLQREPTYSRLILEHLLRRSANDEGAMKKVVEFLDDPYLNTRGAGNYLCALKHTLSTAAVLRKQPVFDAVIRSLELGLLHPSELQDIIKTISNVRFKRSNGFTTRNSRFLVRFHREMWDAIGRCDVYRHRDLGKEIVDAWLSILCERQTYEDFILAKDVILATQDPSSADRRWVPTLIACWLKDSAESRRSSNRHFIKELLGYFHPTATSEIIIRTTEYMVSTKMGCLLEWQRRLSELDNITNIVSSQKWVDIGTQHTAELLGSPQEMNSTLSLRHQIILRIWMLRALSKSLPQGPLWRKDQRVTDSPITHLCTIYESTLDKDGGYEDLLSSLMLEIHTLGIPSNGLLMSVVELKAAKRRTTRAQRRTLAKLETTKVSFAEMFSDIHAYNASNTHFFAAYEKMVRQIDITDPSFVNHAIEIARDGNIQRIWTLIRLFRCHTPLKIAISSFWPRVPDPSEKALVRYYPEPRTSLCPDPHLAVEMLHLFAISLACSRNISPRRAYALVHWLYNFLMKHNAHVKPSLVRAMYHAGVLRFRRAGLNVAPTQYAYILDRVKEIETPEMVQALMEPPRMGESRK

SEQ ID NO: 36458 - protein, 210 aa, A.fumigatus
  UNSURE (32),(63): Identity of amino acid sequences at the above locations are unknown.
SIISPPRCWCAVAGTVADTVFTTAVIRSNIVXHYLSTGGPPRLVTCMTLLKQHLFRYQGHIGXYLVVAGVDPTGVGLFTVHAHGSTDKLPYVTMGSGSLAAMSVFESMWKPQLNREEAIALCSEAIKAGIFNDLGSGSNVDVCVIQKDKPTQLLRNYMRPNERGEKERNYRFPRGTTAYLNEKIITKQDLRKYVTVEDVSGDPNLMEVDS

SEQ ID NO: 36459 - protein, 66 aa, A.fumigatus
NSLCKELLSFQRLAYGDPISKASLRNWTGFEKHGSSGSPDSSGFALVLWFPITLDQRLLLRFLYIV

SEQ ID NO: 36460 - protein, 165 aa, A.fumigatus
IRTHPSTLSNNYPKPLFPTSKMDQPPLSPPAEPESISTANLPSNAPVPLDSPLRTNPIHPSLPDIRVPGSPLRPYQYDPVTCTPIDLESDSFRTQLDHLRTEYATPSAALKAQEQVAKEAKRKIEEAEKKREEVQKAMDKKVKERDTEMKVLSKYQKVRGLDIPS

SEQ ID NO: 36461 - protein, 369 aa, A.fumigatus
PRFEFILRVSLTVLAYRRFLLTKIFAQIIDLNNVPLVSGTAFVKWRLPSSSTAEHHGHTDKAIILDHRAYWNYEKTLQVRLTIDRNQTLHECELVLDIIQEFGSGGHSDKNFLGRIRLNLAEYVDKSDDEEGIVRRYLMQDSKVNSTLRVGIVMHQIDGDRNFITYALLSLIIISLVLIASSPPLRSAAVFAGIAGVVSSEQADHDELGRLPSINTQSREVADMQDMYRRTLAASWLCGTDDIPADKLIEDLFATGSCGNDEHPDARSRRTADNNNELHPDRDTDTRQTRSGNRLSPSFERRPKSSSSQFLNESKGSDSSGHIRKGGSIQEQLQDSANGKTWKSRSEVDELSEFDVREDLRSWEVSVKE

SEQ ID NO: 36462 - protein, 67 aa, A.fumigatus
RILTDKIASKALKKLSITKNFMERLARNNLPIFPYAFTVREAGSRASGLSMHHPLQRYSTIISESPA

SEQ ID NO: 36463 - protein, 73 aa, A.fumigatus
CLLPYGSVSNDSLPWYDRVRLGGSEGLVRNCVVATVKFQHPQNANVHALCLILGSVNPTSTKQVQGSRSPPES

SEQ ID NO: 36464 - protein, 76 aa, A.fumigatus
LSGQRYTIATETTPLPNKTVGAEVMQRYYDHWFNVTNTVLEVPNMLGSIAFQPMPRTITSKAKARGGVIAESLHSI

SEQ ID NO: 36465 - protein, 129 aa, A.fumigatus
KAQVWGGNYIFTADKTPQVLSALRDFTEHYPDDKAAIIVTCEHGLLIHTWIMFLFYDGPEPPEGVFTNFTAIGPTDTTKTWDSYYDLVSNPAVSHLEWLISYRNSLNITIFLFCSKMIFSVLVSATDFD

SEQ ID NO: 36466 - protein, 121 aa, A.fumigatus
SLKAFIASKNALTTHKDLLDFPTDQDYIIIELDFSYAFAADDGKIDAANQNLYRGFDNIISDNIDKGLLPDVYRPLFLNDAYFRQDYWGRIRTREQALQTRIKYDPDGFFQKRTSGGFRLH

SEQ ID NO: 36467 - protein, 180 aa, A.fumigatus
RTIMTRGQPWRAAVAITVAALARLSAADICSVIKQQGIEIQKPLSPHYYKDLANYWSAACGDLKPTCIATPTSALEMSAIVKQLHNFDDLFAVKSGGHMPNNGFASIQDGLLISTENLDQVIYNPEDQTAIIGPGLTWEDAQKGLDGTGRTLVGGRLGGVGVGGYMLGGKLQSLRWLTSH

SEQ ID NO: 36468 - protein, 76 aa, A.fumigatus
ADINPLHSFDTIGYHLLNPYTINMARYGALGATFQIGRNVQACSLIAIIGLTSQFNGENVSKNRTAASRFFGQIPG

SEQ ID NO: 36469 - protein, 452 aa, A.fumigatus
LWPPKMRNGQLGTMSGVYGTFSDLADPVPAKTPVPRKADFIQLDGVSQPAVADIVRSFVRVSCTMPLKLDGYPQAKKTGFGLVIDAGKGLVVVSRAIVPYDLCDINITVADSIIVVAKVIFMHPLQNYTIIQYDPSLVQAPVQSAKLSTEYIKQGQETIFVGFNQNFRIVVAKTAVTDITTVSIPANASAPRYRAINLDAITVDTGLSGQCTNGVLIGEDGVVQALWLNYLGERTPNSHKDVEYHLGFATPALLPVTSKIQQGIIPKLRILNMESYVVQMSQARIMGVSEEWIQKVAQANPSRHQLFMVRKVDCPPPQFTSNADSLQEGDIILTLDGQLITRVSELDKMYEKEVLDALIVRNGQEIHLKLPTVPTEDLETDRAVVFCGAVLQKPHHAVRQQISKLHSEVYVSARVCSTLYLKFNVAMVLTFSRVAVRRRINMAWHRQISSPP

SEQ ID NO: 36470 - protein, 69 aa, A.fumigatus
FGTLDPLAKSYFVTIHVSGDSRYSHNMDLISSEWMNSEHSDLYYQPAQAITFGPLPYFSMNIITSPAAR

SEQ ID NO: 36471 - protein, 148 aa, A.fumigatus
CSHGTNLLQSRGSPAYQYGLAPTNFITAVNGVSTPNLDSFVREVSMIPDNTYFRLRAVTFDNVPWVVTMKKNDHYVGYLFSSVGYLLTAGQFPMSEYVKDPSQPLGWRTVSHERDRHKDGITPDAANLNPDAMDEVYEEVSDVEPEVD

SEQ ID NO: 36472 - protein, 266 aa, A.fumigatus
  UNSURE (257),(258),(261): Identity of amino acid sequences at the above locations are unknown.
GHGRLDDIYDSVTRSATRRGWDGVDLVVIGGDFQVRLIPNSSVLFASNFPTQAVRNSNDLACMSVPQKYKAIGDFHEYYSGKKTAPYLTIFIGGNHEASNYLFELYYGGWVAPNIYYLGAANVIRCGPLRIAGLSGIWKGYDYRKPHFERLPYNNDDVQSIYHVRELDVRKLLQIRTQVDLGLSHDWPNRVELCGDHETLFAKKHGFREDSNNGRLGSIAARFVLDRLRPAFWFSAHLHVKFNAVVQHARQLFLHQXXRKXPRMAL

SEQ ID NO: 36473 - protein, 219 aa, A.fumigatus
ADIHKSLFSHISSSPFTFDDMPISDHTPRLNFLKDSASVLDSLSPSTASHLLMVHNRVLHDEFKPLTQRQLDFACGACGSIRKPERTKTIEIRKKKAKSSSSFAPKKSSALGATVYKCLRCHRRTVKPAARPNIKSKPDTTAAPVPTTQSTTSTTTAKYVSPTAQSGEADRSSKTADNASSKKRAKARKQGGLQALLASKQQSQSKSSASLDLFDFLQQ

SEQ ID NO: 36474 - protein, 213 aa, A.fumigatus
TQSARQMSSDSMSDYSHDEEHDPQADELRETALVTLETLISSCSQQMQPYLANAVKSSLRFLKYDPNVADVEDDEEMGGTQDDGSEDDATEEPDLEDDEFGDFEDEGGYSDIDDMSWKVRRCAAKLLYTVISTYGRTRALDDTSLYQQIAPALIARFKKEREESVKLEVVSTMTALVRKTSEGAMIITSNGFLESVGGSKNSRKRRRQETTLV

SEQ ID NO: 36475 - protein, 64 aa, A.fumigatus
ILRPKWRELYAARRRQRCAAFHLPELPDTFFGWMPVLFRITDEQVLNSAGLDAFVVSSLLVLSP

SEQ ID NO: 36476 - protein, 400 aa, A.fumigatus
FLSFFKFAIRFSNIVFVFPVIIMGPVHFKYTGKYGMPDWDHDDGDDGKDGKKKLISDPNYLWMYVVFTYIFSGLAIYMLLQETNKIISIRQYYLGSQTSTTDRTIRLSGIPKELASEEKIKEFMEGLRVGNVESVTLCRDWRELDHLIDERLKILRKLEWAWTKHLGYKRPKHSENSISLTRQQPRGSSLLSDGDSEHTQLLSESGRAHISEHVQRRPTIRLWYGPLKLRYRNVDAIDYYEEKLRRIDEKIQAAREKEYPPTEMAFVTMESIASSQMVVQAILDPHPMQLFARLAPAPADVVWKNTYVSRPRRMMQSWFITGVISFLTVFWSVLLIPVAYLLELETLHKVFPQLAEALARNPILSSLVQTGLPTLVLSLLTVAVPYLYNCMFTFFLAVSA

SEQ ID NO: 36477 - protein, 188 aa, A.fumigatus
TDHNTGLSNQQGMVSRGDIELSVISKNFFFSFFNLFLIFTVFGTATTFYQFWETLRDAFKDATAIAFALAKSLESFAPFYINLIILQGLGLFPFRLLEFGSVALYPFLFLSAKTPRDYAELQTPPTFSYGYSIPQTILILIICVVYSVFPSSWLICLFGLVYFTIGKFIYKYQLLYAMDHQQHSTGRA

SEQ ID NO: 36478 - protein, 95 aa, A.fumigatus
FKISEILDTAAKTQATTPQCFFTSTISLQSDCIPSQTATSCSIRNSTPDVSSRLPKPLPLGHNHVPDAYVNATIETYIQHTLGASREPCLSQSPP

SEQ ID NO: 36479 - protein, 82 aa, A.fumigatus
DKRMGLRVSSMVYGYHNFIYFKYANGISNPLQQIINIKASLTKFHVWRRHNIGQVSNLPTMTEWDTIAELHQLSRMEVQQVG

SEQ ID NO: 36480 - protein, 425 aa, A.fumigatus
ERSLKMFHTFALRHSNPRAATGEERRGRRPGLRACKECRRRKIRCTGTHPCEPCLYYKKPELCRYSDPRVPHIGTRGNGSHADSQYLSVLERLFPSVSLQSLASLTREELLDLLRDSILGSDRPPSQPPEGAEDHSRSSFEAMSTGNADSGDVNAVNDKADVSDDVNALSMATRPPSTYLGISSINAVLKVISWVNPESIARPFTTAPLRNKPRPKAQVSRPPSTDCHAPDQLIDAYFNFIHPFMPLLDETDFRQTYVSNTRRDEQWLALMNMVLALGSISFYPSDDTTHITYCKRARQHLSLESLGSAHIETVQTLGIMAGHYLHYISQPNLAYVLIGAAIRMATALGLHKETADTDASESRPLQSSSVPVDLRRRIWWSLYCLDTWGCMTLGRPTLGRTSMAVSTKPPAVRSPFPSVVLALLN

SEQ ID NO: 36481 - protein, 195 aa, A.fumigatus
  UNSURE (157): Identity of amino acid sequences at the above locations are unknown.
ARNPRPSPWNSNLISPTPGRSTMAEGVFRNMASTHPLINEIDSAGTGAYHTLEPPDSRTMSTLRRHGITNYNHAARKITKDDFLHFDYLLAMDKYNLRDLLDVRESVVASLRKSGGAKGTRASSGGAGAKVAEVRLFGDFGPGGVLHDRIGGGEVVXDPYYGGVNGFEEVYQQVVRFSKSFLEYLEKKQGSEVEE

SEQ ID NO: 36482 - protein, 218 aa, A.fumigatus
YSVERIPNSYGHNEAYEQRHHEQYPAYDYAVNPEAHHDAYYTQPYEPTVTPQSHYDLGQYHEQHQPYQDDQVPILQPENPFGPDPYSEEYHDDPAAVPTPSPAPIRRWKTVKEVQLFHGNLVLDCPIAPKLVSQVPHAEPPGRDEFTHMRYSAATCDPADFYEERFTLRQKLFAKPRHTELFIVITMYNEDDFLFARTLIGVFKNIEYMCNRTQSKTW

SEQ ID NO: 36483 - protein, 105 aa, A.fumigatus
GWSAATMGRGRPMACTEAVETEIGTHYHDQVREILSWEADAKSRGEELDDELKEMLVTFRRIRDEELEHLDHAIENDAKEAQPYDPLVNVIRLGCRAAIKISERV

SEQ ID NO: 36484 - protein, 111 aa, A.fumigatus
  UNSURE (16): Identity of amino acid sequences at the above locations are unknown.
ENRGDRPKSYILSMFXYPSGTLHMGHLRVYTISDVLARFYRMRGHEVLHPMGWDAFGLPAENAAIERGIDPAEWTKQNIAKMKEQLRSISTSFDWDRVCLAYVSIGLVDSR

SEQ ID NO: 36485 - protein, 781 aa, A.fumigatus
LLQVDSNGFSWRSGAKVEKLKLKQWFFRITDFKEMLLKDLDSLTGAWPERVLTMQRNWLGKSYGAKIKFQVAVDASGDANLHVNVFTTRPDTLYGVEYLALSLDHPIVLEAAEKDAALRKFLDEAASLPPDSKVGYKLANVTASNPLHIIDKESPHIARRLPIFVAPYVLSDYGEGAVMGVPGHDSRDLAFFKENTNSESIPVVIEPEHLSNPNNDSAGTVTRPNDMKAFTQEGILTSRCWKYQGLHSREAKKQIVTDLKGVGHGDFVEQWRLRDWLISRQRYWGAPIPIIHCESCGPVPVPEDQLPVRLPKIEGDWLKGKKGNPLESSQDWVNTKCPSCSGPAKRDTDTMDTFVDSSWYYLRFPDAHNKEQPFSPSTARQVDIYIGGVEHAILHLLYARFIYKFLSQTELFPEIARSGDGLGPSEPFKTVLTQGMVHGKTYTEPSTGRFLLPSEVDLSNPNKPLIKGTQVAPNISFEKMSKSKHNGVDPTSCALQYGADATRAHVLFSAPVSEVLEWDDTKIVGIERWFGRLWKLVLDAKQSLASASFTVSQNDLQKSPYATSKLPSLLQGLGDSDAEGLLHTHQTIVSVTNCIENNPYGLNTVISDLTKLTNTLTSSNPTSPQVLYLCVSSLVRLLAPVAPALASECWEVLNDTLIDQNANTGARVPDIFDCAWPSPLLTSEQADVLSARGGQIVAVQINGKLRFTVTIPRRLSPTTSADSSDSGAVTDEQDWIISRILETDEGRVWLREKNDWEKRRRVVVVKGGKLVNIVFYTGMLL

SEQ ID NO: 36486 - protein, 185 aa, A.fumigatus
TLRAFFCSFLVSAGVDSSCCFVFFFFFFGSSLSIRTGWISSKSRISVTLILCAFSTVRHCTSSISSTSSASDVSSRCSCCSCCSFACSLAIEALDRRALLEPKKFSSASSSSSNSAASGPATLFLFFPWLASSRTLSASELRKSCGFAALPVDGRRVKLCVDDGAAPLFNLVALVSNLKASIFNA

SEQ ID NO: 36487 - protein, 104 aa, A.fumigatus
LLRKHIHHRAKHQVHTQSADFHISNLATFQAYFQPLVNAARNPATLKNFSFQNVISRVRNASKKELAFAGVTAAEVIGFFTVGEMIGRMNIVGYRGHADHGDHH

SEQ ID NO: 36488 - protein, 698 aa, A.fumigatus
SDQARSRTSTYLHKHLPSYALKMDAFKLLTRATKLKSGAAPSSTQSLTRLPSTGKAANPQLFRSSEADKVLEEASHGKKRKRVAGPEAAELDDDDDAELNFFGSSKARRSSASMAKEQAKEQQEQQEHRDDTSDADDVDEMDEVQCRTVLNAHKIKVTDMRDLEEIQPVRIESEEPKKKKKKTKQQEESTPALTKKEQKKARRVYPQPLVSFKELRTRYKISRRLAENIAEQGFTVPTEVQLGTLPLLLGGFKASGNSKSAESIEPDLLVVAPTGSGKTLSFLIPVINKIVRHHHEQEKERGIFSVIVAPTKELASQIVNEGRKLVHGTGVKITLMKKGMRVVDREDDDDENSHSEDSEEGSDSEQDEPSTTRKKKGKAPITKSDILVTTPLLLVNALSANRTKPMATLPLVRNIVLDEADVLLDELFREQTLDIWRACTHPELRASLWSATMGSNIEDLAKSTIKERKQAYDQTKSYPLLRLVVGLKDSAIPNIEHKLVYAATEQGKLLGLRQLLHPAAASVSDVRLRPPFLIFTQTIPRAIALHSELRYDIPAEAGGSSRIAVLHSDLSDGQRSEIMKNFRKGEIWILVTTDLLARGVDFRGINGVVNYDIPNSAAVYVHRVGRTGRAGREGGIAVTYYTKEDIPYVKSIANIIDVSEKLRGKDGEKSIQNWLLDALPDLSQIDKIELKTHGVNAR

SEQ ID NO: 36489 - protein, 250 aa, A.fumigatus
TFFSTSNNKFLVKSLPRHFEHSFFREDLLEPYYEFMSTHADSILVWITDYVYAPYRTIGSMLKTTPAHHIIMENMLVGKEEDSAKDDWETYDLKPIDYFYPERDLLPDPLVSEETLNRLADKFEDKIHMPQSDYERFREVLEADTRFLQSANAVDYSLFLIRYPASSNPGVVGKKNPWRVGFQSLDGKWKYRAVILDFFWAKHKLHAQAMTTVVQTFNVIGHHGPMTITTTADEYRQKFLDMVDELLEVH

SEQ ID NO: 36490 - protein, 172 aa, A.fumigatus
SQRRKKLFPSRGLEDSPPSMGRYLLSGARRFSSDIFLTVRSYSPLHSRCPSYFRTSTDLQYNTPRPSLYPRAFGTSASLYALSGKSSKLHAAMASAADLPVAVEGLTLQSTAETSKFPNCYPSLNPVDVYRVHIAEKLGAAAGIEPEKLYPKLQWTNTLDKGDLVLPVRTIA

SEQ ID NO: 36491 - protein, 393 aa, A.fumigatus
  UNSURE (44),(53): Identity of amino acid sequences at the above locations are unknown.
KKNAGFRVPYGNQGLRRPLGFFPRERKDSSSSFGHLTMARPFNXGSLRSPIIXGFLANLYTVMGWDVIKMNYLGDWGKQYGLLANGFKRFGNEEELLKNPINHLFDVYVKINQIVAQQEGPIKELKEQIKAKKEKNEDVSVLEAELAKLVDVSEDEKARRYFKSMEDGDEEALALWRRFRDLSIEKYKQTYARLNIDFDVYSGESQIKNESMTAAYETMEKTGVSEKSEGAVIVDFTKHGAKKLGKAIIVRKDGTPLYLTRDIGAIMERDEAYHFDKMIYVVAAQQDLHLAQLFKITELMGRKDLASRCQHIKFGMVRGMSTRKGTVKFLDDILRDVADKMHEVMKGNAEKYAQVENPEETADILGLTSVMVQDMTGKRCVYFTSNLESSPRN

SEQ ID NO: 36492 - protein, 272 aa, A.fumigatus
CLLLRITDIFPCKFYVVLYLVAPEPRKPLPEEKRYRTLSEDGAVTQPEQLPCWQDALDRQKRPGRIFDHSHMEKAELFMSLVVPAYNEEDRLAGMLEEAVNYLERMYGTLAASSASNKKAGDAVRQRKPTNGYANGHATTMVTPSGKVPPEKGWEIIIVSDGSKDKTEEVAFAFARDHQLSLHPKGYAGPWTPTPHEGVHIPPGTIRVVTLAENRGKGGAVTHGMRHVRGQYVVFADADGASNFEDLGKLVTACRDIEDVFTHGAWDVPRLK

SEQ ID NO: 36493 - protein, 74 aa, A.fumigatus
VPVGCCGVEASRLVKDHLCKKDPEDRIKQPPIYYSLNPKPKGQVGYPVLRPQFYGIPRMMAIVCSDFNDQCKHY

SEQ ID NO: 36494 - protein, 577 aa, A.fumigatus
RVSGIACPSSPAVKISTLQPSVRQEKLAARPKGQPAEPVEGLSFDQKSAGGDSAVAGGTASHGIFLQPETHPITEEQLINEVRGIYAGLFMVEKKCIEIDKQQSESKTPLSPVQWQALIALHRTLLNEHHDFFLASQHPSASPVLKRLAEKYAMPARMWRYGIHSFLELLRHRLPDSLEHMLTFIYMAYSMMTLLFESVRAFEDTWIECLGDLARYRMAVEEVDVRDREIWAGVARYWYNKAADKNPDVGRIQHHLAVLARPDVVQQLFYYTKSLVSVHSFPSTRESIPSLFNPLLNAPKAHHHYPLIAAFVLAHGYLFYRNPSPQFSRSAEEFLTHLETHVGRMGAAFKMQGVYMSSCNFAAIFEYNHPDAALPAKFHPRETHHGRPALETQPTPAKTSTSACDVPLTADGSMASPDGRRYSPLSLYASCLTFQTLSVLLDQIGNKNVYPTVHISMAFLWCLALNGRSSMEYIEAFVPWRKIAIFLNTMIRDDVDIQIFEGPHFPTVEERKQLPEDFFIRGQIWSQHYFPPRFFEDSLIEDEGRFIELPSLNVSRMYRCLWLGMKLATVCLKNHGE

SEQ ID NO: 36495 - protein, 166 aa, A.fumigatus
  UNSURE (2): Identity of amino acid sequences at the above locations are unknown.
SXISFPGDGNTDATSSFDADHSGDDEWALSFCRVAYGLRAKLNAIDDDYIRDYILYVQKSPCHLSVTLDTENLYLSNWREIGVYDADFGGMLGKPLRMRAPDGYTDGLIFVMAQRSDDKFAPWEFNISLEASTIKRIVHDPLRCKYVELDEFWHSELHFQGPADFR

SEQ ID NO: 36496 - protein, 78 aa, A.fumigatus
RASLSGTGRFSIAIYASFLKSCGYIYCRHAPDILTQLRPYPAVTLIRVYFVMSLPFTLFSSWHLLASETVQGVGETAT

SEQ ID NO: 36497 - protein, 103 aa, A.fumigatus
QGCGHWPCVSMPRSTPVASEQVDFVMKLLGNTTKQITTATYIKLAWAVVISCNTGSNDTVFGITVNGRGAPIDGAGEMTGATIATIPQRIKLKPDQAATNCIG

SEQ ID NO: 36498 - protein, 631 aa, A.fumigatus
  UNSURE (39),(220): Identity of amino acid sequences at the above locations are unknown.
QNHSGAFAGGKGGLYVPKPTDHSTLSSEPAGFFRDLRPXCNSDGCILRVWSLPRMPAGMISRERVQRLLQHLELVLQDLMADPSCKVGDLPRMSRQEWDQIQRWSGTLPPVSRQCVHEIVNQRSLQFPNACAVSAPDGDLSYAELIRSANAVAAELLVHGVERGNYIPVLFEKCKWSPVAMLGVLKAGAAFVLLDSSYPPQRLHTICGGLKTQIILCSKXMYARAASLGPTAIAIQENAAFLADIPDVTFPVVSPENAAYVVFTSGSTGTPKGAVIDHQSYCSGALAHNRAHVLGRNSRVLQYASYAFDVSIMETLSTLMAGGCVCILSDLERHDHFANSVQRLAVTHAFLTPSTARLLMQRELPSLCVLVLGGEAMSLADRSYWMSRVRLMNEYGIAECSVASTIREVSHVEQKDIGFPMGVVAWVVDQNDHEKLVAIGATGELLLEGPSVGRGYLDNPKATCRAFIEQPGWLRAVRNGKPSRVYKTGDLVRYNEDGSLSFISRKDSQIKIRGQRFELEEVEQHLRRIDEIQEATTVVAAPSDRPKQPYLVAFIVPRARESFCVCSARALIPHPTEEFRLQAATIQTKLHSILPAHMVPSIYLPVNRMPKTSSDKVDRCRLKEEVGKWSS

SEQ ID NO: 36499 - protein, 239 aa, A.fumigatus
NGQDAFIDATSTPDPSVAIRLIDASVAAGIHRFIPAEFSIDPAATNCRALPVFAGKAKVYDYLRQVGAAGRITYTSISTGAFLELSLRTGFVNIDIATKRIDLLNAGSRVTPWTRLSSVGSAVANALLRADETKNRTCYVCSIMKSQREVGELAQEALGKEGWRVQSQDAAKALEGAIAQFQVGNVTVEVIGAMIRWTLTQPESAAGWATNDNELLGVPTMTDDEIKQLIQQIAEEMKA

SEQ ID NO: 36500 - protein, 60 aa, A.fumigatus
VACTLSNLCVRYDMYKDVEEVLAKRRGKPFMQQYIRGLPIGLKLSNGTVVGQQPSAEVKL

SEQ ID NO: 36501 - protein, 82 aa, A.fumigatus
ANDGNHLLQSVYYQQIYILVKLSRILKYTIKRRITSYAKLDMIGNVLRGEWLCLLQILQVSILVMTQYLQCTISSPEGLATP

SEQ ID NO: 36502 - protein, 560 aa, A.fumigatus
LRDLMLSWLIAANFEYLFSLPCDNLPGYSYLYRSLIPHCPGSAQQLTMVATTAVDSPQSPRDDKAPAIRVKQDKLPTKGDAALQLLAGRDTENGVLDPDASRRLVRKIDLYVMPLICIVYFCQYLDKIAISYASVTGIRESAHLHGNQFNWISSIFFFGQLTFQFPTMRLIQAFPLARYVATNVTLWGIILACMAACKSFASLMVCRTLLGCAEAAIVPAWVVFTSQWYRKEEQAFRVGLWFSMCGWAQMFGGYVAYGVAVHVGSDPHAALRGWQVIFLILGVFTTLVGVLFFFILPDSPVTAGFLSAEEKALHAERLRGNEQGIGSTVFKREQFYEALRDPKTWLYSFWVFAANIPNSIATSFGNILVTGMGYSATQSLLLVTPLGAYEVVVLVGLTYLAMRTNQRLLWCIIGHIPSIVGAILMATTNKAPALVGYYLSGGIPIGWTTILGLTSTNVAGSTKKITVSCIQTIAYTVGNIISPQTFQHKDAPRYLPAKISIVILYVLITLDLCLIRWLSIRENKKRDAEREALGDAYVVEKDHEFLDQTDFENREFRYAI

SEQ ID NO: 36503 - protein, 90 aa, A.fumigatus
ILAHYPSEGSKGLAIGVRFKEQCMSVINRNQKFCRSCGLQSDSFNTDGDIAYFQTDPGHYIISTIVFQHPSSSRKTELFSLQWSELHQLY

SEQ ID NO: 36504 - protein, 83 aa, A.fumigatus
PVLKRRVALLRALSRPTDAIHSLIDLLKAAPTDAEAWCELSDLYKSQGLGLQAIFCLEEALLIAPNAWNVTTSKHITVHKKRG

SEQ ID NO: 36505 - protein, 78 aa, A.fumigatus
YIPDKKATALLKIIYLEMFGYDMSWASFHVLEVMSSSRYLQKRAGYLGAVQSFRPDTDVLMLATNLLKKVFKVPNSVL

SEQ ID NO: 36506 - protein, 152 aa, A.fumigatus
DLISSSTPSLSLPLTTLPHIITPSLAMSLLPDVLSRLSHSRGVVRKKAVVCLYRLALIYPEALKFAWPKLRERLMDDEEEGSVTTAVINVICELGWRRPRDFLPLAPRLFELLVDGGNNWMAIKIIKLVWCSLFAGYMLLTRLVCDFDTLRT

SEQ ID NO: 36507 - protein, 62 aa, A.fumigatus
LEVPRFEKSLYDLIKGLRNHKGAEEEFIQESLRECRTEIKSQDMGVHFHLQDTASSPLIYSR

SEQ ID NO: 36508 - protein, 83 aa, A.fumigatus
FATLTPLEPRLIRKLSGPLMNIIETTTAMSLLYECINGVIQGGILDGDEALEERDEVASLCVGKLRGMIVANSDPNRKFLCGK

SEQ ID NO: 36509 - protein, 299 aa, A.fumigatus
  UNSURE (85): Identity of amino acid sequences at the above locations are unknown.
IVVKYVALLAFNRILLSHPALVSVHCDVIMDCLEDADVSIRMQALELAARMVTSDTLQSVVDRLLKQLRDATTFDPVESGHPAPXENLNNQKGSMILPASYRIDVIHRILDICSFNNYSDLYDFEWYVDLLVELMKLRPLQTKQFRFPRATRVLEDDRGDDIMSRICLEIRNVAVRVKGVRLQATRAAELLISVDNRHALFLEPHTDSQALGSLAWVVGEYSGCLCNPRRTLQSLIDISNMSLPAKVLSLCVQAVPKVLIQVANDPHQDWNTATVCEISLLFGPVIKFLLTQPGSKEVR

SEQ ID NO: 36510 - protein, 456 aa, A.fumigatus
PSWNPGIKVRHTAREYGCGVAADFVLHTELLKAYRMAHARVLSIEPFEAALRENTPLTSIADPKALTEYLNQITLKGDMVIEELKRVTTERDDYKKKLEEAQKSTKEACDAVADLKKDKTQGAKEEKTASTEDTASKKELPAKEESEEFFSFDNELPRLESELKEKQEEVETLKSQVESLKRDLAVARESTEGMVQNLESATRELVELRDIRDKQDSEIKKLKDTRQAEVDDVKAKLAESENTIAKAGEEAEKLKAELKQKTEEIEKLQDQVTQQKDNDQQKELQEKLEEVAKEKDASEKKLGVLQGLVDNLRSQLKDTEVVVSDLKADMKGKVEELGKLQNVVDYLNNNLKDNAEWQQTRDQAASGQSPDFDSLRKSLAPLQQEPGGGNLATEPEPPANGATGGAGASKKKKNKKKKGGKGGEDTAKVPVLLWSRTRNRTQQSPTKQLRTWPTSS

SEQ ID NO: 36511 - protein, 174 aa, A.fumigatus
SFSISSVFCFNSAFSFSASSPALAMVFSDSASLAFTSSTSACLVSFSFLISESCLSLISLNSTSSRVADSRFCTMPSVDSRATARSRLSDSTCDLRVSTSSCFSFSSDSNRGSSLSNEKNSSLSSFAGNSFFEAVSSVLAVFSSLAPCVLSFLRSATASQASFVDFCASSSFFL

SEQ ID NO: 36512 - protein, 165 aa, A.fumigatus
PVGQTVSLPLNRILNRANPRRTAMNLILAFAVALKHKLRFEPDIGYEDLAGLVGHLDTFAKDAHDRALLQPPKKSSWKAMGEYLGVSFAESNPRKLVKRSKKPLGHLPLEILNYLSAYIDRCIANGTLSVSLHQSQASKSPSCQGPFAFWIGLLICFHQLVLCVP

SEQ ID NO: 36513 - protein, 153 aa, A.fumigatus
QYMLPDNSVMYIGCVGKDKYADILKEACNQAGVHTEYRVDDVQPTGKCGVIITGHNRSMCTHLAAANEYKIDHLKQPHVWSLVEKAQYYYVGGYHLTVCVPAILALAEEAAAKNKVSKMAFPPHPARPRLTFDSGLHAFSFRPLHSSVLQRPA

SEQ ID NO: 36514 - protein, 117 aa, A.fumigatus
RLTQVFMLSLSAPFIPQFFKDQLDSVLPYTDYTFCNETEARAYAESHEWNTDDVVEIAKKLAQLPKKNSSRPRVAIVTQGTLPTITATVKPDGEVEVKEFPVHEISKSSINDTNGAG

SEQ ID NO: 36515 - protein, 203 aa, A.fumigatus
  UNSURE (10): Identity of amino acid sequences at the above locations are unknown.
LELTTADPSXPVVKTRAAGMLYRGGRRFGLRTVRLVALGDVDVRHRMLHHRCRRPLGDPIRLPALPKGRDTPVRLYRVSPGRCRLALAQYLMEPSTNRWLVHALCLCLIDWWIPCSGSLCAAGTARAGDPILDVSIFSRWVVAILVTTGLGWSSFGVWFYYLFQFIQQFRHVSPLDSAVQFAPGAISGNSACPCHTLSDGGHH

SEQ ID NO: 36516 - protein, 442 aa, A.fumigatus
FGSAEPIKITGMTSKLAYSCPNRASKWPDQGRSWSSCSLALGKYFIEPHCRRSEVPVRGSCTRQVTTLQLPTNPTTTGLQAVSLSLSPSLKCLAGQQSRPCPLVAPVRTICQKKLQQAAHQGFKGIEFFFYEDLETFAAQSSGGASRLNILKGALRMRHLCTSLQLEIIALQPFWFYEGVLDEAEHNRLIDDKLRFCFEICHILHTDMILIPSNFLPPDPETGEPRTTGNRRVIVSDLRQAADLGLAQSPPIRFSYEALAWGNHVDTWEQSWDIVRRVDRPNFGLCLDTFNIAARVYADPASASGMTYNGAKELQRSLARLRQTVDPKRVFLFQVVDGERLKAPLVMGHEWYVAEQPSRMSWVSECKTVCLRRKGISSGEGHCPNCLCSGIRGLGFDGIVLPHNLRPRPQYSLRPCTTWDRIMEDTVTEMQGEMVCAKADSV

SEQ ID NO: 36517 - protein, 128 aa, A.fumigatus
RPAPLGCFTAGVVGSVFAQYVWWPWVMWTYGIGCFIIAAVGLWVIPSDYPRCQKAATLQFDYIGSVLGVAGLLLLNISWNQAPIDGWSTPYVYVLLIGGFLVLGLFVLQERRAPGIRSWMYPSLVDGL

SEQ ID NO: 36518 - protein, 95 aa, A.fumigatus
DGAVLASGSITCSSLSSNFAMCLLWIQQCSSRQGPSQGILPALATPYLMAVITSGWLMAIACAAFLGGCILQSTAPVEQSYWMNTFWSFVIMAWG

SEQ ID NO: 36519 - protein, 66 aa, A.fumigatus
AGSRNARLFAFEERGYLPVKDIARTVFALGYEGWVSTELFSRTTFDPDPNTPYGHAQRGIASWKTL

SEQ ID NO: 36520 - protein, 176 aa, A.fumigatus
IRSGRLLSWPGGKAPIAPVALYIDKTDLMIRRMDISFPASTTILSDAVPVKHQGASASLVNTVINYSIAIGLGIAGTVEAEVSHQGVNQLRGYRAALWSSVGLAALAFGIALVYAVRTFQEQRNSRKSSQEREQRACIEGCILGLTLTPDREWERVELGRLLSHVSQTGGLRNQSV

SEQ ID NO: 36521 - protein, 338 aa, A.fumigatus
AHRRVESCFSVRRSYRGMRDRLPNSPLEQFRRLTKNLFNAMQSKFKRLKRGHKDHRQASQGIDDIFNSDEDEEAAGDYGRPSHRRPMHDEMKDFIEEDVFTDDELEREREDLEIARPAKRGVTGLGATDAAGLDENALEDMRAAFGDGNEYLFALEMEEQEEEQEEDQEKHLDLKDVFEPSQLAERMLTEEDNQIRLLDEPERHQLARKPYRNLVLTEEQFREEAAWIANLMLLKKRIEPELREPFQRSVAKVLEFLVTDDWEVPFIFQHRKDYMIHATKVPVAGAPADGDTSQYTIKAEKLLNMTDLWDIFDHDLKFRALVEKRNTIQKTYDNLQSL

SEQ ID NO: 36522 - protein, 67 aa, A.fumigatus
SGTDWRVHLDNDERLTEVVERPLELMGQLLGTEDAHKRRESGKLKATVPEEEVLGLRYLDYGLYHYF

SEQ ID NO: 36523 - protein, 389 aa, A.fumigatus
GGNFGPNLGNPRGLPQGRFKVSPNIRWDLPLDDPAVIIDATQLLLLFIDRNSAGFGADPSKVMAFIKDFVPIFYGMDRDTFHMYMNEISSDAPSGEDGDDESLAAEDASTWRNRRGVNAKKMDLLRDVLERRSEKANRSDKDRNTPASRDGTPDAVLVPSTPVPEPAEAFDVAELKWMEHPGQGNFNLQREYALNESYVKKVHHLYANLNIYCFFRTFEILYSRLLRIKMHEKDAHEHVRRALIPKPARDLGLIDKLPTDFFYDCDPKANLYQQIVRMCEEVIKGDMDASHLEETLRRYYLRSGYQLYNLEKMFAGIAKFAGSIFNGDSKDRSADIINLFFKERDREETTHNQEIQYRKQVERLVKDGDIYRITYVSAPSVGPSLQVQS

SEQ ID NO: 36524 - protein, 209 aa, A.fumigatus
NPQTKKTTVQLLTPEDATLENEELSQEARWSYYVSAYTMRDPTEGVPFSQMRMPFLKRNLPPKLEQEEEYNRYYRPLVHQDGLIIRICANSYHILYEPGSCDWWWRPKALSEESPEDIAKEEAAVKERRRDRFMEKFVNNPSWAQGLSKDQVDESNQRFRSWIRGPESEKEKEKASVGATEEAGFEKKADNEDAEMPDADPTAPESKDQ

SEQ ID NO: 36525 - protein, 455 aa, A.fumigatus
ASTCPASPKPGYYRCFAVCCRIAVLWKSDLLQRTLQLIVSKLAGAPGFENYEEIISPSLLKALIWSPYQCPSIPLPASQTKNHDTIVRWNPGISFAHWARSIGLFLTKAAPQDPVIGPLRNILHVIPSLAVRILPYILHDVLLTEPDGVANVRKTISDVFQQGLHEADDHSIPHVRLIINCLLYLRNQPRPQEATIVERDEWLEIDFAVASRAANTCGLPKTALLFLEIQASRAVSGSRRSSLVKYEPPPDLLHDIFRNVDDPDLFYGVQQSSSLESVMETLEHESSGFKNLLFQSAQYDCEIQMSGDADAHGLLKALNSSNLQGIANSLTSTLRGSKSSVSFDSMMQAAIDLRQWDLPVSPMNHSPSAALFRTFQSLNTSTSLVDVSNSVNESLLAILGSLGSTSRSAMSFRAAMRDLGIVTEISDVLSATSLEELSEEWRKIAERNSWLKATR

SEQ ID NO: 36526 - protein, 608 aa, A.fumigatus
  UNSURE (504),(513): Identity of amino acid sequences at the above locations are unknown.
LSSKDFLPDVYRACAGYERTSLLDLLEDMGEKCLHTYQLERCETSQVLCIHMLDSFIKSWTTGDGDHLSDSASDIYNWVTDVLLVKGRASSRVSIAFSRLLEEIFSTNPAYTSGESNPSPRTTLFMILQESDILTKYNVGNLVPKLFRHFPLKDHDAIFDDILESLPRDPDWTEGIALRLFILARLASQWHTLLRRSIYHMFETPAQLPHSRWHAEKCIRHVASVLGLEDARQLFRLFSSQILYTWTENESVMTMPFSIFGYSTIEDMLSDVQDEIVGQIMMRANEHEASELSTRLKIPFIELLATSFYKAEAYSIARDISTPPGQSSQPKGVENRLKKILGADRFVSLVEKQFPQVIATFFGTLDQCEQIERAFSKRANFQEAFSILKSITAKGASKEILPPNQQPSFRARYLLDELEFLCKRSGYELETIWTPTLASYVCRTLLESIHPALGSLHACSVIRKIRILICITGPVMLRDYPFEMLLHALRPFLTDIHCSEDALXMFWYLLDAXRSYLTENPSFTAGIAVSTLLSFRKFLASTSATMQESESVAVLTIVQTFLQWFEDLLEILRVTSSEPRGACLLSASDGVFAQDLYSRQRVGWYGGV

SEQ ID NO: 36527 - protein, 129 aa, A.fumigatus
TDDPSSAQIHPPSVGYPRLLVYRQIHEGMAIPVACTSTAYHATIQILYAQGTLLGPVIFFAKSSIFLLCRQIFTIQKQMKYAIRFGLLFTFLLYWPGVGLESYFAAPHVGETSEDRLHLRERPDPRRVP

SEQ ID NO: 36528 - protein, 114 aa, A.fumigatus
RALVGFVLIALVLSATYNALVLDSQFLVYEICRLIRLMIRLVLKYTRHQWDIPACWFTARYMKAWQSLLLALRLLTMRLSRYSTHKAPSLGPSSFLRNPPFSYSVDRSSPSRNR

SEQ ID NO: 36529 - protein, 263 aa, A.fumigatus
SLISGRFIVASPGLELVVLSTGLIQTLFPTSVVRHFQTRLFALSVNMSVNPRKPGTSGSGSKTTTTDNNTVNGTPSRVHTRSPSASTNGLSRSPSLRGSAPVSARAAARKPGRSNLSMSNVPKVAADSSEEEARAQNAALIEELKEQLQKAESASEQYRKQLGVLQMRLDEAISEQGKLEDQAHEKDSKIEALNSEIRDHIRQIRDLEQAHESERNAMLQEKEQYLSREEEMQATIQRLKDTLAQKEIRMNADNEKNVSRSCE

SEQ ID NO: 36530 - protein, 285 aa, A.fumigatus
SHRPPIVVTDAVITASFLNRSSPDVEGQFAPSSQIERSPSRNNSKLLLQKDKLIESLRLELAESQIKLVEMENKGGGRQRELEKELLEARMANARLMEDNESYQLLLSERTLNGDFTKGDFMREAHPDYDEGQEPSNGLGSLADELESVDAKAETDNTRKLETEIKALKDQNKALTLYIERIISRLLQHDGFETILDKNENEPSTTAKQVSSVTEKDLPPTPPEKDDSSSQTFLQRAKSVVAGQPNRSQHRSRPSTFMPPPTSVPTAHENPETAPSIPINRAQRG

SEQ ID NO: 36531 - protein, 123 aa, A.fumigatus
SLERVCDISVKLTMETKSLIVFTPTVTLGYKSTIKTLRSGKAKLVLIAANAPPLRKSELEYYAMLAKTPVHHFSGNNVSHKCFCIGFYCYAPTLVLLRWREGDAGAALRRSRISGLWRVNDNG

SEQ ID NO: 36532 - protein, 75 aa, A.fumigatus
GLGLCHSLAGVAWKSTSRLARRRRIPPSLLNSPTPPFSTTSPFAGSAVSPFPAVTMARRPARCYRYCKNKVRAIA

SEQ ID NO: 36533 - protein, 362 aa, A.fumigatus
TYPFVMKWESFLLTAITAGSAMAGAHHANEHAHLRHRLVHNAELKAREVDDQANPAVSTKTIVNLEVVTMYTTITRRPHGHKPTTTVAAVETSTTGSQPLASVSLDVDANLLDVRSATTSTATTLSTSTSSATVSAATSSSGNSASWTSTPSNGVYSTSGFGQRTNSSGSGIEYVGNVGSPWGSNIIEVTASTASQYKYVVKFTGSNTDDWFVSFWNKVGPDGKLDGWYGHSALNFTLAPGQTRYVAFDENSQGGWGAAAGDSLPTDEYGGYACTWGEFDFGNTSNDQWSGWDVSAIQAQNAGLTVQGMRICDHNGDDCSYITTDAAKVVNAYTAAEASVDGIGGSVSAGAVRLVVEVDYSG

SEQ ID NO: 36534 - protein, 74 aa, A.fumigatus
SSRYGTGTECDGGCTGTVAEQKYLNTKITLASADTTFGNTIASAAGATYSGLSSSEGGKVWTIESITIPAMSRS

SEQ ID NO: 36535 - protein, 153 aa, A.fumigatus
QLTLLVYIPMKLVLGLLLPTLGVSASVIKREDTWGGSVSLGPTKSTIVNAVTTLIPGAAPATQSGELFLWPGMSNGTGDLVQTTLESWPSNAWCGATTGQWCVRASLFGSFGQLDGDASPVSGTDQVRIEYTLLDDQETWVQYVSHNEGKDSG

SEQ ID NO: 36536 - protein, 92 aa, A.fumigatus
RPLALRLRCFKYFQTARFPQLFSFSFFSSTTADNIYQQLLSLVMMKLFSRRAKTDPTRRWAPSFERSFRSFAIIWESAVVTIDLVQFALLET

SEQ ID NO: 36537 - protein, 204 aa, A.fumigatus
AQVHELGYTECAKSYVFRGSKEYAAKQVQEMLGLLAAGPRPNMPQQPTRPPVGPAARFLLPVQQAEFQITNVLEQLQRDPWPVANDKRPLRCTGVALSVAVGLLETSFQNAGGRIMVFTSGPATEGPGHVVGPELKEPMRSHHDIDRDNIKYYKKAVKVGVISSSHTGCSHADQFSSTTPWPSAPLTTDMLLTFLPAALTKSVF

SEQ ID NO: 36538 - protein, 184 aa, A.fumigatus
NAVKKGRRSRVGTIQKFLRRGQPGAGAFEELSFNASSSYGALDQRLKNERQKDHYSHFILRLAFSATEDLRRRFVRAETMLFRFRFQQDDSREKRAFIESLNLDWEPVSDEERREVAEKLVSATPGLRRVDEETWYKVDWERVPELVERRAVLLSKGKAYVPGREQLSMIIAEFTARLERALEV

SEQ ID NO: 36539 - protein, 282 aa, A.fumigatus
LNSRHDWSAPSRYESFLHCGCYGLADHCQLTSRALPRLDEDDRLTPILNHLSKNFGSAESVYSEGEGFVEGAPITASNIDRLSQHFPLCMRSLHMTLRKNNHLKHFGRLQYTLFLKGIGLSLEECIIFWRQSFKGFTDDEFNSRYKYNIRHAYGDVGGDVNRRGRGYPPYSCQKILNDSNPGVGQTHGCPYRHFSVDNLIGLLQSTGVHDKDVLRGVREDVEKTRYHIACNRVFEWAHKADIKRVKEDGTWGQTDLDTIVHPNTYFKRSYLLKQMGKPPKDA

SEQ ID NO: 36540 - protein, 76 aa, A.fumigatus
HSHGRFTGSASRLCPSILIHVRIQEASRLVVPIAAVYTPLKEKPDSPLLQYEPVTCKAPCRAVLNPYAYDLRPCRL

SEQ ID NO: 36541 - protein, 114 aa, A.fumigatus
LTKDSNVDVRARIWICPFCLMRNPLPPHYKDITENAIPPELHPQSTTIEYQLARPAPAPPIFVYVVDTCQEEDSLKALKDTLILSLSLLPPNALVGLITYGTMVRTELHFFGFG

SEQ ID NO: 36542 - protein, 79 aa, A.fumigatus
FYDALAKRAANNGHVVDIFAGCLDQVGLLKMKNLANFTGGHMLLTDSFTSSQFKPSFVRVFDKDPTKTSGWVSPPPLKS

SEQ ID NO: 36543 - protein, 61 aa, A.fumigatus
CRPCGYSNRTSGLTSITWLGWHPLEDRAIIVGHYMQTSTDSGTLRPITTIPCRGAAAIAAS

SEQ ID NO: 36544 - protein, 214 aa, A.fumigatus
DTMGALLNYFLGTATAVLAVVWFLRRTKSPPQARPQLEVLPNSALVSKLARALPHIVLLHRDGDAFRTSINTYWVQQEREVVQACIVQPRDADELATAIDILKREYDERRTLPPKESDSVLFAVRGGGQSPVPGGASAKGGVLIDLALFREVTISDDRESVTLGAGVRWAEASRILDEKGLGVVGGRSSDVGVAGYTLGGEHHCSVWTCSQLTL

SEQ ID NO: 36545 - protein, 146 aa, A.fumigatus
PTKSFSPQGKIVTATALSHPDLWRALKGGSNNFGIVPRFTVRCFPSTQIWSGFMYAPNSQSTKALMALHESAKHADSRICGAAVDTHAAAPIACFTYIQGLGMHAVTVHLGYTKPPEEPKKWPVYWNKIRGSQLSGDSGAPSKSRQ

SEQ ID NO: 36546 - protein, 72 aa, A.fumigatus
  UNSURE (67): Identity of amino acid sequences at the above locations are unknown.
IFPHNKKCCQNAMVPSGPLMTFPVAFSASMSEAAHLFLQFAKNYFGLTHFELFQISATHISINSMRXFLNGN

SEQ ID NO: 36547 - protein, 87 aa, A.fumigatus
VASSLTRTWQLNDEDIFNWNVGLIVLNPDSLYYGGYFKASMKFSKNYPYSPPGEPSPLFFFLVSILDGTDLYNSSCRVSVSPPSIPP

SEQ ID NO: 36548 - protein, 160 aa, A.fumigatus
NSPRTTHTPHLVSLPPSSFSLCPSWTALTFTIPHVEFRFLRPLYHPNIYPDGKLCISILHAPGEDEMSGELASERWSPAQRVESVLISILSLLDDAEVSSPANVDAGVMLRKDFESYKALVRKDVEQSKMDIPEGFVMPTHESSMKRPTEKPDDADFWAD

SEQ ID NO: 36549 - protein, 474 aa, A.fumigatus
DAFNAFNVVECLVTLAKTYNRTVIFTIHQPRSNIVALFDRLILLAHGKTVYSGPFSTCQQYFDDSGYSCPPGFNIADYLVDLTMHASVTRSHENGHERPFLDMQPPRTASSSLRAVKSVASASNASIEDSVESSRRPKSKRRISLKQRQDKQLYSRKKDHQTPPTPKTDEEDGGEISDSTQQWLRLSRQQGHVPPQVLDDPDHLPPAAPGPTDLDILIANYASSDVARSVHDEIVAAVQKAHVANGSTNAEIMSGAATGHAKSYPRVSLLRQFVILSQRTWRNLYRNPMLMLTHYAISILLAVLCGYLFYGLTDDIKGFQNRLGLFFFILALFGFSTLTSLTVFSTERLLFVRERANGYYHPITYFAAKVVFDVVPLRLIPPIIMGIIVYPMTGLIPAWGEFFRFILVLVLFNLAAANICLFIGIVFRDGGVANLIGSLVMLFSLLFAGLLLNHDAIPKSALWLQTVSFQPISP

SEQ ID NO: 36550 - protein, 73 aa, A.fumigatus
  UNSURE (45): Identity of amino acid sequences at the above locations are unknown.
ASSSGSSSSSSSPSPSPESSAISNMSGEAWLYLLAVLINAVNLFXQVFFTIMYSDLEWSVSVLAILSQLRHPN

SEQ ID NO: 36551 - protein, 78 aa, A.fumigatus
LSIFHYGFEALIVNEVTFLTLIDHKYGLDIEVPGASILSAFGFDTLAFWPDVIGLAIISGAFIVIAYAAMHFLLVEKR

SEQ ID NO: 36552 - protein, 75 aa, A.fumigatus
VNYDTQTNLVTCCSDYINPIDLCNRLNAYIIPEAAVHAFLTILFLINGYWLALILNLPLLAFNAKKYVSSGIGVP

SEQ ID NO: 36553 - protein, 220 aa, A.fumigatus
TPCLLFSGCLRHRSFHMDLMSSRFKSFGFKRNKNNSSVSVSATQVASPSPSTHTLVAPPSTATSPSSPPSGHSSSSTSLPMNNQNTLGRPPSYTYNTAGRPTSPMPPGQQLAHHPPPLNTNVQYGHQPVQPVGAPPGYPLQQPVPHGIPPSLPQPQYNVRNPAVEVEGAGRSKAQLIVGIDFGTTFSGVAFAFATNNEAREDIITEWPGAGTHTKQKVGA

SEQ ID NO: 36554 - protein, 318 aa, A.fumigatus
IPTVLYYDQYQKVVGWGPDIAEALAPTGYPKTGVQKVEWFKLQLMLSGNTYIDPINLPPLPPGKSEIDVAADYLFKLRQAMRAQLQKTLGEVFTREERNIRYYLTVPAIWNDAGKAATRAAALQAGFLRDENDNRLTLISEPEAAALFCAKTGLLQLKVGDAILIVDCGGGTVDLIAYEVEEEQPFSVAECTAGSGDSCGSTALNRNFSNILRAKIRKMKLPDGSRTAGKVYAKCIMDFENRIKADFRNNGQKWAVDVGIEADFPEANIEEGYMTFTNEEILQCFEPVVNRILELVRNQIIAIQAQNRSLQVGSSRLC

SEQ ID NO: 36555 - protein, 74 aa, A.fumigatus
PAIRSGFEQANKYVIMDANGNHIGYMAEQEKGMANMMARQWFRTHRSFVTHVFDRHENEVLRVCPYPFVKFHQQ

SEQ ID NO: 36556 - protein, 376 aa, A.fumigatus
NSTSNESPNAFQFHRPFSWINSRIRVYDPLDVAKSAFSSSTAVQTASSGSLVQATGTSNARISPLGLEDMRVIGEAQQQWAPLRRKYNLFTYHHSPLSATEMGTQRLPLSQTGLSNSQQMQLTQTNASGQDVGEYHQFAYVDEPFLSWDFSLRSADNRLIGSVNRNFVGFARELFTDTGVYALRMDSAALGSEDLTTRTNAPTGMTLDQRAVMLATAVSIDFDYFSRHSGAGGFGFMPIWFPGIGGEAAAGGAAAGGAAAGEAGAVGEAAAGTIGRAGAAGGIAEGAAAGAAGAGAMAGYDALSRGMAGDSNSQHPLPPEQQPYSADQQSSVSGQAGPYGDVWAEEQEDPFARAPEDPWNIEEPDDEGEEGDNDWF

SEQ ID NO: 36557 - protein, 100 aa, A.fumigatus
FCSLTFLQFWISGYTMSSVAQKRLFHEYKNLSTNPPEGITAGPVSEDDMFHWEALIQGPEGTPYEGGVFAAELKFPKDYPLSPPTMKFVGGGVWHPNGER

SEQ ID NO: 36558 - protein, 89 aa, A.fumigatus
HSLLTVYPNGTVCISILHPPGDDPNHYEHASERWSPIQSVEKILISVMSMLAEPNDESPANVEAAKMWRERRSEYERKVRDEVRKGLGL

SEQ ID NO: 36559 - protein, 325 aa, A.fumigatus
LYNVITQVAVPNVQASQSNAQVEVVCGPLINYKNMTVTPSSSLWHGSVLIVTKPGQGQPQLLLRQSGPVGGSNAPVNGDLSARQPVTIDGLRLYEDPQKAFWRFSITVPLQSYEARWEYDIPGFQYAEANRTITPWNFVVPSVNQSMRLMFHSCNGFSVGTDMDAWLGPNLWNDVLRVHAQKPFHVMIGGGDQIYNDGVRVDGPLKEWTAIANPHKRRAHNFDNSMRAKCDEYYYANYKRWYSTEPFKTANAQIPQINIWDDHDIIDGFGSYTDHFMRCSVFRGIGGVAYKYYCLFSTPPCASKGLPSTRMSPRTMKPNHGSAGF

SEQ ID NO: 36560 - protein, 146 aa, A.fumigatus
  UNSURE (16),(52): Identity of amino acid sequences at the above locations are unknown.
TQLSSLLASDPKQHSXLTRTFHSPNPQTIESTPLAPSHAHQTPLLPPPTTAXSQPDTSHPRSTPPYIPPTSHSSPAPDGRALLAQTGSCALHSPRPVRWSLGVSRAPSTWSSALSARRGGCGRRGGGKGLGWDGGRCGGGISWFGG

SEQ ID NO: 36561 - protein, 146 aa, A.fumigatus
RRRRDGTKRKPVFQTQSVQGKFKVVRIFVIKFTYHLQTDDTTANDNHLLGDLLQGKSAGTGDDSLLINVEARERSGLTSGGNDNVLSAQSLFTTIQQVHLDGVLVDKSTGTLDVIDAVLLEQKLNTFCETFHRRCPWPSSSARGST

SEQ ID NO: 36562 - protein, 74 aa, A.fumigatus
  UNSURE (35),(71): Identity of amino acid sequences at the above locations are unknown.
NPFTPQWHSIHNTRPDHSIDSIIFTISIRPQTAFXTYTYFPLPKSTNHRKHSPCALPRSSNTTPSASNNSXFST

SEQ ID NO: 36563 - protein, 66 aa, A.fumigatus
YFPPKIHSPLYPPNVPFVASTRWQGTSGANGFVRIAFPTARALEPRCVASAEYVVQRPFGTERRVR

SEQ ID NO: 36564 - protein, 438 aa, A.fumigatus
PVGSYNDIPFRHRFSSRQNNQHRKNNKAKCYMWFASVARLEEKIQGGGARGFSGSLEVDGLGVGGHGSLLEGLGQGRVSVACAGNILARSTVFDGQSGLSNHLTSVGTDDVDTENAVGLSIGDELHLALSVEVGLGTRVGAEGEGTDAVLYASGLDLGLVLANPGDFGVGVHDARDSSIVDVAVTLLNVLDSSNSLFLGLMGKHGTEGAVTDDTDVGDLGAVLLVDHKAASLILVNSNVLQTQSFGVGSAADGNQNNVSIQGLLLSTFGGLNAQLDSRAAVITLGDLGVGLELDTLLLQNLLGLLGDVGVHTRSTNLAKEFNNGNVGAETGPNGSLCFRHNQYKENSKSSEFSSSSSHTISKPMIPPPMTTIFLGTSFRERAPVLVMILFSSMLRPGKGVASLPVAMTMFFPRRVCSPPSSRFTLTVCSSTKAPVPLM

SEQ ID NO: 36565 - protein, 71 aa, A.fumigatus
TACIEKRGRLGGTCLNVGCIPSKSLLNNSHLYHQILHDTKKRGIEVGDVKLNLEQMMKAKDTSGGRSHKRY

SEQ ID NO: 36566 - protein, 290 aa, A.fumigatus
IFLVLIVSETQASVWSRLGADVTVVEFLGQIGGPGMDADIAKQAQKILQKQGIKFKTNTKVTKGDDSGATVKLSIEAAKGGKEETLDADVVLVAIGRRPYTEGLGLENIGIDKDERGRLVIDQEYRTKIPHIRVIGDCTFGPMLAHKAEEEAVAAVEYIKKGHGHVNYAAIPSVMYTHPEVAWVGQNEAEVKAAGIKYRVGTFPFSANSRAKTNLDTEGQVKFIADAETDRILGVHIIGPNAGEMIAEATLAVEYGASCEDIARTCHAHPTLAEAFKEAAMATYSKAIHF

SEQ ID NO: 36567 - protein, 121 aa, A.fumigatus
RPRTPPVEGLTKGIEFLFKKNGVDYIKGTGAFVDEHTVKVNLLDGGEQTLRGKNIVIATGSEATPFPGLNIDEKRIITSTGALSLKEVPKKMVVIGGGIIGLEMVCELDDENSDDFEFSLY

SEQ ID NO: 36568 - protein, 189 aa, A.fumigatus
  UNSURE (155): Identity of amino acid sequences at the above locations are unknown.
SHAIHLCKGHITVIQYLQKRAWWFILDNHPRITMASLMRTKQSPSKPTPTPPSSQECISLSPQTKKFLHRISLHPTLTPYRRRVYRTLLSVPKGRWTTYSALATHLGSSARAVGNAMRTNPFAPEVPCHRVLATNGTLGGYKGEWILGGKYQVEXRLLLEAEGVVFDERGRAQGECFRWFVDLGSGKYV

SEQ ID NO: 36569 - protein, 125 aa, A.fumigatus
ISQKPNFPHLTIAVVGQEKAGKSTFIRSALDMKNPLSSRSTTKKMSLDGTVYLVRFVEISTKEITVGSNGELAWPRIGNDVTSPKVIDGVLVLHDVTQPESLSELTGLLGMFHGVLALASDSHFL

SEQ ID NO: 36570 - protein, 521 aa, A.fumigatus
LGSSEFTDHSPSQSEQGTSGDAPYRPGSQDRRHTRANSETPTAFFNGAAGGSNSTSVFESGVDGYGDDLYPVDRTDSSNLASNSHSPRYARSNSFPVRPHTPPSGATLNLHRQSASGESSPAKDRNRQHRLHSAWRNSGGSDAFNSFLETEDEIDVSCSAPSSPGGSSKDKSTSDGSSNETGYTFDELVDRLVAQPMSKQDSKFSSIFLCLYRKFAAPASLLNALIHRFERNEKNITDQLARIADQLRLLNVMAQWVSEYPGDLAYPKTRKRILDFVSTLEKSHFYMFAAKEIGSYLEVNTEDDDVGWPFKDGDVEEFEDQEALYVNSGWSSPSMFLGGPTSGEDEGEEEEEDPIYNMSALDLSEGPPEQSTRLSGTSTVDKPGTISSQSFMSLCIDAAQRESERLELTPTVPLTKIQWRQFMEIPDEDFARELTRIDWIMFNSFRPRDLVRHVSISGPDKDKIQSLKHVNRMIKQFNHVAFFVASMILLRDKPKHRARALEKFMNIAQVRINREQGKGDI

SEQ ID NO: 36571 - protein, 149 aa, A.fumigatus
RSLTLLPFRKETEPLFFCLLVETYLNLTAAALCEPGLNLNANWDPQNSPIIPPASPNREPLATPRTGRALKTAAIPGPTPKHLQPSSTEPRAAQTPPVYLNQESMGTATTCIPSTGPTHPTWLPIRTVPDMPGATRFRCDRTPPLPEPR

SEQ ID NO: 36572 - protein, 76 aa, A.fumigatus
NGPYGSGSFQPRGEDEQNMLHDRGNNTGLETHPAVDHDADILQAAQLLLPGAYRDSQPVGRQSVVILINHWFANCY

SEQ ID NO: 36573 - protein, 155 aa, A.fumigatus
ALHRRALRSWTSVWQQAPESSLDPHNENGPIPFTSSSLLGLAYVRLSLNLGPYRQLESRDPYVIAAALHRSPRPGRSYRLTPALIYAAHALSIPVRLGIDYVARSQAFFWSVRHSIASLECAVLLSKWLLSLAEAGNQTSLSGMRRHSSDTLVSY

SEQ ID NO: 36574 - protein, 389 aa, A.fumigatus
LAIQILATLGTARRSEPRDGIRSWYVALAGKELLSLTYSLEPPQTATNYSPLKVTEEQRLRLATSLEEFRHLIPDFVLPSRHTLTRYLTSFFDGFHTHLPFIHLPTLRINERAPELILAFLTVGAQYRLEHRNAERLFYASKAILLHRLSKEAQPSTGGSYSNAIQMPISTVPGTFHQQAPASIPLPLGNAPGWSAWRQIENIRTLLVLMGFASWEGPELVQEAFGLQHLLVRCLREFGLTENIAVTPRHSPMHWHEWAEDESVRRTRLVSFCFVHVHSIAYNIYPVLRSSEVHLRLPCSTQEWKATTASEWEAAQKEVGSQQLFFQDALALLLQKSRTPVMLDPIPSPLGNYILLHGLLQRIHLVSELSIPNGDQSFSLPTEELNKLE

SEQ ID NO: 36575 - protein, 76 aa, A.fumigatus
SADPPLFDYSIDDSSAVYATLVLAGRTFLAMLAQLEHLDLLKPDSEVKNLGFIMALYIKLAATEDIIDLEESAPRS

SEQ ID NO: 36576 - protein, 467 aa, A.fumigatus
SPCPIRNPDVLAMKNSEILVHISAPSGVRDDVRYRAQVEAILGFQSLSRQLITLSSDERRGNHGALATGQSTSTDPPVDADLGGESKCIQPILSNSQSTIPDEDVEVGRFNAARPNPGHEGLLNATAGSTTLMVKDSMILPDSKVDNSHHISPVSLLSQPQNERAAKDSLESPLSVIPDSQPEAIRSQAEGIMLRPDPCVALGSPPTKRHCSGLSSMLREAVPASDALILAPKLNEEHHRSCELADPHPVTQITPQPDPERPPQVSLDGLPLAIKPSPPPVSREQFVTHVTPTLAMLTRRLKPSRTYKPVKQTRDLEQLERGHWYLRINILQLERDRSLGAPGQQESEARNWDLACFSRFWSFLSDFIAKDGRAGWGVWCILEDATENLCSDSTDGQIMPQRTTAPIISDGKTNPHSFVRPVILKLYAWGEIALHMYLLLFLASERKIRKMGAQWRDGRDEVVIQMP

SEQ ID NO: 36577 - protein, 121 aa, A.fumigatus
  UNSURE (109): Identity of amino acid sequences at the above locations are unknown.
SALKTTADATPTYTHTQDLQTPRRELYRCDQPREADLDPTHCRMATTRVEIPKLASYENVRLLGYVATTYAKRNISLVRPDIENYAAWPTNSSNPALAVRGIFFDDTLXSMMKMPWRICRN

SEQ ID NO: 36578 - protein, 88 aa, A.fumigatus
  UNSURE (1): Identity of amino acid sequences at the above locations are unknown.
XIPLVLGPDHYVRFPGNSLSYLVIFISIFIYFFYLFGFVSSLATFPVYISLCFFFFFFFFFFSQAVVYSLQVLKCSLITGGSQSRRDP

SEQ ID NO: 36579 - protein, 108 aa, A.fumigatus
LQVVHNPGAIPDSRYLSTADSTVVFEATYDTFQERHGAKLFEAIPDSNRSQLCAVIHSVPESVEGSALRSLVKQVRKVADEIFITHLDTDYYASFGRQWPEFVDLMGK

SEQ ID NO: 36580 - protein, 323 aa, A.fumigatus
STSPLMDSLGKGQSAGGWKSWTTRKKLFVLALVLLVIIALGVGLGVGLGIGLGGGGGGEGEEGSGGETTPPEGNYTTAKWQPAVGTKWQIELLYALNDTSVDAEIYDIDLFINDKSTIAGLQRAGRKVICYFSAGSYENWRPDKDKFKDSDLGHDLDDWPGEKWLNISSANVRQIMLDRLDMARDKGCDGVDPDNVDGYDNDNGLDLTQADSISFVNFLANAAHARNMSIGLKNAGDIIPSVIKNMQWSVNEQCAQYNECDTYAVFPQNGKPVFHIEYPKGDKTNNDLSVTASQKNAACDFAGSANFSTVIKNMNLNNWVEYC

SEQ ID NO: 36581 - protein, 242 aa, A.fumigatus
VAIELAGIRVLPHILNAGILLFVFSAANSDLYIATRTIYGLAREGKAPAIFARTDRRGVPIYALAISACFACLAYMNVSSDSKTVFKYFVDLVTIFGLLTWISLLVTHIYFVRARKAQNVSDSDLVYTAPFGAAGSYFALVFCCIIALTKSFDVFVHSSSYGNFNYKGFITAYLGIPLYLCLIFGYKLFTRCKGVKPEEADLWSGKDEIDREEAEYLARKAMEEPTSKRGNWFYQTFVAWLF

SEQ ID NO: 36582 - protein, 192 aa, A.fumigatus
TSRVTPRPSSNILWIWSPFLAFSPGSRCSSPTSTSFAPAKPRTSLTLTSYTQPPLAPQAPTSPSSSAASLRSLRASTYSSIAAPMATSTTRASSPRTSVSPYTYASSSGTSSSLAARASSPKRQICGQVRMRSTARRRSIWLARRWKSQPVSAGTGSIRHLWRGCSKTPPSRLFTFFFFFSSANMRFGCDTS

SEQ ID NO: 36583 - protein, 177 aa, A.fumigatus
GDTEVRGDEALVVEVAIGAAMDEYVEALSERNDAAEDEGEVGACGAKGGCVYEVRVRDVLGFAGANEVDVGDEQRDPGEKAKNGDQIHKIFEDGLGVTRDVHVGQAGEAGGDGEGIDGDAAAVGAGEDGGRFALARETVNGTSGDVEVRVSGGEDEEEDAGVEDVGKDANAGQLDRD

SEQ ID NO: 36584 - protein, 393 aa, A.fumigatus
GSAGIHPVDAPVDPIWRFVLPRLPASVGYRPVDAADGFDVLLSCPDDQCRGVPRRAGNPGASTWEDPWPDGRPLPSQDHRRRRWQPCARMDQYLNRNLRRVQSHHPLWKIAASHPSPGGLRLGVCADAEPRRLRLYLGIRSPMAQEPPAHESPFLSRHRPRPRLGIPMGRRAHTVEPVLGELRRHRAIRRHGSAPTGPVGPQRDTNQQRQNRRLPRPPLLLPTDPLPLLVLLLVRPAHAGKPRRARHRPRKSHPPDHPRNLRRHRRLRRHHHRRRPSPEQPTPETHLPHRRQLRRQRSRLVLPPATHRLRLPDQTARPRELRLPPAVRVHRADRQGDLQCRSDVWEIPHRRSCAEHRSGLGRGAAAHGARRSSCIPRRRASASHAASPAGGCR

SEQ ID NO: 36585 - protein, 450 aa, A.fumigatus
IPSLLGLLPDSLRTAYTPLIDNLAEMIYATYPTRRPAGFEDQPGFIPSMRQSTQFGDLFFRDYQPLSVIVPWMRLMASMFSSHVQMINVGVSHEGREIPALRLGRTRGQTADPYPRKTIVVVGGSHAREWISTSTVIYVAYSLITRYGKSQQVTRLLEDFDWVFVPTLNPDGYVYTWESDRLWRKNRQPTSLHFCPGIDLDRAWEFQWDGERTRSNPCSENYAGTEPFEGTEAHQLAQWALNETQTNNAKIVGFLDLHSYSQQILYPFSFSCSSVPPTLESLEELGIGLAKVIRLTTHEIYDVTAACEGTITADDQARNSPPQRPIFPTGGSSGGSALDWFYHQLHTDYAYQIKLRDRGSYGFLLPSEYIVPTGKEIFNVVLTFGKFLIGDLAQNTDLDWDAELQRTEPDEAPASQGDGPAPATQQVLQADVDDEETEWVENARSEFRRR

SEQ ID NO: 36586 - protein, 90 aa, A.fumigatus
ANTFTDMDASFGAISQHRVLHLADCTFPSLFIPIHGSDEASFAFVEYESRRDADDAYHEMHNKRIGRDDLLKIEVRFLAFCRCPSRLISP

SEQ ID NO: 36587 - protein, 136 aa, A.fumigatus
WARTPPSASWRFESGRDRRRDRTPPRRGRSPSPRRSRGDYSPRRDERYDRDYDRHDRDYDRRDRDYDRRDRDYDRRDRDRERSRDRSRSPDERDRDVKEDREHRDDERERREEDRENGPNGEDRKGTYLSIHQGQR

SEQ ID NO: 36588 - protein, 144 aa, A.fumigatus
FLLSGLVLLLLPHGALNPDVTDVVTVLPLVEVAPHLLVGVEVIIPLAGMKDTIEIMTDMTGTMTVATETMTAVIETMTVAIGTENALVTVREALMKGTVMSRKTENIVMMRESAAKKIAKTARTVKTGKVHTFQSIRDKDEFCS

SEQ ID NO: 36589 - protein, 353 aa, A.fumigatus
EGGASSRGLYKITTYPTLKLLRILPKLLFGPCPSQNLSNPPATMRVSLFAIITALTCVIAKIPDSPRFDLTKPSYDLWRNKKTAAKTVQQSFTFDNVNRRLFIVNRRDGSALDSGDLTISQVDFSGKVLGSMNLLGCGHGVKIAAEPVGSDTYIWSETDAAASGYGTALWKFKFQNGKTLNSATDKRKRIVPLPEFDRGTATIDPVYKRLIVRYQTGTVQNIAAFDLAEASAGNFSNPLAKWEIPHLVKELGAKVNVFQGYTAYGRYVYFLTGESYDASGGKLNSEVMALDLNTGKLVQGPVTTKAGSTLKFREPEGMAIYKTASGEVRLFLGFASGVAGDRRSNLFYKNALI

SEQ ID NO: 36590 - protein, 66 aa, A.fumigatus
TRDQHLVQQGAEKYEDVYVLQLDVDAMSIIIRSEAQCRAIWPVSIFMVTWCRDETITLQLMHVPSE

SEQ ID NO: 36591 - protein, 88 aa, A.fumigatus
RYMRKQGKYRSENKPDASILNSFHWQEGIPSITYSVGGKFRQYYVSITHEPAALAMSSRAGIWNAANLIIIRNSNQLCTWCSVRKAVF

SEQ ID NO: 36592 - protein, 86 aa, A.fumigatus
LEQEEIDKESLRKVSQELSTANLLAHKDKGVRAWTACCIVDVLRLCAPDAPFTANQLKVRWICRCSLDVLGFDLTIMITRTFSLAS

SEQ ID NO: 36593 - protein, 553 aa, A.fumigatus
DIFTCFVTSIIPALGDPSNTYNAQHIYVLNSLAEVKSIVLMTDLDQPDSLIIPLFTTCFDIVSGSSKASTGEEIAKNVEFDMTRLLVTVIDESPVLAPDVVDIIVAQFLRVDPRVLEPLNKRSRKADTLVDSKQGTLLLKDYPPAYNMAKAICQACPERMTSHISQYFNNVIIDASGSGATNGSSKHHRKPNLDESDEEGEDVKELSKAHRLIRELWRACPDVLQNVVPQLEAELSAESVSLRLLATQTIGDLTAGIGVAGPPPPPPMDPAGFPPVTLAEYAQTIPQPNVLVKPLSPKPFSQAHSSTYESFLSRRFDKSASVRAAWVTVIGRILLTSAGGSGLSENEQQTLIENLTSMLRDADEKVRLAAVDAVGMFGLSDVVSKLGLGGGFSTSDSLLAVLAERVKDRKSQVRDHATKTLARIWAVAAGDIEHGNEQVVSLLKDGPSKIFDAYYTNDPEIHILIDRVLFEILLPLNYPPIKPKLSRSSSSQSQKQKESQSAEADSDADIDKIRVRRILTLLAGLDDKAKRSFTRCKVGKSLSGLQQPARIID

SEQ ID NO: 36594 - protein, 108 aa, A.fumigatus
ARVLRRHGLRRSTACATWYVIELQVIVQSVRLTFPSPTSKATGDMLRSQVAKKTELGKEAKKIMDQGGLVSDEIMVNMIKNELDTNSECKNGFVHTCLVEVHSVGDGK

SEQ ID NO: 36595 - protein, 140 aa, A.fumigatus
LSNVSRFILDGFPRTVAQAERLDDMLEARNQKLQHAIELQIDDALLVARITGRLVHPASGRSYHKIFNPPQNDMKDDVTGEPLNQRSDDTAETLKKRLSTYHAQTAPVVEYYKKTGIWRGIDASQEPGQVWKSLLGVFQK

SEQ ID NO: 36596 - protein, 75 aa, A.fumigatus
RHSSIQPAVIAMAPITEEVVHGLKDMIEKLENRVQELEARLGGESKPKSIAEQMRIVLMGPPGAGMVFYKGCRLR

SEQ ID NO: 36597 - protein, 222 aa, A.fumigatus
FRAPNDATLRNTPCPICQETFESTWSEEVQDWIWQDAVKVGNRIYHASCYAEVTKDGTTTAAGRGTPSARTGTPDSVLGKRKAEVCSIHRGRKFARIKLIRRRGPTLLGPMSESRWSLRERQCFNQVRYPGPCFLLVPRGAACMRWSWHYTLCLVVAFSRRLYCILRACTILRRLGDFSLSTSITIPVFHTILHRTFHKPMAIARMALILVPHSLFSLDSPR

SEQ ID NO: 36598 - protein, 75 aa, A.fumigatus
IQSCSQVSVSLWHHPSLLYSSTASSPSFDVTMAPYNVRWGIMGMFFHPPLYHPSPKGRSKLTVLQIKHSHRLDCR

SEQ ID NO: 36599 - protein, 189 aa, A.fumigatus
HLVFVRDLLRDPNLRDASDVSHTVVAVASSSAKDRAEKFIADTGIPAPCAAYGSYEELVADANVDVVYVATPHSHHFQNVMLALEAGKNVLCEKAFTVNAAQAKILCETAKKKNLFLMEAVWTRYFPLSVQVRNLIKEGAIGEVLRVVADNSFGDNVEERWGTQHRMVNKDLAGGCLLDCEFPLSSTGS

SEQ ID NO: 36600 - protein, 117 aa, A.fumigatus
VCTKFALVKWSLLFHMLIGCRPREGLIASLYEARSNRCGTCGRRFFATEEGKEKKARHLDWHFRTNQRMADAAKRAQNRSWYVDERVSGFLFVQFSYPGEFPNNRAGLDKIPRSRRR

SEQ ID NO: 36601 - protein, 90 aa, A.fumigatus
TRISPVAACWIVSFPFLLRAPESFSTASNDRFLAVGIYSLTWVFQTMYHTLPREAAQSSFGHLRAHVSLPPHWRRRGHHDPSHVPDDHPN

SEQ ID NO: 36602 - protein, 182 aa, A.fumigatus
TSTRHVCTNPFLHSELVSSSFLIMLTMISSLTRPPWSMIFLASFPSSVFLATWDRSISPVAFEVGEGNVRRTLCTMTCNSITYQVAHAVLLLKPWRLSTLAYNPIRTMKPLSQAATLVKDHTSTGGSHKDDAHLLGDRLGLGFAAEAGLQLLHTVLKFLNHVFQTVDDLFCDRSHCDYCRLN

SEQ ID NO: 36603 - protein, 185 aa, A.fumigatus
PGSSRLCTTLFPGKQRKAPSAISAHMSLYHLTGADEATTILLTFPTTTPTNNAQPGQSHAVAMTHLRVATDPNEQGAAGPSIRIQGTKGEIQVFGPAFRPERYRLIPKKGLGEIKDVQCPFPADGKGMYWEADEVARCLRDGKLESDGLPWEESIVIMEVMDEVRRQGGLTYPEKIESTVYPTQL

SEQ ID NO: 36604 - protein, 205 aa, A.fumigatus
  UNSURE (199): Identity of amino acid sequences at the above locations are unknown.
PPLEPLVSLADPTKLVGMMMVLSMPTYAHGTLVVGPPAPPSADTVVDIFKYGRVDSALLTPALIDEMCLNDRALSALRSLKLVSYGGAPLSRKSGDLLAPHVQLVPAIGSTEAGGYFTKFRRDDKDWDYLEFQKQSGAVFEPRSGALHELVFVRVPECRMQQIFLLYPDQDRFETKDLWVEHPTRKGRLHHGAGRSDAXVSSING

SEQ ID NO: 36605 - protein, 138 aa, A.fumigatus
STPTCKFTSHSAIDSFLPGSVTMTRIATFPLPGIKHGKRILVSTIEERAKNDPDSSWVSMPVDNNDLSKGYKEITFAEFNNAVNHAVHWLRQNLPESDEPFQSFAYAGPKDLRYPILAAAAGKLQKVVSMLGMTVVPR

SEQ ID NO: 36606 - protein, 367 aa, A.fumigatus
RPAVTTATDTPDYFNSVHNPFSLEPNPFEQSFGGGSQSETPGKSLLPPVAALTSPALPGTSSTGGYNWSNSLRSGPLSPAMLAGPAGGNDYFDSIGRGFPTPNESSLRTGLTPGGGGSMFPAPSPNSQAILQQLQSGGATPSTIEFHRTALNAAKKNGLSGPTSNPTADSEGVHSSSMDIKSSQPASVDPFTHHDAADAANGLFMLAKGGQANQFVSNQSSVPPHTIQGNNQSRDADRRGSQNVNGPVASSREMSGDASDMQTEQAKPSAKGKGKKNTASKSGTTANNRRKADDTPAKGPNKKAKTSVSSGSAEPPSEAGDSEDEDDMKKKSQTDTKKMTDEEKRRNFLERNRYALDCCMTPKATLI

SEQ ID NO: 36607 - protein, 106 aa, A.fumigatus
YNLTRVAALKCRQRKKQWLANLQAKVELFTTENDALTATVTQLREEIVNLKTLLLAHKDCPVSQAQGLGSLMMNGMSTGFDPHPYNIANNMGMQPGAPIPTQGMRR

SEQ ID NO: 36608 - protein, 457 aa, A.fumigatus
KAYPRTAARTMASRQPARSRRIEDALSQLVDSLTPPISLSEIGDTVSEDPDELLAEAEERRHQENLERAWRIIDTYGGSGNDHASPANGAGLGISRRGSLAGGENINNASDLIKRKLLRENASPDKAVRFSNLYSRLLTQPVLSQKWAILYLLYRLSGSDSQVEVVDENGRSRSPLMDAGNLQNMMLKGGHQRVRHSLGPRLEGDSDEDSPAVSSSASQIPAKMERKASMRRQGWEKEKDVDQEHGHATADRVKGGRTPRGAHDAAPGGNRPVDDQKASFQTQSFSDTFEKRPHESGLLRDLPYNLQGLSSSNLEFSSSTVLKLPPTLPLPILSLLNTLAEPCLLYKGLSKYVEDSGGGLLTQSLRAALSNELRSYLGLVATLEGEIRRALAASEDPYQSKESSKGLVTLKRCVVWTRDATMALRLMSLIVEEACSKCAFRLHHGAGRISALKKTKV

SEQ ID NO: 36609 - protein, 393 aa, A.fumigatus
HAQVYPASFKDSNGDGWGDIPGLISKVPYLHSLGVDVVWLSPHYDSPMHDMGYDISDYEKVLPAYGTVADVKKLIDECHARGMKLILDLVVNHTSDEHAWFKESRSSRDNEKRDWYFWRPARYDEHGNRLPPTNYRGYFAGSTWTWDEQTQEYYLHLYAKEQPDLNWDNRATREAIYNSAIRFWLDRGVDGFRVDTVNKYSKRTDFPDAPVTDPKSYIQPAVEMWCNGPRIHEFLREMYDEALAPYGDVMTVGELANTPDPNDVLKYVGASAKQLSMVFHLDIGHIGMGSSLEDKYIFQPWKLTELKAIVGKWQSFVEGTDGWTTAFCENHDNGRSVSRFGSDDPEFRERSAKMLALMMVAMTGTLFLYQGQEIGMINAPRDWYSPPGWKDQR

SEQ ID NO: 36610 - protein, 653 aa, A.fumigatus
ANSYRQRRHPVTVQFPALASLTLAHLTRNLGNGLDRTLLGLSLVLVFLRQSDESPYVIYLGLLLPLLLHLPFITHHISLALLHPLSLDSPAGSPWIDTWQTPEPPVTVDLTRELSHVSSPAAPDTDLKSTGMASRTDNFSLSSVTGSSVRHTAMVRSQSQQTPVSHRKPLAPGVLGHRQYYGPQHWQIRLDHVNEYTPSEYAKQCLDDFQDRSNVSTLSLALSADPALNGIQHQLQISTPEFPINPNGLSNQSLANQPAPLASAAVEMTRSTTTDSICGGLGMIRFDSAGPNLTPSYPFSMPSTEFMPSVSPINVPIHDYPSQQALQPVTFPFTDSAPLPFSCSAPSSTSFYPPPSSNVPETPATEMKPSMSAESNNSAASQQSRAARRTQEQIAQGTRPIAPKLESRNTSPGKPVEQHKMIRISSSDGTSKEVAAIPKASIQRPPRPKTYCHMCNDQPDGFHGEHELRRHIERVHSVVRKVWVCVDISPGKTFLANCKACRNGKRYGANYNAAAHLRRTHFNPCQRGRGGRGKDSEKRGGKGGGNHPPMEVLKHWMVQQEEFVLENAQNAVDQETIGKDLASVPLSASTDEVVFNGLPSAPADSHPQVGMEANIAQGYEGYSDLQTMTVGPSLETACYFDSQTLPPEIDSYV

SEQ ID NO: 36611 - protein, 115 aa, A.fumigatus
VRLTFGDVDFHLVADRYTEAGIEVNEEVVLMTTKGEAIAIGIAQMSTVELSTCDHGVVAKVKRCIMERDLYPRRWGLGPVALEKKKLKSAGKLDVSCWVPPPTFGFCGFWYADQP

SEQ ID NO: 36612 - protein, 184 aa, A.fumigatus
FSCAKRPHSKSKLIKGNLIRFAGEFRVIETKPSFAFEDVLTVISLTKAPSDAEFRHKIKPTKDLLFRFSALTFNAHSIHLDTSYTQNVEGYPALLVHGPLTLTLLLTVLQSYLVESNRAIREIEYRNLCPLYVDEDLTICGKPRADKGSGAWDIWIEGHNGGLAVRGTVKTDKCINLREDRRDQ

SEQ ID NO: 36613 - protein, 67 aa, A.fumigatus
  UNSURE (67): Identity of amino acid sequences at the above locations are unknown.
GILSKLDDRTLTALTFAQSALVYGGLLSGYMLLFIPRLLYSFRLSMEIYFHFSSDRTGPFLHIRSLX

SEQ ID NO: 36614 - protein, 60 aa, A.fumigatus
TFMLSPEACSDFYLGSSFDQVHNADFSKITAGYFLSGVIFTSGEPNLADRVLTRANLQQL

SEQ ID NO: 36615 - protein, 221 aa, A.fumigatus
NHGVFCRAEKTGHSGTLDPKVTGCLIVCIDRATRLVKSQQGAGKEYVCVIRLHDKIPGGEAQFKRALETLTGALFQRPPLISAVKRQLRIRTIHESKLYEFDNDRHLGVFWVSCEAGTYIRTLCVHLGLLLGVGAHMQELRRVRSGAMDENNGLVTLHDVLDAQWMYDNQRDESYLRRVIQPLESLLTTYKRIVVKDSAVNAVCYGAKLMIPGLLRFGKFD

SEQ ID NO: 36616 - protein, 132 aa, A.fumigatus
VAGFHLQHLVFVVFGTLTSPKKYGRANEDTPAKWKTEYKDYSAPEEASAHAASESTAKEDVAAALATEQDEAPSSPQSKMDVDETKEEKKRKRHEGETAEERAERKRKKKEKKEKKERRKSKQEKEDSDDSD

SEQ ID NO: 36617 - protein, 85 aa, A.fumigatus
LELFLLQSYRAQSPSARVEITFHDATFDLSYDTMIASGKFNSRHLSNANGDGFTLCSHENNFFVDFNASLCVSVSNQVKINITES

SEQ ID NO: 36618 - protein, 86 aa, A.fumigatus
TSPDTLLFLVFHDRADTPLYIDQNFFLPLVAFDYYVPNRFNADSPTAIKERTVHQWESNPTTSPKTPDKWRSWEMQCISTVREYLR

SEQ ID NO: 36619 - protein, 665 aa, A.fumigatus
VSFILPRQSTDKMYFSPHASSSAYESQKFSKQKTVSPRKQQHFQAEKGSTHTRNSSTGLSVYSIESKEIPIWFSVFFGKPSLLSPQLDNARFDARISERVFGPSSTPANSPSKSSFRTSVSSNVSLPRPGLLEETPVIRAILSLCHSFEGEILNCVTDGCTICGKGPAQSLVHHPLCATRYGYVELSDFVEMHKLVSTVASHTSHVTRRDEIDWSVGDVMSDRPYICSLAVPICSSEGECHRAARRLMEMYIDGIKDGSVKPKALDKFETPDRTSLPQRRSVTSQRSFRLNATKKEDYSVSTLCLRSPSIETLGSPSAQPYKIGATMFVGRPSLQLSGTPRRGQLGCSVFSSTWSGAALPGVAKNEADDAVFYCRIAAFYESHILSSVSYRCAVCSEVAPARSLVHRPLLFTQTYRSGLQNESERRLIVKLSQFVQGRWSYPEMNAVMGGTTDAHIFDLIVPICESNTLCAEVARTSAREFVKLLLPSDMALIFPGLDPDTDLSLMEDEAADEYCYKPEYAEILVHRIGCDLLTITCEERDEDPMDCSLTITKLRRWYELAFEEENAKRLYLEDIGYKRTGDRSESDSDDSEIEDDLVWVYALNDPDDSSSRRNSARLSNRELTRQDSAIRTFEKLALFQPTLSLEFWKVWEAMKSSDHKHASPH

SEQ ID NO: 36620 - protein, 235 aa, A.fumigatus
  UNSURE (163): Identity of amino acid sequences at the above locations are unknown.
HNIINLREDIKLCQQKGKTILISIGGAASPELGFASEAAAIEAANKMWQIFGPVDADNTAYRPFGDAAIDGFDFDFETSVTNIVPFANQLRRLMDTSAGRRYYLTVAPQCVFPDVADQEMLNGAVAFDAIWVQFYNNYCGVNAFSFGTMQQDAFNFDLWDAWXKSQSKNKQVKFFIGLPGNVVAAGTGYVGAEQLREIVAWSKAFSSFGGIMIWDASSMDANQGYLESVKKTLIG

SEQ ID NO: 36621 - protein, 411 aa, A.fumigatus
  UNSURE (409): Identity of amino acid sequences at the above locations are unknown.
STHLRFQSQGHFSCFHPTDLPFFTLSDSFQHNIMGKKAIQFGGGNIGRGFVAEFLHEAGYEVVFIDVVDKIIDALKSTPSYEVTEVSEEGEKTKTITNYRAINSKTNEEDVVKEIGTADVVTCAVGPNVLKFIAPVIAKGIDARTASKPVAVIACENAIGATDNLRGFIEQNTDKDRLSSMSERARVANSAIDRIVPNQPPNAGLNVRIEKFYEWTVEQTPFGEFGHPDIPAIHWVDDLKPYIERKLFTVNTGHATTAYYGHMRGKKMIADALADAEIRQTVHKVLEQTAKLITTKHEITEQEQNEYVDTIVKRMSNPFLEDNVERVGRAPLRKLSRNERFIGPASQLAEKGLPFDALLGSIEMALRFQNVPGDEESAELAKILKETPPKRPVITAGLIDQDLRSTPHXSA

SEQ ID NO: 36622 - protein, 214 aa, A.fumigatus
FSAFFIAGHILEAKSHLDRAQQCIKRQALLSELRGRPDEAFVSRQLAKGSTSHTLNVVFQEWIGHTFHDGVDILILLLLGDLVLGCNELCGLFQNLVDSLADLGVGKSVSDHLLAAHVTVVGSGGMAGVDGEELAFDVGLQIVNPVNSRDIRMAELAKRSLLHRPFVKFLDADIEAGVRGLVGDDAVDSGVGDTSTLTHRAETVLIGVLLDEAA

SEQ ID NO: 36623 - protein, 122 aa, A.fumigatus
FQPGFGCLSALIVMMSLSFTYLSPDSAFIVSPHFSYIFRALYLLITTSLISRRVLVTGPPYFSSNFVTLCMLELVYLVLDFILPSTRFILVIYLSSGFLVIAHSDFVTFVSYPPHAICCMLH

SEQ ID NO: 36624 - protein, 99 aa, A.fumigatus
DGWRRLLGSRLHLCPSSDEVSFYIVYTPHVDDANNGDKVYNWTELRPDSKIRHTWIAFDCLDSPNTLLIGEFQEGDASTLILLVKYPLDYTHAGCARPA

SEQ ID NO: 36625 - protein, 393 aa, A.fumigatus
LREDISHFAMTHQAQAVNAPVSSALPSGNMRQRSRQACAPCRQRKRKCDGKFPCSACTGYGYDCQFLDDSVNSVKRNADAVSSLPLPSTKAARLSEVTAKSLGGSSVISSSSHGILDPSKLRYMGRHASVAFPMTVGLELQAAKPPRLHSFAYNPGVRTEPSCGVSFNLTAFISWDKVRSLMDVYSSTVHPVFGLLDMERLYHRCEEHWHGKAQGLGLEALISGVIALSSLFSGFLSEEEETRVMLHAKEILEDASVSRKPSIDKIAGWILRTIYVRATSRPHSAWMCSCTLMHLVEAAGLHQPLDAVILTTGSSGRKALEDITETRDRIAQVAQCLNIIIAYDYGRSVIDLGLTWKRDSKSDAPSNDLTPQLFSLIGAVPLDNNADPAAKRG

SEQ ID NO: 36626 - protein, 82 aa, A.fumigatus
ISWLSQRFTVGKVCPAICFLWAVVVPCTPACTNYTGMLINRFMLGLIESGVSPAFMLCTGMWYTHSEQVFRSSLCSPSAGLS

SEQ ID NO: 36627 - protein, 99 aa, A.fumigatus
NRKSSAGYNLNALFTGSEGTLGMITEITLKLAPIPETQSAAVATFSSVRNAVACATKIMRQGIPVAAVELMDEVQMQVINKNGGAGGRLWEEKPTLMFK

SEQ ID NO: 36628 - protein, 193 aa, A.fumigatus
VDKITSWPAYTFLAERQIGFRVPSSLYPLILRESKKSSLRKEAVRSSLRGQRKRCVTYGLLGRKPCGPCVHRGRRARKYGPPMLPCHYLAYPRSLVSLSIVVEYTWKMLMVCVLPELSKTESSSLGLFSSVLGHVGDGNFHQAVMYDPSDPSEAHGVRECVRKMVRRAVEMEGTVSVRYVPEAFILSLIDRLF

SEQ ID NO: 36629 - protein, 61 aa, A.fumigatus
EILFWTSEQLLTQIVPFGAGSSVEGNFTTPHSGISIDFSQMNKIIALHEDECVSPRWLEGI

SEQ ID NO: 36630 - protein, 62 aa, A.fumigatus
HARQSAMKKLIELGSGTNAVRYGTMKDWVINLTVVLADGSVIKTRHRPRYRDPRHPRHWSIS

SEQ ID NO: 36631 - protein, 87 aa, A.fumigatus
KTDRFSGTEQSVSADIARVEKIISQEGGSAFEFARTEKEMRNLWSARKEAVWAMCAQRPEGTQIWSTDVAVPLSSLPEIIGQSVYCR

SEQ ID NO: 36632 - protein, 243 aa, A.fumigatus
KKRQKVYSASSSVSGGLGVPLGDCNLWRVSSLQKVKSHKIRRSIPFKVTQSTARLALLQLSTSHLLLLPGLELQFALIFGARVDSRGSGAGSRRVGDGAAGLRRTGGAVLEAVESDGGVGASDNATIGDVQLLGAQGTHELFVVGNHDDTSLEVTDGHCQTTERVTVQEIGRLVQHQQVRVVPHGTGQDNLDLLTTGETGDLVVVGNLRVQTDILKVFRDRLGFKDSETEALTGGFVIVKLLD

SEQ ID NO: 36633 - protein, 462 aa, A.fumigatus
LEEAKLDQGLTRDHGIVLGKKADPFDFVLEGLLPLLTTHDGFDAARAPAVSEVDRLLHLRLVLLRQNSGLLEEDFAVVSVGITPLQVLAGSLLEMHFNVLQSVLLDVSDPKVGVLLNLSCLGNRLTRQHLDESRFTSTVSTNDGDARREGKREGGVNQRRLARTRVGIRAVGHSKDGAGVGLDAGQDPGGRELELHHAGGQGVVALGFGLLLDKSGQVALVVDQLLSFVVVDVGADLVQESRVVTDNKTGDVSVLLQVLLQPLDVGDIEMVSRFVQKQHISLHEHSTGQSQLHLPTTREGPNTLVLSSLGAIGKSEFEENTANVFLSGFGNLGVLGHIFDDAQIGVFALIVLDEARADHILRREPLELLIGNTAHEGRLAGTVPTTEAVAVALEKTKVRVRKEKHSSVSEGEVGVDNLHLVGVVRNGLAKLAGDLPRIKCSWTARVDSLRACHPWEESPKDK

SEQ ID NO: 36634 - protein, 176 aa, A.fumigatus
SGPADIVKFPSLCLQDGPQGLRFADHVSAFPAGITTGSTWNRELMRERGVAMGREARLKGVNVLLGPSMGPLGMMPAGGRNWEGFGSDPVLQAVAAAETIRGIQSNGVMATAKHFVMNEQEHFRQPFEWGIPTALSSNVGDRALHEVFAWPFAESIRADLANRDVLVSNGEQQPTL

SEQ ID NO: 36635 - protein, 680 aa, A.fumigatus
LIFRGLFPRMTSTEAVDSGRPGAFYSREITGKFGKPVPDDPNEVEIVNANFSLAYGGMLLLSHTNLRLLKGHRYGLCGRNGAGKSTLMRSIANEKLEGFPPQDVVRTCFVEHNQGEDADLSIIEYVSKDPKIAEAGQEHISRILLEFGFTDGPEGRQNQRVGSLSGGWKMKLALARAMLMKADVLLLDEPTNHLDVANVKWLQEYLKKHTDITSLIVSHDSGFLDEVCTDIYHYEGKKLVHYKGNLAAFVKQKPEAKSYYTLSSSMVQFKFPPPGILSGIKSNTRSILRMTNCSYTYPGASKPSLVDASLSLSLSSRVAIIGGNGAGKSTFIKMLTGETIPQTGKVEKHPNLRIGYIKQHALEHVEMHLEKTPSQYLQWRYANGDDREVFLKQTRILTEQDKAQMEKPVDLGDGRGPRRIEAIMGRQKWKKTFQYEVKWVGLLPKHNTMISRETLVELGFFKLVQEFDDHESSREGLGFRVLEPKAISKHFEDIGLDPEIANHNQISGLSGGQKVKVVLAGAMWNNPHLLVLDEPTNFLDRDSLGGLAVAIRDFKGGVVMISHNEEFVGALCPEQLHIADGRIVARTNTAVALDRFEDSAASSPQPGSTVANSAATSAAPSAVNSGAEDQGELKFKARKKKKMTRAQLKEREARRRLRHLEWYAPPYLVTFDFLQTANSP

SEQ ID NO: 36636 - protein, 128 aa, A.fumigatus
PMVPSDSWFPSPKGGTLKHWEESYKKAQSLVRNMTLVEKVNITTGIGWQMGLCVGNTGTLVDCDYGFILIDQARRILLNSPPCVYRTVLKDYDLRTMCLPFRRVLQRGLRGIESSCASVASLWGERLG

SEQ ID NO: 36637 - protein, 115 aa, A.fumigatus
MSRNISGSPLSGGFRPLYRPTWATVPCTKSLHGRLPRVFEPTWLTVMCSYQMVNNSQPCENNKLLNGILQDELGVSRIRALPTGLGPPVWASTAPLGGLLLEPCPGVRSAFGLER

SEQ ID NO: 36638 - protein, 63 aa, A.fumigatus
NLHSFVSTTIVSVPCTFCDSNSDSNREEYMGYIWVLNKSYMGLPSLAFTYYSVVCRLDCIDSH

SEQ ID NO: 36639 - protein, 74 aa, A.fumigatus
YVRIVPFIVSKMTQVDTGTAFGKDTIGGSQFDTLIGQPFLENVTLQSLKRMIDVSKSLPTFFSFVVTGWGIVYP

SEQ ID NO: 36640 - protein, 61 aa, A.fumigatus
LPSRSGEGNALITNAVHYASKHGIILSLFIGWRGPRPAKLPLRLSDFIIYTLGSSARGGQN

SEQ ID NO: 36641 - protein, 529 aa, A.fumigatus
PSEDITLITPPASQAPLEAALSQNPHLTSLPAPSPSVLAPSGLTLTTGTAELLRLPEVQSCIKSDFLLLPCDLICELPGESLIEAWMVTQSALGGSTISGGWNSNGPKSIGMGGEQGGRRGGLGVYYQTRGREESVKGEVTDFVATAPLEQEEAPAVSHNSDGPVSIRYGLSKLVLSIPMDTLKEQMEEQKALLIRHSLVKKHARVKMLTTYRDAHIYVFPYWVKEMAVLNEKFESVGEDLVGWWAKAEWQKGLAEKLRLREIFEPEGHKATESGSLDGEHIEEEIDLKAMSTTKAGAGTSRDALSDDPSEAVQFASRVKRSGTDLSTAPPEPSKGKLTVPPLLAYVHSSLPSAPLVRRVDTSALLLSVSLRLAKLESIEEVGRTAASPFAHSQKVAYPAGVAQRCTVTKADCLLADNVTVEEKCVIKESVIGANCHIASGARLTRCLIMDGAVIGERCQLTGCIVGRRSQIGRESVLKDCEIQDGNIVPEETDAKNEKFMVFEGLDDEDGEGMEVSEEFDDSNDELGF

SEQ ID NO: 36642 - protein, 67 aa, A.fumigatus
SQHFVMPHSIPVPPTGFQALILCGPGVSLNTFTSNPEEFPKALLPIANRPMVWYPLDWCYRMGITSE

SEQ ID NO: 36643 - protein, 235 aa, A.fumigatus
TPYRRRDRTGGKILDRNPRKGKSPSPQKLPTKKSGGVGIIGGKKQIKQKFQTHPPPCPPRDFASHEHKATDSGTDRDTQPLQYHHRPPAALKPSASVTTASKPRGLGVIGGKKKEQSPQQIPQPSLSPEAQEVLTSEPKQKHGGKLGMIGDKARKTTEVFPAASPKNRAETTTSPPPAKSESGEVSRRGAVKRSSSPVKPPPQETEQERADRKREELKRQLEAKSRAPAKKKRRF

SEQ ID NO: 36644 - protein, 749 aa, A.fumigatus
AQTWGIVKFAVIQELESGARAQEQAPERGSRNVKKKLSKEGQHAERPPAWEDGRTDRLRNRLFRGVMETDASKHSTTEIESTSNITTPLARPLPDSPVESLHSPHSQMTSVNDDAADIEPLPPSVLSSNQGTMNTMNSNGWSSMSDVEPHSIPQFEKRHSDAGESSLSSFENPPRDLAGTSAIQSPESDQRSAPRAINRQADWRLRNHPDYVKGASEDEFDQKMEDKRAAIRDYKLFPKKVLSLESHIEPPRPPPFHRHESSESFPMFSESTGSSHPSKSLATSFSSAARLYDSSKIAEADESVIEDYPREHENLELAHTPVLNEQAVQDDGLFQESVIDASRVHLERPSSPPQLLTESSPLQIPKDSSTSAKNAPDLRSVPESTEDLSDIVIPLSPNLSGNKPWSPEMLLKEAIRYNHSSTHVDIQSAAHLLQKLCILFGECEKLLPREECELIFKTYHEHLVRQSMYLEAAELRLLCVPSYPAVYEYAQTNTFINVFCFTCKRPYENPKQDNRSCYQCNTPQEPCAICMSVDPPADWITEQISSFADTEEHSEATSHLLSSSRSSLKTEQIPLSELQRLDGALLGDYTAPRPMGSTLWTWCQGCGHGGHMACITTWLSDPSLSEGGCATPGCMHDCGPGPRREFNRAVLQDVSRKRDAASRKAGLGFVKRDPWAKGESKAVEKVRGMLGVATSGGSTVAPVSANIGAASSSGTMSPKKVRLVTPIEQGKRRSGPSRASTGGSSGINI

SEQ ID NO: 36645 - protein, 281 aa, A.fumigatus
  UNSURE (268): Identity of amino acid sequences at the above locations are unknown.
SLVLQLPSNCFYSTMATPILISYNPTSASSGLSLSQIAYFGRVLIKVSSLSQAEEFLRQNFRLLDVYVDATDITSSGDIVDILNAGAAKAFISLDQLTSLSQEQSVPSSRLVVYTSSDSQVDAFQSWVGEDAERKEAGICTESADVKTVADRLGLNLEAQNLYRTYTTSTVTEDAVKETLKQGAVSIVSADALTLDHKNPSGKIAAAALVAARAVADQSNGLYATSVTDERGVCLGLVWSSDESIAEALRTGTGVYQSRKRVFTGGCXGDQFLIQIWAGIS

SEQ ID NO: 36646 - protein, 92 aa, A.fumigatus
GGPRLLRAYLSLVSGFCILSLVGIMHLPSLSVALALVSSSLALPQAVLPENDVSSRAAAVKEAFSHAWDGYMKYAFPHDELLPVSNSYGDSR

SEQ ID NO: 36647 - protein, 190 aa, A.fumigatus
  UNSURE (128): Identity of amino acid sequences at the above locations are unknown.
PGDLCRNGWGASAVDALSTAIVMRNATIVSQILDHIAKIDYSKTSDMVSLFETTIRYLGGMLSGYDLLKGPAADLVEDRTKVDMLLQQSKNLGDVLKFAFDTPSGVPYNNINITSDGNDGATTNVLAXTVTLVLECTRLSDLTGDQEYAKLSQRAESYLLAPQASSGEPFPCLVRSANNFQTGQFTHGFR

SEQ ID NO: 36648 - protein, 179 aa, A.fumigatus
YSLRAELKPYQLVGLSFLVYLCRNGVGGILADEMGLGKTLQTLSLFQFLKERDGGYSNRNSPFLVVCPLSIQEKWLREIEKWAPSLRAVKYHGTFEQRDNVKKMVSAQKKPSILRVPTDIVDIVITTYETLISEINWFSRVFVWRGVVLDEGHRIKNSRSKRSLVLNRIKAEMKLVLSG

SEQ ID NO: 36649 - protein, 379 aa, A.fumigatus
EKSVLMFPSHLRITDIRQCCIHPYLFADAIPSPYELGEHLIHQSGKFLVLKKLLQYYVTTETKVIVFSNFDQCLNLCEDLVMMLQGSNRAFEYARLDGRTTGPWRKVMVHLFQNDPRYKVFLVSIRAGGEGLNLTSSSVVVFLDEDWNPQVMRQAEARVHRIGQTRPVVIYKLRSAGTVEEQMSRRLVKKAYVADRVTENIPAHCPGNDYLEMLKAEEASMSQNSTDTFGLPSPVFMDQTFLSQQQIDTNELSQWDMSTILAKCSSTQKDGGLSPCLTVEQEQLWLEKADRVRTNFFNGVTIDTSGRHHTVYAEEESSNLLRSNRRIGKERTVMIDGYAVSKESLRASGEEPTSTNECASPTNKFTRLHHGAGRSRSVG

SEQ ID NO: 36650 - protein, 166 aa, A.fumigatus
ALVAIRTCFPINRSACVCISSRMTNSPAMTRIPRHLGEQAESRKRRTGKRNETNVLVLGDGGPGSGVGGRSSRRGRGASGRSGRSGRRGRSSRSGCSGSGLGGIRLGGRTRSGCRGFRGRASGRLSCVGAAGRLRHVGHTGGFTYPVRKLDGGCGKEWVSIFCRVS

SEQ ID NO: 36651 - protein, 189 aa, A.fumigatus
QLRQERGKRMALSNVAVFGAAFLTPVLAGKITHSLSWQWTFYLVAIFTAACLPLTFFLIPETAFRRADHFNTDFEHVGDRLDGSHSHTQLQPAGYATSELSQISGEQKQSVLGTNEKPQGEPSRREDGVSQEPTLPRKATYWETLKLFNGRKTDEDFFTLLLRPFPLFFHPGILWVNPPSHSFIYEAYV

SEQ ID NO: 36652 - protein, 95 aa, A.fumigatus
  UNSURE (52),(91): Identity of amino acid sequences at the above locations are unknown.
LPQACLIQGVLIGWTVFIGVVLAAIFLGPPLWFNEVQTGYLYTGAFIGSILXLILSGILSDSLNKVMIKLQQRQYNPEFRILLVIFQLIFXGTGL

SEQ ID NO: 36653 - protein, 103 aa, A.fumigatus
HTFRPSLPISMGLGVLEDKVLDHVPGKFHCLVYIFTGRLVQSKSPFLNIWLGTSYILEDERDDNTALDSRLKYDRSGDVPILLVPQPSDDPNDPLVGRRSYGW

SEQ ID NO: 36654 - protein, 185 aa, A.fumigatus
NWPVWWRDLILFALCFVSVLCATTSSLMAANTVTIALHYGKSFTSVALLTGYHLCGVGVAGVLIVPTARVWGKRHLFILGNILMVVSCAWAGGSGQNYQSLLWARIIQGVALAPFEALTNACVGDLFFVHVGSICATSRISSDNYARNGASGWPYRMLPCSALPSSHRFWLARSHTRLVGNGRFT

SEQ ID NO: 36655 - protein, 179 aa, A.fumigatus
SASAPIRPSFLVFPAAFSNHAVRTSSRVSSRSCCSRNSARLHMALDSPLRYPTEDAHPFFPTAAVEFANRICKTAGVTNMPQSPSCANTTQSATGTASKSSTATSGSSTESNASQTAATATTSTTPPTSPTSPTSTTGSTTSSAASTTNTTTGAAVTQHKDIGLIALAGAALAAFGLLA

SEQ ID NO: 36656 - protein, 158 aa, A.fumigatus
PTCLSLPAAPTQLNLPLARPLNPLQPLLVLPPSLMPPRPLPLQPLLLLLPRLPLLPLLPLAPRPRLLLRPPTPLPGPPSPSTRTLVSLRLPVRRLRLSACSPRCRGIRVMAGLFVILDEIQTQAERFMGKQVRMATSAHIVTQCPRLHHGAGRIHAGP

SEQ ID NO: 36657 - protein, 312 aa, A.fumigatus
RMTKPAFLELPAGAQLTYLAEGGANIIYRIASAPSPCHTGPTDTYSSSGPHFIVPPEFKGKLLRLRKETKTGISYQEIARNFDRTIRPLFSPDELVDQELVYLPSGLVQRCNEQLSAAERNGERPKKRQGVYLSVTEPFGLLVTDMTTFATPNTVLAELKPKWLLQSPSAPVNARRCRTCALRDMKNYQSRRAGGSEEISFCPLNLVSDKFENVLRAAKYVKGCEDQTRLARILYRNPTLQKLLTHQKAMRDVGLHGPSAQSREQSLAMTLRDCTMFIKVAHSTPSMCTRRLAYSIRFRVTRWGQWKSALET

SEQ ID NO: 36658 - protein, 73 aa, A.fumigatus
  UNSURE (71): Identity of amino acid sequences at the above locations are unknown.
YRFFDIEGPWDKVHQVIGQAHMLLHQQGIVRIQTDIRVGSRFVPCFSYPVDLWWCQLTRFSVPGLNRNNHXEG

SEQ ID NO: 36659 - protein, 336 aa, A.fumigatus
NLDSMDDHQHGHVPYVLLLLHYLEKWKQAHDGKVRSNYKEKSEFREFVRASARTNNAEGGEENYDEAVAAVLKSLNPFSLRGSIREIFEMDQCKNLKQNSAEFWLIAAAVHEFYQTHKVLPLPGSLPDMKAQSADYVSLQNIYKSKARKDVEEVTATVRRLEAQLGPRAAVIPDKDIEIFCKNAAHIKVIHGRDIPRINGDAQTLKAITDNLSSSEALVPIFIACQILDDIVTDIQESNIADVSLDDESLWNTHIQQVISNLASDPTAIDERAREKILEATQELRLTEGGELHNISALTGGLVAHEALKVITRQYVPLDNTCIFDGARSRNEMYRL

SEQ ID NO: 36660 - protein, 93 aa, A.fumigatus
VHCAQTNSLVSNKVSSWPFMMHWTWTAQVFLTLHTLVFLMKMHSYAFYNGHLSETQRRLASLDKPGLVSVDTAVRYPDPAPSGHPTHQHSNHA

SEQ ID NO: 36661 - protein, 79 aa, A.fumigatus
LEAQLSKKKVVDFHSSILFPGSASTGFFAALSSSSFPVSSLIVATPSILLSSSPFGGPCDRHDIPYVFALHDPPHPHPF

SEQ ID NO: 36662 - protein, 102 aa, A.fumigatus
FGSPVSKHQTPAPLNFSRTTSSYMILCRRNNVAKLLYLFTLGERTHFGQIECLKLLASHRFADKRLGYLGTMLLLDENQEVLTLVTNSLKKWVFRLNLCLLL

SEQ ID NO: 36663 - protein, 481 aa, A.fumigatus
EVSWLTGSSDLNHSNQYIVGLALCALGNIASVEMSRDLFTEVESLLSTANPYIRRKAALCAMRICRKVPDLQEHFLEKAKALLSDRNHGVLLCGLTLVIDMCEAEEAEEGQEGVIEMFRPLAPGLVRALKGLTTSGYAPEHDVSGITDPFLQVKILRLLKVLGRGDAATSELINDILAQVATNTDSTKNVGNAILYEAVLTILDIEADSGLRVLGVNILGKFLSNKDNNIRYVALNTLNKVVAIEPNAVQRHRNTILECLRDPDISIRRRALDLSFMLINESNVRVLVRELLAFLEVADNEFKPAMTTQIGIAADRYAPNKRWHVDTILRVLKLAGAYVKEQILSSFVRLIATTPELQTYCVQKLYTSLKEDISQEGLTLAATWVIGEYGDSLLRGGQYEEEELVKEVKESDIVDLFNNILNSTYATQTVVEYITTASMKLTVRMTDPAQIERLRRFLNSRTADLSVEIQQRAVEYTNLFG

SEQ ID NO: 36664 - protein, 107 aa, A.fumigatus
SSQPPPSSSLPPRSGVLATAMTSRTCLPSMIPPTHTPFELATESLINPYRTCGLGTVKQFIRNVRSAKTIADERAVIQKESAAIRASFREESHDSGVRSANTRHQHL

SEQ ID NO: 36665 - protein, 65 aa, A.fumigatus
LTQRYRPLSSFFIKSTSTAARLDNSLIHPFLSILLRYLHRASSSSYNIVNKGLYSSDFLLSSYIL

SEQ ID NO: 36666 - protein, 90 aa, A.fumigatus
DGQDQPTFGHFPVHMVEHISEHRYPAEEVDTSSSPMVFPWDRMKDRKEETEGNRATQRYLKDEGREGKPASGAMRSFLHIGLTEGGGNGQ

SEQ ID NO: 36667 - protein, 205 aa, A.fumigatus
  UNSURE (187): Identity of amino acid sequences at the above locations are unknown.
QEPGALAGPSSNIAFLRHLSRAVSHRKISQKEINTPLIDQTAYDGGVVSATRPPSPLSGCTPTSGQPGLVTNLALPSSEETLQLIRRYFYETGLLFPYIHPPTFLETYDEFKNNAKKVRRTWLGLLSIMLAMAKVTAVSGHAPAESRIKESTVYYRQALNLCRGEMLRGTTLEVGGLILSSADLSVXSTDLSCSAVSPTHGPISP

SEQ ID NO: 36668 - protein, 123 aa, A.fumigatus
ARFRRYALLPAHWANGGGGKRSVSRVLGGSAERLNAGTSSPRRQDTLSAVYHVITGKGCSEVGDQTLEWKAGDTFCVPSWHAYQHFADPGETVYLYRFDDKPMITALGFYRSAEDDSEELISD

SEQ ID NO: 36669 - protein, 97 aa, A.fumigatus
FRVRLQLIEEWIDISMDHKYIPSQATRSILAMPLGYLYISFIIIIGIIITIFIYVSVSPSGRVAAGPAGGWVGRYYLISTRSMVGLIVPLPPQIYLV

SEQ ID NO: 36670 - protein, 95 aa, A.fumigatus
IASSLSNTRKDKDYICYQVIYYFLYYPDLIPYPSIVPNSCLVNRLIYPALWIIFYHEVPFPGKKLHITQLKVINFVRARPFQSEISSSESSSADR

SEQ ID NO: 36671 - protein, 117 aa, A.fumigatus
WSPVHAMTTVQVYKAGSIRGIITSRNSISPTLVSITGLPFDASSGTSVAASYMQIARWHQCYPSNQTNRNTDADMSYSCGKFVVIELVVASSEVVVVTVKAHCNYMDARHLVGKSAM

SEQ ID NO: 36672 - protein, 262 aa, A.fumigatus
CSSKPKGGKPAPPKPDAGETGSKKRQGDTTEDTKQSSRKKIAGSSTPTEADNGATSTASNLKILPGEKLSDFVARVDREMPISGMKRSGKPAPADLPKLREGRQTKHEKRLRRLQEQWRKEEAEILEREAAEREEREAELEEQLELWKEWEMEAAQAKAKKKGAAAKRKKKGDGALDDDGPDPWAKLKKRDRMNKPANPFEVVQAPPQLTKPKEVFKVRGGARVDVANVPAAVGSLRRREELASERRTIVEEYRRLMAEKRR

SEQ ID NO: 36673 - protein, 60 aa, A.fumigatus
RLDLPLTTEEKKFAEPSQASVSINHNHNQQNNNPPCLTSIREEKMTRGAYQSTYNIIYLR

SEQ ID NO: 36674 - protein, 96 aa, A.fumigatus
SHHSIYDLPPTLIAKPLPTRDPNAPKTKGKKPAPKSKAPKKKESLSAFARRKSELDDDTPRAFRRLMQLQAKGRQASTTQTRCRRDRKQEAPGRYN

SEQ ID NO: 36675 - protein, 538 aa, A.fumigatus
  UNSURE (10): Identity of amino acid sequences at the above locations are unknown.
VKTEGPCRCXLRPRKGRLDLTAKQRSSKLSFEDISVGMILPGRVTKVTEKQVIMQLSDTVVGAVNLIDLADDYSKANPTVYHKNDVLRACVVGVDKANKKISLSLRPSKVLSSSLPVQDPEITSMKQLKVNDVVRGFVKRVADSGLFVTLGHDVTAYVRVSDLSDSYLKEWKDSFQVDQLVKGRVTVVDPEQGRLQMSLKESVLDPEYKAPITMHDLKVGQFVTGKVRKVEEFGAFIVIDRSANISGLCHRSEMADKRVDDARTLYEEGDLVKAKIIKIDRESGKISFSLKASHFKDHDEEDESGSDEEGDSNGVSLDGMGGVDVEGSDDSEDDDDDDESMGGVDLEEDSESDGGESDEDVEMTSAPVKRDGGLGATGFDWSGNVKDDENEAMQSDSDDEDNSRKKKKKSRKPEIQVDRTGELDANGPQSVADYERLLLGEPDSSLLWLKYMAFQLELGEVEKAREIAERALRTISIGQDTEKLNIWVALLNLENTYGNDDSLDEVFKRACQYNDTQEIYDRMTSIYIQSGKNEVSHP

SEQ ID NO: 36676 - protein, 196 aa, A.fumigatus
MLTQLTLQKADELFQTALKKKISNTPKFFLNYASFLFDSMAAPDRARSLLPRALQSLPSHTHVELTSKFGQLEFRSPNGDVERGRTVFEGLLSSFPKRVDLWNVLLDLEIKNGDAEQVRRLFERVLGIRDAKKGAAAAVATPTDASKKLRPKQAKFFFKKWLSFEEKLAAANGGDEKMVEEIKARAADYVKSLQNA

SEQ ID NO: 36677 - protein, 266 aa, A.fumigatus
ALPSQTGAGTAASVHGQADLGICTLNDMRANAEMLANISPSTPVIADADTGYGGPIMVARTTEQYSRSGVAAFHIEDQVQTKRCGHLAGKILVDKETYVSRIRAAVQARKRMGSDIVVIARTDALQGYGYEESVARLRAARDAGADVGFLEGITSKEMARQVVQDLAPWPMLLNMVEHGATPSISADEAKEMGFRIIIFPFAAIGPALTAIREGMEKLKRDGLPGLSKELTPQMLFRTCGLDESLKVDAEAGGAAFQGGVDLEDKE

SEQ ID NO: 36678 - protein, 527 aa, A.fumigatus
VLIAGSCQVDGASADNHRYSSDSTFSANRPDSGHRVTSSIYSRDTFDHSRQRSVTWDHQNDGRFFRDPETASENLSVEISPPDSPMSIGRTYHSRGSSRVSSLEFESNPTSNGEHNITKFASHLPIPRKRAGSAQPHNRPSTQGLSDQNRTARWDGFTDGPTTSHSDRFAPNLSTDISFESQHTGSSNASRWIKGHGHSKEQNTEGRQRSPSKNDNPFSLAVREPWKGPSGRSAMINPIQEKPKERSSSRVHHSKNNDRNDRSKESDCASPDYSYLGFVPSVVTTITGGADDALGPDKRQPSKSRQQPSIAKKPISATSDVPPRIEIPVPTLETTLAELKLSTGDQADAPVSRFSATTCATTESDSPTPSRRESVDAASQSTENAPSIMSRKRPIPSAMAPGKKPSRKPTPSQADNGKDLPPCPPEQQSQNRIEMLEARRDNLARRRANINTIIHELTQVIQPSSIAYDMAARDEVKKTVASLNNELADIRREEHEIGMKLFRLWKKRDEKNLYGGDSGLWVKRVTS

SEQ ID NO: 36679 - protein, 120 aa, A.fumigatus
  UNSURE (83): Identity of amino acid sequences at the above locations are unknown.
ISALPLVPPPPLISYFSSLFKNFFLIGHFPHIAAIFVFHLVKRLFPTISLSKTLYTMGGAKQRRYVVPLPWIMRYSQLSYFSXGRAKLLKAPKKGKKELDEEDLAFKERQRAGMLSTCGR

SEQ ID NO: 36680 - protein, 189 aa, A.fumigatus
HAFQRPHIHEYLQEMHEEVFSHYDCMTLAEMSCGVSAPEAVRYTSRFNARPELNLVIQFQHVELDCHDGDKWMLREWELPELKRIINEWQETLVKNGGWNTVWMENHDQPRGISRFTTNSPRFRAMCAKLLALWQFTLQGTNLIFQGQELGMINPGLFSEDMNQDIETIQYWKAYVSLILARHIVRLLT

SEQ ID NO: 36681 - protein, 75 aa, A.fumigatus
FWGRNELENYSVLREEKILMKGEKNIILNYGWDNTLLTTLLFWAPILISSKTPKKFGIEWILPPIFFLCCLPSFP

SEQ ID NO: 36682 - protein, 85 aa, A.fumigatus
QCLGPGKRIMPSTPTRSQFSSPAKPRESPVSVETQRYMARMRRMEREEDASLQRLNEQLQAMIKEGKQALGTRVEVDDLDLDEDY

SEQ ID NO: 36683 - protein, 76 aa, A.fumigatus
SFSECAHNSRHSFYIDTPKRSFTFQILHDYYQMTTVLLRYLIPFVVVLRSSGLFKSDLQPRELQSPSLASAQRLYF

SEQ ID NO: 36684 - protein, 69 aa, A.fumigatus
TRQIQDTVMLDNMKIFSLMGKMPVEGLPQYQFSFLTQSREPFTPCLGRDGPQRVTDGNARLTISATGTI

SEQ ID NO: 36685 - protein, 109 aa, A.fumigatus
LLRTDPSKPTTFSISRDLTAWYNAFGSSHNIVAHEETNMIYAVGTTRSHSCAGGLWMVDVSNPAKPISPGCVNQDGYVHDGKPLPALIVPCHTNSHSTMCNLQGARQEV

SEQ ID NO: 36686 - protein, 116 aa, A.fumigatus
YAERKRYLDNMKFTAFSLLSLACAAVASREGEAAMDRLMSVKVEERERFRAEGLFDANQYPDLGSQKCVNGKAGEYSCENVDLLGFLSHQAMGSKTREGNDIWGMLLTENISNKAH

SEQ ID NO: 36687 - protein, 212 aa, A.fumigatus
SFRAILTATAQCVIYKGPDKKYNGREICFNYNEDSLTIVDVSNKKSPVQISKTPYAGSSYTHQGWVTDMEDMSYLLLDDELDEKDGTGVAANGHTTTYVFDIRNLAKPKHTGTYQSPVKSIDHNQYVLNGLSYMSNYSSGLRIVDVRSVTQDPTGAKFKQVGFFDCHPDDDAEGGKVQFVGSWSVYPYFKSGNILLNSIERGVFSLKYTGPK

SEQ ID NO: 36688 - protein, 88 aa, A.fumigatus
NYDILGLYVLIFSTTSSLTFYYNRHTMGYAVSQGTGPYPATVGAPCLRACSTRITYLDCTCSRYCEPRVTVCDSLRPVSAKARCEGFS

SEQ ID NO: 36689 - protein, 391 aa, A.fumigatus
ITAFSEIYSSTRPSGSCLIGREITPFFLFCKMESPIDGRIARSARQLNCQSERETGLIEKEHLTTETGSTLSSFSDEDSELSLGHQQGSRGRRRVSRKYHARAHGHSWFSQRSTRPATQRDHVPQVSHQRVRANSHSLHSLLPSHVSLSSSLFFSPPSPSSYPSSSTFSQSSPSTSPSPLPFTKRAKTKAMTQGSRPRSTLLRERKRSLQPSRQQVPSQAPSSGQHVPPVTPQRSQWQQIPQVLQHPSTILCPWRLWESVAVHVFNIPREADTYCLWQAFSKEGHVFSIDIFEDFHGNRESRGKIRFKSADSPLHSINWPNPFSRPPPQKDFWCHGTYPITLSDGKPTFVSITLDLKRPDVQIQSPLRPNTMYPAEVVGLSTFPYCTIFQR

SEQ ID NO: 36690 - protein, 255 aa, A.fumigatus
HVFERIRFLVSAGLRWNTTQMSYLTLPRELKSIETSDRYWYVLVINFEFYFFLLQFETNGFTLGRWNAFRITYPEALSKKDEERFELFCNILNDYNIAIENTTRFSVLDQTQERPPPIWRWIDFADLQGSKKIVSSVEELGDETYVHLPFPVRYQLEVCLSHNYLSEFTMSREFAVKLLNLGESEAVKLLEHVAIKEEVYHDPMKIFDLKFAKGSTRAKIPSYCCYMRSARITPTTIYYNTPSVVFTPGLEGNAL

SEQ ID NO: 36691 - protein, 66 aa, A.fumigatus
RLLSYMLVPASFIRSDRQYKTLLYSSSSHLSLSFYKIIFLKIAVSEQFIRHTKLRVQSITAHWYVS

SEQ ID NO: 36692 - protein, 101 aa, A.fumigatus
YYDQSVAMFRILESQAPAKQTATDTINTLSSRLQSATLLEDRRAAIQGLRSFSKLYPASVASGALRPLINSLRNDREDVDTIKVVLETLLMLFSPDESSVR

SEQ ID NO: 36693 - protein, 118 aa, A.fumigatus
LMRRKRQDNITALLDLLDTRDFYSRLYSLQLMFQISSARPERTQECILTAPLGIPRLVGALGDSREPIRNGKLHRVWIFYNARVTHRTCAFYRSITFTHCIDTCLGGISETRCLRKCL

SEQ ID NO: 36694 - protein, 675 aa, A.fumigatus
ALATCADLIRGNSSLQERFGDIEVFWGRQPSQDGVVNGDKVANGVQRVNVIEALLKLSLEPAPIQVLDARLAASECIKAFFANHPGIRVHVLRRAIDGHLSGQDQIPNIMTVLLVPPDARGNSDPYQVWIASVLMFHLLFEDAEAKAIAMQVTEGDAESGEEVITCIQTILGNLITGMKRGDDERITVGYLMLLCGWLFEEPDAVNDFLGEGSSVQSLLQETKHRGVSNVIMPGLTTILLGIIYEFSTKDSPIPRATLHKLLLDQLGREQYIDKITRFRESPMVRDFEVLPQTVGGQFDAGLPDIFFDRTFIDFIKDNFSRLIRAIDREPGLEISVITNGIQRGVSRELVDSLRAELDERSQAVQKLESDLLNLRNQLEQEQLEHRKFKDLSISEASKIRQINESLQRNHEQELARLEEQHNYAKNELLKQHGDQLRAIDNQLKETSAEYERRSQKVKKLHDTEVADLQKKLQSLELELTRVREQSADEIGGLQSTIQTMRSEADQSKGQHWAQVAELESTIQSLRSELDENKANHADQVSNLSDTIRRLQSELDKAKEGHEAELADLRAKAQTVQSELDTAKQEHETEISGLRVKAQSLQSELDSRTERSKEDLQAVHDDYLSKLSELEKRVKLAESKAEKAEADALKSAETLKEVQAQLGKTKAEVDEKDEAR

SEQ ID NO: 36695 - protein, 187 aa, A.fumigatus
LIVRARFTEALLLLIALTPASEEFQKLVAFENAFDVILSLIENEGGLIHGLEVVEDCLSLLANLLRLNISNQSYFRETGCVRRLAKLLADVNKDEDPAEDIPHWTHGQRDKNIWGLLVIIQLFLTKGGINTPANQMALWNNGVMEQILSAAFGQKFNVNVTSKVCAFEFSRYDSSVDLSRRWLHAPI

SEQ ID NO: 36696 - protein, 75 aa, A.fumigatus
ATNFVCTLFPDAGKLQFQRLEFLLKISDFRIVQLFDFLASPLIFSGGFLELVVDSSKLIAMLFQQFVLGIIVLFF

SEQ ID NO: 36697 - protein, 178 aa, A.fumigatus
DRRNPHLVRIGISSSIRRHEQNSHDIRNLILPAEMSINRSPQHVDANSRMICKECLDALACGQPGIKYLYWGWFKTQFKQCFDYVYTLNTVRDFVPIDNAILTGLSTPKDLNIPESLLQRRVSADQIGACSQRLDRSTDESYLENSKAQTLDVTLTLNFWPKAALNICSITPLFHKAI

SEQ ID NO: 36698 - protein, 109 aa, A.fumigatus
STVAIMGVPALFRWLSNKYPKIISPVIEELPYEVNGEEIPVDITKPNPNGEEMDNLYLDMNGIVHPCTHPEGKPPPANEQEMMVEIFKYTDRVVNMVRPRKLLMIAVGM

SEQ ID NO: 36699 - protein, 97 aa, A.fumigatus
AALLVTVLILLVIIIITRVVGRVSTQPVLDILEILVVLKITDILHLTNALFLFILNLFTVVEILIPLTLTCALQTAQDLFPDPLLNIKRPVTVRAAP

SEQ ID NO: 36700 - protein, 149 aa, A.fumigatus
SLESSAESPPNQSSISSRSSSSSRSLTYSTSPTPSSSSSSISSPSSRSSSRSPSPVRSRPRRTFFQIPSSTLSGRSPYAPLRNRSISSRSIARSTLAADSALRSLVSSLRRILGASFGTIFSPSRSSSLAIFRIRIATCVSRVRRCLHL

SEQ ID NO: 36701 - protein, 314 aa, A.fumigatus
IYARTNPARSRTTKGQNFCRNEYNVSGLCNRQSCPLANSRYATVRSDPETGVMYLYMKTIERAHMPSKLWERIRLSSNYAKALEQLDERLIYWPKFLIHKCKQRLTRLTQVAIRMRKIAKEEERLGEKIVPKLAPKIRRREETRERKAESAAKVERAIERELIERLRSGAYGDRPLNVEEGIWKKVLRGLERTGEGERDEDLDDGEEIEDEEEEGVGEVEYVSDLEDDEDLEDIEDWLGGDSADDSSDYDDDEEDEDSDEESGSEEASSDEETKKPKPGAKRKRAAPQVKPRKRGPRVEIEYETEGAGKESILA

SEQ ID NO: 36702 - protein, 87 aa, A.fumigatus
  UNSURE (3),(4): Identity of amino acid sequences at the above locations are unknown.
GGXXYSLHCPSAPGEDGYGAVNGFPAAPNSFSDSFNADAAIEELDNIRLREITGKAISGSLLLMLKWFKRSRKLQVRGLCDMVSNRL

SEQ ID NO: 36703 - protein, 296 aa, A.fumigatus
RTRVGARQILITVKSLTLSSFFHFCHVHSDQPPNSADNSEEDSSPSDDEAVPPPILRHRRDTDPGTSSVRPPSPQEALPELVEGAHRPEVDELGFPTAPPPKEPITVFSFRNFFSAINYLHIMQKITRDKAHRCLLLVQYKSSTILRKGLKIPDPHLRFYTLKLFKSQVPYCGRKWRQSNMRVITAIYLYCRPELRDDWLAGSDIDAEVEEALPLEQALRGLTHWWHLRRYKDVMGGGEGASMMEEERDFFVRELEAMGWGFAGEEMMNEEAEMAANGVMMNGTEWDGGPLQMEGW

SEQ ID NO: 36704 - protein, 64 aa, A.fumigatus
LISFLPSGSVRLANPLFGIQVHQIQSGQVIVDLCSVVKELVENSLDAGATSIGRIIENHQRYAR

SEQ ID NO: 36705 - protein, 104 aa, A.fumigatus
SVDMLILVLDIEVRFKNNGLDSIEVQDNGSGISPENYENVGKLSFGEYSKSDLEVLLTFGSSETLHIETLVLRGSLPLTHFRFPRRSTLVLMRSSRFPHRHGPS

SEQ ID NO: 36706 - protein, 432 aa, A.fumigatus
RSVSRTTGWTRSRYKTMEAEYHQRTTRTSVSFPLVNIPNLILKFCLPLVALKHYTSKLSSYEDLSRLHTFGFRGEALSSLCALADFRIVTAQANQAPKATKLEFETSGKLSKTQIVAGQKGTTASVEGLFKKLPVRRRELEKNIKREYGKVLNLLHAYACISTGVRFSVRNTVGKNRNVMVFSTNGNQTTKENIANVYGAKTLLALIPLDLTLEFEPSAAGRRTAEGELHTIQVKGHISRPVFGEGRQTPDRQMFFVNSRPCGLPQIAKAFNEVYKSFNVSQSPFVFADLHMDTNAYDVNVSPDKRTILLHDAGALIDSLKQSLTEMFEATDQTVPLSQIADYKQSGPKQQLGTLQAVAPRRVLSEKEAITGEQGHSPDKEDTESSQLSSQEKLKSFLSNLGSRQGRATPSSSPVRRGGVGATGLDCNAEYP

SEQ ID NO: 36707 - protein, 337 aa, A.fumigatus
ATLVHDRDERLHPRLLSAEEESEQLDSTATPSTPDGRAESLTKTVDNELFVSEGGTPSPETSQLPKVTDEEQESPRDAVEQSTPRGGSELYGHHTPSTQPDLLEETPNVIQNAFDRMRPRRMPAEVATITIGNKTITSMVGSGMPRKRTGDSIQTAGGRSVRKRRIHTPSRSNIFGKHMRAFAAPGSQIQQASSVEAEEEDEDEEERAEDEEIMDSVSEDGSRSSCPSDKHDDRSAEVSDDEVNESGATAAEMMNDEEKKKHEEAEVQRLIRQAEEKAVLPQENSIHRANKLNKGAGHRDSTTHLMSTVDGSLPKIESQMKKVQHSLRSYRKDVDNS

SEQ ID NO: 36708 - protein, 284 aa, A.fumigatus
  UNSURE (27): Identity of amino acid sequences at the above locations are unknown.
SRSPSPPAGRHDDDSASRQSYDDRPPXRLTNATDPTAPLTGTGLGTAVLATGYSDDFDHALTPQTDRHHSRDYDDHEQGHHRRRRRSRRSSRRRTESDSDGYTSDEDLKNYHREPSARRQPGGSDSSSGGRKDPGSQYLTVEKAHRRRSSRSRRHGENGSLRNETSGRESASSQEDLKKSKDPDAPPKGILKPPRDKFPEEPNPVREGVAPLKDAHKKGIPPGARWTKIDRRLVNPAALEAGNERYEERPDYVIVLRVLTKEEIQRYAARTQEIRGMCCSSTWY

SEQ ID NO: 36709 - protein, 84 aa, A.fumigatus
SPRKNRMYLVRNRFFNVSLCPALNLTNTSPPKANITSRLTELRLPEGYLGPHDSFRKPAISESIQNSSREPAQGWLHHATGQLY

SEQ ID NO: 36710 - protein, 1051 aa, A.fumigatus
SFSLAPNVTNIMITPHKDDSRFRIQNYSSVNPDALRRVREDPKMCSAIDFGRMCVTVGLSFNKESQVWTIPDNRLNPLPISEEAGPSRIWNDFTFQEIGKADEFVDIEAIIENDPSKPQTLISGIAPPHPFLTADKVKQVNQWVVERAEMQPTEHEPEPEPEPELESDFEPQPEYEGRDIHQLKLKRETAIIPQSKRPPGMKTRKAAITAKVAPPSEQSLATETKPVAIGLKETTANPRKRWTMLYSSGAEDASPDDSDALNSGISNLNDTLELPGDFLEFAKPQTSENKVRLPGNFDAGKYGLNQSSRQTSKEGKHSPSFKKIVQVKSKKNSGDPNELIDVFEPGNNTVVGTLSRIPFNQPPLIPDSLVNESTSNTRKMCLQETSDSNSKNTKNGLLSCGMGDHSTPSGSGSTESMFGRAAAGDENHQEQENRLSFLKNFLQERTDNISYHGGYGQTHTSRYEFNKLLVKESLAKLETVHRDQDRQGSDETSTREFYRTMGHKTAKPTNKAKSKSEIKSKRQATLEDAWGFFKKPVKKPSAVAQTLKTTRQSIQESERETVHMASRKNELAAEPAENSMARDVENLFEALKQTLEAAEYFQGSLNLEVHLGLILIPLLPKTCSEGSTIYLTEWTKIFQSQTGIPSPTTRFISRLTTSGIDIDYLVDLKTATPEGKRRIFEQDFREYSVFYEFHCHTRTGQVLVLSVDEQGKFNIKNPNFGLGAVNLHFPHQVWDASIVLSGTPNDAAVDQEFEEAAKYIIEHLWVRPDTSLVQIFTRLPPGDKITIEKVYMKRWTRHRFIHPPKSIIAANGASHIRSNSARIVETDLNSNSADRRQTSAETEAETMENQDIFLQVMEVQDLCIGSSPSDVRAVTACCVSLPEMMGSGRQWYEASLVSSAIEAILRTNANLEIGERTDEWRSSDLLGRDAVLLDGNAAKPDGPNTPLSPVAKAIGIAGLGDLLRLTKTVVEEMDGVGFWGHGLDHDSVQAPSITGSVGTLDQMVRLEPRSLDFDDFESIKKFGSVMATTLTKKSSGGSSAKDKEQLEIDYW

SEQ ID NO: 36711 - protein, 803 aa, A.fumigatus
  UNSURE (18): Identity of amino acid sequences at the above locations are unknown.
GHKVLNPGGKNKRTGLGXEITPKAPCLFPLGAEEEHGGLFSTEERPRARKKGILEKGLTSNSREFCLATERAVQRSAGNKENYALEHIIEVANKNPEICVVLDGQGHMSAWALEDVGSKAKSNMAAFNILHVENIDFSFMSALSAEEDYAQLCAFQTIPLGDSISIIVHHFDGRIEWFESQVDVLFDPTPRKNRIALKASWTGHTDPIKKIVRNAAGDTLVSRTNENKATIWKQRWRHGRSVLVRKSWLYSDEHIHRSCVIESGDFLVNLHHYGISVWDVRSFHARKIASQSFELSSKPLCVLPLPTADKSGNAVYIATIGADMNGIAWEIRLPTGKSRINGVSPAAQCSLRKFCTFNLGLDEDMSYILPVDPAGPQKTVSGFFDLFSPDIALSYTTRGVIHTWTAKVDQQSSQVEFLLTSTVDTGIENPSLASGSSTKKAALVDADRTHLTIWDTNGAQLEFEEHFAQHDVIRDLDWTSTPDKQSVLAIGFPHKVILLSQLRYDYLDARPSWTQIREIWIRDLTPHPIGDSCWLSNGHLGIGAGNQLFVYDNEIDASDRLVSQLRIPSRGLSSVDLFEVVSRLNGPLPVFHPQFLAQCILSGKTNVVHSVLTTLHRKLKFYTEGDDIDGFLERPLEDFYVEHDIPQQASSKHLQASYADLDLSETSNVMDENAAAALNENLSRFAFPQLSSHEQFRLVDTIECVATVEKHRRSMDDNAARYLLFFRQHMLRRSQGVANKDTVSWREIVWAFHSGSQDILSDLVSRQYGGKMQWASARESGIFMWLTDFNAIVSNPRRHRLQG

SEQ ID NO: 36712 - protein, 103 aa, A.fumigatus
RANTEQRAQLELVARNEYTKTEDKNPVDCSLFYIALKKKNILQGLWRMANWHREQGATQRLLANDFQEPRWKTVALKNAYALLGKRRFGMVFLHTPRIEVSLL

SEQ ID NO: 36713 - protein, 93 aa, A.fumigatus
AFSDIFPEYAAAFFLLADQLRDAANVCLNKVGDLQLAIAITRAYEGDNGPILREILEERVLPEAASDGNRWMASWAFWMLGRRDMAVRSLIVR

SEQ ID NO: 36714 - protein, 136 aa, A.fumigatus
SPVETLIPSTPSSPGSPGSISLQAKSFLSNDPALVVLYKQLREKTLQTLKGASQVSARAEWDFIIRNARLYDRMGCDLLALDLVRHWEFLSVPPPPKTLKDVTHKLQENGVDYRKMLRRRSRSCGRRYSHSGWRSK

SEQ ID NO: 36715 - protein, 130 aa, A.fumigatus
LDYESAIRHQDEPGVLRSRDYFNTLIKEQIDKGIKPSRIVLGGFSQGAAISVFTGITCKEKLGGVFGLSSYLVLSDKLKNYIPENWPNKKTPFFLAHGLEDEIVLFDFGDLSAKKMKEIGLEDVTFKSYP

SEQ ID NO: 36716 - protein, 217 aa, A.fumigatus
QSSTGGITQELEIKGHKFVFVNGRLNSPPEAGPYTMTRISICYNSSPLTQITEIEGILDGPFYCHYPRDIYPGEDLARAFEYTLNIIEKQGPFDGVMGFSQGAALACALIAHHAKTNSKPLFKVAVFICGATPYESSGLKELVAEDGKYPVTIPTTHIVGRQDPYYKGSMHLYGICDPSKAVFYDHGSKHHIPFDQANTAAMVSAIEKSLNRALNNE

SEQ ID NO: 36717 - protein, 207 aa, A.fumigatus
LGEWICSLAHKGCLVKEVSHSPRRLDICIAFNSALGSSLPSGASSEIVSAFDLDKDHVPLVLLNSVYLAGFAVGPLVFGPLSEYLGRQPVLIGTYIGYTIFTMACALAPTYASLPAFRSLCGIHAAAPKAVLGGLYSDIYDEHGERGTAMGFFMLMRTLGPQLSPIISGYAALLSWRRVFRVALVIAGGGMPVVLLLPETYGPVLVN

SEQ ID NO: 36718 - protein, 316 aa, A.fumigatus
MIEASCLFSPLLLLISSAISNNLMMKCLDPRVTLLSKNLFRANSYAMHSTTPVERNPSSTLRDRVHILGLGSIGTFVAHSVSEIPNGPSVILLLHRRSLLDHYRQNRNQIFFESRHGVHQSSTGYGLEMTQDNQWYPVSDESPSDCPITSHISNLIICVKATQTVSALRPLVHRLNSTSNILFLQNGSGMIEEVDAHLFQDPLTRPNYLIGVISHGVTLNSPFNITHTGFSATSIGPVPRDDGRYAAISDLRSNYLLQTLPLSPTLNLKSYPYTEILQVQLEKLAVNAFCNPLCALNDAKNEFLFQRPRHATGYPD

SEQ ID NO: 36719 - protein, 146 aa, A.fumigatus
NRTLTPKYCKCNSRNSQSMLSATRYARSMMPKMSFSFSVPDTRRAILTEISNVVLALPELKGVQGLEERFSVARLEKTVNDIIAKTANTTCSMVWDLRAGRETAIQFINGSWSRMGKMVGVDTPVNDALVEQIQMRGRENLEMSDQ

SEQ ID NO: 36720 - protein, 118 aa, A.fumigatus
PSLYRMVVSLFWLGWASLSVVNPIVPMVAGFFFAIGFLFFIAMLNYLTDAYQQNSASAQAAASTIRSITACSLPLATKSMYGNLGIHWANFAVGICCLGDGGDSVHFRQIWRIVKAEE

SEQ ID NO: 36721 - protein, 67 aa, A.fumigatus
FFPPYCSSNHSVDTHDNLYVILGDKNSFTLQTRSSSTISSPLISYLIATREFPFPTRTLHITVLFPA

SEQ ID NO: 36722 - protein, 62 aa, A.fumigatus
SACYRDNTERGYFTPHKTGINSFLLIVPQTILLTPMTTYMLFWEIKTLSHFKPAHPLPFPLP

SEQ ID NO: 36723 - protein, 191 aa, A.fumigatus
SPESVKLFCNPANHFQVDDEVGFIRFYHSLSSDGNDETIRVFDRGDWYSAHGAEAEFIARTVYKTTSVLRNLGRSETGGLPSVTMSVTVFRNFLREALFKLNKRVEIWGSNGAGRGQWKLMKQASPGNLQDVEEELGSVGGLAMESAPVILAVKISAKASEARGVGVCLRGCDCPGTGRKRVPGQRCLFEL

SEQ ID NO: 36724 - protein, 525 aa, A.fumigatus
PSAISIVSLARPIHRAIFNVKTPHLPLVVVYYFAYLPYLPINHICSYLTIISFNPTISTKETAMPRTSRQTRLPRGQVGIQSFARATKPSCSTLQDTKKPAAAQLPVSPSKKRKLNELENVDCATGEPRQTTIPEEAGTPSKTLRFSQLCVSTPRSGHYACSKTEASPAPAPPSSPSKRGGARVKRSNSLIVVERPACVEEFLSLHSAFLKALAIHSAHNGATTAADLREFLQAVERMWKKRKVVVKDLQRLIWAWEQGDEGNGPRYRLANYGLGKVCLERAPVNRERLDRFDEKELQDRFERVVDLLWEKAVDAADGDESQVDFFETLGVSPVHESLTPFTTFRKGQQRLQDLKGGVIKLKTEKLRADSQPETPAKPLDATTTRRKGLLERIKSKELLQSKLPPPPSKETLLRRAAAERAEEVVAVLALLRPVGYVGSGPKAVLAAQKKPFQLEMIVQNVQDSLRNPISSREVEMCVELLARPDIAGQWIEVVAVNQIKSVVLKSCASVYPKEIGAKVSKLELD

SEQ ID NO: 36725 - protein, 68 aa, A.fumigatus
MMVLHMTLRSLSFWMFCVVFDTTGANLHVRHYFALSGSIMYISAAFITYIYILKSTTIMENINSGQNC

SEQ ID NO: 36726 - protein, 106 aa, A.fumigatus
  UNSURE (53),(58),(62),(70),(72),(79),(91),(92),(95),(96),(101),(102),(104): Identity of amino acid sequences at the above locations are unknown.
RFQPRRLRREVSGCVYADATVRELGVSEFLDNDVYSNFESLIIQLGVKKCLVXMDTNXKDVXLGKILAIXDXCGIAISXKTVADFGGEGYXXGSXXAAQGXXVXRP

SEQ ID NO: 36727 - protein, 120 aa, A.fumigatus
  UNSURE (105): Identity of amino acid sequences at the above locations are unknown.
QNVMSLIDPSRTTTPRMRQPTIPTGLKLGSFSVFNASSGTALADVTPEDDSIHVYYDGSNDSILGKVDDSNSGWYDSAFSQSGMTGSQVAAIIWVLTAGWIYVCXSSSHNLCQRCRSISM

SEQ ID NO: 36728 - protein, 248 aa, A.fumigatus
LQCKSVVNKARTKPHLKVMCGFSRRFDESYRDVYDKISQGLIGKPSILRSQTCDKYDPSGFYVAYSAWSGGVFVDMSVHDIDLTLWFFGDDVVPKTISAYGITAVQPELKKFNDYDNAVGIVEFHNGKIAYYYCSRMMAHGQEDTTEIIGTEGKLSVNSNPQRNLVNFYHSGGITREAPSNFIGRFGPAFVTEANEFTAACLDNTPLPMKLSNAVKAVEIGAYLQEALVTGKQIHFDEIGRRVERAQI

SEQ ID NO: 36729 - protein, 149 aa, A.fumigatus
ILIPIYNIFPTCLQYFKPDNSTQPDIVDGMHLYSITPWLLTSLCTLVSPLYTDTGQRGRVIHQPALPPSYPLAVRNPYLSAWLPSHRVQILPYAEPQFWAGQDLGWSIMVRVDDQTYSLMGVKDPGNDVQPAVVQGAEYTATHSVFTAS

SEQ ID NO: 36730 - protein, 301 aa, A.fumigatus
VAWIYCSDRAVVLILKRSRVSAAPSSAGSKSCDTVDLGYQCSPATSHLWGQYSPFFSLEDELSVSSKLPKDCRITLVQVLSRHGARYPTSSKSKKYKKLVTAIQANATDFKGKFAFLKTYNYTLGADDLTPFGEQQLVNSGIKFYQRYKALARSVVPFIRASGSDRVIASGEKFIEGFQQAKLADPGATNRAAPAISVIIPESETFNNTLDHGVCTKFEASQLGDEVAANFTALFAPDIRARAEKHLPGVTLTDEDVVSLMDMCSFDTVARTSDASQLSPFCQLFTHNEWKKYNYLQSLGK

SEQ ID NO: 36731 - protein, 76 aa, A.fumigatus
YGYGAGNPLGPAQGIGFTNELIARLTRSPVQDHTSTNSTLVSNPATFPVERYHVRRLFTRQQHGFHLLCIGPVQRH

SEQ ID NO: 36732 - protein, 125 aa, A.fumigatus
  UNSURE (38): Identity of amino acid sequences at the above locations are unknown.
SPTRPPSPLNATMYVDFSHDNSMVSIFFALGLYNGTEXLSRTSVESAKELDGYSASWVVPFGARAYFETMQCKSEKEPLVRALINDRVVPLHGCDVDKLGRCKLNDFVKGLSWARSGGNWGECFS

SEQ ID NO: 36733 - protein, 199 aa, A.fumigatus
NGIHVFPCNDLLSTGALLRSNRAPISGGQYHWVSEFAPPSCQCILSYITGWVCVLGWHTGIAGCCYTVANMMVGVVAINYPDTYVYKPWHVTLLVIAVALVALLFNTLLAQELPLIEGIILVIHCFGFFGILIPLWVLSPRPTASEVSGPIQDRGGWGNNGLACLVGLVGSIYALIGAFKYPKTREVCHLLTISTIQRP

SEQ ID NO: 36734 - protein, 204 aa, A.fumigatus
WDDCGHHGHAVLRSHQQRCHHISPGLCFCTRQWASILEFLVNGRCFPQRVVDGVDDYSQVNPTFIVPLNALCMSLAIVSLLSLTNIGSSVAFNAIMSLGTAALHSSYIISIACVRLRRWHNQPLPPARWRMGRFTPFVDTVSILVLIIIWVFSFFPLTEKVDSTTMNWSVVIFGGVILLSLVYYQLHAKRVYKGPVTRVNMMAG

SEQ ID NO: 36735 - protein, 82 aa, A.fumigatus
  UNSURE (35): Identity of amino acid sequences at the above locations are unknown.
KYVHVTLLKWLVWLIYNDSVTSGGQCALDASDSLXSVGMTPALLLFGVTVGNHLQCVASRETHHQPKGASYHSEHRSILWHV

SEQ ID NO: 36736 - protein, 67 aa, A.fumigatus
DGRKHKHDPCKAQLDRMTSTIPFLSTIDCRENFCTMVVNQFCTDTCFLFSLFNMHNYNSRFFCLLVD

SEQ ID NO: 36737 - protein, 138 aa, A.fumigatus
CDELAEEIRDASRVLPLGRFWTLILNGCTGLVRIITIALCVGDIDHVVESQTGLALIQVFLNSTGSVRAASGMTVVIMAMQFCAAISNVATTSRQVYAFARDNGLPFSNFWSTVGVFLSEWWMALMTTRRLTRLSSSL

SEQ ID NO: 36738 - protein, 451 aa, A.fumigatus
  UNSURE (16): Identity of amino acid sequences at the above locations are unknown.
CDLRRPVCSRCIRFPXECRYDSSFVAVRSHCRKSSPVRGKPRNPSPAKRSVIPLRASLNPLACLTSPDSHFLMHHFVTQTIRVLFPLAPPVFGQTLVATAMETPHLLHALLAASCSHYARLVQKPSAHQLTVLKFTNLAVTGLRAALADPTETLRPETAMTAMVLCTNDVCNGNARTWKVHLSGVTQLLTALLARQKTADGDPDPFFLCLLKWFAALDILAGLSGTHEGCVNDGQYWNLTRNPNCGNGHVDEICGYSTQLMPLLARIGQLARRNVHEQSIFETYTEPSSALSEELTHDAQDLETRILSIANQVPSAATLAFHDQVLASELHNTHLAFIHSALLHLYRRVELLPKSHPKVRAQVTAILYNVQAIKPFSPANALILWPIFSAGCETDDLQGRQAIQTRMANMQTMGLGNFTRARDALARYWESGASSRWDVYFAQSGLELVLF

SEQ ID NO: 36739 - protein, 79 aa, A.fumigatus
ISGHLVLGASFAENFQSKKADDSTTSLEYEPHIPTPVRLFDKDSSRLGRTSQEANTAHRMTLILEKGYCSCTGRIILMS

SEQ ID NO: 36740 - protein, 308 aa, A.fumigatus
RRELRQTARPAALPEPLDAGQPSEAHPSRDRRRSLLESAVACQLRAQPLALFPLSGRPLRHHPGRHQQGLQYPRSPRHSQPTRTARPQILRKTGRLDGPATPRLPLHLTATSTRYSAPSRRRLYARTRLPRDRLLQRSHHHQPTLSQPFKPQVLQRILLPFRLPRRTQSKIYLPLNVHHYHYHQRTQLRAQRQQRQHQRHHKQQHHRQQPPHKPLRLLSPRRLHPHLHPPRDPRPRLAPPLLPLVEHPPLPSASYHRPFAGFGVVYPPSRDRRPRHRGRHPLHQEVPPLAACYGGGLCRESEGVHPLR

SEQ ID NO: 36741 - protein, 874 aa, A.fumigatus
SLSLDVSASAMEDFSDVYQSTELNPSAESNSVSFEPDQPVPNGLPSALHWQGLSLSPGTPQSGYYLYPNQYDRPAFPHQSSTSSSGRDGTAAGVGPGVAKVAIPRAAPYSIHSQRRRSARACEPCRQRKIKCDGNKPVCRQCHEHHVTCSYLEVKRVRDQKQLEILSHQVKAYESLLRDLEMEVDANAARRIRRTLKTSSRGDKEDGALSDSSSSSAGSLNAIDLVEEDLNRSHRTRASGYFGKNSEVSWMQKLEDEAENRSRMFDGNFETPGLEEQQHLQQKNDVSIATMSYHLDDLSIPLMDDVDPYDLPPKELADRFFAAYMESVHPGFEVIRKTIFATQYRQFFSQPSKPPRRWLAILNMTFALGCRYCLLLNDTANIGNDEDWDDLVYFNRARKLCLGETALFDHTDLQQIQVEILVALYLLTLGQINRASNFASMAFRSALSLGINLRFEDDRTHHASKEARSRLWWSIYVVEHLLTATTGRASCVSESLSAAPLPVPFEEENFDKPHALQLFQNPSMRASHLKLTLLETDEEAYSKAQWLASCEPSPSLFFHCLVDLCAITQAVINKVYSIQGLRDTASQLEQRVRKYSAKLDAWMAQLPPVYRFTSQPHPHDTLHLPDDGFMRERVCLAIAYYSARITISRPCLSRSNPKSSKESSSPSASPDAPNPKSTSRSMSTTTTTTNEPSCGPNDSSGNTSGTTNNNTTGSNRRTSLSASCLRAACTLISILPETPDPAWLLRFSPWWSILHYLVQATTALLLGLASSTPLPETAAPDTAAVIRCTKKSLRWLHAMGAVYAASRRAFILCDSFIRRIAPSLGVDVGDLPDVAQLPALSTPNPANATTPSFTFMPGGNGNGNGGEASDAAWG

SEQ ID NO: 36742 - protein, 227 aa, A.fumigatus
SSPFSRQTKKPTRKRSGLPAASPAPRSFSIVWSTFAPSPRPSSTRFTVSKVSATQPANSNSASANTPQNWTPGWPSYPPSTASPHSHIHTILCTFPTTALCANASASRSPTTALASPSADPVSAVQTPSPPKNPPPLPPPQTHPIQNLPPAQCPPLPLPPTNPAAGPTTAAATPAAPQTTTPPAATAAQASPPPVSAPPAPSSPSSPRPPTPPGSSASPPGGASSTT

SEQ ID NO: 36743 - protein, 150 aa, A.fumigatus
IHVHCLRRPDKESLEKIPCPRNCVFDSVGEALQCAHRERLFWGILRARVGFGDMGQNDLSVAFRTKGTAFKKRFAEENTATINISSCVNVVQSVGHAIKSFPKFLVENVFGVGSYSVSECHDFTFQVRVHCLCRSRSAFTFELPNIFRTK

SEQ ID NO: 36744 - protein, 817 aa, A.fumigatus
  UNSURE (642): Identity of amino acid sequences at the above locations are unknown.
NPSMGFVSTIDQEGLVSCGGPNSPCLEDGDYVTFTEVQGMKGLNNCDPRKITVKGPYTFSIGDVSGLGTYQGGGIFTQVKMPKFVDFEPFSEQLKKPELMVSDFAKFDRLQQLHIGVQALHKFAEAHDGQYPRPHNDDDAQEVIKIANELASSQEEKVELDEKIIRELSYQARGDLNPLAAFFGGVAAQEVLKAVSGKFNPIHQWLYLDSLESLPTSVTRSEESCKPLGTRYDGQIAVFGKEFQDKIANLTQFLVGAGAIGCETLKNWAMMGLGTGPKGKIFVTDMDQIERSNLNRQFLFRSKDVGKLKSECASAAAQAMNPDLKGKIVTLRDRVGPDTEHIFNEEFWEALDGVTNALDNVDARTYVDRRCVFFRKPLLESGTLGTKGNTQVILPHITESYSSSQDPPEKSFPMCTLKSFPNRIEHTIAWARDLFQTFFVGPPEAVNMYLSQPNYIEQTLKQAGNEKQTLEHLRDFLVTNKPTSFDDCIIWARQQFEAQYNNAIQQLLYNFPRDSKTSSGQPFWSGPKRAPTPLKFDSSNPTHLAFIVAGANLHAFNYGIKNPGVDKEYYRKVVDNMIIPEFVPRSGVKIQADENEPDPNAQQSSSLDDSQEIQRLVESLPPPESLGGFRLNPVEFQKDDDXNHHIDFITAASNLRADNYDMPQADRHKTKFIAGKIIPAIATTTALVTGLVALELYKIIDGKDDIEQYKNGFVNLALPFFGFSEPIASPKGKYLGKQGEVTIDRLWDRFELDDIPLQDFLKHFSDLGLEISMVSSGVSLLYASFYGPSKVKDRLPMKYVLPFTHRSRVSTNVICLG

SEQ ID NO: 36745 - protein, 97 aa, A.fumigatus
ALSHTMAEDTPADSRTEVGEAPVERAPSAVAKTAPVESAPEASKEQETEKVNGTQEKPSGKNFSVPLLCDLHSSPFFFFSFFGKGQGVAQFRFSSET

SEQ ID NO: 36746 - protein, 174 aa, A.fumigatus
ENFPCDVPGNKRVVSIMSGLSISMEWAANAKHSAWIPNTDLTPLDPASCRDVPEKGKSKQLLAAYAVAAEGHDLQYFKELLADHQRALQQELEEQEAQQAAKEAAKAEREAKKNKRKSMDIVDDLEDIDMEDAGEPKKPKSSKKRKKDAETDGEAEKVNYDSPILVVTFTLSSD

SEQ ID NO: 36747 - protein, 199 aa, A.fumigatus
LKRLVLFVRHRLQKGFISRDQPPKEEEMTTMSNYFTRLERVADDLEVSIIRATKINKVLKMIVKLNSIPRDEEFQFRRRAINILSKWKNVLDADTTTTPAEPKANGAHKEDSVETPAKTETEGEKEEEEIKAAKQDSAEPQDESMVDADAALEKAEAPEPAKEASEKEAHKIEEATGANVTEEKPAEEKAEEKAVEAAA

SEQ ID NO: 36748 - protein, 88 aa, A.fumigatus
PAKTPKTATKLKLTTPKTPTSETEKKATGASKSKQTASSKKAGKGGVSDEGEEDTGAAPKEPEKQVDQGEAKERKQKEGRVDLSENPS

SEQ ID NO: 36749 - protein, 75 aa, A.fumigatus
  UNSURE (67): Identity of amino acid sequences at the above locations are unknown.
LWLHCPSGEASVSEEKKESTDTSAEKSKAPAEAADAKEPEATAAAPAESEAQEAPPSSKKSGSSKRXSASGVPGT

SEQ ID NO: 36750 - protein, 81 aa, A.fumigatus
VLAFLLTFRLAGIPTDISYVPFPPPIDEWRLEYSKSLRTPFLTKGVLSLIIVSVYRMSIFHISQINDTGSSPGAGRKRVHR

SEQ ID NO: 36751 - protein, 154 aa, A.fumigatus
VFQSPLIDRRRKRHIGDISRNSSQTESEQECQNLSNRRIIVSVRGTKREISEGIRTTICAYVHAAASTAFSSAFSSAGFSSVTLAPVASSILWASFSEASLAGSGASAFSKAASASTIDSSCGSAESCLAALISSSSFSPSVSVFAGVSTLSSL

SEQ ID NO: 36752 - protein, 643 aa, A.fumigatus
VVDSDEDQNNSAQLLKPPTSRAKAGPRDPPNPVAQSLKLFPDTMPPRSSSKGAWRIPNNRIRGKNAPISAKFSDSQQIPATVASKRETDNVKNSIKGTSECQGDPQRSYHSGKASTTRPRKPCSEPAMSPIHPEFPRLKNTRRPASLPMGTIDSFPLPAPLRPLPSLPEQPPALSTVRHHNTPVIKAATRTNRDHSGAFPTTTSNNRSDAEHCHLNTQFALPQLSLVGDDLPASEQGKSVEEAPPNHPESSGKAEENQAERLHSLKFRDMMASRISLDEARKGDGINSPASPMSSGSDHELRIGYENEHLVRTSVQKEATPPAPLSPPLSPPPAPPLVKSAEQLPFSRRHVSSATAIMRASTERREPSLPASDRSATVHRSKRTRSIDVLHELVASEQHTSNRAGSPLPSSDDECMDKGTFMCELRQDSNRYQRKVASRKSSNHCLSRQRGPRKSSIPDQSGPLTPRRQRSRISEETLSSLLGSSSPYHSHDPRDRRDKAAHTLVLLEGRIEQLERQNRILQAALFAALDLGVKPNAEALLGGSTTSLSASANSSSAETSSPSSTQRASKLPGRAVANGRRSLMKKSLRRPESWIDSPGASLQSDYQSDDDVSVRDLEEMIEDIEFTCSSDKPGSDRVRIGRD

SEQ ID NO: 36753 - protein, 80 aa, A.fumigatus
HLAMSPKARVLLVGAGGIGTIAALNLERGGLAEVTCVLRSNYEAVRSRGIEIISCEHGHIKNWRPTAGLQSSLYGMVCRG

SEQ ID NO: 36754 - protein, 288 aa, A.fumigatus
  UNSURE (222),(283): Identity of amino acid sequences at the above locations are unknown.
RSTLVLNVIPRVCSEDHSTLFDYIVCTTKNIPGVTPSICETIAPAVRPGHTVIVLIQNGLNIEKPFLSRFPQNVILSGVSRCDAHEIAHGVIEQKEDDDLHIAAFHNPLLDQRTQQKAAERFVQIYGAGSKTNVRHEPNWERDRWSKLVYNAHLKPICALTGSIQEISRLRGVLSIAWLFLAMQEVVKIIQGCGGGTYLTISLRRRFVRIRWRGRLLIACKXTWKRYVHTYFSITLGLIISRAIYLSMKISSARWSAKLRNKVLPYLSCLFCTSSALLFNGGXPRREA

SEQ ID NO: 36755 - protein, 430 aa, A.fumigatus
SAISLYKCPFLGQTKYLQHHTEDQLNPKCPRQQIRPNLHPHLLQVPGDPKKSLTQNKAWIYGKKGFDKAWDALDKVGAPVNRLSNKLGSEAFWPMTLDKESEKAARILHSFCKEGVYVANDATVATREQTPDKKIDKPRGKPKVLQKIPAEVIRQAKGIAIFTAMRTGLWFSGAGGSGILVARLPETGEWSAPSGILLHTAGVGFLAGIDIYDCVMVINTYEALEAFTKVRVTLGSEISVAAGPVGMGGVLESEVHKRQAPIWSYVKSRGFYAGAQIDGTILIERNDENERFYGRKVTVKEIMAAHVRTENASVRMLMHTLHSAQGDKQFDQTPSGVAVPTGPSPSDFAPEDLADSNLMAQGALVTPAQTATETPATFNDRSVPVDGVQNEETVIAQMESMGFARIDIDRAMRAASFNPDRAVEYLLNVS

SEQ ID NO: 36756 - protein, 88 aa, A.fumigatus
SQRIEAMPRDSQHSHRVTHRIITHHWGKWVAHTLIIACLLSNVCLSYAAAGDVDGFIFLPGSHDRPSVYINVRSSDKQNIYNTIQKTN

SEQ ID NO: 36757 - protein, 128 aa, A.fumigatus
PVKLVSQLYSPENAGNPAEIKFIQERLQSLQKGPEAWLIANDLLSANSTDMRFFGALTFTVKINLDWYVTHWNVYGVQLSDIVAGRNSTSMMLKSFLVGWLATMLYLSTQASALSSFESWPQPWEPSS

SEQ ID NO: 36758 - protein, 92 aa, A.fumigatus
RNSVEGKASEEIVLGSDLLQLICGINFVKNSLFVNQLVFKPRKVFDQRGTVSDMAGPHTRKLYFILDSFSVGNRTPGLLHMLLASQAEAKCP

SEQ ID NO: 36759 - protein, 299 aa, A.fumigatus
  UNSURE (279): Identity of amino acid sequences at the above locations are unknown.
EEASKHHPLKFDYVQLRDDSIPYNPVFFAYAIITPTKAELYIDDDKITPEVVAHLGQDVVIKPYNSIFADAKALSEARRKEAGETASKFLLSNKASWALSLSLGGEEHVEETRSPIADAKAIKNEVELAGMRACHIRDGAALIEYFAWLENELVNKKTVLDEVDAADKLEQIRTKHDLFAGLSFDTISSTGPNGAVIHYKPEKGTCSIIDPDAIYLCDSGAQYLNGTTDVTRTFHFGKPTELEKKAFTLVLKGLNAIDTAVIPKGTSGFALDALAKQYXLERRTGYLHGTRQWCWLIPG

SEQ ID NO: 36760 - protein, 68 aa, A.fumigatus
LRDNPELTTIFIEFISGFSGSAGTAIVSMTKAALSTDGRYFNQASKQLDSNWELLKRGVENVPTWQEW

SEQ ID NO: 36761 - protein, 102 aa, A.fumigatus
NDIAGARSLEETLKRNGSSLVGISQNLVDLVWGKDRPAPPREKVRVHPDKFSGKTFQEKIADLRKELEKKKTAGFVICTATRPSSLKPTAVLMANKEPSYAG

SEQ ID NO: 36762 - protein, 69 aa, A.fumigatus
LIWECRDLAKFIASNRIACTIDRVNGIIETNRPDDKNKQYADLVKHGDALITKLQKYGQAVRLRGSERS

SEQ ID NO: 36763 - protein, 224 aa, A.fumigatus
RGSFDPRGEDLKAYKGLHLLTVRSYNLAAPLLLDSLSTFTSYELCSYSALVIYSVLAGSLSLKRVDFKAKVVDAPEIKAILGAGEDRLAALTGEISAGEGARDEEMKDASVSTATPGTATTAINLTTLGTGSGLQAETEAPIDFSPLANLVDSLYSGNYRTFFRALAAVEDNFLTQDRYLYEHRAWFVREMRLRAYQQLFQSYRVVGLNSMANAFGVTVDFLDR

SEQ ID NO: 36764 - protein, 168 aa, A.fumigatus
SRMITEPTMTVPYTTKRTASDLGPRRLRADNINPNVKAAKYAVRGELAVKAEEYRVRLAKGDKSLPFDSVIFANIGNPQQLDQKPITFFRQVLSLLENTALLEKPEVLRSSFGYNQDVIDRAKKLLADIQSVGAYSHSQGAPVIRESVAKFIEERDGFPANPQDLYLC

SEQ ID NO: 36765 - protein, 260 aa, A.fumigatus
  UNSURE (254): Identity of amino acid sequences at the above locations are unknown.
LLSICSVLTDWTTSSMISTNHPENMERKRRNGQLPSCEPCRKSKLGCDHTRPICNRCVRRGRTEECFYHPSPLTKPRQSNATVQSRNQVPGASYSIRDLSVSSTVSGSSAAHRPSALTKPRESKAAAIRKPRQKLTHRPSQNQSSPNANVSVNASVSPIGTHSVSVSVSASVSASPLTIGESHAWEKRPFANPGFLGLTSYSDNVTGYAAVLDHAMRPHGSGSSPSGSIAAAVDSRQVELGAQVLMLLDHLALXEELLEK

SEQ ID NO: 36766 - protein, 88 aa, A.fumigatus
FDLRRIPTTSHLSPDYITVTAQMATHADSVHPACKVVLSKNVANSLVAEVQEGVKTLEKPPHLVGFLANDDPAALMYAQWTDKTCQEK

SEQ ID NO: 36767 - protein, 93 aa, A.fumigatus
EMSPSHLVYLLYFLLLSLKWTHTDSSGGAAANHMAQQMASMNPGAGVNPLQPGQDPDKLYQSEAENLEVTEFFSILDGIEERVLHNYASKEIR

SEQ ID NO: 36768 - protein, 199 aa, A.fumigatus
  UNSURE (127),(139),(174): Identity of amino acid sequences at the above locations are unknown.
YSGFRYSLRQVSRDDIEDAILAANADSDVDGIIVYYPIFNNRQDQYLQQIVDVSKDVEGLSHRYIFNMYQNIRFLDPETKRQKCILPCTPLAIIKILEYLNIYNTILPYGNRLFGHTICVVNRSKVXGRPLAALVANDXACVYSVDITGVQKFTREGLKKRRHEVVDLGRKTFXDVAPLCECCHHGCSQRIVQVRHKPP

SEQ ID NO: 36769 - protein, 135 aa, A.fumigatus
CSVKILTGILRHYATVLMTTPPKPPATLAESKERLSLMRGVNLRNNAPAVLSREGFEMRKNYLISSYKSGAFLKDPSSRGQPPANPMTDPAGMEAMMGMMKGNMMMMIPQTLIMSWINAFFSGFVIRMVTSLQRS

SEQ ID NO: 36770 - protein, 106 aa, A.fumigatus
PRLCANGVGTVKLPFPLTIRFKSMLQSGVMTRDLDVRWVSSLSWYFLNLFGLQSVFGFILGSDNGERCPHHTLYIYYTSCYFPSSGHILILLGVQLPITWLSKWLV

SEQ ID NO: 36771 - protein, 83 aa, A.fumigatus
FWEHKLLIHKGEVSHLDEPMLMLTVSYFEPQQCEGYILLAYSYITQFDLVSCSLLPWAECGVCFIDKRAIFSVPKICQCPSVV

SEQ ID NO: 36772 - protein, 88 aa, A.fumigatus
PPCANVVITGVPSESYKFDTSLLREGAVCVNFSSEKVCFRYCLNAIWDSGELMYRTELRPRSKREGIHLRSFNRQGDYCGAAPEPLGE

SEQ ID NO: 36773 - protein, 66 aa, A.fumigatus
SCSSISPKLISIEIKAHNGNLRAQGAGLLHQRLVLYTPNSYIELYFGSSYRTRYANPLITVANNHI

SEQ ID NO: 36774 - protein, 90 aa, A.fumigatus
ISIRSSVKKHSPLYKLRVQYTSPSNKILQEKEIDAPFMNWFSADGTFHPEPLRRWLSTEIEVLRLAAKETERKTGGVGSVVGVQDTKNKK

SEQ ID NO: 36775 - protein, 105 aa, A.fumigatus
QPYLDLKSTTDDALVPYLCTLPQPYTFKQDHSKSNVRFLLGYSAVAIAAFTFYADRKLGWEATTSPWVIAAVCSYFILNTGLTFWIWAVEAGEVFRGKRESGETV

SEQ ID NO: 36776 - protein, 69 aa, A.fumigatus
LGLPTRLHAIRLELNNCLAHERFYDVYLDTILVHTLEYFLCSKTLGQGDTFVRVSHLDMFKKLDMKAFS

SEQ ID NO: 36777 - protein, 64 aa, A.fumigatus
VGIGSQNSIFDIVAGHLAQRITESTVSMNFYVSYAKVTQNDAMPCSEIAIEGVGKIRDRTAQLT

SEQ ID NO: 36778 - protein, 372 aa, A.fumigatus
RPSVADACACHVCARCKVSQSMLKQLRKLTNGRFSKNTVFNGVAPESRGKLYAGEAIRLFQERVNYPSLETVQGAVLLGHLVGGEGDAQAKQAYIGIARTHAEVLSLWAMPPNSTVVHREERRRTWLSIRIADPWTIIDMSVNSGASLQNLNVLPEVDDVAFHTYDPELLREVPVPSSSRCDMWAQMAGTLDIYTRISVLLTRLSRGVIAFDAYLSEVPLLKECLDGWVRGLPPTLAYSSKNLAFFAKQGLGRNFLAMHIVYHHFRQMLFFPSLDARAVRDAASTADGIAQCRKSANAISEIIDCSTKADDCQLDYFLYGHVAIVSSCVYMQILMLSEELSELSTARQRLVSNFEYLMGLKTHWPAIRQSVS

SEQ ID NO: 36779 - protein, 117 aa, A.fumigatus
DGVSKSSLRSSVSISPLSTHDPLAYACPPLSRRTDSSTRISSLTARLECYVVCLYHITLSPHHVTFRSRHYSATFFSITLYLTDTSSYLTLYIVHSLLLSALAYHIPTFLTCPYMST

SEQ ID NO: 36780 - protein, 69 aa, A.fumigatus
RGALSEFVRTDSAHLESNAARNTALRRRQLSNPPSNPPSGTLLLDTDKGHSTHHGFRPECAMLRQEEDG

SEQ ID NO: 36781 - protein, 96 aa, A.fumigatus
VYEPLLIVGADKFAGVDIRVRVSGGGHTSQIYAIRQAIAKSIVAYYQKYVDEHSKNQLKQAFVQYDRTLLVADNRRTEPKKFGGRGARARYQKSYR

SEQ ID NO: 36782 - protein, 140 aa, A.fumigatus
TRLAYSRTWHYIDVGSDPRSLGRLASSIALFLMGKHKPIYDPSTDCGDYVVAVGCSDLRTTGKKRFQKKYYTHTTRPGSLRSMTMDQMFEKWGGGEVLRRAVRGMLPKNRLRDKRLARLKSESLGLCCSNVLRKVRLLLT

SEQ ID NO: 36783 - protein, 70 aa, A.fumigatus
LYICCAILGPIYQRMGGSFVTYLFFSIPTILTYFLSSKLSSYMSATFVLFPPTSSHCSSLEPPYPPCSLG

SEQ ID NO: 36784 - protein, 216 aa, A.fumigatus
  UNSURE (4): Identity of amino acid sequences at the above locations are unknown.
KFSXYSSPENISPRPPFRILFGGRRVYLPLAVPGKGRYSRLKTNVLNQHGWVESCIAFNHSYTDSGIFVFSASCSLTRTTEMLEVMCRELQALTLDTGYSALQPQEVNRAKNQLRSSLLMNLESRMVELEDLGRQVQVHGHKVGVKEMCDRIEALTVDDLRRVARHVFGGHVQNKGQGTGIPTVVLQEGELEGYKLRPFPWEEIQERIARWKLGRR

SEQ ID NO: 36785 - protein, 111 aa, A.fumigatus
HFNLTLESEISVESDLDVEGETLYERVAALKDIVPPSTRRQISSTVSTLTSFTKSSISFSGKALWILSTSAFLLGVPWALAYAEEEQYVQMEREQGMIKGANEVCLRMFFF

SEQ ID NO: 36786 - protein, 616 aa, A.fumigatus
PSLAPRDYSQYAKTFISTFAPEILKGYLQEIDKWVSKGQWLSNPALAYTLIFLEECVKPKAMWEHLKPHMDNLIAHFIFPIMCQSDEDIELFETDPSEYLHRKLNFYEEVSAPDVAATNFLVALTKNRKKQTFAILTFVNSVVSKYESAPDDQKLPREKEGALRMIGSLASVILGKKSPIANQVEYFFVRHVFPEFRSPHGFLRARACDTLEKFEQLDFQDPNNLMIIYRNILESMTDPELPVRVEAALALQPLIRHDIIRTSMQQNIPQIMQQLLKLANEVDVDALANVMEDFVEVFSAELTPFAVALSEQLRDTYMRIVGELLERNAAKGEEDTYGDFLDDKSITALGVLQTIGTLILTLESTPDVLLHLETILMPVISITLENKLYDLYNEVFEIIDSCTFASKSISPTMWQAFELIHKTFKAGAELYLEDMLPALDNYVAYGSEMLVQNPAYLAAVVGMVEDIFRDEKVGGVDRICGCKLAETVMLNLRGYIDQYIPLFIELPMRVIEAGEARTKSYRLHLMEMVINAIYYNPVLSLQVLESKGWTNKFFSTWFSNIDNFRRVHDKKLSIAAISSLLTLKAGDVPASVQQGWPRLLQGVTRLFQTLPAAIKS

SEQ ID NO: 36787 - protein, 62 aa, A.fumigatus
ENHINRILQAQKFGSFADDDDDELDEESLLETPLDKIEPYGMFKHVFMGMLTSANVVWCVLA

SEQ ID NO: 36788 - protein, 70 aa, A.fumigatus
EHIRGALESQYERSDGLQYTQSSDALIVQKVSICVLFALGSISLQQFTNDTHVRITELFAESHSKRRQFS

SEQ ID NO: 36789 - protein, 65 aa, A.fumigatus
GVLGPMFGRMQIYLPRCYCLTSLVKVVSTGGLSDITIGNLRLDMTYESINMGMMGANGNSAMTEI

SEQ ID NO: 36790 - protein, 837 aa, A.fumigatus
RQEHRLQSTMRAKRDLRTQCRNEKERAQSQLEFRVANPHCFAQPAHRFRPKVSFTSSSPSKAQLQKEEAKHQKQNIDASAKANRSLLMRINSGGVEDEHKDKLKREVRRNTVFIPPDDTTIASVFMSLFSPLKSDNLDHYVPEDTEINSLESQIVRKRQAKTTMASGRKTPLQPSLKVVQRSAMNIDIAGKITGKENIPPGEMIFSSNDKGLWKSNTEDKFLNSESPRILSDKARPFANPVTERLAKVATNQGLRRSVPGEKRYNARASVNGIGSKMDGIVRSRSRLEGAAVLSASRKTPLSNAFEQSKTYKMNASLVKKETAMTDFALISDDIVSPAMYEDRWLVHQEIVITQLINRLFDRTNGQVRYDDPAARRHELLQLYQSGPFVELHKRLQASLTYGSLGIPKDALTQTKRLKHDLGMKRKFLDIWLETYDLRALRAAAETVTGRRVENESLDGDSHHFSVETTADKEKILRRKLERFLDVFLVQNKDMDRDSQDLSHAGSDMISQAYRRTVLRSIMIVILLDKARLCPGTVLPSCLFRFSSSFKSSTAVIQALARLLLPASGDILRSLKHLDCHLSYEQHQLQEYEYQLSNLAVDLRDGVRLTRIVELLLYSSAGAVGGSVPPLDNDQWPLSRRLKFPCSSRTVKQFNVQIALDALRLAPDAAPLVRDVRAEDIVNGHREKTIALLWGLVSRWGLSELIDWDDMRKEIDRLRQKATSQLGYGQVNDANLFKEKSPKDGITDDNEAILLLKEWAIILAHLSGFQLENLSTSFADGRIYEAIVNEYEEYILGNVASSPGQKPTSLAARLRALGCSSQFGELISRLQPRATANR

SEQ ID NO: 36791 - protein, 94 aa, A.fumigatus
ARVAKVLRITIHIFILHQEDIQESFQFSSKDFFLICSRFNREMMRVSIEGLILNSSSGNRLGSCSQCSKVVRFQPNIQELPLHTQVMFQTLCLC

SEQ ID NO: 36792 - protein, 134 aa, A.fumigatus
  UNSURE (45): Identity of amino acid sequences at the above locations are unknown.
TDGGCDYTFDCTGNVGVMRAAMEACHKDWGESIIIGVAAAGQEIXTRRKCVPHHLVAMYSRSIAFQLVTDRVWKGCAFGGIKGRTQLPGLVDDYLNGKLKVDEFITHREPLSRINTAFEQMKQGDCIRCVVDMS

SEQ ID NO: 36793 - protein, 171 aa, A.fumigatus
KRDSHRCPSPYTNQPQTHQTKKQKQKRQNDPRNPPPRTLRLHPPLHAHPRPLPHPPPPQHLRRFAHHHLRPARGPQLRPRLRRLQNPQTRVSSRGRPRPKRHDPALHRRRPIQPHPSGRRRRRTRRSHRPSRAGALGRLERRPLRPGRQYPAVAADGRGRAAASSGVRHRA

SEQ ID NO: 36794 - protein, 385 aa, A.fumigatus
DTDLQYKRGTATAALHPIQINLKPTRQRNKSKSAKMTLEIPLPEPFASIPRYTLTLGPSPIHLLPNTSADLHTTIYAQREDLNSALVYGGYKTRKLEYLLADALAQNATTLLSIGGVQSNHTRQVAAAAAHAGLTARLVQEHWVDWNDAHYDRVGNIQLSRLMGADVRLHPAGFGIEHKESLRQLLGECEARGERAYYIPAGASDHPLGGLGFARWAFEVAMQEREMGVFFDVVVVCAVTGSTFAGMIAGFKLLERVQPGSRKRRVIGIDASARPAETRAQVMRIARSTAAKIGLKEEDISEEDVVLNANYHEGVYGVPGEGTIKAMEYAASKDAFITDPVYEGKSFAGLIDLAKKGEFAGKTVLYAHLGGQPALNAYSEIGRAK

SEQ ID NO: 36795 - protein, 330 aa, A.fumigatus
GDGRDEALAQYLLPRLHCCQSGRPCRQCHRGQQGFLGSRRAYPAGHTVSASSASCHRDANIVNSDFKAQNGLDKVIVMWTANTERYADIIPGVNDTADNLLNAIKAGHQEVAPSTVFAVACILENVPFINGSPQNTFVPGAIQLAEKHGAFIGGDDFKSGQTKMKSALVDFLINAGIKLTSIASYNHLGNNDGKNLSSQKQFRSKEISKSNVVDDMVAANHLLYKEGEHPDHTVVIKYMPAVGDNKRALDEYYAEIFMGGHQTISLFNICEDSLLASPLIIDLVVIAEMMTRITWKSADDEEYKGFHSVLSVLSYMLKVFNLLSFLGHID

SEQ ID NO: 36796 - protein, 383 aa, A.fumigatus
TSKSCSRFERDLMAVIHSTYVPDQYTLKSLRSVPMLLRPTNLAIRIQSRLTPKMGVKHRLPRKLALLRQIDQPREALPFVHRVRNERIFAGGILHSLDGPLARHPVNPLMVIRIQNHILLGDILLLQTNLRSCTPRNPHHLRPRLRRPRGRINPDNPPFSTTRLHPLQQLKPSNHARKRTPRHRTHHHHIEEHPHLALLHRHLKRPPRKPQPAERMVRRTRRDVVRALAARLALAQQLAQTLFMLDAEPRWMQPHVRAHQPRQLDIAYPVVMGVVPVDPVLLHETGGETGVCGGGGDLTGVVGLDAADGEQGRGVLGEGVREKILEFAGFVASVDEGGVEVLALGVDGGVQIGGGVGEEVDGGGAEGERVAGDGGEGFWEGDF

SEQ ID NO: 36797 - protein, 277 aa, A.fumigatus
HTVFVGVTTRSTAGAHPLVVGHRIFHSTSNKSLDLSAISDAMAPHATSDAVANGAVNGSARTTTAPLFTVNSPNVEYTDNEIKSRYAYHTTDITRTAEGKMVATPKVTNYQFKVDRKVGKVGMMLVGWGGNNGSTVTAGILANRRRLVWETREGERAANYYGSLVMSSTVKLGTDSKTGEEINIPFHDMLPMIHPNDLVIGGWDISSMNLADAMDRAQVLEPTLKQLVRKEMAEMKPLPSIYYPDFIAANQEDRADNVIEGNKASWAHVERIQQDIR

SEQ ID NO: 36798 - protein, 103 aa, A.fumigatus
DRPAAAKVSGGSVQRSCWRDGGADHGENPERPRGKSLQPFSLILALVLTCCDQIMSILQDPVMQSILQQAKSDPAALQEHMKNVQVRTKIQKLMAAGVIRLGR

SEQ ID NO: 36799 - protein, 360 aa, A.fumigatus
RQRATRPSLLRTTLLLCTYYVSMLPRSFQRGCTGFTRKKTNLFVPRNSEKFTQAIELEPSNHILYSNRSAVYAAQSDYQKALDDANKAIEIKPDWSKGYSRKGAACRGLGDLLGAHDAYEEALKLDPSNDQAKSGLNAVKRAIDGEARADGVNPAAGLGGIFNDPQMFQKLASNPKTSHLLADADFMAKLQRLQQNPNSMSPQEIQDPRFLQVMSVLLGIDMSFGAPPEAAGSSRAAAEAEEDVPMPDAKPAAAEKKKEPEPAPQPEPEPEDEETIAKKKAQEAGDAEKKIGNDFYKKKQFDEAIEHYTKAWELNKDITYLNNIGAAKFEKGDLQGAIEICQKAVEEGRELRADFKVIAK

SEQ ID NO: 36800 - protein, 223 aa, A.fumigatus
VLQTSSFRLTQLTMCLQRAFARIGTAYEKLGDFTQAIEYYHKSLTEHRTPDALTKLRNAEKAKVKAEKEAYIDPVEAEKARELGQKKFQEADWPGAVEAFTEMTKRAPHDPRGFSNRAAALIKLMAFPQAVQDCDEAIRRDPKFIRAYIRKSQALVAMKEYSKALDACTEAAEQDDGTHTREIDQQQQKCLEAQFSARAGETEEQTMERIQNDPEVSHFSLFH

SEQ ID NO: 36801 - protein, 149 aa, A.fumigatus
VPFISLGFSGAGSMSQQAEPKITADPEVQQSPIYNGQGTEEDPFIVEFQKDDPGNPWNWSQFRKWFITAIVTFSVFAITFTSSAYAASANELIADFSISTEVFTVGLSLFVLGFAIGPAVWGPLVSSILSEALNRPADSPFLFSESPSS

SEQ ID NO: 36802 - protein, 423 aa, A.fumigatus
PCLVRSELYGRQALWIVSHVAMVAFIGGSAGSHNVATLLVLRFFSGTFGGSPLVNSGGAIADIFPPAQRGLAMTLYCVAPFLGPILGPIVGGFVSENVGWRWVQGVCCIFIGGIGIIGVIFVPETYGPVLLIRRASRLSQAHGKVYISILEKNQGKKKPSEVFQRALIRPWVLLFREPIVLVASLYMAIIYGTVYMFMSAMPIVYNEQRGWSEGIGGLAFMGIAVGIIIGLAYAIYDNNRRYANLLLSNAATAESRLPPAIVGAVALPVGMFAFAWTNTPRIHWSVSIILSAPFGFGCVLVILPIVNYLIDAYTIYAASVLAAAAIFRSIVGAVFPLFTTQMYGSLGIHWASSLPAFLTVACMPFPFVMYRYGGALRMKCKYAFEAAGMMRRMQMQQVPAPAKEEEDSPSEWGTARFGLDGCQ

SEQ ID NO: 36803 - protein, 317 aa, A.fumigatus
  UNSURE (47): Identity of amino acid sequences at the above locations are unknown.
PWDIVNFKARLRSAVNQCFSQPYIQLGRRVVRVETDVVMLTHLILYXTTSVPSALYLYYHFTWTHGVLHWIMQSYYVGTYTLMMHQHIHMGGILAKRFWLVDSLFPYITNPLMGHTWNSYYYHHVKHHHVEGNGPDDLSSTVRYQRDELSDFLCYLGRFLFLVWFELPSYFFRKGQVLQGLKAASWEIGNYLFIYGMYRFVNAHATLFVFILPLFLLRLGLMIGNWGQHAFVDETDPNSDFRSSITLIDVPVRFPASYLTTAADNSRVIASASMMATTPLTISTPAVTGASTRWRFSSKKTATPASMRWSSAISTIS

SEQ ID NO: 36804 - protein, 230 aa, A.fumigatus
  UNSURE (21),(22): Identity of amino acid sequences at the above locations are unknown.
IITNHKPHGRLITSRSALGAXXRVCSAQRSCSGSLMKLEEGDFDHNGTNSSNRAAGNRTREPLAAKDSLRLRITDILRALSGRADPEGAPVQEPQAPVDPLSPFQVSMPFANVPDGFHDLDVLPILSNGLSPNFWQFLDFPPPPFDSHPKEVSLATQGDPPGAFGLGPSQFPDSYSSTPRTRMTHTSPSLQSESIGLGGGSDSATTPSSADAYVAAKFYYAMGDGTLAPM

SEQ ID NO: 36805 - protein, 65 aa, A.fumigatus
WLGLVIDHATACRGYAGVNSLILIYAVSFVIAAPHGYAAYNYWGKSRLAFLFTTELDGSALSVSN

SEQ ID NO: 36806 - protein, 68 aa, A.fumigatus
QIFERAMDTANEDLDLTYRDLAIREEQDLGHCVGGMEIRVVHRRGRLVEKTDGGQLAWDPVYAALGEG

SEQ ID NO: 36807 - protein, 330 aa, A.fumigatus
ASRPTKCHGGHERAREKNSFSGSACTNFAKTRHSTSSTTGANATSAKDQTAKRTSAARRRRSPTAKSACARSSQRRARALTSSTRSCWRGLGAARRGRRRCMIRVPGRMRCSRWRLSRGRSWYARDAVVEPQSELVPVGKRATDVYLEENLKGLIRMPDGTFAPNPEYQINQAAIDEAEAKKAEFESYVRKAEEHVEAVKRSCRHMCLGGKFVFVDLAGSEYYHDKRTVSTCRAKQTPQEQQEGRQINTDPLSLKEVIRAMAQKQSRIPFRSSPLTMVLREHFLTGEGDGGFSAMILTASPSSEQYTATIDTLKYGNLIGVAGEHGKGRK

SEQ ID NO: 36808 - protein, 227 aa, A.fumigatus
LKFKLIPCSSAPERAKKITSMQSIKVFVRWRPLAPSEANTPEIARTQHAHPTSNTSALSLTPPPAHKLSRPWKSESAFTRIFTASDNNKAVFEAVVAPTLPRVLNGQSCNFFAYGHSGSGKSHTIIGYDFEHPDEFGLCLSAARALYEHLDQRNATAGMNEPEKKIPSRAPHVRTSQKHGIRPPQRQVQMPHPRRTRRQNAPPRRDGDARRRQSPRAPDRHKGVLEL

SEQ ID NO: 36809 - protein, 163 aa, A.fumigatus
TSPRKKFLLGLRMYELRKNTAFDLLNDRCKCHIREGPDGKTHLRGETETLADGKVRVRPIVTKACSSFDEFHAQLLAGIGRRATGSSTVHDQSSRTHAVFEVEIVTRALLVCEGRGGGAAIGACSCWEARDGCLSGGEFEGVDPDAGWHVCAQSGVSDQPGGD

SEQ ID NO: 36810 - protein, 303 aa, A.fumigatus
RSCVDNAGVFWRQASRVRAFRTGQDHRGRHQQQANSRAWYVTLGCAAEVPLANSTVQVALLPLFPESPQLCSRSHCLRNLMVCPSSRHICPSDMTAEWQSLVFAQEIPYIVARLSSLVFMGEKVCRDKEWLHVSVNYTIDAFGAARELRLWPSVTQPLVHWFLPSTRRVRKHISVAKKIVQKEIEKRELIRQGKLLEYSPPKPNDALDWFREVAAGRPYDITKSQITLSLAAIHTTSNLLTNIMYDLIAYQEYIQPLRDEIVAVVKEEGCLKKTSLTKLKLMDSFIKETQRLNPVSISKRFAT

SEQ ID NO: 36811 - protein, 95 aa, A.fumigatus
SYPMPFLLGVVSNEDSRSFLIFVNTILISSSLNSLFHCTRTSLYLTAYTQYCLILDSPDSNFSSLLTCRLIQLIPVLHRLFLLKAHDYDQDGFRR

SEQ ID NO: 36812 - protein, 167 aa, A.fumigatus
PADSSNSFLSCTGFFSLRLTTTTKMDSGDEHITYSSEGLSETLMELSISHNTEAKLAIREYYRKQDHGQKDSWLQKPEIPTPEEILPSSSDEDCVELMPNRIDGPWTSKDSYLRAHYELLREDAVAPLRDAVAYFRNDPQMVDSQAVSIYEKVSQFSFLLHILRKVE

SEQ ID NO: 36813 - protein, 497 aa, A.fumigatus
SRVRFPLADHICGLDPDVNAPDYVKEFPTMDIESVTTDEEKKINLLEGWPESPTGDLDQSQWAALKHILTKKLAIIQGPPGTGKTHVSVVALKVLLSNMHPHDPPIIVSSQTNHALDQLLRHISVFEKDYIRLGGRSNDPEIKKRTLFAIRQNEPAITVQGGMYGPAMRKHKTLVAAIVELLEAFSQADDGTPLSSKLFAKHGLLSAEQCDSLAKGAKGWVRPGAEEDTDPLIAWLGDQVVKFQVTYTTENFGFDEDEVDLEYEQLKELEAEQGIEEDEYENLRGQFIFLREAMCGLVPSSVPEAANLDHLGHSDMWKVPLKARGVVYDALRRQLKMMLLEQFRKLVAAYTKNCEDLRIGKWERDHLILRKARIIGMTATGLSKYRALISSVKPKTILIEEAAEVIEAPIAVACLDSLQHMILVGDHQQLKGQCAVQDLEGEPFHLDVSMFERLVKNKIGYVTLRRQRRMVPEIRRLLEPIYGELQDHQSVFRRPKV

SEQ ID NO: 36814 - protein, 408 aa, A.fumigatus
QIQYEAFWADPSDVPILWVGLLFGMICLACLASDPPDGTEVEQQSLQVNLYREKIVQCLVMGEYTKCGPYALETVINYVYVEFCISVDADKDIWFLLALEVNLARRMGYHRDPCHFPGISPFRGEMRRRLWATVLMSDILISNQMGMPRMISDWQYDTAEPRNLNDADFDEDTVELPQSRPETEHTTALGIIARRRMLKALGMIADLTSAVQPCSYAEVMRVDKLFHEAAASIPPPLQMKPMAASVTDSPQVIMARLFIRHMFYKGQVMLHRRFLYMRSPSQNEDIYEYSRKACLDASLEALAIQHILDEETCPGGQLHTMRWRVTSIMNHQFLTATMILCSLLYHEQTLQREDEIRGALQRARTVWMRRSSTSKEAKKATEAINIVLSRTGKDQEGDVSSRREKDTR

SEQ ID NO: 36815 - protein, 229 aa, A.fumigatus
SEADFSIFCRSKCDRQKPCSFCSARGQVCTYAENHPTTGSPKPSPTAVPTLHDRLVQLERLVTSMMPKSSNEKPNASSSAEVCMPPVPSRITPAETMPINTPVDGRSESGSMRITESELRYVGGEHWVAILDGIADLKDHLDREEQLRLAQSSDRVENEHGVGNSSEPFARTRSNGAFLLYGCRRATSRDEILSALPPKNAVDRYISRYFNYLDLVSSCRDSSIHCCKV

SEQ ID NO: 36816 - protein, 69 aa, A.fumigatus
LLLTNIGARAVIMSKSESTNQREKGIDSELEEANIVDWGGPNDPINPKNWPKHRKWTHIVIISLLALTT

SEQ ID NO: 36817 - protein, 186 aa, A.fumigatus
GAVSECSPWRRNMAPTMCAPGISGISADLDITSSAVSTLAITLYVLGLAIGPMFMSPVSEVYGRVPVYHAANIIFVAMIIGSALSWNLAQFLVFRFISGCAGGTPMALGGGTIADITTIEQRAVAMAFFSMGPLAGPVCVIMNSFFDFQITSPISFRSLVLLSEVPRCKHRLAFSTTGVEASALCV

SEQ ID NO: 36818 - protein, 339 aa, A.fumigatus
WPCPCTIPLAISGPTSFPIRYGEPLSVLPRFDISTFLDAVGQHHISETYMVPAMVQILSRSSLPVAESLASLRYVGISGAPIDGFSIQRFQRLLSPDAVAGNLWGMTEVGVVFQNRYRVPLQFGSVGTLLHGYELRFVDPATGEDVAGTPDSPGELYVRGPGLLLGYKWRTDDKDEQGWFRTGDMVYARDGNYYIIGRTKDLIKVRGQVPDSLNSWTSHSTNRLCDSRYSVAPAEIEGILLKDPGVKDAAVIGVMLPDGSSEVPRAYVVRAGISPESTADQLTDVVQTQLASYKALDGGVVFVDEIPRTGIGKPHRARLSQLDREREKLASILGVSVPA

SEQ ID NO: 36819 - protein, 519 aa, A.fumigatus
RSSGVPGSEFGKGAPWRGGKREPLLGEMFATNKRQEDDDEENEEDLDSEEEEEQIKQSILKEDQGEEFNSTQLRKYQLERLRYFYAILTFSSKDVAKHVYDSVDGAEYLSSADFFDIRFVPEDTDFSDDKPRDECERIPDGYQPNEFVTDALQHSKVKLTWDAEDKSRKEAQARAFRGSRKDIDENDLKAYLASDSSDDEGEEEAVEVVDTTKGDGSSTKISKKEEERQRLRALLGLSTEPLKSSKSSGPVGEMEVTFTSGLAGEPKRDTIFENEPEREETTIEKYIRKERERKKRRKEKLKALKRGETQGEAKADANGDDVSSAGEGQAAHEDLGFNDPFFDDPDGKATAAARRKEEKRKKRAEREAEEAANAAKRAELELLMLDDKKSEIKHFDMNEIEKAQKQARKKNKKKAKDQAQTVNDDFQMDVSDPRFARLFESHEYAIDPTNPKFKPTPGMKALLDEGRKRRRDRDDRGDEEVSTSRDRKKKKQKQSAAGNAGSDDLKKLVDKVKRNTQQT

SEQ ID NO: 36820 - protein, 399 aa, A.fumigatus
  UNSURE (343): Identity of amino acid sequences at the above locations are unknown.
IIMLGRLLSSAASTLNPAAYSNRNATQLESVTEEEHTSGLLFPDASLLRRSNTHAYPLHSTFNSPNAYAAGAYDDRGGVELDPVKDFRVIIAQNALGDRDACVLLDTRTNSSDVTSSPHDSEPYVLDNSGTRHVRTLSSLSRAPRRGYPPPSSAADSSPFSVAAESRRSPPMSSGAFARARGRSSTLSPAGGVNEAGRSRHSAENNDSGLLNCIFGSSAFSYRGSSTKMHIISADEDSGRTSSESPATRNSLSRAYTTGSSSGFMGASRGSEPKPPSKVTILLTRMFSVNLPEAGDTSDRPDHPTSMYQESLPENGFPFPDVTKRKKIKEKKTPMYAVAITIXIPLLSRNTGRPGSRFSTQATDSPKARMSCSLDSDHRWRGGFLDDSLSLAFSSGRFG

SEQ ID NO: 36821 - protein, 74 aa, A.fumigatus
ECAEISCYWDFVPWMTAVIEKESRGIRMYDRLSTKMENTFITPAKMMYNIVVYILNILNPTMLVSCSLEKIKPR

SEQ ID NO: 36822 - protein, 184 aa, A.fumigatus
  UNSURE (18),(19),(35),(102): Identity of amino acid sequences at the above locations are unknown.
LSPYQGINDFIGWATHSXXLVPYFSWKITHARHHXYTGHMEKDTVLVPWTDEQLAKKRNVRIEQLKHFAEETPLVSFLQLIGHQLGGWQLYLLTNATAGAQXWPEGKPKTGPASHFNPVGALWTPSQRLSIAISDLGLLIMAAVLYYASTQIGAWNVVLLYFVPYLWVHHWLSVSSLLLFSLGV

SEQ ID NO: 36823 - protein, 120 aa, A.fumigatus
AVAITYLQHTHPSVPHYTPEAWTYTKGALATVDRTMGFIGRHFFHEIIDYHVVHHLFSRIPFYKAEQATWAIQPLLGAQYHEEKEQSFLGSLVTTFRKCIYVSATGQPGVLHFVKADEGN

SEQ ID NO: 36824 - protein, 86 aa, A.fumigatus
LCQYCGQYLRRYNQEFEKCAADGGETNLCQDQKAMQAIGTCLKENMMPMALGEMEQLSMFITTDMCDKMNAYLKGRSFGKLSFLKC

SEQ ID NO: 36825 - protein, 72 aa, A.fumigatus
MTVVNTHGPAAASSKEESLVILMQLPHGHYLPWGFCDKERPLCIPHTATSSDGKYVAFPADASNSESTHFFC

SEQ ID NO: 36826 - protein, 627 aa, A.fumigatus
  UNSURE (3),(6),(7),(8),(9),(10): Identity of amino acid sequences at the above locations are unknown.
SAXGWXXXXXRAPVGSFQPRGEDGYFASKSPNFMQYIFRWKLTVPLPIPKIQFIVEIGDDLVYTSSVFDQMKLPCLPSRVSWVEMFSSIFDTAAYRVLRDEIEVDLGPTANMILSKAMSRVCRYKGKTGGTGFPDRQDLYDGGNTQEPQLINCVRIFEGYRSKYVPKSKYLHKVLEVENLELTDRASPTSEWSYESEFEKLFSYPFVSSYKPCLQVSREELSALALILGMNLCVCESHNPYSLHGEGAFGISASATLSHDMHWQLRFVRTSRRPRHDPSAGSGYSTLFAKYLACGAIPFARGNSENDSKWIKSVYIQDLNKFEEGGYFKDLKDDDCLPDALEYLSRLPTSETTMLWPHLLETQSTNRHKDWGLVKTIDNQTTGTWWDAVAGIPFGGLVPQTTREIKQAVQFTVSELPTVLDITTRCESDSLLNELEMLINESHRQHESLNLFGNHVHERAKSLDTDINFVTKCYDTRDAAAVFGRYMTLLEHLSATCFPGGSANDLESLHGQVSAYLKRSYRTWIASDSKKDTKDVLQKLGIVIKGVRRAYEETRTLSPDQTAKVTCCLIAAWAENVQEINLGLRRRSQDSIANHGRIANGEMINDQGRQLDHTTYMEDLPPIIALS

SEQ ID NO: 36827 - protein, 68 aa, A.fumigatus
  UNSURE (55),(59): Identity of amino acid sequences at the above locations are unknown.
DTMLFSRVAPVALLVALATSSMGAVSAKQAIESMNALQNTVSDARRSIEGMERRXSKRXSRRQQTSGR

SEQ ID NO: 36828 - protein, 277 aa, A.fumigatus
DILTSALASGLCDSVAAAVNQGSRNPSPVTQDVVENLSLDVLHRDNRSLTFPSILLGHRSQQQTLKDLQSMIVRLNSSESGSEITRSIIGQIHRASGDAVVAPFWLALNFLRTGSQLTCILDDFISLDHIEISVQSLSSKAMIEELYYYSLPLLDQPLAETSRDWRISALALEAVALQAQQLGEAFRPELMDALYPVLQLLASGNSTLQRHAMVCLDILTNSCKYEDTSTMIIENVDYLVNSVALKLNTFDVSPYPPQVLFMMVKLCGARLIPYLDE

SEQ ID NO: 36829 - protein, 190 aa, A.fumigatus
  UNSURE (158): Identity of amino acid sequences at the above locations are unknown.
VDSMLGILDMYHGYPKVVETMFKTLAAIVEEGTKTPSLLAITNGDLKPIDHRKRQYERLLVPTVAEDLAARRTKRARYMDEDLEDDEERVSHPKQPWKAEPEKVESLDADNLSDVLNADESEEPLPPPRQPEDEEKPLSKSHTILLHIVKSIPSHLTXPSPYLRRSLLSNPIQGFPGPGAKRGQVFASHQ

SEQ ID NO: 36830 - protein, 135 aa, A.fumigatus
ADGPSGSPSSSASSRTRERFKSSGSSLARALTASSETSTAHSSSSMSFSASRASASVLIRRVSSSSLLASKATSSTSPLSELLSPGLTLSPLVPSSAFLFLRALLAALSFFPPLVEARSRRMKVLSFKRGSTSVR

SEQ ID NO: 36831 - protein, 428 aa, A.fumigatus
SSSTTVKMATVNIRRDVTDPFYRYKMERLQSKIEGKGNGIKTVVVNLNSVAQSLSRPPSYVIKYFGFELGAQANAKPTDDRWIINGAHDAAKLQDYLDGFIAKFVLCKKCKNPETDVIIKDDKIILDCKACGQRTDVDPRLKLSTFILRDRASTKGGKKDKAARRARKNKKAEEGTNGDNVSPGDSNSDNGEVEDVALEANSDDELTRRIKTEAEALEAEKDIEDDEWAVDVSEEAVKARAKELPDDLKRSLVLEDADEDGEPDGPSAYDLLGSWILETASENGGVTAVSDVDIYKKAKEFGIENKHKTVAVLAQTIFDEKIVKQIPARAAFLKKMITSERHEKAFLGGTERFLGKDHPELISLVPAVLLGYYQHDLVSEDVLKAWGSKASKKYVDLATSRKVRKAAEPFLDWLENAESDDEESEDDE

SEQ ID NO: 36832 - protein, 120 aa, A.fumigatus
RLGGLLPFSCNPNGTDGQEYTRLVTIIFLSSTAALFADTYLCRVFPLFWEMLVNLDQIEFYHGPSHQPGVYQCKVTASRAYPTAFPAFFPDYVNLRPGILWDTPRTRTAIDRHDSSVEHI

SEQ ID NO: 36833 - protein, 236 aa, A.fumigatus
AVKKGLPTAAVVASTPKSELSASYDVIVIGAGFAGLTVARDLGFKGKKVLLIEARDRIGGRCWTVDTGETAKLEMGGTWVHWIQPHVFSELQRCDLDEFVETVAFPENCESVKKASRQDPAVAHDPAEGQAMMEQLEGLMAKFFDIDGQGGRSVIPFPFNMASSTKHNPEYLELDKLSIADRVAQMPDCDEEQRAVLGAQAASFYGIAPEKGAFTEVLHTQALCNFDPAMTEIATM

SEQ ID NO: 36834 - protein, 148 aa, A.fumigatus
QRPLAFNLLEIIFLVLPFEWWMPREHYAKLNEVIMGIIYSPLLLIIATLETREAHRIRWNRRQGEEDDDVVHEWEDVAEQVDFDVDDTWRQAVRDTTPDPNAENCTLEIIQLREQIKELTAVVHAFIEKKDTEEHMREQSSSNQGDAE

SEQ ID NO: 36835 - protein, 398 aa, A.fumigatus
TSTLLIGLVACGVYSITRLLKGSPASSQLALNSAIPTNSMTDNSLPLLYAGEHLDTVAGFPTLYAFSPANHDNPLMVFIPGGGHNARISYGGHPGSRSEDFLAHWLNKLGYGLLAISYPLQSQPDEIMAATSPEFRIRDWGLQAAEVTKTVIERHGLSPKVVLVAWSMGGRVVVPYTQAAKARGLTVELFVSLAATPGLAASRPNPPGIKMTSEGYAALDRMPELFLSQVREQNILESRVIIPDDVYLRDYYGCTPVGLLGFGMSYSPERGFVEDRYTSTEDADANNFRQWPLISALHGDSILDGRHVLADKATWGFMQVQQLVSTVEDRGYRSLNPERWEEVVKLVHSRPENMCRQIHGNHFFFLGEQGARETAAAIVEQLKEARIFMSTLDTLLVP

SEQ ID NO: 36836 - protein, 67 aa, A.fumigatus
RGIVLLNILIALYNSAYEDISGNAVDEYMAIFALKTMQFVRAPDENVFIPREFSCCSADWALTNSDH

SEQ ID NO: 36837 - protein, 61 aa, A.fumigatus
TSGLRGCLWTISPHLSKSTTTASSAFSTLDINAANRSSGMWCVFNYKTAQGQSCQFATCIK

SEQ ID NO: 36838 - protein, 67 aa, A.fumigatus
PQDSQIARRSTLVLSLLAYREPLPGRPYSKQRAPPWATGHASQSPSWLPLLLEDPNHGYEILVMLRP

SEQ ID NO: 36839 - protein, 216 aa, A.fumigatus
PHLRFLGWYYYAAENHNTFAVARRTMTLGNFAAFLIFCFYPCMPPRLLPDSYGFYDTVRQEHAESVWVGGKSVNQFAAMPSLHFTYAFVIGCTFIYHSGLVHRLQGRPVRKSPFTQIFFIIMAVVYPLLVLSVIIATANHYWLDATVATFTVTICFLGNRVLLLLLPVEYCICWVLRLAKPVPTTGDRHLHKWRQSHGDVPLLAEQDSDRFSDSVV

SEQ ID NO: 36840 - protein, 104 aa, A.fumigatus
PLATSPHSSSSASTPACRPGCFPTPMASTTPSAKSTQRASGSAGNLSTSSPRCRVYISPTHLSSGVPSSTTRASCTDSRADLSASPRSRRSSSSSWQSCTPCSC

SEQ ID NO: 36841 - protein, 379 aa, A.fumigatus
LYYSSMTKPQPPPILDFSVFYGHDSQAKAQLVQRVRECCLNNGFFQITGHKVSPELQQRTFDCAKRFFDLPLIEKKKIERSKNYPWYPADKQLTLAGPDAFNRGYEAFQSHMSQPGSAPDRKEGLFLGPDLAEDHPYCVQKKLNCGPNRWPQGLDDLEEFKLVSMEYYAALFQLAKDVVAVLALTMDYEETFFDPLTEGAIATLRYLHYPPQPVGDAEAGLGTGAHRDYSCITLLLQDGTGGLQVLDEPTGQWLDVRCSLSNGNLVQCVAYSCNLQVKPVPGAYIVNLANVFARMTNGHYKSALHRVVNKSGLERYSIPFFFTGNPDYVCECLSRFRKEGEPVRHPPATVHEVVAEAVRGTVERANRYNAERQGIHAAQ

SEQ ID NO: 36842 - protein, 68 aa, A.fumigatus
ISYTKKSHSWIVFTLTGNSDIGHRPQKMPIACITKFSGRRGTTLDKFRTFLAWRKPQIRGRTWKTKSQ

SEQ ID NO: 36843 - protein, 182 aa, A.fumigatus
SIWRGGQRENSDIKSRELSLCSQFVSLPVFAVEVNIRWNFWHLSFFAWKDQFARIYLTLLIAPRHKRVKMAASASSVTDVDIENVPKEKLDVKETEKEPDFEYPALSKVVVIILGLYLAVFLVALDQTIIGVAIPKITDQFKSIEDIAWYGSAYFLTSTALQPSYGRIYKIFSVGFLPCCMC

SEQ ID NO: 36844 - protein, 242 aa, A.fumigatus
RWRISMHNLVQLLRRKRGNQLWRMSPDESEHAARAMVQQSLMDDSLHPSRSSSATRPQRTGDAFSIPDVPTSAPRTPAPETGHAAEQGSTLELPSAPATIASSSIPNLPDKSASLGAHHPADPNSNSFHSFPPPANLPSPPAAFNQPSHFYNQPKPSAWAPSPPAQPHTEPAPVVSRPVQQPASAAVPTVSASSQSNSQGIDDQAIALAQKHARWAVSALTFDDVDTAIKELRNSLKYLGAE

SEQ ID NO: 36845 - protein, 100 aa, A.fumigatus
WTNLRVGLRLTHCRQTADTFQAAATFLELCQIWNPLEPEIAAKIKFAKYHALRIVKAIKAGEDPNATNPVIKEDHQAEGPAVTVEDLDAQPGAALASQTR

SEQ ID NO: 36846 - protein, 336 aa, A.fumigatus
KKRLWFFAKHLRQVPAGKRKGPSPKSWWEKFKAKEQPNGGPKSRKGLNRKKAIQRGPTRLTIDSALAFAVQSPSVLSPTSPTGFASPSPLSPIMNPEHMRKELAKSLDELAEEYQHKHAKSTTSLDTNCSLSASVTSPTSTLVSDSPFTPVSQSRGSLADSQSNRPRSQTLPTGTLDPSLISTEESSDHSLSKAALQQSLSITTLESPLEDEHNSKKGPGLDTSSNTIKRNRSNPEIKAKPMYPPSFSKSTTVSPISSPGSPTQDEARRALELVVSYFEHQPTGLGAQEFVTIGKLMERLELARAQQTALPGGLARIDELEDAPQLTKKRSIHNLG

SEQ ID NO: 36847 - protein, 78 aa, A.fumigatus
IENYLRNTIRDFFRVPSVYEFSSILYLRKEADVGQSDQTMTFRLDVDMKLFDAVAEQPSKDDDSHSNVDQLGPALVRM

SEQ ID NO: 36848 - protein, 153 aa, A.fumigatus
  UNSURE (77): Identity of amino acid sequences at the above locations are unknown.
AKLLSSSWRSTSAPDPSRSLLRRQQRPPGMETIRIMAPMASTVTTVTTSVTRSPAPRPHAPKQKLPLQQTTETTETXATMVNMGTMVTTSVAKNPLQPPQPPLRTQVPLQQTTETMVNMGTMVTTNVTKSPPQPTLRHQFPLPIPADLGNYGE

SEQ ID NO: 36849 - protein, 145 aa, A.fumigatus
SDPSNAIICESFPFLDVTMLKLSIMSMTVLLFFQSRTTHATGAVPTAMTPSSTAPHATHTVKVGPKENPHQYSPHNITAAVGDVIVFEFYPRNHSVVKADFMAPCVPAAGEIFYSGQFNTFKENNHGQLEGEVSVSPMSRSQLTF

SEQ ID NO: 36850 - protein, 205 aa, A.fumigatus
  UNSURE (120): Identity of amino acid sequences at the above locations are unknown.
SSALAIKPATLVRPQGLLHFLSQSKLFSSSSTTLSSSTMHLLSKAAVLLLALNVSARPIEEPPAQTTTPAGYGDYKDYGSYGKYGDYGHYKRNEEPSPTTTCTETETPTPADYGDYGDYXNYGQYGDYGHYKRGEEPTTTTTTTTENPSPSPANYGNYGQYGDYGHYKRDKEPTATNTETPIPSPNPRRLRQLWRITAPTAKYGG

SEQ ID NO: 36851 - protein, 268 aa, A.fumigatus
  UNSURE (89),(97),(149),(158): Identity of amino acid sequences at the above locations are unknown.
VLIGKKKKKKQMARSESDKDIDANYGLLNNDEAQNWSHDEKPRTTSHGQWLKALLYIATVIVSCLVGLFIGRQVQYLDRPCARHVSHYXTSHIFGIXENSIINKTAPVTSDVDITFQPQRFNGSLLKENIYRQDASPEVDAAWEALGVXCKMDYPGIXEIPTVSRSKFACSCRSSRKVRTGARPGQDQPEVWRRVSSECRGFPSSTLSSMSSFNYLKMKADQCRIYCAKRSTTTTITTTSSVKGLSRTTILSSDGTCVRISYRSFCAE

SEQ ID NO: 36852 - protein, 83 aa, A.fumigatus
HSLAHCLDILRQQLMCTIDTGVLGQVWIHPDHPEAYVDFNTEHQCKNFEAIRQYAEKNQLPAQIPKDFLEPPKPGDRVYDEIP

SEQ ID NO: 36853 - protein, 65 aa, A.fumigatus
NLLRQTLYYNYDYYHKLGQGAFKNDDFIVRRHVCTYFIPQFLRRVRLTFASPLSGHPATAAHVHH

SEQ ID NO: 36854 - protein, 85 aa, A.fumigatus
IRNVQDCEKLIENFGSVALLRKDNTFCSCGIIEVFAKFHAETLHFRAEFTWELGISEKVVLDCFTRFSDAYNIFENSTMFCLHGV

SEQ ID NO: 36855 - protein, 148 aa, A.fumigatus
PVVGSGKTLIAVLLLRHTILNELDDRANGKTHRVSFFLVFVLLALGRCILTWCKVDSVTLAYQQAAVLRNNIDQNVAHFFGAMGTDLWDKRTWDKHLQRNMVIVCTAEILNQCLLNSYVRMDQINLLIFDEAHHAKKDHPYARFVEHF

SEQ ID NO: 36856 - protein, 267 aa, A.fumigatus
QLRQSTQKATSQKPHRMFSAGEQGDIGLTSCRRLETFLDSRIATTSKITLLREVVSRPIEKVWAYNRLEPPFATELYKLMDTRYGNIKVLEGVYRFAWNASSELGKWCSDRAWWHALADDVLPKLEGNINKLIESNTMKAEHGAVFKDIIRIREASETVKNYFFTDPELPGELSPKVQRLRMELSKHFNDTTGTKCIVFTQKRYTAKILNELFTVLNIPNLRPGVLIGVRPGDIGGMNITFRQQFLALVKFRTGEINCLVRFTSKML

SEQ ID NO: 36857 - protein, 496 aa, A.fumigatus
ENHEKLTFHSDDAGSACRGAINMKIARLSMDAQDKTRFEIHGKSSVKYHLKANHVVEAKRWFWTLNNAIQWAKDEAKEEQKRQTRHAEALRQAKMDQIEGRSPTEAATESPNLAASKSNGKGLAPPSLSVPSGNTSKLTTYGSRTTLDSVPADEEVSIHGSYDQSVLQNEVNRVVSHVTSHLDGEGDEDDYGEYASSRDISPSDKDALNITAQSAKLQLEILANVVAALQAEKSKDPNLPISDPTVGQALVAYEAAVSSLEGLVQNLLKISRDRDSYWQYRLNREAYLRKMWEESMARIAQEHEELQSKMGESEEKRRRTKRALKEALEGVSAHTSRRGSKVASRIQVSGEDSRVGGDEAKELIAQPMEYMTENEENESGKSLRRKRSALSRISSLYDSGSDDDDEFFDAIDAGEIEVEDMTTSKVMEKEKEKPELESTEPRAAKRDEIVPSFKGYEEPVRTRLKLDNDNRPKISLWVSDCEYMLKLGFKQSKVML

SEQ ID NO: 36858 - protein, 122 aa, A.fumigatus
GILKSMIGKDMTKMTLPVSFNEPTSLLQRVAEDLEYADLLDIAADRSDSMERLVYVAAYAASEYASTIGRVAKPFNPLLGETFEYARPDKGYRFFIEQVSHHPPIGAAWAESPKWDYWVRFE

SEQ ID NO: 36859 - protein, 62 aa, A.fumigatus
  UNSURE (30),(31),(40): Identity of amino acid sequences at the above locations are unknown.
ACVLNSRPFSPATVDMPGEYTCGRCLQALXXKVSIQGSTXRLQTVINSPGPRSSPLFVLPKV

SEQ ID NO: 36860 - protein, 91 aa, A.fumigatus
SIRQDHAAPPSSFSRKFSSQNQPLLCTPILPGAIETDIMPIFVAFICCVSNGKAANAPSLVHLFEPSTGDKSFAETKQPLSPFLEIPCTRD

SEQ ID NO: 36861 - protein, 273 aa, A.fumigatus
ITLSCDTVSFFLNFFPQGESALKSKFYGKSFDINLLGTWFLKLRPVSGGEELYTWKKVTSSVIGIITGNPTVDNYGLMEIKNWTTGEVCYLDFKPRGWKASSAYQVTGKVVDRDGTPRWSIGGRWNDKIYARHTPGFEAQVSGQDPESAKTFLVWQSHPRPSGIPFNLTPFVITLNALPEGLREHLPPTDTRLRPDQRAMEDGEYDLAANEKHRVEEKQRAKRREREAKGEEYRPQWFIRAKCPITGEEYWAHNGKYWECRERHDWSASEDIF

SEQ ID NO: 36862 - protein, 339 aa, A.fumigatus
  UNSURE (44),(53): Identity of amino acid sequences at the above locations are unknown.
YNGILGGQKLQLLSMCTQQPSIQPRDSRHAWRVYLRTLSAGPPXEGFYSRFYXSIANCDQFARTTQLPPLRSPESLVRRTNHCFAPRSSQGQLKRTSCPSLSPSSAASPTARQLTHRASSTSSSQAQETRALLKPNNLFHPFSKSPAPAIRQRAAFIKQNAFCPHPSHQQTRVALSPHDPESRKSPKSALPPAHSHFECPDCGVPIYCSEEHWMDDFEAHLEICDTIRQINEDDHDLHSGRFFPEFTYPGPQDDNFVINMTNWDTFLYTREFDAINHDRSMRQVTRMLTYPLTIGSVLHELSPYSIRKGGRLTTEGLKSVSGKLHLSVLSQLPVNCPSS

SEQ ID NO: 36863 - protein, 272 aa, A.fumigatus
ACTKIYLYPSFSPFSPHSSSVLRQSSNLRYPLHSRMSKLSDYRLLCFDVYGTLVDWESGIVNTFQPILDKNNSSISREHLLSVYHELEHEQQAQTPDMPYSKLLTKIHPKLAHRLSLAPPTEEESIAFGESVGTWPAFPDTVDALKRLSKHYKLVVLSNVDRESFAKTNAGSLQGVKFDRIITAQDVGSYKPDMRNFEYMLKTVQAELGVDKSQVLQTAQSQFHDHQPASKVGIKSVWIVRPGAVMGNTKHTIYDWKFDTLGDMAHAVESGQ

SEQ ID NO: 36864 - protein, 240 aa, A.fumigatus
LAPCSLLLSSLSNTQRYKPTFHHSSLRLTIQDSLFPARCWPDPCAGITFQNDTYVCGDPRLGPVVLPQKFPLNNELRTYARFGALCPAEFLDKWATDVAPNGTYIYPPANGFALDTEEQPILGNATLPVGMKLDRFGSEYGTFLAPLGAPYIERSLPPSNLNTFDGMYPYNYHVYQVTKEFVVGLGPIAPWFEQPGMGTQFVTYTNVLGLIDDGYLRRLDESEYDEKVEYSNPYTPGPNQ

SEQ ID NO: 36865 - protein, 184 aa, A.fumigatus
  UNSURE (134): Identity of amino acid sequences at the above locations are unknown.
YQIYGVLSGASLMETAAEVILRPVPPLTQVNGTRYVSNSSEVISLRFFHEWQSFTQDVLEASASLDLSHPVPYTDDVSENYVVGSELGLIGRFSKNVCDPVSKVFATTCLSHLKFGDYQSAAGPTDTSQVPGIXMFNTTGPPRPAAVGELKSFWTVELEDYSIREGYQRLIGIQHHIGKSSYTL

SEQ ID NO: 36866 - protein, 127 aa, A.fumigatus
SVRFISLKHFKYGVEFYHSLPAFYSMGHITQRVEFPVVDSMLGVAHNSSWSYNPHRLDPDFGGRLVVMELTLRSLQDLTLVNPQLGLYCLQHVFEIAHVRLVRAHVLRGDDAIELDALQTPRVRLGE

SEQ ID NO: 36867 - protein, 452 aa, A.fumigatus
PKVNAADTRSELTRRKTRLHRDILRSHLHANSSVLQSAGSSHAHCFYFKQNLVLKPDAPQGNFHGWGPETVPLLRDQWSALSETRDQSERGRQSPRGSNRDRGRDRFRDRERRRRSKGNGRIPPLRSPPPSRSQPQSELGGPRSYREISPNNTSPRGSSGLPYSEARQRQNQDHRQFVDPQPLEGERPTGRDYRRDNSPSAPPPFKRKRTQSPSPVRPFSPRQDPSHHHPASEQFDEFDRGYPHKKRGRYPGRGRARRRSPRRGRDRRRKESDRFKGLKSPLRGPRSPRHPRERYNSPDPADDIDQEYHHRSPSRYSINSAGSRFSATSRHSFRVDATMNPRPIQSAMNNSFRSSSPPRPVPSFNAEITGVPTEGDPNARETFPFNGERALNANDNQLSHPSRLQADTSQYSTSPKYGPSSNSYQGSPQSTSPHPGRRGGLTGQSPHQKPRG

SEQ ID NO: 36868 - protein, 107 aa, A.fumigatus
RQAYVRWQYIPRAHEAGLFVFGVPPNEVGSLQWEGYGRMARNAKIQRPDELVLREIKDRNLDMQRMYVDIILSDKLEPKEDVSPYRWHEEIMKEFENLPWMQVVNVK

SEQ ID NO: 36869 - protein, 108 aa, A.fumigatus
CLLHLGWSLIASRAVLGTTLTQPTMSVAPHINNTYQDVELQRRCLGRLSSTWQFCALNLILALYHTFQKPTFVSMIIHQVCFSHDCIQDVRTASTTTSPQIKSTGSLS

SEQ ID NO: 36870 - protein, 66 aa, A.fumigatus
RTTTHIPKQLRDVAFSIIQRSTQSDLSSALSDEPNSHSYMMPPLTHTYQADMTKLFKSRGQRLYLI

SEQ ID NO: 36871 - protein, 280 aa, A.fumigatus
  UNSURE (270): Identity of amino acid sequences at the above locations are unknown.
TSRLSDFYFIAAKLVPMGFTTATEMHARRSELISITTGSKQLDTLLGGGIETGSITEIFGEFRTGKSQICHTLAVTCQLPFDMGGGEGKCLYIDTEGTFRPVRLLAVAQRYGLVGEEVLDNVAYARAYNSDHQLQLLNQASQMMCETRFSLLVVDSATSLYRTDFNGRGELSSRQTHLAKFMRTLQRLADEFGIAVVITNQVVAQVDGGPSAMFNPDPKKPIGGNIIAHASTTRLSLKKGRGETRVCKIYDSPCLPESDCLFAINEDGIXDPTPKDLEND

SEQ ID NO: 36872 - protein, 184 aa, A.fumigatus
  UNSURE (184): Identity of amino acid sequences at the above locations are unknown.
CESVILTSLCFEGSHWTPLTFDERTWGASIRGLVRWHAQPTIKYQGRNLDVNAANAIATTSDQTYAFAVCLNHTLKIWNLATNRLAATKDLLNRPVQQQESAAYSLNPAESSFIRVFNVERALDGGYRYYIVTYSPFEDGRFKFWAVKGGLTSQLVVEDLFPDAALTPLDPDPTGSMFWSIADX

SEQ ID NO: 36873 - protein, 149 aa, A.fumigatus
AQDLHLASPIQTESFQVGRVKVRRRQKKRCRSGRFPLPQDVVPALHKMPREIPGRLTDNVHRDVMPWHPGYDITVIHLLVRLVQIVKVLNPRVRVILTGPELAVVCVLGSIGRLKASRLVVSEKMLRSVPPSETKVDSANESHGMVDQA

SEQ ID NO: 36874 - protein, 1183 aa, A.fumigatus
  UNSURE (1144),(1159),(1160),(1164): Identity of amino acid sequences at the above locations are unknown.
GKYRGGGPGPFPGFPWEGPFPKYLEEFRGLEKWRWKLKKTEGGNGDCPRKRPAAMRGSGGRKQQQGATPTVRRYIPGDNQALPIPEGETNGGHSGAAEPGQSTKREPYPERQRKKLEAYLQKMIRFLIFKADSNRLCKFLELSALGVRLASEGSYHGKEGYLIIQSSKGLDFRRALTPAMVKKRHSPKWFLVRHSYLVCVDSPEEMNIYDVFLVDPFFKLQTQKISLRNQKAKELAKSAKESARHPQHHTLRLENSERKLRLLARNERQLHQFEDSIRFMVNNTPWVKPNRFDSFAPVRQNCFAQWLVDARDHMWMVSRAINQAKDVIYIHDWWLSPELYLRRPAAISQKWRLDRLLQRKAREGVKIFVIMYRNINSAIPIDSEYSKFSLLDLHPNIFVQRSPNQFRQNTFFWAHHEKLCLIDHTVAFVGGIDLCFGRWDTPQHLLTDDKPTGFETPDGPKDADHCQLWPGKDYSNPRIQDFYDLDKPYEEMYDRNVIPRMPWHDISMHVVGQPARDLTRHFVQRWNYILRQRKPTRPTPFLLPPPDFDPADLEALGLDGTCEVQILRSSSMWSTGTPDVTEHSIMNAYVKLIEESDHFVYIENQFFISTCEIDGRKIENLIGDALVERIIRAHKNQEAWRAVIVIPLMPGFQNTVDSEGGTSVRLIMQCQYRSICRGETSIFGRLRALGIDPEDYIQFFSLRAWGKIGPQKQLVTEQLYIHAKCMVVDDRAAIIGSANINERSMLGSRDSEVAAVVRDTDMIWSSMNGRPYLVGRFPHTLRMRLMREHLGIDVDELMEHSIATEEELRKIQIAEEGSRSPENADKADSESLMMERQDERDMIERRHRIQDEFLSRSEDLHSFNHDVDWEQGNNPNLKANRKLTADPRVTSNAEHKKDVDGHGVDHLDIALEAGLADGRDSQMLEDSVEVLVSPIASEGKGTIRQPKLASQRNTQPGSPIARESSRESPSTTVHDADPTPVLDGLPAARHPALPGTNTENDNGLLSPSSDITDAAKYPHPLIPDLKHIFIDKDCMRDPVIDIFYLDTWQAVAEKNTKIYRAVFRCMPDSEVKSWKEYKEYATYGERFSEMQSQHSAKISHPSPPKTNGSSRGQIQRSWRRYAVTLLLTRIERRSPRDGTQGVTXAPTRRERLAKVDAMXXIECXPILPKQKHYRQLTRGLPLK

SEQ ID NO: 36875 - protein, 293 aa, A.fumigatus
SAFPSSLVVKTRRWLRDRPGPPLASSKGAARNSRWRIWLRLIGFAWKSLWKTAKVAVKLREVIIFLIAWFLLSDAMATVSGTAILFARTELKMSTTAVGLLSITATLSGMAGAFLWPVVSRRLRLKSNHTIMLCIALFEVIPLYGMLAYIPLFKKWGVVGLQQPWEIFPLGIVHGLVSGGLSSYCRSFFGLLIPPGSEAAFYALYAATDKGSSFIGPAIVGMLIDATGQVRSGFFFIAVLILLPIPLIWMVNAEKGRQDGLAMADILEKSHREHASEYGGPSEEAEGLLARDI

SEQ ID NO: 36876 - protein, 87 aa, A.fumigatus
INAKGIAIGLHALSLQEIISLKPAVYYLSWRLRRLGLQARIPAYSSQLLRGDFRVPDYRRHELSLSDHYEAVYGVPEMTQTSGLSPI

SEQ ID NO: 36877 - protein, 598 aa, A.fumigatus
  UNSURE (3): Identity of amino acid sequences at the above locations are unknown.
LFXRLHGDPLFHTFAEELLSHVTRPFYDMLRLWIYDGELSDPYQEFFVVEPEFRPNTDPRRLATSVWEDKYKLDDEMVPSIITQDFAKKVFLIGKSLNFIRYGCGDSGWVEAYSKKASKELHYGDTASLEASIDEAYKTTMARLIHLMAEKFKLFDHLHALKKYLLLGQGDFIALLMESLASNLDRPANSQYRHTLTAQLEHAIRASNAQYDPPDVLRRLDARMLELSHGEIGWDCFTLEYKIDAPVDVVITPWGSTQYLKVFNFLWRVKRVEFALGSTWRRCMTGARGVLGSVSDKVGADWKRARCVIAEMIHFVCQLQYYILFEVIEASWDQLQAEISKPGCTLDDLIEAHTKYLNSITHKGLLGSTSSSRTASGHKQEEGFLTQLHQILKIMLAYKDAVDGLYSFSVAEFTRRQELSAKIETRTAQGRWGITERDLLPSRRPQGHKNSISSFPPSMAQTPTVGVDGDGFDTPGSLAGQELSADDHMLASLRTRLRELSAEFRSRLNVLLGDLAYQPYVDMRFLGVVMNFNDVYEPVRRRRTATASTKDKERARRKAAASTAPGGSGEAGSQKEARRERKDTSGAEHSGNGSGTGP

SEQ ID NO: 36878 - protein, 373 aa, A.fumigatus
FTLLASFAVSLIKRAIYSILQSHLTSPRTPLTLPMSSEESAQPSHVSASKKAGRKLKHAKDTSALEDSEDKEVVQKHKKSKDKKKKNKSSNGQVTEDAAVTADPSEKKQKQKEKKSKKRRLEEESDRGEKGVAEPGSESQQRRKKKRVSFSADTVMRDAEESESESRPDVKDDLKSNGDAEEGQAPPVTEEQVDADDEGEKKKKKEKKKKKKKDRSGTAASDTAPKSHESPILSYLNLYHQNRSAWKFQKNRETHLFKHILSLEHVPESYNAALLSYLKGLKSEGARQRLRQVAEEVVKTEMEEDLAKEQEAETEGKVESDTTGYNKAVEAFRTRLSQGKDDFEEIETPDSLDGEQLAQLQRRLNRRSTTTYE

SEQ ID NO: 36879 - protein, 62 aa, A.fumigatus
RKLTAVRIYRIVVLAMPLLMSLLEAVVQLVKTDPKRRIYQTSMDIMILWLRSLEGIDQWSHA

SEQ ID NO: 36880 - protein, 810 aa, A.fumigatus
CTHCSFSKGEGRQRLQPVLQFNRMAQQPSRHTVEWIKQQQAEAGVDVRKALKLRKKLPLWLDDSPFDRVPERVPLPESRDGSSTSSDPGDRDGNAAKSSLEAIDRDDTFIQPWLIPLPPSLPPSPRQQLAQWLAAKESKRETPLPRQPYRLVLDRAESVFDHIKRGNIRKNPRLQRTSITLYEYYDDSTATRVEIDTAQEIPRFCGMREGLKGRVFLVEDLSTKTINTLGETFGITPEFSEEHLLNSGYGGAKYDDPPARSWKTARLNKPYVSLQWFRPVYRRPPLFSNRDREKLLDLQGNGLEYISGNSSISLKAATNIFRAEWDLRVDPRRTAKEMGEFGLVERASIWKKQDENMEYETGKLLRSLGNHWETDWMAVIVLLDPLPTISISHDLTLRITKETIAESGGSDNRVTGNSNGMENRILIIEGDNTSEGFAIPIENPRREETSRPVLDWLLRRRRPEVDRRKVHVRTSFQVLVKQMAPRKPITIDLEEALLTGGNSLSKLQEELNETRSTRQAMHDIAGDNTAPIHVLQILFQTIHQDTSTLLGVLNQILSDIEVDILDDTKMEDRLASWRQLISKAEGELLELKTSTKSFVAFLGFKFPAETSAATSDDKPGIIRDVVDLFQEIDQMLTKLRHASTSLTSNMGLLDSRRSIDEAHAVTRLTELAFLFIPLSFSSSIFGMEIEPFKDPVPLWNFFVVAISVTAFAYLMRLTMRSQWLGNLKQSVKQDVRRYAEQNGMPVQVRSLSMLLLLQWFGSILERSSKATWSWIGRKGRMAGIGLWRVVGFPVTVFTTGLEGAVRRAVQ

SEQ ID NO: 36881 - protein, 412 aa, A.fumigatus
PSLSSTLQSFFHLTDLHIQDEVYMHVSKITERDLVLLRQYCIYGPKLISLTARYSTARPLGATQEAAMFKKAVKDHSAGPVKPLQSNLFRSNGIVQPKPTPPLQSIGVKRKIEMSSAGDSALGTLHSAVYFDENDFDDDVDLDSEGPEPFIPPTKIVRPSIADQSTVTSNANSTGNNVSQSAERVTVDLISSDIKYPELPPVSNDHVPPSSSVQIPWSSSPPHHLQQPNSSRTLPWLTKNDELSKVEGYKKPETPTRPKSTAIWNKSASAIKEEQKELRRQHKKNQKGDTNFKQLQTRPKIASLFLSDEQRHVLDAVVNQGKSIFFTGSAGTGKSVLMREIIKQLRSKYRKEPDRVAVTASTGLAACNIEGVTLHSFAGIGLGKEPVPELVKKVRQFSASALFIFVDGQITD

SEQ ID NO: 36882 - protein, 64 aa, A.fumigatus
SCPMYVKADSCRILFFNGAVTLKNIYSIQQRQTTSMKGKRVWAFGERHFRSGKLRLTMMPYQCG

SEQ ID NO: 36883 - protein, 213 aa, A.fumigatus
EKSSNSYGVNIERSRIVWQSQLLLVLLPVTSRVSLCTVLQELGWVKSLFQSWSRKLDNSLPLLCSYSLTVKLQIKRNQKARNRWLRTKVLIIDEVSMVDGDLFDKLEEIARRIRNNGRPFGGIQLVVTGDFFQLPPVPEGSSREAKFAFAAATWNTSIQHTILLTHVFRQKDPEFAEMLNEMRLGKLTPRTIETFKSLSRPLNFHDALEATEL

SEQ ID NO: 36884 - protein, 283 aa, A.fumigatus
HLILRFPTRQEVEQANSARMSRLSGETMTFHAVDSGTIQDVQFREKLLANCMAPPVIHLKKGAQVMLIKNMEDSLVNGSIGRVVAFMDEATFEYYRDNESEFADGRDAGSDDERLNHARKKLKGLGNKDGGVVASRKWPLVCFVQPDGTERHLLCQPEAWKIELPNGEVQAQRQQVPLILAWALSIHKAQGQTLQRVKVDLGRVFEKGQAYVALSRATSKAGLQVTRFDPRKVMVHPKVTEFYSNLVSITDALAPKSSKPREHQEVDEDGQLEDEELLQHLYG

SEQ ID NO: 36885 - protein, 543 aa, A.fumigatus
QINGGVVGIDNSNQQVNFKNIHFNGCTTAFRASGGHTALLQGATFENCGVGIDMTSNGLGSLVLLDSTSVNSGTTIKFHDSSNDGGNRNSQILIENLTHDNGNPIAEDSKGNVKLANTSHVDTWVWGNVTPGQYETGTSFNTNRPNVLLSGGKFFMKAQPTYAEYASDQIVNVKAVAGHTVKGDGYTDDSASLNAILADNAASCKISYFPYGVYIVKDTLIIPPGSRIVGEAWSVISGAGNAFKGARNPKAVVRVGNPGDVGVAEIQDMRFSVSEVLPGAKILEVNMAGSAPGDVGLWNTIVTVGGTAETSISTGCTNQDTSQCMAAYMVMHLTKSSSAYIENFWGWTADHNLDGGSGYTVISTGRGVLVESTKGTWLTGTGSEHHWLYNYNFHNAENVYAGLLQTESPYMQSSGATQTAPAPWTADSSVGDPDFSWCAGGDQKCRTALATNVDGGKDVLLYNSAAWAFFDGEWYGDYGTQCSGNCQSNMMRVSNNPENLVWYSINTRKTNVMVLDGQSNPTEYYHPGGWEAIIQAYRQFSSH

SEQ ID NO: 36886 - protein, 324 aa, A.fumigatus
ISFLIYLSRRTLAHHLASMRGLLLLTTLASTLTSTLATASSAAVGARAPSCSGPVKSSPSTYWLVEQDHIGNPRGYAPHAGGNYNYPVWRNVLDYGAKNDGSGDQTASLQKAINDNGSGGSRENSGVTRYPAQVYLPSGTYQLGSALNLRVGTLIVGDPINPPVIKAVAGFNGNTLVNGYDSKNGPPETSFMTLMKNVVLDTTALRPDTRITALQWGVAQGAGLTNVQINMPNYSTGHTGIHVQAGSTIAITDVVGLSLVCAVWSSADKYSKSMEVSLVSTTPTSRSTSRTSTSMAAQLPSERRGATLLCFKAPHSRTAEWALT

SEQ ID NO: 36887 - protein, 431 aa, A.fumigatus
TRIDILRVVEIVIVQPVVLRASARQPCPFGRFDKDSATGRDDSVPRPAVQVVVCCPAPKVLDIRRRTLGQMHHHVRCHALGGVLVRAPGRDARLGGAADRDNRVPQAHVARSAPGHIDFEDLGSREDLRHAEPHVLDFGNAHVAWVANPDNSLRIAGTLEGVARAGNHRPRLSHDPRARRNDQRVLDDVHTVWEVADLTAGRVIGQNGVERSRVVSVAVPFDGVACDGLDIDDLVTSVLGICRLRFHEELASRQQHVGTVGVEASSCFVLAWGDIPPDPRVNMRSVGQFDVALAVFGDGVAIVVSQILDQDLAVAVPTIIGRVVKLDRSPRVDRGRVKQHQASQSVAGHVNAHSAVLECGALKQSSVAPRRSEGSCAAIEVDVLEVDLLVGVVDTNDTSIDLLYLSADDHTAQTRERPTTSVIAIVDPAWT

SEQ ID NO: 36888 - protein, 65 aa, A.fumigatus
RHLDSLYPGHCLGTLDGVMEYSPSGHAGNSQLTNQSHSAGAHLRHIYFGQSEDKLLHLNQNASPR

SEQ ID NO: 36889 - protein, 123 aa, A.fumigatus
  UNSURE (117): Identity of amino acid sequences at the above locations are unknown.
HIGLLDQIGSAVEGFIWPKSLWDFTTRNLNGAVKSTPILQILNLIMGLLGIAWEWPLNLLAGTLPHRSIEVRLIMYPLSALLAALLYQWKIPATYYLIGIAVNFWALPECQVKLVFXSPLSLI

SEQ ID NO: 36890 - protein, 213 aa, A.fumigatus
TMSPPLVPLAEIPTVSLLYKLGRLVPYSVPFAKPSNSFNNIISLIRNDITKLENVDCIVNAANESLLGGGGVDGAIHRAAGPDLLRECRTLKGCRTGDAKITSAYELPCKKVIHTVGPIYHFELRKGDDRPEMLLRSCYRRSLELAVENNMKSIAFAAISTGVYGYPSSEAAFAALDEVRKFLERPGNIEKLERIIFCNFERKDEVAYEQAIP

SEQ ID NO: 36891 - protein, 242 aa, A.fumigatus
RSQLTSTPTTNMPPPQPSPEGPLTGKTTSRFRVLAPEIAKIRSSKSPVPPTTEPSASASASANASPSLPQTQTPTPPQSSPRPKRPSLSSLFRQRYATLPTPIRRTFRVLRILAPIVPIGIFFSEHVLQVMWVRGPSMTPFLNKDYETMHTKSDMVLVNMWPFGGAGWPWERKRRLERGMIVTFRWVVRFPLYSVSDSASPDMELEYADGMVVLGRLLILNTPPSSGLSVSPVIGLRLVNRA

SEQ ID NO: 36892 - protein, 129 aa, A.fumigatus
RYGCARSPANPKHTAIKRIIGLPGDRITTREPCMKASQIVPFNHVWLEGDAEDPKKSLDSNTYGPVSISLITGRVIAVLRPQFRWLNWQDWEKGVVEGDEDHRFGENYRQDVRQRVLKEAVKLERPQIE

SEQ ID NO: 36893 - protein, 265 aa, A.fumigatus
SEKCERGLAAYSGQVATGVLLRYQGLFVDTSLALLDSTDGNSTCLGRSRRNILKYNRASPSSMVTCALRPAGIYGEKDTTFTFKVLEHAAKASPTVLRMQLGDNNNLFDFTYVGNVAYSHLLAAYRLLATQTRYESGQSGPLDHEKVDGEAFNITNDSPVYFWDITRAAWALAGKVVEPNQVWQLSEDLLGPVGAVLETVFGLIGKTPRLTRRIVRYSCMTRYYSCEKAKYRLGYSPIVSVPEGLSRAVGYVLARERLESEKKGL

SEQ ID NO: 36894 - protein, 143 aa, A.fumigatus
ADLFSCLLCLSRPVIKMRFPIPLVSFLGLFTRLQSWIDGFSDLWESTLINDETFDYVVVGGGTAGVTLAVRLAEQKLRVALVEAGKTYELRFPIAAIPGAASIGVGSDIESGTPIDWKFVARNVTGANHRDIHYPRGKCLGGS

SEQ ID NO: 36895 - protein, 215 aa, A.fumigatus
  UNSURE (24): Identity of amino acid sequences at the above locations are unknown.
LPLMPQKRPTLELGSVLVVGGCGXLGWHIVDQLLNFPSETDASVALPKPEGDSRFDNPRLADRYPRCVAKVSVLDLRTANNRLPGAQYYDGDITSEESLLAIFRKVKPDVVIHTATANVLEGNKELLRKVNVDGTKTLLEVAGGDRGDWGGKCKAFVYTSSASVLHDTQSDLKNVNEDWPLIRGKLQLEYYSDTKVCLSTLLWPCWIPLTETQPA

SEQ ID NO: 36896 - protein, 183 aa, A.fumigatus
PTRRFPLRSTKAKKRMLASYTIYCQLSSPVRLQHTNLLRTTTDSLINWARQGSLWPLSFGLACCGVEMMAASMPRYDQDRQGIIFRASPRQADVMLVAGTVTNKMAPALRQLYDQMPDPKWVISMGSCANGGGYYHHSYSVVRGVDRLVPVDIYVPGCPPTPEALLYGILFFTTGAGAIRACN

SEQ ID NO: 36897 - protein, 427 aa, A.fumigatus
TTAWITQCVKQRQTLNPFLPIGHKAFPPRREWLPKNQSPPMMLNESRPQLQQGGLLSQRRHARALEPLWSVLIALQPAVLEERNGEIEFRVVINNDGSRDSTIILTGLKCLFQKQLPKMPKDYIARLVYDRTHLSIAIVKMPLEVIEGITFREFRDRKFVEIVFCAVSSDQQVKGYGAHLMAHLKDYVRATSPVMHFLTYANNYATGYFQKQGFTKEITLDKSVCVGYIKDYEGGTLMQCSMIPRIRYLEVGRMLLKQKATVQAKMRLLSSNHIIHPPPPQWAKGVVTPIDPLSIPAIRATGWSPDMDALSREPRHEPYFNEFRRFLNQIQNHKQGWPFLQPLNKDEVPDYYNVITSPMHLSTIEEKLERDDYATPKELVHDFKLIFKNCRQYNDATTVYAKCAVKLEKYMWSLSSPRGWKHPSGAQ

SEQ ID NO: 36898 - protein, 77 aa, A.fumigatus
LLPSIHSLFLPFGQLAGPRTWMHYRENHAMNLISTSFGDFSIKSKTTNKDGLSCNHSTKMRFPIITMSLHHQCTCRL

SEQ ID NO: 36899 - protein, 354 aa, A.fumigatus
PRCSLPIGGVSLAVILFVLRLPDKNDFSGSPILERIQQLDLIGAGLLIPAIICLLLALQWGGNKYPWNNSRIIGLFVGFGVMAILFAFSQVKLADKATLPPRMFKNRSVLAATLFALFFGGAFFVLVYYLPIFFQSVKDSSAMKSGIQLLPLMLATVVSSMVMGGAVTAAGYYTPFLIGSTAIAAIGAGLVTMYEIDISTGKWIGYQIVLGAGVGAGFQIPMTAVQTVLPAEDIPIGTAAVMFFQTLGGALFIAVAQSVFQNGLISGLAKYAPTVDPTAIVKAGATEMRTVLTQLGQLDQLMNVIKAYMDGLRASYRVSLALVLVAFLASLLMEWKSVKKANNGEKKEVMVAAI

SEQ ID NO: 36900 - protein, 170 aa, A.fumigatus
STADMIPRILRLIVLAIWSAEAVASPVRSSDQDHSNVNHGKILTHEPEYDPLWEKYGLNKSQEFKYFHEPGNDDILGHYDTRFFTEPVPDKERSETMTHMIRAYLNFFNERGLETWIAHGTLLGWWWNGKVLFAPRSLGTVANAGDGGVGSTLGLGHRHTSAGYHPAAPG

SEQ ID NO: 36901 - protein, 93 aa, A.fumigatus
FSPSECNTPPAFISSTADSLLSLYHSLPCHPYHQLAYSSFKWIISLGAPPFWENGGELSDQPLGTDLDHCAIAMLPTFYSNYLFSDLTSSSPS

SEQ ID NO: 36902 - protein, 150 aa, A.fumigatus
VLPWDWDIDTQVLDTTLLRLADQFNQTVVHYTAADSSVERSYLLDVNPWARQRERGQGLNIIDARWIDRRTGLYIDITGLSRLEPEKPSLWQDKNDHKYQTGDIYPLRKTTFEGVPAKIPFDYDSVLIKEYTQEALTSTKFHKYVSSGIF

SEQ ID NO: 36903 - protein, 105 aa, A.fumigatus
ALSSLPEKKILTALQSSHRRSLARRHPVCPPTPRQERLLRQSHPRTDPAAGPHRRRSTDPRHHLPLARLAVGRKQVPLEQFADHRPVRRLRRHGYPLCILAGQVG

SEQ ID NO: 36904 - protein, 288 aa, A.fumigatus
SIWTQSGREQGFEWVLTLSDGWRRQRSMIQSAINITSINKYQSLMDDEATFTVNALLQSPDSFHGEFLRYSYSVLTSSLLGFSVRSPSDPFIHHNETFTAELMNSFRPDCFPSNVFPVLRKLPMWLLPSLRTMERLRKEYVGEMWAFRRKIEKLVKEGSATECIYKHFLLHRDQYSVTEEESVHTFQAMIDGGTRSPHNNLLTFLFLMMEFPEWQKKLQEEVDRVVGRDRMPSYRDIPNLPTVRAIVKETVRYRSIVAEMGIGHCLQTDDIYKGYFFEKGTVFNAIFA

SEQ ID NO: 36905 - protein, 60 aa, A.fumigatus
PVSVTKSKDTPDVQSHVIAADATGLRDYGMWFGKDVPESLEAYASVNMCPTWPLRLEQNV

SEQ ID NO: 36906 - protein, 64 aa, A.fumigatus
KIAFRTKFRHFKYLIILFRLTNTLALFKRFIKEVLYKVLYYFIVVYLNNILIFLENIKEVLQEL

SEQ ID NO: 36907 - protein, 88 aa, A.fumigatus
FLSYRIPNTTLYCPISIILKFRYLIYPNITIRTGPNLIIIKRVPKFSLFRPIISSGTIFIFPRIPSFLIKARFIKLPITPKLIITLAN

SEQ ID NO: 36908 - protein, 463 aa, A.fumigatus
HNLQVTDFLSEHPGGAKIILKLAGKDATEEYDPIHPPGILEENLKPEALVGTVNPDTLPKIQAEPSPAVAEESQGQVPMEALLNMDDIEQVATKNVSKKAWAYYYSASDDKITKRFNTEVYRSIILRPRVFIDCTKCDLDTSFLGHKLGMPIYVSPAAMARLGHPAGEAGIAEACRSFGAMQIISNNASMTPEQIVKDAAPDQVFGWQIYVQIDRKKSEAMLARINKLKAIKFIVLTLDAPVPGKREDDERGNNVAASMPVPSAAKAADKAADGTPIVSQPGGVGKQLFAGTDPSLTWKDTLPWLAKHTDLPIVLKGLQTHEDAYIASLHTPQVKGIILSNHGGRTLDTAPPAVHTLLEIRKYCPEVLHKPHVWVNGGIRRRHTCGGTPLVWGCQGCNESDGLALWGLGTRWRSIVVKRSTAQVCSTPPGIIQKPGMLNFFSQSLAERKPKTSLPAAWVFHRG

SEQ ID NO: 36909 - protein, 165 aa, A.fumigatus
HTNSFTWFSHVHTHRLTLYYGVVLWYDSDVYQRRAADRYRLRMHRARTVALTSDEIVEVRAAQRTFEGAYVRTALSQFSFALVVLKIFTSEFYSTGALFAIYGTGVLIIGLFRRQQGNRQFFSELGEDGVPRHKFKTSGNAVLVLTALSVAAYATLIALTVRLGR

SEQ ID NO: 36910 - protein, 91 aa, A.fumigatus
RCANHDSCDCVKIKNMDKGGEMAQQEKEMTKSEELYPTGYLLSRYTLVVRLSKLFKATIFELYGVPIQSFGQEADVGAWGQLHQSRRVLSG

SEQ ID NO: 36911 - protein, 69 aa, A.fumigatus
KEQSRLPTNKYHRPILHMLQFAHASVLGFFALNRHPDQIKELSLSLIDLPALVLDASGRFRRLKKLQFF

SEQ ID NO: 36912 - protein, 165 aa, A.fumigatus
  UNSURE (147),(149),(150),(157),(158),(162): Identity of amino acid sequences at the above locations are unknown.
FLHLVMPSPAPLPPHFTWGFATAAYQIEGAVDEDGRGKSIWDTFCHLEPSRTKGANGDVACDHYHRYEEDFDLLARYGAKEYRFSISWSRIIPLGGREDPVNEAGVAFYNKLIDSLLARGITPWVTLYHWDLPQTLHDKYGGWLNVXKXXKDFERYXXVCYXRFG

SEQ ID NO: 36913 - protein, 245 aa, A.fumigatus
KDFFSSVPNLKRIFLCFATAVFSQSSGNLLVSNYLTQILKDTGLKTEFEITLVNGMVTLWQYIVAITVTLIIDRFKRRFFFLTGSGGVLVTFIVWTIAAQRYLETGSLAAGRLVLACIFVFQAFYTLAWTNLIVTYPLEIVTYQMRAKTWAFVLLTIQVSSIFGGYVNPIGLKNIGWKFYIYYCVWVAIVFAVVYFFFVETAGPTLEELTYLFEGQEEKKQLARKIEELKQDVHVSEHVEKLRGL

SEQ ID NO: 36914 - protein, 478 aa, A.fumigatus
ETHNATLFGASSRLSPFLNAGHGFFHRKVLLAPKPLLRMSESLLATRRVAFRLSPRSYRQLVPRARQHSRIATAAVEPSTTSHDTTYPLNPSSPSSPSARWTALRSARPFSDFLTDGFNRQHDYLRISVTERCNLRCVYCMPEEGVPLSPPAHLLTTPEIVYLSSLFVSQGVTKIRLTGGEPTVRKDIVPLMRSIGELRRNGLRELCLTTNGISLHRKLEDMVEAGLTGVNLSLDTLDPFQFQIMTRRKGFEAVMKSIERILELNRAGAGITLKINCVVMRGIYDREILPFVELGRDSPIEVRFIEYMPFDGNKWSQGKMVSYQEMLAMIREKYPSLEKVVGHKNDTSKTYRIPGFQGRVGFITSMTHNFCGTCNRLRITSDGNLKVCLFGNTEVSLRDIIRKENDGQPIDETTLKELQLLESAEAAARIQDQGGEVNQRERELLDLIGMAVKRKKAKHAGMGELKHMKNRPMILIGG

SEQ ID NO: 36915 - protein, 190 aa, A.fumigatus
DWSGTTMLIEGLDSEYHRNTTSANIPLHLLPLHTSPFKLQARHYHKRSNNSAPDSRPEHKPEPAPAAPSSPSPSLPTTSDPDLPHLTPSQTVHMTQITEKPITARSATASCLVHFSNARPHELLRKGLTKKGDVFSVARIAGIMAAKKTPDLIPLCHPSIGITGVEVDVTLVDPAPLSSPRGWKDPRWRN

SEQ ID NO: 36916 - protein, 198 aa, A.fumigatus
  UNSURE (158): Identity of amino acid sequences at the above locations are unknown.
SMTNGMQVLQSWQDRFGHPTGSKLGFFGAANAIGGVIPFIFLGWIGDKFGRRLPTALGSVIIIVGVLVEFFATSLDMYIGGKIVLGVGSSLIQMGAPVLVTELSHPKERVQITTFYNTSIVLGYVIGAWATFGCYRISSQWSWRLPTLIQIIPSAYQXWLHLGLPRNPPRWLIAKGSVAGKHARFWSNTTENVIPPPS

SEQ ID NO: 36917 - protein, 97 aa, A.fumigatus
EDASKSCNFEPIYAGAPTCASSYTVLYPLKDTRALHTMAPAAAHATDGILSTIDLKSIPSFWRRKNGILLYFLLTSSLLASAALGIDGVSETPVSRS

SEQ ID NO: 36918 - protein, 316 aa, A.fumigatus
ASDSAMKEDEGRESPLLNHYGPDGRESQSLLSGPPTKETNGTTHPFTNSPPLTSPSAPPGSHQYRSSISQPAPDGQRRPRTMNRVRFDIEEESEEESLPNGHPRDSEDSWLEEEDYARPNTSRSGRNGRGQMVPLLTDIEAPSVTLATSDDFFPEEHLENARPRSGMRMAFMNMANSIIGAGIIGQPYALRQAGMTMGVLLLCALTVAVDWTIRLIVVNSKLSGADSFQATMQHCFGKSGLIAISVAQWAFAFGGMIAFCIIVGDTIPHVFSSLFPSLRDMSFLWLLTDRRAIIVLFVLGVSYPLSLYRDIAKVRF

SEQ ID NO: 36919 - protein, 70 aa, A.fumigatus
LAKASALALVSMLVIVVAVITQGFRVPSESRGEVKNLLFLNSGFFQAVGVISFGKFALPKGPEVLMSNRP

SEQ ID NO: 36920 - protein, 72 aa, A.fumigatus
PSKDHNSLLIYGSLKKPTMDRFAKVTHYSTAVSLCMCLAMGISGFLFFGSKTQGNVLNNFPSDNVMVNIARL

SEQ ID NO: 36921 - protein, 132 aa, A.fumigatus
HQIVRSCFGLNMLTTLPLEAFVCRSVMTTYYFPDEPFNMNRHLIFTTSLVVTSMAMALFTCDLGAVFELIGATSAAALAYIFPPLCYVKLSNASWKSKVPAYLCLAFGITVMGVSLLQAVAKMISSEFGPRR

SEQ ID NO: 36922 - protein, 668 aa, A.fumigatus
LFTDAAREFPGDSWEAHEANMVANAIMDAFIAGHGSRDSIKEARRIAQKYLGDKVDSSDVYETDTQPIVYAIGHCHIDSCWLWPWAETKRKVARSWSNQCDLMDRYPEHRFTCSQAQQFKWLEQYYPSVFDRVKRWVKKGHFQPIGGSWVEHDTNLPSGESLVRQFIYGQRFFESRFGERCSTFWLPDTFGYSSQIPQICRLAGMSRFFTQKLSWNNINNFPHTTFKWVALDGSQVMCHMAPSETYTAEAHFGDVKRSVTQHKSLDHDNTSLLVFGKGDGGGGPTFEHLEKLRRCRGLSDKVGLLPRVKMGDSVDDFFTRLEQKVANGTEFVTWYGELYFELHRGTYTTQANNKRNNRKSEFLLRELEYLSTLASLTKTNGEYNYPKNDIDDMWEGVLLCQFHDCLPGSSIEMCYDDSDKLYAQIFETGERARQQALEALGFPDNSAGKSLVAINTLPWFRSEIVKIPDEFVALTGSRYALARGDPGLIQCQVLDAKRKPTVTVAEIRPGIFRLDNGKLRVDVQDGVITSLYDLEAEREVIAKGGKAGQLVVFDDKPLYWQAWDVEVYHLDSRKELQAGKTSIAEEGPHRVSVATTIQISDQSWVKTTISLAAAVDDQPSYVEFESEVEWQETMKFLKVEFPVDITNTEASYETQYGITRRPTHYNTR

SEQ ID NO: 36923 - protein, 211 aa, A.fumigatus
FSNRNSWDMAKFEVCCHKWADLSEYGYGVSILNDSKYGFATCGNLMRLSLLRAPKAPDAHADMGRHHIRYAILPHAGPLDARTVRAGYNFNSPLILRRCSGMQSADVFRSIAVRGSQSLILDVVKRGEDDEDVSRGELPKRPGKSIILRIYESLGGRSRGTIHAKFPVKEAWKCNVLEDNEERLEVCKGEDDVAVKIELRAFEVATYRLQL

SEQ ID NO: 36924 - protein, 431 aa, A.fumigatus
SVLLPQTGSDRDLPAPLNFGANPAADSPIKSHEEIPVIIPSNSAETSPQDTESDRLRKEIIRSLSRETTPSAETEQQASNKAQTARQDTETSLPDSLIPSEYEKYWSEQVESSPQDLRPPAAVYGASQNVPQQDLYTSSPMSASAPTAPTQPTSEPKLNRRFSWESSSEEEVPPVDLQAASPSAIPISGQLPEANDAAEPAPETAANESEVATDRGPEADVQQTPEKPKLTLVTPAAMENSRDSNENYLPEVVNRQSLEERSPLPEPKMPPTVEPTLLGFRDIMGIQSSDERVRAFDRTRDQFATIDTGLKNWLQVVIRAHPEHMDVVEQSRKASSIEPKAVVSKGKFPKLSSLGHFTSSNQDGHPSGPGHARRPSAPLGSIMNKQQVEQRGKDLLHTAGALGGRAGEAAKGLFAKGRNKLKRGESEKVDA

SEQ ID NO: 36925 - protein, 99 aa, A.fumigatus
LPHDYQIFLRLNAERPCVEVCPVCKSSRYLNPDMRFLINPECYHKMCESCVDRIFSSGPANCPVAGCHRTLRKNRFRKQTFEDIGVEREVDIRRRVMSM

SEQ ID NO: 36926 - protein, 290 aa, A.fumigatus
AALMSFSLNRREEEFDSKRAWDDFLEQREEIIANLVHGTDVAKTEADLQKYAQENMNSIRANRALEVQEATSFQEQQTQEQELARIRREEARQEYENERREVIAGREDYLARLASGKPGDAATIARESHKVLLKKSSARRSEEERIRQKQAALRSSELKKLGQAATTADRAGPADTGLIKGLKKIKTPEPEKAYDPFGGFIPNKRDYYTLRDHYPSSYLDPIRQDTRMQAGGYDLREYYSRTLLEAFAGLGCFIDEEVSKRDATSKLANAKPVATEGAAMAAVSSSKVAT

SEQ ID NO: 36927 - protein, 482 aa, A.fumigatus
PSSGCAAKLWISYRANPSPSRSARDSSICSEQVNNPQPPDRIEHIRRQLLETTDWAAVRAAQPLKISFTPVEEVEHFGKRRRLTEADRTRIAAVENGAVPYEIPKSRRAPRQNISSDRLGIEGLEIKINGQRCHTGESILKERHENFSSQPMLLDGDVSIRPDQGSDPSVQPYSDAKAWSAKADSVDRSLYCQRKSAYPKSSIHSIAISRSRLSGAAIPGRIPSSRNRSELIQTSGFSGQDLGASILAPQRHHESNRVHQSSGSIIQNRFTIDDQIAAEKGRCSNDGIIITTRPDRHGGPQLEQRPFSQSSQYSRSLGQSFGHHEHEHAAAVTRSPSGWLPEPRYSIRRPLSQKVNSLYSLGPDTPCGNSRARQCASPMVIFGQPIDVARNQASNGTTDWMPTPWNSAVKEPKVTPLTEDSHATSIYGFASQSPDNTTDTQGSSQISHTGIGDNGRINIIDRIYTGTPILATATLDPCAAFL

SEQ ID NO: 36928 - protein, 91 aa, A.fumigatus
EFLTWVTSRKYPHFDQSEIFSLQDAFRKLDVDDKGYLDEATVIKATQQSERQPYDVVRQALKEVDLDSSRRVELEDYVDVRVCIFIATGTM

SEQ ID NO: 36929 - protein, 235 aa, A.fumigatus
KSIQQLISRLRSTPAQNRATAGPSAAPGIPEIGMGVARHVSKGSVGGRIHVQGSSANVTHTINEDERTEFTRHINAVLAGDPDIGHLLPFPTDTFEMFDKCKDGLVLAKLINDSVPDTIDERVLNKPGRKIKDLNAFHMTENNNIVINSAKGIGCSVVNIGSGDIIEVREHLILGLIWQIIRRGLLGKIDIKLHPELYRLLEDDETLDQFLRLPPEQILLRWFNYHLKNAKWDRK

SEQ ID NO: 36930 - protein, 156 aa, A.fumigatus
CSSLTCHRVTNFSTDVKDGENYAVLLNQLAPNLCSRAPLETRNLLERAEQVLANAEKLNCRKFLTPSSLVAGNPKLNLAFVANLFNTIPGLDPITEEEKLEVEDFDAEGEREARVFTLWLNSLDVQPPVNSLFDDLRDGTILLQAYDKVIPGSVNW

SEQ ID NO: 36931 - protein, 72 aa, A.fumigatus
RFVVLKKPIEFGMKLDINFSQKTSPDNLPNQTQNQVLADLYDVAASDVNHRAPNSLGRIDHNVIVLSHMECI

SEQ ID NO: 36932 - protein, 133 aa, A.fumigatus
SLISIFPKRPRRIICQIKPKIRCSRTSMMSPLPMLTTEHPIPLAELITMLLFSVIWNAFRSLIFLPGLFRTRSSIVSGTLSLMSFARTNPSLHLSNISKVSVGNGSRWPISGSPARTALICLVNSVLSSSLIV

SEQ ID NO: 36933 - protein, 71 aa, A.fumigatus
PGLRFSPLNRLTITDNDAIINNHALRSVYLPPPSCSWTLSLKLEFCFNIELIIYEQNYSVYRISPLCSIVR

SEQ ID NO: 36934 - protein, 68 aa, A.fumigatus
GSDTVGDHLTPGPTCRPISLTDFQNDQTSTAHNSTNITLIKAALEVIKLLELGELINYTFFANKYGVS

SEQ ID NO: 36935 - protein, 171 aa, A.fumigatus
VDSNSATLASSSVLVDSNAATLESSSSFVEASSASFDSSSVTLESNSDCRASCFSCSCCFSFSYSVFIVVCWSSNSFSRAAKASGAAFSSSALISSNSSINSCLLICKSFRPLLLLTFQFLLVRLLRFFDVRLQSSDLPFQFRLRLQELLVELFRLRQALFNVLPLLLEVA

SEQ ID NO: 36936 - protein, 207 aa, A.fumigatus
GPYLRPTPRGSIDPHYVSAYQAIRDMGLPNGHGVNDRGTISPPQEQHDEPLELLQRIQEAIPDINRLLDGYKNTKSKLAAREAEFKQMETQHEQALMHKDFYIEALQNQMRKAANESAEEATKLKNTINELRMELGNLEEKRKDIEESLAEAEKFNQELLQTKSELEGQVATLKTNIKEAQEAHEQELERQKEERAEALANQKARVD

SEQ ID NO: 36937 - protein, 311 aa, A.fumigatus
DVGNAINVPVLIRISKSSLDCFDQLSRLIVSLSKEHFTYLPIDPPKDILSKIPPELPSFLDNTPASRELRSAYVQHVISKTLTYRIFQPFLFTLGRRYDKADTFFQMLSMDIRRKSVRREAFWRQQTLKAAYTTSDAKQSINVVAAVIVDEIIDLIKHFADPRHLDSLLIGVRKIVKLAAETWRLARVERELIIASLPAPDAEAVSNDSWDEYGAPKERNVSLGNDPSRHVILRTFPQITREAAHEDFAEDEEKASPCTYSRGTVLYSDSPVVMARLQELAKKSTETLASGEDSPRRGSRGSLRSVEVTAH

SEQ ID NO: 36938 - protein, 240 aa, A.fumigatus
RRTSKKRRRRTSKNWNVRRRRGRKLLQIRRQELIELFEEIKAEDEKAAPEALAAREKELLDQQTTMKTEYEKEKQQLHEKHDALQSEFDSKVTELESKEAELASTKEELDSKVAALESTKTELDAKVAELESTQAELISTKDALDAKQKELDQKEQRWTDERTELEARISAKCEELANCERENKKLEENNLLKEQQLEHAVEGMRATIDNLGKDCDRLRKTLHSLGEATDLKSTKGDSFL

SEQ ID NO: 36939 - protein, 138 aa, A.fumigatus
ASGSRNRADHQTRFDFYFKSCSAQPATMPPKARINSKNSVEQEGRVLLAVSALKNKEILNIREAARVYNVPYTTLQRRLKGHTFQAELRVNGHKMTQNEEDSLIRWILSMDQRGAAPRPSHVQEIANILLAQRGLTPT

SEQ ID NO: 36940 - protein, 76 aa, A.fumigatus
FSRRYNHQCAKCEDLKIILEWFNYIQITIMQHGITLEDIYNFNKTGFAMGLVATTKVVIRAKMLSQPFLIQLGNCE

SEQ ID NO: 36941 - protein, 94 aa, A.fumigatus
FDQICTENDIILICMPAHSSHLLQPLNISCFSPLKRAYGCLIEDKMQLGFNHINKFDFLEAYPQACTAIFSADNIKSGFLATGLILLNPDWVLS

SEQ ID NO: 36942 - protein, 217 aa, A.fumigatus
FHPYTIVIMLRRFSSTFKKKGDRESKQNGTASSSSAAVANTNNNDNKRHSKISAARKSSSDDDRNEKKGNSVSPFEKYASVLHASRSPIPNQTGDGAYLEHEHTTSLLQDARHLGFKDFKTLKEVIESKLPGGQLIDDKTMLMERIIQVRWPTANTGRLDQNAETIFTQLVAGQQASSQLKASRGANKRLPYGAVGFVASPSSLVSLRTTSTLGGVC

SEQ ID NO: 36943 - protein, 61 aa, A.fumigatus
YLAAAEIGGYFEPLKHDFITKSSYSCAADIAIAYGLEYGSHCSVGVPIEGVVLYLLPALEG

SEQ ID NO: 36944 - protein, 66 aa, A.fumigatus
IQCKPYLSVRGPEAGCQEMHLLVKLNYSHHIPRFSLVQGSRRSTLSNKDVQQLFVPAGYAFLSFTI

SEQ ID NO: 36945 - protein, 524 aa, A.fumigatus
FVTAPEMSPPAVSVVISPPTVDLDSYEPFDGQYTRTVDEILSDEPSFDASSDACNSGISMDGSNGSLQRERAISRASVGKRTGPKKSPYFSTGQMSQRRIGSKRSITRIDVDEDDDEDDDDDDDEDEDEDDITPATSVESVKIQVVDNNIEDEHHDNKTYAKANGNAVDDDIAEEDIVFASVGPEMQARLLNFIASHSFMRNGSYPVRRSKRRTFVCELYEQAKSTGMDEYSIDRLTNYVRKTYLELYGKDYVDTQGSEFGDEIDDVGGKRRRSLNDSKKDRKRKRLNGDAAKQKHKKSRSQSSQEKRTTSTADSHNNSKREVIDLEAEYPLADFSASATEPEGFESKSTAEELPRRRPSISKQSGRSSNDDRSNDLSLITPENRNNKASVSIPSRHSLRSPANSKDEPIFLESDSDGPRDSATAVPKAHSTNPIHSDKPTTREESIARAKKEKNHRKRRSRRRKRAERYRENLKDSQIQNLAAEDRHIEEDATTNKFGQKDSGDIRLEKDVLILDDPFWALDF

SEQ ID NO: 36946 - protein, 109 aa, A.fumigatus
PFLGSGFLSTDDSQSVTASDEVTSKYFTSPQQVDGLASSVPSQIPTTYFTSSVRDYEPIPEKARQKYDEVGLSFDMLASDSESDLSDVQSDDGHLDHDAFLRDVIQRPS

SEQ ID NO: 36947 - protein, 77 aa, A.fumigatus
SFINTTNKRTKKGEKWILIFNSHGSYLTVKFLQLYKDNSIILFRFLPYTTHLYQPLDGKPFLSYKQHFYYINNKLSY

SEQ ID NO: 36948 - protein, 63 aa, A.fumigatus
  UNSURE (32): Identity of amino acid sequences at the above locations are unknown.
LRNNRNSRKDITFKAFIIEMIFFIKMAGSRVXRPYRLRLSLTKPLRRRGQLIYARFLKAMESS

SEQ ID NO: 36949 - protein, 525 aa, A.fumigatus
  UNSURE (514): Identity of amino acid sequences at the above locations are unknown.
LRDGVLAGSNEGSKSNLQRGESLIFSCYPCLPALSLVTSDSKKLLNAQRRKGDIRPSSTVELDLHADPLGPGPVTTSFLSFPHRRLSQPGTSGGHDDYAERNSVVSRLLRGLAGSHGGSFRDTDADVLPSPTNPTEHSDNLQEDRGQDWKSQGPHQPSEARDHVPSIGPRAASGRLIEQLEAVSARRLRAREMRVALRYKREDEGKHRAALMKRLNLLLAQDHQLTDLIEGLESATESYLDLEQAYHWMEDELDQDEYALIQSMQRFAKSMRESPPGLSKITIQAECNASDDSARSLHDEPLEYPPAVFDYLSRVGDARILQERLVELDSQWYTIVDKQRLRSSLNIALDEESLQFLRSYDGSKTQIRKELHETILDIVRLQALCNEQGLRPEEYTGDMDFPYGMGLGEVAFQPEDPLKTSAIDDPSPFYESGPAKVSSAMFINKWLLHQLRHSSVEISRLKAAPELRQLSDEGWDDANISRLALTMWFSDDTVRNSPQTLSQADDYDYTGASXYTTRKEAIASA

SEQ ID NO: 36950 - protein, 64 aa, A.fumigatus
QLNISDSPLCRLDLDPSFDPAKTPSRNYNRSGSGSFLYAYIFWAQETEQKSEQKEIDCVSKSVS

SEQ ID NO: 36951 - protein, 375 aa, A.fumigatus
PGREDFRRSLPRYRTKIASQLRQAALVEHQPKQIPTRLAVSSMISYVHDRILTPEMMRAMIILYIGPHNRPDFSTDFLLSPVLAPESLLTRFPKTYFITGERDPLVDDTVIFAGRIRQAKLHQFRERQELGLEKSHREFNEKDHVEVSLLPGVSHGFLQMAGFFPDSWKHINKCATWIQNLFDTDEVKKSSSSLLQTLYDTSVDNKNLAIETNGKAGPRNHKRSLTGESSADEDRPLEMSIGRMTPLTPAHGNLDSNETRQSKEDMPSQKPYQFRREATSTADCRPGSKNGIRNRSSSRGRKDSSSGLGRRRRLAPTKLTLPVSDDMSDNLESPVRLRKRERSIHSLPSHEDLLDRRMNGLAGGLMGIGEGAQTP

SEQ ID NO: 36952 - protein, 382 aa, A.fumigatus
LTPGWDIRVYISAILGLSTMVVAFASSIFSAAMPAVMQIYGISREVCTLGISLYVFGFAFGPLIFGPFSEVKGRYMPLIVSMFGFTIFSFATAVSKDLQSLFILRYFTGFFGSGPLTLAGASFADMFSPEQRGIAIVMFCLMVFIGPLAAPFVGGFTVMNSSLGWRWTAYIPGILGGAVLLLLVVFLEETYQPVILARKADRLRRETGNWALHAKHDELRLDPRSILTEYLSLPLKMLVLDPIVTCMCVFASFVYGLLYLFLTAYPTIFQKIHGMNPGVGGLPYLGVIVGQLLGAVGIAATQPWVLRKLEQNGGVMMPEWRLPVAIPGAVAFSAGLFWLGWSGYKQSIHWIVPTLSGLLTGFGLLTMFLPSLAYLVEARPQK

SEQ ID NO: 36953 - protein, 275 aa, A.fumigatus
IATADPSSPVVKTSWNKGTTPYLWALQKLVRPRLTSYGPRAIRIPRPKQSIYTEPTNAWLYFDGPLSALKDQTCVILDIPGGGYVAMNPRNSEDRLLAWAGKTKLPILSLDYKKAPEYPYPYALNECYDVYHMIITTRGRCLGLSGVTRPRIVVTGDSAGGNLAVGTVLMILQSGTEDVMPRPNGLVLAYPSLNMRVESWMTEEQMSLIQDKSARRTNKNILQRKNMDYQRLTPFASPGPSTEELRQEFLSDAGLEAGDLGEKTFEEACRDIEPR

SEQ ID NO: 36954 - protein, 136 aa, A.fumigatus
VSSRNTTRSSSTAPPRIPGIYAVQRQPSEEFMTVKPPTKGAARGPMKTIKQNMTMAIPRCSGENMSANDAPASVSGPEPKNPVKYRRMNRDWRSLETAVANENIVKPNIETISGMYLPLTSEKGPKINGPNANPKT

SEQ ID NO: 36955 - protein, 112 aa, A.fumigatus
GILSRIQPSSCLGKGKVSADGRLVASIKAGDLTLFSEHLSPDQGIMQTLYASPANGISTTQQAYRPLQGEIAIKSGTDAVPGQDRNVYTWFDHPFHRTGKDLSNVMQLWLRD

SEQ ID NO: 36956 - protein, 197 aa, A.fumigatus
DRLSSVQYNGKYCTLLTSLLASGNFGTPITAALQHAGFTVTIITRSESKATFLPDIPVITTTYTLENLTSSLAGQDAAVCVVGPGGIGAQVTMIDAAEAAGVKRFILDDFGWGDNPKSFPEFNAIHAQRRAGWDHAKAKAESNPNFTYTGISIGNPIDWVSDSTGSHTLASQLTSSQGVEALPCDGVRYSALLGRHL

SEQ ID NO: 36957 - protein, 93 aa, A.fumigatus
CSYGSGTDDTPGPVIPFHGCCFEILTRVLTGSTDSSTIDMKVLYNVMTELSNESSSALRLNYGDDIRRAQGRYWECIPGAEASSNDQVASSSN

SEQ ID NO: 36958 - protein, 199 aa, A.fumigatus
TMATTFGGRKAGTGSASPAQRQAATIKSHRPQTDHLQYCTIHPTETSGWDDFLKTDMTTDSKFKRSFWQFDFKGRSPASPFGKLPLELVYQICSYLPGDSLKALTQASLSIQVVTQDNWFWKRFIQWDMPWFWEFYSSQNPRDLPADVNYKRLYMWLDKMTAARYGMDDLALIGVANRRRIWGVCEELASQYHKAVAAS

SEQ ID NO: 36959 - protein, 68 aa, A.fumigatus
LWIESRVPTGSVSSGDAMEDEVEILTGDGVIYLCSLNRVECIYYYQAQWSHLDSVVTHTQVENSKRFR

SEQ ID NO: 36960 - protein, 61 aa, A.fumigatus
  UNSURE (1),(2): Identity of amino acid sequences at the above locations are unknown.
XXDVIFHRACRAFILYRQHYQAAVVAQNPGLANPDISKIIGEQWRKLPQETKDEWKALAEV

SEQ ID NO: 36961 - protein, 496 aa, A.fumigatus
  UNSURE (445): Identity of amino acid sequences at the above locations are unknown.
PSSQEEKARHQQQYPEYRYQPRRYGRDGNSRATGSGISHSPPGSAVCNRCGGRVMTPPVSPDAPFTPSASAASPHPDMVMARSYQRRARDSDRQPNPIRVDNHGDSCPPRQIPYEEAGCRSPDSKRRRFNSQVNLKPNVHRDRSPESAYPMSPYTPRTDGPNTRTLNQIVHPSRTARYNRDHPPHDPSLKLPPLQTTVPLPGSVMPITPFPHDGLSLEATVMTIPFLNKIKVLAKISPPLIPSFRDNSIPQRGVVIAVDGQDPAQVKAVVDYLNAVFQKEGKYKPRVFEGPEVRSRESYSAAGQMGDATVDYLNTISVWHRISDDIVSFVKPTREPSESKPEDDDSASEISPKTIIPKTAGLKISSPAQSSENGSESASSISGSGLSPVPIALVPRYQLTNADAFACSVPINDSYAPLDHWQWMASLWRACVGADITVYIRDCEXDELGRYGGNPVEVRLQDARTVVVRRLAGSQKELEEKALKRVCFEIEDFLTQ

SEQ ID NO: 36962 - protein, 98 aa, A.fumigatus
HSTIFQVYVPTVFENYVADVEVDGKHVELALWDTAGQEDYDRLRPLSYPDSHVILICFAIDSPDSLDNVQEKVNDSPGVPFFHQGRKGEVIHARIHRG

SEQ ID NO: 36963 - protein, 63 aa, A.fumigatus
EFLNRILWMSSRTGNRWSKLYPPVSSLNLSPKYCPFTLGRDLELFIWGISFSDTSHVSTNIIL

SEQ ID NO: 36964 - protein, 87 aa, A.fumigatus
PKETLGIVAGQELPRRGRCMHYGKSYRWFRYFPSLSCKFLATSFTYSFNRFSCCAKVFPCDKYVSPSQEYLPEFATAIGCNPSLILD

SEQ ID NO: 36965 - protein, 75 aa, A.fumigatus
VPRRSDRSSKRTCKSHDLVSTYISSGGNTFLHLLVVSVQENKSTAPRTAVYAVQFSSEKQEAVSGKEERVPGTRF

SEQ ID NO: 36966 - protein, 345 aa, A.fumigatus
  UNSURE (40): Identity of amino acid sequences at the above locations are unknown.
LSTCHSGLGMEPVTPVTCKTMPKFPNHIMQMGSCSNHQQXGLDFDIIYGPVVVEVMIKLFFTPIAVRYLEVEQAGMVTAYLHAFLEKCAIHMRQPTGSEQKWNACKVLKAHYRLRQSAFLWDEKFDDRIALIGFKRVVEDPCVYQRGDDDDAFLLIYVDDTLLTSATTAGIKRIKSWLGSLFLLEALPAGRRPTIVRGWQPLSDSFVAVRSLSSRYLAILSLSSFLFSSMTWRVVNDLPLKTMPRFDCGRNCVLRLRARSSPLEAGAPAFRCSVHRLVSKRAHGPDGRESAITGRSSSHVSNGNDWIRVLFSRAFYLAQETTLQLAIGLYYTSSKSYRRDATMTC

SEQ ID NO: 36967 - protein, 205 aa, A.fumigatus
MGRPGQQHRPQYPAQTPNGQTPAIKQEPGYSSAPQPNMTNSQTDGAGADALSDWKAEVARRREAAERQNGEGDRFLREHLRQRMLQFEGGGLLMPLDERQSSSSTSRRERHLTDAHSAVGINSIANSAQPQAQFDGPGGDDDREEDDEDAINSDLDDPDDLVAEDHDAEDSVGQVMLCTYDKVQRVKNKWKCTLKDGILTTGGKE

SEQ ID NO: 36968 - protein, 104 aa, A.fumigatus
HGHNNQQLHDNADGTFSIVNPETSTPYPGTLGMEKEKPYRCEVCGKRYKNLNGLKYHKSHSPPCNPDFQLAAGRNLAFGGGVMQGQNINVAGAGLPGIGEEGLL

SEQ ID NO: 36969 - protein, 390 aa, A.fumigatus
LDLPVRFRPSPSFHSSSHLPKLEANFMRDFSCCGITLPTLHDLLQHYEEAHATKSPQQSHRPSQTDGRAALAAAAMAQQQNQQMNNQSRGLQADRGGDLQRKLSPNPQLQPHSDLDTIDDMELDDAMGDSDPTTSQLFSSQTQNNTQNGFGNSNQRGPQLNLSMLPSHQGFKGSQPGTPVPSGHPLSLQNNPTVSSVNTPTLMANPLQNSQFRNTPDSSAPGTPAELDENVISGFGDLGMQNNALLQGQSQFRFAGNNDMVDLCIDEPAKRLFSPTGGINTSNAHFKLSGAQYGPNSEIARRIREQQLLAGVPDTTALLPNEEPKPFRCPVIGCEKAYKNQNGLKYHKAVSDSVWKVTVWYGALVANAFACSMVTTINNCMITQMVLSRL

SEQ ID NO: 36970 - protein, 78 aa, A.fumigatus
DNSPHQSIAAFHRAFHRDISSLELEMNDHDRFSQSSYGDPRYLSSASFEAPPAKVLMNGYRETFEPQYAEKLRYNPVR

SEQ ID NO: 36971 - protein, 142 aa, A.fumigatus
LPSAPSFAVWSHGISVDLSVSQASKMPAGHYAADSQDGILSPDPLSMVTVYKVYKRRFWGLAQLVLLNIVVSWDVSALFEQQTQSQNLANVYMILRNSVAHLFFYIHHRIAAFWCLRIRHQLVEHWLSLCLLRSQSSRHPHS

SEQ ID NO: 36972 - protein, 78 aa, A.fumigatus
TVRNYSADETVVLCDVLTQPIGSMKIASGAEYLIPQVASEDSVSSLIYPTVDHTRPLGHFIWSVVDSEHVHYQYITTY

SEQ ID NO: 36973 - protein, 69 aa, A.fumigatus
ETQWLTFSSISTTASQHFGVSESAINWLSTGYLFAFCVASPVVILTLNKGGPKPAITITSASSHAPGRR

SEQ ID NO: 36974 - protein, 124 aa, A.fumigatus
NTRDFPGDKWRKVCGKEISFQGAEDPRVRRNLLHFGKKGWGETNPVSGSRPRRVIRENLPPALERRLNTPKDRLNPWATFSGEMENPGGGGAICRHFFGRERGKLAERIPLFRGHTAVVLDTDW

SEQ ID NO: 36975 - protein, 158 aa, A.fumigatus
FLRRKIGHVLFNPAAENILATASGDFTVKIWDIEAGASKLTLNLGDIVQSQAWSANGSLLVTTSRDKKLRIWDVRQERPAHETQGHSGAKNSRVVWLGERDRVATTGFSKMSDRQLALWDIRAPREPINGFKTLDSISGVCMPFWDDGTQCLYLAGRG

SEQ ID NO: 36976 - protein, 83 aa, A.fumigatus
SKQASPVVPERSTPTVPTPTTTTPPPSAGSTLQAGAAVAADAVQREVSAIKDLLAEQTKIIASQAEQMQNLTAEIESLKAKLG

SEQ ID NO: 36977 - protein, 435 aa, A.fumigatus
WFPAGHHLSRQEAADLGCSSGATRSRNPRTLGCKEQSCCMAGRARSRCDNWFLQDERSPAGALGYSCPSRTHQRLQDSRLDLWCLHAVLGRWHPVPVSGWQRVSGDSFTMFSRHGSVLITTSDGNIRYFELENDKFEFLAEYKSADPQRGIAFMPKRGVNPHENEVTRAFKTVNDSYIEPISFIVPRRSENFQDDIYPPTVGLKPAMGPSEWFAGKEAIPPKISMASVYEGEGLKEVTGVQEQPTPTTSAPEPKPAEPVAAKKVAEPVPTPAPVVKPEVSMKEQGASMAAMVNKFADKEDDAEPVDDDSSFEEIPKPTERAARSADNASPSIKTSPWQQKEEAKSQASPAPVSLFPLNPPQPRTNQNRPLPSSPNEAPLPCPPLPPQLPLHQQARLFRLAPLLPRTPSSARSRPSKTCSQSKPRSLHPRRSRCRT

SEQ ID NO: 36978 - protein, 126 aa, A.fumigatus
SRRKSRRISVTDKESLLAMYGSHSHSHSTGPPHSSPSQPEWRLPATTQHQHSSWSAGSVAPPPPPSPSAPTAAPPYHPNTYGSISNISPGTGGAPVFGAPSGPNTTSWGVRYKHQVLAPPPLPVSI

SEQ ID NO: 36979 - protein, 153 aa, A.fumigatus
SCASSVTDSRLPWPSQASTTTSSWVRLTASVLRESSAVDNRRFTSIPASYCASTASPSTSANSPELPDSTHTVRQPDMATAEPPCLRRISLQSNSSGIVLLSLSTCDRTQLRASSKHESSTSRPTASACRATLVPDLAKRAWNRSASTTQDWS

SEQ ID NO: 36980 - protein, 793 aa, A.fumigatus
PRFPSVTEHQHHNPAQVRSPTLGSPGHHKPPPPPPPGYGSQPPSFENHQQWTTGASHPSQQATAPLPPPPPPPPIPQSYQTQPTPLDNQTWQQPNHPAYAGFPSSQTLQVSSYSASAHATEPSSGLPQSMSPPPPARQLPPAEQPWSQTLPNEHGTAPPVPPKTGPNVFPANHGLGPGTPSDWEYLASTPGAGVGVETPERKQNHPIHSSTVPDSLPSQPASFTPESSNQHTVSTPPTTTSPSAQPAYPQQHHDSGSPVSPSTTPDMRDPPRPVRVNSSGTECSIVSATEASESIDGVIEAWNQPITAQIKSTVEESRESLASGPETRSSTQGSSPVDITQQKQEFKVPRKEVPSRSATPASSSAAGETSGGRPNTASPQPKPQDPYEDLDSWSKSSLARYVAMLRKEEVADSDEERFKIFTAFMAKETKLREILYNIEPEQNKNQDGPQSLPNRHDSTSPPVESGLIPVQSAEGYDAEIASNDALGESRDGRYSPGGRPILPQLHPPQTSGLHRSASQPNTFKAKVTRDFSSSAQNPISRATSVPPSMNDKTFSPLATNPPQPIYTPFRYTEGPQRGSDDLTFDRPAYQAYSALRQASAESGRVMSNAPNAPNRNRSSTVTSSVAQKDFDETFIGLIREKSVAYRNKTSPRASSPPPLPAAFTQGKSGSPIDDLRSMVSSPLAKQSESLWHVTTRRDLEKYSDDFNYIREAVNTWEASTKARREKTDRERTRRQEESEKHIDDLFNQKEIGYADINFLEEEFRQNEARVQLDEEQTGVGSSHTGLEGHAIGV

SEQ ID NO: 36981 - protein, 65 aa, A.fumigatus
GQTLPRFLDSGFDLCSDRLIPSFDNAIDTFRRFSRRDNTAFGAATIYPNRTGRITHIRRSAWTNW

SEQ ID NO: 36982 - protein, 766 aa, A.fumigatus
QVRFLWATLLLDCICMEQTDEAILQALESLPQSLSETFRRVLQQTGVSNIQHRRRIVQLVMAARRPLSVGELCEALSVIPGDTAWEPARQINNIHAALASCKCLIIIDEEEQTVRFAHHSVKQFFIARGDEPENLNPINPDETNKEMGRVILTYLNYGIFDRQVSRTVVPTMSAVDVPTRIVSSVFRDSVNTKRVALELLKTRKNGKCDIGQTLAETAMAQRRSPAESHPFLAYAKDYFRYHILGVWNCEKEMGQLWQGLLARNSLDVSIASVQHPELTHTDKSQLRITDWLQYELQQRRVTGLDGEFVPCDVLSQLVTYRVVRKVLEETGFYGYGASTLAHGILTDRQRWFAILVDIGINHYLGAHFQSSMIQSPLTDRDFPISSVQFLEKYKSNISQTTGSLTVPPGSNIPSSSRPVGPMETDRWMALAELFCLRQHQYLAPILQEGQHYNSEDGIMPFLPVGNFFYNHDYGSLVVEVHPAHHDFPPAYRGGEDVDGPYVVALWPFSKAMDEPPFLLLSQGGFWDVPWHLLRAVASYRPQQQSGILPFETMRLIFPVVGPSIADVWQQSLGTDMHSSRRFLRFCLSQMTGIAEALVFVIQNDPEEWYISLRKITPRSIQWCKYSRSTFQWGTLRLDLRTLIADPIERAPRQSEKAYRAPHEAKGKNGSKRDCVWRLGCIYFEFLIWAVMGSTGLQEFREARGGSNAPFYSQTDSDHHHPGFELSPEVCRWADMLLNEPELPPEVRRFREYLLRDIRPGGKDRVK

SEQ ID NO: 36983 - protein, 506 aa, A.fumigatus
MLTQSASYLEKISMLFMNAGRSAPRYQDMALLYPRSKRLRDALCEYFIVILNICKHAVDFLQKSPLSQFTSAISDSCLVSFEKDLQQWSVVIVEEVTLLSSQSLQEEARENSRFRQIMVKLSDSRNRCQQVALRIRILDACSTYDYQTSWKQARKQGTTTWFASTSEYQRWKGTPSSCALLCTGKLGSGKTTLLANVVDDLFCSASKGSVAYFFCRFDVSDSLTARTIIGCLARQLLAQQPIDLTKIDNFWNNSLADPDEQAIVKFVQKLLSVDPIYSLVVDGLDECPEKEGKMTLEILQQLQKHLKIRMCLSFRQDAGDHAKVAAGILNAQWTLPIPENNPDIDAYIDAELRERLESERLCIRNPAIILSIQHALVTGAQGMYVSPLHHCLNRLQSMTTGSDKLGFSGPHCYSTAFAWSRQTRQFSRPLKAFRKAFQKHLGEFYSKLVSQTSSIAAGLCSWLWLRDGPYQWGSYVRHSVSFPVTRHGSLHDKSIIFMRPLQVVNA

SEQ ID NO: 36984 - protein, 229 aa, A.fumigatus
LQSLFSLLVRPLDEWASARTQSLPLSALKGAVVGIDASHYISQHLLHHSTREPLLVALGGFPFALKTNIERELQSFKELGVACLFVFNGLEFGKKDQRPHVQTESLRAFEQAWELYDQQQADQVVDAFSGAGKTPFLHPRYSCLLVCADKTPPAPGTPRPESLYRFLQRILYQNGVDFIVAPYSAAAQVRKRPSEKLTRKGSVSYFSFLIAFLSCQGLQPRHRCGLWAL

SEQ ID NO: 36985 - protein, 74 aa, A.fumigatus
PGIFLNLNGSNYQKLLSSQDEILANVYWRFLQLRGYIDEKHRLTSWGVCLDQALSVLDPADILHAAAGRYTFPQ

SEQ ID NO: 36986 - protein, 160 aa, A.fumigatus
SWNVDGKVAPMDWENAPSDMHELIGQRLPEEIYFYLSKGVLGPEIPNYLTSGEVRISLPLGVEDTEIYRQTVSSTLTPIRTQSICLLSNSLHRFYQTKVINIRTWFDEKSDKSITLKTLPSVKETIQAWKIRSDQLPEGVKKLQVGSKCYLHAKYVFSDH

SEQ ID NO: 36987 - protein, 60 aa, A.fumigatus
SKAFFASPAEEKATCCISPNVCPTQFSTYIDRYMTLMLVACRIVAGQACTSKLSIQSIKG

SEQ ID NO: 36988 - protein, 74 aa, A.fumigatus
IKMEQTSTVGPPIELPIIDISNPNDPNVGKAMLDAAAKYGFLYVDSKGTDFAAEDVKRAFELVDCPRSTVHQIH

SEQ ID NO: 36989 - protein, 62 aa, A.fumigatus
DLTHILKYLTNDRSSRSSWSFIFRIRILTLPPGQLAGNLARTQQCTTNAILLSDSNQSISRV

SEQ ID NO: 36990 - protein, 65 aa, A.fumigatus
PKRGTCQPRSVKTGVAAYVTKDDAREAQRAESFVYGGQNPSGGMAAQMQVSGMAGWAWVIKLTNC

SEQ ID NO: 36991 - protein, 143 aa, A.fumigatus
IMRLWSVYHDHTISLYESLVNMLSLGLALLFSGTAALASRDTFYPPLNHTTFITNASYGTYGGIYTAPADSAGSPSADDVYNYCSMPHPRGETYSLPPPVANHSIKAKLVYLEYLQRHQRRTPYNILPGGEVIRRSTIAPTRR

SEQ ID NO: 36992 - protein, 317 aa, A.fumigatus
FAGLQLRRLVANFIQDQEYNCDSVDPHVYVAPASQHPSPVAVYGQTYSDPSNPYLATYANGTCQYPQLTLGGFLDGYQHGRDLRAVYGRRLGLIPPVPDQKRVWFRSSSSALTQGSAGAVLRGLWPEYHKPIPVHQQASAVDTVNRGFPCSARSALLSAIQSTAEWNEHLNVTQALRDELAAMFDAQDESAWTSNFDHFADNFQARLCNGYRLPCRVQDQTQCVTAAQANEVFRAGDWEYNYMWRRNANATRYIQVIEGLFIGEIVRKFEAVAEGASKLAYSHNFVHDGDISPILGALGITAMRWPGMGSNIAFEIW

SEQ ID NO: 36993 - protein, 60 aa, A.fumigatus
TAAFPERITTVTIHLKLNLFLSDSSFISVVRNQTNNTSGIDETEKAAEDRVCAVLFLTFY

SEQ ID NO: 36994 - protein, 70 aa, A.fumigatus
FFQEMLQFMSESEREGNSWRGNSIGPDDYSDQTQNQTKHVLFLFNKQRNKHGEKATVQRPKTDYYTLIII

SEQ ID NO: 36995 - protein, 83 aa, A.fumigatus
LSFNPGVSFTISRTEFSKRSMFDLHSPSLPRVFPTSGWEVIDPSLPIEEETIPTYRVEKFYPVYIGEVFKPSISSSGQIGLWI

SEQ ID NO: 36996 - protein, 295 aa, A.fumigatus
GLRIAIKLWLWFAFLSLYIFNIRIIIHRPHCWECSPGLSHSPSFVMSFPPIDPMSSASQPLSSPSSSSNPSGYIKSTSVDHAANPRTHTAHDPPSIRSCVTCRRRKVRCNKRTPCSNCVKAGIECVFPPPGRAPRKSKRPHDAELLSRLRRLEGVIEHLSGKKSGAVEPLCTVSSLSQQEPGSASPQEGRQTTPQTQGVQAGKCPFVLDSDPKAVKPRNLEHDFGRLVIDEGRSRYVSNRLWASLGDEVSVFRFNPQAFVLMLMATDRGAARHFGPFIVRRGRSSFAWILVDSVH

SEQ ID NO: 36997 - protein, 622 aa, A.fumigatus
CLWQQIEELQDILDPSSSEEEDHPSPGSSSTLSTNHDGFLFGYYSLSHSLRSYHPPPPKVPVLWDIYLDNVAPLIPMFHKPTVRKLLTDAAQNPNFLDKNSEALVLSVYYVTIVSMSPEQCFSILGDDRDTAVTRYRFAVEQALSKAGLLNTQSLMLLQAAVLFLIGVRREDDTKFVWTMTAVVLRLAQGIGLHRDGTNFGLKPFETEMRRRLWWHICLLDIKSAEEHGTDAQIQDRMFDTRLPLNINDDDITLDMQEPPEERVGFTEMTFCLVRCEITAALKRISSMCPTNLPHPENTQQPADSCAKLIQEVNKRIEERYTQHCDMNVPVQWVCATVARLILAKLWLIVHHPMTRKDPAAGNLTIASRETLFVTSVEIAEFTRLLGRDQTTAKWSWLFVTNMQWHLIAFVLSELCVRPLSPLTDRAWQVVSSLYETWGLTAKHRKGMLWRPLSRLMKRVAAFREQQQQQQQQQQGLQNTSDPSSAPSLFTPYHPGVWQSAVQPYLAGGVPQIRDLSVPGSVQPASQPIAGPTFDAEIVPELFPNVTWPALPDSQSMSAKDPLSTAAPIEISENFLGPTTTSQDPALQQNWEAWDQVMRDFQMDVQEAQTSHPLGNISDWLA

SEQ ID NO: 36998 - protein, 165 aa, A.fumigatus
ADPSLKATTGLILVPTRELAEQVQSVIIKFSAFCGKDVRSVNLTQKVSDAVQRTMLADYPDLIVSTPARVIANLGTSALSLENLTHLVIDEADLVLSYGYDEDINALAKAIPRGVQTFLMSATLTSEVDTLKGLFCRSPVILKLEDLEDEGAGISHLVVRYGLLF

SEQ ID NO: 36999 - protein, 64 aa, A.fumigatus
LENTWKSLTTANSSSPCFDWLLLLPLDRVYIISPGNGTESYSTSIHNTATNNVQLEGDMMLTAM

SEQ ID NO: 37000 - protein, 130 aa, A.fumigatus
IVEKILPRESHRPTEFLETVRMRKTFQPVVSYNQASFKGPSQRLLELCVVNMKRKLDANDVPSTEVEEEKNTKDADNTDFESLNLDPRLRQALIKEQFTKPTPVQSKAIPLALEGKDILGKHRASVCAMV

SEQ ID NO: 37001 - protein, 287 aa, A.fumigatus
FASRSAQAVVKTPSDKERAKADTVPASWPTQGRVEFHSVSARYKPEGPDVLRNVSFVANPGERIGIVGRTGSGKSTLGLSLLRFVHLTSGSITIDGLDISQIHLHRLRTSVTLIPQEPVLFSGDVQSNLDPFGEASETELHSALSACTSIQVHGSPAGEAGTNKPTTRALTLDTPIAANGENFSQGQRQVLSIARAVCRRSKVVLLDEATASVDHETDMHMQKLLRSMFPDSTIIAIAHRLRTIMDYDRVLVMAEGEIIEYVHPSLSCLSWVCSQRLTLEETIPPRI

SEQ ID NO: 37002 - protein, 98 aa, A.fumigatus
SNILFGLLTISQGSLHYAKAFGEASVESTETDAVHWVASCTKLVTTVAVMQCVERGLLDLDEDIANVLPEWDSPRILTGFDEDDNPIFWPATKPVTLR

SEQ ID NO: 37003 - protein, 209 aa, A.fumigatus
AERAAARAPLASPCSASSILPPAASQSTAWISARSTYIASAQASPSSRKNPSFSLVTSNQTWTHSEKRARRSCTLLYPPAPLSKCTAAPPEKRAPTNQQPAPSPSTPPSPPTAKTSARASDRSSVSRARSAAAPRSSCWMRRLRPWTTRRTCTCKSCYGACSPTRQSSRLRIACGRSWIMTGCWLWLKARSLSMFIPLCLVYHGFVHRG

SEQ ID NO: 37004 - protein, 162 aa, A.fumigatus
STRKTYRITVGCPITSNCDTALNSFEMAIPLPQVHSVVDCASFNRTVLPFLSQLTTLPAQLQVAASTKDVDSLKDIYLSTNPFISALGFTLVLWVLFAVAAEFNRNYSQVDRFWSILPSVYTVHFVAWARLWGIKNQSLDTIALITLLWGVSILKRGLCICR

SEQ ID NO: 37005 - protein, 134 aa, A.fumigatus
VLKLTNQSCLIDTVSNVSTSEARCQSSESAFQIIHILLGHNLLQMDAEDLFPALHRWSVDSNVPIKASRPHQSLVQDIGSVGASENDNLFRSVETIHLRQDLVQGALPLIITSTEALFSSRFTNSIDFINEDDA

SEQ ID NO: 37006 - protein, 245 aa, A.fumigatus
IRLTFNYWRKGGYQIGSEDYRWEIVKSHINNRFFLFLFNVTFISLIQPLLLLLVTAPTYNFILLSRLPGAEPFGLPDLAFSRLAFFFLIIEYFADQQQWNFQSAKKEYQKTARIPDQYKGQFTPEDLERGFVVSGLWSLSRHPNFVAEQAIWLTLYLWNCYRTGSYIQWTGLGILGYMLIFQSSTRLTESISAGKYPEYSEYQARVGRFIPRFSVKPKYNGSKKKTSRSKTEPAGTATQEGKKSQ

SEQ ID NO: 37007 - protein, 230 aa, A.fumigatus
RRLPTTSFSSRASLELNRSVSPTLPSRALHSSSSSSNTSPTSSNGTSKAQRRSTRRQLASLISTRANSLPRTWSAASSLAASGHCPVTRILSQSKPSGLLCTCGTATAPAATSSGLVWAFWATCSFSSQAPGSPSRSVQASTLSTASIRRVSAASFLAFLSSPSTMAVRRRPLGPRLSRQALRRRRARKVSDGRSPMHDFCRLIFVTFNLWGTGRLKFLDIYILLVLSGI

SEQ ID NO: 37008 - protein, 151 aa, A.fumigatus
CIIFIDEIDAIGKSRAKQSFSGGNDERESTLNQILTEMDGFNTTEQVVVLAGTNRPDVLDKALMRPGRFDRHITIDRPTMEGRKQIFRVHLKKIVTKEDMDYLEGRLAALTPGFAGADIANCVNEAALVGKFQNLSLWVSSNVNFSFISGS

SEQ ID NO: 37009 - protein, 126 aa, A.fumigatus
CQYQSKLTQSTGSCQFPTLGFVVDRYLRVKNFKPETFWGIKVVHVQERKKVNFLWRRVHLFDRAAVTVMLERCLLAKTAKVTKVNQKPTSKWRPLPLTTVDLQMMGSRYLRMDSSAVMKVCHCTMC

SEQ ID NO: 37010 - protein, 189 aa, A.fumigatus
  UNSURE (129): Identity of amino acid sequences at the above locations are unknown.
VCGCPVMLIFLSSAARENAESITMKHFEQAIERVVGGLEKKSLVLSPEEKRTVAYHEAGHAICGWYFRWADPLLKVSIIPRGQRALGYAQYLPAGGDTYLMNVNQLMDRMAMTLGGRVSEKLHFDTVTXGASDDFNKVTRMATAMVTKFGMSPKLKYIYYEEDPQQQLSQALLRGHRSGDRQRSPPHRQ

SEQ ID NO: 37011 - protein, 82 aa, A.fumigatus
QRGRALSLDRMLTALGKNNGGDDMTASGVKALRHTGRQAEIYYLRFWKSFASFARLGCFSTRRRNDVGFMTKVGNKGGSGMA

SEQ ID NO: 37012 - protein, 85 aa, A.fumigatus
ISIHGNKYVKNYLFEFNFGDPWGTCSVTMTSVLGHLMALDFESQYKSWLSCPPGALFEAPVREFVEEVCNISFFSVVKGLVMGIS

SEQ ID NO: 37013 - protein, 60 aa, A.fumigatus
DNKPIAENIKEQARMSKALFIWTDCDREGEHIGTEVRKKAKEGNQRILVKRARFSNTERA

SEQ ID NO: 37014 - protein, 81 aa, A.fumigatus
SLINGAFKTPRSGRHNDRAHPPIHPVCWVSPSALNSDEKKVYEFVVRRFLACCSDDAKGQSTEIEMPLWSAFHRRSKSAQA

SEQ ID NO: 37015 - protein, 126 aa, A.fumigatus
PSSACRPNSNTSTTRRILNSSFHKPFSEDTAREIDSEVRRIVNEAYNQCRALLTEKKKEVGIVAEELLAKEVLSRDDMIRLLGPRPYPDSGEFAKYFGAANGQTIAPPEPTPPIEGGSESGAKPPS

SEQ ID NO: 37016 - protein, 205 aa, A.fumigatus
WPSTLRVNTKAGSHAHLAHSLKLLCANLWKKYAISASFRSSRAWLWASLETRSKVNSVYRTISQSPKTSRSRPGCPRLYLSGPTVIERESTSVPKSAKKPKRETSVFWSKELDSATQRGREYIWIKLFFHRQCSPHNRHVLRAARALTDVDENQANAVAARIELDLRIGAAFTRLQSLQLQRMCADLSNKLISYGTYLLQYIYYK

SEQ ID NO: 37017 - protein, 67 aa, A.fumigatus
LRNNTLILTGANTPEGKSSLKVTFSDITDFLNYEVSSMARSKLLVLGATMTARIHLSTQYAGSHQVH

SEQ ID NO: 37018 - protein, 459 aa, A.fumigatus
RRDSLHDETSLDWGRKSLEDPGIYIRRPLAKNMFRLIHDERNHQGIDKCWLSLDGFTLYQGRRMLRQYIEHCPVCLQNKIRHHKPYGSLQPLQVPLAPFEIITMDFIVGLPDDNGYDQLLVVVDKFSKRVGLIPGKSTWTAQEWGSSVLRYFQEHDWGMPRFFISDRDSIFMSKFWKGYFTALKARWLYSAAFHPQTDGQTERVIQVIEVMLRHSYTTAERPDLFRWTMDLPSIISTINGSPNESTKATPHRLLFGIDLRQPWQLLKQFVKQDFSVRLDAEESMKYASIRMKEIYDRNHKPIEFRVGDQVYVRLHRGYSLPTKRANRKLQLQNDGPFRVLERVGRLAYRIELPSTWKIHPVLSVAHLERAPATPDPFHRELPKPPAVVDAEVYPGEDDIYEVERLLDKRTVQRGRKRTPYVEYLVRWKGYGPEDDQWVRKDDLQGSLELIEAFERNRPM

SEQ ID NO: 37019 - protein, 246 aa, A.fumigatus
RLSIKIVTEYLTSTYRTQLPSSDEPQTRRSYFTGTARTLGGDDTPSRVIESPSAPTLQRPQRVQRTLHFWADGFSVDDGDLFRSDDPRNAEILDGIRQGRAPLSIMNVQPGQEVDVEIKQHEEKYVKPKPKYKPFSGTGQRLGSPTPAVRSQAPSEAPAPSQPSAESVKPDVDESQPIVTLQIRLGDGTRLTSRFNTSHTIGDVYQFVSAASPSSQSPPLGFDELPSPTGTLQTKSGWPLVNQPQV

SEQ ID NO: 37020 - protein, 299 aa, A.fumigatus
RQRRAFATGKAINAPTDCETEAFRQLQSACDSPLFRAHFDPLRRLYADLDASYEGFGVMAYHIQIDDHHTNLSIPPARTVIQPILFLSRTLTSAESRYWPTELEVSCLVWALRKLRHMIESSRQPTVVYTDHASTVGISTQTSMNTVALERLNLRLIRASQYIQQFRLQVFHRPGKSNTVADALSRLTTKQNKNIKYNEPDLDSIDAYFTDHGYTASSIQLSTQLKKRIIEGYCDDPRTTRIIEVLRHNRTSDLLPSYPTDWNDDGTLYMTKHPLIGEGNHLRTLGFTSGVPLQRTCSG

SEQ ID NO: 37021 - protein, 70 aa, A.fumigatus
FQYLSLVFFRGYILIYPKLSARSLNRAVNSYPSKMERNPAENDEVVSQFCAMTGTRPAEVYPFKLIPCDA

SEQ ID NO: 37022 - protein, 140 aa, A.fumigatus
ETLSLTSISKAQEYLAANGWDIEAAVTEFFAEQDEAMLGANTAGGRSLGGAESAASAGRSLGGSSSQSGTATPKQSSSSSRKPTSKKRFATLGDFASGGGDFSDEDDTENQDFFAGGEKSGLAVQNPDDLKRKIIEKARK

SEQ ID NO: 37023 - protein, 90 aa, A.fumigatus
SNIQQHIRFSLYLYKMPLSQENHMQMAISAYKTQKIKLKLKAAKVFSISKATLYHQLKGIKAYIETHANSYKLTAIKEEVLIKRVLDADK

SEQ ID NO: 37024 - protein, 119 aa, A.fumigatus
DYLSSSDPNIRGVVISAFRYTLTDSRGSYNDVLRPLIVPLLVNMLSDRDLGNHRLALTTLNSAIHNKMNIILPHLSELLPAVFGDTQVKPELIREVQMGPFKHKVDDGLELRKVCYPAY

SEQ ID NO: 37025 - protein, 597 aa, A.fumigatus
RSMIDFEPSIGTSSAISTPVIAPSSPTTGPQAELSRSVPVIVQSLVKMWKSASVPLKQAIIVLLKSLALVRYGGLADHLQQIEDPIADVLKSSSTGSVTSTVGPAVSAGALQTETLSLVAAIAETHTSDALLPFLIALIPGVIGAVNDRNYKVSSEALGAVEQIIKALTPPRVTASSPDLVSQLEKLYDEILSRITDTSADLEVRQRAIHVFGVLLARTSGEKGADFLSPDRRLKGLSVLVDRLRNETTRLASVRAVDDVAVLCTKETDVTASWVSEVTVELGAQLRKSDRVLRGASLETLRSLAMNPSTRAHYDGKTMKELEDCLLPLISADDFHFLAPSLIILAKLIPGNAQLLVNEGLVSALCSIVLAPLVGTVLKALLLLVKVIGEEGAGAELMQKLLRDVGINGDPSVVGRAIGTLLVHGGSKLGVKMEDFLTELQTAQDAQRKCLALAIIGEIGLRMGPACSLTPDLFITHFESKSDKVRLAAATALGNAAAGNVKTYMPIILDGLTKSNPRSYLLLHSVKELLQHPEIVRPDVAPIAVKLWQALLLVSEEEDNRAVGAECIGRLALIDPVAYIPHFQVSFTSFPKSLSLF

SEQ ID NO: 37026 - protein, 161 aa, A.fumigatus
SCVRYVILHIDASSQFHRTNIHQSAYETLYASLDTAFSVAHVSEFFDRILAGLEDEQDIRTICNLMTSKLIPIAPEETQRYLDQLSERYSAVLSFKPKDNAVKQELEKAQEASMGILKVTRELSKAFPNAEVSGDHHKWKAYMEWVRKTFATQLKSLETEF

SEQ ID NO: 37027 - protein, 94 aa, A.fumigatus
RGIVERYQLALMTNKHIFFIEWSLFISQFLTILNVVHCNVTCSRCGFSCSHTYYVVKIAYWILLVLQTISTFVTGPDRFKRLQLASSHYYLSSQ

SEQ ID NO: 37028 - protein, 162 aa, A.fumigatus
FISSFFHQTLLQMLVRGNVFARMSPDEKHELVERLQSLDYCCGFCGDGANDCGALKAADVGISLSDAEASVAAPFTSRQFDISCVPQLIKSVPTHFSFEVDLLLSHQQGRTRCFGYQLLLLQVHEFVLRNPILECQLSLHVSIKPWRFSGKYSKHFSGSSSR

SEQ ID NO: 37029 - protein, 82 aa, A.fumigatus
RFEVGWTGPHPVLSRKRPTANLVSRKVLTPLLGQISICILTQFVAFKTVQSQPWYVSMYINLHRKPDFNHSQVSTSKNRLKQ

SEQ ID NO: 37030 - protein, 116 aa, A.fumigatus
KRLHHISCYTVVPTPGTSPSTSTLYNSYRYVGCWVNLLLLLSSSVITNHYRCVFGEMFKGKPILAGSSDLNQTQLIFNLVGTPTEENMPGWSSLPGCEGVKSFGYKPGSLREVFKE

SEQ ID NO: 37031 - protein, 86 aa, A.fumigatus
ATSREGRAALVTSFCCFKYMSLYSAIQFSSVSFLYTSASNLGDFQVSIVSTSQGRRLANSFSFCSLTWHSFCRLQYLVSILKHLQY

SEQ ID NO: 37032 - protein, 172 aa, A.fumigatus
IFTGSLILTIHRFQPPRIDLNNSNIENSENTALFLISIFQYIFTSIVLSVGPPFRMPMRANSECYILSVRIELTKWIEPLIVTIVVDTIVSSYMLFDPPEWIIETMQLTFISRGFAFWLFALATSTFLLSWVTERKFFPLLSRAIGHLKTRLRPGNRKQRRQYKVLLDEMET

SEQ ID NO: 37033 - protein, 64 aa, A.fumigatus
FSCLIKTLITRREVYKARSKKDGSIVALKKILMHNEKDGVRSFDHSQHYQRLIESIPVSYHGPS

SEQ ID NO: 37034 - protein, 75 aa, A.fumigatus
PVIAANLLISNNGVLQIADFGLARPYDEPPPEPGKGGGEAKRDYTTLVVTRWYRPPELLLQLRRYTTAIDMWGVG

SEQ ID NO: 37035 - protein, 83 aa, A.fumigatus
LSTGDGRKKPSMYMVTPYMEHDLSGLLENPAVNFTEPQIKCYMLQLLEGLKYLHGVFLPLFHTTGDRSNSRLQNRILHRDMKG

SEQ ID NO: 37036 - protein, 63 aa, A.fumigatus
IIQYQERNRVHLAKPFCISTYKDELIIVGTMLDPLFEPLESQDSGFSFLKHIGPKDDPVYALH

SEQ ID NO: 37037 - protein, 115 aa, A.fumigatus
IDAEPVAEIRPFLHFGNFLSFNFHLLVLYVLLEGSTATAAESLTLSSDVATPVAAAKSTLPTLVLICARGAKSPVPQVRSQSDHASQHSRIRIKAYGSTCEEVIANSMHGGFRLH

SEQ ID NO: 37038 - protein, 82 aa, A.fumigatus
  UNSURE (17),(47): Identity of amino acid sequences at the above locations are unknown.
ESDFSKSSTTPTAEKIXGIKLSILASGESNTPGAHSSGSTSASSSSXGSSSSSSDKESAAGTISVPFVGLLSAASFMAFFML

SEQ ID NO: 37039 - protein, 996 aa, A.fumigatus
  UNSURE (12),(14),(15): Identity of amino acid sequences at the above locations are unknown.
LSGTLRGSCSFXVXXKMAFCRYFPGPYAVENGARLSATDGSDNVDSNKRYFSRLTALASWRSEYILRTRLLRSLSRGKPAQFEPSKKYGTVRAANVRNGSAVATYTSQLMYPVSHLGASFGAEDTRKEPHFIHGASEQGIASASDPSTVKVGTWGLSDHQMFRHFADLFAGDGEYGLGSGDIVGQPNCMDVSQPYGMIYGEGCPQGRSYFISTTEQRGRFLGLVESSSQPQQGVPALNPATTSITAVWIAKSAHILKMTGGLVGMLSGSSVGILTAYALGPHPTYEKRFERGQVTAKWAICPGVPIIGIAVDDNYSKNRSSRGRIWATVLNALGEVFYLTEIPRQPDIAAKLSAEEIDQLAWKTGRSVRWELIELSKRTARPDPFNRDPVDGSYSPRSSSDSMKLDEQQIAAETKEIERFLKFRPKHFRKVCKGWDMRRDLKVDFAGDDGLGAGESIMVITRGAGEGEKASIRRFTRTMLKSDLPAASGTLPHITGDATFRSLFGGPSHTPIPSSASDASSLPPSRTSSYLSDTVVCSVANTEWRMSDFGFGDRKSIRITTSALDSSTYAVLTADEDPLLGMSGGSGFSSAMSSPLPHLKQSSSNPEIPGSRGRYLAVGTATGLVFVWDIRAPSAKSTDIINSVSPLRIIQTDSPQVSCVALTSLYLVHGGNDGLVQAWDPLASTTRPIRTINSRFSSRARRRLVQAEASMHGVGNNFFACGAICLDPDPTVLRGMVALGTHLRYWAFSSSGADQYKSRKRRLRRGHRGSDITAEGQRFSSSGRGALKEYIEDEKVEIERQKVAEVKERAYLSNRFGIDLLGSDVSEDQLLAYAQLLSEEAFASEALKRGEAVVSSVVSTSPSDTIGRNDSSVAADDYSSSSSPYQDTIDDDLAPDIAEAIRLSLLDEGPSQEKSPYPVKFSRKLQSSYGNISPCELSGAESSRQRELDDLELAIQLSLAESQSVGQPERQQDREYPLLSTFSPASDKGKGKGRAL

SEQ ID NO: 37040 - protein, 168 aa, A.fumigatus
LSIDVQEIIVRGMNMLTCQHRRASPAPLASLVHPAQACKEIFPVHTRLLGLAELIGKDVQHQLTIAISVDVAVGLKIQVSFQLGSIDEVSVMGQANTVGAVHIKGLSLGIRAASSSWVSQMSNAHEAWKVRHSRTIIENLGCHTIGLQLVDATTCRARCNTRSILASI

SEQ ID NO: 37041 - protein, 78 aa, A.fumigatus
LHCFTPLQTFRLVLLSNIPIIMFSSYLSVLSPYTPYIPFLAQVPIFQQLLVDFVSTKPLVILNSSKAFLLQFYLLPWR

SEQ ID NO: 37042 - protein, 95 aa, A.fumigatus
LKGLPPPVLPAAVEMNRPTNDSLHSQEPPQPSEPICLDDSDDNSSVCDTDSNTDSSVTIDNDPDRSFFLDDEKFHPGGGRRTPTPFHIGPQTHQD

SEQ ID NO: 37043 - protein, 187 aa, A.fumigatus
VFGRYRALPRASRLILNLQLLDRGQDAAGIATCAAGGRIYQLKANGMAAKVFNDGARVADLPGFMGIGHLRYPTAGSSANAEAQPFYVNSPYGICLAHNGNLINAPELKRYLDLEAHRHINTDSDSELMLNIFADELSETKKARVNREDLFASLSRMYERCQGGWACTAMLAGEHIHTSYDNFLNVY

SEQ ID NO: 37044 - protein, 240 aa, A.fumigatus
FPERLLTIMVGFGILGFRDSYGIRPLVLGSRPSLDGPGTDYMMASESVALHQLGFSNFRDIQPGEAVIIEKGGEPVFRQVAPKKAYAPDIFEYVYFARPDSVIDGISVYRSRQRMGDRLAARILDVLGPEIVKDIDVVIPIPETSTTSAAAVARYLDKPYCQGFVKNRYVFRTFIMPEQKTRQKGVRRKLNAMQAEFKDRNVLLVDDSIVRGTTSREIVTMAREAGAKKVYFASCAPEIT

SEQ ID NO: 37045 - protein, 666 aa, A.fumigatus
TTLIVVLGGAGENVPTSRATASKALGSLIEKLGEDALPDLIPNLMTTLKSDTGAGDRLGSAQALAEVLAGLGTTRLEETLPTILQNVSSSKPAVREGFMTLFIFLPACFGNSFAPYLSKVIPPILAGLADDVDSIRETSLKAGRLLVKNFSSKAIDLLLPELERGLADDSYRIRLSSVELVGDLLFSITGITAKADAEEAEEEAAQAGQSLLEVLGEERRNKVLSALFICRCDTSGLVKSAAMAVWKSLVASPKTLKEMVPTLSQFIIRRLGSSNMEHKVIASNALGDLIKKAGESVLATLLPSLEEGLRTSPDVDVKQGICIALRELITSASPEALEDYEKILISTVRVALVDSDEDVREAAAEAFDALQQILGKKAVDQVLPHLLMLLRNNEDAEQALSALLTLLTEQTRANIILPNLIPTLISSPISAFNARAIASLAEVAGSALTRRLPAILNSLMDNILSTTDEEHREELNSAFDAVLVSVDEFDGLNVVMNVMMTLLKHDDHRRRASAALHLNKFFSEAEIDYSRYYQDLIRVLLISFDDSDKEVVKAAWTALSGLTSHMRKEEMEVLTIPTRQVLRQVGVPGADLPGFSLPKGITAILPIFLQGLLNGNVEQRTQAALAIGDIIDRTNANSLKLFVTQITGPLIRVVSERSVDIKCRLI

SEQ ID NO: 37046 - protein, 100 aa, A.fumigatus
PELITGTKTDDMGVKNAMMKALQEVVGKAGANMSEASKNAILALIDDDASDQTGKLRSKIDEVNVAELTFQADGVAITNAKLLGALVKVLPASTASPLIK

SEQ ID NO: 37047 - protein, 88 aa, A.fumigatus
PGLGAIFFTLNKLLEKIPMAVKPFLPQLQRTFARGLADSTSETLRNRAAKGLGILITLTPRVDPLIAGRSIRLCDKMIAALILILDQN

SEQ ID NO: 37048 - protein, 128 aa, A.fumigatus
FLLQPFIAENSVLAAGKFLLIEDESRNFETNKAIFEALAPCIQAGVPPDVRRLTLVVLRTVSRLHPELTRPHLALLAPPIFSCVRDVIIPVKLAAEAAFLSLFSVEESESAVFDKYMAGPGAELPPWT

SEQ ID NO: 37049 - protein, 138 aa, A.fumigatus
EVCNFFFFCTYLTKPLPQQAYIDFTKSTNVVEDVKAATPGGLGAHAVCLLAVSEKPFQQATDYVRSRGTIVAIGMPAGAYLKAPVFNTVVKMITIKGSYVGNRQDGVEAIDFFARGLINAPFKKAPLKDLPRIFELMG

SEQ ID NO: 37050 - protein, 236 aa, A.fumigatus
LATPTSMTIPDKQWAQVVLEKGSPPVYKEIPVPKPGPDDILVKLRYSGVCHTDLHAMKGDWPLALKLPLVGGHEGVGVVVAKGELVTGFEIGDHAGIKWLNGSCMECEFCKQSEEPLCPRATMSGYTVDGTFQQYCVAKATHASKIPNGVPLDAAAPILCAGLTVYKGLKESGARARADSRDRGRRRWSRLSRPAIRQSDGIASRSDRWRRREARNVRETRSRGKRSAIFFFSART

SEQ ID NO: 37051 - protein, 68 aa, A.fumigatus
RNLALGPGQTVAIVGAGGGLGSLAQQYAKAMGLRVVAIDGGEEKREMCEKLGAEVRGLQFFFFLHVPN

SEQ ID NO: 37052 - protein, 60 aa, A.fumigatus
KADDMNYTVVINSALWGGALLYYLLYARKFYKGPQTTVGQPSSTLSETNLEKLDGEKGVN

SEQ ID NO: 37053 - protein, 221 aa, A.fumigatus
DGAVWYPGVSVSCSYSSCDGYQPGESVGNCFWSTDGAGKLVVLSGTPEVRADDRQIYYDALGKPGALGFMAVVAVVQFFMGLSLVLAASRQSWAFSRDGALPFSSFFRHVSKRIRYQPVRMIWGVVTAAVIIGLLCLINSAASNALFSLAVAGNDLAWLTPIFARLVWGGERFHPGEFYTGQLSKPIAVTAIVYLFFAIVLCMFPTLGPGPTRKFFISSGR

SEQ ID NO: 37054 - protein, 392 aa, A.fumigatus
LSRFFAPYLRLSGFSMADEDLKLSLPTPTSPPSLSSSVHFYPFATSPDIIRSNEKDIFITSSLVNQAQAIIRSLRGARFAHIHSDAIKHLTEILYFSLTTLIGNRTLGEEYCDLVQLEDDTLQLPAIHRRAGYILSSILVPWALQRILPGFRQRLRAKLERSISRQELKAQQKAEELRFTKKNASKKPSFFTALRLQKYILEHLDSITSLSPIYALSIATFYFTGSYYHLSKRFWGLRYVFTKKLEENEQRVGYEVLGVLLVLQIAVQGILHIRKLGLSMQQGGEGIETEMAGSKMQDDSLIRSIQNPYNLPLLPASAARYDLSEDSNVIPWIPSGQQSKCTLCLELYKDPSVTTCGHVFCWTCIRDWVREKPECPLCRQEVIPSKVLPLRG

SEQ ID NO: 37055 - protein, 64 aa, A.fumigatus
LQVYYQQIRVQHDIPHTPVWNVLLKKPRDTRRQISKMHIQMLGCISGFQNKHLALKPKNAPPPS

SEQ ID NO: 37056 - protein, 419 aa, A.fumigatus
ECSMISPTRLCGTCFSKSLGTPDAKFQRCISRCWAASPDFKTSTWLLSLKTHLRLPSICLNLAQQSRQMRPAPTSRTAVKKYNGLQNDLKSSHWLTGLWHGKQSYMREHAFSTLSRETVGGDQRFSSTRPDESGPGRLRMNFCTTHPKRSFRKTLIAQSIASPSNRKGSSGHTSQCQSYSNADVSRSIGSGDETRTETAVCEKRLVAQQSLALTITPGPKFWSHRLRKAPSGRDIIVHYCKSLRKTEEVAKYFLNDHVIGFDMEWKPQSSRSASIQNNVSLIQIANAERIALFQIALFKPARRPEDFISPSLRKILESSEITKAGVAIKADCTRLKNFLGINVRGIFELSHLYKLVKYCQSDPALINRRSVNLSEQVEEHFGLPLAKDDDVRCGDWTTALNYRQVQCEFTLNPILFRVY

SEQ ID NO: 37057 - protein, 93 aa, A.fumigatus
KIISSCRSRKKRKVVRVLNGADQGVILHLGTSHFSLNTFPPLLHTKTEFSNMQDALYRDLKDKQNPQNLIPYSLFIFLEFLREHVAQSPEAFR

SEQ ID NO: 37058 - protein, 96 aa, A.fumigatus
RQGSEYVKERVRVRVLAESLSVGGRQEASIAKNPDRHLKDVLDAAGAEFADEREEVEALTYVYVAGQDRLEDAEWDFEAFKRDKMAWWVDADESEW

SEQ ID NO: 37059 - protein, 607 aa, A.fumigatus
  UNSURE (596): Identity of amino acid sequences at the above locations are unknown.
LSERMLLTWRRSDDEEENPPQQQCEKISRKWQRSVEHYSLQSLLCRINGFNRPLVYPRFGKKKAEVDGQDLERLRDNEFLNDNLIGFYIRFLEDHLERNNKEVSQRVYFFNSYFFATLTNLPRGKQGINYQGVQKWTRNVDIFSYDYIVVPINEAAHWYVAIICNLPKLPGIMKEEEVIDQHAEEDAEPSALPKRDDAENPNTPQTVGIMSSDSGEAETGARSAPNPEKEELARESLAAMSLLDRKEMKERGELEVPPSDEEWPEKEENPVSSPAKLSSPPRDTEPSKQVNSQDARQSSASGSQKSRKPKKKRQGPRYEVWQPTVITFDSLDLSRSPTISVLRNYLREEAQSKRGVEIDTTLIKGMKAQEIPLQPNYSDCGLYLLAYVEKFVQDPDTFVTKLLRRDMRVEDDWPLLRSGLLRSRLRKFLDELYDEQEQLSREKAAERATMVDRQPISYLLGLGGKTDLAAENMEDASATRSEKLPSRNPPLEVSGLELAQKAKLGESRSVTRSSSRDGTPDSTAQAKMSTPQTLAASASGSTTRKEVVEVPRQSRTSAIGECHIALSPSRRRLSRQASAISGSGFKPCRRRHRANXDTSSISEWQHC

SEQ ID NO: 37060 - protein, 95 aa, A.fumigatus
ESRDYLQRSGNDSFNAQDQCYDNLRISKNAWDTNLVKVRPRRHPDYLPGPEDSLTPKIGQPSLPLRELGSRWWWCICCHACCVHLGVAGRAYAPT

SEQ ID NO: 37061 - protein, 270 aa, A.fumigatus
PDRPQLLHGLPERISPPLLDPDHGLLRMRHDRTHRLLVPENRTVTPSLGPRRHWIPMKKRISLQAFWERERVGGSPYFPCLIFIPTLHLLHRIVRTGSCRAIGLTRNGSSLVFKRPLCELVNSRHHHVLLWMSRQRIPFPKTCWTQNPCTSRRMDPLNLLPQRSPYLLPVRHAFEMPASTPKPSPRKKKPPIVPFLHRDSSIKTFNYSTGAEWDHATREKTMEEFFNAFVSRVSQAGQESFGLKETVELYKSRGEYGYPLDLQVCSQLLQ

SEQ ID NO: 37062 - protein, 494 aa, A.fumigatus
RTLKRDHEIAMDDVERQQRAEIETVRQESRQQLQALDNQHQDELRELRRHFEQQINDEKALRFQEINQITSQTALDTQRSLLELERKDREIAKLQQNLQAVREDLERERKANHDLRQNLDTASCNSVTLESSVRALKARIEFLESGREEQSQAFERLNQQMNDALAETEATREKLRKEETLRRKLHNQVQELKGNIRVFCRVRPSLESEVAETAQIEYPDQSDECKEICLLGPEERSALGTVTRKNNSFTFDRVFGPSTQNAEVFEEISQLVQSALDGYNVCIFCYGQTGSGKTYTMSSLDGMIPRAVHQIYQTAQSLEEKGWRYTMEGNFVEVYNENLNDLLGKAEELDKKKHEIRHDMQRCKTTITDITTVRLESPEMVESMLKRAAANRSVAATKANERSSRSHSVFILKLLGENHITGERSEGTLNLVDLAGSERLSHSQATGERLKETQNINRSLSCLGDVIAALGQGKEGGHIPYRNSKVCFLSPLVN

SEQ ID NO: 37063 - protein, 263 aa, A.fumigatus
HLTERPHILTVTDTTRARSATQAPEPSRSGTGSLPPSRPGTSMGRVHTRTNSHASSTLTRSASTASRTTRTNFSSTVGPGSRPPSHAPRPHTSLAGTRKPNGHSITRPATSLDTHEEEDFAASILGKRKGRRQSLFSLFDIYSHPASITPHSKDRKLSCDWSDSQRKLLGIQEAPLRIGQLEASPCPALDESAKDPVSQDMLDPKPVHLAQDGPIKPPPSKIPVSSPRETRIRDACIYPKTFSQEKETTYRTISAQRFFDQDV

SEQ ID NO: 37064 - protein, 109 aa, A.fumigatus
LGLNPTADPSKFACFPMADSELWCRQASATCARTSSSIGSFTNNSSRCFSMYPVSTSPLMKSGLLQTALMNSMLVIGPATSYSSKAAASLRIASSRVAPRTISFAIIGS

SEQ ID NO: 37065 - protein, 72 aa, A.fumigatus
  UNSURE (71): Identity of amino acid sequences at the above locations are unknown.
LNLQDDLAEAATHDALYFDDPSLDVEDLYSDWDELSDDYYDDDPTVEKRRRMIEITSLHHGDGSIHGVLWXR

SEQ ID NO: 37066 - protein, 89 aa, A.fumigatus
PDYRRVGRTASQHGIKVTTLYTDPDRYAQHALSSPFAFNLGSVSAYLDGDRIIEIAKREGCQAIHPGYGFVSVCPRMNDRRTLIIVIYS

SEQ ID NO: 37067 - protein, 578 aa, A.fumigatus
PSLIPESQSKKIMTAAGVPCVPGYHGSNQDVNFLEAEADKIKYPVLIKAVKGGGGKGMRIARSKAEFQAQLQSAKSEAMNSFGDDHVLVEKYITTPRHIEVQIFADKYGNCVALGERDCSIQRRHQKILEESPAPHLPDATRKDIWAKARAAALAVGYEGAGTVEFIFDNDTGEFFFMEMNTRLQVEHPVTEMVTGQDLVHWQIKVAEGAPLPLTQDQVEAEMAHRGHAIEARIYAENPDQGFIPDSGRLLHVRTPPTSEDVRIDAGFVAGDDVSAHYDPMIAKLIVRGATREEAIRKLAAALEEYEVAGPITNIEFIKAVCRSPDFIKGEVETGYIEKHRDELFVKDPIEDEVLAQVALACLHHNSESAIGKQANFEGSAVGFSPSYQVREMTLAEMTPARKDGTKFNVRVKQTGNNVFDIEVGSRIFEQVTSHSDPASRVVTSFFPHTRLDTTVIQDGDSVVAFQRGNQYRLTIPRAKWMEKALGMKDVTNSVLAPMPCKVLRVEVKAGDVVEKDQPLVVIESMKMETVIRSPQKGTISKVVHQKGVGHATLLFFLSLCFCFYPHPGIVPVYWSVT

SEQ ID NO: 37068 - protein, 83 aa, A.fumigatus
TPSPGNIYSTANPTSAKDLITPTIKQDTFTTGRGGSGNMVQYDPERPEIARELQDVKSPPQRVEEAPHHTGRGRVCLFLSSPR

SEQ ID NO: 37069 - protein, 376 aa, A.fumigatus
SPFQPESIVEDRHSSKVNLSINKLLEVEEHIWSPMYGLKGNIDATVQVACNDGEGNRNLVVPLELKTGNRDTNQAHRAQTALYTLLLSDRYGKLSSRNYSPDFVSLILRFQDVDVTFGLLYYLEISKIFRIRGVRHELLQMIQERNRLAGFVRERLQLPPMVKKPGMCNRCYSKTPCLIYHKLADDGDGETSGLGDEFVKAMDYLTPQHRDFFKKWDDLLTKEEQSMMRFKRELWTLLSSEREALGRCFGNVVIQPGSAYEDKESTKINRFRYTFVKKHPLPSFSFTESQLTVGEPIVVSDEKGHFALANGYVVQVSPKHIIVAVDRRLHNTRTKTKGFDASKNQSFRGIAELLGDGPLPSSYFSRAGGGDSLSTG

SEQ ID NO: 37070 - protein, 209 aa, A.fumigatus
FDPCSGPFQPRGETLVQDERTKNKKAVILRESWFDSPCSKGAYIHLTGDFDAAGQCIVDDAHNMIILHPDHLISATVVADSISCQRRAVLQDRIKNSSDISKPQVFGNIFHEFFQEAMKVNKWDLKSLRALVEAILVRHVEDLYLIQMTVPEAVEYMMSRVPALKGWAEVFLRPTPSVSASCRSCDALVINRPSSPNPSLKTGIAPRSI

SEQ ID NO: 37071 - protein, 632 aa, A.fumigatus
SQSIGDCTIQEQRQRDLMRAKTNHSEASRNFWEMGPYLQATSHEPEEEILYRLDKDEFSNGMAIVRNNLICMMEKDLFQANRLRKLIVEGETPIFKPSPSAFPLSDSAKASLNVDQKRAIEKVMSARDYALVLGMPGTGKTTTIAHIIRALVAQGKSVLLTSYTHTAVDNILLKIRDDNFRILRIGATAKVHTEVQQFVDLAAVPKSTVEELKASYEESQVVATTCLGVNHNIFNRRVFDYCIVDEASQITLPVCLGPIRMARTFILVGDHYQLPPLVQNKQAQEGGLDVSLFKLLSDAHPESVVNLEHQYRMCEDIMVLSNNLIYSGRLKCGTPAVASRSLDLPNIGGLKLHHINQLPQSSNQRQFCLGTNQGRCWLRDVLDPSAKNRFINTDTLGIPARDVANGTMIVNPTESSICAQLVESLVSCGIPARNIGVITFYRSQLSLLKQNLRRYLPQLEMHTADKFQGRDKEVVLLSCVRSNVDNNVGDLLRDWRRINVAFTRARTKLLVIGSKSTLRDGNDLLRKYISMVEERRWVYDLPKCALESHIFNCDVSFPPSLDADKSPSKGSRSLPKTSPSPKAPRNPLSPIEGQPSRRGLKKPAKTGAKLLSGSNVIGNRPVLQDVVNELIG

SEQ ID NO: 37072 - protein, 71 aa, A.fumigatus
VIWVKYNHIMGIIDNALPCCIEIAGQVNICALTAWAVKPRFSQDYCLFVFSSLILNQRFTAGLEGTATGIE

SEQ ID NO: 37073 - protein, 83 aa, A.fumigatus
TLVCETCASNPSRLNAVLMTPRATGKYGAQVNGALTAAHQPTDDAHIRESLFHCNGGADGDISFIKYCGGGCKNGGNDRSDYC

SEQ ID NO: 37074 - protein, 292 aa, A.fumigatus
  UNSURE (273): Identity of amino acid sequences at the above locations are unknown.
VQLGRTRGAEMIHESLALCGLPISVLVVHCLPLVAFQRHQTSLLSLCIVYKMAYNLSDILKSASVDLAPYEDLYKYFHAHPELSLQEEATSQTVAAHLSQFNAYEIHTNIGGYGLACVLRNGDGKNVLLRADMDALPVKELTGLPYASTVRMRDAEGVEKTVMHACGHDMHMTCLLAAAETLANMQHAWSGTLIVLFQPNQEPGGGAQGDGGTMASNSNNPRAGIMSLASTSCACGPKALAAAREPSWLLLIVSSHRLWARWPWIPAASDRRXCASRCAHCCQTAGDCEPRD

SEQ ID NO: 37075 - protein, 219 aa, A.fumigatus
  UNSURE (21): Identity of amino acid sequences at the above locations are unknown.
SQVTVYGRGGHGSLPHQTVDXALLAAHIVVRLQGIVSREIDPSDFAVVTVGSLQAGQTENIIADRAEVGLDFRTVKLETRQKILSAVQRIVEAECMASGSPKPPVFTPTRRFPPTVNDEQVASQLAASFAQHFEDFDGDTPRTNVSEDFSTLGTCRGIPCCFWVLGGIDAELWDQAVREDSHTDEIPGNHSALFAPVIQPTMRAGVDALCLAALTFLRK

SEQ ID NO: 37076 - protein, 183 aa, A.fumigatus
  UNSURE (50): Identity of amino acid sequences at the above locations are unknown.
IKIRSLSIVVGLMLVFRNQTSYNRFWDGRNGMNTIVTCVRNLVRTIITNXYSERGPPTAAEQQDVERTISVIMAIPYAVKNHLRDEWGAAWALGSDVNENGTAVYDADYASLLPVGLEGHEHDGLGLPFQLTFFVDGFIKRGVERGWFNAPGASQMQAQLNTLTDAYGRMETIKLTPIPVAHL

SEQ ID NO: 37077 - protein, 109 aa, A.fumigatus
MTGIYCTNDSTHQVMIQTRATLVRAADYKRYEEKAGRSFNRAMICVQSFGAHQLSMVQQSIVVMIKKSYLQSMKLYNPVNIIEVLGDNDVDDFHVPEYITETRRPRTIS

SEQ ID NO: 37078 - protein, 600 aa, A.fumigatus
  UNSURE (20),(80): Identity of amino acid sequences at the above locations are unknown.
QVATSACEYLGLNNQIHPSXRPLKLPRLPFPKTMATNDQPVVIVGAGLAGLVAAYELSNRNIRSIIVDQESEANLGGQAXWSLGGIFCVNSSNQRRLGIRDSRELAMEDWFSSAAFDRETDHWPRKWAEAFVNFATDHMESYLGALGVRFVSVGWAERGSGQAGGHGNSVPRFHLTWGTGPAIVEAFAGPVKEAAKKGLVEFRFRHQVDEIIVDGETGAAVGVRGQVLEPTDVERGVASSRKSVGYFELRGAAVLVASGGIGGNLDLVKKYWPVDRLGPKVPQSFVLGVPAHVDGRMIDISRKAGASVVNSDRMWHYTEGLTNWNPIWPKHGIRVIPGPSSLWLDATGKRLPPFLYPGCDTLATLRHICSTGYDYTWFVLNKSIIAREFALSGSEQNPDITGKSILLLLQRIFGSNGTGPVQVFMKNGEDFIVETSLNDLLKRMDNLGQKHGGPPLDVNQVKREIELRDAQVDNSYTKDAQLMLIQNARDFWPDKFSRVVKPHKLLDQSYGPLIAVRMNLLTRKTLGGLETDLSANVLRQDGSHFTNLYAAGEVAGFGGGGVHGYNSLEGTFLGGCIFSGRTAGIAMADKLAKAPATQSS

SEQ ID NO: 37079 - protein, 68 aa, A.fumigatus
FVLKLLDQIQQLSASVSVGADITRYQQDIVVFLRLSRAVAGGITARSNMQFTKLSKYVQLIRLPKECA

SEQ ID NO: 37080 - protein, 335 aa, A.fumigatus
GMETVLLKAMQRAKYYVASTVQDEQRHHYTLNLPVYTHFTNPSRRYADIIVHRQLEAVLSNGAIDFSDDVESLSKTADLCNTKKDSAHNAQEQSVHIQACRSMDKKRQEIGGDLISEGIVLCVYESAFDVLIPEFGFEKRVHCDQLPLKKAEYRKETRVLELYWEKGVPSSAYIPEDERPRPANSRAAQAAAAAREAEAARERARERDEAIRKQTETGTMSADDVDALFDDDDDISEVTEMAAGVSLNSSADRTTQSMPPSPTRNGHLQQTPHRTRSDPKMPSVNNDVPEAKLTNKEKYLKLFKLREEDGEYIQDVTEMTRVPIILKTDLTKSPP

SEQ ID NO: 37081 - protein, 473 aa, A.fumigatus
GLRGSPARGEDLDADIFICGSKDRNRALEGDFVAVELLDVDEVWSQKKEKEEKKKRKDITDARSGSTAGTDKLSRSDSAANGDRQEIGPDGSIRRRGSLRQRPTQKKNDDVEVEGQSLLLVEEDEISDEQKPLYAGHIVAVIERIAGQMFSGTLGLLRPSSQATKEKQEAERQAREGGSARQQHDRQQEKPKIVWFKPTDKRVPLIAIPTEQAPRDFVEKHQEYANRIFVACIKRWPITSLHPFGTLVEQLGEMGDLKVETDALLRDNNFGADEFSDAVLKSIGWEDWSVSSEGDALLESRRDFRSETTFTIDPSGAIELDNAYHIKPLADGKVEIGIHVSDIAHFVKANSLVDREAKKRGTAVYLMDRLVNMLPRRVSTELCSLLPEQDRLTVSVVFTANPETGAVDDDVWIGKSIIKSAGRLSYDEVNSVIKGETNVSVAGISANIIQTLNVGNPLSQFPLPGLSTNLLGL

SEQ ID NO: 37082 - protein, 145 aa, A.fumigatus
TITRKFREARFGNRVSNPPPLRLLYQLDDENVPVERNIFDSTDSRELVEELRHKANFFVARKLVSAMPDKAFLRRQPSPNSRRLHSFIDRMNRLGYDFDPSSSGTLQSSLCKVQDDDLRKVRVLLRTLLHSTDILTGIRVWKLFC

SEQ ID NO: 37083 - protein, 132 aa, A.fumigatus
  UNSURE (3): Identity of amino acid sequences at the above locations are unknown.
PPXEKNVAANHPTHRGSSPQPPPQRKSPKLSLLDKGINTSARIRDDVIIIFEDASDPSDLQSNDSKENHAALHASKGMGPSARKSPHYPTSLLAPSTAVTCPSGSKSRAVSGSRKASSSSMKAKPRIGIRRL

SEQ ID NO: 37084 - protein, 146 aa, A.fumigatus
ISEWNYIRFVSLISRSSHRASSLPDPRPPPKPPPNPHQPPPPCPCCCKSHPPAQPAQSSSRAPGTKPTDPHTRYSSPRTLTATQTGTDGSRPQHQCYCSQTRSNPVDSAQRQPGTRRRRASSSPTRNTDTSGLTADTAPGYRTSAA

SEQ ID NO: 37085 - protein, 70 aa, A.fumigatus
DEQFIPLTTLVSGQWLAIIVSSFRMPGSAQQFDPFNPEPFFGELAWHEVLELNDPLITFFETLFEGLILF

SEQ ID NO: 37086 - protein, 294 aa, A.fumigatus
PTKSDFSRYSRVSPKWQLLYIPMLPIVFTFITFIGIAASSAGQSRYGGEIPWDPIVLISHWTSRACRFFAAFSFALASLGVNISANSISAANDLTALAPQYINLRRGQIICAILSWCLVPWKILASAGSFLNFMSAYAIFLGPVGAIMLWDFWLVKRRKYDTLALYQPSNPTYRYSSWGTNWRAFVAFLVGVAPNLPGLIASVNSSIDVGVGIHPYQFGWLLGFVATSIVYVGLSVWFPARESLIERAVLADEIYNSRGTVEGVDAGSEEVLGEGGGREEKMLGVKNGILEKRI

SEQ ID NO: 37087 - protein, 409 aa, A.fumigatus
GYRGRHECYLGLVVYPRLRWSLTASGLRTSLAPSDKIRWLVGCRSFFPSHASHVGSSAQNRMLLTPPGLLKGRFLPFQGCFHPHLYISASPQSDYFHSISPTSQSARVVSLENMGRATLFSALAFLAGHVLQATAIPSAFPQDNAVNQVLLSDSYQDQSVSSISAEDDAQNSDVIHIGESETMRAPSWFTSTLMARRLLALSTTGTVSTIFPDPLPGNSHAPPSVAGLPISLPEYIADCDEYLPADVSNGGNGDPTFLALHISTTFRNTAAGSNVSLAIDWWDHLNQTEPVAPGFPPSEAGLPRVTLIGYVEPFDTPLHRDIEAALEECYLSVHPDASAWLPGKPGAPHSSYWAKMVVEQVYWIGGFGGLQQIGWMNVTEWKGIRRVRSLPGVGDGRGWEDVRLPGEKE

SEQ ID NO: 37088 - protein, 325 aa, A.fumigatus
FIFAPHGLFLRFLVLTVILHRPTMIFSRPRLRITQPKSAFAEGNARWTNLDLDPVPHHRRKWGPLSFVGEISPIQFLGLALLTPTIAYWISDAFNAATWQFASSIIAVGLSWRESLAIVAISFFIISFVIAANGAVGAIYHIPFPVIARASWGFWGSYVAIISRVILAVFWFAIQNVNGGNAVRCMIGAIWPSFLTLKNDIPEAQGITTAGMVGYLIFFLVQFPFLCIHPNKVRWLFVAKSIIVPIAWLAILVWAFVAEGGGAIFDQKPTVSGSKYSWLFLANMTSVLGNYATLSVNQVCDAFLRGNTNMLTDKVRLLSILPRQP

SEQ ID NO: 37089 - protein, 105 aa, A.fumigatus
VDFVVHPSTELVKHFQGTFHCFGAKPKVTIKDMGECRFVSFHIISFLGFGEHGIRLENALESTHIFWNLHDLCSNVDAVMGNIVFDIQNDWQASDTDSIQDLYLA

SEQ ID NO: 37090 - protein, 182 aa, A.fumigatus
  UNSURE (3): Identity of amino acid sequences at the above locations are unknown.
KKXTSKFTYTTSGRVANNCPTSGVGEVFVPTEANMFEGKTTAPNYLTEPELIGLMDANGIGTDATMAEHIAKIKEREYVAVHSRGSGRNAVKEFIPTRLGIALVEGYDNVVANLPDKPSLSKPFLRKEMELRMREICAGSKSRQEVVQESLDMYREVFIHTQRRIDMLKAACRKYLIEQATV

SEQ ID NO: 37091 - protein, 66 aa, A.fumigatus
SMPQHERPHIRNYVNRYDLSQTTKTESQTAETNKTTHMSINLRILQTDKRQVIQLAQRATNLLQKH

SEQ ID NO: 37092 - protein, 902 aa, A.fumigatus
IGIARLPVVLDIKDDISHDSVNIRAKIMEIPKNVRRFQSILQSDSMLAESKEGDDVERNKTTLAHVFDGHLRFCTETVKSTLEVLNQLSRRVDHKINLQEQPVDSYGHSQGDQKLIDPTNEFSLYQQELLTKDTLEVTTSAMEKRILGTVDDHTPALDEEAKKRIGIESALANISALHEETKRRIDNIESELAKVQQSLSVGVVDQEQLNETVGGLKADMGNLRTSLQSLSREGSDSQVGVDTIVHEQLQSLENRVRSLERAASVTPLDKKQIEQELDELDQAVINMKNSHAEIQSKLDSTVTETQVKEALKQIAAHLEQETGGMKSQLRGLVEALDEVKHAAIQSKNNDPELAKQLEDIERAIDDSARKVQCFKKDLDTHAVEHKSLREAVNRALEWNKELEDGIKQKISRVTETILETNARMHISTETRDKLEEYKWHQRNMNMSIWGHLHKCMNALGIRFDLSAANLVTVHDKNQDPVEKPESNDEHLAAEHGAHKTETDVADKWPSQDEAQAAGFGVQSLKKTAQHTKDEAKSPKGEAQIKEQIQTSDDQHCASAQSEPINPRTSNPASQAISGPKQSPVAGRSDEAVKHDKADTAQSRAEHNQEDEKGHESASYETHKEAIAQPKASVGTQSLQVPGSVKGRSSEKHAPEPLRLKIETHTSARHEKDQASAQLPSKPSIESTSAKLSKSRWALSTPTQPQSKTPTHGETEEGQLITPTLTEPPSKPITESISSGMSNSKWAPSTTTQAQPETLERTQSLQTSGSAEGKSSKKHTPRTPGLKQEASAFSAKREKSKGADTASAQSPSKSSTESASAEMSKSRWASTPTQTQSKTPTHGGTKGDQPASSASTPEVPSKPPASGELSKSRWADDSPDAKRSKGVSLPSEKYPKGDLGETF

SEQ ID NO: 37093 - protein, 97 aa, A.fumigatus
DYRGLMARDKNGLQMHPQQISKMQSITNYKPYTRRLGMDSCIEHGESSLPAKAGLITTASAVVDLTIWGLPMTTPDSVFFDAASKRSGRKWTQSMRI

SEQ ID NO: 37094 - protein, 276 aa, A.fumigatus
SGWPEIFRRNLNNCHCHQILLGCSHDDTYARFLRETMVDYKYIGRVTLIEGVPLRGDMKAMKPSYRVAKFTHIFRETNIVSASASQETNARSSLTPSPVQHATSLSKTSANTTMTSNSPALSTSSRKMPKSEEFQPVVRSIRSKASSSSPPKIVERNKYGQRVDRFDIKTISKDDLARMKKLKLCNYFYLKGECPIEDCRHDHSRKLTKSEYHTLMIVARMTPCRYKFECDDPDCMYGHRCPHSEPGKRECVWGSTCRFDAAAHGVDTIIVKVTKI

SEQ ID NO: 37095 - protein, 94 aa, A.fumigatus
KQANKVGKLQLTKLSIPCRDYIQIHFPNIASPKFVTMIYMNVKGLADLCIQGGIKMELSVLEAFVRGFNGNGLLSDIIDVGTGKNKASDKIEGT

SEQ ID NO: 37096 - protein, 376 aa, A.fumigatus
TLRSVKSVVSAPKSNSNQKFSLIKDVEERTFVDLTGEVVKIFTNDSEKVALYLTDYTANEGLHNYTIDANNAREGDQFAYLSHPKRQWQGPAGRMTLQITLWEPHASFAREHLKEGSFVRLRNVHIKRSRIEGSPLEGAMHCDRQNPDEMNIRLIDAKNDDRGRELLRRRKKYWESNPRKRKAEELEETTSHRSKSQKSQNKIPTAKKEEGQTSLSLPRKHEVNKTSKLILVQTTRTKPNQCPETVQASNPSIKCTSLADILDGEFHENISPNQIEYRIPFQNVCYRATVRVVDFFPPKLEDFAVPEESDHKPRLDAEVDEIHNFHRADRSIRWQWRFCLLVENVPPHPHGKSSQRMKLFVSGADAEYLLKLDAAK

SEQ ID NO: 37097 - protein, 484 aa, A.fumigatus
GEIGFAGPASRRTEKSATGSKRSPSNASVNPLQLASTILKSCPMYDTIAILIFLLQLPPMVLTLVQFLFASLTFLPPSGASAGSLTSNFDIFQGPAGTPSLGTMIAMDGFCLLIWGLFMWTWAQNFALDLAHVQVAITLGGGGFGKNGGVNTLCVGIVLIMHLVRSKGIQDFVIGHLLSSNIISPDMLSQYSHLLPTEFRRTEPQTSPSWLRSLLAVHILAQAGTAMARRSMAKNRTPNPPRTGKRIDTEASAGSQTQIDSAFESGASVSSYIGADGQIVTSAAHKDGRDRLLSAKKRRRQANQVRSRQPFWAALASTKITVMREYEHSRALSKTARSLPMTEDDLQGLSLDDGLVWITEIDSSTIKFAAGDFSSADDSSGSGACEAGCLGSEDMEPFYVCVNGALWATATICKVHDAPKGSSMVHWRGEISGLAPNCAYTCSFVRSDTDEEICVISVKTPANNDAEQGKNDVLWIFHALEKSY

SEQ ID NO: 37098 - protein, 441 aa, A.fumigatus
LPQAAVSSVSTPPHPSYRPSSPTTTLKNSIVNAEAKLNEKRSRLRKAKNDHKLIISKIRKELDNYNHRLHSGTDENRQKQRSLQLERNIRQTEEATALLEDQLDNLENVPEEELRKWSDQKAKYEHELGLLNSAKEELASARSAIAREVSSLETELSSAIQRRERLQSRRTRINEQYERIVSANAQGLNERERRAAEQFAREQDQAKLEATFNEQFATIGQSVQEYQLRAQQIWQQCDAIEQAIQQQHQQMLLDPGPLTPEGNLPGTNPFSESALPLGALTSTAPSSRSLLGLSFPPLKSSPLQTASSPVGASSSHPTSPVQQPSYLNFPTSPLVNASSHLDSDFVYRHRSFSNRSARSSLYGSDFMDSSRRQPFQLDLSELLADKRSPGSDSNTALNSGLRPVSSPCQRAGSRGSGSGSNGSGGSGSGSGSPSSVYGKTN

SEQ ID NO: 37099 - protein, 74 aa, A.fumigatus
TPKPAWRRLWFSTSKLGRQKMRILRQHIGADDVRGKKMTYDKILYTLAPYKVHYQNYTNTEGVHPPVFSKSSST

SEQ ID NO: 37100 - protein, 90 aa, A.fumigatus
YEIMNSPDRACHLAKQAFDDAIAELDSLSEESYRDSTLIMQLLRDNLTLWTSSDGNEAEGAAAKEDKTEEEPTPAAEEKPEEAKPAPTES

SEQ ID NO: 37101 - protein, 240 aa, A.fumigatus
PSVISKVLDSWDAAEDSEVEREKAAKAAAAAAKAEAEAAAKKKSKAQRIEERKQERKKLAEANESDEDSEEDEAARRARLRRTEKEGDLKHAQDLFEDIDLNRNRGTPKAIVISDSADPTQAVDLSAMPLFKPTTKDQFTRLTSTLIPLLTAHSKKPHYALWAQEFTKQLVKELNSGDVKKIASALTTISNEKMREERAADKGNKKTKAAKTKVSLVASRDNKIDATPYDDDGLDDDDFM

SEQ ID NO: 37102 - protein, 396 aa, A.fumigatus
PPSPQRRIYFGPETPTLAPLTTQGNLPFRRLCIDYGCQFTYSEMAMGMSLIQGQKSEWALMKAHESEALPPTISSTADVVQGYDNSKDFKFGAQIAGNKPWHAIKATELLSRLTPNLRVIDLNCGCPIDQVFREGAGSALLDHPSKLEKMLRGMNAVSEMIPITVKIRTGTRDNSPNATKLIERLVLGGHESGILNIGPPGVAAVTLHGRSRQQRYTKMADWSYIAECAALIKRLNEKKDDVTDTVREPDERMLPNGGKVFFLGNGDCYSHYDYDDHINNAGVDAVMVGRGAIIKPWVFEEIQAGQYLDKSATERLAMIEKYAKYGLDTWGSDEHGVGTTRRFMLEWLSFTYRYVPIGLLEYLPPHIQDRPPAWRGRNELETLLGSPNYKDWIKIT

SEQ ID NO: 37103 - protein, 148 aa, A.fumigatus
SLSPAFDIVTVLTVCANAFAISRAAALGTDRMEVQARKFYSQRNMYLCGFTLFLSLILNRTYTMILEVLRLEDRVKHLEGDKKAGGKDSARLAQAGDIGEIARLRKEIEAKDLDIETLKKQCEGLTREYHSLGDRVTGTTNDGSKKDL

SEQ ID NO: 37104 - protein, 219 aa, A.fumigatus
ANSQILLYLSSLFFHIYPRIKYLIMRSTRMLSSSLRAFNCALPRTMLSQPKSRHFSQLLIHSLQPSPAPSLRLLRTGLPQLAVRNNSSSSSSSSPNLTDQIPDAAQDAANEEQNRLRREQEPAYQITFTCKPCGHRSSHRMSKHGYHRGTVLIRCPSCLNRHVIADHLNIFMDEKSTLEDILQREGKRLTRGYVDGDMEFWEDGTVKKREEAGEGSEAK

SEQ ID NO: 37105 - protein, 571 aa, A.fumigatus
HHLTIQDRIIMADFRKPSIYVASMALFRDQVLRSPIQSDKETTIADVLETTVLFMIQLERSGHVIDRPLIRHCIYMLEGLYETITEEESSKLYLTMFEPAFLETSKAFYRAEGQRLLEMADAASFCRIALSRIAEEKERCHYTLSPLTEPKIKNVLDQELIARNIEEVINLEGTGVKNLLDNDRVDILRDIYELSARVDNKKTPLTTAVQKRISQMGREINASSIAYEKSSISAGSKATEKSSSGEKKSAEKEKPVNQQTVAAIKWVDDILALKGKFDSIWEKAFLSDQGMQSAITTSFSDFINSNARSSEFLSLFFDENLKKGIKGKTESEVDSLLDNGITLLRYIKDKDLFETYYKKHLSRRLLMKRSASMDAERQMISKMKMEVGNQFTQRLEAMFKDMTISEDLSASYKEHIRKSGDPDQKRVDLEINVLTSTMWPMEIMSNPKDGEVQLPCILPKEVESVKQSFEQFYLNKHNGRKLSWQPSMGTADIRATFKRSSGKVQRHELHVSTYPNDHTLPFPTTFPTGRVHSRFEGDSGTGRPFPQHEPNSKLAITGWRNQKPGFLKRAP

SEQ ID NO: 37106 - protein, 200 aa, A.fumigatus
DEHPANSRKGLSAAKTDDFDTIWGVLSSSLNEIHTKNASALSFEELYRNAYRIVLMTRGDDLYERVKKLEEEWLGSEVKKTVTAAISPTLLLAQEPADMQDQASERREAGEKFLTVLKGAWEDHQLCMGMITDVLMYMVCPSLLCVRWIRYLTSSYHTGSNHHGRFSKAFNICCLHGLIPRPSPAVSHSIRQGNHNCRCA

SEQ ID NO: 37107 - protein, 457 aa, A.fumigatus
PRTGASPATSKLKVALIETQDLSKARSWKLEPHQFSNRVSSLTPSSVSFLQRIGAWDHVDASRAQVYQEMQVWDGETGSRISFDWSMETSPFEDLPTVATMTENANLVRGLLSRIEVSGEENLSIFSNTTVSSIENGIDYSSGPDLSAWPVLSLSPSGPAGQSQAPSRIAARLLVGADGINSPVRRWAGITTDGWDYDRHGVVATLSLSEPVSPAFPTGTRTAYQRFLPSLGGPVALLPLPNNTATLVWSTTVENAAYLKSLSPRAFIAMVNAAFRLSMADLKYMINMERPANPIADAENPHEDELTWRLQHTPQPSHIPPMVNGVQEGSVASFPLRFRHASSYISPRVALVGDAAHVIHPLAGQGLNLGLGDVASLSKTIEYAVNHGMDVGDILTLERYAAERYATNAKIGAACDVLHKLYNVPGQGPVTWARSFGLDVIDRLPFVKSFLMKNAQG

SEQ ID NO: 37108 - protein, 106 aa, A.fumigatus
AEFSYKIKPKLPQQFKAAEQGGVPFAVILGEDELAAGQVRIKELGLEEGHPEKEGVLVDLAALTDEVKARLAKKQSQTSAKADISGVTQQLEAIKVEAPKTEDAGV

SEQ ID NO: 37109 - protein, 244 aa, A.fumigatus
KPLSKKKRVLPPPPLKIWGGKKKGGGENPRGKKGFFTPFFVKTLGANASAKAGLEEMGLLMDYLEAFGCLDKISFDMSLARGLDYYTGVIYEVVTEGSAPAISSSAPEAQKLQKSGKKDKSKSGNLDDEDRSNDPTLGVGSVAAGGRYDNLVGMFLPKAQIPCVACLIRSRPYLLHHQGQTRTGKEHPGTAQQRSRCLCHGLWWKGLHRYAQGAYGCMPETLERWNQGKPLSRLSLHSISRESS

SEQ ID NO: 37110 - protein, 418 aa, A.fumigatus
GGGVKGKGGKPSSGEKSAREAIKSLQDHGIPIPWKRRRFRRYGRSVQGTAQRNISRSIGKPSLWQARTYFVGNLVYAVAYWWGRKQIIAGNYTQTQFLMVVFSLLVSALLWSQMFALAPELSSARAAMARILSLIEIGSDKMQGHVRSPPTNDSNDPEATAEPKPIASNHEASSVQLRDVHFAYPARPDIKVLNGLSIDIRPGQFCALVGPSGAGKSTIISLVERLYTPESGAILVDGVDITKHRDVSFRDTMALVPQESVLFEGSIAFNVGLGARPDHEATMDEIVEACKLANIHDVIESLPDGYQTLCGPNGSQFSGGQKQRLSIARALVRKPKLLILDESTSALDAESEKLLQDGLERAAKGITVIAIAHRLHTIRKADVIFLIEGGKCVDRGTHEELLQRSESYRANVMHQTVA

SEQ ID NO: 37111 - protein, 1125 aa, A.fumigatus
TMALLLAAPLVKTNLGESLARYAIVEDSADGKRYMVWTIHHVLYDGWSEPIILKQVSDALQGQPVEVKAQMRDFVRFVRDSDDAAVQEFWRRELKGAVGPQFPRLPSRDFMPTPDALVERQVSLDTSSGSPFTMATLIRGAWALVASQYTGSDDIVFGETLTGRDIPLPGVESIVGPLIATVPIRVRILRGSTVESYLQAVQQSVLARTPYQHLGMQNIRKVSQDAQHACETGTGLVIQPEPEYVGSELGVERGDVVLEALHFNPYPLMLACGIRKGGFRVCASFDSSLIETRQMERMLAQLETACWQLSQGLSRKVDEISCLPEAELNQIWQWNRSPPLSLDETTSRLRANASTKPGSSYPPAVVPWVCSPRNSSLLSPIGCVGELWLEGALLSGDTVDSPAWLVAGSSTCAGRTGKVQATGDMVQLREDGSLVFVGRKENVVPVQGHAVDITEIERHLAEHLPPTIRAAATVVRSSSDQELVMFIEQPAAEEACIELLSEKREIVCDAPDKAFQTTICATIPGSLAAVLKKLDKYMRDSLPSYMAPSAYIVVEKLPNTMDDIDHNLLNQIASQVTPQILNELRDGLSNAWTKATAPNHLSASESILRSAWAKVLRVDPEQIDVDDNFFRRGGDSVLAMKLVSSLRAQGYSLSVADIFRHMRLSDAARVMKVDERSTEKINSYQPFSMLRLPDVQQFLANIVRPQLGDQHWPIRDVLPVTDSQDMDIRATIQPPRTSIQYTMLYFDNSVDRERLFRSCSDLVKTHEILRTVFISHESSFLQVVLNELEIPVRAHKTDKQLDQYVASLFREDIESNFQLGCPFLRLFYVEGNNGESCLVIGLSHAQYDGVSLPRLLQDLDALYTGTQLATFSPFSLYMAQTSEEAIQNKAAAYWRNLLSSSSLSTLDGPSSDPTDKAIFHTRPVNIHPLKEITTANLLTAAWAMVLARRLQTPDVTFGSVTSGRTLDIPNAENFMGPCYQLTPVRVPFHPDWTASDLLNFVQTQSAESAAHDFLGFEKIAKLAGWASERQGFDSIVHHQDWEDFDMMPFGGGSCRVDIANPHGDAAYPVKAVSFVKEGEIHVGVVGSERDVMFVDEVLGELAAAVVELAGQSTEVLLDSKLFSGQ

SEQ ID NO: 37112 - protein, 178 aa, A.fumigatus
DVHSSDFSTSRETTANPASSSAYPTPNTMASPCPDSSKTSTPYTPAPSSPPSPHSPCTWPRPVKRQFKTRQRPTGATSSPAPHSRPSTDPPLIPPTKQSSTLARSTSIPSRRSPPQTSSQQPGRWSSLAVSKPQTSPSAASPPAAPSTFPTPKTSWAPATSSPPSGSPSIPTGPQATC

SEQ ID NO: 37113 - protein, 397 aa, A.fumigatus
GCTACTLYANDHGPRSLRRFLPAARHRQLRLAWTRVIQAFPILRTVFPRFRGRFIQLVVRDIGDSNFYRIVEAPSGQTAEEWARALCTEAIQFRCPVDRPVAQLTLIQAAGSSALVLRLCHAQYDGSCLEHLVRSLMMAYHGRPLVVESDFQAYTRTCLRLRIPEVLDFWRRILAGSSPTQLASSMTGDREAARKINRSFFRREVNSLAAPAGFTLATVVKAAWSWVLRNETRSEDVVFGQLVSCRGSVPLPHADTIIGPCMNIIPVRVGRDLLGAVQAQHAQTMEFDMIGMDEIVRHCTSWPAGTEPDSIIIHENFHVDWEVHDGGVTIQKIAAVFNQQPSSLTFLITIPTETGLIAVLMAPANMSSTHADRVLDLFCNTLTRLAWSPAAVLRRSE

SEQ ID NO: 37114 - protein, 352 aa, A.fumigatus
  UNSURE (339): Identity of amino acid sequences at the above locations are unknown.
FWRFQLRDSTALNPEKVRGNPLVEIPNWTTVAILAEFRAGGAFVLLDPTQPAAYLSAICTMTRTALLLCSSHNQRLAAELRQTTIQVPRDPYHGAMPTSDFRRQSSPAVQPHHTLYACFTSGSTGRPKGFIIDHVAFNSGLQTYAHATGLGCDSRVFQFASYSFAPSITDQLASLIVGASICVPAEEELQNDVEGSISQLQATWLKLTPSVARTLDPGRLPCVKTLILVGEEAQVSDVAAWQDHGITVLGLYGQSENAKGTMVSRKSSEDADPGNIGSPFCAVGWVVDPDDYHRLMPIGATGELLLESPCLCRGYIDNEDETKLAFVSKPSWLTQVRGXGTAQPLLRTGDIV

SEQ ID NO: 37115 - protein, 367 aa, A.fumigatus
YNCVDGTFCLVGRKGNRVKLRGQRLELAQVEHHLRSCLSSTHPVLADVVQPANENGRDPMLVAFVPWADSQSAADATDGFFAPPTKDFQTQARAVLGRLRHLLPSFMVPSTLLAVRTIPRTGTGKIHRRRLREAASMLSRKQLMAYISPFIPYRAPETELERKLQRACGRLLNIEADQISMQDNFFDLGGNSLTARQLVAVARAEGLQVSVAQIFQQPTLAGLAQTDRHPVRRAEVPRSSHDPDPFGRVRDDVRREGLPHIARGNIEDALPVLYTQMTTARDHCVDFFPLRVIGNFVWHGLGSSKPSPFYGRCSPDSGAALSSLLSGISETQTFTESSKLHPARRPRSGQGPSVRRQSNSDAQSTGL

SEQ ID NO: 37116 - protein, 99 aa, A.fumigatus
RLIVLIAEYGSDTAVASGAVLRALNQELGPIRIIQSSYGYLRTEPWDPELIKAHNSSKPKQVDPNNGDLYVKNTICWVLKKVWRRRPRPKLVYIVCWLT

SEQ ID NO: 37117 - protein, 170 aa, A.fumigatus
IHAGQGDEVPPFAEYRFRTLFTFPANTKQRFKCNQHLYVSDMTFLRTEGHIRPVKPDNELGRRHYRVEYDLVMIVDGYNIRYEARWDNGQGEQVHAEKQINIAAAFASLEPEWESDEDGEEYLTDLCIQSGQRSKSIAIVDCSIPTAICLLNGTMQVADVCSIPPATHCL

SEQ ID NO: 37118 - protein, 751 aa, A.fumigatus
SSRPLRIPLGYVYLNRSFAITLTENAVFEPVCTSQPTDTRQPSPLLDTRDPFYSSVTPQLYAIGCATVVSYLLVIILLITPRTFYVGGPGGGANFLGRHGMISGSYSGNSSVVGVGGRPWLQKVAAILVAVSLTIASADSFRVAERQYNYGYSDAEALTEEVIDGTEIRVVRVISSTFLWLAQVQTLIRLFPRHKEKIMIKWAGFALIVLDTIFSILDKFLVKTNTTRPRLYDDAIPALSYLFELALNLLYAAWVIFYSLSKHRYAFFHPKMRNICLVALLSLCAVLIPVIFFVLDIAKEEIAGWGTYIRWVGSAAASVVVWEWVERIEALERDERKDGILGRELFDGDEMLEVTPSEEVDWPRQTYGGGDRDGGSGTSSGWGGVMGLANRPLRTRVGLPRGNRKPDKQRKTVSSDVRRHGAGRPTPPPAATTPVSRADTTSAASTVYNVHYHPVSSPTPPVVMPHMEEEDEYETGQLKEMTMRTEDGGGDVGQPRLSAQQTREESPQIVNMDGRWRTLLNPFRKRRASLPREVASAQADEDPSTAQEDLYGDEGDRPRAACSKQGYLFPFNFRIRPGSDKRDADASLPVTVIPARRRGQNTWSPQWLNDANILEPTPNRVVRSNRSNLPVRVIQPQTRTAAPWSIPEGDTILGNGNYELRYDPETAALIVPDGHQAQQRTAASSTAHNGDGQPVDEATAGPAGHDAPDMLRESQISAPPEQPPSSTPSRQDGQRSPTHPSLGGDPSRDDT

SEQ ID NO: 37119 - protein, 464 aa, A.fumigatus
LDLLHKLDNTGDVARLCRTCRVLNYMALPQLYKHITLTSYDKIRYRGDEPEGIGSASPFSMGLNAIITRPYASLVRSLTLRGDWRENELEEHARVGRVPDSSMMLNIAVRAAVDRMTELESFSWELSTKMLETVYLGLAQRPKLTSLSIRFPSSRHPRPTIVIPPMPHLRSLKITHIDPLCYPDDISTLLWKCKKLRELKMHWSPRMRIEQEPSVMLHDYFRKCIAARQPLKVKKLALQNLYARHSEEFKVALDPSALEDMTFLSECGSESAKSLNTFFDSSWPKGPPGQVNFKSLRQDSTSRRHAEFLSYFTGLERLYFVNASRDSSDDVNSPRRLLPSSALTPPSLDHTANSSTLSASTEETPAASPGSNTGVQASIRDIYLNSIIMNHCATLRHLLLPSRWPLSASTIARLVHASPQLEQLALATDLSSMDTLGLVLPFLRNLVAVRLLVPTGPGSSSAVF

SEQ ID NO: 37120 - protein, 511 aa, A.fumigatus
LELRVLSGQSWKCVNQIRAHEAQVTDVALHVVSDSCLIASSGRDRMVQLFRSTDESLELVQTMDDHVGSVNQLLFINNGEKLLSCSSDRTVFIRERMTRETSGETAIAYLASRAVTLKASPVSMTLSTEDPNILIISTVDRCIQQYDLDSGKQTRSFRTTDSDSSDTVVMTALSMASHIPGKCPTLLMGVASTDKSIRVYDMEREALLTAEFGHAEGVSDVCLLTRDSDCSGKPPSRTLVSAGMDGVVMIWDLVVQAQQSPDYTQTNLSEEEVDSVSKKSTVSKPLRKILSKHELAGFQRQDNITGTPTPVRDSSQSLARKISKISLTPSSLKNEKSAPATPPFSRSDRRSPPSHSRLQKLRKSPSPSRRSTPGKKLGNTNNHSRRISLDFRSRGRNVSKSESGSLNISTEQVCRTLKAYRKKLNTSTEYLHSQKELQRELDLTLRVLAARPNGCGNAETETDSSGKENDGNQNALQSPHRMHSAPSLRQKGTYNRSRILCSNDNGENSSE

SEQ ID NO: 37121 - protein, 676 aa, A.fumigatus
TLPPWCSALSDLYYRDSNTPKMAPPGYRLRALSLSPVFSILILPFLLFFLSFPAPTSAAGSAVLGVDVGTEYIKAALVKPGIPLEIVLTKDSKRKESAAVAFKPTRESNAPFPERFYGGDALALAARYPDDVYANLKALLGVQFQNGDNEMVKTYHNRYPALRLEAAPGDRDTVGLRSNRLGEAERKDAFLVEELLAMQLKQIKGNADSLAGKGSDVRDVIITYPSFYTAEEKRSLELAAELAGLKVEALISDNLAVGLNYATSRTFPSVSEGQKPEYHIIYDMGAGSTTASVIRFQSRAVKDVGKFNKTVQEVQVLGTGWDRTLGGDSLNDLIVHDMVANLAEDKKLKGRATPAEIQAHGKTMARLWKDAEKVRQVLSANTETGASFESLYEEDLNFKYRITRSKFEELAADHIARIGGPIERSLAAAGLQLSDIDSIILHGGAIRTPFVQKELERITGSSEKIRTSVNADEAAVFGAAFKGAALSPSFRVKDIRASDVSSYAVLLKWASETKERQQKLFTPTSQVGPEKQVTMKNLDDFEFSFYQQIPTVDEVVELPVVRVQTQNLTASVSQLKEKFGCLPANITTKFSMRLSPVDGLPEVTGGSVSCEFEVKKGGVVEDVKGFFGLGSKKDEQTPLGEDREPTESITLEAEEPQVSTTSSAAEASTTSTKETK

SEQ ID NO: 37122 - protein, 186 aa, A.fumigatus
DHFFPLHCLFRDLHRYGSHWIFFYFFFCFRDGKEVIQRQTPIIPSEYQKYLEQGLPAPALSSDTVRYWSDYNRLFYHPRSIVQLNDYELNSKIMPFEDWSVGDDLFGELDKEHDLFDRDLRPFAEECDQLRALQLFTSSDDAWGGFAAKYVDRLRDEFGKKAVWVWAIEGGKKVQKVSLFPPRCHN

SEQ ID NO: 37123 - protein, 155 aa, A.fumigatus
LAIPCMFPFSRANRKAGPYLTLPANRGAKTAMTVALQSSDLVSALIPVDNAPVNAPLKSDFGKYVRGMQEVEAQGVTKQSDADKILKEYEEVSFSLLCSDWVLGQSSKSRKTHTNCTVPPHPSISLDQHSSRGRWSEDEIPYPFIGAGTGYSCYG

SEQ ID NO: 37124 - protein, 134 aa, A.fumigatus
  UNSURE (123): Identity of amino acid sequences at the above locations are unknown.
VSPSCAQTGSWVKAVKAGKLTPIAQSLPIRQFLLTNIVRAEDGQKMKFRIPLSVLGPAIPAMADFPFLEPGSVTYDGPTLFVRGTKSKYVSDDTVPVIKKLFPNAEIADVEAGHWLISQHPEXFTTGTEGPRMR

SEQ ID NO: 37125 - protein, 84 aa, A.fumigatus
LADLPEFLHVTSNGRSSLWSVSQCILSVDDEIAHGLQDLRNHGHSFHHHEHNYSVMAKDVEKFIHQHDLAKCVLIGHSMYVSIF

SEQ ID NO: 37126 - protein, 450 aa, A.fumigatus
  UNSURE (1),(3),(4): Identity of amino acid sequences at the above locations are unknown.
XGXXLVEPRTPVDPSSPVVKTIIGYNGTAQSGYRIANEPMTDALYNTESEVHPDISSNPRISIIALPPHPSFLQTSNKLLFLLFGPLKVAFQIVCLWWALAYRTEPAQWLLVQVRTLPAQIDSQVSFLPAKFGPMQNPPSIPTLAIASTASFLRHSKLIIDWHNFGYTILALKLGDRHPLVRFSKWYEKSFCRYATAHFCVTEAMASVLKNHFCLTAPILPLHDRPASHFQPIFDQSERKSFLESLPETTSVKDLLRAGSLRIIVSSTSWTADEDFSLLIDALCRYSNLASTSKPWLPAILAIITGKGPQKEMYLKQISKLQEAGKLSKVTIRTTWLTTDDYARLLASASLGISLHTSSSGVDLPMKVVDMFGAGLPVLGWDRFQAWPELVTEGVNGMGFGSSGELLDHLVDLFENPSKLEKIRAGARKESNRRWNDEWDPIAGRLLGLT

SEQ ID NO: 37127 - protein, 99 aa, A.fumigatus
LYSHQLTVDIYIKLSYLSTTAYSHYSPAKTTKIADLHPLTLPLWFWCEILFLIILFASRSCFKYLPCSYRTPIPTFIFHLSFMIILRTLATYLLQYCAR

SEQ ID NO: 37128 - protein, 70 aa, A.fumigatus
HSANLVHLRFSPSENDVEVVDVRTFHSFNNFPDTLFFCFSTLAVDLNLFQFIRSSPSWPTAWGRKSAEKA

SEQ ID NO: 37129 - protein, 275 aa, A.fumigatus
QQHRKDAIIQSFNLNLRDFRPTYRESVDFISIAVPEVGSNTNALGFIRYEKKSGRVILVNACAQLRTDALQLGHTSKKGQLQFAGCHGEGLKLAAMVMCREGYSVSIETGNSYWSFAYGGPSKSRFCCNIGPLSVATPDGKLNPAQDMACFTYRTWRDVCVEVGPDSEGTGGGVSLEKFKQWLTVSLDIRGYSYPESIIETDQGDLIIDPRFRGKTFLKGLLLPASVLEARPFELSYNFVQGGVNRDRQRLISRYEQADLVRRIWESAIRENEGL

SEQ ID NO: 37130 - protein, 79 aa, A.fumigatus
PLRPMIGKPRNMSMSHPLLLTYIVAVTVYVTWGSATIMDLKTIYFGRLVSYQPVEVGLDLIHHICSDFAKPSAFSQCTC

SEQ ID NO: 37131 - protein, 132 aa, A.fumigatus
QSWCFGMQGSSTFRYQLNCGLDLLSASQENQNITVPFLQVYVKYSFDGSFHIIFCWVFEVQNVDRIHSSLKTNNSSDASSQFAGFSVALELFPGEEFQKVFSLQSRTTDHNSEVGASLHDFFKYSKKNIGTQ

SEQ ID NO: 37132 - protein, 70 aa, A.fumigatus
SKLRRCLAIGSSAAGLYNAGMKVEEISNSEAIVNAGLSTTFSYVNSKTTRKSYASRFIKETQSRHIGRVI

SEQ ID NO: 37133 - protein, 163 aa, A.fumigatus
SSAGFSRYRMSTGYIRPSRLIILPMLPPSSPASPSPWNCSPAKNFRKSSACRVALLTTIRRSGRLFMIFLSIPRRISVLSDRSCASSTMIIEYRERRGSTRTSLSNIPSVRNLILVEADVTSSKRIEYPTSSPNLQRISSATRAATVVAATRRGCYQLSNYTY

SEQ ID NO: 37134 - protein, 565 aa, A.fumigatus
QPRRVAATTVAARVAEEMRCKLGEEVGYSIRFEDVTSASTRIKFLTDGMLLREVLVDPLLSRYSIIMVDEAHERSLSTDILLGILKKIMKRRPDLRIVVSSATLQAEDFLKFFAGEQFQGDGEAGELGGSIGRIISLEGRMYPVDILYLENPAEDYVERAVKTVFDIHLQEGDGDILVFLTGREEIETTIQLITERAATLHPKTPALLPLPLYSGLTTDQQMYVFEPAPENTRKVIVSTNIAEASVTINGIVYVVDCGFAKLRAYNPSTGIETLTAVPISKAAAVQRAGRAGRTKPGKCFRLYTQQAYEKLPDATVPEIQRSNLAPVIMQLKALGIDNIVRFDFLTAPPADLVIRAFELLYSLGAVDDYAKLTNPLGVRMAELALDPMLAKVLLSARSFNCLSEILSIAAMISLQGSIWVQHEGDKKSVESSRRKFAVEEGDHLTYLNVYQAFVTKGKKDPKWCRDNLLNYRSMQRAVSIRTQLKRYLERFGYQVDETLSGRHGTADLARPAEQIQRCLTTGYFAHAAKMQPDGTFKTVSGGLTLHAHPTSLMFVRARHCQCLPP

SEQ ID NO: 37135 - protein, 103 aa, A.fumigatus
LKVVDRPALTMASELEISSTFIPALYKPAALLPIARHRLSLLYLVETYPVTIVVGQTGSGKTTQLPQYLDQAGWCADGKAIAVTQVLFYPLHHDPQHVSMCNC

SEQ ID NO: 37136 - protein, 66 aa, A.fumigatus
HKMSGHHHHSHDHSGHCHGEDGHDHSNDITPAIQSLLYSQIAFDDITTLNGMPTVAFYMVVREHGC

SEQ ID NO: 37137 - protein, 337 aa, A.fumigatus
ATRCIVSTLLTVIVGQHGGGYHQSDIHDSAMIIAYYKFCYIATVLYCPMALFVKIALLSIIIRIFAPYRRKIIFIYVLLGCLCIYYIIAEIVKIRMCDPIPSYWEGTPGRRCLDQSAALLADSVISVVSDLIILLLPLPLTWSLQMSRNKKLRVIGILSAGGLATAFSIYRLILVVRDGNTTDMTIFFICIIMSGYAALVRVSVLVIGSDCGRNAEGGVGLICACLPSVNLLINRARKTGYSSNRYAEQESSVQLGPVRSAAKKRLSRGLSKSDTYVDPTEFGNDQSHLISHAGAVDGESRDAALGIHKTVDVSQTVEVLDGNRRHSGSDSSHPSRY

SEQ ID NO: 37138 - protein, 319 aa, A.fumigatus
HLPHSNVPLVFWPKNMSMAEVAGAEKVRGRTRKNGAYSHGQAQLQPPFSRSLHDSRKQETGGNGPRPKDGSVTETTDRSPDVLLTLPTISRTANHHVYLVQDDIQSFLHTDLDLSRVNIIHNLLWMAGRPMNARPLLRQKMMGFEIIPTERADLHLLKFSTKLLVKPLPEYVLDYDFWTRHLCSSQTLHGSATGLLLSYLWLICTPLDLQLAHDHRLIPHDVTWPWWKAFVTEFYARVDVNALDTVNKRYQFGELRLGRINTIYRVRFFLSHFIRGYLYGYNRYVVFYERNFAWMLMIFAVFFAGVVRDAGGGGCAAVE

SEQ ID NO: 37139 - protein, 107 aa, A.fumigatus
LTARQVNTAMQQQWKDAYPGLLGKLLTTAMLAVGRNVEQGSFSALYAATSPEIEEKGWNGYYFSDVAQPGKESAQASDPMLGAALWDLSHRLLKEKVGEDGLVDWNA

SEQ ID NO: 37140 - protein, 237 aa, A.fumigatus
YMLCQMLTAKQLILSAGINVNQYGETADGLDRHFEVNFLGQFYVVNQLWPLLRKTAKMPGTPPPRVVFESSEQHRNAPKVVHFGSVDEINNPEIGTTEVYGRTKLAIILGVRYGLLERVIKPNKDNIYVLSVHPGAVRSFPSRLSVWSNSSLRDRSTRRCSSSGKTRTPGCSASCSRRRCWLWAATSSRARSVPCMRRRVPRLKRRGGMGTTLAMWHSRGRSRRRRRIRCWGLRCGI

SEQ ID NO: 37141 - protein, 82 aa, A.fumigatus
EVKMALSSPLATPSVRFHCPMQGPQALARTVPPASEKEARVWSRSRVARICSLPGVMKKSALGFRPAADACLTRSSARVMSS

SEQ ID NO: 37142 - protein, 62 aa, A.fumigatus
  UNSURE (35): Identity of amino acid sequences at the above locations are unknown.
IGSCRNEGCFYDGIILSLLGLGQNHGKRLELNPIXAALSEGFCTKHTTSALGTSASPTISID

SEQ ID NO: 37143 - protein, 180 aa, A.fumigatus
RAAGRYPCAACKDLSTQKVVMRLVTNRRQTLLYLIRRSYAYIYALLISSEPVSEALLPVYNQLQTLRRCLLEVKESGGVSNSRELYPYSMKVSNLQLPCKAQKLTSYSSTPLTTCELTANFTWETTFLKDRAALMRCWLNAMILYGSCARLYLTTEREKALNSLLVIFLYLVPFFFVSTA

SEQ ID NO: 37144 - protein, 330 aa, A.fumigatus
VPRTRCRDAQLHWYGHLLQHGCGGRTHHLGLPLLPQYGFLTCRRRTVAMWPRRAAEIAASGPKNLLRADDGAEYDQLITIDLSTLEPHVNGPFTPDLSVRLSDFANTVRENKWPETLGSGLIGSCTNSSYEDMTRAEDLVKQASAAGLKPKADFFITPGSEQIRATLDRDQTLASFSEAGGTVLANACGPCIGQWKRTDGVAKGEDNAIFTSYNRNFPGRNDGNRRTMNFLASPEIVTALAYSGSTTFNPMTDTLKTPSGEEFKFRPPQGSDLPSAGFADGNPALQPSAGVPDASVEVIVSPTSERLALLEPFAPFPEGELSGLKVLYKV

SEQ ID NO: 37145 - protein, 105 aa, A.fumigatus
LGAYFSRIPTTKRPSYIGSTFPSYFLSAIGIMDSPAAPVPFDPQEQPILERLLRTRDALLLLKQDKSSYIKSRDVLPLYEEVISEVEKLNAVRKEQDRRLTHNRR

SEQ ID NO: 37146 - protein, 67 aa, A.fumigatus
FSAGDIPVSCPLLFCINGLKYGGSLFFEVCDFSPDFSSGVCLGAFWDAMTPFNRNELSPLCKLDQGS

SEQ ID NO: 37147 - protein, 380 aa, A.fumigatus
LAPKCLSPQQLFARRGLATEASAARMPPYPKIVRNLEQVRKVLGSSRALTLAEKILYAHLDNAEESLLTGTNNGKDIRGKANLKLKPDRVAMQDASAQMALLQFMSCGLPSTAVPASIHCDHMIVGERGADTDLPASIEGNREVFDFLESAAKRYGIEFWPPGAGIIHQSVLENYAAPGLMMLGTDSHTPNAGGLGAIAIGVGGADAVDALVDAPWELKAPRILGVRLEGRLSGWASPKDIILHLAGKLTVRGGTGYVIEYHGPGVETLSCTGMATCCNMGAEVEPTTSVFPFSPSMGSLPAGDAPWPCGPGGRPRSPHLALRTFCGPTMEQSTTSSSQLTCQRWNLTSTGPSLRICRCVYLTLPTPSARTSGPRLWVLD

SEQ ID NO: 37148 - protein, 92 aa, A.fumigatus
QNTLVTGIAYQLVPDDPLINTEQCTRDVKLMAELGANAIRVYHVDPHANHDGCMKVLADAGIYLFVDLDTFDTQIEQVSSHCRIHILPPAGP

SEQ ID NO: 37149 - protein, 342 aa, A.fumigatus
TDPHWNETQYDRFKQVLDEFQKYENTAGVFVGNEVLTTKEGSAAAPYVLAAARDIKAYRDAQNYRNIPVGYSAADIAELRPMLQNFLACAKNPSDRLDFFALNAYEWCGDSGYVQSGYRELQRNASGYPIPIFFSETGCNAARPRTFDDQAAIFGEHMSDTWSGSMVYEWIQEVNDYGLVSYGPPAPNAPPTDTLVYDGFTRKGVPTPVSPDFHNLKTQWATLSPTGVALSDYVQSTSTISPPECPAYTSGAWEVDPSSPLPTLGQTQTNSGPTYQVTNVSGSGNLPVLSATATRSTSSTPTQVLHSGAASPLSLPRIVGSKYIASASVSVGFVIGMVAVFL

SEQ ID NO: 37150 - protein, 365 aa, A.fumigatus
  UNSURE (122): Identity of amino acid sequences at the above locations are unknown.
ENNPVLDHGSKQVPLPPGYQAIPRPRKGSCPWLCGDSRPWVLHVPHLKEWTQASNFNQSGLQGTQFECPNLVKFSVDDCDDSEDPTKWVLFISVNPEAPLGGSGTYYVVGSFNGTHFTSESXRETLYDFAKDNYASQWYSGIPEDEPPVSIGWASNWNYTQQVPTGPLEGWRSSMSLPKVHTLTKVDGSWVVTKEPFDGLDSVRGKQLKGKRSRNGDVTFDFKNVKSNAVAFDVKINGIPSSGATGQVYFNFTSSTSGEYVDGGLRLDNGFFWINRAGTHLFTQANSTGYWPVFNTTVKSYDHHKFTFSGVIDRSLLEVTLAEGVQTGTMSFYPTHPLDTLTVSGSDLSKKTSFRAKAWGLESGW

SEQ ID NO: 37151 - protein, 77 aa, A.fumigatus
PANPCDCSGAPKDESTIVSRIVSAEYWQRQCHAYFPEVNGYTFGSANGKTAEDVNKWTKGWDLTNTTRLIWANGFVV

SEQ ID NO: 37152 - protein, 186 aa, A.fumigatus
  UNSURE (126): Identity of amino acid sequences at the above locations are unknown.
PPSKKTTRFSTMGPNKFRYPQGTRQSQDQERVHAHGYAEIRGLGFYTSPISRNGRRPPTSTSQVCKERNSNAPTSSSFQSTTATTQRTPPSGCSSFPSTLKRHSGAREPTMSLEASMEPISLRKAXARPSMTSPRTTTPLSGTLASPRTSPRSPSAGPATGTTPSRCPPAPSKAGEAPCRCPKCTP

SEQ ID NO: 37153 - protein, 61 aa, A.fumigatus
PVGLGHAGQYGLRKLEQGLNLDTVEKSIPLSQILQDEKGLVKVYSYINPSRTWLFTTLNEN

SEQ ID NO: 37154 - protein, 73 aa, A.fumigatus
WQYFVPVVEGMPKNCSKDLNRVVEYIDHVYESGDIERQQEIKEMFGLGALKHFDDFAAYVAFAFFERRIMPWY

SEQ ID NO: 37155 - protein, 499 aa, A.fumigatus
RHRSIRTLYNCACYAVKPAAMSESPKSEKYMCLTRFSTPVPELDDHRFQLDSPPRIEATADISLSRQNTAQHAYHQETPQRPDLLSIQDALREAGSLSRDFEQAILDDDRSGKDINTLGRRFSVDPNGNVRHGRTWSRTHQELANMSRESSPSARSSSPPNSVEAFADPRRRERANTLESHAAPDLEAILQRTVSGGTHPRRPTFSNASAIRPQPGDIQLEPNDESCVPTYEQPGRIPVIDYEELEEFVALSRQMKPSTSRRKQSLSSQSRGPRVFYDLRPGLRKSDVEGEKRSSSADRSSSDLMDADLKTADKVYANVVDEKDIVEKLQNENEPTRFGFFSSESQSTVHAAEMGDLVLPGDTFRDLFQLGPEGSVWWLDVLNPTEEEVAALSRAFSIHPLTTEDILTQETREKVELFKQYYFVCFRTFYQLDKTDERFMEPVNFYMVVFRDGVLSFSFTEKSHAANVRKKMGKLPDYVSLNNDWICYAMNVSHKGLDF

SEQ ID NO: 37156 - protein, 201 aa, A.fumigatus
KSHFSPGGYIYNCCSVSRDTSQSVHFIRLLPFQAPDFLSCLSNQTVDLAIFDVPDTAMSVSSFIIRTPCSSANIGPGFDVIGLALSLHLELHVTIDSSKSSSEHPLNCVITYEDQSKSTEKISLDPEVNLITRVALYVLRCHDQRAFPVETRVHIVNPIPLGRGLGSSGTAVVAGVMLGNEVGRLGLSKDRLLDYCLMIGR

SEQ ID NO: 37157 - protein, 144 aa, A.fumigatus
IWLEFHIKHIMFGLPTDNYLYSLERHPDNVAASLFGGFVGTYLNELKPEDVARKEIPLSEVLPAPAGGIDTGRRPPEPPLGIGHYRKFQWAKEIKAIAIIPDFVVPTANARNVLPTTYTRADVVSPTHLNHPHHEPFAMRFSLV

SEQ ID NO: 37158 - protein, 97 aa, A.fumigatus
  UNSURE (34),(58),(85): Identity of amino acid sequences at the above locations are unknown.
VFNLQRAALLPATLGNSPPEPDMIYLAMQDKVHXPIPEDTYPRLERESFNPMNPSTQXGANLGICSIPGQEPTIFGSNPMNRFEXNPRTPSLFSIWA

SEQ ID NO: 37159 - protein, 266 aa, A.fumigatus
PAWECLQLPHLICAIASFSVENFASLQPWIALTRCLKIQGKSLALPYARAVHEMVPTTPLRNDLNIRPHESINDLPVHRLTDPQIFYPVSESRQFTRVDAGRVFSAAPALPHKEAERAVAHPDEAISKITQDPARIERVGKGDDEQQVLQPADVRIPHPHLVSHERQVKSNPNEFRENMKLYRERLQQEEAIEQERKRLAKERAEQRLVRVQPEGSRFEFRIKDVVVSRETTGTDGRGAQAPGRRYGVPTYDRKKGQIKIPTRVEV

SEQ ID NO: 37160 - protein, 139 aa, A.fumigatus
RQLKQHTPGRTNYITRLKGNAGNRPFPLNPNFVSEPILSEELRNEIHRRVVDKKQSVRAVSVDLGVDMRRVAAVVRLVELEKRWKQQVCMFSFLSALFQICRLFPVLRWHCTMMRTTKISISLYEPELNLLGNAYNSHI

SEQ ID NO: 37161 - protein, 249 aa, A.fumigatus
ENIGFTGIKIRICLEEVPTDQFTPERILSPEEPLGVVLDTYFPGGQTVDEALVIDIPQRRTPKPSPRHPVYYHHSEPGEHGEYFPLMPANPNAPTPPTHLSASSTSVNAHHTGPSISILTTGMAPPLPSPGNRANRHSRRPPLTRHTTNSPTMLGTAPNPKGMRGLSLLFFVPLRAHSLLTRCRLEYGLVSSASRSSAPGPYATWSSSRVAPDQDAHAASACCLAAPSSHETEEGRQRPIAKRCLWWPY

SEQ ID NO: 37162 - protein, 238 aa, A.fumigatus
LDVDSNMASCPQPPVAAPQVPTPPGPPPESPQTKTHTPPARVASPRPRPTKPKKAGNGQSPNAAFGGLIEGTVPPINVLIVEDNIINQKLLEAFMKRLSVRWKCAANGEEAVRKWREGGFHLVLMDIQLPVMNGLDATKEIRRLERLNGIGVFTKTASGRSSASSLSPEVNQASSEVSLSEEDTLHDLSLFKSPVIIVALTASSLQSDRHEALAAGCNDFLTKVCHSDATCILVRVDG

SEQ ID NO: 37163 - protein, 146 aa, A.fumigatus
PVGFPWLEQKVTEWGCMQALIDFEGWRKWRGFADEPQSSSPTDGGFTSPLQAGANGVSSKTSTSPSSAAVNATARAFATGPGAGKRKSTVPELTKPVDILPEEPPGSGSGEGNETLNSPASPLTSVHVGDPTEPPGDEEQQALDAT

SEQ ID NO: 37164 - protein, 126 aa, A.fumigatus
HPMEMHTFLFSPEKVFIKALGYSEDALSRPIIGIINTFSGFNPCHANVPQLIEAAKRGIQLNGGLAIEFHTISIHESFYHPTSMFLRNLMSMDTEEMIRAQPLDACIMIGGPFIRFPILAKPAPQT

SEQ ID NO: 37165 - protein, 192 aa, A.fumigatus
  UNSURE (178),(179),(180): Identity of amino acid sequences at the above locations are unknown.
SYRKALFVRKLTASSELTVKIVNIEDMTKVKYLREQAKGTKHVSFDPNGRYIAVSCTDGLLYIYSTFLEEPELVRKLDGVIRRLEAEDEATAKIAWHPDGTAFAAAEVTRDIGIYTVSEWKKEKVFSGGHNGDITSVSWSPNGALLATAGADGKILIWETKTQQVLHRYDFSYVGRPXXXSEQGGAEIMPWG

SEQ ID NO: 37166 - protein, 264 aa, A.fumigatus
  UNSURE (31),(32),(46),(61): Identity of amino acid sequences at the above locations are unknown.
CWGYAGATAHSSSPSAPLNPGRSLGQTLGEXXDASPFRTFPLSQQXIRTLSNPLYLSSSLXVLKVNIAPDGAIIKASASKDRRLLTHTGPAVVFENPEDLAKRIDDPDLDVTKDSVLVLKGIGPIGNPGMPEAGLIPIPRKLASAGIKDMLRLSDGRMSGTAGGTIVLHISPESALPESPFGVVQTGDMITCNADSGKLNLEISDEELKFRVETRKKEADAATACLHRARSRGYRGLYERSVNQAQDGADFDFLTAVGPSDISK

SEQ ID NO: 37167 - protein, 290 aa, A.fumigatus
RKVIRPTHQAFVSWDEGNDPGVKFRDLDDVSESMKQRIRKFKELGLSPRSSAPGHLSLFWALNANSPNVVFWNILRIYSDPALLEEVRKEIAPFVKVYRPSREETGLPFQEPVKVSLDPDELFRSCPLLKASFYETMRLDSAGLSFREVTSDLTVTESPEDAAAASLAEPRTYRIKKGGNIVMAHGMVQRDPRLFSNPEQFDPLRFVVTDPDTGARKADMHTIYPFGAGVSGCKGRALAERMNLLFTAAIISTWDIEPASGKALTVPGHRPSSGAYLPKDDIRVRLRMRV

SEQ ID NO: 37168 - protein, 98 aa, A.fumigatus
SCLTELGCDKTVPAQLMGGISANKPVLPLVTGPMMPGSYRGQRIGACTDCRNNWAAFRAGDIDIEEISAINDELAPTVCLYCYSDSQLSAIHHADSGF

SEQ ID NO: 37169 - protein, 196 aa, A.fumigatus
  UNSURE (163),(178),(193): Identity of amino acid sequences at the above locations are unknown.
IGTCGVMGTASTMACVTAALGLMPLRGASAPAVSSARVRIAEETGANAVAAAIAKRRPQDILSKESFLNAITVLQAIGGSTNAVVHLMAIVNRHPKLQGAITLDTFAEIGRSTPLLIDLKPTGDNYMNDFHNAGGMLALLHTLRPLLHLSTLDDLWARLWASXWTHLHFAHSHFRSRXSEHYPIHFTFHLLSXSSK

SEQ ID NO: 37170 - protein, 68 aa, A.fumigatus
LLIDYSLCSGNVLPGRPASLSTENSKSKYNLRMYLLSFSNFNCRTGVFHVLAHEAINDPDSVNIGTTP

SEQ ID NO: 37171 - protein, 62 aa, A.fumigatus
GACENPRSSGAHDGIDYSACCDASLDDHACRSIASDRIIPSNIIDRLRGAPVCDTESEVGQV

SEQ ID NO: 37172 - protein, 309 aa, A.fumigatus
  UNSURE (254),(255),(256),(262),(263),(265),(271),(272),(273),(274),(275),(276),(277),(291),(301),(302): Identity of amino acid sequences at the above locations are unknown.
VGRRQAWSIANLLFAQKPDPISTKKMCIITLTRIFHLTYQYPTLVREITTPSLPGFITSSLNLISVKPASEPIRKLKPNTPFLEIVLSAFLELIARHPTIFRPFSAQIHSILQEIIGATAPTFPGATVDLAEQLFIALHNCAPKNTSAEEWKNACRLTISSAHRAADYVLRGVVEQWESVDATLRQGAQPQDYSQVVADAGPDALGLPGWEGIHAGVERLTVLLRLLARFLTVPTASAVTIPLGLILDLTSRLXXXGGGGGXXGXGGGGGXXXXXXXGGGGGGGGGGGGGXGGGGGGGGGXXGGGGGGG

SEQ ID NO: 37173 - protein, 127 aa, A.fumigatus
  UNSURE (8),(9),(20),(34),(35),(36),(37),(38),(39),(40),(45),(48),(54),(55),(56): Identity of amino acid sequences at the above locations are unknown.
PPPPPPPXXPPPPPPPPPPXPPPPPPPPPPPPPXXXXXXXPPPPXPPXPPPPPXXXKVVMSDPKSSPVELSPPTPSVLSEIGLASVRVPSVFPLQHECPPSREVLAHLAQHQPPPGCNPAAEHLVSR

SEQ ID NO: 37174 - protein, 308 aa, A.fumigatus
  UNSURE (273): Identity of amino acid sequences at the above locations are unknown.
ILYRAATKTYHSYLILRRLFHVHSALADFDLAVKALDSYIEIVLGAKARAEKAAQYGELESDENLLQTLAEGVTMLVCFGSDKEAEKAKDLVAILKKFVAKHVQEIEDDGEEAKLVIRQDSDDSQVVSPRVIATAYRAIGTGLANWASWTPRNEDRDDIRAEAIENLERSIAPELGDEFNYSSLYTLALLLAESRDLDGAIDYLKSALSYTQTHGPQSDLSRERDLVPLWHLLALLLSAKQDYDIAERSCEAAFEQFPSAVVSLVNGSRGSQXPRTDPVYPPKTTELGPPLDQPPAWAKKGTPPLKTP

SEQ ID NO: 37175 - protein, 143 aa, A.fumigatus
PPTSPASASRNKPAAPTRKTCSSNSTSPLAAGAARSSPFFPAGTPVTTSGAAAPVEIFAVNGPLSRSPHGIDVSWAYCPAPGALVGSTAFESDPNEARTRFVNSFSCTDKMTYRLSIASWYKQAASVEFAQGPGVGLRMTHNC

SEQ ID NO: 37176 - protein, 173 aa, A.fumigatus
RRIQMEDLIYSMSLYIETLSAIKHPSLHHPKLSASYNPSASHRTLGTNTSLVRLATDYIYKPIIPRNTIISLGFLRAPKRSRKMRLFNATSHQLTDFVETIPPYAILSHRWQDKEVLFQDIVSGTARTKKGYEKITQCCAQALRDNLGYIWVDTCCIDQDQQREVLGGAELDV

SEQ ID NO: 37177 - protein, 532 aa, A.fumigatus
VVFRTREVWYAYLCDVDVADTSDGEVPSEGGRSSGGGFGGSVWFTRGWTLQELLAPARVEFFNADWHPLGAKAELKSIIAGITGIPEAVLDGTRRPQELSVAQRMSWASQRVTTKVEDMAYSLLGLFEINMPMLYGEGKRAFIRLQEEIMRQSDDQTLFAWTRSSGSSSSPADAETTYHGLLAQSPADFRDSGEFVQSQQRFNRSPFSVTNMGISIELAVVHWTMDRYLAVLDCEMQSKKSRVGIFLAPLPENNQYARVMGAGDHLPTLPADVKSEYRKVYVRQRIAGTPRPPERMYGFWLRQFPPVWKGPHSQFEVTAYHPWDETERKLCIPPGKRGTGGIIRYFMRQDPVVNLRVGFHALLNPGVPFGGFFMPDAWVPSAPIPCLSKRRWRPNGWTNGGSAFSSETGNHGLNVNDGMIRILVLDEVVQGQPMWVVYIAEPENGAWHKDCVCDGCQLTVFGTRYRCQSCPGFDYCSDCFPNAKHTHPGHEFLEDKPVWHAGVYCDWCAEVSMLLSLSSALADSTGDIWPAV

SEQ ID NO: 37178 - protein, 194 aa, A.fumigatus
PRTTYISPSSPATRSFLWDSSVPPSEAAKCASSTPPPTNSPTSSRPSRPTPSSPTDGRTRRSSSKTSCRARHAPKRGTRKSRNAAHRPSATIWGISGSIRAASTKTSSAKFSEALNSMYEWYSERGRCGTLICATWMWLIRRTAKCRRKEEEAVAGGSEAVSGSRAAGRCRSSLRRRGSNSSMRIGTRSAPRRS

SEQ ID NO: 37179 - protein, 156 aa, A.fumigatus
RINIPRIHTIRTSISHIFKATSYTMRFLTSITPLVSLLPLIHALPSPTSCTTVTPDIARVSEADPVASYLPGFRISQQAGGTNKEDMFVEFNITAGSWGCSLFSLLPRRHAGHHLRSRRARRDFRRERPPQPVSARHRRVLGVLSGTRGAGREYRL

SEQ ID NO: 37180 - protein, 172 aa, A.fumigatus
TAPAECQDHHALIDTRISTPLYLHLFHLRSVTFTPDNLQRDTSKMGYVNKHHTHHDVLTSNRYTHYYTVDNTSSREWQTAWPQLVEDAQKNIDSASIPIGGPDFDAGPPIIDVKQGIHLNGVGDDGHEPLCLDRHGNAGFSFIKTARKPYDEVVACILLRAAVLAPTCVCLR

SEQ ID NO: 37181 - protein, 524 aa, A.fumigatus
KRTPPVCPSIRPPSALRKAWDRRARNPSVGHKKATKWDPGVQQGVESDAQVHDRVLAHEVSDDSPGAPFPRRDAELALCFVPGVVRRHLELRVRALPNRGKLPQPEPVHALRGPWGPCDSLSHVHLAILGLHVGRQCRQVVSSAHHPRILVVFRQRREEDPHPALLALHLAVQHREVPVHRPVHHSQLNTDPHVRHGERTPVEPLLRLHELAAVSKVRRRLRQQPMVGRLSIRRRRTRTRRPRPRKQRLVIRLPHNLLLQPDKRPLALPVQHRHVDLEQAEQAIRHILDFGRHPLRRPRHPLRDAQLLWPARPVQHRLGDAGNPSDDALQLRLGAERVPIRIEEFDPRRRKELLQRPAAREPDTASEPPATASSSFRRHFAVRRISHIHVAQISVPHLPRSEYHSYIEFSASENFALLVLVDAARIDPDIPQIVAEGLCAALRDFLVPLFGACRARHDVLEEDLLVLPSVGEDGVGRDGLDEVGELVGGGVEEAHFAASLGGTEESQRNDRVAGDDGLIYVVRG

SEQ ID NO: 37182 - protein, 68 aa, A.fumigatus
THSDFSAWSIRYTLAVAYFTITLIFHSFRYIKVKGSSLAFCLLCILGVLTGSRHSHYYVRSSTLLHNA

SEQ ID NO: 37183 - protein, 213 aa, A.fumigatus
  UNSURE (135): Identity of amino acid sequences at the above locations are unknown.
KPPPPPQKFFPPPFLGPPAGGGGKKNLSLFPPKKPPFKKFFFFSPPPFFFFLGGFFFPPFFLGKNFKNFPPPPPFGGEKFFSPGPQKLGFWGPFPPQGGPKKTPPPPQRGPFLGFWGGGPPNFFFFFFFSPNPNXLKPTRISRPGLYAIHWPLRILRSPSSSILSVTSRSKVHHWRFVSFVFSEFSRGHAIRITMFDHPHCCIMHRRGAGQYI

SEQ ID NO: 37184 - protein, 115 aa, A.fumigatus
TSNSKSERNQEHRQRSACTSRQRYPHPIHERTTYPAKVQNEPAMGINAAISPRLNIVTNTIPPHMAYEISIDAGPPVARALPVPRKSPVPIVPPMAIICTWRAESLRASLSALTC

SEQ ID NO: 37185 - protein, 89 aa, A.fumigatus
GEGIADDWCRRFVDDALGFALTWNYWFNDAVSTAADVIALQLLLQYWTDNFPGWAISLIFLIFVILLNVMSVRIYGEVWSWCAFCREVN

SEQ ID NO: 37186 - protein, 167 aa, A.fumigatus
ASPNSETSIVGVSNQISWVCIGIASLRFRAAIRRQNLEHLLPFKNWTYPVGPIIAVGLNIVLILVQGWSCFSPSFQAVDFVSFYIEIPIMIVMFLAWKLVKQTRFVHLDEMDLVTDRYDLNAEHAESDGNADGDSPSRVGRILHIKQLQSEKGVLGKLKRVGMWLFL

SEQ ID NO: 37187 - protein, 172 aa, A.fumigatus
  UNSURE (38): Identity of amino acid sequences at the above locations are unknown.
TFDLDVTERMEDEGDRKIRNGQCIAYRPGREIRVGLRXFGFGEKKKKKKKFGGPPPQNPKKGPLWGGGGVFFGPPWGGKGPQKPNFWGPGEKNFSPPKGGGGGKFLKFFPKKKGGKKKPPKKKKKGGGEKKKNFLKGGFFGGKRERFFFPPPPAGGPKKGGGKNFWGGGGGF

SEQ ID NO: 37188 - protein, 65 aa, A.fumigatus
  UNSURE (10): Identity of amino acid sequences at the above locations are unknown.
GFSASEDEAXRPSKKPKVKFTEANDREEAEPWYKKSKKSSDQAAHTPRQIQTLEDLESLATGLLG

SEQ ID NO: 37189 - protein, 145 aa, A.fumigatus
IPKRGSGAWQRSGEGLKRFLAELSSLCMIEAKMTVHDIEKYPPHAPQEPLSGKAAGAEPFEFNQHVNADRLARKLSARQVQMIAIGGTIGTGLFLGTGKALATGGPASMLISYAICGGIVFVTMLSLGEMAAFIPIAGSFCTFAG

SEQ ID NO: 37190 - protein, 167 aa, A.fumigatus
HKECRTELTSSSGGTESIAITAGETKDPAKNLPRVVRNVFWRIVLFYIISIILIGLNVPYNYPNLSKKTTATSPFTIVFMEAGSAVAGSFINAVLMTSVISAANHALFAGSRLLYTLAVDGHAPHFFGHLNRFQIPWVAVLATSLVSGLCIGASYIGAGQLWTWLQK

SEQ ID NO: 37191 - protein, 99 aa, A.fumigatus
YIFLLLPFSLSLSFSLSVSLIPTSHIYFLCFQFTLTDSRGIEEISAILRSRSLFDEESNTLPSIYSLNQTTHTRNPKNIPSICPDNPHWTRSDLSLPNL

SEQ ID NO: 37192 - protein, 194 aa, A.fumigatus
LTRAASKKLVRSYEAVLFSTKKAIHYLVSTPSIKQLTLETPRIYHQYAQTTLIGLGATYHCQICKFLLPFSTSACCIASPESSNPAQNRTSKRFSTVSGSPSLAPSEQTIGSLPSGDPRLAEFNHLRDGLERLENKPLLKQRFVPTPEKSDNLSKLALGAKVERALGRRMTSQDAVMRKPVLDEKVATSETSAA

SEQ ID NO: 37193 - protein, 96 aa, A.fumigatus
SRFCPIAFFSFYFLGDCPINYTRLEDYSPSICCGGRLPILSSTSLHSSANKTFDHLIIMGVLRLRVDGQTFRDPDNREITLRGINVAGEAKYPKKP

SEQ ID NO: 37194 - protein, 155 aa, A.fumigatus
FDLEANLNSVTRNVFLGLALDKLNKNEESERAYRAATRAKSDDKTAWQGLINLYEKQGGFKLDAYHEAALRLGQIFAEVYVSCSTLYKRRTGANLILATTSTVARMSWTNISSSQRNRALDHNIRRLLNYTSQRVRFMSTSKDGYHILPIHTSVS

SEQ ID NO: 37195 - protein, 68 aa, A.fumigatus
EAPTSKAAIMAGQRSELSSMSTKSALKAARIALDSRDFEDAAEKAKVVVKQEPQNYHAYVKTKLANST

SEQ ID NO: 37196 - protein, 676 aa, A.fumigatus
SDPSDDKHRCQDVVDKYIKFAKKQGTRSQYKKALELHLPTSPLYVYLEGRIPHPSHTYLRLIEMAESEEKEFINREIGERRTRLGARIDHVTMEVKREAFKRGELEQLYRGIVDWTHDDQVRRTYEERLLQRTYDILIVLPPAEKAEKRAEVLQAARDMVIIKHPFELAWKIVLEWQDIQSFSEWDLNFLKDFIEFFPEDGLTKILKGFLASDLSPFSKETKETKEPTPTEEETENGNGDNHELAVQDRLLMMVEGLESSRSSIVANRIMGELYLSLEEYDSVVDVARKGLSNITDLARLTGISLVNTTDCLKTLLANSLIYYQIPRHHPEAKEIFEDVLQRKPTFTACLLGIGLILKVDEDYAEAVNFLERALERDPSNLKIRGELSWCKALNGDLETGLHGLQDVLAELQDMESPNREFKSEILYRIGYCQWELDPSPTARKDRSGAYASFLGSIQSNINFAPAYTSLGIYYADYKKDKTRARRCFHKAFELSASEIEAAERLARTFADQKEWDLVEAVAQRVVDSGKAKPSPGSKRRGYSWPYAALGTVQMNKQQYAQSIVSFQAALRISPGDYHSWVGLGESYHHSGRYIASAKAFDHAQQLESALSSDEREHIWFARYMLANVKRELGEFKDAISRYEDVLKFRPNELGVTIALLQTLIEVFTTGLEGAAP

SEQ ID NO: 37197 - protein, 115 aa, A.fumigatus
DILVALGIVELPVRLFGIEAAGIVTRVGADVSPDDLQVGDRVVCFCRKDAFSTYTTTLAAVCVRIPDSLTFDQAGTMLIPYFTAIHSMVNVGRVTKGQVSGKKTRCYCIRWQCIY

SEQ ID NO: 37198 - protein, 412 aa, A.fumigatus
  UNSURE (319): Identity of amino acid sequences at the above locations are unknown.
SVLIHSACGGVGLAAIQVAQMLEADVYVTVGSEEKVKYLMENYHIPRHKIFHSRDRSFVDGVMRETKGRGMDFILNSLSGELLHATWSCVAEFGTLLEIGKRDLIGDGKLDMRPFLANRNYCCVDIDGLWKRIHVARALIFSILDFYDKGYITPLPMTIFPATQTQDAFRFMEKGQHIGRVGVSFKPADGGPQLGLETTKRALTIAFNGSASYLMVGGLGGIGRAVSTWMVDHGARELVYLSRSAGRTPKDDDFVTELQSMGCAVRLVSGDTTKLADVQRAIAAATYPLKGIVQMSMVVANENFTRMSFAEWTASTAPXVQGTGNLHDASVAAGFNLDFFVMFTSVSGIVGKAGLTHYCLGNLFLRRVSPIPDTAGFAPPRGLIWGTVDEVGMDSGTPAPDWGYIPNRFPTF

SEQ ID NO: 37199 - protein, 1096 aa, A.fumigatus
  UNSURE (6): Identity of amino acid sequences at the above locations are unknown.
GLILPXRLTTRDGEDYQSLINEEVVGREPSALFFSSVTGQVLGPDHSTWSKYWQENLESPVRFREAVTAILKHDVGKNAVFLEVGPHGALAGPLRQIFTQATSSAPYVSVMARNQDCNASFLAAIGALHSLNVDVNLEALFPTGCCLPDLPRYPWNHEGSYWYESRLSKEWRNRRFPYHDLLGARVAESSDGEPAWRNMFHVTNTPWMRDHRVGEHIVFPFCGYIALAGEAIRQLTNVEEGFSVRNIIVSTALVLSEGKPTEMMATFRPHRLTNFLNSAWWEFTVSAYNGRNWTKHCTGEVCAQSSAPEQTQDPAGLPRTLNVRKWYEKMGKGGLNLGGSFQTLETMTTSTSEQRAVGKVVNGRQGDEANYHIHPTVLDATLQILGAAAVKGYARKTKTWLPTSIDKFTVHRCASDMVTSVSAQLSSNFSVVGDGRCTSGGTTVVDAVGIRMSLADGAGAADISDTHAASRCEWRPDIDFLDVHELFRSPANRTDHLRLLEELGDICLLLSQWHFSEASNPIPPHLQQYMAWVGSQSGAIAFRLPSTWTGLDHEAISDRIDSILSQLADTPAAPVANAIHQVCVNMESLLSGESLDSILPGETLTHVHEFLGQVDRREFIQLLSHSKPNLRILEIGTGNGVSLHRDILAELTRPDGEILCAKYTLTAPGYVVATTQEKIFPNMQFASLDISQDPFEQGFEDVGYDLIIAVNALRECKNTEESLANLRKLLSSDGRLLLQELCPSSRWIRYVLGVLPTWWAGPADEPIETPYLSQEEWQTTLAAAGFGDIEAVALDSEEPHQVTTTMVVRQAREAPMKKVTVLVEEEGPAVTHIVSELEKEGYEVTRCRLEDDPPAGQDVMSLLDIEQPFFHGIDEARFLLFKSFLLGLQDRNAGMLWTTHLIDIGCRDPRYGQVLGLARTIRTEQLADLGTCQIDSFDSSASIRGLLRLFAKFQTRQGDEELNPDFEWAIVNGQVQVARFHPFILADELLVSEDSKNEMATLNVRTPGRVNSLHYARHERKDLEKDEVEVEVYCAGLNFRVSHSYLPRVSVMLLTEPSRISWSHWALSNCRCVSSESKLQASSHAWAQMSAPTTSR

SEQ ID NO: 37200 - protein, 204 aa, A.fumigatus
  UNSURE (174): Identity of amino acid sequences at the above locations are unknown.
QDTYNDVHEACRPLGLGRVVLADRTADHEPRVFLGPRQASIEDFSSDVVKIYIDILRRRLLQLLLPALILVVDRRIEPKLLDQELALVSTARNADNPLGSLDLGDLPGDHAGRAGRTRHNDGVAGLRLSDLDHAKVGRQPRHAQHRHGIGGAAAGKERPLLGLLGPQQTIFLPXRSTRRPSRRTCIGIVIRFPTRSPVRCSGRP

SEQ ID NO: 37201 - protein, 283 aa, A.fumigatus
  UNSURE (38),(91): Identity of amino acid sequences at the above locations are unknown.
NPIYNMSTTHTLYQSSTGGYNQDPNSTTHIGTNVNTAXSTTDPFTGHASQSAGPHTSNVANTIDPRVDSDLNNRAQYAPGTAASGNVHPRXTQSYNNPNSSNAGPHSSSVMNKLDPRVDSQTGNTTTKTTNETGTGASRNPTDTSGAGAGVRQGSSTTSVGTPGVEDNRSRYDPNVSRHNPATGSGYATAGGVGHQPAPGSSSYDKQDYRAEYAPSTENKHYTADAQGRSAAKGEEIGRGVKSAIAGIHVSRSATFFDPRRRVLTRALTGCWGVVAGGNDCSC

SEQ ID NO: 37202 - protein, 110 aa, A.fumigatus
TDNRKPICEASLHLSLHGFHSCIAFPSIFFIFGRSRYITKMPISNRQLIYANTPSPAIDPSLTNGTFKLNTTSLPDQIPNDKVLVRVHYLSLDPGHAPVAHSKTVVHCYP

SEQ ID NO: 37203 - protein, 198 aa, A.fumigatus
  UNSURE (22): Identity of amino acid sequences at the above locations are unknown.
SRREADYNPNTRSATGSSRTPXWQEYCLLGPKEPQKWPFLPGCSPTDAMSVLGMTGLTAYFGMIEIGQPKPGDTVVVSGAAGATGMVAGQIAKVKGAKRVVGIAGSADKCEFLVKELGFDAAINYKDKGWKKQLKEATPEYIDVYFDNVGGEILDACLARAQKDSRFVICGAISQYNSAKPQGPASFMNVIVSVLLGM

SEQ ID NO: 37204 - protein, 89 aa, A.fumigatus
SIADSVLQSQRITMKGFIVFDFAKKYDIALKDLSTWLTQGKIKRKEHIIRGGLEAAPQGLVSLYEGANTGKMMVEVAPVSEAIGAKAKL

SEQ ID NO: 37205 - protein, 183 aa, A.fumigatus
AIVIFAASLKGIVIVPAYPDRASIHLPRPRLPTPHQPCLPSPRPRIPSLPPPTPGLDVDGPFHSSGLRPPLPHPHLLLLHHLGRPHPSSAPAGGQRLPARKEKTARLAQQHQGGWERPQTSRQAQMKDAIAGYSGYSATGASGIVFEQIHGPVAICLFVAVGVRRSLFLELARGVFGGDGEAL

SEQ ID NO: 37206 - protein, 94 aa, A.fumigatus
VFCIAPSPIGLKWIPKDLRPSLSGVGARGASTPPYFEGIFQLHSSAIVLQFPQLQLFSSDCIFTMPSYNIVVFAGDHCGPEVSSGSTAGISCVG

SEQ ID NO: 37207 - protein, 256 aa, A.fumigatus
RRKERRCRFSWCHWGSGRGTLSHIHLRNPKVTQPMELGKWAVRPGKGLLRLAQEEGKIGYLRPCNFAAPSLVDGSPLRPEVCRGVDFNIIRELTGGIYFGDRKEDDGSGFAMDTEPYSRAEIERITRLAAHLALQHNPPLPVWSLDKANVLATSRLWRKTVTEVMAKEFPQLKVEHQLIDSAAMIMVKEPRKLNGIVVTSNLFGDIISDEASVIPGSLGLLPSASLSGIPDGKTKVNGIYEPIHGTFSPCCLQLAI

SEQ ID NO: 37208 - protein, 85 aa, A.fumigatus
VCADVKTGSAPDIAGKGIVNPVAAILSVAMMMQYSLNRMDDARAIETAVRNVIEAGIRTADIGGKSTTSEVGDAVAAELEKLLKQ

SEQ ID NO: 37209 - protein, 68 aa, A.fumigatus
HPLQRGEEMGGFQLGSSIVLVFEAPMGTRKSFDIGWEGGKREGGWNWTIEKGQRIKMGQKLGYVDIQE

SEQ ID NO: 37210 - protein, 225 aa, A.fumigatus
HQHRDSIVRRRDKIKKPEEIPRRGKCSVQVLQHEHLRCLDKRKTHADYLDFPQSLTMPRHHLRRHPAPVPETNSDEPPQQQTSRSRLGHGSAQTQFQTPPSRNIPNIPQLHPSSGPVEMSAAAPTHPGAAAQGALFSLFGRGVSGRQRGQMMDEDDQDDEEEEDVGEEEEDVDQSYEMDHRRLDLELEEGEREFSAEEMEGMAGEELEGEDEEDELMRDRGKLAQ

SEQ ID NO: 37211 - protein, 297 aa, A.fumigatus
QLLIYSADRSPSPLPSNLREISSLASWTVSTHKPGCGVAALRHPSPTQYWQSDGPQPDMLTLHFFKLVAVVKIRVYLDFEMDESYTPTKMVFLAGMGGNDLVEFATWEGEGPCGWVDIPLEGVGGRDGGWVRRRRRKRTRARPQDGKGKGKGKGKSKGVAWPDYMFSDSENPVEYDEAAYDYDDGESTSEDDEDDPYAGNVLKAMVIQMRVTENHQNGKDTHVRGFQVFARDDDRRRMGNAPSASADGRTRRHSARRSLRGSLNDGGAEGRNPNGDADGVRVGGLEEPDWMGEPVIR

SEQ ID NO: 37212 - protein, 178 aa, A.fumigatus
DTHFLPFLYSTIWSERAAGATGCYRQSRANGLNILIINKVSSHIYFKFAQVISHWTSHGTEIARATRKPPQKNLLLHIHYCFNSFSSSAATASPTSLVVDLPPISAVRIPASITLRTAVSMALASSIRFREYCIIMATERMAATGLTMPLPAMSGAEPVFTSAHTQIASCRQQGENVP

SEQ ID NO: 37213 - protein, 141 aa, A.fumigatus
IPLTLVFPSGMPLKLALGKSPREPGITLASSLMMSPNRLLVTTIPLSFLGSLTMIMAAESMSWCSTLSWGNSLAMTSVTVFRHSRLVARTLALSKLHTGRGGLCCRARWAARRVMRSISAREYGSVSMAKPLPSSSLRSPK

SEQ ID NO: 37214 - protein, 80 aa, A.fumigatus
RMIFFHHCSRQSIKKYVLANNKIAFASQAAFDSQFNKAIKAGVEKGEFTQPKGKSLLPRMFFFCGIIALTRLKFQVLPVL

SEQ ID NO: 37215 - protein, 79 aa, A.fumigatus
LICFTQKATTATKAAAPKKAAAKKTEKAEKPAAKATTKKAGTTTKKAAGRPKANTAKPRKASTAVCDRYRCCFSIFGGC

SEQ ID NO: 37216 - protein, 63 aa, A.fumigatus
PLSLLLLDFRWMLIRKQAPAVVDQPKVLSTTKSGRVTKTTAKPAEKAAKKKATTTKKAEKSEA

SEQ ID NO: 37217 - protein, 325 aa, A.fumigatus
RYAYRYPNRPRNHSPTLPFHELFQTLFNPLGEIKKKPAGAVAARRKVGPHGQSAANLNPLERRRDVIERFISRWRKEVGDDIYPAFRLILPDKDRDRAMYGIKEKAIGKMLVKIMKIDKNSEDGFNLLNWKLPGQAATSRMTGDFAGRCFDVISKRPMRTDVGDMLIEEVNEKLDKLSAASKEEQQLPILAEFYRRMNPEELMWLIRIILRQMKVGATERTFFDVWHPDAENLYSISSSLRRVCWELHDPNIRLDAEDRGISLMQCFQPQLAQFQMDSLDRMVARMRPTEEDPVFWIEEKLDGERMQLHMASDDSVSSPRSGDPR

SEQ ID NO: 37218 - protein, 377 aa, A.fumigatus
LLDCSLAYYFDNRPLLSSDDGQCPLPSHENLWNAQSAEAWRDVLERTSGKFGPGKRKFSTKTSISGSRGISLYKAVLTIYIEKKLVPGIGEFSHVLLIHALYHRMWEVGDYFRRPLSFWNPTAKKQTLDTAIPSGSVWLPGIPSYSKWRNSACDCLDILHWTANSTIAKAAGLEHPTVLHLHAARIVLLAPFREIRSLATSLAMGKIRWSDHQQALEWHYILRWIKHDQYKARLAIIHAGTTLWHVRRYSTNAFHEPVAVYLSILTLWAYGSCHAQIAEEPSSRHGLRHHPVREPTFIHLDRPCDDELVQLFVREGHAMQGNVTGVGDICAPHGPERILEVGCETLAGLTSWGISKRFIAILTKLAELSSQPQAPRN

SEQ ID NO: 37219 - protein, 74 aa, A.fumigatus
HYITCVYCPEEWHNSDNIVFDRTYSHQALYTLLTPYKVITNSQSSPKSKYEFRGVCHNISFSEPVAARIAPRAS

SEQ ID NO: 37220 - protein, 97 aa, A.fumigatus
FKYLVMPFRLTNVLAIFQAYINKMMQGILDKFYVTYLDNILIYLQTEEEYKQYIKEVLQCLNSANLYAKLLKYKFYKIEVKFLSFLIGQEGVWVDPI

SEQ ID NO: 37221 - protein, 196 aa, A.fumigatus
RVEANGPSLPNIKSGGFRLFILRKEALKILGTQPTYKYMFAVSDAVHEAPVYVAAQNKLYLSQLAPPAGYLPQLVVDLNQDPPTLSEFLSDPPVYAPNGGTFYNGRVIWGASGGNRSIGGTEQRPGLRTLDPETNKSVILLNNYYGYYFNTVDDLAVHGKTGDIWFTDPRMSPFCLPICLLRNHWTDALTRILMVQ

SEQ ID NO: 37222 - protein, 63 aa, A.fumigatus
YWTQDLWSPPLILTLTATGQLLGLLSKGSNAPCDCGEFKTTKPEMASNFQSSTSYVWTRPFEV

SEQ ID NO: 37223 - protein, 81 aa, A.fumigatus
PEYSWFNKLTDTPPQLPSATYRYNPKSGAVFVVDDSLSQPNGIAFNPDYSIVYISDTGAVSGPVDPKFGHPGTPFNATGPR

SEQ ID NO: 37224 - protein, 121 aa, A.fumigatus
ELKGTRNYRLDSLMKVHHDYRTIYAFDVSKDGTTASNKRPVYLSAGYVPDGLKVAANGYIVTGNGRGVDVLDPHGQLLLTIQTNYTVQNFAWTGPKLKTLWLMGSGGISKVEWDLAGQELK

SEQ ID NO: 37225 - protein, 92 aa, A.fumigatus
  UNSURE (90): Identity of amino acid sequences at the above locations are unknown.
KDILSRFVDKINLSYRTRAKGGERTGKKSFISTIYLSIQTLVPAKLDACLLKGQISYYSPNSKVSAVADFRVRSSSHVLFHRGLKERSIXKF

SEQ ID NO: 37226 - protein, 349 aa, A.fumigatus
TDSPFSGHFHADEALAVYLLRQLPTYASSPLIRTRDPAQLATCHTVVDVGGEYDPASNRYDHHQRTFSTTFPNHNTRLSSAGLVYMHFGRAIIAQHTSLPLDHEDVTLLYEKLYTDFIEAVDANDNGVSVYDPAALASANIEKRFRDGGITIASVVNDMNNPDPTCPPGEPQDEDSLFNRASTFMGHVFTRKLHHAFTSWLPARATVGAAYQSRREVHPSGRIIILPQGGVPWKEHLYNFEKEASGAGDINPDEQVYYVLYPESATEGSKWRVQCVSVNEGSFESRKPLPESWRGVRDADLDGCLAAEAEKSGKPKIPEGAVFVHASGFIGGHKTKEGAFAMAVRSLEL

SEQ ID NO: 37227 - protein, 95 aa, A.fumigatus
IVTVRFQPLPSAPILKNRVFKISASQKFETVVKFLRKKLDCKDTDSVFCYVNSVFAPGLDEGVGGLWRVSILATGTFALKVLIEGFYSVSRRMIN

SEQ ID NO: 37228 - protein, 179 aa, A.fumigatus
SLSFGDSTYIHYIAVMISSRTAIQLALPLRSLARAAGVRPGLTPIVRFALRGSYLPARHVPPPCTPQVRHSSHSPLGAAPVNPRKKVTMQTLRSLYKKGEPITMLTAHDFPSGHVADAAGMEMILVGDSLAMVALGMEDTSEVLMEEMLLHCRSVARAAKSAFTVRKPCRRCGLYSRLG

SEQ ID NO: 37229 - protein, 264 aa, A.fumigatus
RSEFTSIPGEDEIERQRARQQEKEKKLAPKAPAVKEVPKFDAPDVGPVNLDNLEPSKETKPGGNGFEPPQRMTPEDVQMPLQTKPESPRKSSESFVPPPLHRTGPFYAGREPAASGMQPSNITSAIRSQMVSSTAAAPGAKAGLSKEVHELKRKVLEKSNGGLSTGTVLSPHPTTSTSAPLKTSNCQSNKLCQANTQEKLGRVQDEDTTQSEGNCVAKQRAGLRKVPVSKKKERRRDPKPGYCENCRDKFDDFEEVRIDHVGRN

SEQ ID NO: 37230 - protein, 206 aa, A.fumigatus
VADLPMGSYEVSPEQAVQSAIRMVKEGRVQAVKLEGGEEMAPTIKRIVEAGIPVVGHIGLTPQRQNALGGFRVQGKSTAGALRLLKDALAVQEAGAFMMVVEAVPAEIAAIITKKLSVPTIGIGAGNGCSGQVLVQIDMTGNYPPGRFLPKFVKRYADVWGESIKGIEQYREEVKSRAYPSQEYTYPIAEEELAEFKKAADVIKRS

SEQ ID NO: 37231 - protein, 61 aa, A.fumigatus
LPFQSLALCTVCRRNFKNTAIKTCGHVFCKECVEERLTSRSRKCPNCNRSFGNNDHMHITL

SEQ ID NO: 37232 - protein, 214 aa, A.fumigatus
LARPFQPRGEDQYSMLNTELTSMQTACKKYSLLASQKVADFSALEEKVARLTAEKSKADQKYFAAMKSKEARELEVRTLRIQNSKSSDIVSQLKESEATTRSLLANMEKQASETKEALNSIISKHHAAQQQIAENNIVIDGLKAQVNELKALSVSKDSSLASASSACRKAETEIESLKVTLADTKKSLENWKNKSLGNSSSEYEMLRVSLSAYA

SEQ ID NO: 37233 - protein, 262 aa, A.fumigatus
RLTSKIDEPYLPPNHALLLLSDSALPLGSFAYSSGLESYLAHSKPLPRSVTTIASFHHFLKLSIASIASTSLPYVLAAYRNPGELETLDNDLDASTPCIVAQRASVAQGRALLGVWERAFRSAYASGPPAGETDAAKAVQMIENFSDALKSWVGTADELGPKGHLAPLWGVVCLAMGVDLRQTAYVFMLNHAKAVLSAAVRASVMGPYQAQSVLASKALQAMISERIDREWNTAVEDAGQIVPPLDLWVGRHELLYSRIFNS

SEQ ID NO: 37234 - protein, 206 aa, A.fumigatus
PPPIVRSGRLVVKRSSVKKSEYVLSTDNPLDAPASPKPQNEGEPEDEEMGGTETETKKESEGGDGTGDASAQPSAEGASEEQTVQGKSGLEASARSHLVSQTHAIILPSYSTWFDMHTIHPIEKKALAEFFNGRNRSKTPAVYKDYRDFMINTYRLNPIEYLTVTACRRNLAGDVCAIMRVHSFLEQWGLINYQVSLHLLSITSFP

SEQ ID NO: 37235 - protein, 556 aa, A.fumigatus
FHDQHVSIEPYRVSHSHRLSSKFGRRCMRYHASSFIPRAMGLDQLSGKSASIVYNFIPVANVVSCKVDPQTRPSNIGPPFTGHFRVIADTPRGLQPFQPGPQHVVKPGKPHPATDRAASATPASKADLNLEIRRNIYDDKGKEITPAAEDKEKQTNGEGSAANGTAADASKAMESAVREPRKKFHCFSCGIDCTRLRFHYAKAAPTTTNANAPDSKYDLCPNCFLQGRMPASHNASDFVKLEDNEYTIAPDKDAPWSDSELILLLEGLESFDDNWEQIANHVGTRTKEECVMKFLQLEIEDKYVEDMPEMRAASGRDPINHVENPVLSVVAFLAQMAEPAVAAAAAGRSVEEIRKELRKQLDKDMGSGKPSDKGKEKEGASVKNEDSMDVDTFREEAAAGVADSGEGEKQPKASLATVALGTSAARAAALASHEEREMTRLVSAAVNVTLQKFEIKLQQFNEMEEIIEAERRELELARQQLFLDRMAFKRRVKEVQDSLQAISLKGPTEETANLIGDAATAGISTRYNFQPAGGDARDGVQPLSAETGADYKTLDL

SEQ ID NO: 37236 - protein, 153 aa, A.fumigatus
NLSQSQDSESEYETEFPSRFRRGETQEHISGLPSQPPIRLERRRRGTDSDSYLDSNDSDSDGDESTSPQRGVKLEPDMPEADLDSESGSSFDDDTKDKDERYKNENEDDVSPGSDDDLPYDRYQKRDDSYSASEDEDEKSNLPLHSQPMSPVV

SEQ ID NO: 37237 - protein, 75 aa, A.fumigatus
VEEIAKVPGIDVLFVGPWDLGNNIGRPVKGAFHEDLEAAIERIRKAAVDNGKRAGIYCVGGAAAKKYADRGFHMV

SEQ ID NO: 37238 - protein, 82 aa, A.fumigatus
RWTGALDAGAHGIVVPLLYTADDARRLVESAKFPPVGRRGFGSPFAMGSIGGVSGLEYLQGANDALLTIVQIETKEALENVS

SEQ ID NO: 37239 - protein, 777 aa, A.fumigatus
QIQYADDAARQAYRRNAPTDRRTCLLGTAQHGMYAFAQCMSMSQTQDLTGTNRSLLPRQLKRLRSLPSSSHSPPLVVIQSATPPRSTWNGREPSPRRTLQSSREAGSRLQYRLGLFSHRRTQSGSAMYPARGNWQARGQIEADESSVGEPEGKDDAIEVSSSHSEESFHTATRSPMPEFISTESRGVQGSRFARIRQAQERRTGSVKREEEEVTEARLPILRHSNLAGGTFISAVDEDEEMMDPSVDLSKKDADRLVNIYLKLDYVTLPILDIQDFRAAYEAVSVAGDSTTPNAFYAILNTIFALACLNVDDMREERARYFFNEGQRLANLFDQYKSIDLLRLYILQVQYLNAIGDLPTAWALIGSTIRLAQSLRLPFDAKQHGHSRKERETCRRLWHGAMIMEQIIALRLGIAPQTPDPLRVPLPTHLDTDYVDVFSSAPSSAPSSSQGERASIIEFFTACARLYRLVEDVMAWEEEARIRPHGCAMKKLLSLDFTRFLKADSLLHDWNQSLPSSFRSSGGRGTDEHSIVVRQRNILRARYLYLRLRLNRPLVTLGLALTTACKCKSDGQPHIVVRRPAPDSPIALSLVHGASVMCVRSALELAELIRAHETGLLRFDAPYDASHCLSPPYWESVDYLYVCGTAFLASFNHTCPFFGDMTDEEDEQCRVLWPCIIDLLGRYQGYRRRGRTDNVAHACSRTLSELAKAVESTDFTPWAVDSAILGQDARARLSQRTEMESPVRHRRISGASQTIPDPLGDVPGFPEWMDSLPVDLVG

SEQ ID NO: 37240 - protein, 92 aa, A.fumigatus
RVTLFTRAGCGLCDTAKHTVTQLHKRRPFDYAELDIMAPENKSWKDVYEFDVPVLHVQAALKDQFSDPKKLFHRFTEQEIENLVEEAEEMKP

SEQ ID NO: 37241 - protein, 243 aa, A.fumigatus
  UNSURE (18): Identity of amino acid sequences at the above locations are unknown.
QRGYTRAARKSRTSKLPXCMYGKFAPSPGRGEIPRLNHYSNALARRVQKRRRRDKVPGLQLRKGDSDDDSDRASSSEGKVAGKENSKQKTGQDGKSTSRLSSFSEFFALLEAHPNVPSILSWWAQLVVNLSLFSLAVYVVFGFVSAIRAEFEQAAEEVSDTILAEMAVCAKSYVDNKCAGGERLPALETICENWERCMNRDPAKVGRAKVSAHTMAIIINSFIDPISWKAIVCGHSLCSIADN

SEQ ID NO: 37242 - protein, 134 aa, A.fumigatus
AQPSADLDSSAIKRSNQHSLNQLARYSRVSLHHDIQEMLDTGTSDSSSGEEVEESVAVEKDPEVMIVDQDETVHPYEVAGQTILSDAVNKAVEKYETKETEKLVKEYEIVSHESEMGTGYLADDDFELVDHVQL

SEQ ID NO: 37243 - protein, 69 aa, A.fumigatus
SRFLSSDRMIYTPIVSYETSLITQIHMRWMQYIKLSLNDQCRPTRMLRGRLGTNESRPLRSFCSSAGLL

SEQ ID NO: 37244 - protein, 69 aa, A.fumigatus
SSDLQLLLYAVTLKMEKRSAESPMDFEWQTRAPGDVTSPFYQLSMQHDNQKKRASSAIILAYRSFQYLT

SEQ ID NO: 37245 - protein, 75 aa, A.fumigatus
SGYMKNSMDTLLTRSGHYTPQWMDGSAANPIARCTQQTILFFFFFSFYLIGQEYGQITSTYRVKLHIFIFPVIWS

SEQ ID NO: 37246 - protein, 60 aa, A.fumigatus
  UNSURE (14),(24),(26),(27),(36),(38),(39),(40),(41),(42),(43),(44),(45),(46),(52),(56),(57): Identity of amino acid sequences at the above locations are unknown.
KFTWLVVSFFWVGXFKPPHSGKGXSXXPPLFLVKRXGXXXXXXXXXPFPFFXLISXXNLN

SEQ ID NO: 37247 - protein, 72 aa, A.fumigatus
DIDRDGYISNGELFIVLKMMVGNNLKDVQLQQIVDKTIMEADKDRDGKISFEEFTEMVENTDVSLSMTLSMF

SEQ ID NO: 37248 - protein, 396 aa, A.fumigatus
PSSLCSCFYYRITFITSEVKLRCVTNHNQWEKNEQEVKRYQFTLPSSELATGLACRELPFIKVSLYVLGRRPLLRTGFCEVEILTRRCSRGTPVSRSLSTWMHEADEASRGGGKRKLSGRIHILGLGNVGTFVAHSLASRPSPPPITLLLHSRDLYGAWLAKKKCLAVNTNGLDDIKTGFDVNVLSDRTWYSLPYWNQNGEPNTNGDSVTEENLEAGVEESLSQSEEDDEHIECLIVAVKAPMTARALESVSHRLTPDSTVLLLQNGMGTIEEINEKVFPDPLQRPHYMCGIISHGLARKRDAFHVTHTGIGTTIISPVVPRDALASKDEKDTDWAPSTKYLTRTLTLTPPLVAVAETPSSLLLYQLEKLALNAIINPLTALMDCENGEILYNYSF

SEQ ID NO: 37249 - protein, 107 aa, A.fumigatus
LISLSSGVAVGSSIGHAIGSLFSGGSSSSAPTEAQQAPPPAQAQPMDNGLWQSSATNSSWETPACETDVRNFRKCLDENQGNMTICGWYLDQLVRSILILSRYIECC

SEQ ID NO: 37250 - protein, 154 aa, A.fumigatus
  UNSURE (86),(88),(133): Identity of amino acid sequences at the above locations are unknown.
SVYISKECIQSAIGKCGSWIGVRFRSSATHIPRSSFPAPPLTTYKNQQPINLSTGESIFIKVHLTSLLFQRKYTTKMLRQRRGAAXAXTPARSAPTRPTVAPARPAAAPAAQHHQPHSTAAHPPAQAQQAPPXMAPVQQSSGPGLFGQMASTAA

SEQ ID NO: 37251 - protein, 329 aa, A.fumigatus
FGRTEDISTPPSPLKQMDYYAEPIRSTTKVSIVLEKPDDWWTWNAYITGLARTRGVLDILHGERPYPVPPIRPIHPLTLANQQARTNPAESQPDSERPQTTEASQSDGSLTAAAAPKAPAKITEAELALYTEELSIYKEEKEQYRLDRLGLAALWNTMEQTVAREHLQRLTSESDNEVERYQKLKADMKPSIETRMNQIEEKYQKLAAKPANQSVSSWLSEWQKVLSVCAELKMTQYTGYMGTRSFLTALKKIEPQYANIRLDRLLEDNKLNVFDEISRYQRHWESLSQKEQKSIFTTFKGQSSNQSNSDSANQNRGIKRLKRDDCPCG

SEQ ID NO: 37252 - protein, 444 aa, A.fumigatus
GRCHCVSSRMERRGRMSSPNDYSPSEFLISTGRGSTVNCRKCSIAARGIRPMRADENAERCEDYLRDLLMWRETKTRSYLLQIPTSGNARKNIFSSQKMYRPHLFQSQTTGSNLPGSISKTSCGDYCTSAIRNQGPRFPTINGRRAVIMTRPWSIWSASGKIGIRSRPPQVSRPPPHKYYTIQLQDKFREHGLQIIVKMENIELTPDSGSYKGTDWRMEGQLNEHLVAAAVFAYDVANITEPRIAFRQNTKLDERFYRCSDDREQMRIVHPRHDVPAQQCGKYGSTEFAAVAEILGFSTADLDPCCYHAVKTWQDKGNSQGLTGAVGTFPTFLEHRYEPFALADPSRPGCFRFIVLYLVDPHYRVCSTRNVPPQQHHWWAESVSHNLAAAGLPQEIVDEIMQGTGSWPMGLPEARRHRREFLKEHRWNNLVRIYCMRRPSFDCY

SEQ ID NO: 37253 - protein, 66 aa, A.fumigatus
HQLFISAVCLESVLRSQEIRELKCLHVFHRECLDKWYLQDHFNCPLCHRAYYVQESRPSHDFVWMV

SEQ ID NO: 37254 - protein, 86 aa, A.fumigatus
RSDSCSGCWGIGLGESTPSYPARILLCASESFPTPLRGHFMEFVAAVGKAGAAIGTEVFTPPQKSLDSIFTSPVVLEGVISKQWLT

SEQ ID NO: 37255 - protein, 261 aa, A.fumigatus
RLTGGSASSPGSNREHGRFRTTVEPASALPGYPGSTSYSTVLAEHRSDIPFEVDNSSAAAVSTRSIDSDRLQMGSDMLRLLYDLRVCDIMIRKYHARTVITIVPKIVIYSIVESIRRIFDSLDANDFDSQFQDLVNQIFQNTSRPLTIHGSMTVEQYLSSFTGRNSRWEALGNIFAITGLALMSTPDSDPDFTQAAPDSEAKDRLRAQIVEASGICLGFCDQASSVNELLGFYQYNDVMLRTQQYGDSSMTIYSLRQLMVC

SEQ ID NO: 37256 - protein, 121 aa, A.fumigatus
FHCHQTFLMEDIFKLPRMVEVAGQTRSPAVRRNGTLQSCEPCRKAKLRCDHGRPVCGRCTAKNIASRCFYHPAPMTKRTVASRASPIEASRRLTSQPSSKSGLRPPSCDPGWAMMCVYGKD

SEQ ID NO: 37257 - protein, 287 aa, A.fumigatus
LQVLTCRRYLELVRTIIKRYTLEPAGSHGVWGLDDHSFIPYILGSAQLAPAISETDPTPEEGSLPGAPSPNGVTKAHIVERERLTNMYFSAIGFIYDVKKGPFWEHSPMLYDISGIQAGWGKINKVSLVALAGNDQLLIIQGMIKMYNAEVLSKFPVVQHFPFGSLFSWDRDPNAVPPPTSGHMSTTQSQSRGPAVPSAGQTPPSGTRAPWATATQAAPPAGAGTAAPWAAKRDGCTPGKPPTSLPDTSRLPPGPMAPTRAPWAASSTGQAPGGDPTHVPTKAPWAK

SEQ ID NO: 37258 - protein, 169 aa, A.fumigatus
  UNSURE (43),(100): Identity of amino acid sequences at the above locations are unknown.
FALYHLLGQNPPCPPAGYPPRSPPPAQSPSSSYPSAPRPSPRXLRAPSAPPGTSSAAVWTSHTDPPSLYSVAFANPQSATFPSPPAAYPPPFPPTSQTHXPSPSDPPPPRSPISRLHPRYPASSRPQQQHTPYSPDPSESQSIPRTPHASSGNYTPASNSSSRPSFSRR

SEQ ID NO: 37259 - protein, 228 aa, A.fumigatus
FHSSKNLMANSFPLRVLPTIDPSAGHTFITPSKRIHESEDVSEFLISKAYVDIMTFLLQLNRAMIPVKLADGTVQSWPINTDAVEFSAPVRQLQQLLTKLEELLAEAPPDTGPRRFGNISFRRWYELVESRASELLGECLPSELLQAKSSDPNSVTAEAELKAYFLGSWGSPQRLDYGTGHELSFLAFLAGIWKLNGFPKTTPGVEERAIVLGVIQPYVWPGCDNCKS

SEQ ID NO: 37260 - protein, 82 aa, A.fumigatus
GPGGPICWTDAAVRDQGSLGNCYSGSPTGWSRDRRAMGSKERRMHARKTTHFPSRHVTTASWAYGPYQGSVGSIINRAGTRR

SEQ ID NO: 37261 - protein, 251 aa, A.fumigatus
  UNSURE (135),(192): Identity of amino acid sequences at the above locations are unknown.
LTSAGGATGLSGSTAALMAGGPSSAASTPLVDAVFLLLTSGRHALPSWLRNGSTAARVFPVSSLRNSALRSANVFATSRFPFRESNNGRRRVICVVSSPRPKSTMPARRLSSSVSSTSSIPKLILSLSASAFASXPSRAFRSTRNVLRSRLDLSYGSSQSLFCRFCKSSIRDLSVSARRLSSTFPSNFANAXSFAFRSSPTAISHIPPASPVSRFLPPSTTTYAVFAGSVRISIHPPHAPCFIRKLYTGVE

SEQ ID NO: 37262 - protein, 561 aa, A.fumigatus
ALALYPEWLRPGFTSERHGKNLISWLFFADADHEQVTRIVAAWYKMGQDGDFPLPNFSSNTQDATGPLYPGALFSPSGVVNQYVNVQADHNITARAIARDAITLLKNDDNILPLKKDDALKVFGTDAGPNPDGLNSCADMGCNKGVLTMGWGSGTSRLPYLVTPQEAIANISSNAAFFITDKFPSNVAVSSGDVAVVFISADSGENYITVEGNPGDRTSAGLNAWHNGDKLVKDAAAKFSKVVVVVHTVGPILMEEWIDLPSVKAVLVAHLPGQEAGWSLTDVLFCDYSPSGHLPYTIPRAESDYPSSVGLLSQPIVQIQDTYTEGLYIDYRHFLKANITPRYPFGHGLSYSTFSFSHPTLSVRTALYSTYPPTRPPKGPTSIYPTAIPDPSEVSWPKNFDRIWRYLYPYLDDPASVGKNSSKTYPYPAGYTTVPKLAPRAGGAEGGNPALFDVAFAVSVTVTNTGSRPGRAVAQLYVELPDSLGETPSRQLRQFAKTKTLAPGTSETLTMEITRKDISVWDVVVQDWKAPVRGEGVKIWLGESVLDMRAVCEVGGACRVI

SEQ ID NO: 37263 - protein, 167 aa, A.fumigatus
SFQPRGEDLLNEILKDELGFQGFVMTDWLGQYGGVSSALAGLDMAMPGDGAIPLLGTAYWGSELSRSILNGSVPVSRLNDMVKISYRGCSSQMLIMSRSPESWRHGTRWARMETSRCPTSRATHKMRRALCTRVLFSLRLVLSTSMSTCRPITTLLPEQSREMPSLC

SEQ ID NO: 37264 - protein, 220 aa, A.fumigatus
RTFSSATTAPAAISHTRSHAPNQTILLASVSSRSLLSKSKTPTPRACTSTTATSSKPTSPHAIPSATDSPTAPSASPIPRCPSAPHSTALTHRLGPPKAQPQSTPPPSPTPPRYPGPKTSTAFGATSIHTSTTPPALGRTPARPTHTRPGTRPSPSLPRAPVAQREATRPSSTWPSLSASPSQTRAADPAAPSLNFTSNYQIVWARRHLASCDSLRRRRL

SEQ ID NO: 37265 - protein, 360 aa, A.fumigatus
  UNSURE (162),(220): Identity of amino acid sequences at the above locations are unknown.
LTATQIWDGPLPPLSYSSSHRNPKLTTDNSYVPPDQEGITTGNKLAGKHPLGARARHLRTSGALIVRFEMPFAVWCTTCKPHETLIGQGVRFNAEKRKVGNYYSTPVYSFRMKHGACGGWIEIRTDPANTAYVVVEGGRKRDTGDAGGIWEIAVGEDRKAKXDAFAKLEGKVEDKRRAETERSRIEDLQKRQNRDWEDPYERSRRLRRTFRVERKAREGXEAKAEALRDKMSLGIELVEETEEDSLRAGMVDFGRGDDTTQITRRRPLFDSRNGKRDVANTLADRKALFRSELTGNTRAAVDPFLNQDGSAWRPEVKRRKTASTKGVDAADDGPPAIKAAVEPDRPVAPPALVNYASDSD

SEQ ID NO: 37266 - protein, 229 aa, A.fumigatus
LTFSKLHYLQKAHEKASISYRLKGVTRHINETWARNGDDSAMKKALRRGGYSTLNVYFQTNLQPPSTTDFARWTSDGDNRHAYNSDLAPPSVLGFCTLPDPSINSSSPRSSYSKDGCNVLAKTMPGGPMTHYNRGGTAIHEIGHWNGLLHTFEGESCSEDNAGDYIADTPQQSVPTDGCPSQKDSCPDSPGLDDIHNFMDYSSDDCYASFTSNQLKRMRDMWFSMRKGK

SEQ ID NO: 37267 - protein, 80 aa, A.fumigatus
SDIPVSNSNKMYLINPQQPSEIEAKMLCDKLPQHDVAFQFLRLCLAYYKSHVELPSSMSCDGFTRPFSLCHWWSRCSIQG

SEQ ID NO: 37268 - protein, 207 aa, A.fumigatus
SLIDRRPVKLPDVYLRPPLDGKRVPGEVEIHQNGLRYMSPFRNEHVDVLFSNVKHLFFQPCAHELIVLIHVHLKTPIMIGKRKTRDVQFYREATEMQFDETGNRRRKHRYGDEEEFEAEQEERRRRAALDREFKAFAEKIADAGKDEGVDVDIPFREIGFTGVPNRSNVLIQPTTDALVQLTEPPFLVITLNEIEIAHLERVQVRFY

SEQ ID NO: 37269 - protein, 179 aa, A.fumigatus
GSTSVMTNIYCYADDLQFGLKNFDLVFVFKDFHRAPVHINTIPVESLEGVKDWLDSVDIAFTEGPLNLNWTTIMKTVVSDPYGFFADGGWSFLAAESDSEDGSEEEEESAFELSESELAAADESSEDDSEFDDDASAEASDFSAEEESGEDWDELERKAKKKDREGGLDDEEHGKKRKR

SEQ ID NO: 37270 - protein, 285 aa, A.fumigatus
  UNSURE (1): Identity of amino acid sequences at the above locations are unknown.
XLKGRKSSTYSMIITDTVRVGENGPHVFTKDAGLDMDSVSFYFGDEEEPQKPIKEKKEAKTSAIASRNITRTKLRAERPTQINEGAEARRREHQKELAAKKTREGLDRFAGTTGDDNGVTQKKFKRFESYKRDNQLPTKVRELTIYVDQKASTVIVPIMGRPVPFHINTIKNASKSDEGEYAYLRINFLSPGQGVGRKDDQPFEDLSAHFLRNLTLRSKDNERLAQVAQDITELRKNALRREQEKKEMEDVVEQDKLIEIRSTSLRRTILLPMLITHRPPSCEVT

SEQ ID NO: 37271 - protein, 416 aa, A.fumigatus
LSVSYIQQSRSRFQVKASKTSQKFDEALVELSAIMAATATIPKPKKPSLKGPELATFISQALEVHNSILNCEAYPESWFSVHVYNHRATVKSLEFLATLLTSKFLPAPDDAESFDTRLWESFFMTLLKVVSSDALALETFPEQKRRAVWKIAGDVREQGAELLRSSWEAIGWETTDEDRELYGLRKLGGYQVQYVPGLVAPIIGLCLSVHEGLRHVAVEILRTMILSEWGLNQELSIVETEIISSLDHLFKTKKMNESIIQKLFVSELLEYFEGCTSLDEDLSDAVKGLIATVDELLDLFVASQSGSMAGSMHTLRLMEYMKDMGREDIFIRYVHELANVQAAAGNFTEAGLALQFHADLYDWDPKRVVPEVLDPPFPEQTAFERKESLYFAIIQHFEDGTAWAHALVCYKGLHPG

SEQ ID NO: 37272 - protein, 418 aa, A.fumigatus
PVPSQWSSFGKNESAKDEAITGPLATLRLETYLCSTEYSQDQVILSLLHWKDRPVDEILDTLKRVLFVPEIEIVKQLSSVFDALFGILVENAGNEEYEDLIFNNLVTVLGIVHDRRFNLGPLVDHYADNQFNFPFATPCLMRSYLRLLQASADVQQSRSLRATFKVGRHVLKFIINARQQQKAKEEGIGITRGQSTFNRDLHTIFKSLEVLMRNPSPAMVGSKTLVVQHFHTWLPGLSKVISKDEIIMIALSFMDSCSDVKGLLILYKLVLIQHYTQLEIFESGPERRTLISSCIGWLEPYWGATGSVTDQYRDQVRLSCAIVAQLLKQPDPLLYGFMPQIVSSYYSIIPDGVEETSYLSLIFSKVVPGSRSRPRKPARNSMRHWSNCRRLWLPRQRSPSRRSRRSRAPSLRRLFRKR

SEQ ID NO: 37273 - protein, 144 aa, A.fumigatus
ALISLVNACAITTNTSLTTGQIRTGSKRLVSCHCRDITMSSNQDTTQSSTKKRESRAGTRKVTTLSAEQLARKRANDREAQRTIRQRTKEHIERLQNQVAELQAKNQQFDDVMRRNAALEHEIKSLRQQLAMLTGNQSYSSTGM

SEQ ID NO: 37274 - protein, 121 aa, A.fumigatus
  UNSURE (89): Identity of amino acid sequences at the above locations are unknown.
NYFFRYALIPDIPFIVINYVSAERIIQCGKLRNAEQMFASISAQSPPLKYFPASQRVTYLYYLGRYLFSNNLFYPAQIALQAAYDQCHXQAVSQKRMILTYLIPCNIIMGPLPFPAALAKS

SEQ ID NO: 37275 - protein, 501 aa, A.fumigatus
LVWVQAWTRHYYFTSPHALPDSYKAPGPNNMDDHNKAVATIAGQVRKFHSRRQPFRIYHGSTNSTRQSQHHHNNTVNTAHLNHMIRTDCEAQTVLVEPNVPMDHLVRATLAAGLVPLVVMEFPGITAGGGFSGTSGESSSFRHGFFDATVNWIEIVLPNGEVRIASKSSDPDLFWGAASAFGTLGVVTLLEVQCQQAKPYVELKYESASCMTHAMDIFRAAAADPQIDYLDGIVFARDHIIVCTGRLIDSLPANVRPQRFTGARDPWFYLHAQKRANTSSRKPDYIPLTDYLFRYDRGGFWVARYAYSYFLVPFNRITRYILDYFMHTRVMYHALHESGHSKRYIIQDVAVPYAATTEFLDWLDQKQNFGAYPIWLCPLRRSEGLMSSADSKNPVPPSTDPEDDGYLMNFGLWAPSPFHSNPDQFIAQNRRLEGKVRELGGKKWLYAHAYYTEDEFWSLYDKRKYDQLRERYHASYLPDLYQKVRVRLAAPEDVSYDRRRR

SEQ ID NO: 37276 - protein, 117 aa, A.fumigatus
LPTMAGQGTPVLDRFLAGIADIVKERDGARLQDFLQIEPPLPDAYRQMVDELRQQYPSGSPKEGNLLRRCEEVVPRTKGASSWAAFPTFMKLYFCFLRDVNVDNLLETYNLLKGLLK

SEQ ID NO: 37277 - protein, 209 aa, A.fumigatus
LYVLVMFIAPSLGIADGTDTLSLLLLACISISRDGEWSASNGTIYGVYVGVILVHAVCAVFAGPIMNKIQTFSIFVNVAMIIATVVALPVGKVSRGQSLNPGSYVFGDVENLTTWPTGWAFVLAFLAPIWSIGFFDSCVHMSEEALHAAKAVPLGIIWSSGCATVLGFLVLSVIAATMDPDVSKTMGSTFGQPMAQVSHPCPRMVTDGD

SEQ ID NO: 37278 - protein, 187 aa, A.fumigatus
RSRQEGSSWLHRCADCHSIPGRTEFGKLPAIFSGEKKIYRGTDQQIVAASRQAWAFSRDGALPFSGYFRHISKRIRYQPVRAIVGFVAVCIVAGLLCLINSIAANALFSLFVASNYVAWGTPILCRVVWSKKHFRPGEFYTGKLSRPIAIVAILWLIFGLMLSMFPSGGPNPTRKCLFCLCSLGTDG

SEQ ID NO: 37279 - protein, 60 aa, A.fumigatus
RGYATASTMNYTIVINGFVWVACMTYYFLFARKWYTGPKMTIDSSSSEVVSPPEKDAAAN

SEQ ID NO: 37280 - protein, 199 aa, A.fumigatus
RNYSHLHTSLSLSLSLSHISFTQYPLQALQGSHNTQHTSHTHNPRSKERGSLRTRPLRRGGRRARRTGTSARAGHGGGERPACRGRGIRQGSRGRTGGLAHRPGLRGGRRTIRSGQGGQLLVPRRRRLAGHIGSAGLGVRGHGRRPGLDVGGCGAGLGGERGDGRRAAGFKRGGDGGCVGDDVGGDVLAVGDDVVGCGD

SEQ ID NO: 37281 - protein, 78 aa, A.fumigatus
VAAFERWRPTRIRLIATAELGYKQELRRQYSTLEIFAVAFSIMGLVPSIASTIAFSLPAGPVGMVWVRLFSCFLSRRG

SEQ ID NO: 37282 - protein, 101 aa, A.fumigatus
LQADMASAMPTAGGLYWWTHYFAGEKFKNPLSFLVGYSNTLGLIGGMCSVDCMSWSCLSLHHSASLTVQIRSRCCCSRASRSRVTENGPRPTEPSMASMSG

SEQ ID NO: 37283 - protein, 272 aa, A.fumigatus
PRDGQYGVPELAGIYLWCVGSVTTYKTIPSLQLSLQSLISSLQPPVSNLWLLHCHLELITLSHINKTKHPKKAKMQLVHLTALLLATATSTYAQDNNAIDSLVSAANNIVSNGQNIASNVVADATSIASAFETGGAAAVSSLTSEAGAAASNVQSWASSVASDAQSRASDVASKASSAWNEQLTTLTGTNGTPTATETRSVSETTSSTTATLTDTTTSTSGSFTTTMTRTSTSAGAAGTSTSTSEGAGAQATPFLGAGIVGVAGVLGVMAAL

SEQ ID NO: 37284 - protein, 435 aa, A.fumigatus
YQLHFHDIMSSSLARARPSRRSAPRRSYVIEETSESEDPGNVTPTASNHSDNDDDDEDEEEEYTPVPAKRAKSVSRRRTTNEAITPTTARKVRKTRRSTTAEQGDTLEINNKNDEGDSVVPKEEEPESPLQNAAAALKRKSMAHPRKSRVSSTLHPEKSSLPTPGPSVSPEPEPRSQRGSVPPLADITESVVNQTPAKPSDDPKSQISIINPNSTILERPMDIVMKSRNLAPSVPEEPSGPKPRLIITHLVLTNFKSYAGKQIVGPFHASFSSVVGPNGSGKSNVIDSLLFVFGFRASKMRQGKISALIHNSANFPNLPFCEVEVHFQEILDLPGGEHEVVPDSQLMISRKAFKNNTSKYYMNGKETNFTAVTTLLRERSIDLDHKRFLILQGEVESIAQMKPKAANEHEDGLLEYLEDIIGTSKYKAPIEKGSS

SEQ ID NO: 37285 - protein, 94 aa, A.fumigatus
DTVNLSSNMTPSAKSPIRAEDQQRANSVTVTHPGAIIMGTWEDFDSIFYFNKSFNYDDKVIEQILSNRRALGNQLFADRLLGLLGVQAGRQFAP

SEQ ID NO: 37286 - protein, 117 aa, A.fumigatus
GMGFILAFFLLGEDFGSVKCIVIGRKCCLPLQQKIISIEQNFHFHLEYSSSVKIHDTYSIDRDEFDRVICRPDIQYTSIKGTVIYWLALPRSVGAAEKRNMVVCTFFQQGRCRFGGI

SEQ ID NO: 37287 - protein, 65 aa, A.fumigatus
SASARGMVWPRGERTIAPLLHAVMRELLVFFYKIMRSSIVFSLFVFFCPSLSDLYIENHFQAIAL

SEQ ID NO: 37288 - protein, 147 aa, A.fumigatus
VYFHTSESLSVLELPRLNLPQKASPGKLKVPPDICGTSVGFLAAHEIACAQGKQVNASTPCLLRFVCSCSGEHQSLRPSIYLDSVKLFFEIISERQYISVAGVVVEAAWACCGNFKYDLDKDKAVSRYVHTNRTQAAIQSSECSSVC

SEQ ID NO: 37289 - protein, 111 aa, A.fumigatus
IWPQHSHYRSVWNTLLLLPVPKRTSGGSAQWKYWYGTILFTLLQNPSVFPQIPIECGLGYGIRTRGASLFSPEPPLNSSSSKNCAIFPVNPFFLPGIIPVSVGVSNGSKPG

SEQ ID NO: 37290 - protein, 122 aa, A.fumigatus
GSVANSVPHPPTIVHNLTSAVVFKKERASILIMLLPRKSRVGSSGYSYSSYNNSPWNEDVTFSMYSVYGGRSNFITQLAFEFLTLGVLFLFLFGCFFIRQPKALPKCLPKKALVFGILSYIL

SEQ ID NO: 37291 - protein, 102 aa, A.fumigatus
NPIYTIDIQLPTTTSMVLLVTTTHIISAFEAVPPSSRKELDLPDSLSIGSPISHEQVIRLSRYSNNGANSTSPHPKPDRSLNSLLRGTRVYVPPPSKKPEPV

SEQ ID NO: 37292 - protein, 232 aa, A.fumigatus
YDHQSPEYLALKARLLAAAETDAYNRMTASTFTSSAPGQSGPSPIFSSSTPTLSALHDSKALAGDTGTKDPLTPSLVLNIFLSVLITGFSVYWALTSFRTPDILVSSVSSLWRGQPPSKPSANRVSGGVTEPVRVLVSLLAALMVGVAEVLIYAIYLQKVDQARARERRIKERKEVVETDVVRAGPGQAGKEGVQRIDGEQETIWGRGANGGVRRRVREKWEEKESQWNHDG

SEQ ID NO: 37293 - protein, 67 aa, A.fumigatus
QTNSSSTLETSFELNDTLYARAQISPADTDEVYLWLGANVMLAYPIPEAERTLSEKFLPRHGQEIRV

SEQ ID NO: 37294 - protein, 342 aa, A.fumigatus
  UNSURE (21): Identity of amino acid sequences at the above locations are unknown.
QVEEFPAVSSEDIKLAMKELXDEPTTFMFHAEMLPHIAASVGDAVSTFDPRAAPAGPVEAYSTFLASRPSVFETCAVQEILSLAHLAPNLPLHIVHLSAMEVIPLLHKARTDGVKITAETCFHYLSLAAEEIRDGDTRHKCCPPIRSKLNQDGLWAELERHAEDGVIKTVVSDHSPCTPDLKLLPSHIPGHHAANGEVENSGSFFSAWGGISSVGLGLPIMWTELSHRKNLTSAPDDANTKRALQDIVRWCCANTAAQVGLQNQKGDLVPGFDADICVFDDTAEWVVKPSTMLFRNKCSPYQGRTLRGMVRETWVRGEKVFSRDDGFVAKIPTGRLLLEKRV

SEQ ID NO: 37295 - protein, 98 aa, A.fumigatus
QPLSSSTVTTQTNPRGIPAAPFIDNVSDYVASRADVEPTLQRFQEMISKYQFMELNTQRRAAGLREKIPDIKKTLDVVRFLKMQKEVGHRVQSPVIVC

SEQ ID NO: 37296 - protein, 388 aa, A.fumigatus
  UNSURE (40): Identity of amino acid sequences at the above locations are unknown.
AANPTELPIGDSPDLVLVPATPEERIKSIRLNSTAWKGCXDVETYIARENHLYQQRLVKDGLTCWLLVDRREPEGQRTILSSCETYKKKALLAHHGKVEDIATHGVGSVYCRPEHRGKGYAKRMMQELCTKLETWQMENEPRSRSLFSVLFSDIGKNFYAQFGWKPFPSSHISLPPISREEYDLSSRANLPKARTLVADDVRKCMCSDRVLQKERESLRAASEKTPIAHVAILPDFDHFVWHWAREEFYAEKLHDDQAPPLIKGAGEDKAKVYCAWNRNFGETPQDNTLFILRWVYDEPTTPEETEATAKAMAAILRRAQLEAHEWDMAKVDVWNPTPLLQKAVAMLDSPAELVHREKSSIASLRWTGAAQGLGEEVEWLWNEKYAWC

SEQ ID NO: 37297 - protein, 73 aa, A.fumigatus
SASCFCFEAYHRVTDFLQENSYGHPDQTTIYFVNNIDRHKIKKNISTDANTAAVAKKSRNWHELFRNQKRQKN

SEQ ID NO: 37298 - protein, 533 aa, A.fumigatus
  UNSURE (515): Identity of amino acid sequences at the above locations are unknown.
PIWYWSAEIDRGAKCIVQMKGNQTILVPPPGADEKSRKAGGKGAVEGPKTFAFDRSYWSFDKNAPNYAGQDNLFADLGVPLLDNAFQGYNNCIFAYGQTGSGKSYSMMGYGKEYGVIPRICQEMFQRIAKMQEDKNLNCTVEVSYLEIYNERVRDLLNPSNKGNLKVREHPSTGPYVEDLAKLAVRSFEEIDHLMDEGNKARTVAATNMNETSSRSHAVFTLTLTQKRHDAETSMDTEKVSRISLVDLAGSERANSTGATGARLKEGAEINRSLSTLGRVIAALADVASGKKKNASMVPYRDSILTWLLKDSLGGNSMTAMIAAISPADINFDETLSTLRYADSAKRIKNHAVVNEDPNARMIRELKEELAQLRAKLGGGSTAGAAGGMPAEEYYPPDTPLEKQMVSIQKADGTITKVSKAEIVEQLNQSEKLYKDLNHTWRGEIREKRSGSTGKRDAALERTRYQYRKRLRWLEHSEENAHLVNLSDEPVLAECLVLHIKPGTTTVGNIEQGNXVGDHVEWAPDIFQNNCPF

SEQ ID NO: 37299 - protein, 98 aa, A.fumigatus
RNFCGANGRLTIQTGFSNPTLFIQVGSKFGIGPNRIEEVSSKNITPSMARLSGLQREVLSLYRKCLREIRKKPSVSFLFSLHDELVSKAFFWLIESIL

SEQ ID NO: 37300 - protein, 196 aa, A.fumigatus
TTNMAFPRFSTDLAPLFQLLDDYDTHRTYRPKNKVTPVRTFAPKFDVCEFPDGYRLDGELPGVNQSDIEIEFSDPQTIVIKGHVERNYNNTATETGDDSSSTKSRQPTVEDETEEGNASSAIASPAKPAEQTVTNSPTQTNYKLWVSERSIGEFQRTFAFPTRVDQDAVKASLRNGILSIFVPKEAAPKLKKIRVE

SEQ ID NO: 37301 - protein, 77 aa, A.fumigatus
  UNSURE (52): Identity of amino acid sequences at the above locations are unknown.
NLVTLVGHADSNFFVHKVTYFRQIVQIYAVMAFFPSLLSFFFVFFFFFSFFXWETPGKIAEGVLEAMYFMGIRNHTH

SEQ ID NO: 37302 - protein, 242 aa, A.fumigatus
KAHNRTFGRIFSAVILFSKKGPSSNEPRVTPNAYLSTMPPKTGRGRKAIGAPRTQPRDDGGAGPSNAAATASPSTRGQPPKFRGGTRGEKRPAHAPRPSDVQRMYINDSLRRHIKTYAIALSLIPYQLGTPTPQGRRHRYKPGTVALKEIRRYQRSYDLLIQKLPFARLVREVALELLPAEVGAELRWQSHAIQALQEAAEAFLVHLFEDTNLCALHAKRVTIMQKDIQLARRIRGIWGGLG

SEQ ID NO: 37303 - protein, 188 aa, A.fumigatus
WQYWRLLTTFLYFGPLNLDLLFHVFFLQRYSRLLEESSGRSPAHFSWLLFYAMTSLLLISPFLSLPFLGTALSSSLVYIWSRRNPDTGLSFLGILVFTAPYLPWVLMAFSLVVHGIVPKDEICGIVVGHIWYFFNDVYPSFHGGHRPLDPPRWWRRIFDPRAAAGEAQRTDTDNVNRDFAAAAAPEVR

SEQ ID NO: 37304 - protein, 169 aa, A.fumigatus
  UNSURE (11),(12),(14): Identity of amino acid sequences at the above locations are unknown.
KGTPGELPRGXXLXGTFYCAPPSRGHGHSHSTSSIEVPPQTTPSDLDLLHKWMNDPRVSAAWGEGGPKEKQEKFLRNNLTSRHSFPVIGCWDGKPFGYFEIYWVKEDRLGALIGGADNYDRGIHLLVGEQEYRGSHRVAIWLSALVHYCWLADPRTQTVMLEPRVDNEK

SEQ ID NO: 37305 - protein, 65 aa, A.fumigatus
FYLYSSFSTTIPIYCYYYYYYYYISLSQLFSVNYIYKPLFHSPHHVSSSNYSSLHPQRGFRSPGQ

SEQ ID NO: 37306 - protein, 161 aa, A.fumigatus
LARIGIFPESSPCCNSICTALFLLQFPYTATTTTTTTTSRFLSCSALTTSTSPSFTHPTMSPPAIIAPSILSADFAVLGNECSTKIAQGADWLHVDIMDGHFVPNMTFGAPVVTKIRSHVDRPTQALGKGTFDCHMMIMEVGAHPSQPIYTIQSSLLRETR

SEQ ID NO: 37307 - protein, 87 aa, A.fumigatus
MVLVMTVHPGFGGQKFMASELPKVKALRERYPDLNIEVDGGLGLGTIDQAADAGANVIVAGSAVFGAQDPADVIAKLREAVNKRRQT

SEQ ID NO: 37308 - protein, 71 aa, A.fumigatus
TFVDVVVACLNPGSGIPAGYPHGWIYPTSHVKATTLALISDQIAIVGLTSTASGSSGDVDAAYVIFPFLFS

SEQ ID NO: 37309 - protein, 120 aa, A.fumigatus
EKHANTPPQPHKWVKEFKSAGCDLYCFHYEAAISSVAAMTPEDKETSRLTSPKELIRYIHDEGMQAGIAIKPDTPVDVLWDILENKDEKERPDVSLHYSDTHRLLGFILTDHCCCRWFLS

SEQ ID NO: 37310 - protein, 149 aa, A.fumigatus
RILGEKGGATIRFGITRYQISNFSFVSSSVSPLFPTHCNLSMSDSTLYLYTSLTAGSSHIVTATARLETILKANKIPFRAIDVATDDAARKLWGRRSKGKKLPGLVKFGTVVGVGLSDAPLMKGGTAMRRSYVTNSFAHVGSRGHRGVE

SEQ ID NO: 37311 - protein, 105 aa, A.fumigatus
CYRCGFRLERRVHFILKLPTDEPHISHYKEFNDFASKSESVPQPHNTIIDRVALATQCAKELSSSSNTAAEDTSLTCCFVHACENSTGSECTSIFGWQCNFGPGL

SEQ ID NO: 37312 - protein, 199 aa, A.fumigatus
DLEDIEEWNEYGELRMHIDSVEDFDSIPATSYPLSTSQTNTGSATPATPQPPAQSATPKQSTIKIQSPPAKEQKDDSVTLALRQAGAEAAAKAKGNTSADVKKDNTSADSEQQKGEPPSSGENKEGEETVRRHSVVPAEIVGGCGGRPPLRVPECAAESSADFRADNAEALGLVQHHRGSIVSATSPEEMEKWFKNSAS

SEQ ID NO: 37313 - protein, 381 aa, A.fumigatus
RNQQGIPQHRMADASRTSMRCPLSRQVRGTKLNTIIEEASESLDSDKVESNGVGLHSITSGPQLKLMTAGLSSLSLSKLNRLRSPLSAGTTSSCSDTEWQRQMQSLDDLYDVTDVDSDLSDECTSFSSSRPTSLTSPTTRNSMTSPLNRNRYPSLTIPSSTAWPSLHNVPKSSPVPPTPPPKIPVSPAALSMLARTVPALNAPPSLDGSVTSDQVSNSSEPITPDLQSLPDADWDADMHVRPEMMNSRHADIDTDGIDPQVQSIEIAIEKPDEDWPLVLCSFPAIPNQSNLASECGIFLPEDALLTWKHTPWGGTRNLGHKNLFKRRKWRFNYLLNVPPAPIIEFRLCALRNSLYGAIYLSPEGSLVHLWPGPSHGSNQKK

SEQ ID NO: 37314 - protein, 64 aa, A.fumigatus
FNITAALLSPQLPQRKWRSGSRIAQVNIRASRRNISGLENEHAERQDKMRQSWKIQNGEENKNG

SEQ ID NO: 37315 - protein, 191 aa, A.fumigatus
  UNSURE (177): Identity of amino acid sequences at the above locations are unknown.
SPTQNSSLCLNSSQVRQYLDTFVRTAYESYVLGFPTSDHLLTLSKVNVFRAFASIMSLLGMSHTDDWMHDDALSPFVTMGPGYIDEQKLPPSLRPTRLQKTIPHHPWLDFFPIPKIRDNLLTTGEDNFDDCQLCVDIMGFWDSGMDACCMLVWGDPTDPKNWEVTERFLKKWPWVVXGVLHAQGAEGPHMR

SEQ ID NO: 37316 - protein, 94 aa, A.fumigatus
SSCGKTYANFFVFGIFELLDEGNQKIFSYLKTWKEQCMLVVLNFSEEPQPFQKPMELQNRDLKLFVSNIGKPVSGECELQPYEGRIFEVKAIPN

SEQ ID NO: 37317 - protein, 75 aa, A.fumigatus
CCLCHDLSMTKDIVEQLMLDVWTLQYHYCDISILWNSTVPAYVNYNTLSFHLSSQTNSTYQQGHFSLIREFCCSE

SEQ ID NO: 37318 - protein, 492 aa, A.fumigatus
GCLFAKMDATRLKKPQVSRACDPCRRRKVRCNGQHRCQQCEHLDLLCTYSDNQRARSRKNALRRGTVISEYKIPFARELKSEHISTSVLVPPSSLPDLKSVALSTSYLYSLIPKYMAYVYPFNPIMTDEEIRESIGKMATDRDHAAFVYAFTGVTIDLTQSNAATSHVSEQINELAGRAIQLRTPLLPGFRPSILRAVTSVYIQMCYMSLGQYDLGFFYLREAISMVHLLRIEDKAVMASLDLTERSRRQRLYWLCFIHERFMSIFHFSPATLSPYAQFPEDDPSLDPSVSHGWVQVIKTFLLLEPTFISLWIGDRSQVTVAWVEQKHRELDDELWELEVSMLSDLQQADLVVTRQWMRTLLWQMAMSNCLLSSHASCPSLSLEMPLRLSSQLRQFLTKISQNTIQIHGSSILSKLLEIINTIADVVLHGPQVTLEETTSRIDDILFLKDVIFSFRNLQQVSKKILIEKLHLIGERFAHIEVASQLLCGQGA

SEQ ID NO: 37319 - protein, 73 aa, A.fumigatus
RRTSLSMYGRGTEQIRCRLLPEVVFGIIIIRKIKTMDKFLCFSSDFESNGWKLLDNLSVFRNIYRILALSCCF

SEQ ID NO: 37320 - protein, 382 aa, A.fumigatus
HEEQMTGAAKQEWDTLKMELESRISQAEELNTSLQLELEKVRTERDATERDLRSQLNEASQQSAGDAGLQSQFSELQIKYRDLQAELHQQQQVTEEVRREASTFLMEMKALSEQTQSRWEHEERLSGEVQRLEDELQQWKTRYAKVKTQLRHLRASSGISETRPGLSTVIQDNGFMQDDGLVKDIHVTKFQISIDELLRVARSDEYQLVMHQIKGVILAVRHVLNDIESTQNPADGLAAMRTKATRKVSATANNMITAAKNFVRSNGLSPVSLLDAAASHLSTAVIELIRLVKIRPTPEHELNENEEERDQFSQMKSPDYFSVAPSQSRMSNNDSIYSAMSDPSNRTPNGTHSHLDAGSQNGALTGSQLKSEDHELQELKVS

SEQ ID NO: 37321 - protein, 61 aa, A.fumigatus
LLCSNGSQFFITTAVTSWLDGKHVVFGEVADEKSYSVVKEIEALGSSSGSVRFNTRPKIVK

SEQ ID NO: 37322 - protein, 192 aa, A.fumigatus
PHLARPSLLVPSSPPLSIAISHPSCLFADSIKPLPPCLRSSSTSSTPLWAPLKVSYSAPSLTLFYLVYGLGYNCITPPSRFSASARNCAQSGLDAFGLQSILSILFTDGILLRAVTAKVGRIVFNLFDKDVPKTAKNFRELCKRPAGEGYRESTFHRIIPNFMIQGGDFTRGNVSFRHPQHRSCRSRLLSGF

SEQ ID NO: 37323 - protein, 445 aa, A.fumigatus
SHRQASKTYAHYSRFYAPWCGHCQNLKPAYEKAAKNLEGLAKVAAVNCDDDANKPLCGRMGVQGFPTLKIVTPSKRPGKPKVEDYQGARSAKAIVDAVVDRIPNHVKRVTDKDLDQWLSEDQESPKAVLFTEKGTTSALLKAVAIEFLGSIKVGQIRNKESKAVEKFGVKEFPTLVLVPGGDKEPIIYDGELKKQAIVEFLSQVAAPNPDPAPASTDAKSSKATKSAKSPKSSTILSEEAENLKPTASPDPKVVPDDATESKPAQVPIQAPPIPVLPTAEELEAACLKPTSGTCVLALLPEPREGDADVSSPAKEALTSLSEIAHKHAQRKSKLFPFYSIPAINSGAKTLRAGLGLSEDQTSVEIIALNGRRGWWRRYDASEAQDYGAVSVEAWIDAIRLGEGSKSKLPDGVIVEQKEEGDVEAKKDADKENLHHGTAGPRLLYP

SEQ ID NO: 37324 - protein, 61 aa, A.fumigatus
LSKRGQQAYLELSTWVLKQGVLKLLACDGGDQNSSAMMQTIHERIFSFPHAMAYSATALFT

SEQ ID NO: 37325 - protein, 529 aa, A.fumigatus
LLLDTLPCTTVKMMAEVKVTPEPPRGPGTADFLFMPLEVFWMILQYLDARDIVRCRRVSKHWKEAFTNPEYLVRLLIRLFPSAPEVRGLKDKQSLDELLSAVQSGEHWRELFDKVASRYDHLSRGKPRSVQKLKLCDDFGVTGEREWFQVQPWDSHASHLMQRVDYLYPETFWTYEDGLLVYPSADYSSLVLMDVETGKQVMVPFLIIGKVIRRIRLQKRVLVVEWAEPKAFHWLNDSDGVHRHFASSFDVAQEANGSWNVSFRNEWKIMFLGHPLSERDRFYSTHNKTHYVIYIWQPNRSLYTADEDAPIESLFVWDISKPCPYRPSLDPTGRQRKEEQDQAPAIVSRFGFRELGFFSVRQRGVPGIQGLEITDDGQAIEIIENLCTGPLDRLVGPTEWTSQVQITSIPLIGDGPVWRRDVGYILSPYRGSNGLQTKPLGLLCKQFWYTVISEVYDRNSKAGFALHLSPLGWPFDSRIYMSIQTPYSRIVLKPDDVFELAGRGKICGNEKFVIGENANRELVIWRFDR

SEQ ID NO: 37326 - protein, 222 aa, A.fumigatus
EDQVLPGLINAVLLTVVLSAANSNVYSGSRVLLGLAREGFAPQWFAKVTQRGVPYISVAFTAAFGLLGFLNLSESGGKVFNWLVNISGVAGFICWASINACHIAFMRVLAARNISRDTLPYKAIWQPWLAYYGLFFNILIIFTQGFTAWIPTFDVSDFFVAYVCPILFAVLYLGHKIVFRTKFVDPLEADLDSARVETKSTSWETSAPNKGWFERVKGRFIG

SEQ ID NO: 37327 - protein, 130 aa, A.fumigatus
STPCSSPSSSPPPTPTSTAAAVCSSVSRARASPRNGSPKSRSAACPTSAWPSPPRSGSSASSTSPSPAARSSTGWSTSPAWRGSSAGRPSTPATLRSCACWPRAISPAIPCRTRPSGSRGSPTTGFSLIS

SEQ ID NO: 37328 - protein, 135 aa, A.fumigatus
RPGPPRPDQRRAPHRRPLRRQLQRLQRQPCAPRSRARGLRPAMVRQSHAARRALHQRGLHRRVRAPRLPQPLRVRRQGLQLAGQHLRRGGVHLLGVHQRLPHCVHARAGRAQYLPRYPAVQGHLAAVARLLRAFL

SEQ ID NO: 37329 - protein, 177 aa, A.fumigatus
HQILRTICFYLSIPTNRTNAGIFWYSTIHLCEIFARSNQIHRNILAMDANPPRNAVTPVNTTNTPYSDPYAPNAPAFHPPTFSSASLSGPLITFPTPRPVSRNANTMLTCAERSLFCTSWDSADQEDEYPPAKNPYTMQKAYSVAMWFANPHSRKTDATAPADESKMHFVTWCRSAR

SEQ ID NO: 37330 - protein, 102 aa, A.fumigatus
GLAYLPTPIVIAIMFAFPRARRWFSTAGFVIMCLALGLSSFSTSVTHLIMSQGVAYGIGGCLAYTPSILFLSDWFVEKKGLAFGIVWVCSSPSNSNQPPKLI

SEQ ID NO: 37331 - protein, 255 aa, A.fumigatus
YEGFGVISISIYRSIYLCPCLVSILISCTVAMLANKPTLDPLKPPLVRSRRLPRGTLRLDACGIQIRLEGIHKLRPEDNLMAQIQHGKQDRTDIRDEEIRDIKRGDPRREPLREDDQDIKEKPVVGEPRLPDGLVRQGIAGDIARGQHAHERNVAGVDGRPADEPRHAGDVDQPVEDLAAGLGEVEEAEEPERGGEGHADVGHAALRDFGEPLRGEALARETEEHTAAAVDVGVGGGEDDGEEHGVDQAGEDLVF

SEQ ID NO: 37332 - protein, 375 aa, A.fumigatus
  UNSURE (163),(177),(180): Identity of amino acid sequences at the above locations are unknown.
GETDKALVGPGLPAHTHRHRHHVCIPPSPALVLDRGIRHHVSGPGSEFVLDKRHPLDHVAGSGIRHWRMPSLHAVHPLPIRLVRGEERPRLRHRLGMLLSVQLQPTPQTNLAQSGSGLTGILFPLILQTLLNQYGWQTTLRACSIALFLLAAPFMTFHKPRVXIRHSHLRQLSLAFXWDXVYLIYQLGNTMQAIGFWIPSIFLTSYARTLGASDFLASLTVTLFNLMTVFGCIFTGYLADRHHVTKCILLSSAGAVASVFLLWGLANHIATLYAFCIVYGFFAGGYSSSWSALSHEVQKSERSAHVSMVFAFLETGRGVGNVISGPLSEALLKVGGWKAGAFGAYGSEYGVLVVLTGVTAFLGGFASMARMFRWI

SEQ ID NO: 37333 - protein, 88 aa, A.fumigatus
CLTIYAPPNVSVTIMMTKNGLMINAVFQYMMKATTNAAQNVAMAVSITASLLVTASWTVPISDMMRLVISPGPRRSKNAIFWRKMAAR

SEQ ID NO: 37334 - protein, 486 aa, A.fumigatus
  UNSURE (474): Identity of amino acid sequences at the above locations are unknown.
RDTGVFREYSVILSSPPTESSWQSLDFLFWEEPGYHGPDLLNAPDDIRLIQLAQDNESTEITPASLGSPKAFEFLLQMLRASASGAKCAVKLIVPLHRGFIVRSDIIPLRLRDSEYVESAVSFAEPLQTYSGKKVAISSRADLTTYFAAAAAGLILRQGSTHASDAGSQALFQMVESDLANRLSFRGIQPGTPRRRTLALVDANSSHPQDGLGFYRAARELGINVVVLENAGHWLEDPAQAHWREAFIPTRLTNPPEEDVGDHILASLRAYGKPVDGIVTFADSFWYYIARIAHEIGVETAPPDSMRIATNKFLTSKYVGHDAYLASNVDEALRIAKEVALPYPLIVKPCDGWSSEGVSRVESPDAFPAAIKSIDTSRHGTEFVMEPYCDGPEVDVNLVLLDGEVLFAEICDDLPKSADVNGLTVGSLTNFHELYSVYPSALPSKELELLIHSFVDTLLRLGIRNGVMHLEERXQNSRWNTASRTG

SEQ ID NO: 37335 - protein, 325 aa, A.fumigatus
CWRLSPFAAPSRILNSSEQVIYGLLVSVYDGFAAGTVSASELRSKTATFSLYYVYLSIGLFAFTYVATVGFYYTGERMARALRTTYLAAILRQNMAFFDLLGPGEITSRIMSDMGTVQEAVTSKLAVMLTAIATFCAAFVVAFIMYWKTALIISPFFVIMIVTETLGGAYMVRHHKRAMELYSQAAGIAEEAIAAIKHVTAFGIQTLLSQRYLSVLEQAGQGRPKGREHGSGHDCVDERHAESDLRSCVLGRLDLSDPRPDVRGGSERDDVGRHDRVLCHYPNCPFRTGLAVRDRNHGGNPEVDRETIAARSTGQGRRRAFDRRG

SEQ ID NO: 37336 - protein, 203 aa, A.fumigatus
DITSGRWSCIVRLPGLPRKPSPRSSMSPRSGSRPSSPSGICPCWSKPAKADRKAENMVAGMIAWMNAMPNLIYALAFWAGSIYLTRGQMSVAEVSATTLAVTIGSFAIIRIAPSAQALLSGIAITGEILKSIARRSPQDPLVKEGDEPSTVVGDIVLDRVGLIYPSRDDVDILQDVSLRCAAMKKTAIVFTTGLEGSTVVSSK

SEQ ID NO: 37337 - protein, 107 aa, A.fumigatus
TLLCPVMFSSIGEKTLYIFAISNVITIPMVWALYPESNQRTLEDMDLLFAAETPWVWDAERTFARLKAENPGYIETAGRKNSLLDSEAGVGKPAAQTTQHEENVSSE

SEQ ID NO: 37338 - protein, 98 aa, A.fumigatus
DNLRMAQTQETARTPGFRARKDAILSRRYIEGQIADGKHIIIFDDRVLKVDAWIKFHPGGDKSIKHMVGRDATDEINAYGFRGIQDDSNLQRLTSAFV

SEQ ID NO: 37339 - protein, 283 aa, A.fumigatus
HPLLYRLHSSEARQRMLSFQIGRIQGPWLNFLPPIQGGKFRPYPGETCSSDEDSTDQDISQPPSPVFDAADAGDKAPRVRRRRKSATISDTSVSTTPTEGFEPKPFFLDARTQEEIIFDVAKYPSLDTANQEEIKRKYRELNERIRAEGLYNCNYFSYFIECCRYTLLATLSYTFLRLGWYGISAFLLGCFWHQLVFTAHDAGHMGITHYFHVDSVIGIIIADYLGGLSLGWWKRNHNVHHIVTNAPEHDPDIEHMPFFAISHRFLTSRLHHAPLEGSELAQL

SEQ ID NO: 37340 - protein, 114 aa, A.fumigatus
FGRQNPAQDNGMNCTPYISVLIANCVQVTKCSAHASLIQMDDADWWTRFFKNGAQINTPMDVEIAQSIDNNLEPWPNAWDSLEATAYLHAEALQTILPRYTEAVWNYAVRILPP

SEQ ID NO: 37341 - protein, 97 aa, A.fumigatus
KSTVPSWSSPRPFMYTPLHGVGGLIFPELCRSVGITDFAAVTEQVEPNPDFPTVAFPNPEENGSLDLAMQSADKEGKTLIIANDPDADRFAAAEKVE

SEQ ID NO: 37342 - protein, 262 aa, A.fumigatus
SSGSWFTFTGNHLGVLLASHLFDSLEGRHDKSRIAVLNSAVSTGMLEKMARSKGFHFEETLTGFKWMGNIARRLEESGYHVPFAFEEALGYMFPDVCHDKDGVTAAMVFLAAEARWRSQGLTPYSKLQQLFKDFGYFETLNKYSDHLSPEITKSLFGAIRNGPYRTQKSLGSFKILRWRDMTEGYDSGTEDQKPALPIDKSSQMLTIWLDRDVRFTIRGSGTEPKVKGNSHNRNMRKALLIHFLSLHRKLQCFSCAGCGCCL

SEQ ID NO: 37343 - protein, 197 aa, A.fumigatus
CIERLLISKRRIPRRGLKLSSYRRLERLQSSSCVFGSVRIFYNTGSFVSCTSRLSNHTSAGIQFGTAGLRGRMAAGFSCMNSLTVIQASQGLAKYIRDKHSDIAPNGVVIGHDARHNSAKFAALAANAFIAMGIPVWYYSKPTLTPSVPFGVTHVRAAAGVMITASHVCLLTIRAVTRAKRSDTDDLVDRTQPKTTV

SEQ ID NO: 37344 - protein, 150 aa, A.fumigatus
CPYRQYLLIWTLGYRLKHAHALVEGMHQHHYHQQTTSTSHCNRKAHFHSSEGCPRYLTCHSHTHVQQHRHHHHHHHQQLTHSTHYDGARETSQSCTCSHSYGSETRAHSGGYRGCRGLTQVCLCRRPYGPPLPGGLMCVGRGRVGCVCRR

SEQ ID NO: 37345 - protein, 116 aa, A.fumigatus
IQPHIMASPSSTPPHSDAHVNGNVLPTASVPKLYGSGDGAQSGAGTPIGFQRYPHNKILDNVAGSNVRHPSPQPTHLGIPGSPLHRVLSEEDPGYIAAKFEGKQKQMEQGMRYSLA

SEQ ID NO: 37346 - protein, 515 aa, A.fumigatus
  UNSURE (455),(476): Identity of amino acid sequences at the above locations are unknown.
GRSRLHCCQVRGQAEADGTRYALLARLSSCARSVPLIRVVLPIVMDQLEEKGFFPSDFVVSETTWFYNMLGIDDTYFQTETVDSIVTQILSLYAAKVAAYARDDKKLEIRLDKEAEDHAVYIDTSKPGISSVDGPRYEQRIDAKYINNSTPENSYRVETFRSPTPLPGDSEQQLRCYFVYKCQFAHPNPSPTETDIEIIGEKRFLQKATANTKAIYQEIISNAVNRAGPVIEMFEIEGSREKRLVIAYRQGSAMGLFSALSDLYHYYRLTSSRKYLENFSNGITVISLYLRPLKNAEISAKYPPIEAAIHQIIKETSLLYCIPQNRFQHHFAVGRLSLQETIYAHCAWVFVQQFLNRLGSEYTSLAAVLDANNSVHQELLSKIKKRLRTETFTADYIFEIINKYPELIHKLYLDFANTHYVQTRASEDDFLPTLSYLRLQVDEVLDSTRLKQLIXSTVANEHDEMVMSAFRVFNNXILKTQLFHADEVAFSFRLNSEFLPRHEYPHTSVRHCSWY

SEQ ID NO: 37347 - protein, 196 aa, A.fumigatus
VLFGIPFLRNNPAGYVSRAFELTRQFMFKWTVNWRFVGEELFLSRKFSLALLALHLLLLGLFVATVWLEPSGSNLPSFLQRLIQRRYRTASLSKSFVMTAMLSSLAIGLLCARSLHYQFFAYLACATPFLLWQAGFHPILVYVVWAAQEWAWNAYPSTNASSLVVVLSLAAQVFGVLGNSFSRKHLDQSSQKEHMR

SEQ ID NO: 37348 - protein, 231 aa, A.fumigatus
SVGTIPSYLKLTIEPSNADTEIDWTTYMQQVSLYISGERDYTLIKGSTGPLVYPAAHVYIYNILYHLTDEGRDIFLGQILFAILYLATLTVAMTCYRQAGAPPYLLVPLVLSKRLHSVFMLRLFNDGIAAFAMWVSIFLFMNKKLAAGVIVWSTGVAIKMTLLLLAPAIAMVLVLSLSFGPSIRLGFLAVLIQVMQVSFARKKVANMAGRSYLGYHFCETTRRDMFREPLS

SEQ ID NO: 37349 - protein, 230 aa, A.fumigatus
SRQVILKNFACHESPRPSLTSVAFIRAIAQLRACRLIPESEVRELCYKAREILIEEGNVVSVDAPVTICGDIHGQFHDLMELFRVGGDVPDTNYLFMGDFVDRGFYSLESFLLLLCLKVRYPDRITLIRGNHESRQITTVYGFYDECIRKYGSANVWRYCCEVFDYLALGALVLGASSELGPTGSTFSDTTQSTMPIDGPELGNEVLNSRGDVPLSPYRLGGRSSSEGVD

SEQ ID NO: 37350 - protein, 129 aa, A.fumigatus
FIHDPLINWRLNIRESPERPPFSTERRQSITSVMNLEHGVQPSNFSRHRRPSILDGGILDVQEGIPPEAREAQNARAVQVLARVKEKLTGRDFKPTEELNVSDQVDKLLAQATSVENICQHWIGWCSFW

SEQ ID NO: 37351 - protein, 83 aa, A.fumigatus
MASNRHHYSFESLKLCELIVLLRFISTDCSMSGTCMSIHSQAEVASGQLHLRSGAILGNSFRFVLHPYISSVSSLCSRFYSKR

SEQ ID NO: 37352 - protein, 344 aa, A.fumigatus
LYRETEEIGDLNQAWDLYYTVFRKISRQLPQLSTLDLKYVSPRLKDCHDLALAVPGTYQSGRPIIRIISFDPILHVLQTKKRPRRMTLKGSNGSSYMYALKGHEDIRQDERVMQLFGLVNTLLDNDGETFKRHLSVQRFPAIPLSQNSGLIGWVCNSDTLHALIKEYRESRRILLNIEHRIMLQMAPDYDNLTLMQKVEVFGYAMDNTTGKDLYRVLWLKSKSSEAWLERKTNYTRSLGVMSMVGYILGLGDRHPSNLLLERATGRVVHIDFGDCFEVAMHREKYPERVPFRLTRMLTFAMEVSNIEGSYRITCEAVMRVIRDNKDSLMAVLEAVRFVHFSLSI

SEQ ID NO: 37353 - protein, 96 aa, A.fumigatus
TMTPADADAHPLVRNALRITLSAKEYKLLHEYIIQRTPPSIKDKAPSPSRYEAIVRSKNKHNEAALRASLRVILVSGGLLKLVEAIVRRIQGDMSK

SEQ ID NO: 37354 - protein, 635 aa, A.fumigatus
LNPGRTVLLITRHGIADYDPIDHLNAIFSHPSTLSSVSEVSQALREYEDELDHDIATLVEEQVTSNAESVERIQAAKADLTELFKKIDEVRDRASKTEQAITEMTADIKQLDNAKKNLTQSMTALKRLQMLTTAYDQLRALSKTRQYRDCAQLLQAVIQLMAHFKSYRSIDQIALLSRNVADIQRELLEQVCEDFELAFAKGEVAQNRITLSEGCQVIDALGESARSRLVTWYCNFQLREYRQVFRNNEEAGSLDNISRRYSWFRRILKIYDEEYAAIFPASWRVNEILANVFCEGTRDDFKGILSRSVRNGQTIDVNLLLSCLQETLDFEHSLERRFASPARPSTDTFASTETPVFGQAISEAFEPYLSVWVEAQDKQLAALIPKYRQQPIRPPDEEFDCHIVISSSTELFTFYRHSRQQCAKLSTGGSLADLAKVFAKYLDQYAQQVFLNYISERRTGHTPSNVPSLEDLILVLNTADYCYTTCNQLEEKIKGRLDKNLKQSVDLQSQADSFMGIASAAIRGLVRKVEINLEPSWREMRNTPWSRLDAVSDHSPYVGELLSKTQATFSEILQFLHKQQYARAFADHVVELLSTQFISNISQCKPITETGAEQVCSVFLPRQISLYSLHARGWK

SEQ ID NO: 37355 - protein, 79 aa, A.fumigatus
SLVVSLGPIDRWSLVATAACALRLPPLRANGMSVSTPTSSTGHVPPNGAADLDPLDAGEHTNLIESRSNGLANNSAWNS

SEQ ID NO: 37356 - protein, 143 aa, A.fumigatus
TNWIAIVLCCPDTRDYLINYARSLIYTTAMGFPFLASIRAAYELLVEGQTEPHQTKLQQLVAYFRDRLAELDAGDSAAFQVDHFPTSPIFSVRSRFPRQLAAACQQKGYVVRAIMGATCPCGKEAGEGLPSCLEHEWRKMMGG

SEQ ID NO: 37357 - protein, 275 aa, A.fumigatus
SVRMDSSPPKSLRESLRQALLRREAKSSRRRLTVLPQSSVDFSSNDFLSLSTSPAFRGRFLDLLHRAPPLYPFASGGSRLLDGNSTYAEELEKFIAEFHSAPSGLLFNSGFDANVGVFSCIPQPGDLIVYDELIHASAREGMRLSRAGKRVPFSHSSPDSLDEVLQSHIAADPLIQRGSRSVFIAIESIYSMDGDIAPIQDFLRVVDRLLPQGNGYFIVDEAHATGVFGPRGAGVVQSLGVEKRMFIRVHTFGKALASHGGKPESIPIYMFELTG

SEQ ID NO: 37358 - protein, 130 aa, A.fumigatus
IPRDDDILGSVHKTLSEWARTGVTFALVETAGGVHSPGPNGSSQADLYRPLRLPVVLVADSRLGGISSSISAYESLLLRGYDVNSVLLFRDDYYKNHEYLGNYFRNKSIPLVPLPQPPKRPPSQDAASLA

SEQ ID NO: 37359 - protein, 284 aa, A.fumigatus
TMPLRISRTCLAQAAINSPVPFLYQTRTLAAPLSYAKWSARDGRSFQSTSTTFTTPESSLHRGEESAHDGESSENATPPLESDSPSPAPSNDGRRSRRSYLKKRGAAVSQSRTPPSSQPPRRPLTMTESEKRAFGGLLEQMGVKEKEDLEAATEATDKPALSKDEMHKISNIFNSVLEDLRKKKEGSEVSTEGAGKRKSRRQVDEPASTSKPGPQEQAVDSNPPESRSDVPRSAELAIQFTVQRESAKIERALRAAIDEGKGDTGIWEVCKFSQQPGRTPIALA

SEQ ID NO: 37360 - protein, 343 aa, A.fumigatus
KVRCLVSLSCFFYFCSSPLILADHPRPRAQRTLTLIAKALQGLANMTTFGNKEPWMEPMNKFLLGNRVEFKQFVDSICAIPADRPTPIVTPSYATPIQILNRLPPTSREGFPSLPFLIDHARSFANLIRIWLEAAPGKLAELEDIDPAVKKFHEMALRLHQRTKECLSKAEQAERPNGTLEVKWEELVDSMERSATFFEDSSKPTTPATETVIATPASVPGSHRNSIGYFASRPSLPRRSTDYGPDAEEETPPSSSSATWDQSRVPFSMPRWSDTRDSTGSSKNSSTYSLEYSEPSKARRSSMTKETSSKYRFFDFVPASSRRKAKDRESTQQHSREELRNEF

SEQ ID NO: 37361 - protein, 233 aa, A.fumigatus
RDISGRVSSVRSAGSACDTDLSPLHYSFNCQGARKTVTIMGADNELSEFEKQRLANIAERDALLKKLSLDAQSSGLFPPKSARSSPGGQTKPKKKPPPKKVKKEDEHPVPRRMSSRLRGLAADSEVAKRKADEQYEAAQQAERAKRVRKSDAFSFSEMLVSGQKLSGDSLIGVDVVTKGVAMPYQRTFGDEDIKKTTDKELKALREEMSGLRLWEAWEPNRALAFRMNCDSGD

SEQ ID NO: 37362 - protein, 280 aa, A.fumigatus
HDRITGIKLTPERIYTMTFHPSEAKPLIFAGDKMGNLGVLDASQEKPTSAVKQEDDEEDAEDDDPDPVLTTLKPHTRTISSLHIHPSKPTHLYSASYDSSIRELDLEKTTSVEKYAPESTSDDIPISGIDMAPDDPNTLYWTTLDGAFGRYDTRASRRSAVATWQLSEKKIGGFSLFPTHPHFFATASLDRTMRLWDIRKLSHDDPVPVGEHVSRLSVSHAAFNSAGQIATSSYDDTLKIYDFGSKGIAAWEPGYTLSDAEMKPDTIVRHNCQTGRWVTM

SEQ ID NO: 37363 - protein, 741 aa, A.fumigatus
LKIGAGIDSFFEYAFKSYVLLSSGQHPSHDPRSPWQVLDGHFPPLSEYEHSAEAFLRVWEESHAAIKRHLYRGEGYQHPHVIQGDIFTGATRAFWIDSLSAFYPGLLSIAGELDEAIAIHLLTTAVWTRFSGLPERWNVATGNIEGELAWYGGRPEFIESTYYIYRATKDPWYLHVGEMVLRDLKRRCWTKCGWAGLQDVRNGELNDRMESFFLGETAKYLFLLYHPDHPLNDMDQPFVFSTEGHPLIIPTSTISSTHQHRKQVQHGELVNLPVCQLAPEPPTFGPSSTAARPDVFHAATLARLHLMPSRGPTEGPIFEYAHDHPSVTVSDLSSPTNYTYYPWTLPPELVPFNATSSPMTSRPTLDISFPAIPGMVIGPGSIERVRDGIFIKNIGGLRLSMVQDVPSVDATGKASQDDFRVQVINNVPLGKDEKVYLSREITFDILDPTDPNFTRMSDSAMIDIVIDVTPELLRRGNDSIASRERGAAAAEHSENHVIQENASVDDKIGSVDPSTSGMKNVFSSLMDTVSALLRDEDPGLTTQSPSRKSSILRLSLPAAVSSGAGSAPLPEVEDASIVSISGQPLRSRLSWSTIYFADEICDHRILREIAQSHQVLVIKRGGCSFSQKLRNIAAYPPSRHALKLVIVVDYDEKTFAEASTSTPPHSAGLAAIRAEPFLIRPLLDEPQMTAGGLPRRHPISMVMVGGGEETYGLLRRATGVGIKRRYSIRSQGIPINNLYIV

SEQ ID NO: 37364 - protein, 415 aa, A.fumigatus
  UNSURE (12): Identity of amino acid sequences at the above locations are unknown.
LVALVCAIAVLXEPYPGTVMRSGAQSTPSLHQDDESGADDKLSLQFWNIALKRLGYAMRENSVEAVQSLVLAGNWYMHRMEPLEAWKHFNLAGAAWNTLRLTRFPLWDLKHNRDSTSNELTILQALYFTIWKSECKLRLELPVPGPSLTNTTDFPLAFPQPPRLGSEPSTPDASESERSWYYYLTEIAARHLLNRLVQMNSECADTLTERQVSLLIGHAEILQAQIFDWYTSLPSMFHFTIPDGYDADFQSDPMIFVLQHRYFTLRELVARPFVRLVVDGLLDGMDPLLRARARSFASESIQFCMLKLSQTVAYRHQGNWYMLRSITTASLILASVYLAQCRLREREAAGATPTSESLMPPEAWISRVKDAVELAQPFFDEPSGGASNMKQIILAALEAAQQRSAWCGWRNYGKE

SEQ ID NO: 37365 - protein, 718 aa, A.fumigatus
VLTKMNSSCADILLFATNKWNVTRPSILFDTKDVYEPTTTNKFWLDVQLRYGDYDSHDIERYVRAKYLDYTTDSMSIYPSATGLMIGIDLAYNLYSAYGQYFPGLKTLIQQAMAKIMKANPALYVLRERIRKGLQLYASESNQEFLNSQNYSELFSPQIQLFIDDTNVYRVTIHKTFEGNLTTKPINGAIFIFNPRTGQLFLKIIHTSVWAGQKRLGQLAKWKTAEEVAALIRSLPVEEQPKQLIVTRKGLLDPLEVHLLDFPNISIRASELQLPFQAAMKVEKLADMILRATEPQMVLFNLYDEWLKSISPYTAFSRLILILRALHVNIDKAKIILRPDKTVITQEHHIWPTLSDEDWIKVEVQLRDLILNDYGKKNNVNVQSLTSSEVRDIILGMEISAPSLQRQQAAEIEKQQEEAKQLTAVTTKTQNVRGEEIIVTTTSQYEQQSFASKTEWRTRAIATSNLRTRANNIYISSDDVSEEGYTYIMPKNILRRFITIADLRVQVAGYLYGSSPPDNDQVKEIRTIVMIPQVGNTRDVQLPQQLPQHEYLNGLEPLGIIHTISGNEPHYMTAMDVTQHARVMNAHPSWDKKTVTMTVSFTPGSVSLAAWGLTPQGYKWGAENKDTTSDQPQGFSTSMGQKCQLLLSDKIRGYFLVPEDNVWNYSFMGSSFSSVEKRPVYVKIDTPLRFYDDQHRPLHFQNFAELEDIWVDRSDNFA

SEQ ID NO: 37366 - protein, 70 aa, A.fumigatus
AAREWLPLQSTAINLSGNPRYASKHTRGLQRTSGSTLIDSTWGITNFWFNIKSHPLGLGWPSQCEDLSFK

SEQ ID NO: 37367 - protein, 68 aa, A.fumigatus
LTHTHNSESHEKYSPAYSGLKIAKSPPTGGDTLFISTYGLYYRHSEPFQKFAEPLTGEYSAFDLKHGA

SEQ ID NO: 37368 - protein, 118 aa, A.fumigatus
YRGCSGEFRPAIDFAVSSVGNYSYPTQLVPQPFISPISMRDSMNDCNALCRYRGNHRRGSRPEICRCHCTCNESLSAIIYGILSHKLYLYPWLKRRSTTVSCVRLTPQDRSSSVMSCG

SEQ ID NO: 37369 - protein, 160 aa, A.fumigatus
TRQTAPFEAFWKIGKCKSPQSCRLQTMCVYYTGASCLVQGFLGNADRFFKNAVMNQLAYDVLQAVHPEVSVFLRADGSQVIPTAWLIERCGWKGRRIGRVGVYDQHALVIVYYGSVNGFDVLEFASRIREGVMGRFGIWLEFEVRIVTEVPVIKKSVSSD

SEQ ID NO: 37370 - protein, 75 aa, A.fumigatus
PGVKIQLVGQNAVNYGAERLVASTVAATDLRAGASPVIATIPAEGVTIVHGIAHGDRGYERLRDKLSRIGVVSNT

SEQ ID NO: 37371 - protein, 182 aa, A.fumigatus
AYGFLDHRNFCDDPYFKLKPYAESAHHTLPYSTGKLQDIKAIHAAVVHYDESMLVIHSHAANSPALPAASLDQPSCWDHLGAVCSQKYRDLWVNSLQNVVRKLVHNCVLEETVRISEKTLDQATCSCVVDTHRLQPTGLWGLALPNFPECFEWSRLSCSSRWLPGLVSSNVTLAMNTSVEFA

SEQ ID NO: 37372 - protein, 164 aa, A.fumigatus
RCTCCIDGENPMLDAIQALQNEGTRGEVAQSYREQGNEAAREKRWIDAKEFYTKALAVVTTKIDKWDKPENPEEDEKLLRQVEEASYINRALCNLELSMPLCYGHTWHKLLIRFRKLPFYHPRLCLCPQAQSKQYQSLLPFRYGALFPRQASGGRGCRLAGSRP

SEQ ID NO: 37373 - protein, 241 aa, A.fumigatus
LGSENYRSTTLDCASVLKLNPNNIKAYYRSAMALYSLDKLPEAEDAASRGLALDPKNKSLQQVAAKIADRKATLERIAARKKAEEERIQKEKQLLSTALRARQIRTRKTTQPPEMEDAHIRLTPDPLSPESTLEFPAVLLYHMDAQSDFIKTFSEATSIQDHLEYIFPLPWDTKQEYTINSVDCFMETVTGGLIKAGKKLPLLQILSGGKVEVVDELVRIYVIPTSKSAKFIAEMKARKEG

SEQ ID NO: 37374 - protein, 98 aa, A.fumigatus
MSIALRSCSRPPSGPSRPRRIWSHLGPPTAAKSTASDSRAAFFTSSVTDFPCASMLQPPMSSCRRLNFRCSFSKTFSTLTASVMTSGPIPSPGRTRML

SEQ ID NO: 37375 - protein, 125 aa, A.fumigatus
DFFFGTGHQTFVYTTDSTMGQIEELPDDFDERLSLNEQPPATEVPPAKIYNDGPSPAVEETPFPINEERLKELENDPNAPKLPPTMASVKSHTSEELLSMMNKTPLFMTDINQAGDESEPIFPSL

SEQ ID NO: 37376 - protein, 204 aa, A.fumigatus
PIPPGSDRGRRFRRGEGELRGSVFREEDRRRRLWYVVFNKQYAFETDCVISAMDEWGYSEREIQRITRLSAEIALRHNPPWPVISLDKANVLASSRLWRRVVEKTMTTEYPQVKLVHQLADSASLILATNPRALNGVILADNTFGDMISDQAGSIVGTLGVLPSASLDGLPSETRKRTNGLYEPTHGSAPTYVSSFVTRIIMFH

SEQ ID NO: 37377 - protein, 79 aa, A.fumigatus
SKLTIICRIAGQNIANPVAMILCVALMFRYSLDMETEAQRIEKAVQGVLDAGIRTPDLGGKSGTNEVGDAIVAALQGSS

SEQ ID NO: 37378 - protein, 312 aa, A.fumigatus
NNVVQLSRIYSNELHRTNPAVSSTPQHRLETDRRYRSYDYAYIVLCQQDIVFPWSHQALNQVCGIALDTDHLLHLSHIIQSKRMVTTYNILVLPGDGIGPEVMTEAVKVLKVFENEHRKFNLRQELIGGCSIDAHGKSVTEEVKKAALESDAVLFAAVGGPKWDHIRRGLDGPEGGLLQLRKAMDIYANLRPCSASSPSASIAKEFSPFRQEVIEGVDFVVVRENCGGAYFGKKIEEEDYGTSFLTSSMLSRLTVLFQRWTNGAIASARSSASPASRRKLPSVTTPPGPSSPWTKPMCSPRRGSGGASLKRP

SEQ ID NO: 37379 - protein, 281 aa, A.fumigatus
KYLSLVICYTSLFSVAVNLVALGYLYPRDIARSTPSDFTIHLQGSCLSFLSRDSGDPSHATQVTEERRAGTSSNALRSTTNAIISSCRSTSLTRATSRASRHADRRTPATTTTQLALSEHFNAPIRPHVWYSKRRTWSRAQLDQERKEFFETRVTGRPEVWAALAAAISFMHVNDLATAQSIIDAAGVTVPTGDLCQGCYDEQGALYRLPRCIVSDPENMVQEDSASRCDDGYDDFDTDDSKLSLDEASGDELIAGDSGDRRDEKGKISEPESSPWVEIRV

SEQ ID NO: 37380 - protein, 347 aa, A.fumigatus
  UNSURE (340),(342): Identity of amino acid sequences at the above locations are unknown.
IWPDFSRYFNTVGSKEGWTPAAFVSSRQNRAKDSQQKFQQRPEDFMDEEDIREAEEAKKLQTSDDFAGFGFAATGATRRGGLMDLLMAGGETMGVKLLKKMGWREGQGIGPKVRRKANLGDGPGPGENEADKTYLFAPEDSPMIAIVHKADHKGLGFEGESRLDSHKPGADESDEDDFFGRRLTSGSRRKPSKTKEQPRRGAFGVGVLNDTGSDDDDPYSIGPQISYNRVIGGDKKKKKKKPTDESKPALVAANPLVNTKPVFISKKTLTAKSSTGFRKCHDGRLPLDGFLLADGISSLSISTQEKRYAPPEVPKDWISSKIPLSLQEMSSNYVFTARGXQXFFFST

SEQ ID NO: 37381 - protein, 64 aa, A.fumigatus
YRTSVSGYTNSRSQLRVTAARPGTVNFELDIQKEHTVSLRPVTDSLSHFNNIIRIDSASFMEGQ

SEQ ID NO: 37382 - protein, 105 aa, A.fumigatus
CQAVGFNEILHGYSRLLMQWVILGLIARSKHNFVLVQQLVFPVRQCIVYYEVLITHGPNLGLSHFKHILPEMFDSLHRCTLNLVVQRSCGWEHFARGQHEFVRAL

SEQ ID NO: 37383 - protein, 540 aa, A.fumigatus
RLIEYVENTSKAPSETSLKKRRRDPVEKEGTSARVIRVSTYKQPNPGPYPVDAPKLNTIRFTPAQVEAIASGTQPGLTVIVGPPGTGKTDVATQIINNIYHDFPKERTLLIAHSNQALNQLFQKIVALDIDERHLLRLGHGEEELETETSYSKYGRVESFLENRNYFLAEVTRLAASIGAEGAHGNSCETAGYFNTVYIQPAWAKFFDHARAESTTTEDIIASFPFHAYFSTAPQPVFDPARFERDIAGMWRQGCQRHIDKIFSELEDIRPFEILRQSRDKANYLLVKEARIIAMTSTHAAMRRQEIADLGFHYDNVVMEEAAQITEIESFIPSALQHMKNGELPLKRVVLCGDHLQNSPIIQNLAFRQYAHFEQSLFLRLVRLGVPVINLDQQGRARPSLAELFRWRYHQLGDLPIVHTAQEYKHANAGFQYDYQFINVPDYQGSGEREPTPHFIQNLGEAEYAVAIYQYMRLLGYPASKISILATYAGQTALIKDVLAHRCAKNALFGMPKIVTTVDKYQGEQNDCKLNCLELRIMLT

SEQ ID NO: 37384 - protein, 151 aa, A.fumigatus
PRLCADVILSLTRTRTVGYLRDVRRLTVALSRSRLGLYILGRREVFESCYELKPAFDLLLQRPDKLMLTTGEMFPTTRSLDDEVQGTPMEGVEHLGQYVFEMTQAKVRAMGDQDLIVDDALPDGENELLDEDEVMLGAGDEPEDDPLHEQT

SEQ ID NO: 37385 - protein, 278 aa, A.fumigatus
KILTEAKVFLSGNGRNSLNNKRKNRLAGPLKLWKPRVRMSYLIPTSLQQHGRVFLALVTWGSGRTFPLRKLMCLTRKFATMFLYRQLRILFAAAAVSLNDNELFTDWEFSFMLKEKLTKEGHLHLAAHQAAVEICLMHALKKPLTKICDVVEHEKPVFKLIWKCKIVPNAESQWGQSLVYPDDESKDVLVHIFEQIGGGADTTATPAEEEVQEDVETEEQGAVEDSISQAPTPPFFGYRSVRDKGFLSLSLNDPETKFAVSCLASLIDILWEILLMLS

SEQ ID NO: 37386 - protein, 91 aa, A.fumigatus
FLKRLSQLSGHYFPDPVMHSISTVKQAVEYLEGVVNPKPTKLADQLVNNPELQHLPNVKLFTKRQTALHKDEELGRKKIIESELRARGLIE

SEQ ID NO: 37387 - protein, 249 aa, A.fumigatus
FLPSGVLGPRGEDRYGISRADQDAFAAESHKKASAAQNAGLFDTEIVPVKTLSFDPENPDAAPKEITVTKDDGIRHNISVEKMATLKPAFKADGTSTAGNSSQVSDGAAAALLMRRSTATELGLTASIQARWVATAVAGCAPDEMGVGPAVAIPKLLELVGMDVSDVGIWEINEAFASQALYSVRKLGIDETKVNPKGGAIAIGHPLGATGARQLATLLPELKRTGQDVGVVSMCIGTGMGMAGMFVRE

SEQ ID NO: 37388 - protein, 266 aa, A.fumigatus
WRNSPAPVAKFYKDTTTFSCISNPAIQIPFSAVNDDYCDCPDGSDEPGTSACSYLSRNYPLTSADRPGNSDLELTLALPGFYCKNKGHKPSFVSFQRVNDGICDYEFCCDGSDEWAHVGGTKCEDKCKEIGKQWRKQEEKRAKSMTAALKKKKELLVDSGRQQKEVEDHIRRFEVEIQALEMKVKDMEADYEEVKKREESKMVRGKKAGKVNILASLAKGRVEELRNALVEVRKEKDEARSPLNKSRRHLVQVQNPIQPQFQRRRC

SEQ ID NO: 37389 - protein, 167 aa, A.fumigatus
LVRDTQCNEPYAEDNVIPILPPKESEKQRLMARAQKLAEQGLTHSLKKAPGSKKRKKHANGDSAEIETTAEAESKSALASYSQKERPAASSRSNTSTPTPSASNGIKNASTALLTARVLEEENEKKRRRKMMGANENISSLFTKSSGDAKSTNSDFMTRGYTMPSKK

SEQ ID NO: 37390 - protein, 171 aa, A.fumigatus
DCPTKVLHSIPTRRELVREAAKAPSTAQVKEAQREMQEHFWTTCPLSHKPLARPIVSDCVGNLYNKDAILEFLLPGDDAQGISSKADCEEILCGRVKGLRDVVELKFEVDTERGEHASNKHNKREAWICPVTAKPLGPSVKSVYLVPCGHVFSEEAIRQLRDDKCLQVCLL

SEQ ID NO: 37391 - protein, 781 aa, A.fumigatus
  UNSURE (552): Identity of amino acid sequences at the above locations are unknown.
NNLGPSRLFISAGGADNVTISGPPSKLRQVFRVSEKLRSARYAQLPVYGGLCHAPHLYNCHHWTWIMEPINGAAFNQNMVDTAPLFSAGDDVPFEASTPRQLFESVVCDLLMGMIRWNRAVDGVVELLGQTLPSECHVYAFRPCAVVTGMVASGQVKLPHCQFQTHDLLGWTCHDDTDNGPTCREDSSIAIVGMACRFPGGANDLNQFWDLLEQGADVHRRVPADRYDVESHTDTSGKSRNTSLTPFGCFIDQPGLFDAGFFDMSPREAMQTDPMHRLALMTAYEALEQAGFVPNRTESTHLKRIGTFYGQSCDDYREANAGQEVDTYYIPGGCRAFAPGRINYFFKFSGPSFDCDTACSSSLATIQMACTSLQHGDTNMAVAGGLNILTNSDGFAGLSRGHFLSKTGGCKTFDCNADGYCRADGIGSIVLKRLDDAQRDNDHIFGIILAAATNHSARAISITHPHAPSQAELYRDILTRAGVSPLDVDFIEMHGTGTQAGDSTEMESITSVFSPGVPKRSRPLYIGSVKANVGHGEAAAGVMSLIKVLLVXQRQAIPKHVGIKTALNPRFPNLDRLNVRIPHDQVPWPRSPTRKRYALVNNFSAAGGNTSLLIEEPPVRPEPKADPRAAFTVAVSAKSKASLKNNLRSFLAYLESQPSISLAHLSYTTTARRMHHNHRIAVHGSTLSSIMQELEPYLPAVDTHRPVPNTPPSIAFVFSGQGNFYTGIARQLYEHHPGFRLQITRLHNICLSHGFPSFRRAITGDLSNDGSEAEPIITHLT

SEQ ID NO: 37392 - protein, 299 aa, A.fumigatus
TSIGQQGSNNANPGSATNAAGSASAVNAAIAAITSNPSSNTTATSSSSNNRWTSNVQEILSMNLELWRNSLPDVMKWKDTDPPSNDINVARMRAKYYGARYIIHRPLLYHALHFAGLPNPNPTAASVESPAGSILSGSKSQQVSPSMSHSQRASNMARLSSDMGMAAHSAPPSFQGGSMGTIAYRDLPPKLRRACKVCIDSAILSTEAFDGIEGRPIVTNIFGTAHAQFGNMLVLSATYMSSLSELVDRNVLEKLLKRTIKFLLQSRYISPSLRADARILTEIYEKIFGEPATSFSSYV

SEQ ID NO: 37393 - protein, 81 aa, A.fumigatus
DDFRLELYSILYFMASLYSLYIDVPIDTIYYNTNLYIKVSAHALHYISLLGDLNPTLTQKKSPVIIEMYDQADQESLLYSD

SEQ ID NO: 37394 - protein, 72 aa, A.fumigatus
FLQHDWLCAFIFESNRKSNLNSSGLLVYLSNSVLLALIRCSFSSTDLETIMPSKTIIVTGASRGTSIYQASP

SEQ ID NO: 37395 - protein, 134 aa, A.fumigatus
IHLANSHSTTLSGIGLAIAKYLLTAPQSHNVVVIARSVEPLQKLKEQYNKQVEVLNGDLADFSLGQKAVDLAIKSFGRLDGLVLNHGILGQVGKIDKADPEQWKLGFDVNFISFVAFVRHDRYWMLVLECKGTN

SEQ ID NO: 37396 - protein, 124 aa, A.fumigatus
IKAGLPALREAKGKIIFTSSGAAVSAYRGWALYGATKAAMNHLALSLGEEEPDVTTISIRPGMVDTEMQRELREDHAANLEPQMHSKFTTAHKDGKLLKPEQPGHVMAKLVLDAPASLSGKFLS

SEQ ID NO: 37397 - protein, 109 aa, A.fumigatus
LTLFPTATVQKIITEILPPSSGQTFSKDARDLLMECCVEFITLISSEANDISEKEAKKTIACEHVERALRDLGFGDYIPEVLAVAEEHKEQLKVCILQYLSKKATFAKE

SEQ ID NO: 37398 - protein, 70 aa, A.fumigatus
VWCTSSLCFLFNLYDEYPTFHAKYEGALHLMLLKCIAFHLSTDYDYKLLPFISICSLVQTCTDGHMYRPR

SEQ ID NO: 37399 - protein, 194 aa, A.fumigatus
RKSCYTDIAQTENTNDHNLTDEARSKAPSGPVMGPLHDEAPSSNKLPTELQLSPASAARTLVHDLTLPPVANLDIPPSPPGSPEPMANAKFTHFLSLKKQGTHFNEKLANSSSLRNPSLLPKLMDHAGIDERAQYNTSLPSELWNPSGLPSWGYKEELLKSQKESNNKFEERVRTGQRESIDFVPSVTMDSNTT

SEQ ID NO: 37400 - protein, 225 aa, A.fumigatus
ERDDEILIDAQASGQGEAPSPIPTESAQHSDMRIDEESRPVFTPIADAGTVLRVETRKVPVPPHRMTPLKANWPKIYPPLVEHLKLQVRMNIKNRAVELRTSKFTTDTGALQKGEDFVKAFTLGFDVDDAIALLRLDDLYIRSFEIRDVKASLNGEHLSRAIGRIAGKDGKTKFAIENASRTRVVLQGTKVTILGRFRDLGIAQEAIVSLILGSPPVSCCVALPV

SEQ ID NO: 37401 - protein, 268 aa, A.fumigatus
GYRIFLCSAKQRRSQRTLILPVCNRSLIHNKEPSLTSGLSYTDNGGSTLGITGSDFAILAGDTRSVAGYNINSRYVPKVFKIGGDAETGEGAHILLSVVGFAADGQALKERLDAVVRMYKYQHGKPMSVRACAQRLSTILYQKRFFPYYVHAILAGLDEEGKGALYSYDPVGSYEREQCRAAGSAASLIMPFLDNQVNFKNQYIPGSGEGHALEPKKAEPLPRATVEQLVRDAFTSAVERHIEVGDGLQMMVITQRGIEEIYTPLKKD

SEQ ID NO: 37402 - protein, 289 aa, A.fumigatus
GKCSECDGIMSFNFGRRLYTSIWDTAHPLLVRELRNSRMTFFFESPSTGNWFRRFLFNTHARKISSLPPRTRHITKRFASGSFFMLGISPSPCAVEAGTSCAISPEKFVSQSHLLDRKFVCASLYTWKRGLHTTKDDDGLKSEQSNELLTNDSNTSPSPSRETADSDTRSGTMKSQEEHIEGFTSRHIMNRLPHMSHLHRPTKEELLAAANGFWSRLKVRFKWFSIRSVRPFNFDEITALFSWVLLGHVVWIVLGTTTFFSLLIIAINTVLAQGMFRVIDRRSYSNYMY

SEQ ID NO: 37403 - protein, 135 aa, A.fumigatus
ETLAGWVGNYLTKSSGVKVVFESAIVPKWKDGVITFKNVFVSRRPGQGTGHVSKGSSKTAAAVAAAAALSGSSSPEPFSDQQSIPDEEDTNYTQFDLSIETVNVTLSFTKWINGKGLLRDVDVFQHAARRLIARP

SEQ ID NO: 37404 - protein, 117 aa, A.fumigatus
VTRLARGYVVTNRRLGIPYQRHWEGNCSRTANPARSWEQVKTNAFLGDRAPRAIGRNFVRSTYGSRFLSHKSLIAQPAPLMINAPVKKRPVVPRICMGVADAMGAAMSVEKTHGKKR

SEQ ID NO: 37405 - protein, 94 aa, A.fumigatus
AYLPLRRFKTCNLGKPILHIELRKWAHVLLVAPLSANTLAKMTMGIADNLLLSVIRAWDTTGKVDSGLKDRKPVVFVAPGEMRQYITCSLSNLF

SEQ ID NO: 37406 - protein, 85 aa, A.fumigatus
LSIAMNTAMWNHPATKRQLKILTDEWGVSRTNEEGWVTVLHPIEKSLACGDTGNGAMMDWKDIVNVVEHHLGISSVKIKDIRCGT

SEQ ID NO: 37407 - protein, 434 aa, A.fumigatus
GRNLWKLSPITAYYKMRLQFSYLPPVRLDQLSRRYGSGSSLLNDKRHRLLCNRNSLTTSSRVNSTGRQSAYTAKPRSAITKRTSLMRCQPHSSQSPSSTDRPAAITDNNPATHYIPPQKGFIASLPGSWIPYAELIRLDKPTGTYYLFFPCVFSTLIAAPMASATPMQILGTTGLFFTGALIMRGAGCAINDLWDRNLDPYVERTKFRPIARGALSPKKALVFTCSQLLAGLAVLLQFPSQCLWYGIPSLLLVTTYPLAKRVTYYPQAVLGLTFSWGAIMGFPALGVDLFSNHAALEAAAALYSSCVAWTVLYDMIYAHMDIKDDVAAGIKSIALRHEHNTKTVLSGLAAVQVALLATAGVAAGAGPLFYVGTCGSAAVSLGIMIWKVQLKNVKNCWWWFKNGCLLTGGGITLGMFFEYIAQTTGLYKSDNNLH

SEQ ID NO: 37408 - protein, 69 aa, A.fumigatus
LKPLACIKAIITYIKRIALTNIGQDSRFLSSSAANIFYLNTTDSKMMLYYVNYIFPIHHGTVTSITTSK

SEQ ID NO: 37409 - protein, 68 aa, A.fumigatus
SLERQAPPLTLQSQFLDYLVEGQFNRTPISVYCKTQVSDHEEDVSHEMSATFFPVPILYRSPSSHNGQ

SEQ ID NO: 37410 - protein, 201 aa, A.fumigatus
LILVLGIIPRAAQLLFEKLDGPAKHNRNSSTGLRTPARYSISSTSSFGRATAEKNWQLKASYVEVRHLRTDSEACSRNCLLTCLQIYNEQLRDLLLPESTPMSDRGSVAIREDAKGRIILTGLHQVNINSFEDLMNALSFGSSIRQTDSTAINAKSSRSHAVFSLNLVQRKSSSSITFAKRETDVHAGRGAFRLRCVRHGR

SEQ ID NO: 37411 - protein, 163 aa, A.fumigatus
SWRRKSGLRRGWQNSGQSRYVSRAIWLRTCEGQGRVMRLNQQADVITAVRVRPPLKPTDPGYELIPQRFQRSMVHVTSPTSLAVDVPQGRKLFVFDRVFPETTDQNGIWEYLSDSVSSFLQGYNVSILAYGQSGAGKSYTMGTSGPSEQHDTQSMGSSGSRHI

SEQ ID NO: 37412 - protein, 924 aa, A.fumigatus
  UNSURE (245): Identity of amino acid sequences at the above locations are unknown.
ASAPRFVRLIPPRSTQSPPDPTQSSVSILCNGNPQAQLHSPKEKRMSMPVEGPSGSDASVTVDSKLHFVDLAGSERLKNTGASGERAREGISINAGLAALGKVISQLSSRQSGAHVSYRDSKLTRLLQDSLGGNAYTYMVACVTPAEFHLSETLNTVQYAQRARAIQSKPQIQHIADESDKHAVIERLKAEVAFLRQQIRIAEDNDRRAAGPQERAERQNEREKELQNQLLDVQESYNALSQRHXKLISELARDSEHSTNGEADDVASAVGKSSVERLKRSHSFAQSVEQVVLEYEKTIQSLESSLSNTRSSLAVTESTLLERETKCAYVETVNAQLQARIQKLLDREASTESYMHELESRLDDQSSGEEKYTAIIAELRKELSRARESEAGCEEYISTLEERLAEADQDMELMQREVERLEHVIERQRSLGKLDSLLYELDHVHQNGASHDDLQEEMDSPAAARSTRNSRQRATTLEVLTEAAETAIPESDEDLAETVPDIEEESIVEAVTTAHVDGSDLEVLEMVTSRLETDPNAEPRAQSPSLTESKIVADKLETVSQELLDLRLQHETTVNQYELLEAKYEEALRALAKLQQDAADEVRHPASAVQGLISPVTASRPVSFLEDAKAPDSKSGKQHSFSQSLSSELSLVGEPAASQEPSTNGHHEPAAEIPVDSQASHNEKNSLEIERMRQLLSEHQEGVQLMTQKYAELQAEHEGALALVETLKSELQKSKSASPPTTPGFKTNVIRRKSSQSLMSTVDRAHRSLAALKNIAIEKFEGQPDTMQNFEVHLDAAMHELHSRMERIQSLEAENQSVKKEMEMKATIISGLTRERSSLQGGTPSVDMGLVSQLRDQVVQQENLINELREAHESREKKLLAEIAELKGLLKTQEAAAKAQDAHAEEQDKQSLHHGGAGPRYVRP

SEQ ID NO: 37413 - protein, 1082 aa, A.fumigatus
SHPITMSSTNLRLLQLNIMKSRAGMEALINDHQTQNLDVLLIQEPPVTAYRTHVNHSAWRLYRPTYADESARFRSLLYINRRISTSSHRQILCNHPDVTAVKIWTPEVQYLLFSIYIQPVAIYQPAEVTTAELILEEIQSSIRQHSTGTDKVTKLIISGDFNRHHPAWSHRPVHHTFAEHAEELINFFQIHELQWCLPQGTPTFWSLSNPGKASTLDLTLTNDPTKLIKCHLYHDHYGSDHRGTFSEWNLQPERNIDSKPKRAYDKANWARIGQKILEVMGPLPGIHSNSDLDTATEKLVQSTAAVINQEVPTQKPSPYSKRWFTPELKTQQIEVNRARRRWQDSCATLGIAHLTTAALFQDMRQKRREWTRTVEKAKATHWKQFLDEAKEGQLWKAATYMRPRESYASIPSLKVGAGEISDNKDKAKAFCEAFFPKKAEPEEEDIAPAPVEIPWEPITKEEIHRSLKAAKGTTAPGEDEIPTLVWKHLWKYLQSAITHIFRKSVELGYYPKRWKQARIVVLRKPGKPDYTVPGAYRPISLLNTLGKILEAVMARRLSFWAETYKLLPETQFGGRPGRNTEQALLVLANAVDRAWSRSKVVTLVAFDLKGAFNGVNKTSLDTRLQAKCIPTTARVWIRSFMEERHASINFDDYQTDITLLENAGLAQGSPLSPILFGFFNSDLVDQPVDNSGGASAFIDDYFRWRVGASAEENLKTIQEEDIPRIEAWARRTGSSFAAEKTELIHLTRSKKEQVTGQIIMNGKVIKPSASAKLLGVIFDKELRWKEHVQQAIKRATKVNIALGGLRHLRPEQMRQLYQTCVTPVVDYASTVWHNPLRDKTHLRLLGTVQRTALLRVLSAFRTVSTLALEVESNMLPTRLRLKQRGQIVAASLSTLPESHPVHGVIKRARTRSTHIGTGSRFPLAETMRTMDLARLQALEKIDPTPLAPWRTPAFTEIDIEPDREKAKENASARQKAAGVTVFSDASGQQNQLGAAAVALDQDGNITHSRQISVGSMEYWSVYAAELMAIYYAISLVYHISQKTQEALGTGREPATILTDSMSVRIVGLHHRELDGSAPRVYT

SEQ ID NO: 37414 - protein, 134 aa, A.fumigatus
KVIEENDLGSKGFQIEDIAWLKKKDHPLRTSASLGIWLNTPEAAEYFIANGLLVGQRYIGSVEPYRIDWKRCHRCQQFGHLAWACKEQARCGYCADQHEYRNCPREMRPRCLDCDGEHPTGDRRCQSLNPTPSQ

SEQ ID NO: 37415 - protein, 149 aa, A.fumigatus
VSGNTFTPVPYKCIVEVRSGFLSTLTLNEPHPSNMQPVKHSVMDVPLEGEYVSFEHSLMALPTELHLQISSYLSYPDALALKHTCRHFYYLVYTGVHLKVDWLVERFERKLECPMEKCSFRTDESFCNSRIRGIMERRRRHLECPRRRG

SEQ ID NO: 37416 - protein, 734 aa, A.fumigatus
PVVLTVNCLSTDGNPKMTLCQCLIAPSHLIFTDLPSEEHYRRSSDCSFFVFAQPPGKKSKSSRSKKSRVSKASSRLSTQSTVSEAPMTALDNQMDEDDIPQPPAKTKASKKASKSKSKTLKSKKDDTLEPDNQMEVDTMEYVQPEPAKPKRTRGKKRSSEEMDPEESNIAIAENIHQSEPPTKKRATKSRSSAIQREESTRGDVAIAEVHEEDEEALLEAEAKKGRATTKKTSSKSRKVSEGSLAEKAALEARLPRDSELDAAIVAELEAEEPMAEESPAETHKSSKKSKSKKKTKKAAEEPPKVQHDTVERNEEQELRRVDDDEFIYRRTSDIQLPAEQPKPAKSATKQKTSKEERLSEKKTPESPRSRPATMVDSPEVEAEADRRHQRSLVSVEVTARDPEQDFEPERRDSGSQMKKATKKSSTSKAKKTSHTRATSPESGNPASERPDTRHSLKQEAPLQPEQKTIPRHIQDQVQEQELEPESEPELEQDPQDDIEQDREVDPEPEPEPEPHLGVDETPVRRRSSKVPPKTAERFSDIPQEKQFAKSIAETRTPNSHKVPQASINSSRQESDAVSPLPSTSKSSPSSSPQSSDAENQPPTIQLSAPRTQLASPSKEKAVRIPLATSTPSPSKRNANSGALRSLHPWTPIDIDEILYASMSDKENVDVGAALESIKGDLTSPEKKMTVEEWVYWHARNGEEKLKRECERLVSQFEKEGARAMRALEGIECID

SEQ ID NO: 37417 - protein, 75 aa, A.fumigatus
  UNSURE (41): Identity of amino acid sequences at the above locations are unknown.
RLVLCDNAESTFPGIFLLLDPVFSILPTLFVPLPSLFLSLXGLLFLPLLQSLAKIQLPGTPFFFLPDSLLMSQKS

SEQ ID NO: 37418 - protein, 182 aa, A.fumigatus
RISSMSMGVQGCKLLSAPEFAFRLDGEGVLVAKGMRTAFSLDGDASCVLGADSCMVGGWFSASEDWGDEDGELFEVEGRGDTASLSCRLEFILACGTLWEFGVRVSAIDLANCFSWGMSLNLSAVFGGTLDDRRRTGVSSTPRCGSGSGSGSGSTSLSCSMSSWGSCSSSGSDSGSSSCSCT

SEQ ID NO: 37419 - protein, 75 aa, A.fumigatus
KYPSCVTSSHLHDLLVPPLQSLSNSPFIISSVSPELHFMRDSPPCSRPRYYNTHPHNLIPPLLFRPYEYLYYFLP

SEQ ID NO: 37420 - protein, 284 aa, A.fumigatus
  UNSURE (248): Identity of amino acid sequences at the above locations are unknown.
YAPHQPLPHRPPLPHLYCHHHYRRLHLPSSQQSPTLRNLTSISVPRTYRIPPEQTRQKSSHQTLLTMSDKGNTAYGPPSSDTAFRKTWDREEYAKKAADEEAKRKEEGKARYEAKLLGKKWHAPVDYSSLEATTSRKQRLDVASMVGKTTIVPAGSAVGKRGRGAGFYCSDCDLTFKDNLQLVEHLNSKQHLIATGQSGEVVRASLEDVRQRLRFLAHQKRVREEEERRAWQLDLGQRLKEREEQEAXEREEKRRKRNEKRRKNGENGIKQEEDSWEGRLGIIA

SEQ ID NO: 37421 - protein, 60 aa, A.fumigatus
RQPSSSPSVPHVYIYDKTGQFNNCSHYQQLKQNLAKMVKDKSTVIEYVRLPPLYQIANPI

SEQ ID NO: 37422 - protein, 187 aa, A.fumigatus
YTMGKSRPHKKKASKSREKSVLRAGGSVSKQKMADPAILLEQAVVLLQTGQADAALAAAQQAFNSAPTNSPAQLSALNTIGEIYVELGDINAARECFLRAVELDPNGTIPESEGGGAEKFLWLAQLSEVGGKDSVQWFEKGVSALRTIIQQLEEKQDPQTAAELAEKKKKMANALCGVAEIYMTDLS

SEQ ID NO: 37423 - protein, 231 aa, A.fumigatus
HFTETYSWWSNLTVSSWEEDAENQCESLITEALLVDPQAPEVLQTLASIRISQLRQDDARAALSRSLELWKDLPPEDPKVPEFATRVSLARLLMEVAMELEALEVLERLILEDDQSVEAWYLGGWCLYLLAEKRQAPKDAEADASPESQRQASLVASREWLKQSLTLYDLVQYEDERLKEHALELVDEMNKELGEDMEDDSNAEDAEGEEGEGDWEDEIEDESDEDHEMAD

SEQ ID NO: 37424 - protein, 216 aa, A.fumigatus
RSDISDTAYRISINLETPENDARGEEETEQPALILQVSYPPEYPDVAPDLEISSPPNAPKHPLLDIQEDRERLLEALQPTIEENLGMAMVFTLVSTLKESAELLMAERANAVQAAKEMEAAKAEEEENRKFQGTAVTPETFLEWRERFRKEMEEKEQREREEKEADEKRAKKAPVKEEKKLTGKQLWERGLAGKADYDEDDEDAIPAAVEKIKITA

SEQ ID NO: 37425 - protein, 95 aa, A.fumigatus
QALAGFLMLMPRCLYSLISFTQVLTAHLDSELGVFLLLLLLLRGLLQDLKDFFHVFIDPSVNIVFFLSVTIPEISEAVLYSRPSCIDGYLGHDIG

SEQ ID NO: 37426 - protein, 70 aa, A.fumigatus
EAGSIPTGRFGVFPLWVDRLANSLYVEPHHVAICSQQPKGSFSIGHDKIVVQMGLVTAYSIGLRPTQTGK

SEQ ID NO: 37427 - protein, 426 aa, A.fumigatus
RPTSPTDDKTDVPCCTSFVPDTPTCLGSAAAPPFNEGHDLQPDTCTGAASPARVGSTHLLHSLHDLAEEHLDNPRHPDVHYPETPDCVGALGPDTVPMDCVINLDELESCPPVSSPPEFNMDVQDPLQHPGVEPKDLEVLLAAVPSDGLGPDVQFQTRQELGVNRDGNSVVPVHATGVRSKDPHVAPNSPNSLGFRPCPEGYLEFSHVEIRNHRPLENTTSSIETLENVTSPSSSCCHSKETSRTWCLDGSILSIDIQNADFPIGLGKSSFHVFENQVIQILTVVHGPVEAFLSQKTAPSTKVNKKKRKFSRPAAAAAAAAPLSSEQKQYLLELRDQGHTWNDIVAKFPGRKIGTLQAIYYAKVKNLRNPTSRDQRYTGRPKSAARSSQGLSRTRGNTIGTGVSTVCQTENEVGYSRYSLRPRGVR

SEQ ID NO: 37428 - protein, 77 aa, A.fumigatus
DLPCYSSANSLLYVSVQSIVIKGTRSADNGLSNPANYHHIRITHIESLLRLAVMTSPKQWGCNQLLKWTLPWGNGNE

SEQ ID NO: 37429 - protein, 104 aa, A.fumigatus
TPFLLFKACCALSSLSCLPCEWSNRDTMEAINANPPPYRTEKVEETKYTSDYEEEGQLKTGQVADAFGNEESAEIKYKTLKWWYVLEILISGLGSLLTIAFLLL

SEQ ID NO: 37430 - protein, 97 aa, A.fumigatus
HARRAVILIVGLGLLATYTGYNIGLFRERYPRIQNLGDAGEILMGPIGREIFGLGQFLFFIFVMGSHILTFRVMMNTVTEHGTCSIVFSVVGMLICM

SEQ ID NO: 37431 - protein, 65 aa, A.fumigatus
AIPKLLYPLLSADLHFVYWSGQLFMATRHSSFLTARRLAAVILSVKLPFSQGRTVEMPSVGLVNS

SEQ ID NO: 37432 - protein, 139 aa, A.fumigatus
PTLAFLSIFSAVMITMIGVAVQFKGGSNISVTAETNLYHAFTGVTNIVFAYCAHVAFFGLIAEMEDPKEFPKALCMLQFFEIALYVTAAIVIYYHVGNDVVSPALGSAGPLLKKVAYGIAIPTVCTNLTSSSAVQTLTV

SEQ ID NO: 37433 - protein, 74 aa, A.fumigatus
IVGAGVVNGHVGLKYIYVRIFRKTNRMHKRDLVSVGSWIAIGLSCWIIAWIIAEGFPSVNYYGKLKWYGIKLGV

SEQ ID NO: 37434 - protein, 193 aa, A.fumigatus
STRTASHTTSGRSPSSSTGSRMACGSSSSPCTPAASSSGPATLTTRDPLHPSATCQCTKSASSLRDSPRSFCAASAKPSKKSYTSRKHPSSAPSSPGASASSKRCATPAAPTSSATTSPPTRQCQCTTTACSSSKRRQTPSQGRLSASKSPRDTSSSPARPPRPRAAGTPSSPAPGSSSATCLCRGPPSGCRR

SEQ ID NO: 37435 - protein, 392 aa, A.fumigatus
QSSYIPPKWLEQYRPGKNVAAAIKANRADYVRLSIHESNGARKLSISLVPQVRGVLGYTPWHSSIAVDADGTLRAVHAEDVRETHELVYKNGQPYYFREKSKLFDWVEDGLRVKFEPLYPCGLIIRPSDIDDSRPPPSISHLPMHKVRQLSTGLSPVVLRGFRETLKEELYVQKASELGTILPWSFGIIQKVRDAGRTDKLGNNVTSNEAMPMHYDGMFKFEEETDSVTGEVKRVQKPPGYQFFTCPATAPKGSGYTLFASSRLFFRYLPLPWTTERLQKVTWGMDNDGFWDAKLKNLPLVVPHPVTGLPCMRWHQPWDSTKTKFSTCAVTIENDEQELASVVDDLTYDYRVCLRFSWEQGDLLVSDNTAMLHTRTGYKTNCERELWRIHFD

SEQ ID NO: 37436 - protein, 61 aa, A.fumigatus
GKGRHVRARCRAHRAQGVTVSQAVLNISRHDYSPGPTYVAVYYGDNAKTYVFCPENSSTSA

SEQ ID NO: 37437 - protein, 61 aa, A.fumigatus
STQLWVWIVGSKGANWDARDSGNSSLSQPMECDEKIEVIAETNGRYIVVISELMSILSARI

SEQ ID NO: 37438 - protein, 413 aa, A.fumigatus
RHFKNLKRRRRSFMMSPGSILKLLMVLISSGSILLSKVWVARWTNNHTGMLSHQIEFSKAMTELYKPISGRASDPSTYTIEGNPEGIRACEEYEAIVRDLQESLAPELELIETRIVSPANQLLEVIKVIRKVAVKRDHKKLDYDRHRNTLKKLQEKKDKSLKDEKALYKAENDVEQATQEYNYYNDLLKDELPKLFALEAEFIRPLFQSFYYMQLNVFYTLHEKMQGMNISYFDLTLDVEEAFEKKRGDVKERAEALTIVHFKTKGLGRQPSKFTPPGKDKMAYESKSTFARTNRADETDNPPPPYSASASTVAAAKAKPAPPPPRPKPARLGAAVETVTALYDYEAQAHGDLSFSAGDVIEIIQRTDNQNEWWTGRVDGREGQFPGQFYSRVLLSILKTNLLFTAANYVQLH

SEQ ID NO: 37439 - protein, 119 aa, A.fumigatus
QAARQSLNFNFTLPTKTANLDNISPPPRSLIPEVITALPPSVLMELIIPSQRSALASQFKAGSTPAWYASLPSDVQSYLSVVKSQISEGALTATTGLAYQTAATASGPSPRGWKEPNLR

SEQ ID NO: 37440 - protein, 126 aa, A.fumigatus
  UNSURE (15): Identity of amino acid sequences at the above locations are unknown.
HHSLEGIQDTFMDFXGDSEFGFGSMDEFINPEMFANAQSEDTPDSVETGVATQTPKDSEVPKIQDASGKFDVSDDSWIPMDWINVPSRFEDALVVNDSWENFDWGTVELNNGAMTVDDNGIAIYAM

SEQ ID NO: 37441 - protein, 367 aa, A.fumigatus
  UNSURE (359): Identity of amino acid sequences at the above locations are unknown.
KDMQCVRNCDSPDPKYRQTFEQPVVQTWVSPPVSTMLHNQMLMQCRTDDSVQMFVGEMGCWLVIWASHIYQSFIYPRLSPNSSPLLAGGYNPVHPDDIGDEEDHTIDGPDASNHTLKRTDAEGRPYLSGRRILLLAAPACCDIAGTTLMNVGLLFVAASIYQMTRGALVLFVGLFSVLFLRRKLFLYQWIALFVVVLGVALVGLAGALFGQGHGHDMSRDDTLAIATRAVMEAREIAKTPEALKAVIGVLLIAAAQVFTASQFVLEEWILENYAMDPLQVVGWEGIFGFSITVIASIILYLTVGRTEAGRYGYFDAKEACRQFSSNKYIAMASILIMISIGFVIPHSISLPFSLSLSAXCKFPSTRG

SEQ ID NO: 37442 - protein, 121 aa, A.fumigatus
  UNSURE (16): Identity of amino acid sequences at the above locations are unknown.
FRTASLSPSLFLSLRXANFRVQEANLLLSHRGFNFFGLSVTRTVSATSRSTIDTCRTLFIWLVSLALGWETFKWLQVLGFALLVYGTFLFNDIIRPPLKACLPRDRQERQILLPEEPIEHI

SEQ ID NO: 37443 - protein, 118 aa, A.fumigatus
NRQWTELAAKALAVFGCIFLLTLTSEEFIVPVLSEASAQLPLVHGAPDKALILAETISMLLFPFMITFLLVFLVIFEYVLGAFAEITRFADRQFYSDWWNSSDWYVFIHFFRASSNAI

SEQ ID NO: 37444 - protein, 107 aa, A.fumigatus
RNLTGTLYRLEFSREWNIPVHHFLRRHVYFPSLSYFSQPVAMFITFLVSSVFHELVMSCITKKLRGYGFLAMMLQMPIVAVQRSRFLRGKRTLNVRLLSFLIMGSAH

SEQ ID NO: 37445 - protein, 422 aa, A.fumigatus
RDRNGVPHVVLPAWQDCYENAARAEWLGIGVYGNKSRAPNIDAKELSKALLKVMGHRSYKTKAIELAKLCRKKEGRVAAAEKIVELALNPDRMAMHMPEVKLEDTKRPLYKIRNRAGMVLETAQPSETTSKSARVPILRDIKETLVVTTLCNAWFLFPLLGYSLLLVPRLRLSVLLYILYVKYLAKAHKTGTLALRNDRLRTSWIWKAYASYFPLRLYRSVPLSPRKKYIFGYHPHGIALRGALGTLAADAAAFSDLFPGVTNTLLMKDEAFYQPIYREYLLSTGVSGVSHSSCIRHLTRAGHDGQGMGRAITITVGGSREYNIARPGTMCVVVRIRKGFVRVAVETGADLVPVIAFGENELFDCVNVSSSTVLGVVARVWEWAVGHKVAFSTGRFNIFCPYRRPVNVVVGAPTPVCFMSRR

SEQ ID NO: 37446 - protein, 203 aa, A.fumigatus
KPVPLRTTLSPSQHLASSTSMATPTRVLFLANSEHGQTNIILAITHELLVRGDVDVHIASFPALERRVNKLLNDNAPSYDDSFRSRIHFHPIRGPSNTDVFIRTGKRGAFHPPGYSGAVLGFQSLCEDIWGWTEDEYVDIYQCCMEIIKSVQPSVIAADFFFLQGRDAAFNAGYTAILINTTSLTHIVLGLQPHSAALWKYPL

SEQ ID NO: 37447 - protein, 82 aa, A.fumigatus
MTMPLPTMTRFDPASISTPFADPPIQTCSFARASEERSILLATAAPCSASSHSAKTSGAGPKTNTLISISAVWKSSSRCSLR

SEQ ID NO: 37448 - protein, 138 aa, A.fumigatus
  UNSURE (18),(19): Identity of amino acid sequences at the above locations are unknown.
RVAKLPPSIVSTCLAFPXXGSRLDSYLIALEACDELELVIRPDFALEAFTKDSDNTEEHRGQQIHFQRGMGKNYERLEFLGDCFLKMATSIALFSQNPNDDEFDYHVNRMCLICNKNLFNTAIKKQIYRYIRSRGFSR

SEQ ID NO: 37449 - protein, 99 aa, A.fumigatus
TFLHNKLTNEYGCTNYCLKAGELPTIDGAPATVLAAVIVHGNVISEARSSSSRYAKIKASEKALAVLDGLLPSEFCQKYRCDCKETKNSSSVMEIGTAI

SEQ ID NO: 37450 - protein, 67 aa, A.fumigatus
  UNSURE (65): Identity of amino acid sequences at the above locations are unknown.
KVEDMSLPIKRALALVEAISGDLDTPIHSLLHRKTILHLELSRNSVLLMKNWWCELGKLGTKNLXGV

SEQ ID NO: 37451 - protein, 204 aa, A.fumigatus
PRDRDLNLYDADSLNGRHIWYPDGLTLLHGKDHSTKLLSEGKHALGEKTIADVCEALIGASLLSGGPEHRFDMATKAVSALVDSPSHRVSCWKEYITLYTLPKYQTEKHRGSEDDLARHVEEELGYHFTYPRLLASAITHPSLPSTWGYRVPCYQRLEFLGDSLLDMVCVEDLFRRFPDRDPQWLSEHKVSSKLRFSLSPYLLS

SEQ ID NO: 37452 - protein, 462 aa, A.fumigatus
RITNMEVASAGMSNGVPAPAQASFVDSAALIQYLVDVLQATLGALKTELESTGSLLSEAKYSETVQRCTRFASESQVALYVQKDLVASEGTNAAEDGEGMCIPSGQLYDRMITLSCSSAASSVQYAYNLSAEISSSSTTVASVAFIKRPAPIDPTLPISSQVQVINLPGPASLNNAQAQQGASLSPYEVLHLLVHHALSPYFEANTRNQDAATGLKPRTDTEVKTGVPGTKKKFAELELGLLHLQQNVEIPALNLPLHEVVQAALVEAETRGIKPSVELIPSNVLESSAFINSIQNNVNAWIRSIQTITKMSRDADSGSAAQEINFWLSMETALEGIENQLRSDGVQLTMDILRHAKRYQATLSFVADTGLREATDMVQKYNQLMRDFPLDELLSATTLQKVQESLGLIFGHLNKKLKICPYRSSELLPLLKLSQVISTRQFIVCFTAKPFCTWNYREIRFF

SEQ ID NO: 37453 - protein, 109 aa, A.fumigatus
RKLAASQQTLNLVEDQFETNYFGPLNIIEATLPHMRKQKSGHIMILSSISMISLGPYYSNATLTWSSCPHRYTGPWDVLRRWLGPGGILRCKLLTEFTFLIFQLRSHII

SEQ ID NO: 37454 - protein, 146 aa, A.fumigatus
SGLKGALQGLAVFMLTQFLISQFFGNKSQNAGSGVKPGELTSFQARPPRSEIVDYSPIPDTVAPIWPPNSAVDISIYVSPSIVLPSLSSLPSDSLVLSEKNFTIGNYSDTRGNRDYHRDSQGSPAKWNALGAFLCCADRTPTRPNG

SEQ ID NO: 37455 - protein, 246 aa, A.fumigatus
ILKINGKRMTFAIPSGQRVFLPAVQAPVQQRSTASSQDKDDGFSKTVIPTNGAAKKNEEAQGDTDNTRKSRSSRKRKSEVELASRKKRQQEPISSEEDSQDREPDDDVVLVANSRSVAVEVTSPRAEADSLIPTRILDTISTTNNKEGESVAAAATEVLQDNVTSGVAMDEGSSSTNLASDSYQTSEIILENIGGPTALALKILEVDGRIKDVPNGNAWKEFRSYRNNQDMGSLWEVRQAWYLRGK

SEQ ID NO: 37456 - protein, 277 aa, A.fumigatus
  UNSURE (190): Identity of amino acid sequences at the above locations are unknown.
VKRTSRSGITVTPGEIATTIEIPKEVQQNGTLWAHFYVALTGHQLDPTAKDYSTDSAVHFFRPLNHYLPKKKVKKLKNLLASSDDTEEEEEDNSIPDVSIASYYHPNFTVSLIPDSGVQKYRQVHPAIRHHMQLEATGARDASGQNGWYYPIVFLNTFWQLRSHMTELNSTVKTMPLRITLNNLSNWKFXMMASVDENAKANPRQGAFGKFRSWKAGMALNLRWSRKILFEPKIWLAWYNGGYLQILHINLENLGLLRNKNCWGCPFPLETPFCLPI

SEQ ID NO: 37457 - protein, 75 aa, A.fumigatus
SGNTLQRGNNGLPQACSGDPDPPMSMQSNIASSYIARCGPPKQLSKCRPEYRPLDGGRAKSWGANDLTMLYLRQQ

SEQ ID NO: 37458 - protein, 88 aa, A.fumigatus
RPFVRCFASLFYTYKKFLQPATGDKKKAGLTYSFNMEAFLKSLPSEHAEYIAVLQHTQGKRGENVNHMHGLYCSPRQVLTSSLGKEKG

SEQ ID NO: 37459 - protein, 62 aa, A.fumigatus
PIHLRTGGFPRSTRASQMGAVVLRNGMSILFPRIIGDFNPTPYGRSSITEYSHRVYLVFRVT

SEQ ID NO: 37460 - protein, 112 aa, A.fumigatus
ARGKRKPHAWSVLLTSSGFNEFIGERERVNPKSKDPRLALFDEIVLSKRNRGRSSLFSSRTTTDFLSDTSNHLWRTASATSFPPSSRGQQTLSGDYTRIVTRGASTIDKLIS

SEQ ID NO: 37461 - protein, 221 aa, A.fumigatus
  UNSURE (191): Identity of amino acid sequences at the above locations are unknown.
TEQSICPCNEMMQTAIHQPMAMTILADTAPSVTNNSASAPSPANGAHPPLATAVSANSAVAAAPPSVPADPPRTVVVVYRSGQDSIVHLVAEVLGKPWTTETSLSTLVTGSNAVVVGILAAELARSLDECDPSTLIVINTHCVDDGSSPDEALTDRCDYEFLYSHSPFLRRDLTRFLSLILGQTRPHEDLXTKTRPNFLSNNWDPQRRASKIRANSFNPLW

SEQ ID NO: 37462 - protein, 108 aa, A.fumigatus
ALRRFPCAASMLTCYLGSYDAVMLGRYTDLVKIYGEHTRLCLNSLSLNLLTANATANSENHITISCLEKACDAAVALVQYYVKSSDSEPIVRYGADVSCCYLLLVCHR

SEQ ID NO: 37463 - protein, 91 aa, A.fumigatus
ATRSLPLLHFLNKELNCTAKVAADLVSGLRTARLPPTPRQNIRQPAATAWSKISSLLSDLNPRLDAWQRQWTWAGEPCDDFHALHQCLHAI

SEQ ID NO: 37464 - protein, 67 aa, A.fumigatus
LSGSSFLMRHMNSLTGLDPSLPEIQWDFDICALLGQDIPAGETGLDLGHYFDFAQSFFPPPTDPGTL

SEQ ID NO: 37465 - protein, 430 aa, A.fumigatus
HLRKQGGFTGDGFLKHTTPAYNIDDHTKQKARDNLAGFEATSLVGILSSVTISSFSQNIMQALRILSMVVSKLLVFAHIFTVVVAHSWVEQLMVIAPNGTFVGSPGYPRGNVLRTDPSFNDKAMTNLIPPDGRANLSQILPSDRLCKDTQQKQFQTDGSPRLQANPGAAIALRFQENGHVTLPQNQAGKPRNRGTVYVYGTTEPKDDERLLDIHNVWNKEGTGGDGRGVLLSTQNFDDGRCYQINSGQISKHRQAMYPHEANQLMGADLWCQQDIALPSEAPTGKPYTLYWVWDWPTAPGVDPSLPNGKQEIYTTCIDVDVIDSPPTHERVPANYVEDQSLNNAAIPSQFAEIFGMKLPSFSAPVSSTSRLIPTPTAVPKQPTPATVTSFITLTKTVQPDAWQTSLGSSIPSYSTPSFSSPAWNWFRRPI

SEQ ID NO: 37466 - protein, 62 aa, A.fumigatus
FAILFIAKSRTIAVRLISMAMTGYYRTMVRPRTHRPLSMLKYDPVVKKKVLFLEATKGGRAK

SEQ ID NO: 37467 - protein, 521 aa, A.fumigatus
ILEREQQLRELEASRTQIATRMSEQEAELELLREAKVAALAQQKKISHQLDAVQGTIVELSDRLSSKDVEFKYVQKKLDTCQSNLLKREEELTQVKKKLCNAESARSKMETGKRKAKSEIHALLKRLQDSERWKRNIKAAITRPGDPPFDGPVAGTWDKLKDYLNSADNDTPVPDSQKTTVPTGLNVVSVSRSPSVALTPNRICESPIQGFVQTTEVIYRPQSFQGGELSSPVLTNARAGNTDSLNHCERPELLTEIVPFSSIRQQLSAASCSSLSPEPSDLAEMLDLTPNNKPHSVHGDTVVELPTQTNEKGTVATSDKADGFELGTIDEQSRSSQHQLVKLNCLATETAGGHKNAREDQDKQKTVTFRAEKEGNRIEKRKFSATVDSTAEESASEDRLIKKPGRTMKRTYSKIQRSPSSNGVPKFPNESNASPASERSNRDTHTENQYTSNDKRARVSVAPSNSKPRGQGQGAGNYLERRTSPASLASGNSRQSSAIENNPKNNRWTARGATRRSQITQ

SEQ ID NO: 37468 - protein, 369 aa, A.fumigatus
VPSNVSPDLRTGSKVEHHGNRLLKQYIEKQEWAAAIQKNTNRQDEVMSVERTPNTHSLRPTTDQFTILKRRPTNGKKVPSALRNMTLASNNGSSQLSEEDLFQLLINWMRVREENEISASNLQERMEADMFALTEENKSLKNHLETLDNQLQRSRCQSKIYGAQIENWKTKLAKFKGILNELGAEYRNLRNENLRLKDSKATLENERNEIESGIKDAKRQISQAAVLVKEKRTQLAESERKVESMTLALKNEEEKTAFVQTQLVEERRRSSILESYIHNNSRVQTKQLAIIRTEQQEMLNKLNSAFDRLDQSVNASQAANQTTLELTLEKTFPLLKELSEQLLSCRADIQQYKDTVHKIFSRCDQSQRY

SEQ ID NO: 37469 - protein, 252 aa, A.fumigatus
LVAVSANMFDFKLNEGLERNFALNENVAHKVLEQLKLFENTNGCHMALLKQLGINEEQYNTVREMLEALKPSMQTISSSLTTLNEKGIDLTQHITHLEKCIFEAQNPAPTIDVCALFTENAALKDQKEQLSIRVRSAEENAKAKELETEKANCALLDVTTKMQEEMKRAQDFEAEVVNQRQTIISIEAKIREELNRASVIARDQAKARFEQQIHKMLREKAEAEKDMAAIRESLAEVQASMVVNIDSYKGRS

SEQ ID NO: 37470 - protein, 163 aa, A.fumigatus
AFPWTILRRAGSRWDHMMRQGLALDQGVVQILEGALAIGSVVVVNVGISERASGNGVTADTDGGNLANGGEELVEHSLGDGGVEFTDIEGSRVGLAGAGSSGGRGALNGGHLRSAGGSGVGGLGGAVDSVVSGGGGRDFGRHFGFLFLEQIKSILLASSNTGM

SEQ ID NO: 37471 - protein, 63 aa, A.fumigatus
ERRGEKREKGKERKTQGKKKWIIDEPLFFFFFFFSLFSLPFFSLNFVVEFFFSFWKIQGVTSR

SEQ ID NO: 37472 - protein, 783 aa, A.fumigatus
RALSQRCHVSQENLAQSVLALLRPITSETLTAYEWFARSYLTIPDLSAYLGTLDQLAGNINYKLLLSALGPLQSRFRERPQSVTDLDARLWLLAYIIYFHQYANGTQAGQQAVEPDFVKIVSELLNSTAVHLSRRLEADDMIDDDVTEETPLHPFVKEQISSLVNQSKITGLLSQLQSTHLSQSDLANSESDASKEAKILATYALTLLRVFPRRGDDIRMWLYLGSATSGDQKAGHPGSRIPAIKYFWHASRSSRIFDKISQDSTKVLPLLKPADEFRESGLSMTQAERDEEWTIILLFLELYTFVLKVMDDEEFFSSQSSFTASSNSRVSWTKESALPLKDIKDMTVFLKNLAFTLYWNSADLNEREAPQTAGGIQSYFTGAVSSSDAITSVKDLEMRNKEKGLPGVTGIPLDYFKGLVTGLLRMIHERDSRRKFLPDGHWLMTNRFDMEGFIPAVVAEEENRHQLQDEDEEESQDDWMRDDEYEPLNLIGTGRAQQTRRIEALRRRQQQAARRKQLEAVAPRLEILRNMPFFIPFATRVQIFREFIYRDQMRRRQGYIDPDAWRMSVAQASMGRMIDGRPAAQDILSRHHANIRRESVFEDAFDQFYELGEGLKEPIQISFIDKFNTVEAGIDGGGVTKEFLTSVTNEAFKSGSEPKLFEENDQHLLYPNPAAVEQRREVLRQLGFVENSPEWNEQVRDLLRRYEFLGRIIGKCLYEGILVDVNFAPFFLLKWALTGGAGSAQRETAYRANLNDLKDLDQGLYQGLVSGLIPFFFNEVAMC

SEQ ID NO: 37473 - protein, 229 aa, A.fumigatus
ISASLQLQLKNYTGDVEDFALNFTVTDTIPLPNGGTRTVTQDLKSNGSDIPVTNQNRLVYISYIARYRLQVQPALQTNAFLQGLGHIIQPSWLSMFNQSELQTLVSGESGDIDVADLRRNTLYGGVYTIGDDKEEHPTVKLFWQVMEEMSNEERQKVLRFVTSTPRAPLLGFSHLNPRFSIRDSSEDQDRLPSTSTCVNLLKLPRYTNAKVLREKLLYAINSGAGFDLS

SEQ ID NO: 37474 - protein, 147 aa, A.fumigatus
KKKTKMSAEVSTTPAADNTVNGTPEATNAAATSAPEVTAVESASPSTTPSASQPHSASLYVGELDPSVTEAMLYELFSSIGQVASIRVCRDAVTRRSLGYAYVNYNNTADGERALEDLNYTLIKRQALPHHVVPARPRSAKNGPGKR

SEQ ID NO: 37475 - protein, 177 aa, A.fumigatus
SAPGLCSFGFPMACLDRQQLLQVLYQLFPKKPDIYVGKSVVGVDEQDSRVLVYTADGSTYEGDLVVGADGVHSRVRTQMWRAAKMRRPGLISESEMKGTDSYPDQIGDSDGLIVIMADRDEYRVCLHFRCLSYGSRIGRATPAFQSRQRNSIHPRPRSQWTIVLVHHCPIGQKISIR

SEQ ID NO: 37476 - protein, 171 aa, A.fumigatus
MTPNLGQGANCAIEDAAALTNKLHDALKVKNPGRKLSDDEIEQALSEFSNIQVKRISKIYNVSWTTARLQTRANLVYRLLLRYFIPYAGDKPAKRVLRIFEGATALDFIPLPTRSGPGWTPQKREETFFPRWTIALAFLVLISVVSINLKPVGYYSYWLSLLGGFLMDRIR

SEQ ID NO: 37477 - protein, 64 aa, A.fumigatus
QREHRSAPWSSYPRTKTHRRNRVRKIFRMMDKDENGSLDMEEFKEGSKRDETIVSALSLYDGLV

SEQ ID NO: 37478 - protein, 486 aa, A.fumigatus
  UNSURE (56),(185): Identity of amino acid sequences at the above locations are unknown.
SHLLEFVLILIQCAGQAPCSRCRDLNLLCTGHATTLGSNELPALQRRHQLASSSSXPLTHHPRNKLKALTKDRLPHLQCLANGLLSDRRDRITLIDRRGRVFPADGSLRKLRARCLPLLFHVHRESCPDKLGCLCPQPARITEHPLWNGVSAPPPPHTPALCTTTRGYTDAARVMYTWSLRGLAXMLSDTSRATSDEALATAISLACFEVQNCTNPDSWLRHAAGIKTMMRLRGPQAHLHGFGRAMYIVYRNLMVTAALLSGEECLLQEPEWQDLNRQIAADNARRPDSSAYTDVAERGFNEISKVPGYVKRVRELLALPSKKRASLQPALLRDVLAARAALRGIHTEFGVAVSMVRAGQNEQQGFIGPLPFVFFDGFSCLYVRGIRSALVILNNLILAMDEKQRTTIEAENRTLSDGIPDVVSEPKREEYESPLRPPKSPGRSRKPALAIRSLISPQTREPPTSNMMDRLVTTMGMDGVRVTLLE

SEQ ID NO: 37479 - protein, 90 aa, A.fumigatus
TGNLQGTAAAWSAPRPCVQSRYGVPPLPASRSPSGSHKPFPAARGSLRHHLRPGCAPAGSHSPARGRPASAPTLVCGCPAARSIHPDHSW

SEQ ID NO: 37480 - protein, 117 aa, A.fumigatus
RSLAREPRKTYSGKSSVSPPPLNCSAEGKIRLANIMSPTCRFEAQLTAVKERLEAAKQGSTRGLPSMDGSGGFSFVGSRIAKPLRGGGGGGPESSAPVAGVQSQESGKRTSWFFDRR

SEQ ID NO: 37481 - protein, 535 aa, A.fumigatus
LSSLVRRLVPACGEDKAKVNAELSPAELKQLLRKAQTQVINFENYMSALESEVQVWRSGETVPKDRWTPARGSEAVSAAKAEARASVTRPGTPSRLQDTPRSETPRPDSRFGDRSSTPSLVLEKDEREEFLRRENELQDQIAERESHIANVERSLREAREELKNLKENSARSGKDNEKLSAEVNELRMQLEKVSYEGKEASITMDSLREANAELTAELDDVKQQLLDVRMKAKETSAALDEKEKKKAEKMAKMMAGFDLGGDVFSDNERKLQDLIQRVDALHKVSEAGEPVAPDDLLELRTSLVETQGFIRQAELTMNDRGELSELQDSRRLELEQKLADLERDYESLLERNLGEGDVEEIRERLEKVYVTRKETEMQAAAELRSEIARKDEELTKLRQSLADSQSKASTNGASGKNLQQQIAEFDAMKKSLMRDLQNRCERVVELEISLDDAREQYNNVLRSSNNRAQQKKMAFLERNLEQLTHVQRQLVEQNSSLKKEVAIAERKLIARNERIASLEGLLQESQEKLTQANHR

SEQ ID NO: 37482 - protein, 148 aa, A.fumigatus
RAKSTSTSTTPPERHLPSVTPLPPVHFQSPSTYKMADAPRGRGGFGSRGDRGGDRGRGRGRRGRRGGGKEQEKEWQPVTKLGRLVKAGKITSMEQIYLHSLPVKEYQIVDFFLPKLKDEVMKVRNEQFHLRISSREQLFTINSWTMGK

SEQ ID NO: 37483 - protein, 85 aa, A.fumigatus
LIPAPRGTGLVASPAVKRLLQLAGVQDAYTSSSGSTKTLENTLKATFLAVVNTYGFLTPNLWKETKLIRSPLEEFSDVLRQGKKY

SEQ ID NO: 37484 - protein, 93 aa, A.fumigatus
IKPVQKQTRAGQRTRFKAVVVIGDSEGHIGLGIKTSKEVATAIRAAIIIAKLSVLPVRRGYWGTNLGEPHSLPVKQSAKCGSVSVRVRYDRTR

SEQ ID NO: 37485 - protein, 129 aa, A.fumigatus
EYLAIFGPAATTWFAFLQRNVVLKSHKATIIARVVADQGLFTPTHLTCFLTSMAIMEGTDPIEKWRTSFLPSYKANLTIWPLVQGVNFSIVPLEYRVLVVNVVSLGELCPAHRLAFTPLTRLDQAGTAY

SEQ ID NO: 37486 - protein, 292 aa, A.fumigatus
LLPVEEHRTNVGSCIDLKPENLLYLTRDPKSPLVLADFGIAKMLENPTEVLTTMAGSFGYAAPEVMLKQGHGKAVDLWSLGVITYTLLCGYSPFRSESLSDLIEECRAARIVFHERYWRDVSKDAKDFILSLLQPDPAKRPTSQDALKHPWLTGESASDRDLLPEIRAYIARSRLRRGIEIIKLANRIEALKMQEDEEGDIPSPAEMAAAADEPSKSSDTTAFPPLEGSEANGSSSPAPVDGTTGGTKKRSLSKVARGAIFREVVLAKVREMKENEERERIEREARERTAHA

SEQ ID NO: 37487 - protein, 113 aa, A.fumigatus
VDSFAAEPRGCIDVANDSTEPPEVQFIELPSTSDTPRPIPMHPHIYSNGIICLDLLGSAGWSPVQTVESVCMSIQSMLTANNRNERPPGDAEFVSYNKRRPRDIAFMYDDDNV

SEQ ID NO: 37488 - protein, 163 aa, A.fumigatus
VSHCVCFCLLSFAFCSMELLSLWQKDANHGMVVLVSSMFNKLSGQPESYEKKYVFQALSLLVYHLRPTEDIMLTSSRALYRFGRTLGAGTYGIVREAESSGGKVAIKIILKKNVRGNERMVYDELEMLQALDHPNIVHFVDWFESKVGAGASLLTVRRSQSDW

SEQ ID NO: 37489 - protein, 159 aa, A.fumigatus
LPILLPIWLLRRSQPNDPVPSCAAQIQTNTTTIAEVLGRVYGVITRRRGRIISETMKEGTPFFTILALLPVAESFGFAEEIRKRTSGAAQPQLIFAGFEALNEDPFWVPATEEELEDLGELADRENVAKRYMDAVRRRKGLVVQGRKLIDAEKQKTLKK

SEQ ID NO: 37490 - protein, 196 aa, A.fumigatus
NAFLAVGDKTTRFRRKIQLEIVRAKGLPPLLRLLQSSYLPLILSAVACIRNISIHPLNESPIIDAGFLKPLVDLLGSTDNEEIQCHAISTLRNLAASSDRNKELVLQAGAVQKCKDLVLRVPLSVQSEMTAAIAVLALSDELKPHLLNLGVFDVLIPLTNSESIEVQGNSAAALGNLSSKGTSPAIALLLSQLRKY

SEQ ID NO: 37491 - protein, 112 aa, A.fumigatus
APVGDYSIFVRDWADPNGGIHGYLKRFLASGDPTFQHIAIWTLLQLLESEDKRLIGYISKSDDIVQMVKTISDKNIESDEEDGEDGEAEVIALARRCLGLLGNGPKQTLVEG

SEQ ID NO: 37492 - protein, 251 aa, A.fumigatus
VEMASSLPSLAIPGQRLGPVSSYSAGPGTHVQNANIYASIAGPVVLQQAQPSSKLKSILSVSRNLPRKTDPSTSTTPVKATTTTKPKLRYNTLPAVDSIVLARVTRVQKRQATVSILVVLDESAGSQDPDPSKTASDNDNIVSILASAANPENHSNSDELRFQALIRKEDVRAVEKDRVVMDEMFRVGDIVRGSVISLGDQSFYYLTTARNDLGVVMARSEAGNMMFPVSWKEMRDPVTGAAELRKVARPF

SEQ ID NO: 37493 - protein, 161 aa, A.fumigatus
PFIMAGPQRPASGLPTRRTGTRQAVRRPNSSATERRTSLAIPAKASVPNASRLKSPSDTPSISAIRNQRDYEREINEDTSIHVVVRCRGRNDREIKENSGVVVSTEGAKGKTVELSMGPNAVSNKAYTFDKVFSAAADQVTVYEDVVLPIVNEVSYLLQTL

SEQ ID NO: 37494 - protein, 214 aa, A.fumigatus
HVFRASSGKGKLTASRESKLTRLLQDSLGGRTKTCIIATISPSRSNLEETISTLDYAFRAKNIRNKPQINYMAKKTLLREFTLEIEKLKGELIATRHRNGVYMTPDAYEQMTMESESRRIVNEEQRAKIESMESSLRNKVQELFTLTSNFNNLKKDHEDTRAALNETNEFLEKTEIVLKDTRATLEEEEMLRKAHQDTEAQLRDIGSDLVLTLE

SEQ ID NO: 37495 - protein, 164 aa, A.fumigatus
TVGDVEGLHAKLERKAGLEATNREKWETSVDEVTDVTSMVDSRVGSFLDRHSKLAENFITKINTFVEGELIQFQSTEEALRNYNLSFEKALREAQAQTYNSHDQMNNVLEEIKVLREEVKGRVGEGLNGLSAAAARISKEVIGEFSEFHAQVSWIPVLRPCTKC

SEQ ID NO: 37496 - protein, 491 aa, A.fumigatus
  UNSURE (347): Identity of amino acid sequences at the above locations are unknown.
LHASYSALGKDLKSMFEDMVAHVNSQKAEIHQLRLQLQEANQQSVEANRKASAHLAQVMEEEHAHAEAERDHLMSQIRSLIEESRQRQFGRLKGRVECVRTDIMSSGDSLEQATTHYDRQVDEWVFKSEQFAKDVIASRDELKTKMQHDWEVRNHLSISDVSILISQTFDQRNASIQKVTESVHEETVRIVDAQMKDMSRQMGALDDFVAKARAQNGQYCDAHMTSLQTMASNTQQSYAAYEEHLSSSRDRITCLQEDANQQMESLQELTLPLSDEVQKPLSELRTNIRERPLQEYIPTGITPQKRHYEYPTTLPRTESHDALVKRMRISKELEALPFSNGEPSASXTSQDSSTRGTPSKGFVYHDVEDEVGAQQPPSTAATPSNTGLREVDANIVAKQLACDTDDDPTATQSKSSIAANGRVSLSTDKPTEIEEPDAPPAKRHCSSSGVTDNKLPQKMLTKKMAGMMEGRENVPLPGSRGRRLRSQHASD

SEQ ID NO: 37497 - protein, 69 aa, A.fumigatus
VMTTSDHVRGADDPLEHGPYNAVCATCGFVYIFLFQSPSSHNKRWPNYFDIYGEGQLTDIQRPTEQFSC

SEQ ID NO: 37498 - protein, 218 aa, A.fumigatus
RKQMLAGYNCTIFAYGQTGTGKTYTMSGDMTDTLGILSDNAGIIPRVLYSLFHKLEDTESTVKCSFIELYNEELRDLLSAEENPKLKIFENEKKGTSGSTLVQGMEETWIDSASAGIKLLQLGSHKRQVAATKCNDLSSRSHTIFTITVYTKRTTENGDDYISSGKLNLVDLAGSENIQRSGAENKRATEAGLINKSLLTLGRVINALVDKSPHIPYR

SEQ ID NO: 37499 - protein, 199 aa, A.fumigatus
PLIALGASLHNVLTRVKSHPHLYPAVDLAYSSSDPVQKPVILQLPSNGLRLRFDGPDQRLRLIEVLDFSKITLVYKNQEVMKAVKPQEQAVSQQGPSFRHIYNRLFGPSYPGEYTPPGDGQSPYGTYVLSYPGIAFSFPLQNSAWSEQCDFVALLSSSAALPATSMAIFQGASWPEARDKLFSQQPQYPRFPALSARYC

SEQ ID NO: 37500 - protein, 294 aa, A.fumigatus
LDMASVGNTAFPQSKRDISTDPVSREGNAISDTIDSNTADHELLADQAPQDDAPDTSLFEESEVPTSTNSPASTPRVLSKRRKRIVGGKPKRVRTGCLTCRERHLKCDETSHRCQNCRKSGRICRRGVRLNFIDTQTVAPPHCIPRPPGASVSFRDESRVIASEYVGGAERYPPPGMEPPLELALPSEYPSQTSPPIPLSSMDSMSSLFGITQDSLPGQSGNFTGNALSADYSVLPDQSASYAPFKSAKVGVKDSSDRVYLNDPDDILLLRVFVEEVGLWMDSMAAVKHVRPML

SEQ ID NO: 37501 - protein, 625 aa, A.fumigatus
TRRSAYNRGRKTLIYSTRFASELTTLDIYFSIQTLLEMTVAQGPGGTSPPPQRERPDIDEDTPLLKTKSSHLRLYSDAGSYSALDESADAGSTSTAFPAEDEEALLNLARVSSLPQGPDIEPSLEHIPPAPIADKGASADPEHCSARRKDDYASRFIGVSPMRFWLIFSGILLGYVIGFFDSTLMAFSHPVITSHFHASNSASWLSTAFLLTSTAFLPLFGRISDTFGRKPVYLFAIAVFFVTTAWCAAAQSIGSFIAARAVCGLGAGGVFSMGMILSSDLVRIEYRGLYQSYINLVLGVGGCLGLAFGGFLCDHVGWRGAFLVQLPFIFVYFIVAAWTTPADLGLKRAKADQMSVPQLIKSIDLTGSFILVVTVTALILGLNLGGNVFAWTHPFIISSLALSIVLAMVFVRYERNVERAVMPISLLSKQPRASIIFGNFFGSISINTMIFNAPLYFQAVKLASPTDSGLRLVAATLAVTVSSVSTGFLITWTKRLKPTMLVGGLFLLIGGCAAALIGKDTPDLIAMICVSLSSLGQGFSFPTLMVSVLATSAQEEQAVATTTLGLFRNLGSVMGVATSSWIFQNTLVYQLDELVTSPDKESVILLARKSVQAIANLDPMHQQQG

SEQ ID NO: 37502 - protein, 66 aa, A.fumigatus
VCWRCPSCDDEVNEDERQLHEERTSPPNMITQEAAKSKPKAAPNSEDEIDIGLIQPSVLDTYKVTR

SEQ ID NO: 37503 - protein, 284 aa, A.fumigatus
STYMATHSSFFGMFLSSLPFIFGNIANFFKAMVSVAEQFGNLRNTLGSALGIFTIIRWFRTLIAKITGRPPPADAASLTPSAFAAFMHGRSAPATLPDGSPAPPKPSKKPFFMFLIAVFGLPYLMGKLIKALARSQEEQRKQMMLGPNGEPMQAPLDPSKLDFCRVLYDYTPESQESAGIDLAVKKGDIVAVLSKTDPMGNASEWWRCRARDGRVGYLPGPYLETIQRRPAQQAITSGSEAGSRTNTMTSVIEKGQVGDEKKPVLKGKMGDISPESFQKSAFYS

SEQ ID NO: 37504 - protein, 368 aa, A.fumigatus
VAERSGLRRLCLTSTAASSFDERSLRLWRSRSEECLFLSAFSGVRNLSLLRNSSCLSFSSCCRLASSRALFHRSRRLPLRSGFLRGNDLRTSSEELFECRLCPSSGDRLFLLRACSAAMATGTTAGKAASNGSKASISLEISSTGVGSGVSSENSAPTGAASLTGTDSSTGAPSSTTAGSSAGISSAAAAGSSTGPGSTGAGSTEAGSTEADSSVGASSMGAGSSRADSVGGASSAAGSSTGAGSTGADISAGTSSTGAGSAGVDSSAGASSTGIRSSAGADSSGTDFSTGVGSSAGSCKGAGSSAGTSSAGAGSSVGISSAAAAGSSAGAGSSTGAGSSTDGDSSAAGSSTGAGSSAGASSTGAGSS

SEQ ID NO: 37505 - protein, 71 aa, A.fumigatus
ESPRQQRQGLQPEPVLQRGQDLQLMEIPQQQALQREQVPQQEHLPQEQVPHEPTLHEGPPRHQQQQALPLK

SEQ ID NO: 37506 - protein, 741 aa, A.fumigatus
  UNSURE (3),(12): Identity of amino acid sequences at the above locations are unknown.
QWXRIWRLGRVXKKTEEAPQEPPEQPLTEEVVEESASPESVAEEPASAEQPPPADEPAPEEPPAAEESAPAVPEVEEPAPQDETPVQKAPAAEQSTAEDVTPEEPAPVEEASAKEPVAEEPTPGDKSSPVEEAAVEEAPPAEESAASEESTPVEEAAPTEESAAEESAPAEEATESISVGEPAAADAEEGLREESAHEEPAPVEDAPAEEPAPVEEPAAEESPSVEDPAPVEEPAPAEDPAAAAEEIPTEEPAPAEEVPAEEPAPLQEPAEEPTPVEKSVPEESAPAEERIPVEEAPAEESTPAEPAPVEEVPAEISAPVEPAPVEEPAAEEAPPTESAREEPAPMEEAPTEESASVEPASVEPAPVEPGPVEEPAAAAEEIPAEEPAVVEEGAPVEESVPVKEAAPVGAEFSEETPDPTPVEEISRDIDALEPLEAALPAVVPVAIAAEHARRRKRRSPDEGQRRHSKSSSEEVRRSLPRKKPERSGSLLDRWNKALEEAKRQHEEKLRQEELRSKDKFRTPEKAERNRHSSERERHKRSERSSKEEAAVDVKHSRRRPERSATYEVERSSGEKAAVPIEPSRRTREHSSSQGGERRSTSSRDGHSSGSKPRAFLKYMTAESETNGPLLKINGDKAAANVLGRRSSPSHSHSHRHSHEGRGSDRSTSSHHAAEEEQARRERRARRRAAEEVEQAKEREATDHHRHRHSGETRHHHHRRRRDEPPKEESKLKNILKAVVAH

SEQ ID NO: 37507 - protein, 100 aa, A.fumigatus
KTTISCLRRLLTICCRWSVALAETFKEQGLQNVVREEFSTDTYLLLLDQTNYLGLFGELISKLDGDLKEELTQLHANTVAEARKGLSWKVRRFAFLGQKP

SEQ ID NO: 37508 - protein, 296 aa, A.fumigatus
  UNSURE (3): Identity of amino acid sequences at the above locations are unknown.
GGXLGLSALRSAVSTPGEDSFTFLTTNSRPSTRTSPSSNRHRSKTLSLTSWRTPKQPQLDYWTRLLQNHSFDFPSAVIEPKLSSTEVAKIDASLGINGLASSTGVTAPIVFQTAYSLLLAHLSGARDVIYDNLVTGRNVALDNPQLINGNCANFLPYHSYVADDMPIETLLRSTQADFWTSTENGLVSLGEIYEALGRDRSTAAAKCLFCFQPFEPVTAQQDPMRWVVMKMSKNRMTFNYAIQMEVVKAAAKGEYLVRFGYDERAFSAEEARAALAWYTRCLDGMVKSKVVGELGV

SEQ ID NO: 37509 - protein, 383 aa, A.fumigatus
  UNSURE (11): Identity of amino acid sequences at the above locations are unknown.
LLRIARLLRAXCGEDAPAPFGTLKTAALSEQRNPFSTTGARPLLRVFDILYLNGRDLTGYTLRDRRKALQKAVRPVHRRFEIHPYEEATTKDQVEAALRKVVAEASEGLVLKNPRSPYRLNERHDDWMKVKPEYMTEFGESLDLIVIGGYYGSGRRGGNLSSFLCGLRVDDGHASQGASASKCYSFCKVGGGFNAADYANIRHHTDGKWMEWNPKKPPTAYIELAGRDAQYERPDMWIKPEDSVVICVKAASVSASDQFRLGLTLRFPRFKRLRMDKDWKSALSVQEFLDLKSNVEQEHREKELNVDNSRRKRVKRTAKKPLTVAGYDMDEDVKYAGPSGHIFDGLNFCELYTGQLGLFIDGVLIMRGRYSDRFECAHQENKA

SEQ ID NO: 37510 - protein, 63 aa, A.fumigatus
PPQRQSRISYGWTLHDGPTTYSSGVLQAVPFHFATSSLHPTIPILAKCWPDEEAVRSQVGHCT

SEQ ID NO: 37511 - protein, 274 aa, A.fumigatus
  UNSURE (7): Identity of amino acid sequences at the above locations are unknown.
HIRLRPXLNPAKIRHKSFKVECSFAQVSVDMFLFSSQYQDVASLSNLPRYTGGQTYFYPGWNAARGEDAIKFAREFSEYLSSEIGLEAVLRVRATTGLRMNTFYGNFFNRSSDLCAFPAFPRDQAYVVEVAIDETVTKPIVCLQTAVLHTTCNGERRIRVLTLALPTTQNLADVYASADQQAIATYFSHKAVERVLSSGLEPAREALQAKAVELLSTYRKELAGGNVSGGGLQFPANLRSLPVLFLGMIKNVSFPCSTFYSLDQSVTSPGETVG

SEQ ID NO: 37512 - protein, 169 aa, A.fumigatus
RLLFLFFIQYIYPKMYSLHDMPDIAGLPDEQTGEIVLPPPVNLSSERIVPYGLYLIDDGQTQFLWVGRDAVPQLLLDVFGLPDRSQLRVGKQNLPELDNDFNQRVRAVIEKSRDHRSKGVGSIVVPHLYVVKEDGEPGLRLWAQTMLVEDRADQSVSLVQWMGSLREKV

SEQ ID NO: 37513 - protein, 67 aa, A.fumigatus
VHHPVPYYLSVFSAARLSPDIKLQICASYTIDEAEHSHGETESFYNSAFSIYIHSGPSLSDPRFSPG

SEQ ID NO: 37514 - protein, 272 aa, A.fumigatus
  UNSURE (261): Identity of amino acid sequences at the above locations are unknown.
FGDPEESASDLDDDTSDLPFPEPLTRASFLAPDFNPADYLSSLANRHQSLEDLRQELRNLDQALSRELLDLVNENYGDFLSLGSALQGGEEKVEQVRVGLLSFQREVQAIRDKVEARQSDMEKLLNEKRRLTGHANIARALLDFAERVEDLEKRLMIGDAPTQHQRESAEGLDTDSDLLDSESEESDEEDLPTGSSAAPLVSLRRLENHIQKYVYLTRLASRIGDDHPFLLNQRPRLAKIRATVLVDLKTALEQGSHAGAXRDTKTMAVLRL

SEQ ID NO: 37515 - protein, 180 aa, A.fumigatus
  UNSURE (32),(42): Identity of amino acid sequences at the above locations are unknown.
YPPRTSDEHIALAEQLLTLASTDPAVASSMGXPRLAGAVLVXTPQAVATSDVRKEAIFCVKTQIPALGVIENMSGYTCPCCGEVSNLFSSGGGKVMAEELGIRFLGTVPVDVKFGELVEGKMVVDSDSDEEDGPTQAQQPEEPVDNRPLVERYKDCWSYSRFEEFAKTLISQIESGSAAS

SEQ ID NO: 37516 - protein, 440 aa, A.fumigatus
WDDFDNKPEIETFFIFYVDPGLLIMDYRSDRLSSHHGVQLSPSLSGQKWSQLTPSHSRPVVETVGPSHQASSGRYRVALDTSARTYRTTALRQINGNHRPPSWVNRQANRSGNRSSTLASQPVLVRAYSGSTDDTGEISNMPSRLSFPFSVRSGTPKRGPSLPSEDDFSIDGILRAIEPEIRNTLDAIGEICGRSKLSLANEYGSHIAPLGEIRAPPGGLLTVEEASSDHERQPDDAMIIFDDDSNSVMGVRDYTTLPQYRYLEQTRPSTIPPSTMGYHSFVPFSVAEGLSVLAQSANLDENTSDPVADSLPATREFMSKPNSSGRTLLGKQSECITEDHLKSILTPALVAEIRLEAQANGHSLHALPSDSRRGQLSAAENGDTATRDGGQTDKLSVLTDVQALFNWLRNASQDGQPRSAEKLLRAMLEKQNEHPPRNTC

SEQ ID NO: 37517 - protein, 94 aa, A.fumigatus
  UNSURE (74): Identity of amino acid sequences at the above locations are unknown.
RSHESFPFERACWCRSFVCIIINSVADCSEVLQAIKLRYAQKEIYTYSGIVLIATNPFARVDSLYVPQMVQVYXGKHRASQAPHLFAIAEEAFA

SEQ ID NO: 37518 - protein, 60 aa, A.fumigatus
TILFRERSRKTFETTQADLQMDNHPKLPPLMNPAMLEASEDLTNLSHLNEPAGAALSSVS

SEQ ID NO: 37519 - protein, 1079 aa, A.fumigatus
  UNSURE (24),(1077): Identity of amino acid sequences at the above locations are unknown.
FLLQQTPSLGLTRFMYHKWYRCTXESTVPRKHPICSPSRRRRLRKPPLRPLLNFYLRALLSDMLRDGKNQTIVVSGESGAGKTVSAKYIMRYFATRESSDQPGKYTTSRADAISETEEQILATNPVMEAFGNAKTTRNDNSSRFGKYIEIMFDDRNNIIGAKIRTYLLERSRLVFQPLKERNYHVFYQLVAGATDQEKEDLGLTSVEDFEYLNQGGTPTIEGVDDQSEFNATRKSLTTIGVPERTQAEIFRILAALLHLGNVKITATRTDSTLSPSEPSLVRACDMLGIDVNEFAKWIVKKQLITRGEKITSNLTQQQATVVKDSVAKFIYSSLFDWLVDKINRRLASDEVLNSYRSFIGVLDIYGFEHFAKNSFEQFCINYANEKLQQEFNQHVFKLEQEEYVREKIDWTFIEFSDNQPCIDLIEAKLGILSLLDEESRLPMGSDEQFVTKLHHNFAADKQKFYKKPRFGKSAFTICHYAVDVTYESDGFIEKNRDTVPDEHMDVLRNSSNEFVKEILDTAAAVREKDSASISSKPVAAPGRRIGVAVNRKPTLGGIFKSSLIELMNTINSTDVHYIRCIKPNEAKEPWKFEGPMVLSQLRACGVLETVRISTAGYPTRWTYEEFAIRYYMLCHSSQWTSEIKEMCHAILQKALGDASHQKQDKYQLGLTKIFFRAGMLAFLENLRTSRLNECAIMIQKNLRCKYYRRRYLEARSSILTTQALIRGFLARQRAAEVRQVKAATTIQRIWRGQKERKFYNEIRGNFILFQSVAKGFLCRRNIMDTIHGNAAKIIQRAFRSWRQIRAWRQYRRKVIIVQNLWRGKQARRQYKKLREEARDLKQISYKLENKVVELTQYLESLKRENKSLNSQLENYETQLKSWRTRHNALENRTRELQAEANQAGITAARLAAMEDEMSKLQQNYAEAQTIVKRLQEEEKVSRESIRSANLELDQLRQLNIEAENDRASLRQQVAELEEQLELAKRSISLNGLNGDAQNSGPIQPPAGGLINLVSSKKSKPKRRSAGAEKIDTDRFSGAYNPRPVSMAIPSSTFGRQNFPGHTFSPGLDTVEVELENXLS

SEQ ID NO: 37520 - protein, 296 aa, A.fumigatus
PIGYSNVARTMQEFLSLTSRDAIQALFQSYTLDPLQFYILGGNVAYSLSPAMHNAAFRHCGMRHTYSIPESPSLAALDRLGRDPHFGGASIVQPWRVQVFQKLASKSRHAEAIGAVNTIMPLRARADGTMFPLQEQASRRNQAGPVLGWYGENTDWVSIMTCISRHLSPRNTISPLKSAGLVIGAGGMARAAIYAMLRLGCRNIFIYNRTLSRAEGVALHFNSWAASQVGSTQVVRVLKSLEDEWPLDTCPPCLIASCVPADPDRDEPPANFEMPTQWLGSPTGGVILEVSNVCRV

SEQ ID NO: 37521 - protein, 93 aa, A.fumigatus
RDLADRFSLTQFAYKPLDTPLLRQMRRFRRETGRPWILVGGLELVSEQAVAQFELLTGRKAPRRLMTLEALQNYVGEDGPLDEKEIQARLGYT

SEQ ID NO: 37522 - protein, 124 aa, A.fumigatus
YGVIEQSLCRFGLGLPHRQYGLVTGEFRKKDHRSFFGNDYETWDPDKVLAEAKLVHFSDWPLPKPWVLSNQKLLAEILPKCDFKPGTMQERGCRDREVWKSLYEDFRRRRKVCPKIRTIHTEYG

SEQ ID NO: 37523 - protein, 163 aa, A.fumigatus
QGQPVASARQGEVQGVASTYQCGNDQGWRRYASPGSEAQFAFSSKAELALTLITIDTGSGESWDKSIAKLLAFGETEYDRVIHIDSDVTVLQSMDELFFLPPAKVAMPRAYWALPDTKTLSSLLILIEPSIANSKPSWRVLSLLSTVKWKLIRMRHRGMIWSY

SEQ ID NO: 37524 - protein, 143 aa, A.fumigatus
TMIQPWDYASIEAAESLLQQPSFEPFHLQNLIDGAQTPSTSNEWLDSFNPKTGQIFARIPNSSAQDVEDAVQAAESAFASWSQTPPSTRAAHLNRIAALIEERRELFAVWESIDQGKTLARSRVEIDRAISNFRYVFREYTGD

SEQ ID NO: 37525 - protein, 192 aa, A.fumigatus
ICLCGSRIYVQNSIYDAFLSRFVAYVKEHYVLGQTVGAVVSLAHYRKIRSYLSLATQYADSFKLGSVPPETPDGGYWIEPTILTVPDDSPIMKDEIFGPVVTVSSFESEDEAIARANDSQYGLASILLTRDGARMRRVGERLDAGLVWVNCWLVRELGTPFGGMKASGTGREGGDYSRDVFTNVRTVHIPSV

SEQ ID NO: 37526 - protein, 156 aa, A.fumigatus
LTALVNETEVRLQWHQPSETNEQEWLYQVQGDMLLRVIENDTFRDIPIKEGEMFLLPGTYSEFQSIKLTLVGNTPHNPVRYKDTIGLVMERQRPAESRDRLRWYCTKGNHCSPTIIREEVFHCADLGSQLKPIIERWQQDEESRRCGECGCIADPK

SEQ ID NO: 37527 - protein, 71 aa, A.fumigatus
IPGRCHRACMTISIQINMATLNPLSWVTWLAENEDKLRPPVNNYCLYQGNDFILMAVGGPNERNEYHGAIF

SEQ ID NO: 37528 - protein, 186 aa, A.fumigatus
VLCREVRLMANWTVLGKVIQDAGLPPGVLNLVYGAGYPTGSPLVRHPRVRGVSFTGGTATGVQIRRDTVEDIGKHISLELGGKNPTLVLEDADLTAAVATAARAAFENQGEVRVPPLPTNSDGTDKLDLPVWFEDLRPKLYLRRLSLPLRRLCQGALRARPDRRRRRLPRPLPQDPLVSLPSHPIR

SEQ ID NO: 37529 - protein, 253 aa, A.fumigatus
ALQYLPGPGVSHQALSQARSYISEPLPINTSWWCAKSIYIGHPPNNIVVSSLLNHVSMPHIIPAVSGQHPGRIRFRVYIKSSRNLGLPTSRSCHQPSHLRILKMSNGTPYFLPAEKAQGLANYPHARFAPTTAHRTLYVSGTSSRRGDGTWDGVTEHADGTWTLDIRAQTAAVLRNIEGIIHGATHGRGGLQNIVDATVFLIDLPQNYAGMNEEWNKVWPDRANAPARTTIGVKELPNPRLLVEITCTAVVAL

SEQ ID NO: 37530 - protein, 414 aa, A.fumigatus
ISIRIIILAARINMGSCCTNHRLFRIDMHTHIMPPSLPDLSSYHSNTPPPPPPSSSSSDSSTASAAESPWLTLHPNPTNPEEVDMYVGDRFFRTVAKNCYDTATRLAEMDAAGTDVQVLSTIPILFFYDQPSAPATLLARHLNDHIASVCRQHPTRFLGLATVPLQDVPAAVAELHRAKQELGLHGVEIGTTIDGMTLDDPTLHPFWAACEELNMPVFVHPLGYTWPKENPRRWAKYWSSWLIGMPCETALALHLLICSGTLLKFPRLKLCFAHAGGSFPALLGRIQHGYDCRPDLVAGDAGGVTPTEHATVRENIWIDSLTHDVELLEYLVKKVGAHKMIMGSDYPFPLGEVPEAGRMIAKDGRLEGFLSWRQRAEILAGNALRFLNLDKDEKWRGLMEERWRMFEKVYINVF

SEQ ID NO: 37531 - protein, 156 aa, A.fumigatus
  UNSURE (90): Identity of amino acid sequences at the above locations are unknown.
LKRDMLPYILDGIPPDLDTSRCTTGERNTPDTGMPDQRRSGGIARPINEVQDTRRKSRILDYLSKYCPISHEPNLPAENSQYAETLVISXGFATAVHPNARHGAIFQVYRYSGMFHGAISANTPIGERCSNVSTLLSVQRAAVLCCWMYVAKYVSH

SEQ ID NO: 37532 - protein, 94 aa, A.fumigatus
ATASSALSRKTATTRQHDSPRWTRQGPTCKSLARSPSSSSTTSPPPPRPSSRDTSTTTSPPSAANTRPDSSASQPCLYKTSPPPSQSCTAPSRN

SEQ ID NO: 37533 - protein, 103 aa, A.fumigatus
SFGRRSSNHTGRSNLSVPSEFVGKGGTRTSPWFSNAALAAVATAAVRSASSKTSVGFFPPSSSEICFPISSTVSLRIWTPVAVPPVNETPLTRGCLTKGDPVG

SEQ ID NO: 37534 - protein, 291 aa, A.fumigatus
PVLRVDNMVHSNPSYDLPANYSDYQAYHHYSSQLSLSSSPSSDGSSAENPDNSTPCSIVWVNTLETAFTFLDPWALSTTQVYPLGASTSLLEAPKDGKLDLFSYCDEGTSHTTAPNTRPDHVEISLEYPRATESSSGWIHGVEGYGRNGPDFQIYLTPSPAAEHFPQPSEAMHNTPSPATTSTTSSDSSQHVNWGRTEVEREIERNDAEKNSIPDDSGPTDLPYSHLIAEALKAAPDRKRTLQEIYSWFEQNTSKGRDQRSKGWQNSIRHNLSMNAVCNPTDLHSFTFSLF

SEQ ID NO: 37535 - protein, 269 aa, A.fumigatus
SLFMKGGGFALSPHFQQVFTSHFQNNNYSSSVRPSSSSSHSTHGQTASFAQSGRPQSTSGGINAAPTIHGRYSTKYLPYALLDFEKNQVFVDAVSGTPENPLWAGDNTAFKFDVSRKTELNVQLYLRNPSARPGAGRSEDIFLGAVRVLPRFEEAQPYVDDPKLSKKDNQKAAAAHANNERHLGQLGAEWLDLQFGTGSIKIGVSFVENKQRSLKLEDFDLLKVVGKGSFGKVMQVMSVFSSTMPSLMIILIFSQEKRHWSNLRSQDHS

SEQ ID NO: 37536 - protein, 222 aa, A.fumigatus
VAYYEGHPSHSWLINRIAFCGTPEYLAPELLLGNGYTKTVDWWTLGVLLYEMLTGLPPFYDENTNDMYRKILQEPLTFPSSDIVPPAARDLLTRLLDRDPQRRLGANGAAEIKSHHFFANIDWRKLLQRKYEPSFRPNVVCINLPFYQALPLTIPLQMGASDTTNFDTEFTSEAPQDSYVDGPVLSQTMQQQFAGWSYNRPVAGLGDAGGSVKDPSFGSIPE

SEQ ID NO: 37537 - protein, 156 aa, A.fumigatus
SFHRKKDTGRIYALKTIRKAHIISRSEVTHTLAERSVLAQINNPFIVPLKFSFQSPEKLYLVLAFVNGGELFHHLQREQRFDINRARFYTAELLCALECLHGFKVIYRDLKPENILLDYTGHIALCDFGLCKLDMKDEDRTNSKSPIMKVIRLIHG

SEQ ID NO: 37538 - protein, 225 aa, A.fumigatus
LFTHKWPPRQTRESHSSLVMPAISSKAWFPSSERPVRPTRAPRLCGWPRCVCSAMPLSTIKTVMPVLPIDLCVKLTFAEFWQSPSHLNQISTPLINQLAHATNSSTAATVIAEAVPAITELAVAADSTDNHKELNTALMKFLRPSAGPNGKPAGGENPHTRLAALKAEQSLTEQLGEEWLALLPEMLPYISELMEDEDENVEREVRKWVKQIENVLGEKLDDMLT

SEQ ID NO: 37539 - protein, 101 aa, A.fumigatus
WHRYMEPSTLSAEEFFKRWRQIGGPPLEAQHTFGVTAKAKNVSETFTRRLVEGFHWRILENVDPNPNNIVGCAVYQSHGGKTGCLLRLEPNYERKVSILSA

SEQ ID NO: 37540 - protein, 63 aa, A.fumigatus
WKGPRFDPAWVHYNALLFVLLLGLMFTFILDTITLEYRVHKMSFFFLELEDTCLFMLITGRST

SEQ ID NO: 37541 - protein, 156 aa, A.fumigatus
STPSTMSSMRGLVQFIADLRNARARELEEKRVNKELANIRQKFKAGNLNGYQKKKYVCKLLYVYIQGYDVDFGHLEAVNLISSNKYSEKQIGYLAVTLFLHEQHELLHLVVNSIRKDLLDNNELFNCLALHAVANVGGREMGEALSTDVHRLLISP

SEQ ID NO: 37542 - protein, 263 aa, A.fumigatus
  UNSURE (248): Identity of amino acid sequences at the above locations are unknown.
VFHLYYTDFPFSSSPFVIEDSHVREIIRASLQQIMTTAMDTPKNVQQNNAQNAILFEAINLLIHLDTEHNLMMQISSRLGKYIQSRETNVRYLGLEAMTHFAARAETLDPIKKHQNIILGSLRDRDISVRRKGLDLIYSMCDTTNAAPIVNELLRYLQTADYAIREEMVLKVAILTEKYATDAQWYIDITLKLLSLAGDHVNDEVWQRVIQIVTNNEELQAYAAHTLLGYLKTDCHESLVKIGCYVLXEFGHLIADNERLEPD

SEQ ID NO: 37543 - protein, 133 aa, A.fumigatus
ITDSKDSSSTAPSPVLLCPLALQLLDFPRASSSLRLRHTSSYDSHKHLKQHRSLLRESLTCSTIYSKPPSQPKDAMVHPSSTCCKTSGDGSCVCAAQAKCSCGKENALHCTCSRSAIENTISGPRCSCRKSAR

SEQ ID NO: 37544 - protein, 134 aa, A.fumigatus
SGCRTSKAFVKKKAALTLLRLYRKYPGIVQNEWAERMISLMDDPDMGVTLSVTSLIMALAQDRPEEYKGSYIKAAQRLKRIVVDNEIAPDYLYYRVPCPWIQVKLLRLLQYYPPSRKFSIFITQTFLSQAHPLL

SEQ ID NO: 37545 - protein, 353 aa, A.fumigatus
SPTMKGSSPIEQFLALQGKMITSNDNTRAMILSSFIKVVNLFPEIKPQLLHIFRLYSHSPDTELQQRAFEYLTLATLPTDDLLRTVCDEMPPFSERTSILLSRLHQKTAGTTEKKTWVVGGKDANADKKEVLLAQNTGLKRTFTTIVNGTKTGANGSAATSNASGDLAGLDLSAPPAPPPNMASAAHLTPDWEPGYNRLYFADEGVLFEDAQIQVGLRSEYRGHMGVVKIYISNKSSFAIGSLTTTLDNPAAPNLKIDSKSLPEPSVPAAGQTQQTLLVEAPRPFSDAPTIRISYLAGALQAYTLQLPVLMAPLHGAVDSVSGRVLQAVEADWRSPTRGAAHVRRHCQGEECQ

SEQ ID NO: 37546 - protein, 351 aa, A.fumigatus
  UNSURE (5): Identity of amino acid sequences at the above locations are unknown.
RRACXRKSKGEPEPQVDLGGPRKLNFEQIYSFFKDITSGLRHLHVNGYIHRDLKPNNCLLHETSDGLRVLVSDFGEVQAQDTTRLSTGATGTVSYCAPEVLRREYPGGPFGNFTFKSDIFSLGMILHFLCFAELPYRNADLIHEEKEDLDQLRAEISQWTGFDDERRLRPDLPEKLYTFLKRLLSVDPDRRPTADEVLSGIQAGVNGNEHFRFRRSSSTSPDPRTNSRIHPVDSPDVSSVGRSLSPRNTLAGSPVALRCSPNYEPNSAVLEAASVANSNVTEERDSLNSERELMIRPRFSATPPPMQDHIDRDKQTNENRDTRPLQHLLPPPPTRHFLARVLRSSLVSSIA

SEQ ID NO: 37547 - protein, 356 aa, A.fumigatus
YVSADPASPGVKTLAELRREMLRYSLDEVGAVVAELELDEDADEVSVDDEYDYDYDDDEEEEEDEFGRTRPVLDEDYHRQMRELEKKLNAKGLWNVGKDTTSLPEDIQKELERPAVVRIEKSDNSVDTVMKESKPKKKVAFAEELDIAPAPKPAVPEKKTLPPKQPEVPAMADSIVERIQQNGKTPAASSGPKKASRFKSARKATTEEIPSVVPPINSIRASDLRSSHRKPMVPTPDSIPLFPAKPRQPKPFSQPISDIIEKPNPPPQPEGTKGKVLADTLVERTVSEGAAVAPEPDELDEQLHRKEIATEFYRMRNRKIQQNGGFLDDEPEMVPIDTDEAPKRVSKFKAARMRQS

SEQ ID NO: 37548 - protein, 112 aa, A.fumigatus
TLGPHIRDTCMDYLNQVTALTEKVLQAIGVSLGYDESYFDEICTETMAFYQLLHYPPQPADADPLQRGIGAHRDFGVITLLLQGMSPGWRCGTRSRSHITLCHQSRGHMWCT

SEQ ID NO: 37549 - protein, 193 aa, A.fumigatus
HLYGLPQPSNRPHRESPTSHRRVPGLRRVLLRRDLHGNHGLLPVASLPSPACRRRPAAARYRRPPRLWRHHAAATGDVPGLEVWDEESQSYYPVSPIEGAYVVHLGNLFQQWPNDKYMSNVHRVINRSDVDRYCIPFNYNGNLDFVIRCIDSCRAKPEDEKYAPISVDDYIRQKYKDVYGRVGIYSVAERVKE

SEQ ID NO: 37550 - protein, 68 aa, A.fumigatus
FYLCLSKDIRKRHPGGFFQRSIEQGHEKHRGKVAYFTERPDIRLATTTKDDVGESQYLAAGGRSTQTA

SEQ ID NO: 37551 - protein, 283 aa, A.fumigatus
  UNSURE (20): Identity of amino acid sequences at the above locations are unknown.
KGQPLMTRFAVSQIPSLAVXHHVSRRQSRLVAPTVSVFARSPSAFSTTSDNQEPNLPLAGIEAVHIAKTFSTWPVDATNVTRREFRKYVEGSSSILHIGTHGDVDYRNPLLSSISMGEDFRVLDMSTIKTNANLLVFAACLSGLGRATTGSEVLGFSHVILSSGCQAYIGTLRKVSDFASMLLMTLFYRTLKKAPWMPLAYVLRQAQIELSQFDREHAARYLDQLIQTSPSSDGDSHGLMDFVPDTDFMISMQKMILAQLDWSSPFFWAPFVLMGYGSLRFAT

SEQ ID NO: 37552 - protein, 723 aa, A.fumigatus
LLGPIFTSPVALNLVLVDASSAIGENNLWDPVELELKDRYSPEVKECYEAALELFGRANCRRGQAAVLLRQACCLHIEARRLQPTDTCRTALMQDACAKFTQSKQLFGKDEVNCQIVTTHQILLDITSGDNRSVKATARGIGIWAAQAENQSVGHCLGLLIFRFARQEWCTFARMDNALVAWECAYEISESIDDVVLMFQSVVSRAWVQGEMFNLAALKILVDQAVGMFDRVRQYYDTVAKSIPDTEAEDADRLIVQTSKFDTLSSFESKASTMYFRLEDPKLAQEWQAKFADIMENDESFLTMRERMEKTLDFQGLSPALSCSNSRIKGLWQMKVIGDAMAAKYRDAKFIFQEWLDRGDIERAEAVYRRFMDETKIMESSYARDAYRLLFCSSVGDETSAKTILASMDDNSLFEGDLNDYQQGIGVKSTFAGVADNALMFCLLSRDAARAHRVVQIVQKIAPTFYDTMDDNVIDRSFRLSYYGATMLYNGHLQVALRRLLDARQLIELRRQQTTDVDARVGTFSSGWIVEEYLNLVRACFKCPDARVPSNMLQELDHSHRDDLSWEEHALLFLEESRARSVLEALNTQVACDRDEHNASAPLLELMHKRRLLRTLLALRHRTPEQEQEIGELRLQINHMEASEVCAAASSFIDMAISIVAPKLLYKSINQDAVVIEATFGYQGMIAFAVTSDGLQNIYEDRSSSVDIRKPVMQMMKVLTENA

SEQ ID NO: 37553 - protein, 345 aa, A.fumigatus
YDQEKTSHVYSRLSAPNPTRFEVILSSLLNGEAISYSSGLSALNAALVLLNPRRIAIGNGYHGCHGVIEMFGRLTGLQKLDLDCPAEQLEAGDVILLETPVNPQGTAFNIAAYADKAHSRGAYLIVDSTFAPPGLQDPFIWGADLIMHSGSKYFGGHSDVLCGVLATQRKDWAKKLFQDRLYLGSVMGNMESWLGVRSLRTLDIRVQRQSSNAANLVSWLDKALRAQNPAAGSDEAATQAALEQVFHASLQKEDEEWLLKQMPNGFGPVFSITMKEEDYARKLPSKLSFFHHATSLGGVETLIEWRTMTDATVDRRLLRISVGLENWEDLKSDLVNAFRALIGTK

SEQ ID NO: 37554 - protein, 74 aa, A.fumigatus
VDVPVAIIAIYPLFPLIIGRVPSFSYLAITQYTGPQHACFDVTCVLLWGSPTIGHLNPPATRQDVPFSVIHNIL

SEQ ID NO: 37555 - protein, 126 aa, A.fumigatus
LRNITMAHLNQAIGASTRSLHADDELNVVTDVAPPLHVSTTFRYSDNPDELVPLTDLSGVCHSSLINPFCAYWPYSDIVNLYCSMIKKKPAMSIPVFPRPTRPVSKSFYRHSSTAKQSAIPRGYPP

SEQ ID NO: 37556 - protein, 157 aa, A.fumigatus
PYQANFIRQDGLKKPHPRRASSSGPIPVLGSRSFPHPSFTELQKPRQTCIAVIYCVISFILFLNNILPFLASAIMNALVLVAVIVVAVIIGKPLSYLKCDVIGDLTGDGSSAYAFATSLDNYLDHLGGKVDYKNWIAASRGVCLEAKSIWGLSIALW

SEQ ID NO: 37557 - protein, 75 aa, A.fumigatus
IWKVRDTSISIHGFLTDHNYQCLRNNYSIHSIAAAYAVGLFPHGCYYVKMMANAKDHATNIEYAQASLTYTLDSL

SEQ ID NO: 37558 - protein, 85 aa, A.fumigatus
GAYLSRNSIKLMHTTQLAGNLAKLPTSDLNTLSLEYIGARLLYTALYMGAKSEAISYLRTGVWAWSISIPIWGLIQAGRALNRAE

SEQ ID NO: 37559 - protein, 342 aa, A.fumigatus
VRCVPNTQLQLLNTRSVNMSLIKTFSVRLQSNEWSQGDQSSDSLPQSPLFAFSAPESDEGTTSYNSGNPDGDVFTAARESRISSQDATVSSSLEAVAGCGNDGELEPSSHLFSSTPHLSSGLSLNVADCADCIKMQNPGRKRSASDASLTDSGSDSERTKTTGMKPSAKCIISDVGGVKSAPELDKRTYNANEGKKGTLQPSIQSSEQNSRRRHSRTLSMIPKPVTRLDKDTVFIPAPNGSQDTSIAACSDKPTEEENAPTPTKTTMTETFHRKWGDSDSFVTSTPVTSPGSLEANESVATEYTNGPRHTSDTDSPEATLGKHNVLSVFVFKPNLEGVDTTG

SEQ ID NO: 37560 - protein, 642 aa, A.fumigatus
RPLNWNVIYNFILLFAMCFVSAVVNGVAWGSDDRSLNYFDFGSYGSTPVVTAIITFWVALILFQNLVPISLYISLEIVRTCQAIFIHSDVFMYYEKLGISCVPKSWNISDDVGQIEYIFSDKTGTLTQNVMDFKKCTINGVSYGEAFTEAQVGMIRREGGDADTVAAEAREKIAADTTKMLQMLRRIHDNPYLRDENLTFIAPDYVADLEGQSGEAQKQATEHFMLALALCHTVITEQTPGDPPQIEFKAQSPDEAALVSTARDCGFTLLGRSGDDLILNVMGEERTYTVLNTLEFNSTRKRMSAIIRMPDGTIRLFCKGADSIIYSRLARGKQQELRKKTAEHLEEFAREGLRTLCVAERVLSEEEYRTWSKEHDIAAAALTDREQKLEQVSSEIEQELMLIGGTAIEDKLQDGVPDTISLLADAGIKLWVLTGDKVETAINIGFSCNLLTNDMELLVFNIPEDQPQRASQELDEQLQKFGLTGSDEELIAAREDHRPPPATHAVVIDGNTLKLMLSDELKQRFLLLCKQCKSVLCCRVSPAQKAAVVRLVKNGLNIMALSIGDGANDVAMIQEADVGVGIVGEEGRQAAMSSDYAIGQFRFLQRLILVHGRWSYRRMGETIANFFYKVSEVSIDACHTLC

SEQ ID NO: 37561 - protein, 93 aa, A.fumigatus
TITQNMVWTIALFWYSLYNDFDGSYLFDYTYIVLVNVAFTSLPVILMGIFDQDVDDKVSLAVPQLYMRGIERKEWSQTKFWYLSLNSWCSSSF

SEQ ID NO: 37562 - protein, 180 aa, A.fumigatus
YAFFLALPSKPCKRFSFPRDVDIIREQVTQGKFKYLDQYEAFVPPKAAATSGGLSNGSAASSDLGKPIQSSMKQDPFSDDQQIYPPSVAPTIHTHNPRSQNGSNGTNYSFDTTQHPRPQSVQCAQRTRHSFDRARPSYDVNSDFNSGAMLSRVDSATGIPVPQSPHSPLKSPHDPPSYQV

SEQ ID NO: 37563 - protein, 184 aa, A.fumigatus
RQGVTCRPSAVYEGHRAKRMVADQILVFISQFLVFQLLLTSLRLYMLDGFYQSIICFYMPYLLFSPATFVHSNGLNINDRTRMGVLVASCAVIASNTYILMNTYRWDWLTVLINVISSLLIFFWTGIYSSTTASAQFYKAAAEVYGALSFWVVLLMTVIICLLPRFTVKAVQKVFFPSGCGHHS

SEQ ID NO: 37564 - protein, 64 aa, A.fumigatus
MTVEAEPSACSNNSQTRTFTCASSQIEQQTKCQMRLFERCKRSLTVLNLKASASLQQKVSLGLL

SEQ ID NO: 37565 - protein, 349 aa, A.fumigatus
KRRLVSLFYRKAASCLLTINQGDRTTPFIMPPRGKKHYTEIWAEEDGLMNVDQANGDRERLPLNQGRGSIDQVTDETVETDKVSVGPLVSRLYSLLRYEHRADPDENSTTGAANGEPSTSNFFNGDSMDIDQPAGESDTKPLPSATSFPDASPSGFKVPAAKLDHAQLDERLKAELRHIGFLGEDDNPDYDAHYDDDIAQRLRLLQSELKKQMVTNNARKARLLEIARERMAYQEYTTIHDDLDSQVQQAYLKRTRTLGKSKKGSQAKHRPGGAGGGSHVASGAGVSRPAIGDVARTLMDRRKRWEECIGPIFKDSKTSVPGKGETIFDPAVMAEYEKAELEGWDEEQE

SEQ ID NO: 37566 - protein, 133 aa, A.fumigatus
KTIVDRMSGVGPIPDSKSLESLMEHLKTLSQLAEARVDACDAGIRELSQKRKEVVEDQETYDRETASKVKRDIDDDEEEPIRASKGGKLKKRRERGGSTKEDRPLAHGAHDIARQDGAETKVEGGTFYYALFL

SEQ ID NO: 37567 - protein, 189 aa, A.fumigatus
SSAPNMDPANEPNLAASPASKKSKNMASEVTSPTCPSSMTSPKYTATAGEASVTAESPSEDDSDEHQPEPAPAIPQIQVFGPNPLKFDDPTIYHIREVTPDMTDEEKKEIYCVNRFPKSDLSHMMAGVPPDKDFSNAKPTNQVSANTFLSYIEPYVRPLTEEDIAFLKEKVSFIVLPEGSFMFAYNQPG

SEQ ID NO: 37568 - protein, 60 aa, A.fumigatus
SLTIHADELNTLNIKLFPVYPAPPQVRAWQVPLFTVRYQAFMDENWDLTMQRVRLKRCDL

SEQ ID NO: 37569 - protein, 386 aa, A.fumigatus
IVPHINGVNSIRIISILADTDFSLTCRAIRHLLYYGCLFLLDIFSFSAIYAPTAQFSSTIACDEGMQRECARYVNTLFAPSLIHGSASAATAPSASTSALSPAAHGLTNAHVSGIPGNLVGLSKHDPDSVWPPVGDYRDRRSTSRTPSPSSSYRSSTTTPSNSTILPDDHDPTQPPPPPEVVDGVGIVELYASLKQGQSVRQWYAQNSRKLAYIDIRRFITFGIIKGFLYRVHKYAYATGQPAPQLKSSHHYHNSQSQPPSGPSSRGPGTGTNSPYASSVGDDAAPIAQQQQQQQQQQQQQHHYRQHPGQRGDDAREHATSVHSGSRSAVVFDDEDEEEIVDNKTLSKYLDGMHCFDQICTELEISEKDLTAALKKYPGEVLIIHR

SEQ ID NO: 37570 - protein, 93 aa, A.fumigatus
PIGLKSPRYDRNEFIFNFCLVLAEEEDFSSYKSVVQKLADLMHGLEEQNGFLSRDHSKSGEGKVYSLCETLMEDLNNYCECMIPIGTLPSSRG

SEQ ID NO: 37571 - protein, 133 aa, A.fumigatus
VFYKVGFGGLSYTWNVLAADVTNLRNRGLAFAFTSSPALISAFAGSKAASDLLAHSTWRWGFGMWAIILPVVALPIYGLLAYHLRQAEKKGVLVKETRDWSITPKTVWWAIMEFDRKYQPRAVVASKGFLTEG

SEQ ID NO: 37572 - protein, 267 aa, A.fumigatus
KHSRGETKENELASSTLFYSVDSSRPNYPLDNMTIKAQPTLHTARLELVPLGHEHREFTMKLDMDPEVMKMVAFGRPFTEDEAIQVHTWLMNCATSVPGFGTWVGFAEGEFVGWWVLAPVPTTENPKSFRTDRTEYGFRVSPKFWGQGYAKEGAREMVRYAFEELGLADVIGETMTINMASRAVMAGCGLTHVETFFNKYDTPPPGIEEGEVRYSITREEWLRMQKPSMTRSRWFPAFASWLPRLLLSRLWSYIFQGRRLAAGAASP

SEQ ID NO: 37573 - protein, 133 aa, A.fumigatus
ITCAGSRYLTFMLHVLSVGPSHAAFTVEAAMATMKKFHSIVGEKPAQDAEAPSVDDPNVGQIRADDKEAAHAPANAETNNEEANPSDGAQAGVKKIEAVTLSWTRGTAYAILVLYVSLPLIAACASHPKRSNC

SEQ ID NO: 37574 - protein, 103 aa, A.fumigatus
PGFHSDSIWFLTLVNDFRLSMYTSLNAYATSSFLGHSLLTVINIVSYVMGGSVYIPMAKALDLWGRAEGFLLMTFFCILGLILLASSQNLPTYCAGQVRHDHR

SEQ ID NO: 37575 - protein, 335 aa, A.fumigatus
VSTKGGCRLKRVPYRRLINDLTTHLVPGVLLFAGGFVIFLLPFTLAATAPHGYQTDYIIAMITLGLALIIAFGFYEMLVAPVPFLNYKFLIDRTVLGACLLDMTYQVSYYCYASYLPSFLQVVYELDVATAGYVTNTFSVVSFVFLFFAGWLIRWTGRFKWILWVCVPLYIFGLGLMIHFRQPGGYIGYIVMCEIFFSVAGSVFILCVQLAVLASVDHQHVAAVLALLFVMGSIGGSIGSAICGAIWTSTFLSRLERNLPASAMPDLSLIYSSLPTQLSYPVGSATRTAIVEAYGYAQARMLIAGTAFMVLGFIWVGMMRNLNVKNMTQTKGNVV

SEQ ID NO: 37576 - protein, 385 aa, A.fumigatus
LIVLDSQGDLVVAPSPRVEQTEAAIAKTLITKRQKNVSQARYPERPGYGTQGSPVTLYANYFELKSVGKELFRYNVDIVADSARAKPTGRKARQIIRLLLDEHLLQYQNSIATDYKSTLASRVELPSQGQYDVRYRDEHEDDYPEQPKVYRVNCQFTGRLNPGDLLDYLTSANASAMFESKAEVMHAMNIVIGHHPKADRSVVSVGANKHFAIHPNAAERYDLGAGLEVLRGFFVSVRAATARILINVQIKYAACYQEGPLANVINEYQRSNSRDIYKLEAFLKKLRIQATHIVRKNKKGQVVPRIKTIAGLATRADGASLPHPPKVARHGAGPNDVQFFLDAPGQKSEPGNSKGKKGKKPAKAGPAPAGRYITVSDFFLQGKFP

SEQ ID NO: 37577 - protein, 166 aa, A.fumigatus
SVVKWGELEIARKSPQRLTQSSLDHSFSYFHSLTYSVNLVNFLIRLNSTMSSRGAGDSQPRRGRGGDRGWARGGDRGASGRGGGRGGTMELPFRPSEPRGGSYRGDSRGRGGGEFRGSGRGDSGGRGGRGGGFRGGRGDQGPRIFSYVAINPFFVFLTAYWLIDCP

SEQ ID NO: 37578 - protein, 529 aa, A.fumigatus
MPTIVEIELASERQSREALLPAEESHLGYPDLPWPVRVLRLIEPTLPQSVSGSVRDAASPVGNPRDLPPHEEEEDVKPAARQTTGSRVSWGEHKTHEYEVPSTSSELESVDHETTREREQPHSPVLQQRYVSPKNAADDVGADIEFAAALAAATAAAGFNPALVTEDPTYHTWSSPPGSHGRVEYRDPWVETESKSRIPHGFVEGEVETPEEEKAPSSRVIEEQPLYSEPEPVSREPESQESSEPQTRTSIAQEVIDRLSEKQDERDGSRKALYGTEKSSNSGKERDESELRAQDSFSMPGGFETEELRSDPKRDVDSRDDGDVDRRSVASAPVSGEYDFSTRPRKSTQDSEYFDNGEDAGSASIEQDGSEGKKKRRKRRSKRDSDTFTDSASVESSPARIGQSSEKLKSMDDKDKEKKAGGFFSSIFGSRVSEPVDSKRSSSTDRPSRDVHSEIGRREYEESRRQRKEEKSSRRDEESGSDKENSKVRDKDDVDIENYKSSRQRREERRRRRYEDIVDSGKSGEYEKV

SEQ ID NO: 37579 - protein, 557 aa, A.fumigatus
  UNSURE (552): Identity of amino acid sequences at the above locations are unknown.
DRKLSEDNDENQSFLAEGPEMPAQIGDGDRGSGASGHVRLAEGAITGLGIGVLGQRPRGRSTPPEASERIMDPAPRSRSRPASPEPDRQEGDNQSQSSRRSSILRSKDSPTAVPLHFRRPPASPGTNRSVSVGTPTAPSPGSPTTPKRRPNSTEFKNSREMRPLWLVERHGPGHGEHELEEPLPSLPSSKTSSANTSVEDLTALQDERSWEAVDLSHHVHGMRRLSGIDVSQSRGFEHDAFGSQHVTPTATTFEQIHPHSRKEKLKYEFHSPSELLQDPSPYGDVQPSNMGDLPSAEGSAVGVKDASSENEDSAELAAEALPPRPSTPQNNVTAASEDTETTPTQTRTVNAFEGPGFAGVVDAAVAAAVSNRLSTRPDVAIPDKSSPEDLPYDADRTHKPIADQELAATSPPAPGVPLGFAAVVDAAVAAATISIGGQPEAAKELEQSPEISEPIPQTPHPNEQETSHPTGNDSVPRDDKRRDSVDTVVPQAEEASDEKEKLDTSAVMPDLTGENKELPSEAKNENANDNSQAQTEQPPVDTDEPSSSSAKXKKKKN

SEQ ID NO: 37580 - protein, 66 aa, A.fumigatus
TRIPDQQAHGIESLSPVTVTYGYLHKGTEVFSFYHNSHDDGFFEDERRIGKNIFVYYEILEALEEI

SEQ ID NO: 37581 - protein, 213 aa, A.fumigatus
STVRKPLNGLTILQDVEYYPNQFYKSNSMGIPQWSEQDECQARMQDAGLYIDWPNPYNLEPGLYIIVHTDYATRPGDIMDVIDDAYSAVTTRLKSQKFSNPRQPLPGRKRLFIHYELINQDDGTTNSFPTEVDLFEDVQRHLMHMFDQLEFGIKFDFPYKLGPVHVFWCDMVEWEHDLPTVTVEVFEETESDSQDAVSPTITVEMYEEVDSDS

SEQ ID NO: 37582 - protein, 72 aa, A.fumigatus
KLIVFSVGSSRQLPRFFFVAQVSKSYDVSNLGQIVEARSYKKAFKSQKPFVVACSKLVFVHCDFLTWPEYLR

SEQ ID NO: 37583 - protein, 84 aa, A.fumigatus
ISIVVQNTHISTMESADVVESPRKRLKTEDTPVSGDAVLHPSTVPGLEFSDGDAQTLKEAEVGITEFVSADNLGFSGILKKRYN

SEQ ID NO: 37584 - protein, 79 aa, A.fumigatus
VISSQNTAPKSNLNIRLMSWLEKTCPQPRHHAYKTDRRPEARQETFDRLSDIAVSRLAQAAIMYNRTMIDDFRRPVVLP

SEQ ID NO: 37585 - protein, 290 aa, A.fumigatus
KDACEQRSTQLQNCKTKQKDIPFHNDNSKPSGPQTVCAKCRFLYRSDGYFFQLAQCTNRKFSYKRKAKEGSLLCSFRKLIVILRLPLRVRVYLLIHFNCDCGGDSVLRIRLRLLKHFNSDSGKVMLPLDHITPKHMHWTKFIREIKLYPELQLIKHVHEVSLNILKEVYLCREGVGGPIILVDQLIMDEKSLAPWKWLPRIAELLRFESRCDGTICVVNNIHNVAGPGGIVRVDDNIEARFEVVGVWPVDVETGILHARLTLVLLGPLWNTHAVRFVKLVWIILNVLKNG

SEQ ID NO: 37586 - protein, 113 aa, A.fumigatus
GRNHRICQCRQPGLFRNSEEEVQLRPEILQIKLTLFCLRYTDFLVNEILPSGEVLHLRNLNPPTSPTDGTKTNDAESKSESPIADNTVEPAASGEKDAPAAKQVTAAEFQLSE

SEQ ID NO: 37587 - protein, 478 aa, A.fumigatus
TRFCGSYKLELGRYPRLAVMGQSHSKGNSGPGDSLQSYPSFSRSDTKESLRSLRGSIRSKIRSSDSPRGSTAGLSDDKSDAASVKSTTSRRSSTNQSVLSPDDTPSQPDAPEPPPSPSLSSSLKRGHKDVNAMQQSGEVDHVSDVPPTGAAPTGPSTQKVGESILIKRENQLNPILDFIMNAPLETSGSPGMGMGALKSIDLDDMISRLLDAGYSTKVTKTVCLKNAEIMAICSAARELFLSQPALLELSAPVKIVGDVHGQYTDLIRLFEMCGFPPASNYLFLGDYVDRGKQSLETILLLLCYKLKYPENFFLLRGNHECANVTRVYGFYDECKRRCNIKIWKTFIDTFNCLPIAATVAGKIFCVHGGLSPSLSHMDDIRGIARPTDVPDYGLLNDLLWSDPADMEEDWEPNERGVSYCFGKKVIMNFLQRHDFDLVCRAHMVVEDGYEFYQDRILVTVFSAPNVSTEHSFCMIFFL

SEQ ID NO: 37588 - protein, 92 aa, A.fumigatus
  UNSURE (85): Identity of amino acid sequences at the above locations are unknown.
YCGEFDNWGAIMSVSGELLCSFELLKPLDSTALKNHIKKGRKERNSMLSKSVRSPLLRFVGAKEITTFCAKSPRRLWANSCLSGXWHIRGHK

SEQ ID NO: 37589 - protein, 331 aa, A.fumigatus
  UNSURE (276): Identity of amino acid sequences at the above locations are unknown.
IYSADANLIVSLLDIHVTPPAEGSQEQPPLEILESGTGHGSLTLHLARAIQAANSVPPPLPPKSQIQYLQGRPIRPGTDAEKADPKSTSNTIQESPDGFVEQQTEQQQQQQQQQWDAWRAHRRAIIHTVDVSPKFSAHAEKIVRGFRRGIYAGNVDFYVGHVENWIAEQKKVRASRSLLSSSPTVEPFLSYAILDMPSAHLRIPHVAPILKRDGILVVFMPSVTQVGDCVDLIRREKLPFILEKVVELGSGISSGRVWDVPFAVKKSRADPSSWTXAADFAETRGRLSDAGIKKYLPLLKELQGKMIACWSAGLKSGPGSWAEVSSACGEG

SEQ ID NO: 37590 - protein, 60 aa, A.fumigatus
  UNSURE (3): Identity of amino acid sequences at the above locations are unknown.
VGXQGLHCDGESVLYSLWSRIEGSTLVRLYKISHSLTNDAIVFQNSSSHIGLLPSSKGLR

SEQ ID NO: 37591 - protein, 125 aa, A.fumigatus
LPVCAVARHCSQRRRPLTSSIVYSDAFRDMLDSVKTPFDKCIEILQENMKLDPHFIEFYYWAEENNVPIVVLSSGMKPIISALFESLLGHKPRSHLHIVSNDVESRDGKDINTVGGWKIKYHDDR

SEQ ID NO: 37592 - protein, 403 aa, A.fumigatus
TVGPFPLPTPRHRDWVVLGAEPPSSLDHCNEQSQFPFKQKQWVILRHSSHMTVTFQLGNFLGSLGRELIWNELRFHDSDIIVLQEIDQGSYNEYFREQLAYNDYKGVYWPRGRAMGMQEEDAKCVDGCATFFKGSKFILLDKQLINFGQTAVRRPDAKGQDDIYNRLWQKDHIAVVVFLENRQTGARFIVVNAHLYWDPAFKDVKLIQTAILMEELTKLSETYAKWPPCTDKAAFRFSKEEGQSETPPLEEPAPSMQYASGDQIPLLMCGDLNSSPGSAAYNLIAHGRLDEEHPDLEKRLYGNLSKVGMTHPFKLKSAYGAIGELPFTNYTPDFKDILDYIWYSSNSLHVSALLGEVDKDYLQRVPGFPNYHFPSDHIALLAEFTVKGKKGKVVEADFGPQRN

SEQ ID NO: 37593 - protein, 299 aa, A.fumigatus
SPTGEQVGQRRQPPASPQFGHASSTWTGLLINSEDKITQSTNRLLEKYGRPVFTPSIRASLMGVPDSTNSDLFHNWAKLPISREQFARELREEVHRQFQTCTPLPGAEKLLSNLNSARSTCSGERIELALASSTKTHTFDLKMSRPETKKLLNIIPSERRVLGDDPRVGQGRGKPAPDIYLVLWQALNSTADSGKPILPSECLVFEDSVAGVEAGRTAGMRVIWVPHPDLAVEYEKRQREVLAGRTGMIEIGDEWQIGEIDDGWDESIPSMDFFDDEKYGIGCTIVVELLSEIWSRAKE

SEQ ID NO: 37594 - protein, 96 aa, A.fumigatus
VHRTFSRIALYPLLISINSSQPCSKYAQFMGNPGVSSQLSFTYSSPNTINPLVSRSNHVVVVVLSLKEHYDLWVTYAQSKTANIYMPNEFTHWFEW

SEQ ID NO: 37595 - protein, 708 aa, A.fumigatus
  UNSURE (270): Identity of amino acid sequences at the above locations are unknown.
IILRARQQHLFNEFVSAHPTITAEVLDIARNAYTAYLKKNLPLLNPELPPAQYQEEVEKVYATVLNGGPLPGNEKAGDDEAKVKMHIKTVASAAKVIAHAESLDQAATPKGFAESFYSNAQDLLLPYLDSLKASSINADDHSIFTKLTMKYEERFMKDMRDLFVLDPDELTRVTEYGAEIADFVEKIVENKFGYVTDDGSVYFDITAFENAGHPYARLEPWSRSDNKLVAEGEGALTKKTTEKRSASDFALWKASKPGEPSWTSSWGRGXPGWHIECSAMASAKLGKQMDIHSGGVDLAFPHHDNELAQSEAYWSHGHPHTDQWVNYFLHMGHLSIQGSKMSKSLKNFTTIREALERKEWTPRSLRIVFLLGGWRDGVEITEELVSAGNSWEDKVNNFFIKMKDPATLSGQTSGSDTTLPAALEAAKKATFDHLCDSFNTQGAMSAISELISKYNSADKSTLNPRDVEAVARWVTSMVNIFGLNGSATADSTEIGWSGIDVPEEAKPFLYPLSSMRDSLRQAARAKEGVTPETVAEIVSKGDVPELDLTESAKPYAELLSNFRTKVSSIQPSESLGKEILALCDRVRDIDLFDLGIYLEDRENLPALVRPVTRELIQAREEKAARARQKQIEKENKEKEALKKLEKGKLSHLEMFRTNEYSAWDEDGIPTRDAAGEEITKSRAKKLRKDWERQKKLHETWLASQMGAK

SEQ ID NO: 37596 - protein, 252 aa, A.fumigatus
QRRWSGNCMSRTHLRQPSLKEKTIANTPKLTALTQPTPEDLRKEIRRCRTMTKKPFGVNLTLLPALVPPDYAAYAQVIIDEGVKIVETAGNNPGPVITQLKKANTIILHKCTTIRHAKSAVKLGVDFLSIDGFECAGHVGEHDITNFIFLSRARQELNVPFIASGGFADGQGLAAALALGAEGINMGTRFMCTVEAPIHQKVKEAIVASDENNTNLVMRRWKNTSRLFKNKVSEEAPKIVLLPQASKDSRIG

SEQ ID NO: 37597 - protein, 60 aa, A.fumigatus
RGNWALPVSCMDLELVEGTPVADGSTVPVVQGGMQWVGYAELAAAVSNAGGLGIVCLGRT

SEQ ID NO: 37598 - protein, 188 aa, A.fumigatus
YGVTCQTLGRYCSTLPLRFRWSYQIPVSLFFPLFLMPISFSRTSLLVSSFANPSKARLSFFSPLLIFSRSMATARQQPPWRQPTEYPEAKARLPPLKIWNSLTRSKNPFIPIDPEGKKVTWYACGPTVYDDAHLGHARNYVSTDIIRRIMRDYFHFDVKFIMNITDVDDKVCKALHVPLVSLATVLMQ

SEQ ID NO: 37599 - protein, 169 aa, A.fumigatus
LHGGLGVADGRALVQDDRVGLLQLRDHGAGVIARCLDDLDALVDDYLCVGSVVWGHEGREERQIHAEWLLGHGSASANLLAKVFGGGLRECSELGCISDGLFFQTRLSQVRPRHTIPRPPALLTAAASSAYPTHCIPPCTTGTVDPSATGVPSTNSKSMQLTGNAQFPR

SEQ ID NO: 37600 - protein, 97 aa, A.fumigatus
  UNSURE (43): Identity of amino acid sequences at the above locations are unknown.
ASLCASSLSWWGNARSTPPEWISICLPSLAEAIAEHSMCQPGXPRPQELVQLGSPGFDAFQRAKSEAERFSVVFLVNAPSPSATSLLSDRLQGSSRA

SEQ ID NO: 37601 - protein, 283 aa, A.fumigatus
NNSPYQRPQVIASFSRPVPSNPPVVCASQTPYLIDVEGNESTASFPAMRNQIREIITSSTVSLATALFLASDGDRYINVFDVEGRKLVLNLVADTEVSSLALTSGTGQKTDDALAIEKQILAAVTEDGTIELFTRPFVPPKDQNSKTSLKARGRQLTRRAESSIKITQSETSDASVPVVAATFQGTDILVVWAEGGIIPVFERINCIDIDTEELAFTGLKKIVKTRSSSVLASVTTNGVRAADETQVDESRAVVEQGDLLEDDVEMQDTRADIFTTGLEGHAL

SEQ ID NO: 37602 - protein, 168 aa, A.fumigatus
GREDVYKTRGRCCELSVCRISIKHQINIRLNQFVILSVAYHEIWKRSYNYHITLSIHTLGGHYKAIPPLSTTKQNKSNTRNTKSSKDHNRVNMSSKSFKSTTTLDNASTRTTSSTASTLKGMFTKSWKLKAPEKAPSSPKPSSKKAPAKDYTGEAVHHEAVAQYLALR

SEQ ID NO: 37603 - protein, 707 aa, A.fumigatus
ADIGSLQDELALLISPLYAPYPSKDSDSVCSSHVPSPSFPASTGSENRMRPSFVLRASLMGLASAVTESYNGQYVDDCPRLCADAGPSPANWTHLHHLRNLERCDQTVLFGMNVHSSVADPNTILTIRACVASQGQTYEPAAPPDVPQQQRPRNLAVAENCGAKAIQTAFTPHVGPSTLLKASGAAPQSADVAEAARQLALFVGQSAECGATILFAKHKSAVVGLYSGAQITKHAAQGVLDSYAGKQTSVLQICHPASAALTVGVVSTGFVDLAAAQDGVKSWSNGLCLDRTTPATAVSMDVLVPTMDTGFNATRAGHGNLTASSRAGTMLDVRPQPQPDGTCNTYTVKDDDGCWALAQAYHLQEKDIEDFNKNTWGWAGCGNLQSGQLICLSKGNPPMPAPIPDAICGPQVPGTQRPSNGTALADLNPCPLNACCDVWGFCGTTADFCTETPADTGAPGTAKPDTNGCISNCGMEIVNNGNAPAQVKTIGYFEAFDQLRACLRMSVDEIPAQKYSHVHFAFATVTPGFDVDTSSVEDEFRRFVKRTGFKKILSFGGWAFSTDPSTFQRFRDATKPEHRDTFVTNLVSFMSRHNLDGFDFDWEYPGAPDIPDITPGSPDEGQNYLAFLQRLRRKLPSGKSLSIALPASYWYLKQYPVKQMAKYVDYFIYMTYDLHGQWGKETHSPVYLSTCLPVYLSTCLNLHNDLC

SEQ ID NO: 37604 - protein, 159 aa, A.fumigatus
SCFVTLNADVDNQWAIPGCPAGNCLRSHVNKTETHDALVMITKAGVEARQLVVGVTSYGRSFRMNDASCSGPFCTYAGDRTHSMASAAPCTATGGYIANAEIHDILQNHGNYSIVKAYVDKESDSNILWTEIPERWIGWPKWTGAVKARPFDWIKNLYF

SEQ ID NO: 37605 - protein, 148 aa, A.fumigatus
TSIALSPIQTPSSPSAPAWPARARRTSLPRPPMCLSSNAHATSLSLKTAAPRQSRQLSLPMLALRRFSKRLARLRSRLMWPRLLANLPCSWARAPSAAPPSCSPSTSRPSWACILVPKSPNMPRKAFSIHMRESRLRSCRSAILQVQP

SEQ ID NO: 37606 - protein, 203 aa, A.fumigatus
IENALRGMFGDLGTRIQAHDGRLVLGEQDGGAALGALAHEQGKLASSLGHISRLRSRARRFEKRRRANMGSESCLDCLGAAVFSDSEVAWALLLRHIGGRGRLVRLALAGHAGADGEDGVWIGDRAMDVHTKEDRLITALEVAEMVEVSPVGRAGTGVSTQTGTVVHILAIVALCDGRGEAHQRGTEDKRGPHSVLGARAGRE

SEQ ID NO: 37607 - protein, 233 aa, A.fumigatus
  UNSURE (96),(129): Identity of amino acid sequences at the above locations are unknown.
RLAFQTACDRAASPWPWTPRGTSAATSSSPPSPKRRRPSTGAAGAISSPRHAGPTSRPSLTQDWGNSRRPHHVLGAGVLTPSHPICQDAFGSPRQXTSWRSTRLSSPTMPWRRCRRAKSSSRIAGASAXDTTTRAMLAPTPRPPTGRTSSQPSGASARVQSPPRSPRCRLGASRPAPATCRRRRHPHRPSPATPRLAMTFPAGPRPSGRLTAGRLTHPRGPSSDANPSGALRW

SEQ ID NO: 37608 - protein, 130 aa, A.fumigatus
LSVTAEARPIREARRTKEGRILFSEPVLAGNEGEGTCEEQTESESLEGYGAYNGLMSNASSSCKLPISAQAISCRAIEIRGKLTTLVGVARFPLMMHEAPAPLEKQGKLLKSGLSAECKLALKCPSATQP

SEQ ID NO: 37609 - protein, 432 aa, A.fumigatus
  UNSURE (209),(242): Identity of amino acid sequences at the above locations are unknown.
SWCIQLLTLLPLLKYPIWLATRTMGSALNSPVYIDYGEFFMNSSNVLAVPYQNVTAAFTTPVAVNSTAIDGFDWTQPYPGSRRDGHTVYLEIAQEMPLSASIVENSTTVLSSLTFGIPDSMRSGGQPLAMDPSWYICRHVFISTKPEAKAAVDGGRRCDFLSQACRADLKTQLDPGLGEQPPTAPCARRWGFDPIPPNLSGRVWFAPPXNVMAFDAAFFADDALAPVQTSQEQQPYSWRIGXGYHDPGDARAYAAAANRTYLVATVWGFSPSAKSTPVPEVSFGCLSSGSSYVPPPPSPPSSIPSDAAFGDDFSSGSAAQWTTYGGSFDASSGAFVGRKSLGGLALVNSNFSNFLFEADVTLPSTSGNAGLVFRASNPSVGADAYNGYYAGISASGVVLGRASNNWTQLGSGAAELAAFSMRSSRSGYSSPG

SEQ ID NO: 37610 - protein, 187 aa, A.fumigatus
KYRQVTVTQLTMKPAHLSNSLVFLILPALGYAAPASATTQHQARDVKITATQIETIAPKSKSCADAPAPGECATSEQAAANIAKSFETYKVTSAAEQAAVIGLMAFESLDFEYNRNHFPGVAGQGSMFALVFSFFFFYDSYFCKRKVDPDVNSPEYAIACIQCQVCGFSASSCRQVEGRVWRSGGCP

SEQ ID NO: 37611 - protein, 216 aa, A.fumigatus
LELIQGCNRRLDPLLSYPAWVRRTVPTGISNDAMGSVPQHPFFLRVIELLKSYDRSWLLPYITVMYSTGPLFLSVIWKEYMQDKPSEAARVRILMQDEYNKYSWSFFTHHVGNSWHGKDARLIFWMGQHWMFLTVLGFILASVVGFCLWWVYGRMILLSSKYRYRYSKLPGLGRLSSPTRRSRGVMPTLLRRVSFKEDEESAHVTETSFELYSRRD

SEQ ID NO: 37612 - protein, 103 aa, A.fumigatus
IARNMQSPAFNAKYAASLPALADKLKDVSGDPAGVLDLLLSNEEYDFGSGAWFLTTQCSQDVRSELQSGSQGGWEKYITSCVGTDANEERKAYWMRAVQALGA

SEQ ID NO: 37613 - protein, 187 aa, A.fumigatus
NAGHVPLKRSDTERDPDYCSVLGVEILLRQADSRFNCTGTFWSPAPRNTTLQLLNLPPYIYTMPLPARTATVSRVTNETKIQVSLSLDGGVLPPYEPSDHFPAPEDLKEAEAANHGIVPPKNAAHATQFTPTQQITVSTGIGFLDHMLHALAKHSGWSLAIRAKGDLYSMCFSLVHSHYIVANVLYS

SEQ ID NO: 37614 - protein, 165 aa, A.fumigatus
PSEPREICTVCASVSSTRTISWLMCCTVDDHHTTEDTFLALGTAFTKALGARQSLARFGRGDAPLDEALSWAVIDLSSRPWAVINLGFKREKIGDLSTEMITHGLHSFAQAADVTLHVGCTYGDNDHHRAESAFKALAVAIRTACTRRVAGEVGAGDVVSTKGVL

SEQ ID NO: 37615 - protein, 141 aa, A.fumigatus
VHIVIQRLVIDSDSTTAGIPNVYYFGQEGLHNILVIDLLGPSLEDLFDHCNRRFTVKTVVMVAKQMVRVVFTPPACPILTPLPAFARPNNPRKESDLSRYQTGQFPHRTAGHQGCKCDSCRRLWYGQAIQRSQDQAAHPLS

SEQ ID NO: 37616 - protein, 197 aa, A.fumigatus
LNHAEEFNKYLTYVRNLGFEDTPDYDYLRDLLTQALKNAGEVEDGEYDWMKLNGGRGWEYKAYSSQQHLQHNLPNSSARELHAQQLRGSQRPGVTADRLNAAQPPPPSPAKPGAGKTRDRPSASGGMPPKRQSGGLEATTPTASTQAQFQNSNANLSGHMGSPANPTKNSQQGQGTQGNDPQPTFVQKLMKALCCGR

SEQ ID NO: 37617 - protein, 146 aa, A.fumigatus
HHYQLSRVQTIHEKNLIYRDIKPDNFLIGRPGTKAANVIHVVDFGMAKQYRDPKTKQHIPYRERKSLSGTARYMSINTHLGREQSRRDDLEALGHVFLYFLRGGLPWQGLKAATNKQKYEKIGEKKQTTAIKDLCEGYPGMLFTKL

SEQ ID NO: 37618 - protein, 194 aa, A.fumigatus
ANSYFPGYLFFLSTGIFFGFKKPLIFFAFENIESVSYTSVLQRTFNLNIAVRPHNGDENATQEVELSMIDQADYAGIDAYIKKNGLQDASLAEARRAKRYNINGAKAEENAAGTANDNAVEESELQKAQRELEDQEDEEEEDYNPGSDGESDGSGSSSEEGDDGNEEGDEDDEGQDLVAAELGSEAEDVAEDEL

SEQ ID NO: 37619 - protein, 89 aa, A.fumigatus
QDLVYVECTKVSVTDPRHKSQFVLSYVFCFAPKLGRNKVLPFIIFVAFFIAIVPLFAARATTIALAIAPRIVVFFFLILLIFKLALSLL

SEQ ID NO: 37620 - protein, 442 aa, A.fumigatus
  UNSURE (8): Identity of amino acid sequences at the above locations are unknown.
GRLMSAAXEGHGWSKLWDSVDMRAIERDITESRLHLHRTFLKATENLVKRPRRPLHKPEEIRFLLILLVNPLIYPSSPSSPHVNLTQSQGGRRPSHPKESRERIPLRDARPSPKEQLGPSAPCSGPPGHHFGIVKRILGLMAHLPNDCHHYLVSWFSRLPTGQFERLVDLVGSFVTYRLSRQQGRKRSEAIENDNSLVPSFSSAAGNTPAELHAAINGRGPSKPAKDKRIKPVVYGDDWQIRAAARVMSLLFTANNTSAARKPDAAFGQEAGSLANRAAANRRGHKVPISAFYNTLLDYSDLVADFEAWESKMAKFSFCQYPYFLSIWAKIHIMEHDARRQMEVKAREAFFNSILSRKAISQYLVLKVRRDCLVDDSLRSVSEVVGSNQEEIKKGLRIEFVGEEGVDAGGLRKEWFLLLVREIFDPHHGMSTALHAKTESSS

SEQ ID NO: 37621 - protein, 327 aa, A.fumigatus
PSSRYVDGVARQNRELELIDTGLFLYDEDSRFCYFNPYCFESSEQFFLVGVLLGLAIYNSTILDIALPPFAFKKLLAAAPQTSGPQPSSARSNYRCTLDDLAEYRPALAKGLRALLEFDGDVADTFCYDFVAHVDRYGEAVAVPLCPGGETRPVTNANRREFVDLYVHYMLDTAVTRQFEPFKRGFFTVCGGNALSLFRPEEIELLVRGSDEALDVASLRAVATYDNWSHPRPENIPVVRWFWEFFENTDPQAQRKILSFITGSDRIPAMGATSLTIRLACLGDDASRYPIARTCFNTLGLYRYPTREKLERMLWEAVGNSEGFGLK

SEQ ID NO: 37622 - protein, 211 aa, A.fumigatus
  UNSURE (89),(127): Identity of amino acid sequences at the above locations are unknown.
PSVYSLLFDNCIATRLSSVRHLSVLSSPLSSLQLSLFEITHIYESRSPHERHKLKIMATHVVTTTTTISPLSANQISVYGHPSPVNSVXATPANNSPITPRLQHLPLQCRQLRLLKGPLYVPAALRXTERPQKSSPPTHPRSAHGSLDSLNNEEPSTLVSRRSTMESNFNNTISKLAENEWMKMEQLGQVTGLPTREHWKVSIFFFLFSSS

SEQ ID NO: 37623 - protein, 167 aa, A.fumigatus
SFTLPGLSTALGNEQKINNAPSQADAASPNCDSPTCRSSFGLFLRRHHCRHCGHVFCSSHTPHIVPLDQDARFHPEGVPSRACDLCWSAYQRWEEARTERLNKIQSLLAQQETTGNNNQDTESATNATASSDTLQQDDPSNQATNASQGQATDIAASVPRGWNWSTF

SEQ ID NO: 37624 - protein, 249 aa, A.fumigatus
IGSLIYALRLSYIFCICIPSSDSFSESVLMILLRGLSDHHSGPFRSSVRSTGFHSGFLSFAPFRSLRMGFHAADRKGSCRCCSDSGYPVMLLSERRCVISILMVYGAYEGMAWLLHLLNSYQGTIDGCLIHYNDSLSRYLRSDPFSHCKSMHEALGQSSSTSLHAQCPPHPTSPSSHPSQTQTAHTSSPPAPVREPAPTPSTSTPSPPPADTPPGSPSHDPSPTPMPPQPVSARVQDLGTPSKPPLSST

SEQ ID NO: 37625 - protein, 76 aa, A.fumigatus
MSLYYDAVSVLTAPSSTGGSFKSRIYSSRNLKSSPAQIYALVIEASKWDILLKEVIEAAGILKHEPKVATIMFYLP

SEQ ID NO: 37626 - protein, 331 aa, A.fumigatus
PRPVVEQLTPLLALLLVHDHLLAKNGIAANANHPLRQAIERHKTRLNGEFVKARVRRGCASIPDLKAAVLREKQAAQGAVGTSSTAVYPRWVRINNLRTTMEEQLQSTFKSYTRVNSLAELGEKDEAKLYVDPHVPDLVAVAPGVDFTSSPAYKNGQIILQDKASCFPAYLLLGDSEDWSGDLLDGCAAPGNKTTHMASLLAKHAAGRDVTRHIVSMDASKVRSKTLQKMVSAAGADNIVTVLQGQDFLALDPTEERFANVTGLLLDPNCSGSRIVRRDDVPKLPLPAAASPPTNLITGKRSANPRPDDEGGDSAPGNAGGCELNFSVRDR

SEQ ID NO: 37627 - protein, 64 aa, A.fumigatus
WISTNCPSSYSPSFTSNAQHIKMTVDPNPKSFTGGLQTPAETGLNLPISSNHFPPTTPRLSTTR

SEQ ID NO: 37628 - protein, 126 aa, A.fumigatus
LLQLYAGLLSQELKVFLFFSDAPESAQTIIPSFRASIDQVCLYHIDIMVAYQLLLSLATAGMVSAQNTVTSMLIYGADPQPLVASVVGSVSSHESCQFLTLGRQSDLASLGRHRNNLQHQLSPRHR

SEQ ID NO: 37629 - protein, 62 aa, A.fumigatus
RYLNFFSTLAFSATLMASWETVGGSIAAGLLNGGPSAIVYGMVFSTIGSVAVAASLAELASV

SEQ ID NO: 37630 - protein, 176 aa, A.fumigatus
TVCYKRKLQSKYTESHCSSPEKPSSTTSHPRHPPGTHSRRGLARSSRSGRSGSTGSRRRRTRTSTSTSTSRNSHRHQRQIIGKRRGTNTREIRRRAAGRLDTHACGRSANRAADRPMTTAHQSSVHRSGQSCEFVTYKSSCGSSIFSTVVVGPATSVRPGPMPQSVLSVPGGQLML

SEQ ID NO: 37631 - protein, 287 aa, A.fumigatus
LLWVVSSAEIMFKKHKSLTILGVDGVIHMAEEVKMAPRTVPRSMIWGTITNGIMAFGYAIAVLYCMGDYMEALTSPTGYPIITIVYQATRSKTAVNILMAMGLLPGWIALFNGLASVTRLTWAFARDNGLPFSDFFVHIDRKHKIPIRALFLVATLVVLLSFIQIGSTAAFNAILSISTLGLVLLVHHPPDPIGDQALPRAPGHPPWCLPHGPLGSPRQPLRDCIRNLRLHFPTLPSSGARYRREYELCGARPGGGHDLRLRGLGSARTEEVGGSDDCHSRGPTLVL

SEQ ID NO: 37632 - protein, 164 aa, A.fumigatus
HGLSPVTMVFRSPIFSCTSTGSTRFPSVLCSSSPPLSSSCRSSRSDPPLRSMQSSPSALSGLYFSYIIPLILLVIKRFREPQDIPRGVFHMGRWGLPVNLFAIAFAIYVSIFLPFPAQVPVTGENMNYAGPVLGAVMIFACVDWVVRGRRKWVGPTIVTQEDRR

SEQ ID NO: 37633 - protein, 102 aa, A.fumigatus
MILSCSAFLKHSLPSFAKANPQIEIRVSPRPHKHPVIKGHYINGREKAICVRNMEPEQILKKANLLKEASGEKLKRTKKPVTSLNESVRGIWSPYHGDLKMV

SEQ ID NO: 37634 - protein, 63 aa, A.fumigatus
TDGQEGYPVCKEGEVLDSRQTTLLKMFGVATAEFKVDLKAQWTRSTGEVKILEKDEGMDVDGQ

SEQ ID NO: 37635 - protein, 157 aa, A.fumigatus
VALSRSDRLAVATSYARGPGISLILSTTSIAASKATIPATTGTRGSVWWSLSTEAIASALIANPATRAKTIATAISSSKASTSVSAPESATKSSRARRRTERSRSGGTRGQSLSIATSSQASTEAARLPAFDCAATFHIYQNTSILDSDSICLFVGS

SEQ ID NO: 37636 - protein, 61 aa, A.fumigatus
EGGTNMSTRFRYPYLLLCLVPYSEFLITIWAHDQIVFPSASRESFGGRTWRFVRALAGAST

SEQ ID NO: 37637 - protein, 61 aa, A.fumigatus
IPEIRPYEAPISRWRCWHWFWLAHCGSDKLNFRTTWCIYPNYIFWFFKIDNFGHYVSSKSW

SEQ ID NO: 37638 - protein, 92 aa, A.fumigatus
QTNFPLPSWRSSSLVPPLRYVPPVDRAPDDIKKSSIGGVADFLGELKKYGEEVPYNATESWLQRKWRQKLEKKERLNKQLTEGLQSCKGLDH

SEQ ID NO: 37639 - protein, 83 aa, A.fumigatus
LVATASLSDLERATQSETDVIMIVIGKVTATETVIGIATVTVIATANVRDMVAERTMAASDITKTIHMRILALKGGTKPPLLD

SEQ ID NO: 37640 - protein, 358 aa, A.fumigatus
RPHHQMSDPSRSQHQSRWRSDPEPSSSQGLNSPHSRPTLPPMRYPGDGYDFRRPIMSDPPQREDVIDLTNEPDFLEEQRRPQNSDSRTTPRLPRFGRNIMAEVVDLEEPEDIIRIDTPSSPEVQFVRATVRQPEPVPAPPPRNRGFIGANLWDLIRLQREMAPRHLISREESFRQEIAWRARDLHRRPPDEVDMFLLGAAEEAIDLEDAMDLAIVGDRPLRAEYPTYGLTSGRGSRQSSYKAPSPPSEGFTRSAGEDDLVVCPNCDEELGIGDETKQQIWVAKPCGHVRATFLHDVGALLTFSRYTVANVPGIVLFPRPRRLPREPNRFLNVKSLIVVNPSVHPDQCSRYTFDHLYSA

SEQ ID NO: 37641 - protein, 228 aa, A.fumigatus
PDHPCPDSAAYKETDGIRIKDRRVLVDVERGRTVKGWKPRRFGGGLGGRGYTKALPSRPTGPGSFGAPSGPGGFGGGFRGGYGGRGFRGGYRGGDRFGPRGGIGYQGGRNGFGGQAPPNAPSGPGGGRNGGFGGGYAGGGKYERDARAPGVTGSNREPIRPREGYSERDRRDHDRDRESDRHRDRDRDRYRDRDRDRERERYGGREDYGRKRYHEDDSYEDPRAKRRY

SEQ ID NO: 37642 - protein, 106 aa, A.fumigatus
HCYSVYGAGLNTAAKAKGLKYFGSATDNPELTDSAYVAQLSNTDDFGQITPGNSMKVCLRLPPWSIASKANWLFCLDSGMPPSLLRILFRSQMETPWSIWRTRMAS

SEQ ID NO: 37643 - protein, 267 aa, A.fumigatus
RFVAPSILNSSFETDKPVNLALNEDGTFRNSVFYQIIGPAYIPIAFATAAAADPDVKLYYNDYNIEYSGAKATAAQNIVKMIKAYGAKIDGVGLQAHFIVGSTPSQSDLTTVLKGYTALGVEVAYTELDIRMQLPLTAAKLAQQSTDFQGVAAACVSTTGCVGVTIWDWTDKYSWVPSVFQGYGAPLPWDENYVKKPVYDGLMAGLGASGSGTTTTTTTTSSTTGGTDPTGVAQKWGQCGGIGWTGPTTCVSGTTCQKLNDWYSQCL

SEQ ID NO: 37644 - protein, 60 aa, A.fumigatus
QLTVSSGSWTNATLLAAMKNHITNVVTHYKGKCYAWDVVNEGLLLHLSSIVLLKLTSLSI

SEQ ID NO: 37645 - protein, 167 aa, A.fumigatus
RPRVDSTYALSLTRGRSPLSPQSLGTGEVNDSTDQDDVKALEQKGTAEQVATDNGSQAKRRKVSHECVVPLNITCHLKATLPLRDRRLLRRYYQKAFESLQQINCRIIAKAYVKLVEPRKQVNYPYNGRKVIAGISRQLDPEMTKPAWWPHGVTHREPDHLPKVGKI

SEQ ID NO: 37646 - protein, 867 aa, A.fumigatus
FFRELCKGYILLCKVSWRFIAQHLSLRALQVLSRIISRTKGYRCHLTTLLGLALPGIDANDLEKTLHALSFIQSACYNIPLFDLTKGREDINCDMLAMQWINGEMGRMEAEGAEVQLNYDTDLSDENEEMILRSSTCGFGDFIVSFLGRVFTLLENLPDASRVRNGSPEENIVNTLPATFMPLLSSLSPEYFDTALSKVVDFVSNHVIHQARDAMAFICNSICKVNPDKALKRFIPVLTQAIRTEIDDNGAGSTRTTGTDVLPRDRALVWNISMLSMCVVHVGDAVLAHRKELFDIAVYMQQKCRGIPTVHISNFIHHLLLNLTGTYTIDYSLYEPEVLAEGITPKLWSYQPDPDNLTVKWHVPKREELEFAVELFQDQAETALRSLTALTNGTASVKRDGSGKDWSDEVSRNLVLLRLILSGISVLFDSKAASKTKDEGVDGIANDVEMSDAKDFPVANGVGDEDPDASLDTSDEATVRPSFHYPTGYPLEENDPLYRCIHDLRERAGWVLHDVHRFLSDKQEDDVPCFAALYSAFRSWFIDVGMERSAHVLDRVTRLLAADIHPYKMSGIRKDYPRPLLVRRANVYHLQRLRHNAAPRPRSRLDEILLLDLAESCVSLYTETRRNAQSAGESALKAIWGSRLLVIPPLLTALQKGIKENDHARIKGALFSLLLSSVAKTVGRHWKYAPTLIRTFIDASAVDKPSVQKICSSAVFQIMDYGRAMERMAVLDRDIVEAIAPKEDVQDQITQKRKSINNKRAIIEKKKADMAEELVNLARVSHWKVASRAATIVITMGLRFDYIASSNLIELVTLGSVDDHPGLRGMYSQALIALFTMIDVRAICGHDYKNYVFTTGLEGSAAGANSN

SEQ ID NO: 37647 - protein, 156 aa, A.fumigatus
PLRRSNCRTPYATMDTAGPKAILTQNVYPPHEISRATSPGGEPAGVNGEGEPKARVRPRTYPYFKYLPYPIEDEAERERNLREILNQLYIAVEAGDFSPGAVHWTRELRGWLSLKFDPTRTERINLVKLYYELSLAPGIDPNVAERFASMFMLLTK

SEQ ID NO: 37648 - protein, 505 aa, A.fumigatus
ISSTSPLKLGISVPARSTGLESLGVGCHSSSTPLVQSGSTWSSYTMSSHWPLGLIQMLRNASLACSCYLQSEQADSLLMLLSWVRRADTICRRKHYLRPVKDLILDWRPLYKELKAFVLPTESGLVHSTNLKRNVKTLTKLCAFVQLYIDPCELPAMLDEFLPHFSTSFSEGAFVVVGLINLLLPTSPPPQSREDLLPQHYLPTYFHLWSLVNRSKTFDMTFLDYLSRLARDSLPAEHIPFSEYGLFTKEQSALIFTAILRLLEIPVGQSTSPYSALVDISSGLGIMLDRDARKYPVAHHIARWVVMSLAPECADAEDSILTQLEGLIQAVETFFHPSNSGGWTKTLSQLVYYLSDFFLMRWNREQSGEMEVPIGRRLTEPLKRRFVLCLRDVVFMGIYAKSGTAISFSLSTLQNLAFLEPHLILPGALQRIYPSLQGLVEVHRTASFSPRPSSLVSNHFADERLPLPSDNPAWARSTRHRCQRLGEDSSCSVFHSISVLQHPLI

SEQ ID NO: 37649 - protein, 618 aa, A.fumigatus
  UNSURE (15): Identity of amino acid sequences at the above locations are unknown.
RCFSCSKKKPSPRMXASRIASTRGSRKTWDQRNLRIPYEKKPWPRRPGRKRIAMVNNFSAAGGNSTLAIEEGPLRPKPAGAIDPRSSHLVTVSAKSKISLKENLERLLGFLDAHPDVALSDLAYTTTARRHHHNHRVAVATSDIADLKAQLCKTLESDAVNTLQPISATGPPPIAFAFTGQGSSYKSWDLQLFQHSPYFRSQILHLDTLAQGQGFPSFVPAIDGSYPRDHAHCPVITQLALVCTEIALAKYWVSLGVTPDVVVGHSLGEYAALHIAGVLSASDAIFLVGQRACLLQERCQPSSHQMMAVRASLEQIEQFAGSLPYEIACVNGPREMVLSGTREEMAAVARLLEAEGFKCIVLEVAFAFHSAQMDPILDEFEALAASGVVFQAPNLPVISPLLSKVVFDEHTIDSVYMRRATRETVHFLSAMKMAHKISTIDDATVWVDIGPHPVCVNFVRSSLPSTSVTVPSFRRGEDNWVTLTSSLGVLHCAGVPVDWNEFHQPFERALRLLDLPTYSWNEKTYWIQYQGNWALTKGNTFYDDEAPQTKALAGLASELRTSTVQQIIHEQYDGAAGSVVMQSDLMQPDFLAAAYGHKMNGRGVVTSVSALSLCIPHD

SEQ ID NO: 37650 - protein, 175 aa, A.fumigatus
SIHADIAFTLGEYLYKKLNPNQEPHMNIANLEVVKALVAQENTKSPQLIQVSASTDNIRSRQAHLKWHNVISGSIEEPFASATVYYEEASDWLASWRPATHLVQGRIHALEQLAEDGVANRFTRRMAYGLFASSLVDYADKYRGMQSVVLHELEAFADVVLTTEKGGTWTVPPYF

SEQ ID NO: 37651 - protein, 358 aa, A.fumigatus
PSGGPPVRIRALFRKFDIFRGRHFGCASRVRGAVSCKNINNSRHARSVVPGPSIAALDTRFIARYPILSTGSGEPFPTATTATELFEHVMTEILTQAIEWENVIQGVVERAKLLSVSEVQVQVFRNSHPVHDLLSALETSLREGVEVAIKDLGPWITRTRDEERPPPRGTAQSKIAIVGMSCRMPSGATDTEKFWDILEQGLDVHRKIPPDRFDVDSHYDPAGKRVNASHTPYGCFIDEPGLFDAPFFNMSPREAQQTDPMQRLAIVTAYEALERAGYVANRTRSSNKHRMGTFYGQASDDYREVNSAQEISTYFIPGGCRAFGPGRINYFFKLWGPSFSIDTACSSSLATIQVCRTS

SEQ ID NO: 37652 - protein, 220 aa, A.fumigatus
  UNSURE (198): Identity of amino acid sequences at the above locations are unknown.
AACTALWNGDTDTVVAGGMNVLTNSDAFAGLSHGHFLTKTPNACKTWDCEADGYCRADGVASIVMKRLEDAEADNDNILGVILGAATNHSAEAISITHPHAGAQSCLSRQVLRSAGIDPMDVSYVEMHGTGTQAGDAEEIKSVSDVFAPAVKRRSSQQPVFIGAVKANVGHGEAVAGVTALVKVLLMFQKEAIPPHVXIKNSINPGFPKDLGSAKFAYSL

SEQ ID NO: 37653 - protein, 876 aa, A.fumigatus
CVKTGEVADQDQSSHMENGESANHIPEEDVDIANTTESAAPKTLRKDQDASSILEHVDDQSSIDQRAEKQLMESLENQSARQNDATTVQDVPNVDEVEPNPSSAGRKRSSASAANEDYQAEPVRTKSRRTRLRDSIAETSLQSDEVSFDQNKYYEDRLQTYVEADEWMFDTVGPLLSKLGVDKLESLDELRRQSAANCSKSSVERSSNQPTSAVHVLYRDLDSIVKTWDEAKSQAMLQDDTSLTFQDMKAMDNSGLTIFLEHSRKSARKTGLKPSFTDDKVLSKFLKGVNEEWLHLHEVGFAWLKLLLMPVYGKSPVRKNSRSKKWPVMESAYVAFQWPDVLKEKVVQLLVRDDEYIFKKMREQAEQTELQILNHTPQTPFKYTRDHLAYLEMTQTVFEIHLDVYASINNPHSEVDQDTRLVQRDRLMRWSMLARTALSHYLDHGPSRKDSQNSIILRHIWASTFHSNMEPDVHREHILLCLQDLKEMLHRLSIPEIHLMNNAMMPELSADAIDQEISKLNSMDFFMKIFTPGSEDPVELIETIEPIVEPSSVEIPEESESNDQSLSQSMVQLKEMRSFLDRGDAMLKLFLWQRLRDAYQAIDYPPKVVSCYLRSVETIIQELLGASYLEESNEHREIALIRWLKSLDRILMKLVTLVLQQSDKAYECLDMEHLRSSMSALTTLTNLLHSFALYEDSVRVGQTPSSSVRGSLSKSLGNFTEKLREMEVRCWILQYTLLKEAITQNGDLFESPLEDRILFLRSVHNALGIRKMCKRSNKQFLKLMKAEFFSLESKEAYESEICQILWDLYGINLSPPGMFLFEHECPPEKLDRSTAIKLVDFVLKLAKRMNIKDLSKSELKSTIESSPRRLDGSALR

SEQ ID NO: 37654 - protein, 620 aa, A.fumigatus
RPYQCRRINLPCEGYAQRITFKDQTKLVVARVTGKPAGKKGQSSTPKDEEDDEANSTLPSSIGRKPISPRGPPSPPSSEYTESCSPMELKQENTKTNFRRGPDTPTNPDLETYSEIKPDQRHSVPAWPDVLDTVSDSFKVMHNGYLTPHSPMSARTGLSPRRILFNSSLSLLGAFEFPEDYMYYEYSANGHLLGLLKVLPLPEILKSQPMSHHVYNAAMALAALTMSSFEPYSRGSIKLRRHAFHHSLKAIQGLNAELSSSSAAKTAVQSWNYDRILSLLPTPRSLANFELQRGALLAWRSHMQGAALCLNTGYKQLKQTLAGMLLIRSFARMALLLRLYNKDYSVTSPETMPTRLSQWLDLLLKQSSQLQDRMLLLVEEVTALEIQKRQEPELDTFWSSKSSELLCKLDEWRTDVPIDEVPVDDDISGAYLTISSSDHASLIRVSALVFPNTRDPCTSAVNYVAYLCTCMRARTRYLPDSGRIVPPDAERTALTICRIAAGIPPTRFGESFTHSYGMLPSVVGAYRWSTNPGLRNWIKHWLAGYRGPREGIWNVQQTLKLLATMDSLPKPGWHFIALKVIDEPQEPSPDLDEAQSNEPFKVVLQATVQNATSTNVFVVK

SEQ ID NO: 37655 - protein, 453 aa, A.fumigatus
IPISLESASTDSITNRNIKCDGLRPECSQCRKYGVQCPGYAKVRKFMDEGPVIKKRYGQAADLVNEHEIEEIRRQGSLARPPDSIDERIFPSLVAKSMTRQQPAVFRDFVLTAFPRFFGLNKYRVHVPWAVYVSDVLGTTPALDAAIFCITSVFMGRSNHDVALQNSSREMYSKALVSLGGMIKHDKIMRSRESVSTSILLSLFEAYSQTREDSWAQHAAGAALLMSMRGAKSHLTGFDRCLYLSFRSFLTAAAFIEGKPCFFEKPEWQSLIDEIRKQDMADPRANATISAIIDVTDRLFIEVVKIPGMMYRVNRHLNASPPASPSDTEQLISRLYQCKEKIHGLASELRLVASVQGHRNTRGKLSLIGPIPSTLPQSFSSGVLRGTKNCFKILDLLLHNLTVSQHNKYYSPCAVPGTPAGYGPSSSSSSRISAPESMPSESFFDEPRIIPFH

SEQ ID NO: 37656 - protein, 68 aa, A.fumigatus
GLIGERPECAYDHLTFTELHHDPLTLKHFPPAESFLGFNSTNCATTLLSHSWIFLPSHSIASADCLLY

SEQ ID NO: 37657 - protein, 114 aa, A.fumigatus
ASPRACPPVLSPSLRCRHHCHSGDEFSPDFGLQTMGPLSQPVKLYAVTSTRTPYNYSDNVLAGDSRFWCSRSNVLFAESDFASGKTIYYLTTKTFVEVAFWTVACNTTLNGSLL

SEQ ID NO: 37658 - protein, 68 aa, A.fumigatus
SESRGRGNERIKTRVVFDDPHSIEYQFDYARVQSVHEQLGVSIGSKIVYQYRRQSAEAIEWEGRKIQE

SEQ ID NO: 37659 - protein, 79 aa, A.fumigatus
PAVRLPYNAFAMLLEFVRSQAEVSCFLQFMQFPQAIGNAATTRSPVLILLTPGPTLSTIPQNSCPRTSPFSSSGMTPMR

SEQ ID NO: 37660 - protein, 121 aa, A.fumigatus
CHRQGDGKHNLWKRSPFISWYDLWSPWPQHTLGKTRASLTPYLIGVIPELEKGDVLGHEFCGIVESVGPGVKSIKTGDRVVAAFPIACGNCMNCKKQLTSACERTNSNSIANALYGKRTAG

SEQ ID NO: 37661 - protein, 95 aa, A.fumigatus
LWTGDGCQDQGDNLARKKQHPSWWVLQDRAHVSYFSLTSTVLPTVEMPKPRVIDEADVIVKVTGSTICGSDLHLYHGMICGPRGRNILWERRAHH

SEQ ID NO: 37662 - protein, 72 aa, A.fumigatus
ELEMAASQAAGLVEKVIGHGDNAAVTTDVSNYSKNDYGQETGARIKATTWQGKNSIQVGGFSRIVRMYLTSL

SEQ ID NO: 37663 - protein, 137 aa, A.fumigatus
HCKCIVWQTNSWLVNPCGADPAPKTKYDSLILLVVGMFGYSHFTAGFAGGQAEYVRVPERDVNLLQLPDDVPFEKGLYLSDVLATSYHCVTDTRVDKGDVVAIWGAGPIGQMCGKFSFDQSASKVILIEGGKGCLKN

SEQ ID NO: 37664 - protein, 110 aa, A.fumigatus
VTLSSMILGTPQINAVLQTNHFNVGAMMQTGVRLIGNGQAPVQKYWKHLLELIRKGEINPLDMVTHRMRLEDMEKVYALFDKREEGMQKIFVQTRFSAPPAAGSPSLTVL

SEQ ID NO: 37665 - protein, 131 aa, A.fumigatus
GRRLGWLGFCINAALTGHSGEVFTVRFDPTAQHIASGSMDRSICESQLKLSILLSTTDASSTNDSTLEHIWAMRELWRSDWPSRGDPGFTMVERFTVDFFGIGGHDTSELGLGNWAENTTPRWARGDNKLS

SEQ ID NO: 37666 - protein, 81 aa, A.fumigatus
NIADKVGFDLHLNLRETSEFQLLEELTFMQKPASWLRLTISSAPLKTPHKILENHSSSCALPSSGSSTKSARGFSSKMREN

SEQ ID NO: 37667 - protein, 133 aa, A.fumigatus
  UNSURE (130),(131): Identity of amino acid sequences at the above locations are unknown.
SSAFYLVRLTLLLPTTVLWNTYGQCENYGVLTGHRGAILDLQWSRDSRSIFSASADMTLASWDLETGQRIRRHVGHEEIINCLDISKRGQELLVSASDDGCIGIWDPRQKHAIEYLETESSPRGARAVSXXPP

SEQ ID NO: 37668 - protein, 61 aa, A.fumigatus
RLCFEVFDSMLLSWVPNPYATVVARANQELLASFADVKTIYYLLVPNVASYSLPSFQVPAR

SEQ ID NO: 37669 - protein, 103 aa, A.fumigatus
APPSTLETLICTLRNLLEGSASANAANLRTRVDKVNAELVTLTYGTIVAQLCQDYDSNYQEVNKQLDKMGYNIGMRLIEDYLAKSGMGRCANFRETADMISKV

SEQ ID NO: 37670 - protein, 103 aa, A.fumigatus
VGFKIFLNITPTVTNWTSDNNQFSLIFDENPLADFVELPDDGRAQDELWFSNILCGVLRGALEMVRRSQEAGFCMNVSSSSSWNSDVSLRFKCRSKPTLSAMF

SEQ ID NO: 37671 - protein, 91 aa, A.fumigatus
PGMEAPIKPTAAHRPLPKTQIKDEFSGTEGVYLLPHHQEEIKRLQRQHFFIKAATEDKLTSVELPKGARVLDSGCADGEWNPQPLPACCTK

SEQ ID NO: 37672 - protein, 63 aa, A.fumigatus
LHFANQKLTGLRKLTGGVRCLSHFPTTGFKINRRQLKQMGHAAGPEVANGLFPSAVPNYVQSV

SEQ ID NO: 37673 - protein, 217 aa, A.fumigatus
  UNSURE (200): Identity of amino acid sequences at the above locations are unknown.
VEPATPACMLHKVKSTIIGARPRKRLKVASAGTWLADLAGTDRPDLDLYGVDLGMALFRPDPRLKLRAHDVRQPFPESWGWKDSFDLVHQRLLVWGIREDEWPRVLANLATVVKPGGVLQLVEAEWVLSSYSDEQVHQKKLAKVQEWSTRSSGMDVHIWKKFPDLLLPLGFVDMKVETFNLGYGATSTRPEDRIWTAEAXPQFFRHLARKTPGMYHA

SEQ ID NO: 37674 - protein, 223 aa, A.fumigatus
ALKVRLLSLLTLSATLKPLTYKTLMDALSISAPAELESLVTKAIYSSLITARLSPASNPPFVNVTSVAPLRDIKPQSLPMMISLLTQWESRCGDVISDIEAEIAKVKTNAAKRRAKEQARAALLEKALASADGSAKDVTGGGSGSRRHGGSQRFGQGGGNKREFNADDYDDEDDGYWDNGNDGGIDLHAAGSRMDIDESTGSSRFGLGGAGARHAKRILGKKS

SEQ ID NO: 37675 - protein, 98 aa, A.fumigatus
PHANSHSFESSIGICLVGCLSLSLTMASPSLLDLEPRNRLPTLFEVLSRRTLAPVDLFSFYIYMRDQQRSVDYLDFWYAQDLSLNSAAHESREFSDLK

SEQ ID NO: 37676 - protein, 220 aa, A.fumigatus
NRLDVSQHMSLCRHYVRELRRSVLVATPDLEKADSKGSSAALDNLEHLGDIPLTEAGPSSLRRGFRDYDDKDADQRLSAFLRSDGHTSQHSPQSSLGSQNAARLPSNEQPPRPSSGTQNESNSPGHTVTRHDIRASAEKILYTYLLPGAEREIVLPEEMVSTIINLIEDDGRDDPEVFDPAKDYVFQSNGPLRIPWVFAAKALGKPCAIDLHDTLSFGFD

SEQ ID NO: 37677 - protein, 103 aa, A.fumigatus
QATAYSLLGKPYFDDPCALLLMTDQVILPFIVAAYFIASYQYKIDPVMAYLGYSEYTFMNWAPIREPYVRKLLNKRATATLFIALLVAAALSILFIFVPGTML

SEQ ID NO: 37678 - protein, 488 aa, A.fumigatus
GQLLETALADTQKSLKRLFDGSSTISPSARCPASPASPSPRLSDKRFPDSIQSAVFTRPLGRFRVDQDRDERCFGPTSLESLMLNIKDELLQSPDTDRHTVKECVLQAQRKIDHLVGQGEEIPIGGKAPPTMPPFAILEAMIEPYFTTTHGHFPIWSKKRFTEMATALRQSAPSERDLASIVCCNNLILMAMSADSPGSHQRESMMSKQTRKTSSIDFDLITGFLTNAKRAVSNIDQLVSPHLVNVQALVSLVDLRLIPTVTNGIGSLTNKKHIVAQVYLSIGLSETLLALAIRCAKSIGVHQWHAFQGRLSDDDVNERQNLSYCLYMLDKAVCWTAGSSPSIPVSDVHFDPRLVPSENGIPSSLVAKAEMARIEETVYLEIYAVHVQARDENQVRGFAAAIMSKLQVCLTETGVDLDQIQTSLDGSASNLQLAIRYLSVQLLLIWPHKHHPDPMFQQAPEVARMCLKLLLRLWHSPPDQGSQAVFSL

SEQ ID NO: 37679 - protein, 111 aa, A.fumigatus
NRHWLTGNTGSLLVDTPHALMKEWAKTIPNDGILRYYIVGNMERLTVTSPAVLREILVSKAYEFAKPLVIQQTLRRVLGNGILIAEGEEHKVRKAQQWPFIWLQQAEEINV

SEQ ID NO: 37680 - protein, 206 aa, A.fumigatus
FRYSFLASLPSLYLYEVLISILCGRGTNRDIDMLQEFVEMLQTITDCRAEASYNRRLYQLSLIVTDVVKARRTQHKRPKPTSEGPTDPYLMSELLSPATTGYSYMNSEVQETYDSRFDGGVFQDPDGSFAPMSSITSTSGELARGSDEFLSQLRSYGKSAPGNEHFDSLAMEALGESVLFWKGVNQGASADSPSVRCDLGERLNYI

SEQ ID NO: 37681 - protein, 84 aa, A.fumigatus
NSFVEQCHYQSPSLGNTQGCVSIWFCLDAGSSFWLSNPVLVGFRIPAWSIYGILTSNNHASDNEWTSRFYVQLPYSFCGSKHRS

SEQ ID NO: 37682 - protein, 789 aa, A.fumigatus
RPVRKDLAWEQNQKAVSAAWNAANHKKTRIGYFSLHDINSFPCEYGDVEKVRNASVCIDKAHGQSIWNVHLETWKSDAEFWEIYAAKYTILLEKARAFLRLHTERLLDSAPGDTPPKAAIFISAGFDASEWEGSGMQRHQVNVPTEFYAKFTADVVQMAEEEGLGVDGRVISVLEGGYSNRALTSGVLSHLAALGDTTTLSAIVNHEQQVGLASEMFDRLHVSDSNAPAEALRTPSDIGYDSQWWAPTRLDELEALVYPPPSTAPKSKSARTYFAPTQSFAAKVVAAPRDRKSTGSPAGSDVVPLPEVGWATAAHELSKVLIPSHRQTTSYRPEELNAEASRIRRERQTAVAAAQASQKAASAASAASEGNRMQLRTRKAKASLPSSPKAETPKKNVTKSTRRTTIDPGDLPSSTADSSPGVRTTRRKSTTPIASKPSGAAESGRPNTSSLDVGASETPEQASIAAGSCPPESPSRSRSSTPSRSAAPKRSEGPKVPPVPRVPSSFLSKPASSDDQKVVSDQAQAEMTEKTDSRPADLDDLAAGVKKLSIKLKVPTPEEHAAREKQRKTTKAAKATEQHQRRAPRPTTSKTPTSSKKASSVTAAATAHASTARGTSHPSPSPSTCQMPFGPNIAISNGNMDRVKQESPENAPDDLVVSSPDPLAENETPLLSNVTINRPRWETPKDVLVSGSVSTQEAPSGSATPSSWASESLPGRSTVYSPPTTTRQTMNGLPVFTSSCPIPFAAASTAPEGKQALAMQQPNLFTHSDNAGTGHPDLMHNQNYKPEQP

SEQ ID NO: 37683 - protein, 317 aa, A.fumigatus
KVIPTMAPITVSKGRTPSPNAQESFTQMADKDLESIGRHCQFEYCHQLDFLPFRCESCRGTFCLEHRTETAHRCPKAGEWARRRNGNQNTSTASLPTQKPTIYNSDQCAHLDCKTLINTLKDPGVRCPDCNRQYCLRHRLREEHECTKIAPLGARAGSQGPSNAETIRSMFARVRTWGKDKGQALAPKPKANSAAARISELNALKKAAKGDAGIPADKRLYLHVVGTADAQAQKAEPPSGDFWFDSRWKVGRVLDDAARRLRIENVNNRAGEEERLRIFHVDSGEFLEFSETIGDGKVKQGHTIVLLRGAGVILGKS

SEQ ID NO: 37684 - protein, 90 aa, A.fumigatus
GELSKWIFGEKYHRVLLLGEDSCGKTTFLRRLTFGEIGEHEPLPTRDFDIETTNYPATYKWSIWEFRSMLLALFRLPFSVLHFIPWFGRC

SEQ ID NO: 37685 - protein, 725 aa, A.fumigatus
  UNSURE (531): Identity of amino acid sequences at the above locations are unknown.
LRENSQNGSSARNTIASYSWEKTAAARQPSSAASHSAKSESMSRSRRETLTSRRRTTLPPTSGVYGNFGVCYLHFSVFRFLFYILYLGLVDADRQASVRCWPLIWRELAPHTLVLWLHDCSTEDDWPPWKFRSLLEQMVERGCRYIWVGLNKQDSPDVSEESVQEARRKYEEEFAKYKDDLSWKVLTHKLSAKTGVGVSEVLKDIYQAVKRANLEPPKEDKQDKTGTVISDSSDEKLTTEQLQRRIEKEVTGDTIDPDAFWTSFLEGDLPAWTHYTYLKALYFVILESAKKKTFTEIANDFNIHLIRLRNISPQLFNDSETPSAYVHAPFNICLATFWTLQLQHGIREYRMHSMSSHLPSREEFPQVLRRSPSLMSTYLWKSYYSFNPVSRPRDYWSIPNLRKLPTQTDYLRDPATVPRKDEGPDKLIRYAFAVMQYVRNAGAARGQVVTQALVALQQATMRARTADSTVETYSETQAYFWIQIVHAALRSLDDKKGSVDTSEMSFEAFQQTFHLKPTDWQEYYSKKLWNXVAARSQFVMPDLKPLPNVIASLPSKVIRKAPEGIPKLPSAEELTFRARMACEELTPTLQSSGPPVLSHTHLLFYLHKRFTQSAEGGTRKKLERRARELFSEIAGPIVAGATYRNFWIQQVGVAVLNSDIGKGRSTFPEFITSNLHLVFEELHGIYYGPGVWTSADAAEKILGPDRRRMETIVNMADVNMSANTK

SEQ ID NO: 37686 - protein, 201 aa, A.fumigatus
  UNSURE (7): Identity of amino acid sequences at the above locations are unknown.
FPLTMNXRKVELMSDTVDSLEISVLHELHGEGEAVGPEGQFPETQEARRKRKKNKKKKRLSEVTQTGENAQISLTPIMDLQQPSQSRSITDEEFLPDMFHRLTTITPLNGPHANPNRRIPPAPVSFKHNDYLCNLSISEADVIAMQLFQGTYRLDIRELPHQECRMTLIWDYDHLWGCFDIGVWKGLMLIDPGPRDNTKTM

SEQ ID NO: 37687 - protein, 264 aa, A.fumigatus
SFAWRGFCENEPEVAYDNEGITVGEITLGGKGPVSGCFKGMPVANFPNDKCDFKAVREVGPPMVPWPVETFVADWNYLQHDRAKEPESQRLVLLALSPEPESQVVNDETMQMDGEEDQEEEGQCQDEVTTDVHPSSPARQPAETPHTSPPPDEPTQQSQRAPSTISRFHATPLAMQRSWARHDQDKFLDVVCGSYEISSPTMKHNWSRKASKLRMRLLVDRGESCVWGMFAMGVYRGIMLFQESPIRFQKDLHHGAGRIRAMRN

SEQ ID NO: 37688 - protein, 103 aa, A.fumigatus
GKCSVCNYAILERPLQQVAFDINYLYQGVSILGPLKYMKVVLARSENSAAVKAASHSTCHILFPVSHNLHVAFLLRPACPVRVKKLLSFSPLPNISNCKEPYL

SEQ ID NO: 37689 - protein, 152 aa, A.fumigatus
  UNSURE (46): Identity of amino acid sequences at the above locations are unknown.
HPERQGPVFRGVHDHLSPARRHRRRLFPPDPVLGPPQPARKRFLPXDQPGPPVAPRRRTARPALLDARARSQPAARRLPRHSDHPAPLAHPQQRPLGGIARRRVRHRRSLRDFPPEGPTAVSRSDLRPVRAQRGAIAAFGVPIRAAEGNRRV

SEQ ID NO: 37690 - protein, 523 aa, A.fumigatus
GITNDKQHANYSLFVFRERWPAPWIGGNSWPQTIRQSHLACSFSSASASAAYGFTISLCTVSPTPPSPARTHRRATSAATASPSRSASSASKAPIRIHARVNMTRRPSARTDATSRAALPLNAVQAIPSACATLSPRIMPNTRSTHAANTAKFSLASRNRTISLASTFVVPSQMLLTAVFRSSRETLNSGSSGSSIYPTPPIASWHSWIPTIAILLITALDTAVNARKTTVASAPLGTCAGTAAPGSPGFSTTPITATVKNPSCIAARCRTSTSASKRRCIGINHSGSPTVLRARENARAMLSARRHAPSEPMKVCVRVTFSSGAIVATPLSRGPTRCARISRSSSSAVGRSLVPSLFLRRWMRTPLVTSRGAWLGPVMVRRRGARKVLSFPEGAVLARRRVTLASVAEEKNLKPLMLYSPSPRVPSGLLLVILLLLAVEEAGTGSWVAHVSVFWTSLPPARSVIHWPEVQKSSLREVRRLKTTRKGWSSGKACCWSCWERISAAPSVMATGQEVSPDEGPYR

SEQ ID NO: 37691 - protein, 337 aa, A.fumigatus
  UNSURE (7),(24),(113): Identity of amino acid sequences at the above locations are unknown.
GCARRVXGGAIGLYGNRFPSARKXKNPGNGLTGIVPAKTSFSGGDRPPRGQSTSGTGTSSPPGWDDFDIQNDKAQFFVAYTTICLLLGDTVEGCFRQTLSWDRRSQLENAFYXWINQALPSLRAAAPPDPLSSTHELEVNQLLVVYLAILIILHRSPTPNSVPSAASLVAASGIAGLFETFHQKDQLQYLGPIFALYGLSAGLSLLSAYRYEPLKETAEYELSTIKLCLQTLSKRWRSAVGPIRALDRLTEQVRRQPLFEGNVPSLGPGLVDFFNGIDRRLCRQWGVIQGERMVARPVSTLETAKHDVMPFDGYMDILDQNWEGSGFDWSGSWLLDI

SEQ ID NO: 37692 - protein, 92 aa, A.fumigatus
EIQTADVQGYLPSSTYQSIQSNLTQLGEEAISPQIREWSADAERHQPYVKGYNVWGQRYDYDRLVTSEGWKQLSRWGARHGYWRCVLSYVQD

SEQ ID NO: 37693 - protein, 298 aa, A.fumigatus
RKQGGGIRLRSELRRLPPSRPIYRQLSVRAFVRADLLPRRHDRRRRTDPLPATPATRLPGRPSFPGRLQPSHLPQRRLLDLRPMDDRTRRRQRRPKHRNVGHPRPCPGLLHSQQQQYHQQQPARHPRRRRVQHQRLQILLLRNRRQRHPPPRQDRPLGKTQHLPRAPPAHHHRPQPSPPRSHQRGPHPPPQEQARDQGSPHRRAGAAGYARAPRRAARQGRRDDRAAAERDPHAHLHRLAGCVAPGAEHRPGVLPRAQHGRRAAVVDSDASTLAGGGGGAAAGGDAAGVLHGGRDGCG

SEQ ID NO: 37694 - protein, 369 aa, A.fumigatus
DGPVSAGEGELRGVCCVGGAGVGHDPGGEGGARTGDGLDGVQGQGGPGGGVGSGGWSASHVHPGVDSDGGLAGAGCRARWGCGGGRGGSSVGSGRRRRRRRHGAQGYCEAVRGRGRRGRERACEMGLPDCLGPGIASDPGGRPSFSKDEQAVVSMLFVISDTSWHNHHNHNHICTVHQISNNQDPLQSNPDPSQFWSKMSIYPSNGITSCFAVSRVETGRATILSPWITPHCRHRRRSIPLKKSTNPGPRLGTFPSNKGCRRTCSVSRSNARIGPTAERQRFDSVCRQSLIVDSSYSAVSFSGSYRYAESSDSPALSPYRAKIGPRYCSWSFWWKVSKRPAMPDAATSDAAEGTLLGVGERCRMIRMAR

SEQ ID NO: 37695 - protein, 558 aa, A.fumigatus
ADGELDMGTGAVSCLTCRTNESRVVALGYDPSYGASRRLVQYTVNYLYGPSSGLTSCPVAMTDGAALILSQQLQQHAFPEDHPFRVVFNRLTSRNEDFWTSGQWMTERAGGSDVQNTETWATHDPVPASSTASNNNITNNNPLGTLGEGEYSISGFKFFSSATDANVTLLLAKTAPSGKLSTFLAPLRRTITGPNQAPREVTNGVRIHRLKNKLGTKDLPTAELELRDMRAHLVGPRDKGVATIAPLLNVTRTHTFIGSLGAWRRALSIARAFSRARSTVGEPLWLIPMHLRLLAEVEVRQRAAMQLGFFTVAVMGVVENPGDPGAAVPAHVPNGADATVVFRALTAVSKAVISKMAIVGIQECQEAMGGVGYMDEPDEPEFNVSRLLRNTAVNSIWEGTTNVLASEMVRFLLARENFAVFAAWVERVLGMIRGERVAHALGMAWTAFKGKAAREVASVLADGRRVMFTLAWILMGALLALDAERDGDAVAAEVARRWVLAGEGGVGDTVHRDIVKPYAAEADADEKEHARWDCRIVWGQELPPIQGAGHRSLKTNKL

SEQ ID NO: 37696 - protein, 114 aa, A.fumigatus
  UNSURE (2),(92),(108): Identity of amino acid sequences at the above locations are unknown.
SXGKKRFRAGCGGPRTGSGGNSLRRCRRAGDRWSCTPRKTGPCRSGCQSRPTRAGKTSLSRRLIVRGAAGPPRKMMFSPELCRSVRCPGFSXFGRMGICFHTNQLPHXKPSWRN

SEQ ID NO: 37697 - protein, 252 aa, A.fumigatus
RPVAFDFRIRPWSQSRGMTTQVRPQGELRSYNANLLSNGSLINSCLHRIIPTGYKMSGPSSRATSLFSSYPSTPVPSMVSRDPDSLDAWILGSGIASLTAAVHLIREAKVPPSRIHILETLSEPGAGSVSKGDAESGYHFRAECMPQFCGNRMEELLALVPSERPGKTVWDDIREYFEEHVSKKASRTRFLARQKNGLERIGRRRLHLGVKDRMDLFRLSSRAEDGLGRSRIQDHFSEGFFRTEYWLVPSTL

SEQ ID NO: 37698 - protein, 360 aa, A.fumigatus
LRYHARFGFRPCHSAVEFRRLIQHFPHDIQTHHPHPLDRLRFNLHESVVAPVARFLQAQGVDFRFNTTTTDIIVEPAQEPTRVTTLRTVYKREREVTIDLGPQDIIIVSLGSVLSGASYGSNTKPPSLEMMEIEKDLDDNWLLWLELASKHPKFGNAYNFCTRLRESRVAYFTVTAKNPAVFEKMLAIIGDDPATGSLVTLRDSSWLITLNMPRQPLFPDQPDGVRVFWGYALEPENHGDFVKKQMLSCSGEEMLTEVLHQLDLPVDEILPQTITVPCVMPRLTAVLLPRSNGDRPQVVPPGMSNMGLIGQFVDIPDEMVTMDYMVRGAQMAVHQLMGLEWEMKKSKKGSTVSLLGFPKD

SEQ ID NO: 37699 - protein, 142 aa, A.fumigatus
PNAPAAATSKTPKRGPPTTLSRPPPQPATTISPTTTRSAPSEKASTASAASNSSPPQPTPTSPSSSPRPPPRENSAPSSRPSGAPSPAPTKPPAKSPTGSASTASRTSSGPRISPPPSWSCGICARTSSGRATRASRRSRRC

SEQ ID NO: 37700 - protein, 573 aa, A.fumigatus
CVFFSILQNPDSKVANILLAVYYLYDSSRHATTDPAFGSLYKVAMTQYTQKAFKLDKEDPMTCALFGSYFLLRKSYSTVETLARKAIEHTDVMAIASDGWYLLGRKAHYEGDLARAAEYYSRADQARGGGDKGYLPAKFGTVQMQVSNQNYDDAKFRLEKIIQQTKNPECMILLGALHAEEVFAAQASGSKEDKSAEAKKAISLLESVRSLWKDEAKKVSPDESVLVYLSRLYEQVAPEKSMQCLTQLEEMQLAEIAEEEHPEGIEDEEELKAVLRTNLPPQLLNNMGCFMYQADKVEQARTLFQAALNACVRSQEKEAQLDTDALVTTISYNLGRAYEASNMQDEAKKVYEGLLERHADYTEANARLTYIALRQSPTDEGPKKMAKLYEADSTNLEVRALFGWYLSKSKKRAANLAEDHEQRHYKHTLQYFDKHDRYSLTGMGNVHLATARDMRRDTDQDKEKRRKMYERAVEFFDKALQLDPKNAYAAQGIAIALVDDRKDHAAAVHIFSKVRDTLRDPSVYLNLGHVYAELRQYSRSIEHYEAALSKDRARDAQILACFGRVWLLKGKQE

SEQ ID NO: 37701 - protein, 268 aa, A.fumigatus
  UNSURE (13): Identity of amino acid sequences at the above locations are unknown.
NLSAMKTALDYAXRAHAVAPTQVHLEFNVAFVQNQIASLAYSLPETQKTVQDVEEAAEGLHQAIETFGRIAKVKNPPYPAGALEQRANMGKTIIKQLERALQSQKEYEEKNAAKLQQAREAREAEIRKREEEVRKAQEAEQERKKKLAEERQRMIEEAQRLAEQRAEEERAREEAEMTVDSATGDKVRRMKKTSVEAQEEEAEDDFISDGETSRRTVSGEPGIEGEAAPKKPKRLERRSGGKAHSKYKSIEIVEDPDVGDDVHYAAAG

SEQ ID NO: 37702 - protein, 270 aa, A.fumigatus
  UNSURE (21),(24),(28),(53),(74): Identity of amino acid sequences at the above locations are unknown.
HWWKSLKGSKRPERGFKAGNXKAXLSFXVTCNMVQLLLYHYFYDPVDRSPLYXINKDYYYSNMALTKQSFGLVXTALTEWGCPTYVRVSGDESVRGQIHLCKDGRLKTQFPERLVLIANHQVYTDWIYLWWIAYTNQMHGRIFIILKESLKYIPIIGQGMTFYGFIFMARKWLSDKPRLQHRLEKLKTQTSGSESESPQYDPMWLLIFPEGTNLSPNTKRRSDEYGRKQGLPPLKHELLPRSTGLLFCLQQLKGTVDWVYDCSVAYEGPP

SEQ ID NO: 37703 - protein, 138 aa, A.fumigatus
HLPFTNCRKGSYPDKYFTLRSTYLQGRPPTSVNMYWRRFAMSDIPLDDQKEFDSWLRARWTEKDELLDEFFETGRFPTALAGSIDAGNVSDVQIEAASKGFVETHVRLHHWTELGRIFMVLTGMAVLCRLPKVFGLWD

SEQ ID NO: 37704 - protein, 295 aa, A.fumigatus
KSIMTSLENGYVNGNSFPSASSQVNLRFSDIPSAIDIPASTLDSEVEVSLEGLPDDPTELCTLLENEKAAKNFWVIIALAYAKQKQLDHAIDILNKGLASVGHGAAKEKLGLLGWVCWLLMLKSRQAPRVASEGELYTEAKTKDYYLQLATSTLNEASRLNPAFPPLFLARGVLCLLRASLHPPRPVRPGSVDTSERVESLRQALKCFEESSKAFGGRNVMAILGRSRAQYLLGRYAEALEGYQKVLMKMPGLTDPDPRIGIGCCLWQLGFKDQAKVAWERALAVVSYARLLGVS

SEQ ID NO: 37705 - protein, 202 aa, A.fumigatus
CTSSPTSGSSTISMLLYLLCALPPDRRSSRLGFFGAASPSMPGSPLTVRRDVSPSLMKSSSASSSCASTDVFFIRLTLSPVAESTVISASSRALSSSARCSASRWASSIIRCRSSASFFFRSCSASCAFRTSSSRLRISASRASRACCSFAAFFSSYSFWLCSARSNCLMIVLPMLARCSSAPAGYGGFFTLAMRPKVSIAW

SEQ ID NO: 37706 - protein, 115 aa, A.fumigatus
SRNSSGTHGGPSYATLQSYTQSTVPFSCCRQNSRPVDRGRSSCFRGGSPCFRPYSSLLRFVFGDRLVPSGKIRSHMGSYCGDSDSEPDVWVLSFSKRCCRRGLSDSHLRAMKMKP

SEQ ID NO: 37707 - protein, 117 aa, A.fumigatus
KIILAHLLRQPFPYWTVQLTPLIGGAILANLPHLGLPAVSAWVELLYLRAYLLFAFVAYMHWAFLVINRITTFLGINCLTIKKDRSMAREQAYRNFGESLLEVPDATDPLKGGLKHH

SEQ ID NO: 37708 - protein, 87 aa, A.fumigatus
SRFRIILWSMISDLISSILWSAKQALRMIDRLRIQALAYDTKGLYMSVGFPLRSVVTTLCFANWGYILSSMTSDFTSLVMAYATPIN

SEQ ID NO: 37709 - protein, 222 aa, A.fumigatus
RPGEEDGRYHRTDSRSSSAYLQEDCRGKLTLHPYVIRDNLLTGLSQLLEKADRTPRDELDEEKLVKEVRPLIEEGGQVLQECNGAIRALDPDGSIASTAKARAASHEASPEEYALAEKIKELSELVMTTIENGRKRIADMPHAKKKINPLWALLSDPLFQIIAAVGLLLSGVLGLVGRLLDTLGLGPLLNGLLGGLGLDKLLGGLGLSSLTDSLGITGSKKD

SEQ ID NO: 37710 - protein, 682 aa, A.fumigatus
ADDAVEQAKDKAEETTEQAKKTVTDLADLDGLPVSEGGVIKDKSGQVVAKIAEGDAEDLVGYTLNNEGEVLDEDGDPIGRAEIVSQQAKDATDGFDDTEKLAPEDQSTQEDVAKQAVESVQQQDVDDTAEKAESAADDTKEEAEEQLPPLSSLEGMKCTKSGKIVDPDTGKPIGELVEGDAKKISRMSAQLDDKGQFWDNRGNVIGKAKSLPVEDYEGEPPFAGLEGLHVVEDGWVEDENGKRVGKIVQGDPKKLLGRAVDEDGDITDKNGNVIAQAEYYESPDEPEPEKPDLSQLNGLKPNKLGFVIGPDGVPIARVVEGNPKELAGKEIDDGQIWDGRKPIGRVELIPEEERDKKPEGVFAGLDNLVVNKEGFVEDDEGNIVGKVTEGDPKKLRGRAVDEDGDIIDKYGNVKGHAEPYEPEEEEEEKPDLSVLEGKIVNKAGNVVDAQGNIYGRIVSGDGKRLAGRKVDGQGQIWGDNGNVIGRAEIVPGAEQEKPEGQFYGFDNVEVGKDGFVMAGGRIIGRVIEGDAKRLLGRKVDEDGDILDKNGNIIGKAERWEPEEKKRDVNPMSGRKVNKEGEIRDADGNLIGKLTTGNLPTLVGKSIDDNGYVVDNDGNKLGECTLLENLPEEEELEPGLTQEESEAQKKAEQDRDLAKKMAGIIGQTLDRLQPTCKRIAEVS

SEQ ID NO: 37711 - protein, 205 aa, A.fumigatus
PRATPRSSGAAPSMKMETSSTSTATLKGMPSLTSQKRRRKRSRIFPSWRERSSTRLATSLTPRATSTDVSFPEMVSASLAERWTARVKSGVTMEMSLAEQRSSRVQSRRSPKDSSTDSTMWKLAKMALSWPAAVSSAVSSKAMPNDSLVVRSTKTETFSTRMATSSARLNAGSQRRRSVMSTPCLAERSTKRARSVMLTVISLAN

SEQ ID NO: 37712 - protein, 99 aa, A.fumigatus
ALVIGCCNIGGTRPVRDRVPEYFQFSLHFRDHMEIYQDAMIQLRECSILRVNPNNSSAIYWTNYDGQKSGSHMFEVLIGFTCPNPLAHFHYDVKNIGMK

SEQ ID NO: 37713 - protein, 141 aa, A.fumigatus
TWGWMMETMITDSESGMAILHRYSVHQRMENDASFDLIDMAKKYGVLYLGTAWGDFDQALSPLRYYPTCTPYVSSLGPSCHFAADKTTTKFSKFFAALECDVFDGSPFTYEGVHSKRPSCVSVNSNSSDDDGNKYFVTLSY

SEQ ID NO: 37714 - protein, 68 aa, A.fumigatus
KTWLSSPISGPKRYDWVLEGDQMHEKQDTRPFGNGQWIYLRDGSNLTDLLNAELSLNIAKDVYSEFEK

SEQ ID NO: 37715 - protein, 503 aa, A.fumigatus
NLDLPPVVKTPKRTKLEDEGSAEVKLPDLPTPVTETPARTTVNGEATMTKVQHKFVLKGIQSLKRMNDARFYREPVDPIKMNIPHYPQIIKHPMDLGTIERKLKNNEYKTAQAVVDDFNLMVQNAVTFNGPDHLVSQEGLKLKGTFEKQMMNLPKADEVEEKKPKKVSTKTSAAHREPRTSIGTSTARPTAASPQATTFALGPEGLPLIRRDSTNTDGRPKRSIHPPKRDLPYSTKPKKKKYQWELRFCQEVLDELHKPKHYNWAAPFYFPVDPVALNIPTYHSIIKKPMDLSTVQSKLKTGQYENAKEFEVDMRQIFKNCFKFNIPGDPTYMAGQRFQEIFENKWAQKTRYLEAHEPHPEHQSVSSSSEESEEEEDESDTDNEKLTMLQKQIAEMSRQVEAITQKKKKTPPGSKKPGKSKSGKKDSKKSGTIPLGKKDKKASSKSSKPEKQRYVTYHEKQIISNGISSLPDKKMQEALKIIQSNVPALKVSFDLRLISKCRC

SEQ ID NO: 37716 - protein, 121 aa, A.fumigatus
SQNVGANVSFQGTQETEIELDIDELPNEVLLMLLKFVKKNAPHVIEEEDMTASTAANMAAPKPKKNKPMSKYEQEAQINMLESNLSRFQGGGGRSPDPLPSVEANESSDDSEDDSEESEEE

SEQ ID NO: 37717 - protein, 84 aa, A.fumigatus
SDLSIHTNFGTTIPWSLPHLRPKVRMTRYGGMGRTRPKKLTSKASIPIVREHEIDIIDDEVQNALQQVETGVEKAEESVSVSPN

SEQ ID NO: 37718 - protein, 562 aa, A.fumigatus
EFHLQAAISATAQGKVNEAHIPTPETVLSNLRYDELYPPIFSQPATYIRFSSTVEDCCGCPYNMTEEDDVFFKIMNEKREPSNRITEDQFEEVMYFFEETAQTKQPFAAVDSPPVLSFAEMQDSMDATVEESVKCFAKDIYEHWKLRRIATGNRPLLPSLKVSRPHRMTPYFPRLTMSSLKLVKIPMIQTRMSAFVGVKSVRFGRPAAEMPKVPTNCADSERSWKMLDSWFALVRQRELARKEMLSMERQIFLQRSEVKEMKRKLNIKDDDEDLINQKVTSIPARLPHAFANLPEQPKKKPAEAPAAQRPTAPQIRMPQKPGTQAADDMQLLEDVQAEKENEILRDIKQNIAKHIKWNEGYVDYTRAPLSPPPEKTFQAAFRPAITTQLPTPPSSDSSDNMMLESALDTANSLSFRDKLVPRTWEMNEDTCRIPSFRRRIGRGGRLMIDRRNMASRCRIEMDPLKADRFKYDREDSDDESEFECDPYDVQIMQHRAIMAAKARDQAAAAAQAHAQAQAAQAQAQAQAQKRLQAEQTTTNNGPPNMGHTMGSNPGPGAVASTS

SEQ ID NO: 37719 - protein, 166 aa, A.fumigatus
LAFLEDLELLDDGYVIPRPSPEDSLTDFLPDELLVLVKTLTLSSEQLEHQKSKSKAPKPSFGHAEAAILLKAVQLVGSQYPTTVAQDEEILSGLVQSEASQPLNQTDRRQKMAIQVRLGEKYILQTLANMLEKFITNSAQSNGGSGLKRGANGDSGDSRRTKAPKN

SEQ ID NO: 37720 - protein, 63 aa, A.fumigatus
DGSRNTRGRGLPSCGRGVVPPTSTIAGPIANNGSGISACLSSPPEMPMGLLSVYPKTCISKFS

SEQ ID NO: 37721 - protein, 263 aa, A.fumigatus
KCEAQRNKIVLPQNRSRLLLALIPDFLTIYPCAQIIKDWAAGFQLPSDVDPEQPPFLLGAQDCFWEAAGAYTGEVSPASLRSLGVRLVELGHAERRALFGETDDQVARKAAAAVDQGLIPLVCIGEVTAPGAIASEAVGLAVRECAGQMRAVLDAIPSAAPVIFAYEPVWAIGKAKPAGVDHVAAVVEGIRAVIGKREGEVRVLYRGTAGPGLWGAGRLGKAVDGMFLGEFAHEIEGVQKVVQGSGRKLVRAIADSLARSFFR

SEQ ID NO: 37722 - protein, 420 aa, A.fumigatus
FDAAIMAPETPQPIDPADLPLLMTLDQLKNPAPKNANVSFLRRTQYISAGLRAPDGPKVAPIRAKARSADKTKSQDDPMYIKKYIQKGFDIAYPDSRHVGEDTPNRIKGHTPTKIEVDAWANPVHPDNPKLKPVGFYPLLPDLQGFPDPGGFVQFKFDKAPVQGVSGKRDERMDVAILLPSAPEERVCQEHATKAALHKSNPELYPDPGPIPWDYDLFLPEKKDAVKEVIASLRLSNPDRDSEVLYTHEGTDGIRFHRYERMRTYATSAQTLGNESKQRDVALTLFDPAEAKEGQQTKQRGAYYYPILGKTRLKPERARTIAQAGLAPTRPKTKEDQVDQIQVVVRDPDEAEVYKRSLHRAAIDPKFAKTLPPPPEPESAPEQEHPETHDSDRGEEVTEDRNHQPTAAEVSDDEDKMSDE

SEQ ID NO: 37723 - protein, 194 aa, A.fumigatus
  UNSURE (47): Identity of amino acid sequences at the above locations are unknown.
GVDRKTKPYVMVKVSLDDDSDEQVSCICDAVWQFGVDRAYRGNTTNXRPAPLPHGFTLPPKEQSTLKETGGYSGPQLFDRTAALVARYRALLDAPPTPASDANETDQAKELAAAVTRAEPDVENVPAVEPPTPANRPARKVIFASGGITNGKQAQAVLDAGASVAMMYTAVTYGGIGTVTRVKQELREEKKNRQ

SEQ ID NO: 37724 - protein, 208 aa, A.fumigatus
IVSIVHDHNDHPSILHLKKLLASESAIALTSFLPLPWTTFWTPSISCANSPRNIPSTALPSLPAPHSPGPAVPRYKTLTSPSRFPITARIPSTTAATWSTPAGFAFPIAQTGSYAKITGAAEGIASSTARIWPAHSRTASPTASDAIAPGAVTSPMQTRGIRPWSTAAAALRATWSSVSPKRARRSAWPNSTRRTPSERSEAGETSPV

SEQ ID NO: 37725 - protein, 157 aa, A.fumigatus
QGRLVMVANSTSLAWKSAGLRARAVPSLRCSHRSSVLHRQAAFQQHGAVRHASSTTSEAAEAVKEAPKKAGRGLKRTVYGTSLVLAALVGYVYATDTRASIHRYAVVPLVRTLYPDAEEAHHIGVEALKTLYKYGLHPRERGNQDGDGVLATEVIQP

SEQ ID NO: 37726 - protein, 204 aa, A.fumigatus
LNLLMQVFGYTLNNPIGISGGLDKHAEIPDPLFAIGPAIVEVGGTTPLPQEGNPRPRVFRLPSQKAMINRYGLNSLGADHMAAILERRVRDFAYANGFGLHDEAEQRVLDGEAGVPPGSLQPGRLLAVQIAKNKATPDSDIEAIKRDYVYCVDRLAKYADILVVNVSSPNTPCLRDLQATAPLTAILKAVVSAARGSTARPSRM

SEQ ID NO: 37727 - protein, 122 aa, A.fumigatus
QVFFHFLGPLFGHLQFHAQTPPETSHQRPCPAFQPPTAPAPRFPGTKPSLPLLASQSPPESLPPQPQHGPPPQASLSQSPKQAHMQRSPAQRRGSHPAPRASGPHTHAPPAPPLLTRSPPAQ

SEQ ID NO: 37728 - protein, 316 aa, A.fumigatus
CSWEVYDNAPDLSSPPTAGVQNGTLMDDGDHGKAVKICYLTEQTSHHPPVSAFFIDCPERGVSARGFDQLSAKFTGTSIRVAPGQHNLGIFVNIEKRDNEEYQLTHPSAHLGGLLRGALAVSVSDTCFITCSKTRIKVILQYLEEGWIGRAQNKVEGLIFRYDPNQDTITRIKDVPDGDVLARISGSWHGEIYYTVAGTAEPRLLIDVTPLFPVPKTLPPEEDQLSNESLKFWAGVTKAIKEKRYSEATRLKQEIEERQREKAAERQQKNESWQPRFFTGSVTPMGRPELTEEGYTALQGLRNGDYKLAESEIKGA

SEQ ID NO: 37729 - protein, 291 aa, A.fumigatus
GCSRPRPKDLFARTFSVLFIVGHIAIKQIFHLEPCELDFRVRKAGQESHKVAITAAHKDNQTGEDDELDLIGGTTEDDFTEAMSHIRERELLYGENSLLSNFGPLVAEICSNSNAYPDRNLQAAATLCMAKLMCVSAEYCEKNLPLLITIMERSEDPTVRSNAVIALGDMAVCFNHLIDENTDFLYRRLNDDDVSVKRTCLMTLTFLILAGQVKVKGQLGEMAKCLEDDDKRIADLARMFFTELATKDNAVYNHFVDMFSLLSAERNLEETALRRIVKFLIGFVEKVSYKT

SEQ ID NO: 37730 - protein, 149 aa, A.fumigatus
NLPTYTMENVQPLWNADPMIRHLLAAFRDTFSNRGSIHHLHRHHPVINLHVPFPQALSGNLHHAPLSQITNGHAVNNGLQVQPQRSPRPPPPTPALPPHPPRPPPQARSRDAHPGRLIREKRVPRTQKRRESSAYCTLPRFSSGQIEQC

SEQ ID NO: 37731 - protein, 202 aa, A.fumigatus
CLHIKRCVYQCLTATLTPYHLQVMTNHFDQEKYTSAGPINRTYIYIQRNHSPATEALYSLPSQTNKMPPKTSIMENPSSKIPPPASALQKAPTLKPRRGVLRDGTPVTMYPIAHGASSIPSGLVATLADEFRAEIEAGCTYPMEEPMGEAKFAEYWFGTFAVVALTGDEEEIREGRDWKKECLGTFYIKPNYPGNLFCIQFV

SEQ ID NO: 37732 - protein, 137 aa, A.fumigatus
FAISSPPSGIHSPTAAVSIIFIVIIQSSICTFLSLKHFLATYTMRLFHRLLMATPSTMGSKSSLSEALALLPPLQLYRRILRVHRRKLDPEMRILGDSYVKSEFRAHRNVENPLHIVRFPVFPQVKLSSAKACRSAS

SEQ ID NO: 37733 - protein, 62 aa, A.fumigatus
QPTEYEDLDILFVYYYASAQKLATGGCISLILTAFMSIFSFALVQRYKIPCMQLALGLEARA

SEQ ID NO: 37734 - protein, 84 aa, A.fumigatus
EISLHILTITNFSHPACVPLFPTDSAFHPPPHPRILSLTSSGRFCAQSSTYATPRSGCNTPGSASSNRFVVSIPSNPPAYVNDR

SEQ ID NO: 37735 - protein, 274 aa, A.fumigatus
  UNSURE (142),(156),(168): Identity of amino acid sequences at the above locations are unknown.
NLQGCKLHNMLPTPSTDHVSFDTIYEPSEDSYLFLDTLSSASESQWLSERFNSTSTTTSTFPLVVEVGTGSGVVLAFVAANSHEIFGRRDILTLGTDVNRNACVATRTTVKTAIQERQAAAALKSTHVASVLGDLCSPLRPXSVDVLLFNPPYVPXEELARLPFVTEXEADPAAEPLSRSAKFERDSYYLSLTYAGGLDGMETTNRLLEALPGVLHPERGVAYVLLCAQNRPEEVKERIRGWGGGWKAESVGNSGTQAGWEKLVIVRIWRDISQ

SEQ ID NO: 37736 - protein, 142 aa, A.fumigatus
GGGGAESKKRAFRGGGGGGAGGGGGGGGGEGGGGGGGGRRGGGGGGGGGGGWGRGGSERGAGEGGGGGGREGGEGGGQNEVHIDRRWGGCGGGGGGGAGGGVGGTCGSAGGGRWGVEGGEGGGGGGEGGGCGGGVVVGGGEG

SEQ ID NO: 37737 - protein, 616 aa, A.fumigatus
ETHDSLRLKTMSSVFGSQPPRFSPPQSAQPYRSIFGGPSSQDVTDLEPYPETQQGGNRPDQHDSDVDMEDVPLTEVDHSDDETYVESEDDGSVSDDEASNDGDSYKLAKKQAAVLPSSSKQHPDSPPSSPSYRPNRFRGPESTWRKLTFEDRQNAQALEELRARDLAAHLYNAFALRVRAREIARQALESDKQLDETEAFVPPKRWTAWPVPATEVPRPGEHLRRQIDDEWTLRMPPDPRPSAELEESIIAIMLKTAKDRFQARDWTTKGVGPNQKQRARSMSQTNDETTGIESEWECDIDTTDAMELRPVVQADDDKSRRQLRPLTRNILTRFDQLLMGLHHARKGGMTGDDSSASEWQSDTESAASNASHSRKMRKGEKGERSQSRGRKRSRRSSVRATSTTGRSRSVLASSARTPSHSRGRSFDRDRRRSASRIRRGLRDWSEVLGVASIIGLPHAAVMRTARRCAALFGEDMEFRTFSEGQLQHSKEGDVNKWEYVENETDESEPEQIVPSPPSRTQSRKSRSRAASTIGSTSRPSSPTSEAAGSKQRLKGKGQHRKQDIVCPVKSCPRHIDGFTRTWNLNLHMKRMHAGYRSRSASLKSAGARSRAPSVSG

SEQ ID NO: 37738 - protein, 202 aa, A.fumigatus
NFSGPGLETWLFLRQNLDPYDPRPPAPPPLPQPPHPPPDLPRPAHNTLSPHTAPRTPTLYPSPPPTTTPPPHPPPSPPPPPPSPPSTPHRPPPADPHVPPTPPPAPPPPPPPHPPHLLSIWTSFCPPPSPPSLPPPPPPSPAPLSLPPRPHPPPPPPPPPPPRRPPPPPPPPSPPPPPPPPPAPPPPPPRKALFLDSAPPPP

SEQ ID NO: 37739 - protein, 207 aa, A.fumigatus
CKFLSRILADQAWKHGFSCGKISTPTTPDRLHHPHSPNHPTPPPTSRDPPTTPSPPTPLPAHPLSTPPPPPRPPPPHTPHPPPPPPPPPPPPPPTAPPQQTRTSPQLPPPPPPPPPPRTPPTSYLYGPHFAPPLLPPPFPPPPPPPPPPSHCPPAPTPPPPPPHPPPPAAPPLPPPPLPPLPPPLPPPPPPPPHPGKPSSWIPPPPP

SEQ ID NO: 37740 - protein, 199 aa, A.fumigatus
RTRLGNMAFPAAKSRPLRPPTACTTPTPPTTPPPPRPPATRPQHPLPPHRSPHTHSLPLPPPHDHPPPTPPTLPPPPPPLPPLHPPPPPPSRPARPPNSPPRPPPPPPPAPPPPPIYMDLILPPPFSPLPSPPPPPLPRPPLTAPPPPPPPPPPPTPPPPPPPPSPPPPFPPSPPPSPPRPPPPPTPESPLLGFRPPPP

SEQ ID NO: 37741 - protein, 73 aa, A.fumigatus
SAPIGEDRKFPNGIAHLADKVHKLGLKIGIYSSAGRWTCARYEGSLGYEEKDAALWASWGVCSLSGSPGVLQG

SEQ ID NO: 37742 - protein, 246 aa, A.fumigatus
VPLPPSKPQCNNIQPRPKDGKFTLTRRTEVGNGGLTDDESIAHMSLWAALKSPLLMTNVMTKIDPPTLSILQNPAVLAVSQDPLASTPVRQWRYFVDDVDENGKGEIQMYSGPLSGGDQLVLLLNAGSKAREMNATLVDIFWESGAKGTAKQVKQHWDVYDLWANRMSNEDAAAIINGTFTGPSPYNLTAMGGAHEVYSRPLPSNSKVLMGSKVGSVQPSGTVTAYVRPHGVAMLRLRATDKKDEL

SEQ ID NO: 37743 - protein, 148 aa, A.fumigatus
IDYLKYDNCYNEGEEGTPKLSFDRYNAMFKALNATGRPMLYSLCNWGVDGPWNFAPTIANSWRTTGDLSNVWDRDDVNCPCSELDGLDCKTPGYKCSIMNVLNKAVYYPSKAIPGAWNDLDMLRKFHFPPANPNATTFNPARRMGNSR

SEQ ID NO: 37744 - protein, 207 aa, A.fumigatus
AAPPLLGVGAVDSVADPGTRAALRSLFSESLTFRNPPPPEARIAARRSSLPPVGLGRGGAAPLAGGGGGGAPAPGGGGGGGGAEPPGAGGGGGGGGGPPIDGGGGGGGGAGGPELTGGGGGGDGGTLVEGGGGGGGGGGTALVTGGGGVGREAAGTGGGGGGGTGLRAGGGGGGPAAEVGTCGTLGGSCGGVAGLRGGGGGGPGVPS

SEQ ID NO: 37745 - protein, 86 aa, A.fumigatus
CRASSASSASSPFNECSTITSPSSSSELRATRSSASSSSPVNRRASTTPAASAGSWRLCASPTSASSWCRCTSPTSPCEWRGSTSA

SEQ ID NO: 37746 - protein, 216 aa, A.fumigatus
INDRLKYGLLPRDLRKIDSSTLPHILVRPSAILINLLHLRVLIKHDRVLVFDAYGSTDSYMQSLFVYDLEGKLQQKQTGGFGALPYEFRALEAVLISVTTGLEEEFNGVREPVVRVLRALEEDIDRDKLRHLLIYSKKLGTFEQKARLVRDAIDDLLEADDDLAAMYLTERANGVQREEDDHQEVEMLLESYHKVCDEIVQASGNLVTSIRNTEEV

SEQ ID NO: 37747 - protein, 204 aa, A.fumigatus
VFLFGPNWSGYAVTDCFSVKAILDANRNSLMLLDLKFSIGTLGLATGTLFSALYGMNLKNFIEESDLGFGAVSMTCFMITAVVCVYGLAKLRKLQRVRMWGEAGVGGAPLTPLTTRSGILSGHRSNWRADSIEPVWGSLPGEARTERIKRLRETAAAAAARSASADATAQRASALRSSANANGGAPKGSEHSPTRETEASGSSA

SEQ ID NO: 37748 - protein, 243 aa, A.fumigatus
LGTPGPPPPPPRSPATPPQLPPKVPHVPTSAAGPPPPPPARNPVPPPPPPPVPAASRPTPPPPVTSAVPPPPPPPPPPSTSVPPSPPPPPPVSSGPPAPPPPPPPPSIGGPPPPPPPPPAPGGSAPPPPPPPPGAGAPPPPPPASGAAPPLPKPTGGREDLLAAIRASGGGGLRKVKDSEKRDRSAALVPGSATESTAPTPSSGGAAQGGLAGALQDALAKRKQKVSGSGKFLPHQLFASKTS

SEQ ID NO: 37749 - protein, 306 aa, A.fumigatus
VHRVFFLLSPLIPLRVALTNSGSSHVHSPLAAFSLTPSKTSVRAGSAETRERRRHDPFLMAQSRQRKAANLSRQQALAREREESLGDPVESKPTPFIEELKGLKAPTSEDAALNHFISPEGLQEALEYSKSLTSPLENPDRETADPQLEKEAAERHLQEHRNAQEAIRRIININNGNTKDRTRLLIQKCIDTFGRHNTDKILPPKPTAVAQDSSTVHPKKTPRIGPDTGSPEVQVAILTAKIINLSRHLQSTNKDKHNKRNLRLLVHKRQKLLRYLRRKERGGPRWQHLIETLGLSDAAWKGEISM

SEQ ID NO: 37750 - protein, 268 aa, A.fumigatus
GRSGRAGGPVTTVSLPAGGGSSGSREGGARNTSTRSLGIPVLTSEAGLDSTGANLLSTGDLSLIGNLLVLLGFRVTVEVEIDNNVPLGLTSGESTTETENFTGKQPPDQTNGVTTLVVGGDGNINELGGGVSVAESDDGDVDVAGLLDSLSIGARVGDDDEAGLLERTGDVVGEVTGGETTGNGGGTGVRSELQDSTLAVGTSGDDTDVGGVLNGSDDTSSQEDLLPTNSRSRIRASHQSPDNQKFKATYQVLPMLMTLTPSGRVFQR

SEQ ID NO: 37751 - protein, 255 aa, A.fumigatus
HWQDLVCRLEFLIIGTLVTGSNTGSRICREKILLAARIIAAIENPADICVISARPYGQRAVLKFASHTGATAIAGRFTPGNFTNYITRSFKEPRLIIVTDPRTDAQAIKEASYVNIPVIALCDTDSPTEFVDVAIPTNNKGRHAIGLIWWLLAREVLRLRGTLATRETEWDVVVDLYFYRDPEAEENKEIADEAKVPGAEEIGAGAVESGFAGENWDTQAPGAGVPGTAFSAATAAPTSWEADGGDWAASSAAPA

SEQ ID NO: 37752 - protein, 69 aa, A.fumigatus
QYQSTTMAPSQLPPIFNPTPQDIEMLLAAQCHLGSKNLQVHMEPYLWKTRPDGVNVINIGKTWYVALNF

SEQ ID NO: 37753 - protein, 68 aa, A.fumigatus
DTIRWASDIFAVGKTSLITRFMYDSFDNTYQATIGIDFLSKVDFTSFTDNLRRRSRILLRLPITEYAG

SEQ ID NO: 37754 - protein, 227 aa, A.fumigatus
TMYLEDRTVRLQLWDTAGQERFRSLIPSYIRDSSVAVVVYDISNAKSFQNTRKWIDDVRGERGNDVIIVLVGNKTDLNDKREVTTAQGEEEAKKNGLMFIETSAKVGHNVKQLFRRIAQALPGMEGEANRESQSGFICCSRRLASSETDCSSYSDRRQYQPQRDDKQRWMRVLILYQPFDYLFIIATRPFDDLISMTIIEIVHNVLPFLICTLPVSIPCFRSNSVLD

SEQ ID NO: 37755 - protein, 127 aa, A.fumigatus
SCQLLTYVIRGIFLTGSSIVGGGVKAPRIRTKNLISIIFCEVVAIYGVIMAIVFSSKLNLVEGDEIFSGSNYYTGYALFWGGITVGACNLICGISVGINGSGAALADAADPSLFVPDPLAYFLRTHS

SEQ ID NO: 37756 - protein, 109 aa, A.fumigatus
KDHLIAADLKQSDTYKMTESRVPSSRLGRLWQYSGLATSMAFGAVGEGLRRMTGGKDDYAGSIMFSPGNMERLVAKLSKMRGAALKLGQMLSFQGWYSGVPPSLRCGGH

SEQ ID NO: 37757 - protein, 393 aa, A.fumigatus
VFRVGIREFLLPCVVVDTNSFSDNKMLPEAIHQVLQRVQDRADYMPASQRDKVLADNLGPNWRDLFSTFDEVPMAAASIGQVHGAVLKRTGQPVAVKVQYPGVAESIDSDLNNLSILLTASRLLPRGLYLDKTIANARTELAWECDYIREAECGNRFRELVKDDPVFLVPEIIPEASGKQVLTMERLEGIAVTKIHDFTQAQRDWIGTQILRLSLREITEFRFMQTDPNWTNFLYNAKTNKLELLDFGASREYPVEFISKYNRTLIAASRNDRERCHSLSIELGYLTGHESKTMVDAHVSSILTLAEPFMDSSPDVYDFRNQTITDRVRRLIPVMIRERLSPPPEETYSLHRKLSGAFLLCARLGSQVRCKELFADAIQKAEKSGLDVGSTRK

SEQ ID NO: 37758 - protein, 79 aa, A.fumigatus
ARISFFMRESTILYLPFTPRGRPEIPLLAPLATTNFTCCLGFFLTALLINFAMVCDLSLSLSASSSASKADFLRSFSSL

SEQ ID NO: 37759 - protein, 105 aa, A.fumigatus
AAFIFLRPLASITFLMGRALMARSFSLIAAAAAFVIGRWGLECLFSSSRNHSGRPSTSRKVYRLKPSSIMSWDFFSPVAICWASAMASAVMISISGVKKDVSDSG

SEQ ID NO: 37760 - protein, 104 aa, A.fumigatus
EVIDDLIVELRCKGLVVDQNNICAFQNINDALLLQKVATDKVCFPWRNTPEPAACSKLGLLKFCQVTSIGHHLAAPTFTSNFKRSLQNDITNSRSKIDKDVPRF

SEQ ID NO: 37761 - protein, 172 aa, A.fumigatus
SSSLSLSISASFPDAMTSLAPSLSTRFKEKVASSPPGPSCSMPMSIGVVICICMRIISLRFFSFSLRLSFLRLALSFSWRRCSSSWMANSSSMGATSATSSGSSALACPFLTTSPNFSRTFKRHRSRLRNSFLPRIFKSSQQVRISSVVSSSLFNVANARSPPGDCSKLSLL

SEQ ID NO: 37762 - protein, 199 aa, A.fumigatus
VGTFQPESLTSFFTPDIDIITAEAMALAQQMATGEKKSQDIIDDGFNRYTFRDVDGLPEWFLDDENKHSKPQRPITKAAAAAIKEKLRAINARPIKKVMEAKGRKKMKAAQRLEKLRKKSALLADDEALSERDKSQTIAKLMSKAVKKKPKQQVKLVVARGANRGISGRPRGVKGKYKIVDSRMKKDIRAQKRLAKKKK

SEQ ID NO: 37763 - protein, 75 aa, A.fumigatus
FPSYVGRLLCANIDQHGKGRLDKWYRLAKEKGYRARAAFKLIQLNKKYGFLEKSKVLLDLCAAPGVRLVTPFFSR

SEQ ID NO: 37764 - protein, 342 aa, A.fumigatus
RKVCTSGLVIPVTQSNCLIWCRFNLVVPRDNDDFKPIDDIVHVIDIVSENYIPESEADFFNNESTGIKRRLRRALAHSSETEFREAVASYNREIERLRRSGAIAKHLDATHRLNLPLVERILTQIYARTVSPRVESLRRYENGTDNVYGELLPRFISTIFKETRLKSGHVFVDLGSGVGNVVLQAALEIGCESWGCEMMANACDLAELQQTEFRARCRLWGIAPGKTNLVRGDFLQEQSIIDVLKRADVVLINNQAFTPQLNNEIINHFLDMKEGCQIVSLKSFVPAGHKIQSRNLYSPINLLKVKQLNYWSNSVSWTDVGGTYFIATKDSSRLKAFADSME

SEQ ID NO: 37765 - protein, 492 aa, A.fumigatus
SWCQVAAECMPTQSIIIGVDLAPIKPIPRVITFQSDITTEKCRATIRQHLKHWKADTVLHDGAPNVGTAWVQDAFSQAELVLQSMKLATEFLVEGGTFVTKVFRSKDYNPLLWVFKQLFTSVEATKPPSSRNVSAEIFVVCRGFKAPKRIDPKFLDPKHVFAELTDSTPNNEARVFNPEKKKRKREGYEEGDYTQFKEIPVTEFINTTDPIAILGTYNKLSFEQSPGGDLALATLNRLEETTDEIRTCCEDLKILGKKEFRSLLRWRLKVREKFGLVVKKGQAKADEPEEVAEVAPMDEELAIQEELQRLQEKESAKRKKERRKENEKKRKEIIRMQMHMTTPMDIGMEQLGPGGDDATFSLKRVERDGARDVIASGKLAEIESDSEDDQTESDYDESDDEGDRLERELDSLYEQYQERREDRDSKVRAKKARKDYEAEEWDGFSDSDKEDDEESEEDGASQAVVKPAPPNSGTLSSKAAMFFDQDIFHGYR

SEQ ID NO: 37766 - protein, 190 aa, A.fumigatus
LRSMGFFDHLQKGGAFSLQAQKPQIRKVVQTRPPPPSRSSSHTPVRSSSQTSPPGRVKRPRDSTSRSVSRDPDHRPSKRLSTPLRNRKRPTPEQRFSSDDDASDTDTSFELRKRARTEDSAEPDLARRIRSLKAFSEENVKPLPLVHAADITSKQKAGNFRRAFGGADRPTEILLQYPSASLKERFALQV

SEQ ID NO: 37767 - protein, 157 aa, A.fumigatus
VLSKSSFRCMELLTPASEKVLGQLKGEEREGLIDQIRPLLSQLKKFSYGKQIVAIEKLIFDSTTLGANSLPPASSTTPPHSHKSSPQPSKRLVNDVENSRAPVVGAAPPTPPPTDNQGHTHGPAESKNLAKSTVTSLSVSESASADSNGSVPVSAST

SEQ ID NO: 37768 - protein, 409 aa, A.fumigatus
SFRVGLIGVKTTDSYFSIPISSGIGSSSGGGNHKTYLNAGADGISPCGYGLSFGNFGGLRSGDGRRHPNSSAFGGSPVGTGFPMKQGFTTLDTTRPDEITGSLTMSSLPQALPDTMSHPLARNGFAHASHNSASITSQRPTHASHPSFHSESQGFEGRFGGSSMDLSAEINTLQLNEGGFSGHPVSRPPYLSHSSYDGSLQRFKYQSAADESSYEAVGGYAGDGLSELPLGHHAGRSRLGEGSLSPTDLARMESTFYSALEAGAVPGSHYRNGSATRLSENQALALERKLRAMQHDQDLAHGAANSLQRIPYNTPAYDLAGYQAARLNALSGFYPVAQLGGLGSAGIIPRGHRDQDPAQVVRSPLLEEFRANSKGNKRYELKVCIFVSLYYSRAKTILIILAGHLQSHC

SEQ ID NO: 37769 - protein, 199 aa, A.fumigatus
ALEHILTDQQASMVKELENHVLKCVRDQNGNHVIQKAIERVPSQYVQFIINAFKGQVSRLAAHPYGCRVIQRMLEHCEEVDRESILAELHACTAHLIPDQFGNYVIQHVIENGEEKDRSRMINVVLSQLLMYSKHKFASNVVEKSIEFGEESQRQQIISTLTSANERGESPLLGLMRDQYGNYVIRESFPSPRFDVWNC

SEQ ID NO: 37770 - protein, 104 aa, A.fumigatus
SLQDIYNHIVEFSGDQHGSRFIQQKLETANSDEKEQVFREIQPNCLQLMTDVFGNYVVQKLFEHGNQSQKKILANQMKGHVLALSTQMYGCRVVQKVWLLHAKG

SEQ ID NO: 37771 - protein, 75 aa, A.fumigatus
LNGSEIRPGPHWPSFPSLQREYKVGPFPPLLPLSLDIREDTTGLSTSFLPHGSGSPCLVSLCEMSTKDHEVEAAQ

SEQ ID NO: 37772 - protein, 67 aa, A.fumigatus
ATNALPLNSRASSLCACQPLNHRNALTNPNTPHSAEYTFYQIFCMSSAYLDTEGVIYIIAQGRRMGR

SEQ ID NO: 37773 - protein, 74 aa, A.fumigatus
  UNSURE (13),(24): Identity of amino acid sequences at the above locations are unknown.
CLEALTGVCALGXTLTNAQAYSPXVPLAQKEKCNQVQLGHCQLQIGFDFFSLMALETMTLKTKRPYLAHWAPII

SEQ ID NO: 37774 - protein, 239 aa, A.fumigatus
LVVVQGQYVKSLSFPSMPTFLRIFEPRYCLMIRRVMESRERKFGMVMYNRLGRPQGQLGATQFMQYGVVLRVERFEPLPGGRSLIFAMGVSRFKVIKSHIVDGYHVGQIQRVDDIPIAEEENLESWETSTIPHRSTEARPSQQPLDSMSTQELFQLGLDFVRKRRGEGARWLHPRVLMAYGDIPSDPAQFPWWLACVFPVSEEEKYALLSATSVRERLKITAQWARKAEARERYVLKCH

SEQ ID NO: 37775 - protein, 61 aa, A.fumigatus
LAVPLLVFGLIPLALGPITSSTSVRSAGVLTSFSPLSFSVSVSFGSASPATYYINQRWIAR

SEQ ID NO: 37776 - protein, 71 aa, A.fumigatus
PNLTAAKYGRANFPYPNDSLSEKSVYLYTSTADISQTSRWLTTAFFLGSRLQEDQISCRVDLYTACTEHCK

SEQ ID NO: 37777 - protein, 194 aa, A.fumigatus
CMITYQVTQPYVVADHSLLQILVYGANLPSLSPKVSGELYEQQDYDGLEIRPVTQFKSSNNHGNASCEVGENYEDDPEDDGIVSPNSDEKDDFDESRSADSESSPAGQRTVFIRGLPDRATHQDVVDAVRGGALLHLYLRARDHAAYVSFVEPAAAAEFLQHAKTLGCHISGKRVRKPIETVAHVLVLNHSSSS

SEQ ID NO: 37778 - protein, 136 aa, A.fumigatus
  UNSURE (94),(105): Identity of amino acid sequences at the above locations are unknown.
VEVSWNDRQFYLPPYVGSKIRNGATRNLVIHNVNSNITESIIRRDLDHIHNLIVITVKFKQGNAYISTNSVHNALFARSCMMSRGAYRGMRIGXYPDECAGLLSXRPSGPKREVQPSSIRSLSASNRFRLLFLDGS

SEQ ID NO: 37779 - protein, 75 aa, A.fumigatus
GVVQYKYMCNGFDRLSYTLPGNMTAKSFCMLQEFGSGSWFNKRDVSGVIPSPKVKVQQSTASHCINDILMCGPVR

SEQ ID NO: 37780 - protein, 61 aa, A.fumigatus
FVALLRARLLSVYPFLSDQICFSARIEWAEILVQAAAQRGMPRITHYIIIIVLLFFAFGEV

SEQ ID NO: 37781 - protein, 116 aa, A.fumigatus
FTLFGHARWLNRARLLRVMPENRESNTDNHDLSISGTTPTNTAVPIYLPPTQLHNWTASFLAPLPLAGYCMIVLLFPGPNDAFGRGLPNSFPKFVKGYWICETWPNQKSCRWVVRQ

SEQ ID NO: 37782 - protein, 64 aa, A.fumigatus
SDAMGKKGAKNKKKNNNNNNKQRLPVNDNKFSLSEDNPTAEPGLAVAAEAGDHGQPTVCTASQV

SEQ ID NO: 37783 - protein, 249 aa, A.fumigatus
MKVLHRKAKKETATVCFGIPKCIKSQLTSFPEDDFPECDPSAELDKVEAEKAEAARQAEEDAKAEEEAEAAAAAAAAAGVPDDVDIDIGNENSPTDTPDNEEAAPAQGDPPTNESAEEDVTKPDTENSPAPDGPAEEQSDSPPEAEQPVAEVQVPTEEQPAPKKPAPEPSSEEPAAPTETAENNTSEEAVAPEGATADIAADETTKPESTDEKAPEEPAAAESPVEDKQDEATKALAASSPRGWKEPRH

SEQ ID NO: 37784 - protein, 138 aa, A.fumigatus
TIISFPSLKTTLQPSLALQWPPRLGTMANLQYAQLPKFEYQTFERQYQTFDRQTLQFSFYPVTAAASSDGLTSDKDQDTTDNATHSEEGPSLESAPVEESGSPVDAAPAPESEGTHDCQSPLSRFDRGSPSSHSFRVT

SEQ ID NO: 37785 - protein, 144 aa, A.fumigatus
KNQVLPLTLRLHPNLKVRMIVNRHFLALIGVHLPHIHLESPEAAAAPPEPDPSDEPAPEAKEEAESAPEADGTKQKAEDAANPAEPETPAATEDAAQDSPPEDGDGAAAAVDESPAPESKEGDSNGMLWDTEMHKKPANLIPRG

SEQ ID NO: 37786 - protein, 261 aa, A.fumigatus
WRGSFQPRGEDAARAFVASSCLSSTGLSAAAGSSGAFSSVDSGFVVSSAAISAVAPSGATASSEVLFSAVSVGAAGSSEEGSGAGFLGAGCSSVGTCTSATGCSASGGESLCSSAGPSGAGLFSVSGFVTSSSADSFVGGSPCAGAASSLSGVSVGEFSFPMSISTSSGTPAAAAAAAAASASSSAFASSSACRAASAFSASTLSSSADGSHSGKSSSGNEVSWLFMHFGIPKHTVAVSFFAFRCRTFIYRRCGTITVLGR

SEQ ID NO: 37787 - protein, 168 aa, A.fumigatus
VSSHFQCQYQRHQEPLLQQLLQLLLLPPLLLLHLPPLAVPLPLFRPRPYRAPRMGHILGNHPLGMRLAGFLCISVSQSIPLLSPSLLSGAGLSSTAAAAPSPSSGGESCAASSVAAGVSGSAGLAASSAFCLVPSASGADSASSLASGAGSSDGSGSGGAAAASGDSK

SEQ ID NO: 37788 - protein, 452 aa, A.fumigatus
  UNSURE (403),(428): Identity of amino acid sequences at the above locations are unknown.
GDVRTKSVSPEGSREAVDMSIKSRISYILDDTFEHSRSPSFHSSPVTDEREVTALPLSRNPDVIRRQPAPPFKDRHVESTVKIESDPFITDSKDCSKPNDVFSIIDSIRSSSPPVQTPRELGFMTPPHARQLSNPAMSTHSPRTPTFPAVAIENEDGFFGSSPTPGTRGRAQVVGSTIPSTLTTEAMDPCMNFDPPSSPPGIRSLSPNSRNIATPSNIPQMPSDAEKENIRAVLTQEKTTVNDVTSEYTGLGKEEHCETGQSERPLKRRLRSSMGKQQITNAPAVLEPETPVARQETESVPEPLNNDKGGFLESVHVVESAPKMDQEMMKGNVNQEEMHTDPDCIADSFSDDMETQVASQLEQDLESAGNMNEEPKSKAPSEPPIQQTTRKTIRGVKEADAGXTSSTRERRRSSRLSSTKNPSAVRSXRIHEHSWLEIHDHSFFAEHQVFAR

SEQ ID NO: 37789 - protein, 203 aa, A.fumigatus
SSIGGHPAPAIADEGQYRRQSSRTARSRKQAKNKELLSESFSLKKLEADAPDSVMETPAAEIPNQNLTCIRELTLETYVHGSNLPKTITPDASVQPSNSSSGDTEMVEAEPAAEPEPTDDHAQVNAAQTDADGNNHAPEDKIMISHSAQTGTLVGQEGVISSLRRVLDDVKSTTLNLSALKEIDDLLFDIRVEMHEALRRHAG

SEQ ID NO: 37790 - protein, 152 aa, A.fumigatus
LIQIRAVITIRYRSHRREAETRRLYFLGRTILADVDISRQFPLAKLSIWRALHRGKQALGAESDVPDPILCSICMEQLRDDEDVRPLPCEHIFHPECVDPWLTRYHTSCPLCRVSLVEDDGKLDLEDGRPPRLLTLPMPPQPALIGFAGRFG

SEQ ID NO: 37791 - protein, 88 aa, A.fumigatus
QAQRRVLYHRQHSVIFASCANSERTGIYDPAARASTKQPSHEYTFSSDAYFSSSCNRERGWLLRLFPYPWHQRQGTGGRLNHSLDVNN

SEQ ID NO: 37792 - protein, 102 aa, A.fumigatus
SLVCISDGPFVNGSLAFWRCIVVQVSKVDDSVYNVLLTSVEVNTDARKRCRSRFTSSGPLYLLNQHFPEKKWMKFYLYYELSSPFAPTPEGQHSDRPTCKPD

SEQ ID NO: 37793 - protein, 404 aa, A.fumigatus
IRILEADAHEILNVNDEQLSVAERSRIQKGKRKSASHNTLIELCSSEVSYDSTLWSKVFPNIIRISFETCPFAVTLGREIVCARLVQMHKTITALADSPHPPPYAPIDPAQARALGRSNMTAEILIEQWKLYLVMACTTLNSVGAQSQSQLANAQHARKSSKGSQQSQDKISSARSLFAFVIPLLSAERSSIRNAIVMALGSINKNLYRTFLESLQYAVTTCNEEAKIRIGAHHRSPSSPRRNRKTDRLRTEVTHVYKLTSHFLREPEVYNDDWIVNNLVTYTKDLRIFLSDAEVQNDWEFQRLRFHYCGLMEELFEGINRTKDPSHWIPFESRKSAFSLMEDWCGYSPNQAQIAQREENMRKFAMAHQSESGEFRNTAAAMEIEKKNLRAAALSAMASLCVSS

SEQ ID NO: 37794 - protein, 709 aa, A.fumigatus
QAGPISITTESGSVLQFDVGRMLSWIDIIFNTLSDKWHAIGRRALKNLIIHNKEHSYLLERAIEMCHVSERPKALESYFEVVTQVLIEHTDYPLGFWRILGAVLVTLGNQKREIRMKSAKLLRILEERQQKSSRLQDFDISISDKTTAVYKLAQFETSRRLAKQHSDLAFTLFSEFSLHFRNVGPDSQRNMVAAILPWVQTMELQIDPNGGPTAKSYMLLANLFEITIRCGNILPNEVQALWQALATGPHGGNVQLVLDFIISLCLERKEQNFVEYAKQVVVFLSGTPAGSKVIEFFLMQVVPKNMVQERKDITPAPPDVKSLPYVADLGTVLPVGNKQAGLSLGQVALIFLVDLMVAPVTLPLEAVVKLLHVVLILWDHYMLTVQEQAREMLVHLIHELIAAKIDDDAPAATRQGIEDFVESIRESDPKVVWEYEDNNDKEDGDDGSRVPLSMSTVTRQVVNFFSFAYEGVSDLWAKEALNWATSCPVRHLACRSFQVFRCISTSLNPRMLADMLARLSNTIADEEADYQTFSMEILTTLKIIISSLAPADLLRYPQLFWTTCACLNTIHETEFIESIGMLEKFLDCVDMSDPAVVTELIQGQPPKWEGGFDGLQNLVYKGLKSSESLNRTLDVLHRLSGLPNNALIGNSDRLLFTILANMAHFLHQFDPDVDDPKTLARATLLARVAEGEGCPRLAASLLGLANGQY

SEQ ID NO: 37795 - protein, 96 aa, A.fumigatus
  UNSURE (26): Identity of amino acid sequences at the above locations are unknown.
LQERDETLHLNHRQAKMTSNQPPLRXRGIVSYGSYKTGGWKLKDLTLRPLKEKELLIEIVASGICQTDLHFAGAESGFGVHYPRIMGHEGIPYHLS

SEQ ID NO: 37796 - protein, 317 aa, A.fumigatus
TTGAGYVREVGSGVQVAQIGDPVILSFSACRACESCETGHPAHCANFNPINFEVEPDNLVFSEEASTATEPSIYGRFFGQSSFASYSIVREDSVVNVRGVVDARSELQLLSPLGCGIQTGSGAILNAAKATPKDRVAVLGLGGVGLSAVMGAKIAGCAQIIGIERHASRLELAKQLGATHVVQVDTTADPQSVSDAVLAATNNLGVNIVLDTTGVPALIAQGVRMASFKGKVLQVGTAPETGTLTIPIHEFMVAGKQYMGVVEGDVNPKDYVPKMVKWVREGSLPLQKIVKFYKAEDFEQAIRDMQSGETIKPVIVW

SEQ ID NO: 37797 - protein, 162 aa, A.fumigatus
IGMVNVPVSGAVPTCRTFPLNEAIRTPWAISAGTPVVSSTMFTPRLFVAAKTASDTLCGSAVVSTCTTCVAPSCFASSRREACLSIPMICAQPAIFAPITALNPTPPSPKTATRSFGVAFAAFRIAPLPVWIPQPRGDSNWSSDLASTTPRTLTTESSRTIE

SEQ ID NO: 37798 - protein, 306 aa, A.fumigatus
NGAGLQVQGLLPSGQQGRSIAIIIAKGPYNSQDKHPTSPLLLPLHQRGRRNNSYPHQIHRLRVSTSLREALLLLGRLLADRIGCEVDPIGNECICRLDLQQTADSFLRRCVSDNCGSHAFDVSSAVSIYAEYCTSNGYTRATSTTQTTGTTSSGTPIASAAVTVNVMHGAGVWGTTSAAGGPWTNVRTRLTVVYALVSTSQATAATSTSEKASDWTTESTRQSVPSATLSTTTTSPTTDLVTREGDKTVEGDGSKLKVGEIVGIVVGILGLIATALGSWSSCKTLKQRKHLAANAHKAPNYLKLCS

SEQ ID NO: 37799 - protein, 107 aa, A.fumigatus
MVTGQGLTNDMVELANRREAQTGADETSINRAREVRLGSAPGQTKCSICHSTFRRPEHLKRHFRSHTKEKPFECAQCGRHFSRTYVVAFFFFFFISIFISLPPLSLL

SEQ ID NO: 37800 - protein, 529 aa, A.fumigatus
GAVVVPHAVRCENRSLECQYPTERRSKAKTRKEVAQNLSSERNSTIYGQATQRESPSSPAGADVPGADIREQPRNEPPGFQITEFQLDLPGSHRVDTPSKHMPAEKPHGPPRGISSEHQNGPPGDETADLNARMLLSDAGGSTHDARVSLPEYASLSSQQFYSQLPAGGAQTLSQESASQLDHRSRDIQQPVAATSNLNLELEGVGGQQMQLGFDPPFLDQSMLSTLNWLPNDMFPDTTSDQSLSRMPPLSDQLGILDEPVSRTAWLPPVTDLRQMGPSARENHSHTPSGHMSVGTDAGSPDRFSHSIGEGSLHSEPSNATKRSGDFYVDGAGARLPKYRRNRTSWSRLSAEPIELLAPLHQHDTRHQFSFPLTQEIRPDFLPGEEAASNCRIEAPTYDRIYQSFLQLCRTDNPLFLKFETGNFPSADALSSYVYLYFDSFQPVYPLFHPPTFNPNKCHWLVTLAISAVGCRFSGLTSLDECTTAFDEFLRRAINIEVRPLILAYGLFIADRVWRSRKRNVAQNEYRCG

SEQ ID NO: 37801 - protein, 62 aa, A.fumigatus
FMAMERVTCNSSQFSNTIVIQPGEHSDTETATATVISQQGKGGEGNKNRNKKKKKEGDDIRS

SEQ ID NO: 37802 - protein, 518 aa, A.fumigatus
SDFQRMDDKSRGTTNAKHLATDTDHPPDDGSAGLPEPGSVKSKTGLFTARSTQKALDGERDEFATFRTRPPQQAAIAMQKPPVPVNKPVTLGRPNSTPELRQTESQGSDDRAEPGYPMSKPVRNMTAGADTVENLLQDNRELPVRNPPIPHRNPAMHSDTSPRPPDIASVSGTKPRPTPPPPRKGGAKPVPKSPSRNEPKIHGEKQSYIPLSNSDVDLTGADEARPTLPPRPDPSRVTHIPPSDHRILLEAHEHSKRHLTPSSPLLDRSLQNNGSSPDLIDYSPGLDEEAMSDAIVASSLASRKAFSAKKVPPPPPPQRQLRTHPLLRPNTPSSDSPRSSSPAPSLRHTLRPATKVGEEELDHHKHRKHIIRRHPHKHHEGDRKRWQSEVTEKERKRYEGVWAANKGLLIPISNSKERSSLEEVSCEGYPPSASEMVLNIAVREIWARSRLPSSILEKIWNLVDRQKIGLLTREEFVVGMWLIDQQLKGHKLPVEVPGSVWDSVRGVPGIRIPKVPSR

SEQ ID NO: 37803 - protein, 359 aa, A.fumigatus
VSCPASVLTGEILTDDDVDKDAFDDASEVQTTSNPSLTVSIPQSSSTRSLTDSPPSGTNATSQFTEAPPLPSVTQNEDKRDEDTEDARSERQSGTDETPRRTRSPKSPLLTTHRLSTTSLDEVNLASNNLDEVTLQNHDLSQEPMSDVPPVPSRNSASFAQSIPLQGLSGNLPSNSWGSPPVNRTPAQAVSAPAPPLTRKLTGPFAWLSRSSTASREVKSPPPQTSRRNTAASVSTLSSNSELTKHDGEDLDGSAARRPRRSSLKDQFKLLRMRDEGLVSENDGASVASGRASISHSAGSPPSIPEEEEHVSAPPLASPQTVPPTANPNLPPGNSLGNICFCHRCVCACRLGAVAETCK

SEQ ID NO: 37804 - protein, 408 aa, A.fumigatus
HGIPRYSSLGERSEEALQQELRKIQNYQALDRLVRDKVGFDSPARIFRLSSSAPHHRRQKTDEACQIAGHDYTPETLQKISELLSSNPEYYTVWNYRRRVLQHEFNLASSNDSEEAVTGQIAALIKKDLQFLIPLLRKFPKCYWIWNYRMWLLDEAKRLLPRAVARKFWQEELALVGKMLSLDSRNFHGWGYRRFVVESLEKLAPEDQEVRSMAQDEFEYAKKMIGTNLSNFSAWHYRTKLIQRLLSEQSASDETRKKMLDDGQFSHCAKRVSAAGTILTGIAELDLIHRALCDPYDQSLWFYHQNLMCTFDPSLSDQSMAPNLSNDERLKYLRKEIGEIQEMLDGAEDCKYIYQALIDCTLLARKVKGTMPSTDQENILSWLSELKKLDPLRCGRWLDFEKSLHADV

SEQ ID NO: 37805 - protein, 184 aa, A.fumigatus
GCGMKDWFRRTTEQVSRQDGQASVILLEVLPVYLKKKNMSLLHLLHRHKLFRLQPIPICPPGTVSGISASATDASAPVDWELWQKLVNDGPQALKGPNSEEINPAIKRGIPQTIRGVIWQILADSRNPELEEVYKDLVARGTDKEKQVTNGTGEQESLDSSRASVRSENSTAHSNHGSSQSPSQ

SEQ ID NO: 37806 - protein, 93 aa, A.fumigatus
IDPEKLAKEQAANEIARKKKAKEDAMALQKLEKAIRRDLGARTSYSRYFVSQGNQDGLFGLCKAYALYDEAVGYAQGMNFIVMPLLFNVRTQP

SEQ ID NO: 37807 - protein, 196 aa, A.fumigatus
MDEAEAFTLLVKLMNKYGLREMFINDMPGLHRNLYVFERLLEDWEPALYCHLRRRGVHPQLYATQWFLTLFAYRFPLQLVLRIYDLIFEEGLESTILKFAIAIMRRNAETLLTMKDMTPLTTFLKERLFDVYIDKQPSPSSILESGFFGSSGAADKEVYRADIMVQDACGISLAPGTISTYTAEWEEKVRTERERE

SEQ ID NO: 37808 - protein, 135 aa, A.fumigatus
CVRTTVSDMMVNLIRNLEITLQNMKDAYTSREEVPFWATKLLTPAFMAVAILTTIPPPGPTRVIVGMTAFTSLWLYVLTHWMAGPAFFMDAIFMISITVRWMLMCLTGAPEIDYYQNSKTATKLDTMRLDTSEQG

SEQ ID NO: 37809 - protein, 377 aa, A.fumigatus
  UNSURE (373): Identity of amino acid sequences at the above locations are unknown.
SLLMIKTYRRQNHSQGTIKCQLTSLLFDGSRQLVPDMLSNCVPSAAPHSDNHRTIDNLVNNHNQQRSIMSSTHSSPSPLCTQAGATANWERLRKSCDSCQEAKVKCSQHKPSCHRCLRHRQPCIYSPQRRTGRPRKRPTLDGTLHSAVNLGSDEYRAIITEATSSTVNGQDLVMADVRGDDTPLLAGGITADNINSISSVFEPSFEALLAGSPLSKDPTTRDSHSDSCHTGYPTASPSDAWGDLSLFLPDYNTSSLSHPEHVVAGIDQLPPLSVDASNTSSENGDCGAKCYTALLQQLLFLRQSLPESSRPSIDVILEVESHERRLLDRVLSCATCLSNRSSVLLMSVITERVIQMLDWIMAEQTLFSHTTSXRSRE

SEQ ID NO: 37810 - protein, 96 aa, A.fumigatus
VCVPLCIVGCALTVLSLGIAWVLPHEARSTIIDAISGTGSTFVRDLDPTIKSSVLAAIVTAIDRTYILCIVAGAVTLLATFGMKWERLFIAATAAA

SEQ ID NO: 37811 - protein, 551 aa, A.fumigatus
SSTFHDICQRSQRRDTVYIVIISSYKETPFCNELFQLVDHHETRASAYSPDCTFSIMTDLTNTEMRPSDSDIPKDPVKQESSYSESDQSKDTPRSPRNVHGFLWVTVVLAIYSSTFLFALDNTIVANIQPAIIKSLNGVDKLAWSGVAFVMASSATVLTWLQIFNQFNIKWMYIFSIAVFMAGSAICGAAQSMNMLIGGRVVCGVGGVGQYVGVMNFLPRLTSMQERPMYVSAMGLTWGAGTVLGPIIGGAFTDSSAGWRWSFYINLCVGGLFTPVYIFLLPSLHPQPVKTSVIERLRRMDLLGSLILMGAFAAGVIGVNFAGAMYPWDAPGIIVALVLGGVLFIIFGIQQTVCIFTTDETRLFPVELVSWRKPLLTLLFICGCCTGVCVTVPTYIIPLYFQFTASDESLQSGVRLLPFVCLLVFSCVGGGFLTSRLGYYIPWYIMGGALCLIGSALMYTIHPHSSAGTIYGYSALIGLGAGMYLQIGHAVAQAKVKPEKIPAAVAFTTTAQLNGLTFALVISQCVFVNEAAKRKFAFPFALWAVHLRFCL

SEQ ID NO: 37812 - protein, 560 aa, A.fumigatus
ERFFRVEGDILFMEFLYPKAEDGDKIILLLLVSQNQVTQAICYEWHADETIRQASPRITKRFLPPEDTLPTMLIPLTKTSSFMLITTTSMAVYKNRLDPRRQPSRYPLPVPDREAKKAPLWTRWARPLRNWSYNQRHDDIYLCREDGRVFYLGIGNEGELENQAHLGQLCCDVDAAFDILDIGHEGGDLLLAAGTTGDGGLFVQKARDQPRCVQKFINWSPVTDSVIVSSGQDSSSSDTARDRLFVCSASSYGRGAIFELRHGLEAQIGLVVSLEDLSSTRDIWTMSDDINGGVYLLISDPVSSILLYLSADFGEEMCAIDEADSGLDFSTQTLAAGCTSSGVLVQITEKAILLGTTTKSTMRARFEFGSDQSVAVAAVHSSASLIASAVRTRHEMHLSLKSINIGQDQLHLSEIGQPLRLPHEPVSILIEVLGTFTLIFVGTGNGKVLIYSFEDSTMLLSEVSIDVENGDDLSKAIESLAVVAIDTDGPSQKYTILCGLRSGIFAPFEMTLGHGNTKCAIGTLNLTLNLRASLIGVFSLCRGQTSEPTTNWEYFCQDTK

SEQ ID NO: 37813 - protein, 481 aa, A.fumigatus
PAYHPGNVHSFAMAKTIDPNIDGEADTLFCIADGQLLICTLDHAAKTVPRRIDLPGSASKLAYSNYLRSLIVAYTRAELDTESDPIRRLTRPFIEFVEPDTQHGVSKAVDVSEDGYSAWRPHGAAGEKISCILEWTPKKGDEEYHFIVIGTARKQQQERGRVIFLQASRSSSDSSRIECSVKYIHKFESPVYAIAPYGDFTLMVSTGHEIVPLEPKLSQTRRVRAARYPMLSPAISLSCHEPYVYMSTSRESLMVLKSSEDKLLLHAYDRQKHDGLSHIHIGGEFNLTVTTSRGGRVSILSENGITDNDKMMPVALCEAHLPSSVMKLSSGSKPSPFSRSSQVYYGTAMNGIAYRFLILDEKEWRLLRLLQNLCIRDPILCPFTPKRKRRRNPATNGIAEPQPSHMHIDGDILSRLVMRGPKYLTKMLTTQGFEDAAFPENGTAQATLELFTELSNNLLGESPDQVEKVMRWLEKAVHVEF

SEQ ID NO: 37814 - protein, 176 aa, A.fumigatus
KMAPKKKGNRKQDDDWEAELGESIAPVSEQPKDATPADAAPEEDDMGGGLLAALRKNKNKKAKKGKPVNDFVEGEDATEQANGDVDFSSKQPEEGTVDQEDVFAGKKKQKPAKATPPAPASVEGDGEIRVKTKKEKEREKKEREKQRKREQVCVVSGALFAPTNRVSPVADLEYLF

SEQ ID NO: 37815 - protein, 66 aa, A.fumigatus
ALKKKATAPEPKAEPAKAEKKEQAAPAAAAAPTPPACAPEAPGKKKKLPAHLAAIPKAPEALPDTT

SEQ ID NO: 37816 - protein, 748 aa, A.fumigatus
  UNSURE (705),(711): Identity of amino acid sequences at the above locations are unknown.
FRWLYDQPGSEQGLCKVHFSTAIMSTLSPQLVRSESPTDMGFPNANFSDPYLSAPLDPEQDVFKSSGIRWTPEPGQHDLREASTSPYNHNVNSDTAQGAETAGYPTSYSDFLSPIDDFSSDLSAQASPNGDQPPGSINMELHSYLDAWPHEGSSSNMAVADEPRSVDSESAALSQPALVTSQLLTPERTNHPSPAPDLTNRRNNESQSHSEQILTIVTAPLDNNLNVHPPSDAARARSPIVTVESYSRGDSPVRNTISVRRQPSQSTTHLSPGRESEDGDHNTSWQTSEQAIARAPDGSWLPDGTTGQAGVAPTSRDDTYILSPNEVESRRRLEEKNADIRSWSATVSVAGSEDGDDGLHTRGRKVPAGTRRRARSAGDPALQQDYFNLQFGAYGPVLPGPGALIHESSDEELSVNDSEVEASDPGSPAVSVNEARWARDGFADSPVQDQPNSADEEPAPHQFLATHPWKDADHDSTPRSVRMQPSTASAAMMEYQRRAREIDAVSRYATWGTRPMSEIEVNSIIGAGGSFANLSISQDSSKKHTRRSSLMKFFPRKPSISVLKRPLSDLSLVENQTTNNEIKSPPSRNDSFPHRKLSLARSPKSPSLSTGGAVIAIAGQMAAIGGRDSLSTVSPHSTSNPWNKFGRTRSRSEIPRSSAPGLLDLMTSHGGPPVPTIGHSQTLTTDNHGLQQVASSRTVETGDDXEEDDDXADQGQVMDFPVPNHLPVATTERFKAQIPQLNPRLELH

SEQ ID NO: 37817 - protein, 92 aa, A.fumigatus
GLGVWTRFIHLGVKASYAIGVAEPLSIFVETYGTSEKSSDELVEIIRKNFDLRPGVIVKELDLAKPIYFQTAKNGHFTNQSFPWEKPKTLKF

SEQ ID NO: 37818 - protein, 462 aa, A.fumigatus
FSQTSVAYFAKGPLARCRAAFQTSGSYSTNTPKHLAEFYREAILAAKKMDLKYRETLPSTIRDVLLSTSDDDARKKRKSRKRKLGKNGLYPEEEGFIRKWWRDRALADNGVPAESSRDAELKKHIADLRLRETQLQILLILETLALEMNGPGETSKTDESSEQPSDDTRTKSKKKPQDLDVLLELHLDRLCIWHAVSTDDTALAESAKSFDSQTGKKIESDAVRDFCTEVIVPFYASRLPDRCKLITRKLGVSGAISPLAKQSSGTKKASRTEPGKPTERQSSQRHPRRSLQRVLTDQQTASQARPRSLGRSNTVPSQAGAKRESMEPLLPVLSVSARGGIQKPKRVENREVDLNAVARQHEAKLRKVQMLMEQKKELDAAINALRKPNRELVAKDIVEDAVKRASGGSSRKPKNPVRNPFGASVQVMATRKETARRTRLGLGSPIQKYCAVLPNLERFSPF

SEQ ID NO: 37819 - protein, 209 aa, A.fumigatus
SVFVDFRGIFGTANGYALALTASHAIIWPYSPSASASSPVDVFTLTIPESCRESHGAPPLGTFLSSANGEIPGLMVVMPYTGRIIYWETISHAGSLGLPRQKQSGLQGHVPGLLPSEYVTDVINCEPSGVIVTFSSGRVAHITFRDSQGRPTVMANFLRNSSSSSGLLNGIKSVFSGGCWKKDVSAVKGCPFASTRAAGHHCWHNDRSV

SEQ ID NO: 37820 - protein, 60 aa, A.fumigatus
  UNSURE (3),(4),(13),(40): Identity of amino acid sequences at the above locations are unknown.
AGXXISLAADYLXQITTFSKEYGTVTACGKCGIKAIKAPXYILDGNFACKLRRLISKFRT

SEQ ID NO: 37821 - protein, 84 aa, A.fumigatus
DVNFSVLQRHQNILQLSGITKSPNATSFGVDFANFLADQISADLAWPYANPSFDSSILVKIANTVPPFNGFNTLSRQKVFQIVP

SEQ ID NO: 37822 - protein, 418 aa, A.fumigatus
SLNHVAIPQSEIHHCHPLCLWSLNLKAEPPSPKYLSALHHNKIAHSSILSRFVIPSTPEIRIPDTDIGPGHGVQRVGMANSWVDNFPGTARPFLDEMDDTLGFNLSRTIANGPNCELNKTENSQPAIMATSILILRILEKEFGFDTKSRVNVTLGHSLGEFSALVAGGYLKFRDALRLVRRRAEIMAECTRQASKQSGEDYGMVALICEPAHLESLLSAIHEFTGHPSPDLKDDSSHGLPTIQQVMIANINSKNQIVLSGSIHRITTLLIQLRQFGGHDPRAVRLKSESPFHNPIMAPAAGYMRHELEHIDIEFPSQLPCISNVSGLPFESRDDLKNLLSRQCVETVKWWDSIRYLDQDRGVKRWIGIGPGKVGRNLVGKEVGKINTKGGGVWALSDPRELENVLMALQNTEIDVLTQ

SEQ ID NO: 37823 - protein, 743 aa, A.fumigatus
ELLLLLDDTLIAKGIRNFGGTFLVFQTRTRSLTLNPVVAGRSHLAIHDSPDFLGQVLGELTGVGNDNDTTLESLESLGQGTQRVTVEIVGGLVEDDDVRTLPRAGGEDDLDTLTTGQTAHTRVRNEFGIETEVGTVGLNLLADHGTELTAGEGFLLVNLGYHLGVGLDNLATTNPGVVIAHQRGPLLTLHADVLTKSKRALLLVAVLELTTSVDTDNTTQGAVDLVDLVHGLLIILGDDLVGAVHGLTVLTGLETPLNVLRGSLVEVVIDVSESMLLDVGDTDVLVLVDLTAGGDELTSQDIDESGFTGTVGTDDSNTRSQRNLEGDVCELGLGSAGVLEGHVADTDDGLGLGLDTLKETRLGELELHVGGAELVVGTSTGDLLDELAQIAAITLELKALVVDNVLDNIVQELAVVGDDDGGARGVAKVVLQPGNILDVQVVGRLIKEQNVGVLEHGTGQSQLHLPTTRQRGDGVFELLTQETELLELRLDIGLRDVDTDITELLHGPANDGLLSVGGIQVVLNVDSLDLVLLRETFKLLVVDGTHQSSLTGTVRSEKTVTLTTLQAEGGLVQQDLGTIRKREGAVAEIFTLLLVRKNGILLGSARRGTLAQSLGNGFGFLLTNDGGDVGKSVLGPAGDLGVLLVNELTSDGTDIVDDGLRLLNLSFVLGGEDILQDSSNGLNVSGQLIFRGSWPSLTSPTPNEGVQRPAWVFSTGPLGSGQGPLSSFSQKGGITLGPLRGAT

SEQ ID NO: 37824 - protein, 494 aa, A.fumigatus
GGPRSPKYQLPGNVETVAAILKDILSPKYKAQIEKSEAIINYVGAIAGQLVDEKDAEVTSWTQNALPYITAIIGEEEAKAIAETLRKRASPGAAEEDAVLSDEEEGEDLCNCTFSLAYGAKILLNQTSLRLKRGQRYGLLGPNGTGKTTLMRAINNEQLEGFPKKDEVKTVYVEHDLDAADTEQTVIGWTMKKLRDVGIDIPQSDVEAKLEEFGFLREQFENPITSLSGGWKMKLALARAVFENPDILLLDEPTNHLDVKNVAWLENYLCNSPCTSIIVSHDSKFLDNVIQHVVHYERFKLKRYRGNLSEFVKKVPSARSYYELSASDMEFKFPEPGFLEGVKTKAKAIIRVSNMSFQYPGTPKPQLTDITFQVSLGSRIAVIGPNGAGKSTLVNVLTGELIPTSGEVYQHENIRIAYIKQHAFAHIDNHLDKTPSEYIQWRFQTGEDRETMDRANKIVTEDDEKAMDKIYKIDGTLRRVIGIHARRKFKNSYE

SEQ ID NO: 37825 - protein, 217 aa, A.fumigatus
ECSFALGENVGMKSEKWTPLMSNDNAWIRRSEIIQSHAKMVAEVDQKEAFASGQFRPMVRKEIEAHCANFGLDAELVSHSRMRGLSGGQRVKVVLAACSWQRPHVIVLDEPTNYLDRDSLGALSKALKTFEGGVVIITHSREFTENLTEEVWAVMDGKMTPSGHNWVQGQGSGPRLEDKEGPTEVTDAFGNKSVVEKKKKLSSAEMRKKRKERLARK

SEQ ID NO: 37826 - protein, 113 aa, A.fumigatus
ELTASLETVVLIQNLEKTPMTFVPVPPAAHLSYPPEVGELTSLVMNIVIPSKPKNPNQRYPVMVYVHGGSLLYRGANLPIFDAVNLVSQSIKMGTPIICVNFNYRVGPRRIPS

SEQ ID NO: 37827 - protein, 272 aa, A.fumigatus
TSTTASALGGFLASKEIQRELREDGFQGCGNFGFTDQQVAFEWCQRYIDALGGDPNNVTAVGESAGGISISNQLAAASPLRFRRAACMSGLSVSIPQWTMEQHEALFEAVCRYFRIDSTRSDVLDHLGQIPQQMLADATPIIQGVLSGTGNPCLDGWFYKSDTDPREIQTAPSWLDALMLGDTYHEGIIFHSNILEDTFQSIRQTLAEYVGAEDETDQILAEYGISPDVPLGLLIKRVEHMCRDAVFKIPNYATALGNSHLADKRALFCVPF

SEQ ID NO: 37828 - protein, 301 aa, A.fumigatus
ARILYHFWGNIRWRVQDPYFPKGTPLVTHSGKPTHPVFVSYGISSRAPILETDYNQHKSNSTYFSDLDVARTALVTRLYSPGASIVSKELDVELLEASQRDGTKPPKRKGIYVALGSVYCSFKREIKPFELYEMETKVIAWDQKWMYVMTFFFRPASRKGGEKTLFATALSKYVVKKGRLTVPPERVLRASGFLPPRPEGSVAPEVTTSAEASGMGTPVNGEGLTASASGVDGSLVREVLKLREEDMPEPKSLEAEKRSNSASWDSNEWTWERIEQERLRGLKVIEGYSTMDAKLYEEWQR

SEQ ID NO: 37829 - protein, 236 aa, A.fumigatus
  UNSURE (42),(61): Identity of amino acid sequences at the above locations are unknown.
YCIAAPSPPRGQCCLRQLPRSRHSRGASLLPNRWWRPQRPYXKTYLLDIPVPRVLLQHGAXTTNWKTLFTDLCATDLGDGSANGPKLYLVVEVRVPETPTVGAPLQSRPSVSRGSSSAAKSPTSAGHPGKGSLRTRRSMIWSTKPRGLQSAEPAKESSAGPPQSSESASSTKDRGDTQSSKSSTTLRTLGVGLLEVSQILRQEKDAEQIVNIWSPSSWLEEGEGHVDGFDDLVRTL

SEQ ID NO: 37830 - protein, 86 aa, A.fumigatus
REREMVKGRKVGQEAITMERKIEATKKGPDCTRSRHPGRKLADRSHWTGLNTNLLDTTGLLSTSLEAGFWILDSSSLKANFIHRYY

SEQ ID NO: 37831 - protein, 249 aa, A.fumigatus
SGRERKTYHSVNTTAVASLDEQLHIGVHEWHSHGDIRAVGKDKVGVLAELLDEGEDVIPAAAVETGAVITQFIDNLHMLAHGTKASWRVSWTHLIHLKRSSDGLNQNSRTDGPPGHADVVLSEVEDVIPESGLEVGLHLGEVEVRTVAASNKLLGIVEEVKTKVEQAARDRLAVHSKVLLVKVPASSTSNQGGKGAVCTELVLLVSLLEVDLTANSIVQVDLAVDHVRPGRGTRVYACQFVFLMQLNVK

SEQ ID NO: 37832 - protein, 136 aa, A.fumigatus
LTLEIRHVSPDVRIQSIDDHLAVRGTSDLHATVNQTGSGRSTLPCVIFTNVFGLGEEVRQMTLVDLGLAIDTALREGFPGRVERAVEDGEESASFLGEDLAMLVVHGAQDGDILELYFDLAHVDIVFCNDQWLGMR

SEQ ID NO: 37833 - protein, 194 aa, A.fumigatus
RAVLLQLQPPTTTPVSSSPVHCAAYRLNLPSQEISSTMSASTSSCKVTLENVAEILKNDTKVKLAGVDVDGQLRGKLISKKKFLSIAADGFGFCSVIFGWDMHDRTYFKELAISNKENGYRDLVAVPDLSSFRRIPWENDVPFFLVSFFDPETKAPVCACPRGLLKTALSKVEAAGYRAMAGGRSIALLDFPGP

SEQ ID NO: 37834 - protein, 259 aa, A.fumigatus
PFRYVVKSIGAKHGITPAFMAKPREGLPGNSGHMHISLVTEDGKNAFLRPTPDPSPPYPDVAHLSDLGRHFLAGILTGLPDIMPLFAPTINSYKRLVENFWAPVTVSWGLEHRAASIRLITPPTASAKATRFEVRVPGADANPHFVLAAIVALGWRGVEKKLEIPVPPLSKDEDMGGASDQGVRLAKTLKEATVAFMRKESVARKVFGDQFVDHFGGTREHEVHLWEEAVTDWFVFPACMTTGMMLTQDREVRRYIETV

SEQ ID NO: 37835 - protein, 65 aa, A.fumigatus
ILLFVSYRQSETDTPFAPESVSNRNGARKLELYSLATGYHMQPVIFTCHMPTLKIAMSTVSRWNI

SEQ ID NO: 37836 - protein, 139 aa, A.fumigatus
CHHDCAIHGRLCEAAHQDLPPPWCSRYGKFFALCLINRRETDSPRVVWLLRSLSRMTLSPTTRPWRACAPTSCVRSVPATTVPGLLTPLSPPLPPRSSTNTCLPPTSCSSAGRTSTSPPTICSTPTSLARSPKRVSARI

SEQ ID NO: 37837 - protein, 93 aa, A.fumigatus
FPAEYEFYQFRAPGDYSTPERNASATAAFLQKNPVEALPALTEGMFGYSLTRPIHNQEYYYGIFDACEQFNCEIEGWHTESGPGVFEAVSVLG

SEQ ID NO: 37838 - protein, 158 aa, A.fumigatus
FLSFFFLNFIWVAFLHPSPHPQPLIIAKDNINMSQIEVQLKDVAILGAVNNEHRKILTKEACAFLAILHRTFNPTRKALTQRRIDRQAEIDKGHLPDFLPETKHIRENDAWKGAPPAPGLVDRRVEITGPTDRKMVVNALNADVWTYMADFEGESLDI

SEQ ID NO: 37839 - protein, 109 aa, A.fumigatus
KDKLTGVDSSAPTWANMINGQVNLYDAIRRQIDFKQGNKEYKLRTDRALPTLIARARGWHLDQKHFTVDGEPISGSLFDFGLYFFHNAKELVARGHGPYFYLPKMESHL

SEQ ID NO: 37840 - protein, 77 aa, A.fumigatus
HVQIIYELRDHSSGLNCGRWDYIFSFIKKFRKHPNFVLPDRSDVTMTVPFMDAYVKLLIKTCHRRGVHAMVSFSLSA

SEQ ID NO: 37841 - protein, 163 aa, A.fumigatus
QSQGGMAAQIPIKDDPVANDKAMESVRADKLREVRAGHDGTWVAHPALASIASEVFNKYMPTPNQLFVRRQDVNITANDLLNTNVPGKITEEGIRKNLNIGLSYMEGWLRGVGCIPINYLMVCLFTWTLTTFILANFRVRRCRLPPKCPGLNSGNWVHHQVTT

SEQ ID NO: 37842 - protein, 63 aa, A.fumigatus
SRSQSPSLPRSVNPHPTQRQHQDSWLSFPLHYSVSISSLKKPATAAPLIGNAQLFPVTLLPAK

SEQ ID NO: 37843 - protein, 115 aa, A.fumigatus
GIRRLIDKYGLDTQVRDNTPVYIEDMVPFNETILQTREKRFHLGFQRILLCFYVMMGLFTVSRKGAMLHLQYKHLVVTLQKNPHGGPPVPMVDFRAEFIKGFLGMKELYVTIHGP

SEQ ID NO: 37844 - protein, 74 aa, A.fumigatus
  UNSURE (11): Identity of amino acid sequences at the above locations are unknown.
PSRTNGLVGHXPTIIQVHKYHHNYIEKSSNYLKNYFLYPGSIYRHLPNCSHYRYEIAPFLLGFLINLNTQLPFL

SEQ ID NO: 37845 - protein, 150 aa, A.fumigatus
WTLSGSSLPDDQGPPSPQRTLPSVVQYPQGKGFSPYILLHDVCNYSLTFYDRRLMKFHSLNFTFMLVQLSYGFITGSLGLLSDSIHMFFDCLALVVGLCAAVMSKWPSSARFPYGYGKVDTLSGFANGIFLMYDLNPPFNESKPDNYPGS

SEQ ID NO: 37846 - protein, 143 aa, A.fumigatus
REGQIGKKDTMSTGPPMSSLDTQFPATHGHGFGHSRGHGHSRSKRWTQPPVGQSLSSLNGSATPVQSVLPSVDAVSPNGSALGSLSHNHHHSHSHSHGGANHPGSCDHGHSGHYHPSERTEDATELRARAVPVISTDFTPSTK

SEQ ID NO: 37847 - protein, 408 aa, A.fumigatus
LTYSSSRELLSGLLTTLPWIALSWYYNQYANRNSDIDIANTDKVDPNTLAGGSLDQVVLRTCSLTAVSMVMTGVGQLQWSSKAGNKSAVKVPNLRADFAGVALARIFSIALPIYAALEVSGFLVSLGVLLAAASGLPALAKGRAAGSDTREKLAHKRFTVALILTILVLSFFGWVGSYDSRSYFGHLALLLSIFVMPPPFADVGQSSSRGTGFGVSASSKSDALARRISGSLSVVSPDDGILTLVLGLVVGLIGFVLFGIPSLSALDAMYLLVAAGSYATSLLFSSPPHLRSLHKWGLATGIVAAGLLSSPPIAADNRVVYASRCTLAVMSFFASRFDDRRLRLERHSHHNQHHDGHSVAPASRMTKVLLRHSEPYPLLYSILKERDSRRIFYFMTYAITLLRFMTDD

SEQ ID NO: 37848 - protein, 62 aa, A.fumigatus
GRYRTIITTRTRTRMVEPTTQGAATTDIQGIIIHPKGQKMLQNCARVLFLSSLPILRPAPSE

SEQ ID NO: 37849 - protein, 117 aa, A.fumigatus
  UNSURE (107): Identity of amino acid sequences at the above locations are unknown.
QLPRIISIEIIYEAVERLSSGSQMHRLGELLAVSVAGLVVNLVGIMAFDHGHAHHGHDHGHSHSHGNENMHGIFLHILADTLGSVAVVISTILVHLSGWAGSDTSLXSTSREWKALV

SEQ ID NO: 37850 - protein, 159 aa, A.fumigatus
VRPGIEKIGHLLKYSENFSASRVAEVTMSLRSGRLLIVFFSSPKRTSVAIVRSWASSDRIREYLFRSGSSKTSLWSIPSVMYLIFVSGLVQSSKRIVYPTSAPSLQPTSSATRVATDMAATRRGCVHPIIPLFAYPASARYCVTWVVFPDPVFPTTITN

SEQ ID NO: 37851 - protein, 534 aa, A.fumigatus
RSFWATEEDNQKPARPQTHCYFSHSGCRKVLRILQQVSDLLDSRSYLSRRDHVFERARARLLGCGSHHCQADSLDRTTWRYFYVLTGQEEIDTACEILYERMKALGKGVPELIILPVYSALPSEMQSRIFEPAPPGGRKVVIATNIAETSITIDNIYYVIDPGFVKQNAYDPKLGMDSLVVTPISQAQAKQRAGRAGRTGPGKCYRLYTEAAYQSEMLPTTIPEIQRQNLSHTILMLKAMGINDLLHFDFMDPPPTNTMLTALEELYALSALDDEGLLTRLGRKMADFPMEPALAKVLIASVDMGCSEEMLSIVAMLSIQSVFYRPKEKQQQADQKKAKFHDPHGDHLTLLNVYNGWKNSKFNNAWCYENFIQARQIRRAQDVRQQLLGIMERYHHKIVSCGRDTKKVRQALCTGFFRNAARKDPQEGYKTLVEGTPVYMHPSSALFGKPAEHVIYHTLVLTTKEYMHCTTAIEPKWLVEAAPTFFKVAPTDRLSKRKKAERIQPLHNRFAGEDDWRLSAQRRQGRGGGGGTWG

SEQ ID NO: 37852 - protein, 558 aa, A.fumigatus
NLVVQGANMVSRDDKYGNGRSERRRPRDRDEDDDYFRKLPPVELDEQPILYKIYDGRVTGVKDFGAFVNLLGVKGKVDGLVHVSAMQEGARVNHPSDLVSRGQPVKVKVISIQGSRIGLSMKEVDQVTGLDLVPQKRLASGANMERLEGVSGKDRYGNLSSEVPVIEDSNGKPMRNRKRLTSPERWEIKQLIASGAVSAADYPDLDEEYHATLTGEGTFEEEEDIDIEVRDEEPPFLAGQTKMSLELSPIRVVKAPDGSLNRAAMAGTNLAKERRELRQQEAQDKAAEQAAEIDLSAQWQDPMAAPDQRKIAADLRSAQPKSDDAVPGVEKITMGKNQSFGKRTNMSIKQQGESLPVFKFRQQLLDAVRDNQLVIVVGNTGSGKTTQVTQYLAEAGYANNGMIGCTQPRRVAAMSVATRVAEEVGCRLGAEVGYTIRFEDCTSPETKIKYMTDGMLQREVLLDPDLKRYSLIRSDEAHERTIATDVLFGLLKKTIKSRPDLRLIVTSATLDAEKFSEYFNKCPIFSIPGRTYPVEIMYSKEPEPDYLDAVLITVKQIH

SEQ ID NO: 37853 - protein, 305 aa, A.fumigatus
AAAPLSKDSTFHNLTTMAANGKVVSEMIAWIKSQKLIAPRMKYAPTFYRNLEEALDVRRSTQSLMTRGQSTWKTGDAIDFCSNDLLSLGLTGELRREFLAELARHPDFSLHSGGSRVMGGNYDYIEAVEQEIADFLGAETALMFNSGSNGNIAIYTAIPRPGDAIVYDELVHFSTHTGMAASLATTKVAFRHNDLDAFREAMSSTMDSHPMLQDGSRSILVSVESVYSMDGDVCPLVEMLEIAREICPKGNFAFIADEAHATGVVGPRGVGLVKLLGLENEVAIRLNTCGKALACTGCKNQSPRQ

SEQ ID NO: 37854 - protein, 552 aa, A.fumigatus
KEACAAISRGDCGSAMVGGVNLILAPGMSMAMQEQGVLYSDGSCKTFSADANGYARGEAVTAIFIKPLADALRDGNPIRAVVRATSHNADGKTPTLSQPSTDAQEALMRRAYELGGITDYAETAMVECHGTGTPTGDPIEAAAVARVFGDKGVYIGSVKPNLGHTEAASGLVSLLKMVKALEHRVIPPNIKFTSPNPNIPFAEGKLTVPTDPLPWPKDRLERVSVNSFGIGGANAHVILESAATYNVPVAVHETPETPQLLLFTANSSKSITRMIDGYKAWVEQNPDKVSDLAYTLARRREHLPHRAFAIFRNGVLESVSQPANSKAAKPPSVVMVFTGQGAQWPQMGRDLLRSNDVFRSSIRLLDQHLQTIAGEKPQYSIEEELKKPAKKSRLSLAEFSQPLCTAVQIALVDTLASAGIHPDAVVGHSSGEIAAAYAVGALSAGEAITAAHHRGAVTSRQKRVGTMAAIGMSWAETEKYLVPNVTIACDNSPRSVTISGDVDAVKSVVAAIKEAQPQMLARLLQVDKAYHSYHMKEIGEDYQSLDPRFSPV

SEQ ID NO: 37855 - protein, 232 aa, A.fumigatus
NQNAEMIRQVTDCEASTFYVEFTSMTMDESTGTNGHGVTMGSNTTNGATPNGVYANGTNGTLAHGVLRGAQVPIAICGMACRLPGGLTTPDELWDFLLAKKDARCRVPHSRYDIDSYYSDTKKPGTVSTEYGYFLDESVDVGALDTSFFSMTRTEVERADPQQRLMLEVAREAFEDAGVTHWRGKTIGTYIGNFGEDWLEMFGKETQPWGIHRQFPFKENFVVGESGSRYQF

SEQ ID NO: 37856 - protein, 76 aa, A.fumigatus
PRPHAIFQLTNLPNEIFADLHYASRLKGGVNHTYIIRRDRVLRRLLCSGTDITYWLRGKVKGQMLLCYKPGANPRS

SEQ ID NO: 37857 - protein, 68 aa, A.fumigatus
ICWQNSVIFLNLHKCTQPEKKLDDYVTVPFFYIVYDLRGLAVNIHLITRNDNIIAISIAVTYNADVSA

SEQ ID NO: 37858 - protein, 281 aa, A.fumigatus
  UNSURE (269): Identity of amino acid sequences at the above locations are unknown.
PTLSSYRHGRPPLSKEALLASANFTLSLLPARLASRIQALRNLPFIVVSNPHISKIYNNYVHSLSTLLPYQQRKVTTLEEENKFADVLADLVHTHSNTIPILARGFLECRKYISAADVTRFLDTHLRARIGTRLIAEQHLALHFASQPVSDVGSRTEKSSENTVPSNYIGVIDTALQPARIVKVCEDFVGEICELKYGVRPRLKIGGQADATFAHVPVHVEYIITELLKNAFRAVIESGNEREPIEVTIAAAPDVPTHQVHNVLGIKSXASGIYPDADVWL

SEQ ID NO: 37859 - protein, 261 aa, A.fumigatus
QRFSASTSIIMSTSRRPPPAYTAAKDSAVYGTSQVYRKISESASSESGRILETSFTIRPCSGQAWVVPAGHICRLTTPKGPQVGDLNIWNANNPRERLWAARTRQIHASHVSVGDRLWSNLPYLRPLVTITGDSLNGGQLHEVLEVNGQRKEGVGFGTSKWGGRVHDLLGTRCDPYVNLLMGGETFDFHCHSNLTRAVMPYGLTELDVHDVLNVFQVTGLDEQGKYFMETSPAKPGEYFEFFAEVDVLCALSACPGGMVPC

SEQ ID NO: 37860 - protein, 324 aa, A.fumigatus
  UNSURE (295): Identity of amino acid sequences at the above locations are unknown.
IIAPGSQVTLAQLGLPESFTPARFRFPTRMFPGEKKGEYEPYKIHEKRRDVKPSNGSDAPKEDVEMKDAETSAPEGAADTVTDETPQTTETGGQPENGEPHENNGEAVQETTQEVFYEEDVTSDEGAIYPIENGRIVDWPAFFALLTHVYNTLSPPFHTPIMLIAEPVWSARDREAITQFVFEKFKTPAFCLMDSALAVCYGYGTSTATVVDVGKGNVDVTAVTDFLVNEHGRSIALEGCGGYYMTERLLELLEPTGFTREMCEQLKRSNITEILPPGTPIPGTAETAQQGTHPXASASTGAQERVGVNGSVPRGPRQQHSSRG

SEQ ID NO: 37861 - protein, 90 aa, A.fumigatus
ERFQVVSLSISYELSGKYILIFCYFSHVQSESHVRQMLLIGEDPKKHIEEFSREFLNNFVNLLKTTHGEKKVHVNQFYQQVIADKEVSLA

SEQ ID NO: 37862 - protein, 131 aa, A.fumigatus
RNTRILREMEEQARPEWEKKKTVMSLDIKGGRVTRVYQSAAPAQSSSAAEEKEEDVEDVSYEKSKPTGGEAFSRNPLLAAGGLLRPVWKAADDKQERTATKERKQTWRRVQDDNDDNEQWILDGGLHGYTT

SEQ ID NO: 37863 - protein, 238 aa, A.fumigatus
REVKKKKCGLWMPLDTWHLDQILIHKLTNDRWNFIMNSRVEANERAKERTQAGHDAKKDFFYYLLNAKDPETGKGLTTPELWGEANVLMIAGSDTTSTTMSATIFYLVRNPRAMELLRKEIRENFSSVEEIVTGPKLNELVYLKACIDEAMRLAPAVPGAPPREVMEGGAMIDGVFLPEGTDCGTPTYSIHRQPEYYREPEVYIPERWIEGATCQAGSESWTTSKESVELAPEGLLPL

SEQ ID NO: 37864 - protein, 218 aa, A.fumigatus
HSGHKTLAYVTYNRFFHPLRSIPGPFLASITPWVQLYHGLKGDRHLWLHRLHEKYGSHVRAAPNFVSINTDRGLHDIYGHGKRLRKANFYNAFPAIKGVYNTHNAIDKAMHGRKRRVLSQAFSDQALKSMEDVMLLHVRQLCEILTGGLDGPKGEKSATAVFNLGDWFSYLTYDVMGELCFGKSFDMLISSGRRKLIELVDRAANRHYVVWPSFSPPP

SEQ ID NO: 37865 - protein, 144 aa, A.fumigatus
  UNSURE (110): Identity of amino acid sequences at the above locations are unknown.
SMGFSCPRARTAGPRRTRSTGNPSTTASPRSISPSDGSRARRARQAASHGRPARSPLSWRRRAFCPFSIGPRGCIGKSMAFMEMRLTIARLMFLFDLELADPQGEDEKGXLALVGTISPTASYGPNVVGPEEKFGISGFGENPG

SEQ ID NO: 37866 - protein, 226 aa, A.fumigatus
  UNSURE (81),(139),(182),(194): Identity of amino acid sequences at the above locations are unknown.
YILAPPPGMAAPGTAPPPGMQQANIPQPGRPAGFPPNFQPPPNMPNINFSAPVIRLGTSGPSKSATPDTSKEREAPGRRAXLGSTSLESQRQNVRDAMMQLQPPTREEIVRTIFVGGIYRGRRGDEGIEKILRSAGNLXRWIRATDADDKPLQVGFAEYEDPESLRTAVEILKGREVPVKRXTPSEEVGQKERXWKRAHYWFVYCPSGAFYRSDHVAIRWSLTTVP

SEQ ID NO: 37867 - protein, 83 aa, A.fumigatus
RVDQTSLDKTGSDAMNAAGDYSAAYCIINTDSSYAGHGMVRIKPLVFLLALSKERTNWDRDRPSPLAVETRLSAPPSAFSLPW

SEQ ID NO: 37868 - protein, 60 aa, A.fumigatus
LNVIHDGLNIVQSPLDRLDTPKVELQFRGGLVNINCNDPGILGNLARSRRGEVDNNTQWQ

SEQ ID NO: 37869 - protein, 520 aa, A.fumigatus
VVVDDSSLSYLEQYENSRGEQDPAERQARLDAARSKLANVLSELFHPTSPTRKEDSSAIDREGDTAMKDAEGADGTSAEVVTIPITVEDELSDIPPEMRETVAKEIAAFRERSNRRDIERLKREEEIESMERARNAGSRLNRLASPPPSAHSGPAAGANGVPLGPRDRGMPNAPSGHKGFGVQIPKDYQKGVSFVNGGAINGATVIYNDRDDEETDASDEELERRRQEKREAEMEKQFLDQERRWLNRERSRTAALEREKKRDKEEEAKAQEIRDEADRRYREWNDDIEASRKVEDYYADRGAWLRSRAAFRAREISNDEADRAAEERERARSAQQREQARGMADDFLARQAEELEARTQAPREPQRFKLSLGAAAQKAQAATTRRTVAEVEGLLEDEEEPQATARRPLIPIKFDSATEAAGLSDEERAQAARQLAAEIPTDKEGLWKWDVKWEFVDESVLREQLKPVVEKKIVEYLGVQEQMSVDVVEEHVRKHGHPQELVEQLEEVRSAKPIMNPQQS

SEQ ID NO: 37870 - protein, 200 aa, A.fumigatus
LGPRQTFTIGRGNEIVCAAISLLAPLVVGKDLDELTADWGKTWRYLVSDSQLRWIGPEKGVIHLALGAVVNALWDLWAKTLNKPVWRIVADMTPEGFVRCIDFRYITDAITPKEAIALPTEIEPPQSRSVSKDALTEPRAVPGIHYLIAGLAPVSPKEKPALPLPERDSCSLKGFQTTFKPSRVWRPSFGTRGPFPRIEL

SEQ ID NO: 37871 - protein, 122 aa, A.fumigatus
  UNSURE (13),(25),(68): Identity of amino acid sequences at the above locations are unknown.
RTVYKPVVCSFPXPLLLSNLLGWGXSLDRHFTSLKYFYSSTKTFRVLVLCEANLQWLIIGIRSADPPXEIPSGTQNLLDALVTAAPSVNTPHKYSPYNLFPRRRLQLHHRISYILALRLKTC

SEQ ID NO: 37872 - protein, 353 aa, A.fumigatus
HSPCEIQATVLTLHRPVNIQLVVEPLIRLARHLELNRAKGVCNLLDAVTERVRKVVRRIHLPLATSAEVALLVDVQNTPREDIPHLRVRIVQIHLHTQRSLSRLVLALLHSFKLLQRLLNRSRSVRARIPRFAPRTIRLATLGLDLRLGAVAHIGTISSDKLLRKLIQSVEVVTSISDPDRLVSQPAHNILNTAIVYLLLTLGVRVIEAQDAFAAMVLREPEIDRNCLAVTDVQEAVGLGREPSPDLGVFLGDGPFLVYICEEADLEHGVGVDRAQISCGLFGVGGLRLAASLLAIVVIVFAVGVLGCLLLGSFRLGCFGGLLFRGLFTCGGKALLCRSSCLLWSLRKSSFSC

SEQ ID NO: 37873 - protein, 515 aa, A.fumigatus
  UNSURE (1): Identity of amino acid sequences at the above locations are unknown.
XRFDLVQQDESNVAGHTEENSSTTAGSQQSSDNEAQKAKETPQTSPVLGPSDKLKPDEAVDESNKEGGADLGVEDFPTVDEMLSRSQDQHQQVTVGRVEVEENESKKPLEPTKPERRALTKPPIRVRVSRQSIAQKQLEDSDDDLEVVTDPAKCRRIAAFENLPAKKMQESASMLKLKALAHLTSPTRRSKTMNTAELSAMLLLQARQQAAKERQERIQELRAKGVIVETAEERAAMEDELENLVEKARQEADAIAKKERGSKTKKLEDVDDVDDEEDEDFELSGSDQEGYGDGKGDEEDEDEEDDEENEQGFVDSEAGEDEESEDEQTEVMSADESEVPAVRRKRPTRVISDDEDEDERQAPKTPAKPTPSTVNSVERPQFPGMTSDGLTMSLTQAFAGTLGASQPVTQEGSPAIPDSLPDPAQITHDRRDSESQIIIKDSQEQRAESTDILAGYTQPESRVSESPAPRAMSQYSQIPDPTQDAGFVLSPFDPSKRIPRGPPQFDYRNRACGTK

SEQ ID NO: 37874 - protein, 132 aa, A.fumigatus
IPGTTTPVPDGKSKHLRRGRAANLSMIEEQEEEGFEIDASAFDVMKKAAKTKTHVPFDPKTSKAKEMVEDAAEESDDEYAGLGGASDESEDEEDAYDRQMINDNSGETVDEKQLAALNACVPRVNCPKMFAN

SEQ ID NO: 37875 - protein, 394 aa, A.fumigatus
  UNSURE (394): Identity of amino acid sequences at the above locations are unknown.
SSPHWNIRFLPTMASTGETTLPERPKEAAAPAEQSLAPAGEKPSEEKSAKAPKPKAPKQKAPKNPDGKNNNNNGKKGGGKPKAANAKEAATDLRSVDPDAMFKVGFLADVYQERPISEKHPKIRTRFPPEPNGFLHIGHSKAIAVNFGFAKYHGGECILRFDDTNPEGEEEIYYRGIEDIVSWLGYKPVRVTNASDNFDRLYELAKELIRRDGAYVCHCTKAEIKAQRGEADGARGKARYACPHRSRPIEESLQEFEAMKEGKYKAGEAALRMKMDLDDPNPQMWDIFAWRILDVDQKGHFRTGGQWKMYPTYDFAHPLCDSIEEITHSLCTVEFEMSRQSYEWLNDKLDVYRPMQREYGRLNLTGTVLSKRKIIELVKKVFTTGLEGTARAQX

SEQ ID NO: 37876 - protein, 103 aa, A.fumigatus
RSSLVEATTCPSALLPCCARLQQARPLVLRRPSLTHQSESPYPLLERLSPRKAAVNYYTAAREREREREIRAKNRSGGSNITALLNKYASNRLGSLGGTGQWE

SEQ ID NO: 37877 - protein, 372 aa, A.fumigatus
GGGNGWTGSTQCVAGACCSSINDWYYQCFSGNCMPSTTMTTTTATHTTSTSTSGATGSLPTSFRWSSTNALVGPKNDGRNLAGIKDPSIIEVDGTYHVFASTAQASGYNLVYFNFTDFNQAGNAPFFYLDQSGIGTGYRAAPQVFYFQPHQLWYLIFQNGNAAYSTNKDISNPAGWSAPKNFFSSVPSIITENIGKGYWVDMWVICDSSNCYLFSSDDNGHLYRSQTTLSNFPNGMGNTVIALSDSNPNNLFEASNVYRVGNEYLLLVEAIGSDGNRYFRSWTAPSLTGTWTGLANTEANPFARSNNVVFSGTAWTKSISHGEMVRSQVDQTMTISPCKLRYLYQGLSPTATGDYNSLPWRLALLTQTNSAC

SEQ ID NO: 37878 - protein, 330 aa, A.fumigatus
  UNSURE (236): Identity of amino acid sequences at the above locations are unknown.
CSAHVNWLTRSDLRLKLICQMKGFIRALFFMGAALGSNFNQPVLWEDLADLDIFRVDDTFYYSASTMHYSPGAPILQSYDLVNWEFVGHSVPTLDWGSIYNLDGGQAYVKGIWASTLRYRKSNGLWYWIGCIQFRTTYIYTAPSVTGPWTKSGVINTCLYDCSLLIDDDDTMYVAYGATTISVAQLSSNGLSQVKTQEVFKSTIGPIEGSRFYKINGEYYIFTTLPANAEYVLKAXIPWGPYTEKLLLKDISTPIAGGGVTHQVCHLLISKPSNLWEYKVGIVQTPAWRMVFTWAFGWTPYPMGVLIPIPPLPNYFGAPYWVPRVNHQIF

SEQ ID NO: 37879 - protein, 61 aa, A.fumigatus
MEDLKWVDQCIYEIELDINRRMFDILYTAIGAYVVAQRVYSLNATNTVPSSASDVTYHRKA

SEQ ID NO: 37880 - protein, 147 aa, A.fumigatus
AAVRIHSELIHTGLGIIDRSITLVEERDHVTLELTRSGDSDLHHGLKDRRVAFHESLPESLLGGVLERHFGRIRHVGSTIVDDHLGTKHLVTDERTLFASKIETLLTSEKELLRDTTTNDLFLKFVVLEFAGGLHPADDAGIFTRTS

SEQ ID NO: 37881 - protein, 71 aa, A.fumigatus
CSQRRDLFSAPKKSSEKPGTRHVIISATTNEIGVVQTISTAHVLCKFDMTDSLGITMAINIMIISVVNQSK

SEQ ID NO: 37882 - protein, 258 aa, A.fumigatus
EVGRVLAVLGLDKKRDNRLGHEHGSHGVTELSIGESVARGTIHTEHGAYFTGSNLRYLLHLIGMHANNARNLDLLVVASIEDIGALAEGTLVHANIGQLPKVAFFQLESKTNKRLGVVRDKLDRSLVALPVKSEVFNFRWVGEVVDDTIKHRLHGFVGQCRTHEDGSELQANGCPADSGLELLLRRLSLLQEELSDLVVDIGKRLDEHPPPILHDRLDLLRNLILNHDSLTVRYIVVNGLHTNQVDHTLELVFSAYWH

SEQ ID NO: 37883 - protein, 239 aa, A.fumigatus
FLAGVNCILDINIERMGREYRVDCVTGPPQVAYRETIGNRVEFDHLLKKQSGGPGEYARVVGWMEPTGKLEDNKFEEQIVGGSISEKFLFACEKGFNLACEKGPLIGHKVLGTKMVINDGATHMTDSSEMSFKNATQQAFRKAFMESNPSVLEPMMKIAVTAPGEFQGDVISLLNKRNATINDTETGVDEFTVYADCSLNGMFGFSTHLRAATQGKGEFTMEFSHYEKAQPQLQYVQSF

SEQ ID NO: 37884 - protein, 154 aa, A.fumigatus
LRADTDFSRPGCAATCYALYRAYRSMKAGDSVEMNKMFRARIYAQFFTLVAVVAGGMYYKTERQQRREFEKMVEQRKAQEKRDAWLRELEIRDKEDKDWRERHAAIEAAAKEAGKRPAPKKLPEQDAARSAIEPADERSIGVLSAVRDLWMQQK

SEQ ID NO: 37885 - protein, 142 aa, A.fumigatus
NMYLDAQKEPQISFNVSSGTYIVISLDIDAPFPSLGFLGPILHWIHPGFKPSTDTTVTGETILTTSAPFVANYIGPAPPPGSAPHRYVFLLYEQPEGFNIEKHAPKNGKPVGNWQRIRYDLGAFAKEVNLGPVLAANYFRSN

SEQ ID NO: 37886 - protein, 456 aa, A.fumigatus
AHIDSGKTTCTERVLFYTGRIKAIHEVRGRDNVGAKMDSLDLEREKGITIQSAATFCDWIKKGDDGKEEKYHINLIDTPGHIDFTIEVERALRVLAGAVMILCAVSGVQSQTITVDRQMRRYNVPRISFVNKMYRMGANPFKAVEQINTSLKIPAAAVLVPIGAEDEFEGVVDLIRMKSIYNDVPNGETVVVKDEIPEKVKSVVEDRRRMLIETLADVDDEIAELFLEETEPTEQQLKAAIRRATIGLKFTPVFMGSALANKSVQPMLDGVIDYLPNPSEVENLALDRKRDEASVKLVPYNSQPFVGLAFKLEESNFGQLTYIRVYQGTLRKGANVFNARNNKKVKVPRIVRMHSNEMEEVSEIGAGEICAVFGVDCASGDTFTDGQLGYTMTSMFVPEPVISLFIKPKNSKDSANFSKVMARFQREDPTFRVSYNAESEETLISGRGELHSRHKH

SEQ ID NO: 37887 - protein, 71 aa, A.fumigatus
SVISKHQNHRLTYASLDAKSNALARGLESVGVRKGDRVGVMLGNSSEYAIVCRLSSRPSHELRLLLEINHT

SEQ ID NO: 37888 - protein, 161 aa, A.fumigatus
TGDEASMSPDGYITITGRIKDLIIRGGENIHPLEIENCLLTCPGVADVSVVGVPDERYGEVVAAFIICKEQDRRTVAEDKIRDWVRERLSNHLGKNLLSFLFSGKTSFIPQYANQNQLANSSEIRFFPFTFRFFPQDCERQSSEVQAEGDCHQDSERAEQC

SEQ ID NO: 37889 - protein, 63 aa, A.fumigatus
HYADIKPPLIDSTVGDHFASIVSQYGDREAYVTKSCASILLDLSNMADSHALKASYQNIRITD

SEQ ID NO: 37890 - protein, 422 aa, A.fumigatus
TADSDKELSAEPHLQVPLNPSFNATQVISALSHLGAAHLIISAESNLPRKEPRSNVPLLKHLVQDLYTGKVESAVVPSVKNVIFVDNSSGRVKWSDYKSLTPFTSVISDNVADANPLPPQDLSPSDVVNIQFTSGTTAMPKAACLSHRSILNNGSQIGDRMRLTAKDIVCCPPPLFHCFGCILGYMATATHGSAIVFPTESFNARATLKAVQEEKCTALYGVPTMFLEELGLLQEGEVEHKGFEFLRTGIAAGSSIPEALMKKLHKVLNLTELTICYGMTETSPVSAMTATDDPLDKRISTVGTLMPHVEAKVVDPADRSKILPINTRGELAVSGYLLMKEYWGDPHRTAEVMIADQEGKIWMHVSQPYLTAFSVSRHHKVAGDLTEDHRLATKPPCHRMATSRSRAVSKISSSEEARTFTL

SEQ ID NO: 37891 - protein, 73 aa, A.fumigatus
VTTSVRIFYLFFLAARHPSYLNMLTKINLLIVPKYVFFLSPSDSFPKTASGKVQKFKLKETAIKILKEQSNAN

SEQ ID NO: 37892 - protein, 93 aa, A.fumigatus
WVIGRCHGRNGTSFSHAVADGQFCEIEDLMQLLHERFWNAATSGDACPKKLKPFVFYFAFLKQAELFEEHGRHAVKCCTFFLLHGFQSGTGVE

SEQ ID NO: 37893 - protein, 71 aa, A.fumigatus
ICRNVPANDDRADFFVSNANRTRINSNGYVKNTDVTPARLPDMSLRNGVSLSREGMITARICSYARNLMAA

SEQ ID NO: 37894 - protein, 272 aa, A.fumigatus
MLIDWLHNKIVHRPVGGTKKSCMKFLKPRSDQDNTTKKLRYRNFISAHLRQTADRDIEMTTRKRNEFLDVVSDDDEGSDRGYDSEAAEESKGRLAKRRKTHTRADDVSDEESDIGRSESEDESKTRLKGKPKSKSQTTERSNDDDDEDEADDGEKMQVDQYLDATATLSPSQSRSQSPSTSSVTSKPTKLKKKPLDKVRPPKKNKTGVIYLSSLPPYLKPFALKSMLETRGFGPINKGLLDSLKWPSKFRPLRRPIPLNGNPTPNGGVEFPV

SEQ ID NO: 37895 - protein, 66 aa, A.fumigatus
KEHFSVHDLCFINGRDYPVARDILLTASPTPELGLLLGIRLCRQHFRTMGVLISLVLYRAQDKITS

SEQ ID NO: 37896 - protein, 326 aa, A.fumigatus
AKTVVAPLDRVKILFQASNPHFAKYTGSWFGLASAVRDIHRHEGVRGLFKGHSATLLRIFPYAAIKFLAYEQIRAVIIPSRDKETPFRRLISGSLAGVTSVFFTYPLELIRVRLAFETKKSARSSLAGTFRQIYNEQASVPSAAAKGTAGSAVTTAENVSSAMNKVVPRYGLSNFYRGFTPTLLGMLPYAGVSFLTHDTVGDWLRSPLLARYTIIPASDQSSHSQSQKGSRRPQLTAAAELFSGAVAGLVSQTCSYPLEVVRRRMQVGGAVGDGRRLGVVETAAKIWLEKGLRGFFVGLTIGYIKVLPMSATAFFTYERLKWSLGI

SEQ ID NO: 37897 - protein, 99 aa, A.fumigatus
PLSQSFCRLSLSSHTELHGASRPDPQPALKAPHDTTDVLAIRTERFQPSLLNSAGVNNQDPAKHIGMTAHVLGSTVHHNVGSELQGVLQRGRSKSRVHC

SEQ ID NO: 37898 - protein, 298 aa, A.fumigatus
YVMTEYDRPFSIELPAKRQAVTMAATVASWLGYIPSLAGDKELPDEPPKALPASWYYSPEIYQLERRAIFSKRWILVTHKLRFTKPGDFLRFEEAGFSFVLCLDREGNLNGFHNICRHRAYPLVSEDEGNVKILSCKYHGWSYSLNGKLAKAPKFEVVPGFQKENQSLFPVHVHTDALGFIWVNLDSSPNPVPWEEDFDGVDRQERFQRFDFTQYKFDHTWQMTGDYNWKTLADNYNECYHCTIAHPDVAKLGDLSYYYTVSTPGHIQHFSRPKPDKVDEDIQNASTYYFPNACMTVS

SEQ ID NO: 37899 - protein, 162 aa, A.fumigatus
QYRELLLSFTFGFSTTSYLLTSNHPRPHFFYMMRCVPTSATSCSMEYEVYRHIEASDEDFEYIDSFFKRVLDEDKHLCNAAQKNLNAGVFVNGQLHPDLESAPLFFQNTVRSLLKSHSDEERKINREIWPARQHSAGQATAEDVAFCLGLACSAAGSADLEW

SEQ ID NO: 37900 - protein, 364 aa, A.fumigatus
PIKSRQTIFTGVITYFVTKTLKMDHFDVAVVGLGVLGSGAAYYAAKKGAKVIAFEQFELGHVRGASHDTSRIVRTSNFAPEYVALAKSAYKDWAELEKITGYQMLTTTGGVVFFAPDSPTSASDFTRSLDTHDVPYELLDAQEVKRRWPQFNIPQSVSTVYTADSAIVHAAKTVSTLQSLARSHGAILKDNTPVERLIPQASGGVIIETPKGQFHAGKVILATDAWINKLLAPLSVHIPVSVMQEQVTYFKPTDAGTFEPDRFPVWIWHGANCFYGFPCYGEPTMKAGRDYSNNLMTPEQRTFVHSPQLLEQLTSFMNGFIPDQDRQPLRTITCQYTITPDRRFTPSPLVFTTGLEGSAVALCK

SEQ ID NO: 37901 - protein, 117 aa, A.fumigatus
NPHGRPSSNKGPYYRVLFTAHHTMRSINASENRSKFIMTAEALNNALPDFHMATRAIHADDFVSPHRAIAPGIHTAVNFRYARDPDELVPEENKDVRSLSGFISFSALTRTAAKCAL

SEQ ID NO: 37902 - protein, 348 aa, A.fumigatus
RGRQPNAPFDSHIYSRYTAPNANRLEVLLRSLMGGEVITYSTGLSAFHAMLILLNPKRIFIGEGYHGCHSVVDIIHRLTGIQKLDLTQIDQAGPGDIIHVETPLNPTGEARNLAYYRAKASEKGAYLTVDSTFAPPPLQNPLEFGADIVMHSGTKYVGGHSDMLCGILVIHPRRVKEGWLKTLRTDRQYIGSVMGSFEGWLGIRSARTMQLRVTRQAQTAERLAKWLQDQLKDETSPIAKVLSHIQHASLQEDDLKNGWLQKQMPGGFGPVFAVWTKNPEHARRLPSRMFIFQHATSLGGVESLMEWRAMSDARCDHRLLRISCGIEEFDDMKADILQGLESLLRDFP

SEQ ID NO: 37903 - protein, 66 aa, A.fumigatus
SPGIEQYAMRAFADALDAVPLALAENSGLSPIETLAAIKSRQVKEKNSRLGVDCMLTGNNGMYLIL

SEQ ID NO: 37904 - protein, 93 aa, A.fumigatus
IIDEAKRSLHDALCVVRNLVRDNRVVYGGGAAEIACSLAVEEAAVKVSSLGIHVLLQQTDSWNFRAPASNNTLCVPLRMRWMPCPWHWPRIRV

SEQ ID NO: 37905 - protein, 223 aa, A.fumigatus
RWFSGWGTLGAARNVGFRNWIKGRTGKGWAVALGRIGSWSKGVNSGIRDFSHPQMPDEVTDAKWGFWTCPFEPPKPKTKHKLDITSVDEFKKLQDYEREKFTEMIQHLKDSGANLVICQWGFDDEANHLLLQNKLPAVRWVGGPEIELIAIATNGRIVPRFEDLSPEKLGTAGRVREMTFGTTREKMLVIEECANSRAVTIFVRGSNKMVRRTCAVWKTERHG

SEQ ID NO: 37906 - protein, 79 aa, A.fumigatus
DAERAPQRVKGSRDATAADLFLAVRLYNSCCAWPLVNGYNKNEGTRCDRRIPQYKLLGISVISFVSFRHFSLCIRHVLH

SEQ ID NO: 37907 - protein, 141 aa, A.fumigatus
RALGFINDLREKGQPCLSVFHTAQVLRTILLLPRTKIVTARLLAHSSMTSIFSRVVPNVISRTRPAVPSFSGLRSSKRGTIRPFVAMAMSSISGPPTHRTAGSLFWSRRWFASSSKPHWQITRLAPESFKCWIISVNFSRS

SEQ ID NO: 37908 - protein, 885 aa, A.fumigatus
  UNSURE (56): Identity of amino acid sequences at the above locations are unknown.
ISSRYTRILTKYLTMNRPARSSSIRKDAHTNRSPPRTPPSQASNCKTFKRGLHPRXSLRETFLDDTNPADNANNSSNDSSEERDPHDLSLSPKHAARTSIVDNMLLSLDQFTFSTGNSILDDYRLFNSVFESELYGRNSQESAGPNRYRGHTFSSSLSSEADFGYDDSSTRYGTQPASAARGRRSNSSSQYHSSLGRFGSTRSREGTNSRGQLNDYRAVTGADQTTRGTRKSSKASSSTNLDFGSALIRGRADSSGERRSASFDYGTRPPFISTDFDSTFYDSTDAAPTPSVPAGPRKLHSSAQNDYVGVLNSQSSRTPVASRRNSIKSSRTNHARKIRPDTIGTSSILRGADSELANLTDDGLDPPPAISASLDPPAPSPTISFNKPAMLASPDSTPAKERQGFFRRVFGSSKNTASGPSESIQSDSTLPQENDPKETIAAGGSLRSRRQPLRTNVSGANALREGQPHVVNKKSSFFRRRKKSISTTDNLPPPIILPQELGPKAVEILKPEPSPVSSLRKVMNPYLADGIGAACDKSNSGPIRVAGAGPADNMDPILTSARNEKENVSTAPAKGGQTSKYSLYPPPTAGSGHDTSFLMNSSGDEESTARTAEMDSTSSVDRKQEKVAVEDALNSSEGDKGGHTTDGTSHIMIPTTTKSAPALSPVVESISPASVSPLEDSEYLTTETAAVNSATRTAGHRQRSSSGGDQRPQPSKLSIPAMKADASSQVSPADSDEFFTAANTPAVPSEDPKTPQIIEDIAECSDDDSSGGPSSSDRDQAKRLFDSQDQVVGNEPAAAWLGDPGRASIRAAYMELFDWSNMNILAALRSLCTRLVLKGETQQVDRVLDAFSTRWCQCNPRHGFKAVGTFTFPSPSITEYISDLT

SEQ ID NO: 37909 - protein, 135 aa, A.fumigatus
LRPDVVHTICYSLLLLNTDLHLADIEQKMTKNQFVRNTMPTIRRVAVEAAPDGFETSRPVNRSKLSTQESASSPGPSQQNSSNNPEASNADTDRPSHPPHKLVNRLSRTDLSIKLSGDPESHLRPVGPCPIPWVQ

SEQ ID NO: 37910 - protein, 400 aa, A.fumigatus
DPIPADLTSIGGPELGWILDGVFQDIHIETGELLFEWRASQHYPVTSSYEALDGAGKDRNNAFDFFHINSVDKDDQGNYIVSARHLHAVSYIDHVTGNVLWTLGGKLNEFTDLSHGQATNFAWQHDARWHANNTITLFDNAAHSNSDPDSESRGMVIQLDLSQRTAELLAAYYHPQQMRSVSQGNVQILDESGRVLVGWGHSAAFTEYTADGDLLCDVHFAASAFFSFGRVVSYRASKGTWVGRPLTIPDAAVMGDRVYVSWNGATEVVAWRLEVWDARAVEDSTFDVVAQFAKTGFETVIEIPEELGSPLFRLAALDAEGNALGYTEVLQKDQGVDVDELLDLHNWIVAAAFIISVGGLLLGLYQCCGCCQILPRCRRRPNEYQLVAFGDNDNGENDPV

SEQ ID NO: 37911 - protein, 107 aa, A.fumigatus
MTRSVKHTYLCHRRPTSTSRVSASRSSAQLARRILTGAVSVENNKVYQTVTMNGEVVSQQSDGKHHPLSSRSALTVSALDNDLKYLYSSNECYTGSGNCGLLQGYSM

SEQ ID NO: 37912 - protein, 75 aa, A.fumigatus
FLVSAAVRIKTNRAEITNVTVTLSAADESFGKTMALFSCTDAGFATTDNGRTWYTDYIAIQEIDFDSSSDASVQE

SEQ ID NO: 37913 - protein, 165 aa, A.fumigatus
PIRGSGHFYPANSVFLVMDFLEHDLKTLLDDMREPFLPSEIKTLMLQILSGVEFLHSHWIMHRDLKTSNLLMNNRGEIKIADFGMARYYGDPPPKLTQLVVTLWYRSPELLLGAEKYGPEIDMWSIGCIFGELLTKEPLLQGKNEVDQVSKVKHPLSFYIQIRSC

SEQ ID NO: 37914 - protein, 167 aa, A.fumigatus
  UNSURE (26),(32): Identity of amino acid sequences at the above locations are unknown.
NTRFHSTFRSVRADRHIQIFALTAFXIQQTWXGFRSLPNGKSFRLPPTSTSGLTENPPLLPRSKFPFLTNSGLRLLSSLLALNPSARPSAQECLSHKYFREDPRPKPKEMFPTFPSKAGMERRRRRETPEAPKRGQEAPALDFASVFGGQSSGDTGETGAGFTLRLG

SEQ ID NO: 37915 - protein, 65 aa, A.fumigatus
RDLAGALEIGDGVRPKFCYSDSVTITARLYHLLPDFISQLNADLNVTHQRHYSHQSAKSTGFGFS

SEQ ID NO: 37916 - protein, 250 aa, A.fumigatus
SFIGAMSAPTKSRWAAEDPEDDAIIAQRKREKEEKRRAKAEKQRQLEEQARLQTAQAKQQQQADALNGDSEAPPKKRRRLSNEQPQTSAVSESAAKAPAEQTRSTLLRFPGPEWGPCRLVDNFERLNHIEEGSYGWVSRAKDITTGEVVALKKLKMENSPDGFPVTGLREIQTLLEARHTNIVYLREVVMGTKMDEYALPSYPLPPGFQCPLPALVLLPPRKVQDTPVLTNSGLWALLSRQQCIPRHGFP

SEQ ID NO: 37917 - protein, 159 aa, A.fumigatus
YRIRSVDWHAWCRCLRNMTMVDLTINGLAPGKYWATVREAGDISRGAESTGGIWEALKAKVMGAEAPKEPRGVFGSVDVDKHGRGNVFLDRPVAIWELIGRSMVVSKSQEGPFQREDPDTLVGVIARSAGVWDNDKTVCSCSGKNVWQERQEQVSQGML

SEQ ID NO: 37918 - protein, 71 aa, A.fumigatus
FMFVIPGVKRVEANLKDQLVLIEGTAPPSSIVTAIQATGRDAILRGSGTSNSVLYLPFSRQTCEGGTDLVV

SEQ ID NO: 37919 - protein, 70 aa, A.fumigatus
KGRPSRGLGREADGGLYGRNRSIVSTPDGYFSERFLSETYGMIHTWLLQSSSLGAERDSKQDVLESRWAK

SEQ ID NO: 37920 - protein, 133 aa, A.fumigatus
QFANPEVQAPALSTPTDEMFWSPEDPSKPNLQFLKQHFYREGRLTEEQALWIIHAGTQILRSEPNLLEMDAPITVCGDVHGQYYDLMKLFEVGGDPSETRYLFLGDYVDRGYFSIEVRDDFLGRLMIGEADIG

SEQ ID NO: 37921 - protein, 96 aa, A.fumigatus
CVLYLWALKIWYPNSLWLLRGNHECRHLTDYFTFKLECKHKYSERIYEACIESFCALPLAAVMNKQFLCIHGGLSPELHTLEDIKSVRSKLLECSF

SEQ ID NO: 37922 - protein, 70 aa, A.fumigatus
VLNFTLSKISNRYVQSCLNVPFSSFTHVSLQIDRFREPPTHGLMCDILWADPLEEFGHLHHRRRRIRSSG

SEQ ID NO: 37923 - protein, 688 aa, A.fumigatus
LYVCCIDSANLTICDTGAGIAGILKAVLAMRHKTIPPNQHFHNLNPSVKPSFKHLSIATSPQPWPVVPPDTPLRASVNGFGSGGTNCHAIVESYVPEIHDNGPWGKPKEMRQVPNGVAAPETDFSPIPLIFSASSGTALRAMLERYQEYLERTEVSLLRLAMTLNSHRSTLPVRVSIPGTSKADVLAAIRTQLAKVGSNPGAEIGTRSSVPEFDHVRRPKILGVFTGQGAQWAGMGQGLMAKSALFRQVIEVMEEAMAQLPDGPEWSLKEEIMKPPKTSRLGEAEISLPVCAALQVGLVKVLRSAGITFSMVVGHSGGEIGSAYAAGKISEVDAIKIAYYRGVYTKLAIGKDGKKGGMIAVGFGYEDGLNFCAMEQFADRLTVAASNSPKSVTLSGDLDAVHEAKELLDAEGVFNRVLRLDTAYHSPHMYPCAAPYLAAIERCGLVAGKSNGTAWASSVYDDNRMMTSAQDKDLEAAYWKDNLIGRVLFSQAVERALDEGNGDFDLALEIGPHPSLKGPTLETIRHKIGSEIPYSGVLDRKADDILALSTALGFSWLTLGSGVVDFAGYVSGFDPSNASILNAPALPDLPTYPWDHKKVLYRESRLNKNVRHRVDPPHPLLGSRTPDDTDYEPRWRNFLIMEELPWLRDHCVQDQIIVPAATYSVMALEAAKSFAGVFTTRWKIRNWY

SEQ ID NO: 37924 - protein, 380 aa, A.fumigatus
VDNDSHCSLNAMVYTHSPKEPIAIIGTGCRIPGGSTSPSKLWDLLYSPRDLTREVPAESRFNPKGFYNVDGEHHGASNATNVYFIEEDPRYFDAGFFSIAPREAESIDPQQRLLLETVYEAMENAGLTLNGMRGSATSAYMGAMSADYTDTQLRDIENVSKYMITGTSRALLANRLSYFFDWKGPSISVDTACSSSLAAVHLGVQALRAGECTISCVGGSNIILNPDCYLAATSLHLLSPTGRSQMWDQAADGYARGEGVCVFFMKTLSQALRDGDRIDALLRETCVNSDGRTQGIALPSAEAQVSLMRTAYKNAGLDLSKAEDRPQYIEAHGEPLVIDKFFVTNPFVSLRNRYSSGRSQRSIRHCHHVFPAWRRPQSST

SEQ ID NO: 37925 - protein, 72 aa, A.fumigatus
NPEMKQPALIPGKTDESRVGEIFGISIAFTCTTVVIVVLRIFTRLKYVNQLRSDDYIILGSLVSFLPLNCVD

SEQ ID NO: 37926 - protein, 151 aa, A.fumigatus
LFYAAEIAYYVIVGVTKISLLIFYLRIFTTSSFNFLRKLSYVLLVAISLLTVIYVVVCVFQCRPIALAWDKGMKGTCINVTVFFYCHADLNILADFCIYIMPMPLFWTVKRSAKERAALVGIFAVGGFVCLTGIIRLTSLKTAMASLDPSC

SEQ ID NO: 37927 - protein, 127 aa, A.fumigatus
HVKLDGAALGFSLAIGQVCCSHISRRAADLPNIRTLILHSQDAIQLLTVLPLAAVAFAQCKFSSVINSQLTLLGDDDVAVPKAVSLLSQQEIFLLIDPYELVDGKLDCYVNFYLLEPCSIINGRVER

SEQ ID NO: 37928 - protein, 241 aa, A.fumigatus
TIPNEIRANCVIDSGSSLSPPFDKYKSRTLVTSPEHQTYAKQRQSTMTSPFSSTLVSPAEFHAAVNSPTNTRRIVPVAAGRRTVHTPAYHAQHIPNSVYVPASTTQHQHANERSFFDMDLIRDTTSPYPQMLPTAAHFASCIAAVGITKDDVLVIYDAVDVGIYSSPRVAWMFRFFGHQAAHVLNNFRVYVQLGYPVATGEMRPLPSVGEYRVSPPDSDRVIAFEELRELVLGGGEGFQID

SEQ ID NO: 37929 - protein, 81 aa, A.fumigatus
KSFYFRPIVQSLLSNKHISTCKISRGQGDGVPKASITAHLTTEASASNLLLKGRCSIGSYSIKLSRKALNHPTIVHVIDVN

SEQ ID NO: 37930 - protein, 209 aa, A.fumigatus
NTMSTPGIGGDFQLFSPLESTRRISQGNSLSVDQSSTDDASQDWTQWMRWDDEQAFPETANASPSSPFDLAFISPSASSGREASDAMHKDFSPDISLDFKSPSLGFFPGGDLNTNVSPQPDHVGAGSLSVHSNSPLSSIGASRKRKTGSDDDGSTMTSMFKAKQAPSKKRAHNVIEKRYRANLNEKIAELRDSVPSLRASYKQGKRQLR

SEQ ID NO: 37931 - protein, 730 aa, A.fumigatus
  UNSURE (718): Identity of amino acid sequences at the above locations are unknown.
ETVCLVYGPPTSRANGNSGDDDDDGVTSASKLNKASILSKATEYIRHLEIRNKRLEEENTALKIRLRQLDKAADQIVTSAASVSSPSDCTVSTESGASSSPSVFSHAEDVPSDHSPTSSHPPEGLIKVPDAWKRMRAAGSNESPYSQSYIQYKKTDSHSSQSGGGRMRSHLPNKYMLGALAGLMVLEGLGTEKKTESTAKGLLAVPLNLLNRVQLPSEVYSSAAFQYFWSSWHARAISHFLMLAILVVGSAFIVFVYLFNSDPRRQYSASKVAPDVTLSSCNFRRQAWLTSIQRVGVPRHRFFHEWYVVTSRCFEYVLRCLLGWKLYSLVTGVTEEDEKGRVKTWDIAIDAQLAGGDAEISKSRLVLTIFAAGTLPRSPMRMMLKALHCRILMWRVGEPGSWTFNVSNDVARSLARYQWDLARKMNAALPKDHPDSLPSHLATLLKIDCDDVMIDTIIQRAANLTWNRPTQEGTDDDEALLDVVEEDPAIQSSLDALAAWWSSHLLQGALLRYFEASSGGPDAKKSRNVFKSKIKLALDVAPQPSAAHTRALVMMAVFFERDRVANIGSVLAALPKEKGKNKQNQASNFLDSSLPISVREEISTAVRCAMIAAIFNARATGDTSLPATFTVEKAIHWYNRLPLDPVELTLLEFAVVYHLLHILASDIDYLASSDSTAPSSPMSKASDMLSSSSDDGEDGASQRNNNIILHPMPQLGPXCFRAYLLGSHCL

SEQ ID NO: 37932 - protein, 287 aa, A.fumigatus
KNVEEFIEETDSRLQCTTLEQNVKDFGLTYFGMGDKRQGIVHIIGPEQGFTLPGTTVVCGDSHTSTHGAFGALAFGIGTSEVEHVLATQTLLTRRSKNMRIQVDGELPPGVTSKDVVLHIIGVIGTAGGTGAVIEFCGSVIRGLSMEARMSMCNMSIEAGARAGMIAPDETTFEYLKGRPLAPKYDSAEWKKAVAFWSSLASDEGAVYDKTVVLDGKDIIPTVSWGTSPQDVVPITGVVPGPDDFEDENRKVAWQACPRVHGSRGWHPDTGHSRRQGVHRLVHQRAD

SEQ ID NO: 37933 - protein, 62 aa, A.fumigatus
VARGRLLHVPGHEPRHPLPPGALRQHLQPQFRGSPGCWRPHSPHVPRHGRCRCHHRPPCRCA

SEQ ID NO: 37934 - protein, 517 aa, A.fumigatus
LPSTTAPSGRRLSPSGRASRLMRALSTTKPWFLTARISFPPFPGVLPRRTLFPSRASFPDPTTSRTRTARSPGKRALEYMGLVAGTRIQDIPVDKVFIGSCTNARIEDLRAAAKVVRGKKVAANIKRAMVVPGSGLVKQQAEAEGLDRVFTDAGFEWREAGCSMCLGMNPDILSPQERCASTSNRNFEGRQGAGGRTHLMSPAMAAAAAITGHLADVREHLTASPLLAKAQPHLDIQEEHEDPTTEDEFDRIMDMPADNEPHANSSAATAAAGSTAGLPKFTTLRGIAAPMDRSNVDTDAIIPKQFLKTIKRTGLGSALFYELRYNPADGSENKSFVLNQEPYRNAKILVVTGPNFGCGSSREHAPWALLDFGIKCIIAPSFADIFFNNTFKNGMLPVVISDPAVLATIAAEASAGREIEVDLVNQEIKDAAGSKLASFEVDAFRKHCLINGLDDIGLTLQMEDKIRAFEAKRTLETPWLDGSGYLKRGNRGGATMIQAAPVPKTNRGDVKTEPLEW

SEQ ID NO: 37935 - protein, 134 aa, A.fumigatus
RQGYHSHRFLGYFPAGRCSHHGRRSRTRRLRGREPQGRLASVPSSTWVSWLAPGYRTFPSTRCSSARAPTRGLRICAPRPRSSAARRLPPISSAPWLFPVLVWSSSRRKPRGLTASSRMLVLSGARPAAPCAWA

SEQ ID NO: 37936 - protein, 157 aa, A.fumigatus
TRSPTATPRFSSLQAPTLAAAAPASTPPGPSLTLASSASSPPPSLISSSTTPSRTACCPSSSPTPPSSPPSPPRPPPAARLKLTLSTRRSRTLPAPSSPPSRLTPSASTASSTASTTSALPSRWRTRSVPSRQSAPSRPPGSTAAATSSAVTAAAPP

SEQ ID NO: 37937 - protein, 189 aa, A.fumigatus
RTLDALHSAYCHNSLTDILSAICLPIAIILWSVGLLVFFGLPNYYRQIPGKVPSFYKSVFRRKIVLWNFVVVIVQNFFLSAQYGRNWSCKSSNHGILQYPQGQWLIFLTFSLQQFCGAPRMRKPGRWEFCVPFSLALSGPRCCTCSVTYPSLIAGSFQCSPAAWGLHDGPRCFGVSQGLGCMFPGLAGT

SEQ ID NO: 37938 - protein, 197 aa, A.fumigatus
VRPPAPWRPSKLRLEVLAQRSWGERMSGFMPRHMEQPASRHSKPASVKTRSSPSASACCLTRPEPGTTMARLILAATFLPRTTLAAARRSSIRALVHEPMNTLSTGMSCIRVPATRPMYSRARLPGDLAVLVLEVVGSGNDARDGNNVLRGSTPGNGGNDILAVKNHGFVVDSALIRREARPEGDSLLPLGAVVLGS

SEQ ID NO: 37939 - protein, 159 aa, A.fumigatus
SEGIGKQKNLEKIHLFGGVFLPVTYKFGGDPSRFPGKLKGPWRYVIYRRGASRKAFHSVAGDSRKGEADCTLLLPPGGSIFFAVNFGDENGVPVKQWVFRACVIQGTQQAYVIGLWYWGTSLAQASNSGIINPQGDITNTWRITYVRRPSFRLLSQFAN

SEQ ID NO: 37940 - protein, 195 aa, A.fumigatus
VVEPWDIAISSRAVADISHFLPATVLWSSKNAEAWQVGILCAFFFGAVWAALLYLFGYLSKSHSWIIPVFACGLGAPRWAQVLWGVSGIGLYVPWAGGDLAGALVSRSLWLWLGVLDSLQGLGFGMILLQTLTRMHICFTLLASQVLGSIATICARAFAPNNIGPGPISPDLTAGVSSVANAWFWIAIFFQLLIW

SEQ ID NO: 37941 - protein, 466 aa, A.fumigatus
RHLPFQRLGLDVSTVGFGDGGGLDHGGAAAVTALEVAAAVEPGGLEGALCLEGTDLVLHLEGKADVVEAVDEAVLAEGVNLEGGELGAGSVLDLLVDKVNFNLAAGGGLGGDGGEDGGVGDDDGQHAVLEGVVEEDISEGGGDDALDAKVKEGPGGVLAGAAAAKVGACNDENLGVAVGLLVQDEGLVFRAVGGVVAEFIEEGAAEAGTLDRLEKLLGDDGVGIDVGAVHWGGNAAEGGELGEASGGASSGRGGGRVGVRLIVGRHVHDAVELVFRRGVLVLLLDVQVGLGLGQQRAGGQMFTHIGKVAGDGSGSGHGGGHEVSAAASTLATLEIAVGGAGAALLGGEDVGVHAQAHGAAGLAPLKTSIREDAVKPLGFRLLLDQTRTGNNHGALDIGGNLLAADDLGRGAQILNPRVGARADEHLVDGNVLYPGASHETHVLEGTLARRPCGSRPRSRRVRERRP

SEQ ID NO: 37942 - protein, 64 aa, A.fumigatus
EDERTFGSSQIGGCCQNGHTALALGHTGTNCVILAAWGEGFVCHIDGEGSLSSDFQSHNDAVKS

SEQ ID NO: 37943 - protein, 83 aa, A.fumigatus
SNPTVSHSGSQLAVSLLHMTVTYDYAHLSGNYPLCSDLKEIKHFLASNPQHWDGRSSMTGWDSLQLTSFSTVTIVQMEYKLRR

SEQ ID NO: 37944 - protein, 113 aa, A.fumigatus
CESQREKGEYQATNLRHSGSSKLRLHSISHNDQSLSETVLFTVDLTIDAQLLRNYGVQTKCHRSSGILGLRATHGCTKLFSSCIESGAVAQKDLPVLILSALSFVPSESNLRF

SEQ ID NO: 37945 - protein, 62 aa, A.fumigatus
SFTVTMSQSMFETAAYATGYCSVVQLTRVVCQYLTTLKMPINLPTSNSSSSSVSYLSEYVKV

SEQ ID NO: 37946 - protein, 232 aa, A.fumigatus
PASVSQTWNILPSSSSSNALKQITPSHWVCYSFTTPHGCSQVRLFLLQVEYQLTRPGIWRLIKGWMDPVIVSKIQFTKTIADLEKFIPRGQIIKELGGTEDWTYEYVEPDENENDRMEDTTARDALLAQRASIGDELLNTTSKWITAIKNKDEEEAAAAKTHRDALIEQLRLNYWQLDPYVRSRNYLDRTGVIKVGGKIDFYPKSQPQSDVEVAKVVEVEHVEQTQVQVVNA

SEQ ID NO: 37947 - protein, 274 aa, A.fumigatus
PAGPPSRHSSTENLTLTMAHSNVPEGFLGNLTADQQKKLEQLWTIILTLSDALTSTTTIDTNEPQHRRNSSLARTNTTASKGSTATTPTCAAQVSQHLQRLGLHAPEIKQVQHILTQITPEEIRDGLLSTAKHDHPDALLLRFLRARKWDVTKAFVMMLDAILWRMKDFHVDEEVIAKGELHALKASRDTSNAVAAKNGKDFLAQMRMGKAYVHGVDRLGRPIVVIRVQLHKPGAQSEETLNQFIIHVIESVRLLLVPPVETAVSNRFLVDGQN

SEQ ID NO: 37948 - protein, 81 aa, A.fumigatus
RLQAVVFDMTGFGLSNMEYPPVKFIIKCFEANYPESLGVLLIHNAPWVFSGPFVPIAGGVSTDETRYLAPHQRLDGSRHCL

SEQ ID NO: 37949 - protein, 67 aa, A.fumigatus
CAVTEMSVKELGARLASLRCLARLQRSWIPIFLFVHNNGIAILSLSVFNACAVKDPGNISGNCVFFF

SEQ ID NO: 37950 - protein, 113 aa, A.fumigatus
KGSGSIQQLFLVIMATATVELPYLASHYAIAESTLTTLTQAPTVELVNQLLEAITKKAHEYDELKSDKLRLEVELENAVRSSDSKIKVLKSSVEKSHTEVEEARKKLHESGGL

SEQ ID NO: 37951 - protein, 320 aa, A.fumigatus
PTLSDTCLENARSALESEIATLKSSTTSNESEVNTLKSRISSLEASNRDTLGLLESKSAAYDKLAEELSAQHKRTIELRRELATAEQNLQAANSASASARFREQSLQQELDLTKKNNEWFETELKTKSAEYLKFRKEKTARIAELQRENEEANSTIDSLRRSENALKSRLDEVEQRYEESLSSIQQLKEEAIQAAESFRIELDSTNRLAELQGNAAQTAKQRVQECQLALEKARDDAAEEISRLRVEIETEHADKEAAERRVAELELTVTQLQSEGATAGRSMSPARGLNGTGPSTPVRPGTPSGAFSSSPRGWKDPRWS

SEQ ID NO: 37952 - protein, 319 aa, A.fumigatus
NKISLALGAGRRLNHQTFTSVTSLPAIAIMSLQQQLKSFNASVTDYANRMPQQRRFVHNGSTSTSQVPSSTSTPTPGSDAQRKRQNADIVYSQPANTGTGKDIMTQVLFAVEHLKSKGVPLRYSDIVSYLSLQHRSSDEGYLQALRRILTQHEKVLYDPSGANGEGTFAFRPPHNIRTAEQLLQKLQSQTTAAGMSVRELREGWPNVEETINRLEKEGKLLVTRNKKDDHAKMVWANDPSLVQHFDEEFRQIWAKIKVPDQQAVKEELGKAGITPTSKNKIVKVRPKVEQKKVKKPRRSGKTTNTHMMGVLRDYSHLKR

SEQ ID NO: 37953 - protein, 68 aa, A.fumigatus
ENNIELLKKNIIGVKVRIERLQGKFKMSQEMGAGDREGVIEGFEKLGTEVGMGIAKTVKERGDMKDKK

SEQ ID NO: 37954 - protein, 189 aa, A.fumigatus
EDNDRICKLFIVYDSNQNPFRNLIPLAVKDPLLLSTVLALAARHRANEGQTFNGMEAPVPWTDNAQHNALVFKHQAIHGLSQIVGDPESCRSDPTIASIFLLIFLDLVESGNDRWNAHLEGAKALLSLNKSLSQVHDPGQTVQEIRSFITKQIYLYVHSALNLSDSNTKQNRDTWWDLCTAEPIIKFSC

SEQ ID NO: 37955 - protein, 472 aa, A.fumigatus
HKVLPTEKMAKFTIYYRIPSTRLVQSQSTDMRIQYGQVVRCHKHICVRERNKSRAVQGWVCLKDLTGRLIGISLILSCYLQLGIGQVQLRQPSHERGLARCRGSDVAVVRPNGTTWLIPGKLDFAPGECERIVLVARNGGSAIITRDIVVDTGLARWDCRIAWITSAVSDNFPCCGSIGVDAVGVGLVDHMQVGEVLPDQPSVVRRAGRNVLGQQCPVPGLRDTGSEPYGHGLEAKKLAEDRLLPGLNGFRFDDQGRDLLRVEMARLAPGPGLAPAGELDVEVDELADRLERIVLCALAWGRLAQHVAHEGGVAGLVRGHVFDQAAVLDSETSIEKVLRAEDFETIVEKVQLDIFLVDAQSHGLVVKIALHHVHGHGAIGSHAAGGHVWHRHWLSQLAIGIVVRGGWVGLNGDSGRQRGRILLSTGGGRGARVGTVGGDASRGTVDERRSRTGLIPTGRLGLNGGNVDNLCF

SEQ ID NO: 37956 - protein, 164 aa, A.fumigatus
SNAEGITTSEAQYDSNGFARNSMSFPELTGNTFPRFGTTGFGEAMDADAETTFSIRMQPKQGRPGSNLNHEVRMSLKNAMVKFITLTTVQSYLGLEDVFPIWLPSMYVIVIVDTLIYLGTSLYQSGNSPRANTLGTRGKTVPYKVGWFCEQNIFDAPLHGWLFL

SEQ ID NO: 37957 - protein, 236 aa, A.fumigatus
SLSHGKAATSSRPTTIKAAKRPVNCKPSAVSHRLSTIKMKSLIWILAGSAAAVPLVSNSETKVINIPAIETQPPRGNEPGAAPPLVNSATTGVTTHGAYSGTPTTTGAEQYPSTLAATIPIQPNPTATYYNPNGKLTEPMPMPYMPAGGVGTNGTVPVYMVQSDFDYQSVALGVHQEYIELDLFHYGLEVFSAQDFLDAGLTVEDRRLIEYMATHEAGHATLMSNMLGESAPRQCT

SEQ ID NO: 37958 - protein, 246 aa, A.fumigatus
SSHLDSKEVATLVVEAEAIEARQQSIFRQLLGLQPMPIWFAAGIPQSWHWTLLAQYISSCPANNTRLVWQNFPNLHVVNQANPNRINANATAAWEVVGNRTSDPSNSTIPAGQSCVHNNVTGYNCGPAISRDKYDPLTFPGRKVELTWDEPGRAVGPNNSYVTSTTAGKPSFVAWLSQLNLTYTELKVTGQNKGYTYQPASEVFETDPALNGTAFIALTDTDMFVTPYNLTILNPHIRALGLYQAG

SEQ ID NO: 37959 - protein, 96 aa, A.fumigatus
SPSSGSLPALPQQSPLCPTQKQRLSTFPPLRPNRPVGMSPVRLLRSSTVPRLASPPTVPTLAPLPPPVLSSILPRWRPLSPFSPTQPPRTTIPMAS

SEQ ID NO: 37960 - protein, 194 aa, A.fumigatus
IGSIQKNPREPTFFTNRALTRIRLEKWAGVEHDARTAIELYGPKNTQSLKSCWYLAQALLGLGRPQEAYEVAIDAYRASLAAKSAQTENLSKTVLRAKQQIWAAKETARLREMNDTLATVESLIEADLNRELAELQAKLDKGEIGQTGFVEDQKALRADAEKNIQNVRDAFRIASNGDIQERVSGSSSWESVPC

SEQ ID NO: 37961 - protein, 65 aa, A.fumigatus
YGQAKFKYNAWKEISHISAQKAQALYIKQVNDLINKYGPRAYIDTVLVGIWEAIVIGRYSLLLGV

SEQ ID NO: 37962 - protein, 212 aa, A.fumigatus
KAPESPSVIVQVDSFHRTYAVYQRLSPLVSRLSIHTHSTLLLPSGFYSVIMSTDLKPLRIVMACDEAGQPYKEIIKAALEKNPLVESITDVGVNSTSDKTAYPHPAVAGAKLIKEGKADRGLFICGTGLGVAIAANKVPGIRAVTAHDSFSVERSILSNDAQVLCFGQRVIGIELAKKLANEWLTYRFDPKSASAAKVQAITDYEREFAAAQ

SEQ ID NO: 37963 - protein, 71 aa, A.fumigatus
LMNGQYALGQEQQAESIESNYCESGEWSIESKFLKLRLSHLDITQYKLRPSCPFSDMDTLARWIVLRCQSS

SEQ ID NO: 37964 - protein, 77 aa, A.fumigatus
VVPDYLVDGITFEIMHDPVITPSGTSFDRIGIIKYVEQSGVDPITRVPMTVNDLRPNYALKAACEEFLNKNGWAVDW

SEQ ID NO: 37965 - protein, 160 aa, A.fumigatus
EVCLFTPCCPNGFYHVQPHHPSHLRYFSTPHTTSPNLKLPQQNTLPNLFYQLSIKQTERNNTMASLTDFFTAFDAAASKEKFTPALQSAAASIDKAALQAALDAVLAGGDDATAAGNDAVLKAGFEFATELVKMLEKEPGPEEKLGVCPFSLHTPLGITE

SEQ ID NO: 37966 - protein, 118 aa, A.fumigatus
SRPRLTMFYSETLLSKTGPLARVWLSANLERKLSKSHILQSDIESSVNAIVDQGQAPMALRLSGQLLLGVVRIYSRKARYLLDDCNEALMKIKMVGLIALSDQCLPSFTDMCGSRRSV

SEQ ID NO: 37967 - protein, 167 aa, A.fumigatus
PTHRLFTAPDARSTVELSTAAEDALAGEFALTRESLALLAILPIRRTVRAAGPDVKEEISLWTSNGSGQSKCHILVTAMWLSVRVPVLSLHTTFTDPRVSTLGSLRMIAPRLAIRSTPRARVTVTMIGSPSGMAATARETPMVNISRSFRPCTNPITTINAITPKEI

SEQ ID NO: 37968 - protein, 518 aa, A.fumigatus
AFRLTNNNELTSTVVAPGGITLPDVLTESDLFMNLDSSLLLSQTLNLEPEGKRQGHSMDFGSQLLPDSSFRRSVSQEPPRLEDHTLVDLNFGDDDDTHIGRDFSMEVGRDAPAPRPFEDDLLSDAGKFNDVDLQLDLGEDDAPLDKMDLGEDGAQDHFNFDETLDIGGDEELTREAEERRQQRDSESAMTELSEEELNRLEAEDVHLSKGGRGILDEEYADGEHEDGEQGDDITVQQAQRAKRRKVMPVMDLDEAIDFKPSHIKEQQADRSGILKPAAFLPRDPVLLTLMNMQKNGDFVSNVLGAGRGRGWAPELRDLLSFDAIRKAGELKRKRDSGIADMDVAAATAPALEFGEEEAIVPVDEGVGLDSTLHQRSEIEFPGDEEEQGLHMSDDEGMHLPVEEMDDTTVHPVDSGPVSVGTKHAVHILRDALGESAADQKKSVKFQDLLPEKRTSKADATKMFFEVLVLATKDAVKVEQGTDSVGGPIKIRGKRALWGSWAEENTSAEAASQPTEVAA

SEQ ID NO: 37969 - protein, 159 aa, A.fumigatus
TVMSSPCSPSSCSPSAYSSSRIPRPPFDKCTSSASSLLSSSSESSVIADSESRCCRRSSASRVSSSSPPISKVSSKLKWSWAPSSPRSILSRGASSSPRSSCKSTSLNLPASLRRSSSNGRGAGASRPTSMLKSRPIWVSSSSPKFKSTNVWSSKRGGS

SEQ ID NO: 37970 - protein, 725 aa, A.fumigatus
TSTSTYSLLGPEETAERLQTSLLHGLTPAEAEIRLLRDGPNELPHEEPEPLWLRFLKQFKETLILLLLASAAISFFMGNYDDAVSITLAVTIVVTVGFVQEYRSEKSLEALNRLVPHHAHLIRDVPPSSAPLMNNSTTAALGPDIELEDLASKSPSSASAAIKASSTVLASELVAGDLVLFTTGDRIPADIRITAATDLTIDESNLTGENEPVAKYPEALRSTKAAVSHSPKIVSPPRSPFYDAPASGAVGADIRLNEQHNIAFMGTLVRSGYGQGIVIGTGAKTEFGSISVSLQEIESPRTPLQLSMDRLGQELSYISFGVIALIVVIGLVQGRKLLEMFTIGVSLAVAAIPEGLPIIVTVTLALGVLRMAKRGAIMRRLPSVETLGSVNVVCSDKTGTLTLNHMAVTKMWHFDCPEPFEVHNDISSLTSGPAARTVLRIGNIANNARLSRVSANSPASASSAAVLSSTVDRASGAVKSRWVGQPTDVAILDLLDTFGEDDLRDRISRRVAETPFSSERKWMGVIIGSAQNDAPSFTGANNVAYIKGALEQVLTRCDTYLTKDGREVILDEPRRHTVRQAAEHMASEGLRVLAFASGAVRDTPGGGRVFGSRTSTPLSITSQGDEDDRYTGLVFAGLVGMNDPPRKDVHKSIRRLMAGGVRVIMITGDAESTAVAIAKKLGMPVRDSPGSRPVLTGQDLDRMSTADLAQAVFTTGLEGSTDVLQ

SEQ ID NO: 37971 - protein, 176 aa, A.fumigatus
PRSPEYPMLFESEEEEMDTYAVELNSFVDTVLKMAYDHGQGRNMIFSSFNPDICLLIAFKQPSIPVLFLTDSGASPVSDIRASSLQEAIRFASRWSLLGVVSQAEPLVLCPRLVRVVKESGLVCVSYGTLNNEPANVKVRFQCYPRAASRSVLKLRIAPSRRGNRCCDRRLRSRHS

SEQ ID NO: 37972 - protein, 60 aa, A.fumigatus
CLFKHCNHHVRLLPWCQGKVIRATLTSIICDNLVYICTYLNGRFRISMCASTKRQPPTVT

SEQ ID NO: 37973 - protein, 64 aa, A.fumigatus
AQGLANQPLSDLVYPHHAVIDPVIIRTDLPQRPYIVTSLNLPPDSTQKNERRRCDGALRNKCQR

SEQ ID NO: 37974 - protein, 376 aa, A.fumigatus
  UNSURE (190): Identity of amino acid sequences at the above locations are unknown.
LECKDPAPSLLTIVLDTNPHAWALLEDSLPLSTAIANILVFVNAHLACNYANEVAVVASHSQKATWLYPCETKEDNGKSTSKTGRDEDGDVAMNGSGAGAGAGFAAAQVNKYRPFRIVEEQVTRNLRELMDSTSGADVAATTSTMMAGALTLALSHINRRSIAWADAHGGTAAGPPGAVEAGSSGAGRAXADTGAEGLQSRILIISVSGSTDSAHQYIPIMNCIFACQRLHIPIDVCKLSGDAVFLQQASDATKGVYMSLSEPRGLLQYLMMAFLPDQRSRRHLVIPTRVDVDFRAACFCHRRVVDIGFVCSICLSIFCEPPENGDCLTCGTHLEMGDYGAKPAVVARKKKKKKARTNGASATATPTPTPTPTPGP

SEQ ID NO: 37975 - protein, 374 aa, A.fumigatus
TERRCNVSPRGSHTPRSTEPIKTCGHRYLTDKAMIVVSLGTMDMRKHMEAVNLDRIPMVNAHSTQLDTALSIVVSANGAEGEPEIIDLPVQDNISTEPIVFHAADPSKVRLLFDLIPTYAGSKDQIVGRGVALLSSVKPTIGSHRINLKGDSTVPIMAANTLEVIGSVTFNFLIITPFKHPNMSITGNRTYYKSMSSTMVIGHRGLGKNLASRRSLQLGENTLPSFIAAANLGASYVEFDVQLTKDHVPVIYHDFLVSETGIDAPVHTLTLEQFLQLGESGVSRRSTSPYQSPDATGKKMGSPSFRPRSMSVGEFEYDAAELNERIKHTRDFKKKGFKGNTRGNHIQAPFATLEELFKKLPKSVGFNIELSEFL

SEQ ID NO: 37976 - protein, 260 aa, A.fumigatus
LTLSIAQGALRAPVVNPADKYQDKTESLHKYGQYVMSCLPKYVQQFSVWKDELTIYVPPTGIIPVMSFLKYHTAAEFTQISDITAGDFPTRDQRFEVVYNLLSIRYNSRIRVKTYADEASPVPSVTGLYEGALWYEREVYDLFGVFFSGHPDLRRIMTDYGFDGHPLRKDFPLTGYTELRYDEEKKRIVIEPLELTQAFRNFEGGTTAWEPVGSGVDRKPDSVCLVTNSCEAMETNMVQYSSSSPPLSRSIRQGLPIRLC

SEQ ID NO: 37977 - protein, 86 aa, A.fumigatus
PTFPFPLPFLFFNIFAFLSRVLWIFLTALLSFQRPIHFFLGFFASFTFPLLSGSRLTGIGVSHPSAHTYSISTLSQGRSLCRVARK

SEQ ID NO: 37978 - protein, 130 aa, A.fumigatus
RIRFHTRFKADLALKHRKAAAAKKKEAEKREIEASSRKNLAGVRVVQKNLVYVIGLNPTIRDESQLLQTLRGKDYFGQYGEIEKIVVSKAKPGGNPNQGIGVYVTYATKADAATCIAAVDGSTNGDRVLR

SEQ ID NO: 37979 - protein, 63 aa, A.fumigatus
RRVLVCLKCFPIAGVIRQLADNFDLSPLCIEEFDLSDKNFKPCPCGYQVCCSLLPSGVHWCKF

SEQ ID NO: 37980 - protein, 184 aa, A.fumigatus
FYCRAQYGTTKYCSSFLRNEQCNNRNCTFLHETGEDSDSYSRQDLSSMNTLSSQRPNGIPSGPSHAIPAHVARSSALPTSQPMRRQASKDDTTGMRQPDGSALPSSASWANKDSAINRTRRASLAGSQASQSPRPVHATVAQGVEEVKKAEKQSQERRQTRAPSEARPANLQRSVQTRPDPIAP

SEQ ID NO: 37981 - protein, 434 aa, A.fumigatus
LENILKAVKSPDFKFIFSAAGLSTEEVALIENHPSFIDPYGGVKRRAMREKAEQERAKREQELLQNAAAEEESRESGSLQLGGEPDDAHPPRGRGGRDSHGAIQPPSQQGTTTNSAIGSPVSAASHQFQGLNLGGRSLTPLQQQQLMLLKSAGSQQAGLVDPLQSGLGSSVLDQASQVRQGLLQSQMAQFNALQAQNRQSSRFSFTNDANAKNLPNVRMLSQQAGLMQSGTPNPLAAPSPQHGLANNFYTSGVQGPPPGLKTAGTPPISGGGMFAQGHGFTTNANLGLGGNVGKQEANPELMRELLRGRSGTNTGGLQGQEAAKREFMFPFLQQHQTPPPLTPANGLLSSFYGSQAGTFSEAGPQKQKKKGKKHRHANTSSGGGGVVDLADPSILQARMHQVGANTTAGQALYGSQGQGGYNHSMMYGGGFNRW

SEQ ID NO: 37982 - protein, 352 aa, A.fumigatus
DEWNDTASAAPRDRNHVTISPKRQVLPAVIAVCSKKLFLPNHTPPSSEGTLKFLGRSQRATDVSAQLGLSLCHLWLILEFVSIMDELFDVFEDQPQAAAKVTDVAPKRPKKDKSKKRQVNGDVKENGAATEPKEDIEIPDAPTGELADGEQAEAPATENNEQQPDAKRPRLEKEPQPVLADEFETAQEREVAASAGLQAAKETTSVKLSHQVRHQVAIPPNYPYVPISQHKPPENPARVWPFTLDPFQQVAVASIQREESVLVSAHTSAGKTVVAEYAIAQSLKNNQRVIYTSPIKALSNQKYREFAAEFGDVGLMTGDVTINPTATCLVMTTEVGRHDSSSASWMFADSCA

SEQ ID NO: 37983 - protein, 259 aa, A.fumigatus
SLDNRKEDICANPIAELQEFEEKRANMTIPDEGTIREYYELRTQLDKYADDIQAVISHPDYSLPFMLPGRLVHIKHKDKDFGWGVVVNYKQRKPPKNSTEEIPRDKRYVVDVLLNIAEGPSVATKTFEELPSGVRPVKEGKNSRMEVVPVLTECIRAISHIRMKLPKDLNPKEAKNGVKKSLAEIHKRFPDGIATLDPIEDMNIKDESFKKLLRVRPYIFFCIYFVFCAWLTIITESGGPRVSFAFQPTAQLTPPTRTL

SEQ ID NO: 37984 - protein, 400 aa, A.fumigatus
VIGSTAEPEKLLTAMAVRGVVWEETIILLPDKVRYVFLSATIPNAMQFAEWIVKMHNQPCHVVYTDFRPTPLQHYFFPAGGEGIFLVVDEKGAFREENFQKAMGSIADKKGDDPSDAMAKRKGKGKDKRLNKGGNEGPSDIYKIVKMIMLKNLNPVIVFSFSKRECEACALKMSTLAFNDDSEKEMVSKVFNSAIEMLSEEDRNLPQIQNILPLLRRGIGVHHSGLLPILKETIEILFQEGLIKVLFATETFSIGLNMPAKTVVFTSVRKFDGFSQRWVTPSEFVQMSGRAGRRGLDDRGIVIMMVGEEMDPAVAKEIVRGEQDRLNSAFHLGYNMILNLMRVEGISPEFMLERCFYQFQNTAGVADLEKRMLNRLITGRRIFVLTLLQNSRNLKKRGPT

SEQ ID NO: 37985 - protein, 275 aa, A.fumigatus
LSSQKVEVLESRLLSNPLHNSPRLPELYEQYSEKVELGTKIKETKKKISEAMSIMQLDELKCRKRVLRRFGFINEAEVVQLKARVACEISTGDELMLSELLFNGFFNKLTPEQIAAVLSVFVFEEKSKETPALTRDELAKPLKEIQAQARIVAKVSQESKLAVNEEEYVNSFHWELMEVIYEWANGKSFADIWYVVYLSALSSQSPLQKLTCLSHSGMTDVYEGSLIRVFRRLEECLRQMAQASKVMGNEELESKFEEALTKVRRDIVAAQSLYL

SEQ ID NO: 37986 - protein, 117 aa, A.fumigatus
GLRQLVPRESRSFFGLLLENEYTQYSSDLFRSKFVEETVEKKLAEHELISRADLAGDSCLQLHDFGLVDETEPTKYPLTALELIKLHDGHSLGNLLLRLLYLRPQLYLLGILLIKFW

SEQ ID NO: 37987 - protein, 79 aa, A.fumigatus
RGVFAGQPSSQHLIVSTPASFIPVAIFRLGASMLSWSWISHEPWNGSLGYLSYQQSNQCSPLTHNFPWSAEWLTPYSIG

SEQ ID NO: 37988 - protein, 90 aa, A.fumigatus
VSLIGPIYAWSYNPSDDTSHNLPPFHISVYLFLFERFLSHSTTAFLYTIHFLLFEGYFVQSLETRFDKDLCFPVLFAFDIFSVLFVCDTL

SEQ ID NO: 37989 - protein, 151 aa, A.fumigatus
EELAQANSKIEELEQQNSCLRDNLDAKTSELAELTQDIERKSNEIVTLRSRSNLSQQNWLKEKEELLQQESYLQSEFEQAKEAMHNWEILAMEERSIRESLGEKVIDLEEQLVALKDSYEKVACERDSQIATVDGLQRALQEIQSGRAYPV

SEQ ID NO: 37990 - protein, 101 aa, A.fumigatus
LFLARKQELRDLVESSNTQLEELRRALQGAEAKAFEAESALQAAQKELERVKPFEKEVKEKNLLIGKLRHEAVTLNDHLTKALRFLKKGRAEDNVDRLVRI

SEQ ID NO: 37991 - protein, 91 aa, A.fumigatus
VISLKSWSWIYDEGSALNRGMNLKVDRQVNRLPYEMARTVIKEVDSSTEYVVDFPTLKFPNLENPTPLLLNLFSGAYQRCIKREIISELFC

SEQ ID NO: 37992 - protein, 143 aa, A.fumigatus
DWEVKLISGAGNKKDNITVIYTPWSNLLKDGSMATGQVSFHNPKMVRKVYVRQRENAIVNRLNKTREERFPDLRAEKEEFLKKKQKEERRARDEQRAREKQEKREREQLKWQKEHAYDDLFTEENMQATSNQDRDSDFLDDFM

SEQ ID NO: 37993 - protein, 78 aa, A.fumigatus
RLTTEQREQAGLARPGTSSNAGKFKMPSISMHRTPSTPTLATDFLDHGNPNKESLAELWSNFLEQESQASGNPESPKP

SEQ ID NO: 37994 - protein, 89 aa, A.fumigatus
ANRQQGVLRGLLDSDNKATINESMSESDCKPFQPALVPRAFRIEMRWNAEAEGSLGDSVLSAVAGAKDILVAFSSVTPVFIYISKAKVS

SEQ ID NO: 37995 - protein, 104 aa, A.fumigatus
RMRWVDSIQVRYKTTSSSTVRREGSMSMSDFVSGTGNDSFNGFLFHSPRFTLSRSKRSCVRFGLDSRTSSANDLMSGNCQSITEQESQRHMAGTYLRDQVGKYA

SEQ ID NO: 37996 - protein, 127 aa, A.fumigatus
SILGSRRFQYNNDDYVLSIMTEFQQKMGPPDPEQPQPPEQRVRKRRRRTMACTQCRSRKLRCDREYPTCGRCVQSKTPTKCTYEDGFLWQQPNTVASPVFSDRGSTSTGSDAPSRSGARTLLPGTRG

SEQ ID NO: 37997 - protein, 437 aa, A.fumigatus
  UNSURE (243): Identity of amino acid sequences at the above locations are unknown.
LSCSVMLWQFPDIRSFAEEVRLSSPNLTQLRFDLERVKRGLWKRKPLNESFPVPDTKSLIDMLPSRRTVDELVVLYLTCIESTHRILHVPSFLKELDEFWAQKDNPALVSTGFVVQLLLVLACAWNLADFDTLQLKNEASLKCYTPVEWVLHVEKWLDNAHIKRPEITALRIQILLIIAQNGFGMKRSHAWLATGTLVKQAMIAGYHRDPSRYTKISVFNKEMRRRIWTTIVELDLQVALERXMPPSVQESDYDTAPASNINDNEIQETSTELPRERPLHEITDSSFQAVLTQSLPLRLKACSLMHSPRISCRYEEIQRLDWELGRHLQKIPAWPTAQNDDCQSKNKVTLLKSLLETKIAHSLLSVHTPFAIEAPREPLFAPSARSRLEVATLILSNQKRLHETSKQLSLCNFGEWTVQAFCTVCQILHAGSSTHSE

SEQ ID NO: 37998 - protein, 119 aa, A.fumigatus
ICHIFITTQRRESDDAMFRIQLLLQACVLFHQAVVGSPSLSPKEKSALFSNTDKYPLPNQGNVITHDPNIIEYNDTFYLFMGGVHIPISKASSLDGPWTRVGTDLDGPSIIEKQNRTRP

SEQ ID NO: 37999 - protein, 131 aa, A.fumigatus
SDRRPYRQRKNRLSSPTRISTRSPIRAMSLPTTPTSSSTTTPFTSSWEASTSPSARPQVSTGPGQESEQTSMDPASSRNRTGLDPERRRWSSTTAHSTATTRSAPAAAATAPSASQRPIPSTAGNGPITER

SEQ ID NO: 38000 - protein, 195 aa, A.fumigatus
QSQRMMISASNLRSPEDLETEKDNKGNTVLILPSFTFVDCVKPEDVRELVDRYIDTPQDAGTSQSDSGLISRPCEYDYVVLLCSHKRRDARCGITAPLIKKELERHLRPLDLYRDAYDERPGGVGIFFVSHVGGHKFAANVMIYRKKEQQMIWLARVRPEHCEGIVKYTLLQGKVVHPESQLRGGFDRLRGLTSW

SEQ ID NO: 38001 - protein, 139 aa, A.fumigatus
PVGQDDCAPASVCTPQSAYHFKLPCPCPCPCPCPCSCLVTVMRSRRGMPQSDLHHNTGTGRSVRGRLLRKTLSFHCCIASIFQSPLFLQVHDPSPRPYPYTASGYRCKPKHIISDRIQTPTPEQVNEKKNMDFPPGHPG

SEQ ID NO: 38002 - protein, 206 aa, A.fumigatus
ATSSFGYVEYVNAADAAKAYNAKKDTEIDGRKINLDYATGRPANNNNNQDRAQARARNFGDQTSPESDTLFVGNIPFSANEDSVSELFGQSGTIVGIRLPTDPESGRPKGFGYVQFSSVDEARQAFNDLNGAELNGRPVRLDFSTPRPSNGDAPRGGRGGFGGRGGRGGPRGGGRGGRGGFGGRGGGAPNKARGGIPEFKGTKVTF

SEQ ID NO: 38003 - protein, 153 aa, A.fumigatus
TLRAGPSGPVVKTCLIHLAKLHPVSVMSSTSTRPTLPRLTTPRRTPRLMVARSTSTTLLAAQPTTTTTRTAPRPALGTSVTKPALRATPCLSATSPSVPTRTRSRSSSVNPVPSLESVCPRTPSRGAPRASVTCSSPQLMRLARPSTTSTALS

SEQ ID NO: 38004 - protein, 142 aa, A.fumigatus
SPIMATEKGDQNPEKIEQSLPQKIPYWRLVVDQGVLTQQIIDYPYKGSGTEEDPYEVVWMENDPRNPMTWTQLRKWSLTMTVAVSTLAVALVSSAYTGGVREIEAEFHIGSEVATLGVSLFVLGFAIGEFFPGFVRSLPVRG

SEQ ID NO: 38005 - protein, 265 aa, A.fumigatus
  UNSURE (230): Identity of amino acid sequences at the above locations are unknown.
CASGPVLGPIIGGFLGMNAGWRWVMGFLGAFSGAVWIICTIFVPETYAPVLLRRRAEKLSKHTGKVYVSKIDIDQGRVTLKDAFKTALSRPWILLFKEPIVFLLSLYMAIIYGTLYMLFSAYPIVFQGVRHWNQGVSSLPFLGIMVGMMFAVTYSVWDNKVYFQVQAKHGGFAPPRGRHAAHPDGFGCHPYWIFLVRLDQLPVDPLDCLHPSRCSVRFRYGSGFPGHHEXSHRCLHHFRRVSPRSQFRPPFDFRRRFPIVHHLYV

SEQ ID NO: 38006 - protein, 170 aa, A.fumigatus
GFRGVFFFFFGDFFFFKKRKKKKKKSILAGRRLILQTGIHWASSIPAFLALACVPFPFLFYKYGATIRKRCEYAAKSDAFMRKLAEQMKQAPEPESEETEEPVFDRTEAPAPDVSDVSETESNVEELPDVRQMRSRASTRTASSLRRVVSYEGNPYDIDRVNTRESFTKK

SEQ ID NO: 38007 - protein, 100 aa, A.fumigatus
FIINMSIYSFGINHYVTQVKSLRHSGVGHLFELYNSNVCLVKSHLYFSRRKDSIDETALHDVTSGTRDILVVASLFKLTQSQGSQIFSTSYDSGETEVEN

SEQ ID NO: 38008 - protein, 205 aa, A.fumigatus
  UNSURE (81): Identity of amino acid sequences at the above locations are unknown.
CLLSPTVFGTTRFISKFKPSTGDLLPPEEGMPPTLMVSVAIPIGFFWFAWTNYPSIHWIVCILAGAPFGFGMVLVFLGIMXYLIDAYTIFAASVLAANSVLRSIFGAVFPLFTTYMYEDLGESFSFFLVIFFFLKKEKKKKKNLSLLAGGSFCKQESIGRPQSRRFWRWPVFRFPSCSTSTALPFVSAASMPPNPMRSCGSLPSR

SEQ ID NO: 38009 - protein, 144 aa, A.fumigatus
IGPLLWAPLSEMFGRQIIFTVTYCALTAFNAGSAGAQNSWTLIILRFFAGAFGASPLTNAGGVIADMFHAKQRGIAMSLFAAAPFLGMSSSSSYCIDRMLMRLRSCFGSNHWWFPRNERRMAMGHGLLGRLLRCSLDYLHYFRS

SEQ ID NO: 38010 - protein, 70 aa, A.fumigatus
HFCGDHVLEAYVDLVSLFGVISSLIYSTEWYLFSVVEQYRGIDLVKPSPTLNAWGSVILMYVPPTFHSLD

SEQ ID NO: 38011 - protein, 980 aa, A.fumigatus
  UNSURE (1),(2),(3),(5),(702),(715): Identity of amino acid sequences at the above locations are unknown.
XXXDXPLRAAGSFQPRGEDPRWTGKQMISMALPSGLNLLRVEKDNSSLAEKFSPLTDGGLLIHGGQLMYGMFSKKTVGASGGGVIHTIFNEYGPDTAVAFFNGAQTIVNYWLLHNGFSIGIGDTIPDAITIQRIENCVRERKKEVEAITASATENTLEPLPGMNVRETFESKVSRALNNARDEAGSETEKSLKDLNNAIQMARSGSKGSTINISQMTAVVGQQSVEGKRIPFGFKYRTLPHFTKDDYSPESRGFVENSYLRGLTPTEFFFHAMAGREGLIDTAVKTAETGYIQRKLVKALEEVMVKYDGTFQKLSWVMGIKFIYGEDGLDGAHIENQRVDVIRCSDDKFRERFRVDLMDPERSLGPEVLEQANEIAGDVEVQRYLDEEWEQLLKDRAFLRTVAKEDDEMMQLPINVQRILETARSTFRIREGAISDLHPAEVIPQVRSLLDRLLVVRGDDPISREAQENATMLFKAQLRSRLAFRRLVTEYSMNKLAFQHVLGAIESRFAKAAANPGEMVGVLAAQSIGEPATQMTLNTFHFAGVSSKNVTLGVPRLKEILNVATNIKTPSMTVYQLPHRCHDKESAKQLRSVVEHTSLRSVTEATEIYYDPDIQTTVIENDRDMVESYFIIPEDVTDATSRQSKWLLRIILSRPKLLDKGLTVQDVAAKIKQAYPKDIAVIFSDNNADEQVIRIRQIQDYXEDEDDERLEFDVXLKKLEQHLLDTLTLRGVQGVERAFINEKSKVRVLEDGSLFASKTDPLCKEWVLETSGSSLGEVLAVPGVDATRTYSNQFIEVFEVFGIEAARTAVLRELTQVLAFDGSYVNHRHLALLVDVMTVRGYLTPVTRHGINRADNGALMRCSFEETVEILLEAAAFGELDDCRGVSENLILGQMAPAGTGEFDLYLDQNLLNTVVSNNARFGVMGNIGANDAIISDCAATQYDTGSPMQESAFIGTPDPESAFSPILQASAESPGGFTE

SEQ ID NO: 38012 - protein, 190 aa, A.fumigatus
QTIEQRADLRDNLSRMQVTNGPFTYPECAPSSFKDSLHVDGKLHHLIVFFRDSAKECPVFEQLLPFFVEISLDFNIASNFIGLFQDFRSQAPLGIHEIHTESLSELVIRASDNVDPLVFDVSTIKTVFSVDEFDSHHPREFLEGTVILNHDLFQGLNQLPLNITSFGSLDGSIDQTFSTGHGMKEEFSWG

SEQ ID NO: 38013 - protein, 240 aa, A.fumigatus
CFLICMLLFYSSNKFWESYAERLPSSFGRGYSDCPSDAPQDDRLFATQIFLALSSSPVSWTGAGSGKFCLVGYSLGGGIAAAFASYFPNLLSGLVLLAPAGLIRDSQISLQSRLLYSRGLVPERVLGFLVGRRLRAGPLTTPKPKNEKLNAADALTEELPSQTVGNMQVLSRAYPHVSVPNAVSWQVNNHAGFVHAFMSSMRFGPILKQRQWDTWTRLGKHLAAQKQLSTEEQLTNGLPK

SEQ ID NO: 38014 - protein, 65 aa, A.fumigatus
QMVFPSDKVLIMCGIHDAIIVKDEIVPDATLALQGNVDFEFYNAGHEFPSTLYDKVAQRILELLQ

SEQ ID NO: 38015 - protein, 153 aa, A.fumigatus
VSPTLANTQNCLLTFNSRFFFSDGDYIFVPKLQEDDPYDAAWAGLEQCLCDAPPNMISKYSLKYVFEQVVGEGQLEHLSQFFRHTLSIPDASWSDLTGELVERSQNHCVDFDQIFHMYKYLSEMEIFSIDDLRQVSTFLFLSWDCIKELNFYF

SEQ ID NO: 38016 - protein, 335 aa, A.fumigatus
TSRLTWIFASWIQQRLPMKTAERFSHIWEPWSCRLVQFDLQYWRIIDPCATGFASKIREFHLRYLYLTHNRRQIEEDFCNVCVYCDHGTMNNPHEEEIYLPHSHPYGPKALLGPTEYSQGMEVLLMHSTYFESIPSRPHSDYPSWRAWLTTSLGIRERLSLVSSDGDSLSDSWTYIAETRPGKLLGLLQYLWKYQSSELRQNADLIMEIQSMNARKLCNRDLPDDCRLDETYLPLSNLRALCHRFMEEDEPFPFLYLEELLDEELYSKWIFLHNDFSVGKDDDMGFLLNVLYWIQSANPDESALTSYERLWDLYITIGAKHLAAEDRVVAGDKIK

SEQ ID NO: 38017 - protein, 95 aa, A.fumigatus
CQSRIVSRTILPVSTCMYREVAIAQYGRNLTLNLDSRTGKKANISCFSSKGLESTVRGNAKTTSASENAVLVSSVLRRLRLSLVGSSVAVRLVTW

SEQ ID NO: 38018 - protein, 105 aa, A.fumigatus
RHRSLQAFRSGVADNMLVLVDAYADWCGPCKAIAPKLELFSNQYANIKFFKVNVDKVPDVAQELGVSSMPSFYLFRAGDYVEKVVGANPGLLETYIKKHAESVQG

SEQ ID NO: 38019 - protein, 276 aa, A.fumigatus
NLRMSKYVLFGRPWPRRGPPWQRLSLPRRSPALIKPLSTGTTPKPTSSRPNGRLQVWPWLAGPILGVSLFLSAHRRPMQLETDTGLQRGNLTRDESQDDIDLPKEDAILTTAPNVPPPITRTRPVLLHVPLTTATKTRQLTSQYKYDTWTFNDTVPGPFIRARVGDVVELTLTNHDLSGNPHNIDCHAFTGPGGGAAVTTAEEHETKTARFKLLYPGLFVYHCAAAPVPVHIANGMYGLIYVQPEDGDALSPVDREYYVMQSEFYVFTTGWKGRSN

SEQ ID NO: 38020 - protein, 276 aa, A.fumigatus
YQMHLMTQSGLQSQVSMQDYSIPARDGFPLEARSYRPVGVPSPQRLPVYLHLHGGGFLFGTLASEDAICSRIVATLATENTPVVVVNVNYRHTPEYKYPVPWNDAADALHWVHDHLAELGGDGDNVVVGGISAGAWMTASLTLAQHLGTDEQLAKRPKIRGQVLMIPPLVGPGCYAPQLKYLKDPKLSSYVDSEHAPILPVTRINSFMDLLEAKGHETDLVLNPGNATAEQVRGLPPTTFGIAGRDPLRDEGLFYAKLLTDNGWVRVEQRHCGQAY

SEQ ID NO: 38021 - protein, 794 aa, A.fumigatus
  UNSURE (2),(5): Identity of amino acid sequences at the above locations are unknown.
AXEAXDAKGARGELFYPEYYSMSKIMTGLRAGTLHQGVFNVSPYNYLEGSVNVAAFDKPLLILGRDNSNRAIAGDVVVIEVLPKDQWKSPSTKLVDEEAVTRNDNPEAEDNEEVVTEKERKALQEEVKKAHGKHSEGRPQPTAKVVGVIKRNWRQYVGHVDQSSTGASASSGRRQQNVFVLPMDKRIPKIRVRTRQASDLLGQRILVTIDAWDRDSRYPTGHFIRSLGELETKGAETEALLLEYDVQYKPFPKAVLDCLPPEGHDWKVPADKEHVGWKGRRDLRDILVCSIDPPGCQDIDDALHARPLPNGNFEVGVHIADVSHFVKPNNAMDLEASARGTTVYLVDKRIDMLPHLLGTDLCSLKPYVERYAFSVLWEMTPNAEVVSAEFTKSVIRSREAFSYEQAQKRIDDPSQNDELTQSMRTLLRLSKILRQKRMDAGALNLASPEVRIETDSDEVGDPLTDVKTKAMLATNSLVEEFMLHANITVAAKIYDSFSQTALLRRHATPPPQNFEELINQLSKKRNLELDVSSSRALADSLDRCVDPENPFFNTLVRILATRCMTSAEYFCAGAHAESEFRHYGLASPIYTHFTSPIRRYADLLVHRQLAAAIGYEGEDGRAQVEGVMTRNRLEDICRNINYRHRNAQFAGRASIEYYVGQALKARGEKMAADGVDAGIEEEGYVMRVFENGVVVFVPRFGIEGVVRLEDFVLPGESAVRSAEERRELLVRRESDFDGEEYTLRVSEKGHPEKERGVTVELFQRVKVNVSSVKEEGGRGAGKRRVRILILGAGK

SEQ ID NO: 38022 - protein, 158 aa, A.fumigatus
TPVTLCLCFTSDIVVWRVQNFYFPAPRINIRTRLFPAPRPPSSFTELTFTLTRWKSSTVTPRSFSGCPFSETRSVYSSPSKSLSRRTSSSRLSSADRTADSPGSTKSSRRTTPSIPNRGTKTTTPFSKTRMTYPSSSIPASTPSAAIFSPRALSACPT

SEQ ID NO: 38023 - protein, 122 aa, A.fumigatus
DHEKQNANNQNSNIAIQHRFEDIHNRPKQSMDRLQKAAGLGVWYIRILSFVRGHSGCLFGPCIILSTFTSFTPCFGSASATTTRSNSGFEGSDKLIAECGLAINGTLFDRTYMFLALIHVRS

SEQ ID NO: 38024 - protein, 916 aa, A.fumigatus
RTPPLTTRNSHTDFYTSSSPLIKTTSVDPNDTDETQADVESAVSGPSATASETLPEGELSRPATASGPMLSIPEERSSKKRAVSPGRRLKKAFSSNSNKKDTNRERTSSTSGASTKSGGLLSRRSSLSSKRSQTMEVEPLPVPPPVLTNLKEDKPLRISDGPNPPRTPPHTAHPAPQTTVTPPTPTDSRSEFPRLFSSPDVTESPESVKSKDLPSGVIVSTSGNMISHRRVRSASSASHKPSKLSNSISVLTPTAEEPKAPSRSPSSNQQTGFFSSVFSAAQNAASTLSSSLNPQAKARMVAQPEPAASDESQSKSTAEGSKENEWSTGEKKPSAIDTLGSGDLNFSHLDIDAPSGGSVSTPDGVVITKPDRVTEKRAAYKKDEEAARLEDQHAARAVSMAYEKPSEQSSAHPAEEGLELQSANSLSRADGDQTTPSGSIFEGETGTRPYRSGSVRSRLAQRRHRGSSGATASTVGLAGASAIALGVPGANASVPRLTGFAVASKKRNRDFHQLFRSVPEDDYLIEDYSCALQREIILAGRIYISEGHICFSSNILGWVTTLVISFDEIVAIEKESTAMVFPNAIAIQTLHARHTFRSLLSRESTYDLMVNIWKINHPALKSSVNGTRVATGTGDKTEKAGESEVESDDDEEEEIYDEDEEGDNAESVFGPGGASANASERSLPTKGLSRQASGLLQNGNGTAPTAMPNSSGESKAGKSSPGGDLDADFPGPATHPPTEYTESNGQYDKVIKDEIIPAPLGKVYSYVFGPASGSFIPKFLVENQKSGELQFESEKKGLTNESRTRKYSYIKPLNGSIGPKQTKCISTETLDFLDLEKAVLVTLSTQTPDVPSGNVFCTKTKYLFTWAPGNQTRFFMTCTIEWSGKSWLKGNIRFRSFMNERGLTLRTYRSYRKGCH

SEQ ID NO: 38025 - protein, 173 aa, A.fumigatus
LDWSKHYLHSASTPRPVPSLPSLFPHSAIFLMEEPAIPEPPPVPQTEPQGFSKSNRTWTTPADLDTMWSSGRSNGGASISSGSDRPKSQAGEVAETAKAGSSGFSKLLNARRKRKKEKEQKQTEESSLVSQNDPDLQESRSNESRGESASANDNLSPPGEVITLLTDDSEPDR

SEQ ID NO: 38026 - protein, 178 aa, A.fumigatus
TRSFQPRGEDETQNQIADENRRLADLSGGSYSRKEEQVQQAKIEAAEIRKQCEEHQQSARQLYQEAEEAEIAVKLAAAPIDKMKAEVDQAESNLRSLSREGIRRTGFHERMPALLKEVETERSFSRKPVGPIGSYVSLLKPEWSSILENALGTTLNSFIVTSKRDMNILSHIMQRVGW

SEQ ID NO: 38027 - protein, 233 aa, A.fumigatus
GVATSTNIRVHRIQRDVVAGLRRELSNQEQQLRSARSRLESCKQAIERHKRRSKELQVLLQRQEDQVEELTDALERETVEDGHLDVLRTTLQEAEAEKHLNEGSLKDSVDAMDAIMRKLKATKQELSAKDAEISTLQEELRVAQGEEHLVQDKRRKIIGLKNTAIERVNDIKLNRTRIQQEKDRVAARVVEYEEKASLVSPRVAIDEGETANSLSKKLERLHGDLQRSNQQSV

SEQ ID NO: 38028 - protein, 83 aa, A.fumigatus
PFVQVLKATLRHRKARWLIFRSHISSRAKAQFTYLLSERSFRGRLLTDHNSKLLDLQAGDAEYRQAWSLDLTSYLGRAGHNKG

SEQ ID NO: 38029 - protein, 439 aa, A.fumigatus
LTPVDILPLIRLGLDSSAHSLVDAAIKCLPVILPVLDFSTVKNEVFPPIASTFSRTSSLAIKVRCLDAFAVLCGGTTGDDAASEDGLSGIATVKTPTTVKSSILDKYTIQEKLVPSLKAIKTKEPAVMMAALKVFGQIGTIVDTEFLALEVLPILWTFSLGPLLSLRQFEEYMTVIKRLSSKIEREQTKKLRELSSGPEATGFQTGLGSSLSMSNDLMQSEVDTTRNNFERLVLGRESTTPSSQGLDPWQELASQAPAPQISTQKKAADAFPWSSVSRGGPQSNLNTRSVTPDYSMSSFPSLEPVAREKSPIVAQTVPTSQPSSSTAWSLPGLLEYSAQYAGQWNWQHDWFDHGCIDRYEVAEQARFGRLVAAVLQLFRFLNSTSSVSTKYDGVVCYQLWWFDYRWQGFACRESPGTCQLLKPRFNLNADYAEARSGKV

SEQ ID NO: 38030 - protein, 314 aa, A.fumigatus
RAVWSLDHRAAFEGTRITLRQVSPESEPIYDLIIALYNACNGDWVSLARKTKVSDEHLRFFLEYAAQFLGNCGNYKGFGDSKFIPRLPVAAFEALASITPDAKAAFEKANRTGGGIYETSNQSLMHLGYTEGGHMTTYYPDSPSITKDEITAIGDLMEQKGLPLENTRLKKLPSGDFELLIASGVSSPPSRDRDLGDVESLDLDGKLKGKKVQLVFGDHREEMAKIAHSVKQASLYSANENQKRMLNAYALSFGAGSIEAFKEAQRIWVKDQKPILETNLGFVETYRDPHGVRGEWEGFVALVSHVLRLVIPGG

SEQ ID NO: 38031 - protein, 139 aa, A.fumigatus
  UNSURE (81): Identity of amino acid sequences at the above locations are unknown.
VNLERTRAFGKLVDSAESMIPKLPWSKDFEKDKFLSPDFTSLEVLSFQSSGVPAGITLPTMTTSPKSRLQKLLLREFLSCXTPNEPVPFIPQERLGVLRKYRNLPFQVQFGFPNFPGLERENLCRKRSPEITLQVSNPP

SEQ ID NO: 38032 - protein, 309 aa, A.fumigatus
  UNSURE (56): Identity of amino acid sequences at the above locations are unknown.
VWQDLPNFREFTFISFRRRVLSEFFYHDPELPQSVQLNLEYTSPDFALDSNVTTAXDMFSLGLVVIALYNSPHVSPLQSHSNLSSYKKLLSSPSSTPSQGNNFLCAGAIPKDLSSHLLPKLITRRPAQRLNAREFQQSQYFDNILVSTIRFLESLPAKNANEKSQFMRGLQQVITEFPPTVLEKKVLGALLEELKDRELLPLTLQNVFAILQRVASARRTLSEKVIPRLKEIFFAHQSGKGTVQERDSKKDAGLMVVLQNMNIVAENCSGKEFKDGESTIHYSFALVTDPSRHFAADSAWFGLVSPFPG

SEQ ID NO: 38033 - protein, 81 aa, A.fumigatus
LMVTSYLNSSRNAPSSRCLEASAVESPVALHPPPIYYYDHFSLTPQLSASLFAPHPTIQFLIFDSFLCKLYPSFDVFRSRV

SEQ ID NO: 38034 - protein, 82 aa, A.fumigatus
DIAMTSGPHQEQAREMYSSLRKNLVENVFRQWKETGFAWEQYNPETGKGQRTQHFTGWTSMVVKIMSMPDLPANKQIGHDEL

SEQ ID NO: 38035 - protein, 269 aa, A.fumigatus
SLSLHLLTITTELSANGLKPRWILLPVFAKKAAGKYFVKFSLPCSYFMNIDCNSGGRGEFKWSDVKDSAHRENYLGHSLMAPVGRWQQGRDLQWYTKGETTAEEQARRDREELQRVKQAEEEAMARALGLPLPVSSGSANANLTPLGERETETAVQDPADRKRERRSEQSRSPGRHRIRDRESNRDRDRDRRDHRHHRHHRHHEDRERHHRNHRHRSRSPSGDREHRRRRSSSRSTSRVRAGEDGHRRHREDHRRRHPRDHDSDHYRRR

SEQ ID NO: 38036 - protein, 374 aa, A.fumigatus
QWVWIHSEMTAWSWFLFHCDRLARKNTFNLFNLRCGKVRRHSDVVTKPCVGFMINHIPHRSFTVDILSSSPTLYWPKNMENHPTALSIIEAENLTHALPDKVIFITGCSSGLGAATARALSNTNATLFLAVRDTPKARHVLADLLASASDSDSGSRLASDADGKCSTSTSTSTSQSEIRLLHMDLASLSSIRHAVTSFLSQSDKLNILINNGGVMATPESRTEDGFETQFGTNHLGHFLLFQLLKPLLLRSATPQFHSRVVSVTSSAHRKSGIRFGDLHFETEKYDGALAYAQSKTANIYMMNEIERRFGGQGLHGLSVHPGLILTGLQKFTDRRVSGEAFRNSTELLKDTETKLTTRDGEKRRRDDSIIKLLI

SEQ ID NO: 38037 - protein, 125 aa, A.fumigatus
TPPSGSAILSSTQKPLRNTTAIRIKFIMSSTIDHVGIHAPKDQFESIIDWYKKALAPLNYREIMRFPGAVGLGSEHPDFWISETDEQCGGFHFAFIAHGRFPLVPGGPTADDQTMLRLTLFTRLL

SEQ ID NO: 38038 - protein, 64 aa, A.fumigatus
LLVEDGADVHQKAYLGRSARSLAADQGHVESVRWRIDQRADINESDGISRTPLSWAMQMDSRGG

SEQ ID NO: 38039 - protein, 80 aa, A.fumigatus
LWCSCVALDGRLSSSCWPSLAIGVPHVYLVSLSIWPYRTLLQLISHFNSGTFLHGDNIVTQMAYLSFPFESSFYRDYCRC

SEQ ID NO: 38040 - protein, 269 aa, A.fumigatus
GLAILTVLKAGFLGSARFGSGIVVARLADGTWSAPSAIATAGAGFGGQIGFELTDFVFILNDAAAVRTFSQVGTLTLGGNVSIAAGPVGRNAEAAGAASTKGVAAVFSYSKTKGLFAGVSLEGSMLVERKDANEKMYNSRVSARQLLSGTIRPPPAADPLLRVLNSRAFYGNGRNGDTMYNDIPIYDDRHDDVVWEGRRGEAYGEGQRRDRGGFNGTDDYEYRDRPRASTWADDVYDRPPAGLARSFYYGSRRCFRQIRRPQSEQHRSI

SEQ ID NO: 38041 - protein, 445 aa, A.fumigatus
  UNSURE (53),(61),(78): Identity of amino acid sequences at the above locations are unknown.
LRLLPQTKMTHLVYSGFQLGCIQSWLPRSSNPSSKLRRNRSDENRAKFSASNXVGQGGRFXRKKSMLSRQIDTLPGYXDGREPFQPERSQSRNKSLSPNLLQLESVSEDSKLQTPSAASFLDGVQKLTIEEDVPILPPAPPGHSLRRSTRTQYRKAGSLRKGEKVPFSKRAGRASDTNDRASSITSSSADEPPSGLTRVATDPTPSTRRAQAEPHYPIQAAVSSSTQFDNSRANGWPETNLGDRTNASPQARHQWHSRISSNGRSTLNIPPTEQRVPEIIETPPAESPATPTTPTTSTTPTTPTYHHSYSSGREASQDAPPTLPSKDSPLRDPSTTKRSGAARLPGKESSKTLNDFANNPQPLPGNTTRTDNLSFIPTISEDRKPEPKKSKDKKDSEGSRKSSWHWLLGSEEKDKDKDKEKKKDKDSDLKKSESKSAGSTSRRSK

SEQ ID NO: 38042 - protein, 189 aa, A.fumigatus
TPAHSTAMAETETPCTMIFPSMMTDMTMLSGRAEGARHTVRGNGVTAAVLTAPMTTSIATDLARVLGQTTFTIGPPQVWPVLSIMVHADAFDRYGARSRSNTVPFDEDYVYSDRKPSRPRKPKPVFGQRTGQSALLRADQPFALYTFDADQEGDLGFKKGDIITILKRTDKAEDWWTGRIGDRVGIFPR

SEQ ID NO: 38043 - protein, 62 aa, A.fumigatus
TSLNILEFVRNRLSFAQYVITFLLRTLIIREIMYPMNWIKAEIAEPPTLSRVPYFVVPVSIA

SEQ ID NO: 38044 - protein, 247 aa, A.fumigatus
  UNSURE (230),(238): Identity of amino acid sequences at the above locations are unknown.
ASPSPSEAGGGYGTRRGHVPQLSISDPSHHVTEAIGHMYEDDYDRRESKRLSFLSSPLSESISIIPPSLAGSEDSASPQSLHVQNRSNAVDSPQTNGRSRPSLVSSKSVDRDTSNPTSPPSTDTATTSFPLNDVDYESDPAAVAQELSNLAAIRRMSMDVTATGDPDLPSFSVPSIAPSPSADENDASRLFWVPARLHPELAPKEFKSFLETKAEQIRRKSGEILGFEHXGAGGSLPXKKVYVVPTD

SEQ ID NO: 38045 - protein, 195 aa, A.fumigatus
MISTILSQVVQLIPAPCRRTCTFPTRPLGGQRALSLRTTNSNRDWGTTGGPLPCNVRNPTFDSSHPPPFGSIFLNQFLAAQRSGSCARDIRFSFVTCPIRNVPLVFLAEANWRCIIFLPISFYLGFAHIPHHHHHHHHHHYALLPLRICFLSVHGHFALIRPCISALGGVRTSSDLCSLFVSFCLMCDTTRTKHQ

SEQ ID NO: 38046 - protein, 162 aa, A.fumigatus
VLAFSGATLRRRSSSSSASKGAMSLSTPKSPPSLFCVNSLCRKESGSRFLSLASLCTNSSSTSSSSSSSFRFPSTPSASGKRTSFSLTFVVRGGKRGCAASRPIVAAVLASRLPLPIGPEPPALLPAPINPPAADARRERGRGCVVVEGGPRCCMEGTSEAY

SEQ ID NO: 38047 - protein, 78 aa, A.fumigatus
PAAPDQTWIIIVLILISIVVTTSEVFLRFGLLSAREKNPSSTSFGAMLFSRASNPAICSCPAQGAFDMNATGLGSHYS

SEQ ID NO: 38048 - protein, 385 aa, A.fumigatus
AIAVLPARGEDLTPKLQVHASDDNAKDGYTTDHETDRISANGSTLKPAPKSGAPAPKKRANDKDSTTKRTNPTKSKSSTNSTLTGRVTKKTERKPASKTEGKFKSAEFVQESDEDDTDMPDAPVPTPAPAPEKAKPEQSKVQPKTKQTASSNVGDLSHALTPKANQFDAPPPRAESSSQNAIRPVAAKRPPSNRAPNQRSPQKPSPLGSSPPENASDSQSRSRSSSQNDTSSSSSSPLITQLTKPNKVTPSTGAIKTNGVTKTTESVNPLKRKAETDRPSANQSKTTGRTTGNLEHKRRRAVSTCSGSTGSASPPLSREILRQQLREKSQKFKQYYAKYRAVHDSLASHPDPPRGELERLPRQHIRLQRMKKEIWDEHGRLRDGL

SEQ ID NO: 38049 - protein, 172 aa, A.fumigatus
KSISVSPSQQCLGSSSFPQANKRNPQIASNMLDVPNFFWESEPTLYPLYNAVREYLEIKPRIQVLNERCRVFLDLAEILSDSIADNRTSRVSFPLLTHLTDFLTNRLHQIKPGSLSSSSLSPSLLQPPRSSSALVCSRLAKRIPLRLPLAPCFSLALQIRLSARVLRRVRLT

SEQ ID NO: 38050 - protein, 515 aa, A.fumigatus
  UNSURE (345): Identity of amino acid sequences at the above locations are unknown.
VTDSREQQPQPVRRASGTRFITVDNVLQYASDVPSMQQRGPPSTTTQPRPRSRLASAAGGLIGAGSSAGGSGPIGSGSRLANTAATMGRLAAQPRLPPRTTKVSEKLVLLPEAEGVEGNLNEEEEEDEVDEEFVQRLAKERNLDPDSLRQRLLTQKRLGGDFGVDNDIAPLLAEEELLRRRKVAPEKAKTYAERLPKARRAEKLARVTAYCTAQAYKMSSLAAFVKDKHGGRTKLYDDCLYTAYHLPLLPGLEGYRVRSSPMVKKPGGKSLLDEEIERNELRDHHDDYVMDAEEHSVGGHHQRHSSLHDASESLVLDGTLINKFEEDLHHSESDTVKEGSRVSVXGHRPAQGSPASTEPARLPYDVAEMFVFSYGVVVFWNLTERQEKDLLADLAFANSSTTGSRIPLATMPLDEEDFETEEFHFEYSTEISRPRVFNDMITLRSGDHMIKLAISHGIAQSTKLCFFEEVMARQMAEAKDVPRRLAMTGKLGMKREEDLPYPRQAFQKPRRSQSL

SEQ ID NO: 38051 - protein, 142 aa, A.fumigatus
  UNSURE (56): Identity of amino acid sequences at the above locations are unknown.
LDSTQIREERAAEYERALEEHRRQLEMLRKENGDSDEETYSSNGDVDEQDEWEGFXELPAVDYVAEYIDEDKYTTVTVEEMDASREGLLRAAEGDKSDEDEDERTKTKIGSRCQIHNHKFSREENEGEEQAKKEEKEVPVRK

SEQ ID NO: 38052 - protein, 104 aa, A.fumigatus
PNISMKTNILPLLLKRWMRPEKAYSGLRRATSQTRMRTSERKRRSEADVKSTTTNSAEKKMKEKSKPKKKKKKFRYESKEERKVTLMKQRQAKSRKAKVRRERG

SEQ ID NO: 38053 - protein, 146 aa, A.fumigatus
DAYRPHNDLESEKLTFSNIIVELPDIPDDIAYDTTFPQFQPKNLALGLESVYGDNQVGEDGLTKRQRKFQEDSIAFDKKVDEMILKQLEEIGFEDKTELDPPSEPHVEEVPKRRLEVRRAKLTMTKPKYTSNICLHHGAGRAALTN

SEQ ID NO: 38054 - protein, 112 aa, A.fumigatus
RMNALRLEADEAQNKVEELKAKVKTLEQENLAKEQEITSLNHRNQLLEGEVEKLEAALKEAKESANQSAQHDTQNEALQRRVQLLEEEAEEADRNLRETNEKYDSACSVHIP

SEQ ID NO: 38055 - protein, 117 aa, A.fumigatus
QAPSSILATSSNIKAATSVLEDLSSQLSTCPSDYYVIASQPGVHSSDFATRKSAPRLGAKLTGNDKAIRSSMIVKEVAGVLEAKQIQSIIEKECGARSTLIDASGEFERLISFRSRD

SEQ ID NO: 38056 - protein, 106 aa, A.fumigatus
HRMFVLTDDKDGLLANIIDRIPSSKKYTLLYVTSPREFEGSEGVVYKAEDSYQDPLRMELKRDYSAHESQSTPASNKSLFREYQYLTPGTISEGFLQCPNVVTDHF

SEQ ID NO: 38057 - protein, 77 aa, A.fumigatus
SLGLPDDLQCTTVQYQSVFAMRPIHLFYSIALASNGHEPDTILYSLLDTLHGLLLIRPSTDESFPTVQGTLISFSSC

SEQ ID NO: 38058 - protein, 78 aa, A.fumigatus
VLLFRPVWHLSPLLTLLAEKVSMQDFYRVPLKQPSLPSFPYYFLLLLRSNGGSSGNRAEAHLKPVTSRHQQVIRQDGR

SEQ ID NO: 38059 - protein, 94 aa, A.fumigatus
GKLAAMQQPKDTDPNFPVDGGGCRPQGETHIETQRSVDPNMSIEDYNRVMLQYTQRRMSTFLDMGNDGGPPPSRNGRSSDSVATLSKRVFLYHY

SEQ ID NO: 38060 - protein, 105 aa, A.fumigatus
PIRRFTLVFPSFETRLRTIVYFPASTKQHGLQQHRNRQRANYDFDTRIKATINKNASYNYPLHPRYTLNHTGRPILPGIQINQRIKIDLFFNSAGKSTLANTQRT

SEQ ID NO: 38061 - protein, 485 aa, A.fumigatus
VLNSDQGHSYLRLNVMIIFRYIDYLGCQGVNLTRANNYYARYTTSTICSGLVQSSKTHCNLSDQQSRPLCADTCALMATSEAEIVVNADLCRTTGSNYMSQIRSDFTICSLPADSLTGTCISGADNEPQECGYRSNLIGLCGYCGASSPNSTDSCCVNADAASRCEGVTIPTPTVTLRPIFTSTSNLTADAGAHDGLSGGQIAGIVIGSVAGAALLAALIFLVLFCVRRRRQSRDYSALNKPNPQRRGIPAMQQDKNQQGLPSVPGGRVARMSALREVPSLSPTRSRNSAARFGSTKHSDTSDSEGYGASPGAMSKRIPPVTGRRHGSLSSNSALAGAYSDTSPRSGTVGQFSSPEGVASGQSEQLSSFQDYYSSDDIHPGDKVAVLWAYQPRAGDEFALERGEMLKVIGIWDDGWATGIRVPETAEDYDARHRKQRDSGVSNGSQRLAASPSPTGDIKAFPLVCVCLPQHWRKIIEGGQDEDFS

SEQ ID NO: 38062 - protein, 79 aa, A.fumigatus
WSLFNYLSRTFEAKVTGNAQEKYLSYCAVPDYLSTYWLSGRYPLLLFFFCTAPGCRLPSAGCESVIIESTWGSRPYFDP

SEQ ID NO: 38063 - protein, 282 aa, A.fumigatus
  UNSURE (29),(44),(57),(113): Identity of amino acid sequences at the above locations are unknown.
FKGPKRTKTNSARMSNSPLLKCSKILPRXVNEQALPSKFQFHQXFIWGLFVAGSWLXYSLFFQPYDLGSKYSYAVTFLMLIIISYGGMMFASSYVKKEQQFWYWVVTAWTVYXHIKSLRPWHGSKDTRFSFSPFARCMTVGLAISYRILRRWNQTGQKFAAEPDIARDFFPRHQNILWALIILTYFDTCMHLCLNSHSSNIWRSAAILTTIAAFFFKLVFVASDSPELLYESLLSPIQKSLEEMPLVLPARLVFCGIALLVVTSFCMINATQKRSSLTGGEC

SEQ ID NO: 38064 - protein, 200 aa, A.fumigatus
QTLVIPPGNIFHESLTLFLITQSKAVNIPIFLMFRLQAIILDFLKMSAIEVTLTSLLSQNMTFFAFGGSNAISSVDLSNAYNGIGSYSVVLVGVLTFISNWAGPIWWASAARLLYSNPTFAERYGQRTLLTFHAATSLMSVMAACTMLRTHLFIWTVFSPKYLYTLAWTILNHMFINLPATANVSQVLNWQYAFHSVACR

SEQ ID NO: 38065 - protein, 108 aa, A.fumigatus
DHDFSGAGGVLVVPYLASSSKNAKKTAPVYKGYLNHGVGLFLFIIILFTNTIFLSVLFHLVILFPCLFACLHALPLILYLTTPVPSIFSLNNGFEQPVIVCSAQELPS

SEQ ID NO: 38066 - protein, 205 aa, A.fumigatus
LGISNGVYTAAGSQALFDTAGASWCGAGCGKCYNLTSTGSAPCTGCGTGGAAGESIIVMVTNLCPYNGNQQWCPQVGATNNYGYSYHFDIMAQSEVFGDNVVVNFEPVACPGQATSDWETCVCYGQTETDETPVGMTPGGSNPSPLTSTTTTKTTTTETTTTTTTGGATQTLYGQCGGSGWTGPTACASGATCKVLNPYYSQVLS

SEQ ID NO: 38067 - protein, 212 aa, A.fumigatus
SSCPSCGRVENGQILALLMNKNSTTLYSLNGVTYDTLKDWIISGVQEYYSTLQTTWPDLTPFHQAGGKVIHYHGDADFSIPTASSIRYWESVRSTMYGNLSYKAGANALNEWYRLYTVPGAGHCSTNDAMPNGPWAQTNLATMIEWVEKGVTPVTLNATVLQGEYEGETQQLCAWPLRPLWKNKGKTLHCVYDQASINSWHYDLDAVPMPVY

SEQ ID NO: 38068 - protein, 153 aa, A.fumigatus
RTNHIITAPNSSLADTFLKPPRSVIPGLSTRRRLDEYNKVTSHLKHETQTSIKADRSDRKILSRSCHFTIFIFDTMPAKPILALALIAAVSAAKPTVYLIRHGEKPSDGGNGLSAQGLERAQCLRNVFGSASSYNIGYIMAQTPKRSMMTVFF

SEQ ID NO: 38069 - protein, 123 aa, A.fumigatus
YIHPDGKRARPYETVEPLAEDLGLTVDTSCDRDDPKCVRDVVEGYTGSGNILICWEHDALTEIVDKLGDDDAPSYPDDRSVVFKYKLTIPWLNNLRFDLIWTDPYPYSEITAQTSEQCPGLDG

SEQ ID NO: 38070 - protein, 196 aa, A.fumigatus
NPHSRHTRVRTTTSRRRTMKMDSVLVHAYEQEANDADGVDQVRDEYSGSMAGVKSTYAPNMRVASNEKSGNRALAKDIAVGMRLPSFPVVNQADGSTISLLNLMSSGGCWRLIVFSGDLRRPRVCERLTSFAESFTQHSHLAHQQQTESPQRRGPPLQTLLVHANPRMSISLLNLPIIFHPSDGELGRDYWKTCRR

SEQ ID NO: 38071 - protein, 134 aa, A.fumigatus
QPRRENHRHSLELGGGCAKGAARAGRYPHPRRPDEPAPAAGDRLVRGLSRGEGRHAVAREASSGGPGDGRAHLRLACLGSPAVPPGGTAPDILLAPLPPRRRMEHLPLPPRPIPDVPRRGGNPTPPASHPRPPQ

SEQ ID NO: 38072 - protein, 652 aa, A.fumigatus
IDTLRSMMKKLLVANRGEIAVRILHAARELSPPVQTVALSTPNDTSHCLLGHPDQTIALPSAASYLDISLLAQICQKHAIDAVHPGYGFLSESPEFARRMHQIGVTVIGPGAEILEQTGDKLQAKALATSCSVPVLPSHSAQSLDEIRAFVEKVGYPVMIKAVDGGGGRGIRLIHQHQASELGSLVARARSESPSQTVFVEKAAVDGFHHVEVQVLGDGTGTVHHLHERDCSVQRRFQKIVECAPSLLDRSIIEKVSEAALRIARTIRYRSLGTFEFLVSESTSDFYFLEINPRLQVEHTVTEAVTGVDLVQAQLRLARGESLQQILAECAPTPSARSIQLRLCAEDPSANFALSIGKITDFFVPSGHGVRVDTHLSPPVTVASDFDNLVAKIIVTASSWEAAVRKARRVLGGTRIQGVPTNLPLLRGIVSSADFLAGRVDTQWLEKHLPAVLGMGERISASLASVHQPSHRAVQLPTSSLLLFRRGDAWSISLSPLGPSRTSQEEAETRHHLRLTRVLRNDFPSSLTAEIEYTTPSASIPYTLHLAAAGANTAASALVSGHRRGDPSNPRHIVLPLSGKLIEVLVQPGETIAQDQVVAFVKQMKMELEVRSPRAGHVTWVFEGSDGEEDVVEGMLLVELDPVPASVTKGKL

SEQ ID NO: 38073 - protein, 200 aa, A.fumigatus
PSPPTLTTSSRKSSSQPRAGRRLCERRGACWAVPASKASRRTCPCCGGSSRPRTFSRGGSTRSGSRSIFRRSWGWASASPPRLPRFTSRPTGRYSSRHPPCSSSAAATHGASPSPPSAHPGRPKKRRKPDTTCVSPASSAMTFPPRSPPRSSIPRHRRPFHTHSTWQPPAPTPPPAPSSRAIAAATRPTRGILCSRCRGS

SEQ ID NO: 38074 - protein, 142 aa, A.fumigatus
KTKKPPGVSINSPPTCRPPGYHQTTPTSCPPSAPSRKSPQPPTPLAAATHARNKQASSGSASASPSSSTPTRSKRSAPCLAPSPGNPPVPRPKSPSPSRPATMSRASGSSTADASSSQPTTLASAAATPTAPRPTRPSTPRS

SEQ ID NO: 38075 - protein, 211 aa, A.fumigatus
IGLGAARVVSCHFSVMAADIGALFNAGPEVVANATFEEGLDFQDLGGPMVHCTNGTIDNLAANEAECFEQLRTVLGFLPNHGGEAPPVVKCEDPVEREDVGLRSVIPRRAARMYNPYTIIRSVVDAGSWFEIGGLWGRTAIGGLARLGGRPVGIIANNCEVNGGALDAAGSQKLARLLKLCDVMNLPVVQFVDVRMSWSFPFPLATVRKVC

SEQ ID NO: 38076 - protein, 119 aa, A.fumigatus
DAGGVGFPPLLGTSGMGRGGRGRCSMRRRGGRGARRMSGAVPPGGTAGEPRQARRRCARPSPGPPEDASRATACRPSPRESPRTRRSPAAGAGSSGRLGCGYRPARAAPFAQPPPSSRL

SEQ ID NO: 38077 - protein, 218 aa, A.fumigatus
KASRRLNQLSSHLSTARLPPDYSDVLSTISTLKEIAATPNPSRRGYARQKQAGKLWVRERITQLLDPDSFEEIGSVSGTVAWKPTGPTTEVPESFTPSNNVQGFGKLHGRRVLLTADDFSIRSGHADGSTADKTIYAEKLAVALKLPVIKLVDGSSGGGSVTTIRKEGWSYLPYVRMYAQVVEQLNKGIPNLGAVVGPAVFAPSPSPFLPFPRSIPLD

SEQ ID NO: 38078 - protein, 171 aa, A.fumigatus
QQLLAKADTSPQSGIDQMGTPWSDGVPGLSQRPIPSGSSFLYKWNAGQYGSYMYHAHSRGQIDDGLYGAIYIRPGDEVEKPFWLISNRTREVKAMRRAEERTTPIVLSDWRQLTSEELWHAEEATGLDAYCVNALLVNGRGSVQCLDRSTLDRYSAAKWAFLGNSSLTDIG

SEQ ID NO: 38079 - protein, 361 aa, A.fumigatus
SEADSPSCAPPTIPLLQGDFPHNFSATPPTLFSGCTPSQGSTELLLVDPQASYASFDLISAAGVSMPTFSIDEHPMYIYAIDGRYIVPVRVDAITIGNGNRYSVMVKLDKPAGDYTVRVANAGINQLITANASMSYNTLFRAQSRPSQPSIDITGANTTADVVILDESRVIPFPVEVPAQDVAQTFFLDVARFNASYRWILGSSDFPLSVEESPPLLFNRSAAKPDLSISTRNGTWVDLIFRVTGPLQPPHPIHKHSNKFFVIGQGNGVFNYTSVTEARKHIPESFNLNAPQIRDTFATPPSVSGPTWLAIRYHVVNPGAFLIHCHIQIHLSGGMALAILDGVDKWPVDIPQEYQLAASGS

SEQ ID NO: 38080 - protein, 219 aa, A.fumigatus
PGLHLFLPTFHTPPSKNTYSDSEFKRLCRGILPYNNQYHIYSDLWICHTWNQYRCARIIVSEMILSCLRRLHRKSPGARAVSELQSHCIRIRSSTRQLAADICASVPYHFGVGSTGDSQTGSVPLNECHTAGLVLLWPLVMAGATEGKNHPVRKWGIDCLRLIGHGMGIDQALSLIDVLETEAGVYDCVGDDGVLIEESSSAIVKNKVLATAWKHLEDK

SEQ ID NO: 38081 - protein, 160 aa, A.fumigatus
LRLDKAILHKSELLLASHATCSKRKRAHCSPVSLFGSYKAMDSPCCIIPCIVAFALSWHLLSRHGLLSRWTDFLRPASVMLCFMGSAGVVRFKITLTWEDWTPTGIARKMILTNGQFPAPPLYVRQGDDVEFLVDNQLPFATAVHFHGKACSLTAIASQG

SEQ ID NO: 38082 - protein, 318 aa, A.fumigatus
HIGGFRPYTATGPLRCAHPVVPLARTAYLFRNGFLHPHIVPVRPNKIATYWFTMVFCGKPSKGCGQCRSRKIRCDQERPACSQCLKGNRVCPGYRDELSLMFRDESQQVVRKARNSAAARKSKTQERKAARRTLSPSESSPESTSGATTVSVGRSSDVIDFGHESPVQTELIERQPLTRIQPSYQTTQDEAVCYFLRYNRWPGFHWMLDLSPEFLASSGFSVSHEAMKASVGAVGTAMLGRVRQDMSMIIAAGAEYGFALQMLAFAVSDPAEVKANSTLGAVLMLAIFEVSCLSSLVFLHMHCSDIYPGRDQPDNTKY

SEQ ID NO: 38083 - protein, 73 aa, A.fumigatus
AAMQTHDLLDKDGSMVSLLDNNKIENSLEDFQGKSSNDILALDIQHREHVYHENHETSYIYSGGRKRDIALYH

SEQ ID NO: 38084 - protein, 68 aa, A.fumigatus
YSGYACSTLLSVIGSGAHVILYIRQLSHYVTSFQKTSLLYICFVLNPCTHSTTLSLVYHPIKTSELRA

SEQ ID NO: 38085 - protein, 171 aa, A.fumigatus
QRHLRSGDIANKSCIDPHHTDLQRLCNPENALDVSAEEVAGKADLGTIGQLDDLFLGLKGENSSHRAERLLGGHQHVLAHLGEDSQFVEVGAQLGDFLASRDKLGSLGLSVLNVLVDLFGSTLVDKRAVSDTVPEAGAELEVLDLCREALDEFIIHTSLDVDPVSADAGLA

SEQ ID NO: 38086 - protein, 245 aa, A.fumigatus
SLKNTPEVGEVITTHPEVRKVSFTGSTNVGRLLMKQASSTIKKVSWELGGNAPFIVFDDVDDLDAAVAGAIASKFRSSGQTCVCANRIYVQRGVYDEFVKRFAAKVKNFKLGSGFGDGVTHGPLIHERATEKVDQHVKDAQAKGAKLVAGGQKVPELGPNFYELTVLAEMSKDMLMASEETFGPVAGIFPFETEKEVVELANRAEVGLAGYFFSGNVKRIFRVAEALEVGMVGVNTGLISDVATP

SEQ ID NO: 38087 - protein, 125 aa, A.fumigatus
WPPRRRSALWLEFSPLRPRKRSSSWPIVPRSALPATSSAETSSAFSGLQRRWRSVWWGSIQDLLAMSPLRKCLCQRECYCIVLTLARFGGVKQSGFGREGSKYGIDEFLTIKSVTFGGMGEPLQS

SEQ ID NO: 38088 - protein, 175 aa, A.fumigatus
VLSTEVRLIFLPNNKICSLTHFLGDPYPAEVAATVHAVMQRLNFSNPYRLCWQSQVGPSAWLGAQTSDTVENYVKRGQTDIILVPIAFTSDHIETLYELDLEVIKEANSPGVKRAESLNGNPIFIQALADIAQEHLRKGEKCSLQMTLRCQGCKSERCLEQKKFFAGDRFSSLVV

SEQ ID NO: 38089 - protein, 496 aa, A.fumigatus
VFWLFPFLLLYMLGFAGVVVPKINLVLSLVCRDYLSKKASQDPNFTYLPVIIGEDNPQCQVPEVQSLVAQFQLYLNLIAGILSALVSPRLGHVSDRYGRTRLIALSSLGAVLGETLTVLVAARPERFSINLLLVGALLDGIGGSFTTILALATSYASDCTAPEKRSVAFGYLHGALFVGLACGPLVAAIVLKKTGEIIHIFAAGLAFHALFFFMVLLVIPESLSKEQQQVAREKHRRRFTQKETAGWFSSSSWLQHLNPKNLITPLSILCPPVGRPSSLFPNRKGASPALRRNIILLAAIDTVVFAVALGSAQLVIIYAEFMFGWGNIESSIFISIVSTVRVLVLFLVHPILTRIFHKRTAEQRVIPGSNRVELVIIQISIFFDFLGYVGYTLVRSSALMTLSGIVAALGSLATPTLQSSLTKHVPRERVGQILGAKGLLHALARVIAPTLCNLVYSLTVGKFTQTVFVSLAAVFFLAICSSFYITPNGSEIFPFT

SEQ ID NO: 38090 - protein, 157 aa, A.fumigatus
  UNSURE (3),(13): Identity of amino acid sequences at the above locations are unknown.
TAXHKPYVAFRYXDLLTEEMYTKLLEDGFGNGKGGRAVAFTQYPQYSCSTTGSSLNELWKWRTRLEGKRANGNMDPAGAIQWSVIDRWPTHPGLVEAFARNIEEQLMTYPEEKRNGVVLLFSAHSLPMSVVNRGETHLLTEQQDLLANTFPRRPISC

SEQ ID NO: 38091 - protein, 426 aa, A.fumigatus
  UNSURE (16): Identity of amino acid sequences at the above locations are unknown.
ILLRTGCEAVILAARXEPHDSEATHTQLEITGHSGVDDEPLALGENAVTAAQFPPGVPLPPVKRLPAEFECPICFKVKRFQKPSDWTKHVHEDVQPFTCTFPHCNEPKSFKRKADWVRHESERHRKLEWWTCTVHDCHHTCYRKDNFVQHLVREHKMPEPKIKKTKTKGVGPAAETQEESSREREAEQLWELVDQCHHDTSKGPREEPCRFCGNVCSSWKKLTVHLAKHMEQIAMPVLALVQERHLFPNIDADVAPKAVSYPGSIAQEVTSFSPQLNGIKAEPEAPMNFEAGQSEPPTGFLNPTYPPTSTTLHQGFLSAGPDVYTAYGSQAGFAGQQFVSLHQNSVTYPPLLNTGSRPRITTQELSVLQNPYQLCSSPTDMRATYDPQGTLHMSPPPVENGQAYHDQITQATSYSYDGSVGYSRQF

SEQ ID NO: 38092 - protein, 69 aa, A.fumigatus
  UNSURE (21): Identity of amino acid sequences at the above locations are unknown.
LESLSTHRLSICSPWESPIRXTTTLTGGAPTGQYSTPSENDSQYNGLASGDSGYRESKPGLTPAPILVL

SEQ ID NO: 38093 - protein, 278 aa, A.fumigatus
  UNSURE (98): Identity of amino acid sequences at the above locations are unknown.
PVSHSYRIERISVARFINMPGLTLHLLALAPSTTAESFFRQLRQSSAIKIILASRPQHIVIPPTFIDSNLLTTTKWDLLVLLQPSSRTQEAARESLPXNLQPFVQQEYRLAVGVPSKLLSNYDDRDRSLKRAASSIPLTGSLANAHQKPSSKNLELSPDLLAYMDTLTRTHDGPVTMLNLLHFHHPNGKKSYYQYGQAFIPVAGKRGGNAKLVGNVIRPASTAQVDSRGSLDRPETDWWNEISLVHYPSIRHLCDMLAGEDYQAINEKYRLSVHCAFL

SEQ ID NO: 38094 - protein, 66 aa, A.fumigatus
ANTISVTARNALYRLVGLVTSTLTFGGRWTPSAIIVTKTAPTILANAAVITQCQLVTAHTTDLTNH

SEQ ID NO: 38095 - protein, 161 aa, A.fumigatus
PRGVILIVGIAILTVYTGYVMGQFKQRYPHVHSIADGGEVLFGWVGREILGAGLLLCLVFVMGGHILTFTVMMNTLTDHGTCSVVFGVVGLLISLILSLPRTFKRMSWLSVICKICRMSSDELTLSDDCSVCQYRWGSLGHNDRAWCPAAAECEGRSDQAD

SEQ ID NO: 38096 - protein, 77 aa, A.fumigatus
PTTAAAHPAFFGFISEMKTPTDWPKTLCFVEIINTTLYTVTGVVIYRFAGQHVASPALGSTSPLMAKVAYGTAIPTV

SEQ ID NO: 38097 - protein, 67 aa, A.fumigatus
TFAPPPLLALIGVPRITLAANEEADFVSDGQSGLPKMSSRLTTFSLFFSYILFRFWETGTGRCQKEA

SEQ ID NO: 38098 - protein, 66 aa, A.fumigatus
VDLLRSASGEQLNNTEEAALLFYLFPGPGEKWGRIHPETEQVCCLKDMGLSGEIKIDEINLKGLNG

SEQ ID NO: 38099 - protein, 405 aa, A.fumigatus
HSAESVIAVTSRSSNISSAFLILVSTRSLFGAAGVLTHTLVHETRLSAGIEDKPATELRGSYQALSFAKRCGRVDYAGLDGPARKKRKRGKKSSNATKIPNESSSQKHSDAASPGQTEQANTCAGVATDKSLVPGEPKVGGTAPAPHGQEYPTSNSSALPEVEAERHSALDSPSSATEGVPRPDHQKEPDCPSLAATHICSGSTFDVNGAGCNTLLPSRLSSMPTLCASAMRTIETILTNCVELNYALTQYRRQKKDVTITTKIEDIRGYVEEITQLKYADAMHIVKKDNALFASKAMQARYNETAYWDIILKGAKFLDPAKLPTAMGRLDDFTRAEKHAMRTFMEEAGYGTSYANQQRCRRLWRNLSQMRNAGVDRIPLYRTKEFDSFCHEYPKDTEPSLLEMI

SEQ ID NO: 38100 - protein, 155 aa, A.fumigatus
KTNATTREYSALKSIVMASPNEVVKMPINEPAKGKKQSQIEEYVDFYNGAGVQHIALLTDDIIRDITNLKARGVEFIKVPDTYYEDIKVRLKKAGLTLHEDFETIRSLDILIDFDEGGYLLQLFTKVCHFPFSRRPQTVTLIERTALDGSPHRLH

SEQ ID NO: 38101 - protein, 243 aa, A.fumigatus
QLLYRGLISSLTRTAYHLFSLDFNMAPSAISTSPPPTDRVSSSLASYKGYDHVHWYVGNAKQAASYYITRMGFKRIAYRGLETGCRSVCSHVVRNGDITFILTSPLRSLDQVDRFPPEEQELLKEIHAHLEKHGDGVKDVAFEVDSVDSVFYAATNNGAKIVSQPRTLEDDNGQVRVATIQTYGETTHTLVERGSYHGAFLPGYRMETGVEDPISQLLPGVHLNRIDHCVGNQDWDEMDKVCE

SEQ ID NO: 38102 - protein, 148 aa, A.fumigatus
  UNSURE (123),(130),(136),(139),(147): Identity of amino acid sequences at the above locations are unknown.
HYRIIHFFSCNIKTPNKMASGTTIQPSRPSLTSNDSAVLQALFDAESSPSSAVAIDPSLSPFPEYLHISASDHESLKARELSIIRSLQSDDVSMDTITSGIRDLDALITEHPTYPSAYVNRAXPSAYTLXKTPKLXPTXKSYLPPWXT

SEQ ID NO: 38103 - protein, 85 aa, A.fumigatus
LFSGMVFLRLTVKVYPREQTQSSSSFSIRSFLGDRDRDASGQNSGQAAGKPASFLLVLEKPEDVTMGGLASMIREKWTKLPPNAE

SEQ ID NO: 38104 - protein, 536 aa, A.fumigatus
QDAPKWPSVYEKDYLRHGQPLTSLPTSQQRDALAGVHSLNGPRVVRNIPSISGPSPLELANDTPRELMRSPSELALPPALRHSTIIRKGWDNAVDIFVTILLLFFGAFIYFNSHNIQELAKQKLDVKNIIASYAQPPLSTPSTPVVESTHFKRDSSPSRPISNLTVEVTVPEEQQEGDATPKSKRDRSAVGPDSTPRVKIREPSRGPDSDDDVEELDQAASPEKPKKKARRGRRGGKNHRRGKKPDSEGESKDQADRVVDQVNNLQPQSRLEPDLQLVRTVSNDIIEMDGVLQIGRLRVFSDVVLGHGSHGTVVYRGSFDGRDVAVKRMLVEFYDIASHEVGLLQESDDHNNVIRYFCREQAAGFLYIALELCPASLQDLIERPGDYPQLVQGGLDMPDILRQIIAGVRYLHSLKIVHRDLKPQNILVAMPRGRTGSRSLRLLISDFGLCKKLDDNQSSFRATTAHAAGTSGWRAPELLVDDDNRSAIQGGESQHTESSEPAVVDPQTNRRATRAIDIFSLGCVFYYVLTRGYSSL

SEQ ID NO: 38105 - protein, 371 aa, A.fumigatus
FNDASALSSMALAGPGRAVRARPAQASSSSAGLAPQLHARSLQDWEVEDFVLLATVDGSIHARDRRTGAARWALEVPSSPMVESIYHRANRSSFDRAQPEDDFLWIVEPSQDGNLYIYSPGPDAGLQKLGLTVKELVEQTPYSGTDPAVTYTARKETTLYTVDARTGNILQVFSSRGPITSGHGCRKVDGFDLEAEECDTPSGTLVLGRVEYAVAIQNTETGDPICTLKYSEWTANNRDMDLQSQYFRTMDQSHIYSMHDGVVLGFDHSRMDRPRYTQRFSSPVVRVFDVARPINVESPEAATPLVLLSQPLQPPDPDYGSLDDRDARVFVDCTSAGGWFAMSEETLPSRDRTRQNGPVFTRKTTCGMASL

SEQ ID NO: 38106 - protein, 183 aa, A.fumigatus
  UNSURE (17): Identity of amino acid sequences at the above locations are unknown.
SRSMLLSDPFATGKLMXGSFIAFRLFTDLFPRPDASAVLMHPFFWNPSDRLSFLCDVSDHFEFEPRDPPSDALLCLESVACRVMGPEMDFLRLLPKDFKDNLGKQRKYTGSKMLDLLRALRNKRNHYNDMPAHLKAHIGGLPEGYLNFWTVRFPSLLMSCHSVIVELRLTKIDRFKRYFTPVE

SEQ ID NO: 38107 - protein, 89 aa, A.fumigatus
FQSNIKEASRLLATEIANYVVMVVTLLQQSNFMRGDIVKLNQHAFDRNIPTIEGSTVHDGSVATMAQNNVTEYPETTNLKNTVHFNNIV

SEQ ID NO: 38108 - protein, 598 aa, A.fumigatus
LWLGSRGFYSLRYGYAHVWHSAFARIHSLLRLTLTIGSFLPITLEQMARDRGVLFSDKVTPCSATLNDPSRTSIQARWTLSSRYDAGRPTVANQCVVYIFGVEINTASFAMYTFSVSVFIQAILIISMSGAADHGSHRKLLLMAFAVIGSVSTMLFLGVVPKIYMVGAVIAVIANTCFGASFVLLNSFLPLLVRHHPSVLRSAREPRPALDDSRAQEGHSDTTNGIEHGIESNVTSPLLHARQGNGENAEADMHPATHITVSQELKVSTRISSFGIGIGYIGAIILQIVCILVVIATNQTTYSLRLVLFLIGLWWFIFSIPAALWLRSRPGPPLATTHHGKHTRSWIGYMAYSWKSLYRTAVRTRHLKDILLFLAAWLLLSDGIATVSGTAVLFAKTQLNMQPAALGLINVIAMVAGVLGAFSWGSFSRVFNLSASQTIIACILLFELVPLYGLLGFIPAIKSLGFLGLQQPWEMFPLGIVYGLVMGGLSSYCRSFFGELIPPGNEAAFYALYAITDKGSSIFGPTIVGIITDRYGEIRPAFVFLAILIFLPLPLMLLVDVERGKRDALALAAELQPSGAQTYGTLPTNEDRAPPSEL

SEQ ID NO: 38109 - protein, 144 aa, A.fumigatus
ENLRQQTNGHCTPPNDVPTSYILLLSLPSRSSDISATMNTARVARLGLRATQQFSVPRTAALNGLRTYATPAQNVKPPVALFGVDGTYATALVWLAFLPGLSFNALRIWSQSAFFSRSVDPAPLSPPANRVKMHIVHPGIPKGH

SEQ ID NO: 38110 - protein, 135 aa, A.fumigatus
YTASAKSSALDQTSKALSSLAQTFKADRKLTSIIAAPTLSASDKQQIIQELQKIAGNDKGDIIKNFLQTLAENNRLGLLEGICQKFETLMGAHRGEMEVTITSAQVRFDYCVIMSDLLLTLVFLPGTRQQDHQPP

SEQ ID NO: 38111 - protein, 86 aa, A.fumigatus
WVLTVVRWRLPSPVPRCVLTIALSCRTCCLHSSSFQELDNKTINRLEKAVSKHELSQGKKLKIVTKVRTLLYSIIHDHLANVCVTG

SEQ ID NO: 38112 - protein, 364 aa, A.fumigatus
VDFSVFQAVAKARRTSMLGKWFPENETDHEILWGIKDAQPYVKDAFQSPYRQRREKCDYPCHKGTKFAAWYAFDEGDGIPPGECAVVRFRFSRKNEQFIDEEVLDDTIEQRRAEADDFYYRISPLPMSDDLRNVQRQAFAGMMWTKQFYHFIWDQWANGDPGMIPPPPGRKHVRNQQWKHLYIDDILSMPDSWEYPFFAAWDTAFHCIPLAMIDPDFAKKQLDLLTREWYMHPNGQLAAYEWNFGDVNPPVHAWAVFRTFKIERKMYGRQDLDFLERVFQKLLLNFTWWVNRKDSEGKNVFEGGFLGLDNIGLFNRSEPLPTGGVLEQADSTGWMAFYCLCMLNIALELAKHRRTYEDSESTFY

SEQ ID NO: 38113 - protein, 268 aa, A.fumigatus
QLIRHSFYYDAISYGEPWTQQLPVRSLVGLIPLYAVLTLEPELINQFPSFKKRMEWFIENRQDVAERNIASMKRRGKDDRLLLSLVSKDRLEKILKRMLDETEFLSKHGVRSMSKYHEKHPYSMDVNGQTFRVGYVPGDSDSGLFGGNSNWRGPVWLCVNFLLVESLLRFYMFYGDSFQVECPTGSGDYMHLGHVAEEIQHRLQHLFARNDQGRRAVNDGSDLLDYDEHWKDYMWFHEFFDGDTGRGLGASHQCGWTGLIAKVIHDTG

SEQ ID NO: 38114 - protein, 161 aa, A.fumigatus
ERLTNVDGLASSPRSSTIPGKFIFGSLKLPSIHTSNLLCRINCRLPHTPRSPFAAASHYFDDIFTRSGRPRSSRKPSFRRSSTTRSIGNRSDFESTFAGAETPAADILSEDEQDHRVPRNGVDEHVSNYVASQLQRVRSSASIGAYEDEFEAQADRTPNGH

SEQ ID NO: 38115 - protein, 471 aa, A.fumigatus
FSFTELLAEQQLSDLLPPSLRYLLAIATHRHPRYLLRILNSYDEVYALLSLIVERYYLRTFGGSFTENFYSLKRERVLRTKNGEIPRAQLGAPGPVRESLKLRSSDVWKNLFVMVGIPYLKRKLDEGYDIHAAPQASLILGGGPRYNPSDDLPPRPTIRQRLMYYYKWFLRNVYPSVNAAYYFSILAFNLAYLFDNTKYSSPFLWLIGTRIRRLGAADHRAIAEVLDAKPSASAAGARSRPGSGLMGILSPQNLYPQLLASMRYFIPASIFALKFLEWWHASDFSRQLARKATEVLDLPAPVVNGMVPPSERIKKVDSRKGKEAASKDLKPAFKSPRRRMQPPISATSYLPIFTVPLPPADSDSASACPICLNTLTNPTACQTGYVFCYACIFRWLNGEHQRQLDFMNGESAGAAWEDENEDNEDGAKSREEGSAEKKVSREGKWESGKGRCPVTGRRVLGGTEGLRRVLI

SEQ ID NO: 38116 - protein, 79 aa, A.fumigatus
LTTVFTMEYLPSLQQEFDELKPSLFGKRTDLRRLDSRTSTDSVSQNCSRSSSSQISCLLHYDISSRSLHIVILAIYYEF

SEQ ID NO: 38117 - protein, 91 aa, A.fumigatus
FGGTVGPSQIPSSRGRTRNFGAGFMECIQPCSAMEFSWVSCKNHSKFNNIKDYTRPWFAWANSVFAQTILKIAAERPHLIFGEGAKPYIVQ

SEQ ID NO: 38118 - protein, 137 aa, A.fumigatus
IRRIRQSTRDPGNGCADTITRNIHWTIKTITIPTTQCNDATSSWQKRSSAPTISQPRHSLTSSTTPTHHHQEAATSPTIASAFGQSPGNAKAPSTRQATPSTNQNSPTTMATPWTTARSGSPLAESTCGRPRTPPQS

SEQ ID NO: 38119 - protein, 182 aa, A.fumigatus
SIHLANINRKSGYPIVNMGYDTKTPKYCCGSVVDNQCKDGDPFTIGNGAVIPEVAALAGYVKASAITDTTCSNSLSITTSSNSASTAITACPTSTGDNTSPSSHDLAIGVGVGVPLGVIALASIVWALWERRRRLLVNISINIWRTAYINHILRSSRLDKQGRHRSWTATGVQNELDIGSVR

SEQ ID NO: 38120 - protein, 60 aa, A.fumigatus
TLAAAPSSPVVKTLFTNSVLPARIFANGPLRAKEATGYISSKYPVIVSDCRIDMETNWSN

SEQ ID NO: 38121 - protein, 69 aa, A.fumigatus
DHEYDAVVVGAGGAGLRAAFGLAEAGFNTACVSKLFPTRSHTVAAQGGINAALGKYVNEMMELNIGRLC

SEQ ID NO: 38122 - protein, 86 aa, A.fumigatus
FFFFRLDANKMSCSTQTAVAAANRKESRGAHAREDYPERDDENWMKHTLTWQKKPHGEINLGYRAVEHRTLDENECKSVPPFKRVY

SEQ ID NO: 38123 - protein, 99 aa, A.fumigatus
EMTLHLARQANTCTGSKQWYVCSKGNFRGCCSIDPCNTGVCPDQESQSTLSTSTTSTTSKPASTTTAISPTTAITTAPSTSSQGDIPGLIPTRTVTQAV

SEQ ID NO: 38124 - protein, 494 aa, A.fumigatus
  UNSURE (310): Identity of amino acid sequences at the above locations are unknown.
NDGVEYWAIVLMPICSMHPDDWRWHMYDTVKGSDWLGDQDAIHYMTREAPASVRELEGYGCPFSRTEDGLIYQRAFGGQSKEFGKGGQAYRCCAVADRTGHALLHTLYGQSLRHNTNYFIEYFALDLLMEDGECRGIIAYNQEDGTLHRFKAHHTVLATGGYGRAYFSCTSAHTCTGDGMAMVARAGLPNQDLEFVQFHPTGIYGAGCLITEGARGEGGYLLNSEGERFMERYAPTAKDLASRDVVSRSMTLEIREGRGVGPEKDHIYLQLSHLPPELLHERLPGISETASIFAGVDVTKQPIPVLPTVXYNMGGIPTKYTGEVLTVDEQGNDKVVPGLYACGEAACVSVHGANRLGANSLLDLVVFGRAVSHRVRDIATPGKAHRELSPDAGAQSIKDLDFVRNADGPKSTHEIRNAMQRAMQSDVSVFRTQESLDEGVQKITAIDKMFDQVGTKDRSMIWNSDLVETLELRNLLTCAYVSFQPLIFFLSVRC

SEQ ID NO: 38125 - protein, 65 aa, A.fumigatus
SVQYGCMSGSREPVYIVDVDYFHHLETCLNHNGDLANDSHHYCAFYKLAGRHPGPHSDSNCDSGC

SEQ ID NO: 38126 - protein, 490 aa, A.fumigatus
  UNSURE (192): Identity of amino acid sequences at the above locations are unknown.
VLQDILLASNRKKKNQRLKGYIRASEQVTEFQSLDKVRVPDHAAVLGTDLVEHLVDGGDLLNTLIQTLLGTEDADIRLHGPLHGVTDLVSRLGAIGVADEVEVLDGLGTSVRAQLTVSLARGGDVTDTVRNGTAEDDEVEERVGTQTVGTVDGDTGGLTTGVQTGDNLVVTLLIHRQDLTGVLGGDTTHVVXDGGQDGDGLLGDVNTSEDGCSLRDTGQTLVQKLRGQVAQLQVDVVLLRTNTTALANLEGHGTGDDVARRQILGGGGVTLHETLTLGVEQITTLTTSTLGDQATSTINTSWVELNELKILVGQTSTGDHGHTVTSASVGRCAAEVGTSVSTSGQNCVVGLEAVQGTVLLVVGDDTTALTILHQQIKSEVLDEVVSVVAQRLSVESVQKSVAGTISDGAATVGLSTLAEFLGLTTERTLVDKAILGTGEGASVALELTNTSRSLSGHVVDGVLVTKPIGTLHGVVHVPSPVVGMHAANRH

SEQ ID NO: 38127 - protein, 297 aa, A.fumigatus
LRLISPQVFQPGLLSHPQHDMSPDEYKLSQDVLIFLIENQDHFLFGMNGTAADEQTLKEVEGGTTRRTTTNSNIRRSVSSASGGADSFRKYENLRRNVSVSSKHSRHSNNSPGPVTPTSLSGVGVHRSNTLPSKMSPISSARYGRVQESTSVQPSGLNPSVQNSRSSSRAPTPREETSQTTPAPPSGSNADSGTAYIHSSTHGPMPKVAEDRAPVAEKPVIQDPLPTLVSSPPPPVETPTKERKLSSFFTKSPPQNGELKETPSAKSPERRSGFQEVPAKVLTVLPCHYRQPQVNLL

SEQ ID NO: 38128 - protein, 207 aa, A.fumigatus
ISLVLYIVLTHSFEYSTRALLGPISPVLMTSASPSPLRAANGASSGTVPPPAMKPSAPPVNILPTQLARTYSFVHPAALLAILATRFQALVADPVAEMLNTLPFLALLQVTYVMVCLPPAGSVLPSPPASPVSDGDEKEKEKEKEKEKEKEKEKEKEKEKEKEKRKLPLRAGKLPRKKNQTHAAGLSAKLTVRTPLSSSLSSQFIQC

SEQ ID NO: 38129 - protein, 102 aa, A.fumigatus
RGCGGQPALLSLILTFLLATPVLSLLLVLFGAPLTTHNAETVLCAAHMALLASTALIYVHGVDGAVWREVWAFARPADAVWGGALGTALGAWFGAVPIPLDW

SEQ ID NO: 38130 - protein, 335 aa, A.fumigatus
KKKRISGSASESAHSSSLSLQAAPGESVVSVVPSATRANEADGEAGGATPRPPNTTNSGDDATIIVAEEKPAVQNDLHNADNSLRPHGSRTPSMNSRSSFTDHSDLDQTDEKADRREHRRSWRFHRSSKRSNEQIGLGLASPPLSASNPSAERSTTSVASWHQSSKSSPSDLQQFASESSQQPLSLDAEISNSAAPKESIEPEKRSLFGKFKAKVAQVRDGVRDPERDRTRSPAQPDSERPHSNHTMSPAGKDRISSGPAPIEVPKESREEQTRSPVSPIMSSSGLPPAIPEEPRTPESPIMSRTDPDLDKEASAAVPADPSNPSHTEALPCRAA

SEQ ID NO: 38131 - protein, 179 aa, A.fumigatus
PRGGNAEYTPLLGTPAGDIRDGVSAARGVGAALAAGLSGKRRRREGKGEGEREREREREREREREREREREEEAPASSGEAPPEEEPDACGRFVREVDGTHPFVFLIVITVHSMLMLTWLWWTACPPLPDPHFPPRDPRPLPPPRSLRRPPDNSQCRDGPLRRAHGAPGFDGADLRAWC

SEQ ID NO: 38132 - protein, 165 aa, A.fumigatus
GRQRGAYRQLRGQTGRMRLVLLPGELPRSKRELPLLFLFLFLFLFLFLFLFLFLFLLLLFLLVAVAYRRGRRRGQHRPRGRQTHHHVCHLQECQEGECIQHFRHGVSDQRLEPCSQDGQQRGGMHERVCASELRWEDIHGRSGGFHGWRGNCAGGCAIGCAEGGG

SEQ ID NO: 38133 - protein, 199 aa, A.fumigatus
MNCDDNEEDKGVRTVNFADKPAACVWFFFRGSFPARSGSFLFSFSFSFSFSFSFSFSFSFSFSFSFSFSSPSLTGEAGGEGSTDPAGGRHTITYVTCRSAKKGSVFSISATGSATSAWNRVAKMASSAAGCTNEYVRASCVGRIFTGGAEGFMAGGGTVPEDAPLAARRGEGEAEVMRTGLIGPRSALVEYSKECVRTM

SEQ ID NO: 38134 - protein, 106 aa, A.fumigatus
APAPAPTTPIQHQRGKILTNPMESAQPQTTPREPFPAHRPRRHQPGAQTPIPRATQRRQHHARRSAPSKPGAPCARRRGPSRHCELSGGRRRERGGGRGRGSRGGK

SEQ ID NO: 38135 - protein, 674 aa, A.fumigatus
LTPPSDPSSPVVKTAAVTPGLLSGTSRTVYLGNIPAETSAEEILNHVRSGQIESVRLLPDKNCAFISFLDSNSATHFHSDAILKKLAIKGNDIKVGWGKPSQVPTSVALAVQQSGASRNVYLGNLPEELTEDELREDLGKFGPIDTVKIVREKAIGFVHFLSISNAMKAVSQLPQEAKWQAPRRVFYGKDRCAYVSKTQQQNAAQFLGIAPGYAHILNSADRDLITNALAQQSVAAAAVATSAGGVNNLGNRTIYLGNIHPETTIEEICNVVRGGLLHHIRYIPDKHICFVTFIDPTSAASFYALSNLQGLMIHNRRLKIGWGKHSGPLPPAIALAVSGGASRNVYVGNLDETWTEERLRQDFSEYGEIELVNTLREKSCAFVNFTNIANAIKAIEGMRNREEYKRFKINFGKDRCGNPPRQTGNGGQHGRNGAGLEGTQSPPPALNNFQPNLSQSGSQSSPTRHALSPAPGSTGSQNGHQQNRHPLQTVSSPSGILNVGANNPLTMYLNQMSAQQQAQDQENRLNDPMALAALQSQSQPQAQQQSYYNAASSSELTNGSIEAPMHQRKPSSGYLNVTNGSSGPSHHATASTSSLSVPRAQHSRTVSLPSFSQEPFGPVSSQPGHGRSGVAHQPQASFSSFSSALGGLNHAGFGLAIQNESSLPGWAEEEIGAK

SEQ ID NO: 38136 - protein, 94 aa, A.fumigatus
PILTHTAENNPANDYPDEDLSWDDEEDDPAAIYHKYRTHDASDDEEFDSADSANEGRRAGRVGVGFGFGLDSHVDSDEDSLDGDGPNHDRMRRW

SEQ ID NO: 38137 - protein, 127 aa, A.fumigatus
YHHLYCYVGRIFLISVFYLCLFYSVSHLFEPFSAADFQCATREWDETSADTLDWFGAGLSFDVSFPLFTFLVPLQRFQAEHTAHPRCMLDTDKGYIAVDVMVHDGKGDCKPWEDERYGTRINKNEIK

SEQ ID NO: 38138 - protein, 460 aa, A.fumigatus
HETTDIQSELHQTKRRFTDFVFQRVQVSGNARDSGSSSPASLAAPSRTLLTPRSVSSSAFPASRGAARPSGPGTGVGATVPLVRATSPGAEFREEQRLAAVRKAAEEKLHRALHPSSRVAGADLVSSTTVGGTQESSVSSGRESPVSASPRSVRRFQISRSSTPVNVLRSAGGGVQKRRGDGAVAVLVEKLRRAPHSRQASLVADAAAQAATAEGEDRGVNVPEPAPEPEPVRPRKRPVVNQAERKWREERKTAISAAKEHITKVLEKEAHARKSNWEDESERLAREFEQIALELEGGRETEPPVQQPVAQPTARPTVPKPPLKYQPRTPNKPRGTTPRETSVVEIPDVQPPVETVAQEDDSDGEYVYDTYIRQPLPEGTLLTNPLTDLETAHEIWFQQNGIDTTRQDIGVIVITQEDEEYWEHFAEDDEDEEWDSEDADSNGMLSPPVQTLCMHSANPS

SEQ ID NO: 38139 - protein, 354 aa, A.fumigatus
  UNSURE (200),(209),(216): Identity of amino acid sequences at the above locations are unknown.
CLLVDNQAHCCGHLGKVIRSEYPIPKVIQPNRIYGRTSALSVSEITFPSFFVAISCSRMAGPNDNHRFSVLIINPNTSTHMTNALKPILESLDYADIYFNYFTAPSSESVTLPDGRIINGVPSINSGEDSITSALHCRPFVEPLVPKYDAFLVACYSAHPLVGMLKEAITEYERTSSRKDSTLPEYRKKYVTGIFEASVXTSLSLVSSXHLMGDAXFHKAQSRDTFGIVTTGSIWRDELTRAVAEMIVNSGGGGGSTARFAGVETTGLTASELHTAPAEEVSRRISDATERLIKSTSHPVSAICMGCAGMAGMEEAVRDGCIRAYGERQGRRVRIVDGVVAGAGMLVTACKAGF

SEQ ID NO: 38140 - protein, 79 aa, A.fumigatus
KPVYEFTLHKCAAVYISSESELSLHGQVLNSIQSGPYKNIYNPENFFIGQQGIGAGNNWGAGYAAGEVVQEEVFDMIDR

SEQ ID NO: 38141 - protein, 79 aa, A.fumigatus
QGFMFLHSIAGGTGSGLGSFILERMNDRFPKKLIQTYSVFPDTQSADVVVNPYNSLLAMRRLTQNADSVVSFPSMRPPN

SEQ ID NO: 38142 - protein, 123 aa, A.fumigatus
PMTSLKATNTRVRWFSVVMGTGMISTALNTLPYNGRWLYWISIVVFVLNVAIFAVCSILSVLRYTMYPETLNTIMNEPAQSMFLSTFPMGLATIVNMICFVCVPAWGNWTRDFAWALWMVDVF

SEQ ID NO: 38143 - protein, 211 aa, A.fumigatus
PHCSIRFRLRQLKGYHDYTHTLIFIMPLVVPSATPRVILGLMTFGPDESEGARITSLDDFNKCLDHLQQQGYNEVDTARIYVGGKQEAFTAQARWKERGLTLATKWYPHTPGAHKPDVLRENLERSLKELQTDQVDIFYLHAADRSVPFAETLEAVNELHKEGKFVQLGLSNYTAFEVAEIVILCNERGWVRPTIYQAMYNAISAYPPAVT

SEQ ID NO: 38144 - protein, 190 aa, A.fumigatus
NVCYKISFELHLLTPINTARNIETELIPACKRYGLDIVVYNPLAGGLFSGKYKTKDIPAEGRYSNQSSTGALYRGRYFKDATFDALRLIEPVAQKHGLTMPEIAFRWIHHHSALNMKDNGRDGVIIGVSSPAQLENNLKDIQKGPLPQEVVDTLDQAWLIAKPTAPNYWHLDLKYTYDTQAALFKPKPKA

SEQ ID NO: 38145 - protein, 1207 aa, A.fumigatus
AAPCSPVVKTGSGSGDFGLAAYYAAWQHAQQTGDDSDWKQFQFKRRIGWKPTGDEESARVKVGEKATDSQPGLHDSPRVSKASANAEISAQVEEAVAREIQIQEEQAQAEEASEAKDEGTEAFPDLPPEVAAVSDATAEQSRFVSDQIVQLASGKKYAEIPAAFESLLRDGLTPTVGAYNALLESAVRLHTDVSHAIPKALDVYSDMLRRRVIPDEDTYRTLVELFVVRSHETIKAKESLEQERLRYGGMEEPGKFMLHSSQLERDLLAEDHSLAIAVKLFNTATTRHSDLVFSLDMYRYLITACAKEGQVEDMIRIYAHMESHKVTPHASIFPSMIDAFASTGDLTSAVECYNEYKDLAISDDNGTFSIVQRLDGQVYAAVVRAYLAAGKEENALRFLERIRASFDEVTENREARQEAVESVIVQDGLVQYCLKSGEHAKALKHAKEQLRGDALDHAMARICVTAADAGDLNTASEAYGRLPSDPIVRQGPAIAMLALHVRQGNVSEARPLWLMLSTVGQATPDMVQPTVMYAVALAKSGQVDEALLEARNMFARIRNSSANNAAVLNSIREQINESLHLIGRVLMQTAAVLSPQAAMNLIWSMTENGGLVSPLAEHAVASLGPLGISQLAAPDLALALQVQAGMLLNNNSMAFDVAHPIRFSHMLDIALATRLPLDTHTTALVDQAVAKLFNSRPDMVKRWQDHLSMTSSPSSFLSGHHSPVSEVSSMTPVSSDDSFDPYAYATDFRGSSIIAEELESASGRAESHLNEALTRLRNMRRLGRHPRYITYAKLINAATKVGRADLVQEILSMARRDVPLLPQYHAVKYGWISILDAMVASCLTLGDRSLAAKYHNELLELGSAPSANTFGLYITTLKESTKTFDEATEALKIFHRAIAEGVEPTSFLYNALIGKLGKARRIDDCLLYFAEMRANGIRPTSVTYGTIVNALCRVSDERFAEEMFEEMESMPNYKPRPAPYNSMIQYFLNTKRDRSKVLAYYQRMQSRNIQPTMHTYKLLIDAFASLEPVDMPAAEKVLETIKASGQQPEAVHYASLIHAKGCVMHDLDAALDVFQSVVSNHKVRLQPCLYQALLEAMVANHQVAQTEAIVKDMADRRVEMTAYIANTLIHGWAAAGNVAKAKAVYDSVGIDKREPSTYEAMTRAFLASEDREGASRVVQEMLSRGYPTAVASKILDLVGGGAPVAAI

SEQ ID NO: 38146 - protein, 75 aa, A.fumigatus
FPAVDFRCRLPALMADDAQNSPTINRQKSSPFARLTQLHSLCLRVAYVYALSALSIAFVWQQAIIATTKRGIFTV

SEQ ID NO: 38147 - protein, 109 aa, A.fumigatus
RSKAGNSMFSKGRDETTILSHRPNEVHGSLWGENSSSLHENTADKVKAFINLFTDGIQYGGVVGRGVANPGKHIAGFKKGFVNLATLGQGYCVHNRRLNHIRSCLTHGA

SEQ ID NO: 38148 - protein, 169 aa, A.fumigatus
WRDGRARGARVLTLMLGSVFLAVKYASLGMKVTSAAKPYPSGSIICTASVAGLRSNAGSTDYSASKAAVVSIAQTCAYQLAGTGIRVNAICPGLIETGMTQQVFDAARARGTERKIGQLNPLQRGAVADEVARVALFLGSDESSYVNGQAWAVCGGLSAGHPFVPGKLA

SEQ ID NO: 38149 - protein, 344 aa, A.fumigatus
QQQACFPHDVEICTGKSQPHCVHHAFVLQQDSSHTLYGIALRVWSRADDKRAETIRELRKKTEADFYDNPDETYWIPYCLSFLSRYPLYDLLGDYLRGMWIHWNKATNLFHAEEVSRILSFPAPRLNDLVRIDMKDYALCYQFPSSPTGFQNFAMWPLFTCLSIPNIVGVVEAAVSPTRRIIFVSHYPAMLTIAAETVRYCVRVYEWSGLYVPVVHARHIKDLVQEPGPYILGVTAECRTLFNAPSDALVVDLDRNFVLTSSPPNVLTPGQRTKFIDRLTQALNGDVSPSGVPNHLRSAYAGGKLIPAGQIIVMRGEVESIQDPSWWNQDAVMSVMDHVCEKLV

SEQ ID NO: 38150 - protein, 371 aa, A.fumigatus
LNNTDLAQFLKFQAFAEQLTKETAELKVKIENHKRENRRLSGLIDQQKDDVARLTLRLSGTEKQRDDALEALVLQQEIAEELERERKRNQKELASLQHTNASLARQRDEAQRVVLHLRSLINGQAHHMEHIVRSISSSAELSELVEQAEESQENEENAAPEETKERAEKAKSLAPNMTPELEQHLLNLGKEQKRLARLSITDVADRYLRDKTDAISDIIRSISEQCAAAVEGLHLAQDAEEDDADESGQRTPDGNHLAPDFDGNDGRSTREGSEVGDDNSTLHPDHRISSVPPTPDLVHNRSSTSMSMISSSTFPERSSQQYGPGEVPTRIVEDDDERAHETDGLDDHTETGTLSKQGSEDLMRSSPRLLV

SEQ ID NO: 38151 - protein, 418 aa, A.fumigatus
NKRKMKFTIWSSLLALPNALAHPRSVQERSNFAHPGLLHTAADFSRITSKVNSKAEPWFTGWNKLSSSSYQSLSYNANPQAVVYRGSDGTHSENYASLYRDIAAAYITAIYWKVTGDTAYADKAVSILDAWAATLTGISGSSDKFLAAGIYGYEIANAAEIMRTYNGWSAQNIAKFQNMMVEVFYPLNHIFLEQHNGAAIDHYWANWDLCNIASMMSIGVLTDNRTMYDEAINYFKTGAGNGQIEKMIWKLYQVDGQTLGQGQEAGRDQGHAMLDFALLGVIAQTAYNQGDDLFGYLDNRILAGYVSMICPCACHTDLNRAEYVAKYNLGNDVPYTTYTNSDVAQTVISNASRGDIRPIWELLYNHYGVWKGLNVKYTKQYRDLVVEDGAGAEGGGGNYGPNSGGYDQLGFGTLMYTL

SEQ ID NO: 38152 - protein, 137 aa, A.fumigatus
FGGNPDHVVIHGASAGGGSVSFHLTAYGGRNDGLFVGAIPESPWWAPQVTISESEILYNRLLQAVGCSTLACLRAVDASAIQKANLNAPDQGLISYPAGLGKFWPVIDGDLVRDRLYASFEKGKFIRVPLMVASDNR

SEQ ID NO: 38153 - protein, 142 aa, A.fumigatus
TYHVPQISSRAHPLQFGPICVGTGQSTTSTRAEDCLFINVFTPADATEHSKLPVWVFIQGGAYATNSNANYNGTEVVRESGNNIVFVNFNYRVGALGFLAGAEVQRHGDLNVGLLDQREALKWVKRHIRQVRHTVDCMALAF

SEQ ID NO: 38154 - protein, 208 aa, A.fumigatus
WWRVITDEGSSFAYNATSPAEVSVFLRSFYPRLNSELLQTINDAYPKMDPVPQHAAYFPSVSAAFGDATIVCPGIHITNNMARFFEHGSDKVWNYRYNVQDPPRIAAGLGVTHTFDLQAIFGLNYGSSVSSSMRDITPIIPVVMHYYISFIRTLNPNLLKADSAPFWKPWGDGERLKVQTNATAMETVSAVQWDRCSLWKRLAPVLEG

SEQ ID NO: 38155 - protein, 63 aa, A.fumigatus
LKAVQAEDLRPKPKPEPGLTLSVLCTAATDWVLRIPSQVISAMDSLMLWKSTLHGIESESSAI

SEQ ID NO: 38156 - protein, 64 aa, A.fumigatus
RWQLALCRTVSEDQLYEATEKAIVDEKHTLENYRLILNNMEMGDPPGARHVSQQSPTRIPPARQ

SEQ ID NO: 38157 - protein, 193 aa, A.fumigatus
IRFCCTPLSKAMNSLSWAVFFILLIPLLVIRLRKALASYFQKPAQHAGCTDVKRMAPYPAQPIRGRERYRVMMDIRKLDVENWLTVDKNYMDEHLVRSRLLQEEREQVLQCLPESYDACLEALEEVVEFLCQRFPHIFERKQSGNESTIHNRMTGETFVFGGENKQVDPLEIAVRLTMESLPQGPKHRRKGKG

SEQ ID NO: 38158 - protein, 487 aa, A.fumigatus
  UNSURE (479): Identity of amino acid sequences at the above locations are unknown.
NILLTITKSTAGRTAASKIPPEEGDGDGSADSHSSTSASTSASTSTTDRRKSLLPQRSIPSGDRDRDRDGAAPVRQQQQLETRLQRGSRILTKTPGAQKKQEEGVSVSSTAVPATATLANTRRQSLIRPSPLKTGTATATATGAGTRTGTNPGGRAATTPKSATFSVQGLSTFPMKRDGVASMSPKRTEMPPPARPTRSASMRQPLKAGTGTGTGTGAGAGAGSGTPATGVRHVRHRSQIVAPSSSQGQVSRRSDSESSGSTPMTTPGLAAGTRPSGQFTTYQQQFSPRKVVRPAASSVASASAHGEDSLIPTSWPEIAALQTELLQLSLLHSSSLQQMAALEAESEEQLQTKYDAVAKTYRAMVGEEKKRQRLLNGQALNRWLENASEHGGRPNFAAQIQAFSQLVQEVCDLTDSLEGKYTMLVQKFEEWFRKVQAIESMRLHRQQGDANHVVFIDPLDRVWKDEVHVMIVTPVFTYXERRHPRLI

SEQ ID NO: 38159 - protein, 312 aa, A.fumigatus
PKIYQQLARAPLFTRTSQTKLQNLLERVQHILVLRALRICSSDEPSTMTGTSPNLYSLPNTDALAPHLRAYVLRCQNSAINRHNTFRVAVSGGSLPAVLAKALLAPSNGSPEDTVRFDKWDVFFADERAVPLDHPDSNYRLLKDELLSKIPAEMGTPKVHPIDADHVNDDTQELADLYQEELMRSFAAKDSVKLPVFDLILLGCGPDGHTCSLFPGHELLREKDAWVAAETNSPKPPPKRITLTLPVVTHAVSIAFVATGAGKKEILKQIFDAEEGRELPSALVNQGAGEKVSWFTDHAAVDGVSFPRRGSL

SEQ ID NO: 38160 - protein, 101 aa, A.fumigatus
PVENGDSYSYSYRRRHKDGNESGREGCYNAEERDVQRARIVDLSDEKGWGCVNVPEENGDAAAGAADSVGVDETAFESWYWYWYWYWCWCGCGFRDPGDWG

SEQ ID NO: 38161 - protein, 122 aa, A.fumigatus
ACAAPEPDCGAVVEPGSGFQEERLGIFWVDAYDDPRVGGWDETERAVYNVSAAVFAEEGSETRSFIGCQRVRAWGGFTDPDVVARDRGASDGITTVELATFVVTTADGSTGGRVGGTATDQV

SEQ ID NO: 38162 - protein, 93 aa, A.fumigatus
RGRQSRHVLIRQDSFYHNLFEGVKILVQLSGNLVHEFHIIESLVGCQGGLQKVCNGFGLDNATGSPDLKALAEINVPLFVLGSARDQFETLAK

SEQ ID NO: 38163 - protein, 121 aa, A.fumigatus
SQENTMIAPAPTITYESLRNIPLSYATCSIGSSNADTLPRKLEAISKAGFTGIELSFPDIIDYGSRDPELQVSPGITPPNFSLFPGKNSESSGVTQQIPKMNNSFRPVLRKFPRAVPPRVL

SEQ ID NO: 38164 - protein, 533 aa, A.fumigatus
GTQIDQVRSLLRTPIMPSSQDPIQRFKRIGIVGAGNMGSMMTFAFSELGCDVSVWDVDPKNVDSVMKFAKDAQHLKGKIYGYYTIDEFTKSLEGKAERKLFLFSITHGHPADSVLGMIKHDLKAGDIILDGGNENYRRTERRQRECAGIGVHWIGMGVSGGYQSARHGPSLSPGGDAKALELVMPLLELYSAKDRKTGQPCVTRIGPGGSGHYVKMVHNGIEGGMLSTLAEAWSILHNGLGLNYDEIGDIFSKWNSDGELKNNYLLQIGADMLHRRRTPQGDYHGEGASKDDGYVLDDVLDKVVQDDDNTEGTPYWSIMESAERHVSAPTLATAHYLRVASGNREERLRVAKKLHMPIPKPIETIKDRGAFIENLRRAVYCSFLASFCQGLELISRASEDEKWDIDLGKCLQIWRAGCIIQSEAIADLLQPALTSNKRLNNMKFVDEVARELHKNFDALKEIVIEGVLSDQYMPALSATLEYLKYEGGTMLPTKFMEAQMDYFGAHAYNKPSVPGEDPGPVRKGPHHYEWKPA

SEQ ID NO: 38165 - protein, 181 aa, A.fumigatus
SLINLEPVRIAVIGGTGLRELPGFTQVASLSITTPWGSPSSPITILHHQCSHNNKTVAVAFLSRHGTHHQIAPHEVPARANIAALRSIGVRTIIAFSAVGSLQEEIKPRDFVIPDQVIDRTKGVRPWTFFEGGVVAHVPFGDPFDEGVAKVVRACGHSLEGEGVVLHDRGTLICMGTSFVL

SEQ ID NO: 38166 - protein, 241 aa, A.fumigatus
NVRILLTLSNIKALQAEFVPHLVTNFETSFSVKLTEEAKTIRDVLGQIDDRLFQSYTKPTVNKLNTMIVSGITDPEWEPSSGRPEQVRPYVYSVLLTLVLVHTEISTTIPSCVASGASRSPPAAPSPLLNMVLTHLLTQISTSLLNAFRSRPSYTLAALMQATLDTEFIAQTLSQYSTEEASTVQSQIYVELDQRTTHEARARLQSELGEMRSILKRLRERTKGEFACFKKPRSGTGHKAA

SEQ ID NO: 38167 - protein, 310 aa, A.fumigatus
RFPDRSFSPVGFEGESRRHHRLSESETRKLQTGVVELVNLIRENVLSLFADPPLDDASFLASPISPATPNSPISQGVTPTESRFKLDPKNMPIPTPKRGEFWEDYAFWPPFSNSLSGVHYLGQFMIIIGTAASEMAALNPVASGGNTHDLLKSLVSIARERSVRVACAAWGKDAEICKMLEDWTRDPESKDLTKMPGLFVAFESAILGRMQKILYISEAMAKSGAVDVVTQPPAKLLQMVRTQFVSSVYKALSGLVENAEHPVGLDEGSEWILAGSAVQVHGSDSTSPALAADTVDSQDRVGLSLNLLPS

SEQ ID NO: 38168 - protein, 510 aa, A.fumigatus
  UNSURE (507): Identity of amino acid sequences at the above locations are unknown.
HEVKQLIHSSPFDPEPWRYTSMTDIEVANYYNLPSAYPEEWPAELDQSEPSDDEEALGRTPSRARRSRYFALERSHSGKALSLGPFKGSNARENLAKVDEPDPLGSGDSVLQILKKRGLSLEDESRLRNRFLLSSTSFSPALFLSQVHSDASIESLLEGLNFLSRSIDQKSASLKVLVEANFERFVRAKATIDSVYTEMRNQGKEKHVPLTQAHRRSAGHLRSISGASRSAPLADDRPGKNALTKESDYGMKGIRVPLLEASVKAEEVWGPALGGREREQMLKSVVDTMEKHRDVYEIGGLLSKSIKLRDYDSVFEQYTKARTLAKSAKHIAHKATSSGRSLTDEETHAILAMGRMWMDVDHQIQAFKRDLWRRLSDAPTTSTTATADGTVEEYMELIGALLELGVDDNPIWVWLLSRYDFLKTKIGAFCGRCKMEIEILRRRLAGGDKPTPKAVASYLRLAPREESAELQGVLDTDQVVELWECILAYLNKLLASQGGLLGEVFEXLGK

SEQ ID NO: 38169 - protein, 77 aa, A.fumigatus
VIPACFSTLCFLSKRVSGVTVGAVVIPQGMAYAKLAALPVEFGLYSSFMGVLIYWFFATSKDITIGVSNTTFCSLRA

SEQ ID NO: 38170 - protein, 442 aa, A.fumigatus
PVAVMSTLVGTIVLKAQKEIPDVPPYIIASAMAIICGGIVCAMGLLRLGFIVDFIPLPAISAFMTGSALNICSGQVKDLLGETASFSTRGATYNIIISTLKHLPSAGLDAAMGVSALAMLYIIRSACSYGAKRYPQRAKTFFFLSTLRTVFVILFYTMISAAVNIHRRQHPAFKLLGKVPRGFQHAAVPVVNARILKTFAGELPAAVIVLLIEHIAISKSFGRVNNYTIDPSQELVAIGVTNLLGPFLGGYPATGSFSRTAIKSKAGVRTPLAGCITAVVVLLAIYALPAMFFYIPKASLAGVIIHAVGDLITPPNTVYQFWRVSPLDAIIFFIGVFVTVFTSIEIGIYCTVAVSAAVLLFRVAKARGQFLGRVTIHSVIGDHLVQGDGKYGPANGYTPADGQGNFQRSIFLPIDHPDGSNPEVEVQQPYPGIFIYQILRRI

SEQ ID NO: 38171 - protein, 127 aa, A.fumigatus
GHGILYPIFQTSPGPFERLSTYTTIMSADLKTKIGHGLAKGLGIKLPYRDPLGANADPVTRGESMFSVGTVDTYSYVEPEPTSAEWLRELCPTWRDVGHYFYRLFPFLTWITRYNWQWFLGDVVAGK

SEQ ID NO: 38172 - protein, 168 aa, A.fumigatus
AYCHLQVLRPGQQLYHRPISGAGCDWCYKSAGPVLGWLPCHRILFPNCHQVQGGSANSSGWLHYRSRRAACHLRLAGYVLLHPQGIPRGRYHPRGGRPYYSAKHRLPVLARLSLGCDHLLYRCVCHRLHLHRDWNLLHRRCFRSRSAVPCCQSAWPILGKGDHPLGHR

SEQ ID NO: 38173 - protein, 560 aa, A.fumigatus
PECHHPVKGWLRSSALQMSMVPKPSSGLPFWSHMGGTARTFITASMQSHLRRCSCAQIADPTSFHPKSFSEVNPEHRSEHSAWETPDPGFWTKHGYAIVRADERGTGQSRGKLDTMSRETSEAFFDVIEWAAEQPWSTGKIGLLGISYYAGSQWRVAARQPKGLACIIPWEGMSDYYRDRCRHGGILSNSFIKFWWDRQVVSNQYGRPGRAARNWGPDTIEGDLPEEELVANRQDQTIDNAENYFRDDIYYASKEYTPSDIQVPLLSVANWGGILLHLRGNVEGYTQAGSELKYLRFITGRHDLPFYYAEEVEIQRSFLDAFLKGEDRVGWSNGTAPKVDLVLRKGDVGFDNAEAEKQFPRRVENEWPIARTQYTKYYLTSDRQLVTEPRQERPGKITYRALGTLDNPQLVQFTTAPFEQETEITGHIVAHLNVSMSPEPGAPTPRDIDLFVTLRYISPEGKEVFYTGTAGDPVPLCKGWLRVSMRKVNKEHRRHRSYLPHRDYYSTDALPVIPGEVYGVDVEVWPTNVVVEKGGRIVFEVSSGDTQGCGIFQHNSPTDR

SEQ ID NO: 38174 - protein, 213 aa, A.fumigatus
  UNSURE (212): Identity of amino acid sequences at the above locations are unknown.
LTSALLHLGQTHQKDTQGPPVTPLYQTILPKMPSKPKNIRPLQRYITTHDASGKAIFSSALSEEMPVTTMADGADFSLAYTSSHFPAKLINDDDIPEYANYLSSPPGIVISTGTVCRIVDMQPGATSPMHRTVSLDYGVVLEGEVELVLDSGETRLMKRGDVSVHRGTNHAWRNTSQTEWARMLYVLVPAEAIEIGGKKLGEEVREIRVRPXT

SEQ ID NO: 38175 - protein, 179 aa, A.fumigatus
KDGSGLVRCKCLWSQSPRAGSRSGHIWAVRQGHSLPRVCSPICAAVHVPRLLTRPVSTPSHSAKSTRSTARSIPRGRRPTPVSGPSTAMRLFGRTREAQVNHGASWTPCRAKPARPFSTSSSGQRNSHGRPARLGCWVSATTRVASGESPRASPRASPALSPGRACRTTTGTVAAMEAS

SEQ ID NO: 38176 - protein, 76 aa, A.fumigatus
FHCIHCCLGTTSGAEIIGFSDLILSRPRAPPWVYIPESYDYQSNNNGRIFRVIQLESIHTKATIISQPYLSMPSGE

SEQ ID NO: 38177 - protein, 241 aa, A.fumigatus
  UNSURE (191): Identity of amino acid sequences at the above locations are unknown.
CPAMLTTNTQKWLLVHRAHLHEGLKAAALAPGSGIPAELHTSSKVIDIDPHRATVTLEDGQVVQGDVVIAADGVHSVARSKLPRASNVAPYDCGRNAFRCLMSRQAALDDPETRELATERGVIDMWDSPERRVVIYPCQNNEILNFVCLHPSTMTAIENGTEWNHSGGKESSIEVSKDFDPLLVKLLGQAXGETLRIWPLWDMDTLPNRGLKFDGCPWGIAAIPFLAQSWSGRGPGLLKEW

SEQ ID NO: 38178 - protein, 187 aa, A.fumigatus
GLPKGGHVTAARAQLLSDKAEQRLCWGEVLFRGKLHLPFSRCKCWPRHSTAMGSNDLNGTEQDSLQILIVGAGIGGLTAAIALRQQGHRVSVSDPAFSSESVGNSHASHVHSCSSEAVLRMKSGQQFTSPQMPTVSSYGSGWMRPSSERSKQKWFVFNANQVNEGHMLRSDSFASAQPTGKSFRLFQ

SEQ ID NO: 38179 - protein, 61 aa, A.fumigatus; identical to SEQ ID NO: 32766

SEQ ID NO: 38180 - protein, 306 aa, A.fumigatus
FKEHQQKIVNELSGIDGKMFKTDTWTRPNGGGGISCVLQDGNVFEKAGVNVSIVYGELPRPAIEKMRADHKSFVGADVDSLSFFAAGLSLVLHPHNPMAPTVHLNYRYFETSDPKDPIHGEKNWWFGGGTDLTPSYLFPEDVKHFHQTIKDACDRHDATYYPKFKAWCDKYFHLPHRGEARGVGGIFFDDLDASFLETSSTSSQNPQETIFSFVSDALASFLPSYVPIIEKRKDMPFTPAQKEWQQLRRGRYVEFNLVYDRGTSFGLRTPNARVESILMSLPRTASWAYMDPVSGTRTEGPMSEEE

SEQ ID NO: 38181 - protein, 583 aa, A.fumigatus
ASGSRNRADHQTRFDFYFKSCSAQPATMPPKARINSKNSVEQEGRVLLAVSALKNKEILNIREAARVYNVPYTTLQRRLKGHTFRAELRANGHKMTQNEEDSLIRWILSMDQRGAAPRPSHVREMANILLAQRGSTPTQTVGEKWVYNFINRHDEIKTRFSRRYNHQRAKCEDPKIILEWFNRVQIAIMQHGITLEDMYNFNETGFAMGLVATAKVVTRAEMLSQPFLIQPGNREWVTSIECINSTGWVLPPYIIFKGKVHIEGWYQDTALPADWRIEVSENRWTTDQIGLRWLQKVFIPATTSRTTGRYRLLILDGHGSHLTPQFDQICTENDIIPICMPAHSSHLLQPLDVGCFSPLKRAYSRLIEDKMRLGFNHIDKFNFLEAYPQAHTAIFSADNIKSGFSATGLIPLNPDRVLSQLNIQLRTPTPPGSRSTNSIPKTPYNLKQLKKQETTLKKLLRERTYSPPTPTKAVLGQIIKGCEMAMNNAALLAKENHDLRAAHEKHLQKQKRSRRQIETAVGLSIQEGQEIIQRRDQAAEAIPTIPPEQVVDTEQRPQRAPPRCSDCHILGHRRLQCPQRKNN

SEQ ID NO: 38182 - protein, 88 aa, A.fumigatus
CSTAGGSRLPHRHPYAPRKTTPGASPGPRSCAGCATRSAETPCAPRPATAHGTHSAHYPAGLYSAAPASRPRPGPATPSGTQPYPTPR

SEQ ID NO: 38183 - protein, 329 aa, A.fumigatus
  UNSURE (328): Identity of amino acid sequences at the above locations are unknown.
PGVAGLGVSANVRAAYGFLADNYNDGDKIYFFGFSRGAYTARAVAGLVCKWGLLTPRGMDNFALVYDDFYNQKIEGYDAERRKRMGFRDPLSRFTHEIIGVWDTVGFQKAWLGRDAGEKLELRNTILQDNVRYAFHALSLDEERTAFQPIVWHIPHRNEGQEMLQVWFSGVHTDVGGGDENPRLSNITLAWMIAQCMKHRQLRFDIDEYLFDDPPRPEESEMAPWATSLGKIDHSSIGRTLQGKLGGRSTRKPMGYNPTGQESDITNEFIHESVRDRNLAKWPCAALKGRPDEKSWTLTSGKQIAELPALQMEKYMKGRIRTVHVTEXD

SEQ ID NO: 38184 - protein, 221 aa, A.fumigatus
QAASWTRYRTLTPKSRAIPLTPSFVSYLRANGIVLPPETTRPHGDDDIDTFSDDGADEESDPSVEWQEIHSQIKSTISEFGGKVTPKLNWSAPKDAVWMSATNDLQCRTPNDIYLLLKSSDFITHDLEHPFDGCVPDPDDSSEAPATQPDIPYYLVLRKYVNFNPSLEFRCFVRNRVLLCMCQRDQNHFDFLFSLRDTLRSRIQAFFDEKLKDTFPDPNFV

SEQ ID NO: 38185 - protein, 698 aa, A.fumigatus
  UNSURE (59): Identity of amino acid sequences at the above locations are unknown.
EACALRLCSSGIDSNTETERRALGAQLSLLHRCTQAIAYLLRKRVYTLLRAKLLVLSRXLHKTLSQQKTVPPFLDNLRNQLASLRRTLLKRIDKRLASAKSIVDDTIESLAAYCLATSSSSDDAIRHFHHVRLDVIGNLLGLHESSGENVSNALQLYIQTLQMSKTLLSRRLSDVLNKLKARPILADPDILSLDELSVDVLGRWVAADVKNFTPWIKLSELSKPEAEKTIKQWSRQAFDAFIKGCSHTLTDWCNFSELLALRRKTLELWLSSWGSTPTHSPMNILGGIQSVFNERLSQILSHQAKELEQFGRAVSSVVTNWDTNEHVEALSLWDDELINLDYSDGAAVFKQTIADRLLGRDADVSAVLAKYETWLAAIDKSKQYINDMKRVRWTDILEEGEEEDADMDITPILNDDDTALLTNALQQSVRESFKHLQSSFVEILGSFGPSHRDKKAAFLLKLVRLVRKDLPVNFISSDFSLFKDIVPQLQEILIAQVVTLTEPSNLWPKRVSQTNEILQGRTLWEGDPELPVQPSPAIFKFLRHLVDTMDAYGLGLWDVSTTQALKEGMRKELWATAAATLKALESVNDQEGSAVSKEAQAVENGDNDNIEQSEANVAIGAQNTDDYKIQLYFDLLYLRNALSITKSAQDSLPDPVESLFSSLNSNPTTVKILEQRAHDYWKRTHLLFGLLEVGTEQL

SEQ ID NO: 38186 - protein, 369 aa, A.fumigatus
SCGSPNSSIMASPRLPFLYPHFMRAIRTCEPSTYRTIRGRPHSRSFHASRYRGQEAYHRRYGPAAEANLPPPSKPREELSKEQVSKTPAVKDGNHKLEQSRSQDGTKGDVLDASHKEDDDPKAAQSHESQSPNDSQTHEESELDLDDPDIHAVSPVSTERPSQDRHKPNSLSDNPLEGVLHMPSPSSPLTPTETSRSDTKPHLAPVPYVHHFDTYSLVCDLSKGGFTEAQSITIMKAIRTILHKHLDIARQSLTSKSDVENETYLFKAACSELQYSLQTARNSEMQRQRAARAQLEHEADILSQRLNQELAGLKDDIKGMFNDHKMATREQQRSIDTSVQELNYKITVSLNSDGKSEILQRGWKIRVKV

SEQ ID NO: 38187 - protein, 1086 aa, A.fumigatus
PQPTDISVDAQDYPENHTYFVFTTSEDPPSRVVTVMENAQSRFLGVALEDFLTYIDEIVQNALRLPASEADDDEKVGYGVDDTDFVDDDDDNDDDVDWDMENEPVFGISRADEKHLLKTLRRDLRAVKNAGLKVGCLGTLTGAVIVSVSCRIGRLGVSEEAMEAWNVRASEYLVLLMRYPGTYVDFQELLALGKAKYPAIQFHVGLCDSYKPTTEDAIRAFQGNLSLSEEGLTGTARLRSLFIEQPLDSLLNERFLRIMELRYHLGLSWTGAELYIQQNQGRRPDYGAITDDYFEPDTWSASAPALFQNDHIGQGLGVDKLSLPLIAMQFTLRHFVKCTEFCLVCHCKILDRFEAIKPYVCSSSLCLFQYMALGMGPSLEHEIQFHPSVVDLLISLTYARAVSGKLMDFPMGLGLKVPGVLNMNRLDEIEYHLAKPNDGNSSPVPTCYSGNLVAATMVCRLDKRAHLKPGDWVVIFQTGTDLKDGPWHCRVEAIDVGTREVQLSSPTVKGQQLSATELLLGPSQVKIMVYERNFDDLDVNEKRAAVRLLLDTLPNVDKMKTYLADSDNKKLAGWRDVISPAALDVLRWVVASNRSFILEDDTTHSDHRVSGMGSYKQFRLVQGAPDKEQRFRAAVAANVAMTKTDYPTIFAWHGSPVWNWHSILREGLHFKEVTNGRAYGDGVYLSNDFHTSVGYTREGLDYSWPQSNLKIRMLVSLNELVNAPAQFKHTNPHYVVTQLDWIQPRYLFVKCQGAGLGDGTANAKPSAIYNQDPKYPARGPSGTPICIPISALNSQRRHSLGVANRTDSDLAISASPERKKRKREADKLPTPDVSTNSMILEEDDVASVATAFDDLQVLLSEDECEVEEAPTTKPLKNGEASDFEPGTLKKDSLPLLAPPQYATAPATKVLQQHLQATLKVQARESLHDLGWYIDPEFITTVYQWIVELHSFDPKLPLAKDLKQANMKSVVLELRFPPAFPMSPPFVRVIRPRFLEFANGGGGHVTAGGALCMELLTNSGWLPTASIESVLLQVRMAITNPEPRPARLALNRSRSDYSVGEAVEAYKRACLAHGWQIPEDIQRLSWA

SEQ ID NO: 38188 - protein, 93 aa, A.fumigatus
MSVNLMQTSHDNCIIAWIFSVCLTFAYPLNDAGRLPLTSTDVISPPRSHLGFFGSPSFQFFTYKTTFNSIIVDTSNNFYLTIKVRRRRHLDDG

SEQ ID NO: 38189 - protein, 483 aa, A.fumigatus
KFVVDGIWTTDSSAAEEDDGNGNINNVLYPRQLKQASNPPQTNGTTMATVTPEVTEAAIAAGIHKDTEKRANEAIISSAAPGSTTAELAKAVPLEQRSNVPGTFPETPGQEAGTFSVNPIPASGTSGNPISLKPGEKVPDPSTFTSNTVQSTARTDPTGYTQDPSAATVLEPVGEPSQRFRDPGVTIQSAAPNSTTAALAASVPLESQRPHGAAEGVADEVPKVVRESIAESHRDPEAAANKEAVEEKKEMENELQKRVTRDESCGTPAPSISAVIGSTQTSGGAPADEVPEPVKHSIAEAHKDPEAAANPEAVEEKKEMEDELQKTVPREEHAGAPAPTATAATTESAPRATGVEPQSQPLSPGAGSPQGPTVTTGVASAKAPEVSGPGAGARTGQSEGSTTVMPSSIPDKAVGPSERQTEGTPAPSQPTAAPATTSPQVQTAGTTNGPSKPAGQRNGLRNEMKEEKKKKKSFWSRLKDKLK

SEQ ID NO: 38190 - protein, 791 aa, A.fumigatus
  UNSURE (764): Identity of amino acid sequences at the above locations are unknown.
DDMASPESSLLSASAVSHRKSGDQYSFRSGTSKSSLNNPKLLETVEDAIRRLILPELKELKKDQKVISNTSKFERDLNASHTSSASSRSRDELGRRLSKHASAPDVMKPKVVLNKNSKDEGVILSGEPVPATKERRTGKDSEKKLEPTYAIWGNRPELTEQEKLRRQRSKGLRHAEKAAIVGTALTAAALRRHESQTSIDKDESRRGDDRDRAEGINETELVFQRHNVAPMPLRSAVETELTRDSLLSHRSAETETPRKESKVQGVSRSSPLKVNSPVSRTPNRTPLGSQHELALKHSNLSHHDLSLHSTSNPSLHDRDHSPVSEAAAGAIAAAAAANLLDVHSERRDSGFNNDSRRRTLSPIQSVASYRSDSQSQQYEHEQHEYSEGERELEPRLSIESLSSAPSTSLARSTRPDGLTSHSEILKHRDVIDHELGYEETPRPTPQNESWHEGSELDGPNNRHSTADTIDSEGKRLTNYTDESEVSYMKKIGQGQRVAQGIGANPQYVQPIAVESAVASLLDPSILDTKSNQSGGNLSQQNLPRIQDDRSPESHQQTANTSRQGSPLKQRQDASSPDETSFPRRMGATSPPQSVAQSLEDPTQSPQIYADEHRNTGSPIGDDRDVSPDSESEINTNPSIIQGPIGGVAQDSNWTYHQTPPKGDQSPHYHEHADAGAGRAGLGVESMDHHGYNKDYYAADDYGPDSYFDQPYAGGHMFGSPLGAKDEGYVSAANPLSPGADTPEPLSKGFGGIDANGMSLFDTPXEADDPTGAFSPEEPKWLFTRHWFSSIR

SEQ ID NO: 38191 - protein, 479 aa, A.fumigatus
LTVRDAQRNARDTEILVTLVRSAAEMRNSLEEMKKFIAQRDGMIMEASDKQHERVYKAIGGPRPLPASGSRNFRQAAEDMEDMRSKRKSIFKRALKGLSLKSSNDLTKIEEMLEQLLEEVEALRAGQDDRFARSVNRTASVDPEGYEPEGLAGSGSPGTGYLSTSSRPLQESRNNEQKRELENRVSTVPEGDEDDDYDDRGQFLSPNVPSQENADGHRERAESAPLSTPPRVPVASGALSNETSPKTEKARKHKSSSSSFFPKISRWSKTTASSMGDNIRNSLQPGRKERPYLDASRSGSDINGPYKSADWYDPEGDDRLRSNYTLNDQQQENRPPSPLVPSQVSEAPKYRAHRDSLDLQHPQPRQGPTGRYQSQLETQAQIYGMPMTGATSDQWGSNPSVSATNPNQNRYSGGASRLSPISDAGYSQTSSRAGRQGPPRPPKIMDDGPLVPERPPKIKEERSYAERVASQVSPLCSLH

SEQ ID NO: 38192 - protein, 122 aa, A.fumigatus
QQGVAGQFRLDGTAQRHGRHVMSLENELRLIDPLGAVSVVTSSAFILIDAGLRFMTSQSGRGQCSAYNCGLFRMAQSFASLSPQLFLFGQLGAIAPDCIGRFEFLLAILACAALLRCRHRLS

SEQ ID NO: 38193 - protein, 65 aa, A.fumigatus
KYADYNNSQGGYGQYNPYGGQQQNNAYGSQQQGYGQAPYQQANNMEQGNGSYGRSPHILSSGVYL

SEQ ID NO: 38194 - protein, 185 aa, A.fumigatus
ALEYISNALPLTEMSAMGGYGGQQQQPSGPTALLNKCKEINDGIADLRAKREGQLAAAQNALLDSSTGKEDQASRQTLDYIEDEINNGFRYLRDLLKKIKQTPGSGDTRVQTQIDVTSRNLRREIEQYQRAQSDFQKRLREQVRRRYEIANPEASPEEIEQGVDNVLMGQEQSFQVREHGSSPIS

SEQ ID NO: 38195 - protein, 201 aa, A.fumigatus
VTGSRTRQANDARQAALERSAAIRKIEQDMIELGRLYQEVAELVHQQDAAVEQINQGAEDVVDNVQNANTQIDHAIKSARNARKWKWYALLIVSTCHLWPQCKSINLTDCDFSSDHCHRCRCRCWCHPGQQSVKWPSLKDACIKRLAEYVCRLLMIYSALGNLRRYVRLLDIPVSRPLHYPFVIHGPRNAEAKVDKFGEAS

SEQ ID NO: 38196 - protein, 123 aa, A.fumigatus
LAVTLLAILASNAIALPLSPAFPVGELKYILDNSQAKVLVATQKYRDKAHDLLKAGLNTEPVLDIKEKIQVGATSSHPVSLEDLNGERSLGGMMLYTSGTTNRPVGIEFSVNSVETPTGWKNF

SEQ ID NO: 38197 - protein, 289 aa, A.fumigatus
KGVLIPQSALTAQASSLLEAWKYTPEDRLLHLLPLHHIHGTVNAIVTPILAGSCIEFMFPFNTDAVWNRLAEPFLPNSTNKSKITFLTAVPTIYNRLLSSFPSLRPEIQEAAKKGISPENLRLNISGSAALPTPTKQAWQDLSNGNVLLERFGMTEVGMAISCGLDFADRVDGSVGWPLPSVEARLVDTETNEVIKPGEELDANGREREGEIQLRGPTIFREYWVNEKATKGAFVDSEDGKGKWFKTGDVATRRVVRNAGKGTSGKWAKGPSISSRVLHHAAARTTLMY

SEQ ID NO: 38198 - protein, 109 aa, A.fumigatus
VFIEAHSFFVLNSTNRDDRFLRDAYADVDKHYPGDTWNEPGNNVYGCIKQLFLLKKQNRKLKVLLSIGGWTLSANLTQGTSTDAGRNTFAQSAAKLLLDYGFDGRFSLS

SEQ ID NO: 38199 - protein, 223 aa, A.fumigatus
  UNSURE (110): Identity of amino acid sequences at the above locations are unknown.
HSNLGPNNYSKLKLREMTPFLDFYNLMAYDYAGSWDSVAGHQANLFPSNGNPSSTPFSTIQAINYYTQVGGVPPSKIILGMPLYGRDFLSTNGPGTLYSGNGAGSWEHGXWDYKALPQPGATEVFDQQAGAFWSYDAGARTMVSYDTVTAAEMKVNFIKEQGLGGGMWWEASGDKGGKAANKADGSLIGTFVEGVGGVNALEQSQNNLDYHESQFDNLCAGFP

SEQ ID NO: 38200 - protein, 70 aa, A.fumigatus
  UNSURE (7): Identity of amino acid sequences at the above locations are unknown.
HDRTTRXILPAPCEDLRGGAKKRKKKVYTTPKKIKHKRKKTKLGGLKYYKVDGDGKIERLRRECPSPEVC

SEQ ID NO: 38201 - protein, 206 aa, A.fumigatus
QNGVHVFSVQLRLAPENPHPTPVEDCYAGLTWLYEHAEEFSVDRSRIATMGESAGGLLAAGITLMARDRGLAPPIAKQILIYPMLDDRNTVPNPELENFALWDCNDNITAWTALLGTDIGKDNVSQYAAPARAVSVQGLPPTYIDVGELDIFRDEDIAYAARIASANISVELHVYPGLPHAFEVYAPHIEATKRATADRFRAVQTL

SEQ ID NO: 38202 - protein, 97 aa, A.fumigatus
  UNSURE (14),(35): Identity of amino acid sequences at the above locations are unknown.
DFFPSKFFYPLKPXSVAICGLISVASTRHIQQFAXHSAIYYTLTTSTSWHFWHNYFPIAENKGTKTILGGHYNDIYNTIPFLNRAHFRYHRASASSF

SEQ ID NO: 38203 - protein, 75 aa, A.fumigatus
GTGMIMPRNFNLTSDLTWSNIGSGRCLLECRQSPGPSSYSTYLRCSALVTKAQHLNQAHNAFGSSTMMILTLKII

SEQ ID NO: 38204 - protein, 177 aa, A.fumigatus
DKYMRSVADFLNLQERTKRDMENARNFAIQRFAVDLLESIDNFDRALLAVPAEKLKAEVTESNKELMDLVSGLRMTQNILLNTLKKHGLERFDPSEPAEDGKPQKFDPNVHEATFMTKVEGKEDGDIIHTQTTGFKLNGRVLRVSHSSLSSFFSQGSNPWFHRLPRSALSRTTRRRT

SEQ ID NO: 38205 - protein, 199 aa, A.fumigatus
KLHIPFSSLKYPSYIMFQRTLLRQAQAAKSIVSLRATSTTPSVIRRTSQLQSQLLSVRPVVRQPTYRFYSTENQAQNAEKAEAKENEAAEESPEESLRKELEAKEKEIVDLKVLITLCGWWNIHCWDDRQPMFAGADFVHRTSTCVPLQTSSTCKNAPSVTWRMPGISPFSGSPSTCSRALTTSTGLSLLFPLRSSRPK

SEQ ID NO: 38206 - protein, 137 aa, A.fumigatus
STQLSRIPNLNIMDSEYEAFITAQSQRDYPAPASMLSAIKSLLVDPSTPPSAAARAAVLGYIQESNPDPDYTSLWPLLFATIGKFTEQNDRLVAFVADLQSLTECNGAFSRLDGLSEYMTEFVFDCMSSPRSTLNSN

SEQ ID NO: 38207 - protein, 164 aa, A.fumigatus
WLSKDIKVSRKTAKDCAHQQAATRLPSKIQAFEVNRKTLSYNSKMPSFFRSLALYALLAGALVAQVTNAYPQPALVHSEDAAIPHDTITTEPISMVRSIEDDGDLYQRSKPLKIAKEPTKSYSCPATNNYGSNTYTSGQLKAAFVKAAQYANDGKQIGDSWFAA

SEQ ID NO: 38208 - protein, 409 aa, A.fumigatus
AKDGDILYIYYRAEGIGITFPYIRHFPMMTPLDKSKRSTPQQLQPGSPPCLPKPRQKWLVRSVIFVESNVIEPRTGRASTVEWLDRNASRSSHDVESIDAAATLVMIRDTNFFGRYKRSNVRKHRSGSARRAHSQDGNHSTPSTQPPLTRESVGPHPIQYETAGEETGESDQVHCPGFIHMVNNPARGMEVVYYGDSFNLNYVLREMGNPFQGDFDSSSLKLRIEELYLNRLGQSTKDQLDAHECSQRIRLEEMGAFQRLDKEISDALIQTFFAVVYPLCPIFDLSEFHTKYRAEHFSPLVLQALYFVAASHCEQSLIEKAGFPNRHMATFTFYQRAKALYDANYESDAIATVQALYLLSYWWGSPLEQKDMWHWTGLAVGLAQTLGLHQRSVDIAIALNFVLTNCPIQ

SEQ ID NO: 38209 - protein, 101 aa, A.fumigatus
WQADWRQLVCSLILEDIVAHCYLGHYPHTFGNGEKLPFPCGRSTMEFPLDRDHPGTVYSGQSVKNLPDRIVFEFKDGKKEAKAKFCGVMRHGNNGDFVNCP

SEQ ID NO: 38210 - protein, 168 aa, A.fumigatus
STISAAGGAPSPASASSSPPTSTWARTWACSRGRAPTAPPPTPPSPLSSSTPSAGPSASAPSPTSMARRSSPRASATSATRSACRCTGSSSLLSSASLRTCSSRSMCGAPTSFGRSFASLGSSSWASGCLRRRACPLSGWVISSRDRGTCAGERSQDPSVPFHLLRLG

SEQ ID NO: 38211 - protein, 141 aa, A.fumigatus
PWMLCPSVGYDEGGFSASVNLKSFVSDFHLAASEWTNNKTELANRRANITSFNVLGAALGALLALDLNDRLGRLRSWRLACLIWAAGLFVQIFSSGIYGLILAARLCSGLGAGILTVTTPLYLSEIGMGCLIWTQLADTKC

SEQ ID NO: 38212 - protein, 364 aa, A.fumigatus
TDIVKGFFINYAASLHMAPTRTQYRLVQSIPLIPVGIAFFASVIAPETPRYLVSKHRHDEGRSVLARLRGRQVSDPAIEDEFKSIDAQVRTKAMDLASVTHWEAFKETQLNPNYRQRFWLLIAMQTISQWTGGNGITYYVATIFQYAGIDGNARSLVSSGAYGIVKLVFTMAFTWGLIDYLGRRRCALAGLSLQLAAHIYMGAYMGLQPGSSTNRSASNAAIASVFIYAVGWSIGLCTIPYLYGAEIFPTRIRNVSYAISMSLHWFFQFAVVRVTPNMFVALDVWGAYVFWAIICFSGLVILGIWMPETKGVPIERMGDLFEGPWYLRWRAKPRPISSFSPSPAGMNAGDPPGEKRPGWANASV

SEQ ID NO: 38213 - protein, 108 aa, A.fumigatus
TPAVDDTSEIEIWTPHGVIFPEGTHYPPTQAHSTSCFMRMCGLAEILNEILIHIYDPIRQVSEAEFHDCVQEQARNLTEWWDELPDYLKLVVTELPPYSPPSHIVILK

SEQ ID NO: 38214 - protein, 181 aa, A.fumigatus
PTSSDRQNKKKCLQSPGDMKINGPYYSDTLLNAILSHSVRWCKSEPKIGPILESFDGGAQFSDRAVTGLYDSLRVGYAGIPTIQTLLILSAQECGRGNRTQAWLYSGMAFRLLDDLGISIDSRKYPDAAQLSDEDIEIRNRLFWSCYFWDKLVSLYFGRSPTMQNSHVSPPRTICELSLLV

SEQ ID NO: 38215 - protein, 171 aa, A.fumigatus
FPPVITTALGLIYHELEKFRIDIHITLPPSQSEHPSSEPASQAHSPTHSQSPSQHPGQPALHLRSGSRHVSPAGQAPTMPGSLPAPRVTNAPLPHQGYAFQRSVGDFEPSQTGVPPLPATHLLGGMPNAAMTLDNPGPYEITPEVFEAFSYAEPITANMASAFESAWGRPG

SEQ ID NO: 38216 - protein, 155 aa, A.fumigatus
AAGLSEAGGHRATSLLATKPYRDPEVSLSPLRFDGTIYNGLLHSCLYHTINILLHRPILCSKRNRETYDQSHLVQCMTSATAILSLYDLYCQTFGDAHVVLSLAYSVYTAASIFLLEIQALKYAAPGTLNKLKFCILALERVKVSSPGTAEPFSR

SEQ ID NO: 38217 - protein, 127 aa, A.fumigatus
QAHADFLQSSPQLWASYTMNWRSSELTSTSPSHHRSPNIHPQNPPRKHTPQLTVNPPASTPASPLYIYVAAPVMSPQPAKRPPCQAPSPHRASQTRPCRTRATHSSDLSGISNRRRRACRPSLLRIY

SEQ ID NO: 38218 - protein, 909 aa, A.fumigatus
FGSNGDSHQRISTRMTEGRASGELEGSTLGSSSRDGDRARRSQRRTASSSSFLVDSSFLSKSKSIRTSSHRPRLLESHRNEKRGAPESDIATPKKRSRFPWSRNRESVEGSSVEGSSVIAGPQEAAGTETSGPSSAQQPPTSEPLPARADNNEAVPGLDRDSLQIVNLALNLSESRRRNNLGRSVSTRLSGAGGSVPYADSATLTTGAGRGYPTLHTRRDYPHPGISHRATPLPGELAVNPASVLDLLPNAAGEETLPHAFSTSTLARADKARRHFELFHLYLRLLPSLPPLRHHGTQDATDASSASKASFPQARDYNPLQAIRNRKVRFRERRPIDPESEGWYDVARVREWVNSVQFQYGDRSHLPSECLKLPPFERGEKDPPREEPDDPDLFAASPPSSLRRVSRTSSTKAARRPRFDWAISPAELLADAAWVEEGQNKSKMVDKDGNLLFPDPAQLHPCGEMPPTSAQAHMQAKSPSAGARHADSDTSFSNAHPALGAEFRSVNRGRRRHRYHSAAHGFHSRGTSLTSIGTKERKLGLRSSSSSSVSATGERHSWYHHADNAGGSAASKLTRARSARVNSSTTAPDEEHGLDAGPLPSQTSTIQPMWAKLDERSGSLSSAASRQDPSSTGTPPVPLGYFPSIASNLSPPSSRSPSPSKRQVAHGIIARHARSKSRSRPREILEDKLISATDTAENLQQYIPDAAYRAGKLEPSPIPDHVSPLNQADKTRTHTHVRKGSFQPESRLRGIFKGPGKIAEIVGNEVSKMGDLIMKKDDPAHSRTSSLETALPSEDSALDEGEETKGEKRSGPKALLRRLPTFSDGTPRKHSERVSAKGLLQSTAALATPSRRIEQEEQCRASALDSPMKQGPDASFHDAQVSQTKNLDAPMLQKNAHLLAEKIGDGPKN

SEQ ID NO: 38219 - protein, 310 aa, A.fumigatus
SRVQMLRSMMHRCRRRRISMLQCYRRMHTFWRRKLVMAQRIEPEFQAVRSQIEKRQIKDPSVPFSMIRPPVTGLAQAEISAADRLQDKLRGASGQSRTWSISNRSISTSVDSGIPDRREIERTRALLLTSGIKAREITRRAESIRSPPPDFLQKAYSGSPVPQVIRLYEFDVAAKGLLRRLETSHDSFRRTIEDYPRASGALRTQLAQLEDLVNQTLAPRVRALADDAENLSVELNTTSTLAVKHLSDKLDKGIRKRHRRLRWLRRTGFVMLEWALVAMLWWVWLIVMAFKVLRYIFRGAIAGLRWVLWL

SEQ ID NO: 38220 - protein, 590 aa, A.fumigatus
QSRILPAPSCRLGRPEGFNIIRNGKNQQWYTVRAPLLHAFLFQRIVIDEFTYAGNERLAPLLALRARSKWVLSGTPPLNDFADVKTIAPFLGIHLGVDDENTSFQNHRLKVLRRNRSDAEVFQSWRAPHSEAWHRNRHEVAQRFLNQFARRNIADIDEIPCSEHLILIDQSPAECAIYLELYMQLMTHKKQLRRSRRGRFKNDQNERLDEIISSSMSTEEALLKRCCSVTLKERWEEGKPEAVTCSSLITTREEQLANLRAEFSSKMKLAIWLYFTWDLKYEKFHKFAEGILMHHFGDEVVTTAAFLLFKSAMCASHPNDWKLFFTEKGSNPRKENSPEEAETGTTVSQENAGSLEGDKMTEERVAGKGAQKRQAKKTKRAEVNKDQCSELPIKPTILDDFELCMDEVTSILRNILSEWVRRKRALRFLRTVRMLQTNRETPGCHCCREEVQSRSDLNVVGSCGHALCKDCTEKTVRFEECIVDNCRGSGTKFNMISAASLGFEEDRSTQYGGRKMDKLVEIVKEIPNQERAILFIQFPELIDVASKAFDLAKITHAVITARDTKKIEEFKKGNEKVAILQLGSETAAGL

SEQ ID NO: 38221 - protein, 150 aa, A.fumigatus
RRVTPRRLKNLKRVTKRLRYCSWVARRLLVCKWPSPTILSLLSHPIFFHRNLQCTNHVIFLSPMLAETQYDYDSSMTQAIGRALRYGQTRRVHVYHLLMKRTIDVNILQERRGKILVERNGQAVLVKADECLAEEALSCQGPALVVDNFL

SEQ ID NO: 38222 - protein, 175 aa, A.fumigatus
QMSLKAVSLARQAASKTLFQSVRSVQPLLLVSTSPLSTACHPTTLPTTQTAARPPFRPYKRTMSTTVPDRYKLIFFVPHSHLEQCKEAIFATGAGTFPGGKYSKCAFQTPGQGQFLPSGDANPAIGTVGQLETVEEMKVEIMCLGRSIMLQAVEALKKAHPYEEVAYEVYKMENV

SEQ ID NO: 38223 - protein, 130 aa, A.fumigatus
HPATYVAAVSPKILQTIQEHLGITAGHTTEDGLFTFIEVECLGACVNAPMVQINDDYYEDLTPESIKALLTALKESATAAESGKEVKVPAPGPLSGRHSCENSAGLTNLQNPVWDPETMMRKDGALDQQA

SEQ ID NO: 38224 - protein, 115 aa, A.fumigatus
GIANLMRGLVRKEIMLTVCPLSNVRLRCVQSVEQVPIRKFLDAGVKFSINSDDPAYFGGYILDNYCAVQEAFQLSILEWRVIAENSVNESWIDEARKAELLKRIDDHVQKHTVVA

SEQ ID NO: 38225 - protein, 98 aa, A.fumigatus
HRNKPNNNPSIPFKFSEQNMKLVDEILKRYPPQYKKGAVMPLLDLGQRQHGYTNISVMNEVARILEMPPMRVYEIATFYTMYNREPVGKYFVQLCTTV

SEQ ID NO: 38226 - protein, 61 aa, A.fumigatus
GVFSASARLSSDQSPTNPTASHPWPKPLAVPEFGVTALSTSVGDTEVQMNSAKIERSIGFQ

SEQ ID NO: 38227 - protein, 119 aa, A.fumigatus
SIFHRFVQDYRAEKTIMSLHRLSAPVCKVLRDGRVVSVPAESVLLGDVVHLTVGDIVSADLRMIDGTNVSMDEALATGESLPVNKTPDICLSFHNMPHGDGTTMAYSGCSMNQGRATWN

SEQ ID NO: 38228 - protein, 62 aa, A.fumigatus
VNIFGPVRLYHVSLTRLSRNGLSSAEAATRLERDGPNRVQEIEGVSTWKILLRQVSNSLTMV

SEQ ID NO: 38229 - protein, 150 aa, A.fumigatus
AKVGMADFAWTQQYLTLLPALLHASLLALISASVPLSMTFAACILAVTSSGDIIRQPSVSQAAAAKSLHVLAFSSKGHLLLSESQRTFDFATWEKVHQHASAICRGTLASNADDDVSMGEEGGEQGLEKFMRETIEDKVYQDYAWKIDAA

SEQ ID NO: 38230 - protein, 157 aa, A.fumigatus
SQIPPSKAVGPTPPLIHSRALSSLMASSSSSHGPLKPQSDTLPSECSALLSSSSPPLSSATPLSDPTSPDSCPLTSTTVGVSLLRDYASHIDPSQSTNDLHVNQSTSGLSNSRANVPQKLELHQQEAPPVASLPTSPFLSFRTAGPLGSQHRKNASS

SEQ ID NO: 38231 - protein, 77 aa, A.fumigatus
HTLPNIDRPLTHINKKGRPVSQCAHCRGLRKSRTTHTRCECGDKKKNSHKNDLDPNAVDKRDLKREHVGDGTLVQYF

SEQ ID NO: 38232 - protein, 457 aa, A.fumigatus
DFTEDSRPKCGCTHGQRCICALKKEPHLDTVPETGLPPHPPAAPSEQPKKPQLTSAKSESTLTIFRDGHHKPAHKHNDMAHKCGLPYTIPRSHTIHTTSDVPRRSVEFLPLTEPTFLEKAFTSLVQSETQSNGSQQRLVNSEHGSPDHGPAAATEDITTTVPPLDMSSFFAQAQPSMGQSSGGAAESISTPLGQIPLNPLDPVMTSMPPLDVSFPSFPTTTATTSTSPVTSLALQDPYKEPFFASPDSDLPLNSAAFSAPPVDWSNFPLYSSDVPTATSTQAPSYASFDYNSMAPGFTAPSSSGDISEAEDFGPLSGLGNTSGDLHDMHSASDGSDFDHFRISSASSFIGLPQAQLLSSNNLEAIDIDEFLKSANESTAALEHQLQASMGVEPKPVPAQNTFVPLTDADTFKPMPDSTTSLPMTTSPAETMWPTAMFDSSAPSMDDSNGNFYTPPWV

SEQ ID NO: 38233 - protein, 84 aa, A.fumigatus
GAMYLFPSITLPPKAVEAAAAEGRNADEFYCLRLLDATGVCVVPGSGFGQKENTLHFRTTFLAPGTDWVERIVKFHAEFMAKYK

SEQ ID NO: 38234 - protein, 140 aa, A.fumigatus
VHYPMNRICSQCELKLLYIVLTGCSTSYSLQTELMQLMMSPSPGISAFPNADGNLLNWTATISGPNETPYEGLTFKLSFAFPNNYPYSPPTVLFKTPIYHPNVDFSGRICLDILKDKWSAVYNVQSVLLSLQSLLGEPNK

SEQ ID NO: 38235 - protein, 545 aa, A.fumigatus
RSALSDCLENDRSGCLCLVCSDATKFSLLGLSNSTNALPSIKKACPSNTDNPIFAVKFIHKEYAARHGKISPRQLQMEATVHKHIGDHKNIISFFQTGEDNVWRWIAMELAEGGDLFDKIEADEGVGEDIAHVYFSQLISAVGYMHSKGVSHRDIKPENMLLTADGNLKIADFGLATLFEYKGVTKLSTTFCGSPPYIAPEVISCSNRRQVKGAGYRPDLVDIWSCGIVLFVLLAGNTPWDSPTDSSYEFHEYLATNARTSDELWQKLPAATLSLLRGMLNVDPSNRFSLEDVRRHPWFTRQNRYLALDGKLRDPINLATTMFESLHIDFSQDPLSRPHRTSSFDPEQMRFDDGDLNTEPRISSTQPEMPRAEMLVDWDTPHTADVFSSTQPTGRPSSSDDMLLASYLEDEPSMSQFSPHPSVPLSRTQKAQRFRDIVPARPMTRFFSTWELKILVPLVCEALHRLGVPVPSVPAVSPGDTSATIRVVTRDGRMCTLQGKVVLECVSDGLFEIEFMKVKGDPLEWRRFFKKVAVLCKDAVYIPDN

SEQ ID NO: 38236 - protein, 142 aa, A.fumigatus
INVDNRAGVYSSSKAAVMQISETLRLELAPLGVGVVCLMVGTVSTSFHENEPRVVLPAGSRYAAIRDVIAQWATGQSGPKGCSVEEFAESIVDDVLGASGSGSGGLVWKGPNSAAVRILSRWCPVWLLVSHWVTFPRLNVSR

SEQ ID NO: 38237 - protein, 105 aa, A.fumigatus
GNDNRCEYCMYVCMIHSHASGNTFDLFSQLLPRDGQTGPSPARLRLPSCPVQSVNLAPRVVFDFLRYLMMSIRQTGFSIDYSELPTATIKQVEPAPYFSYGESPT

SEQ ID NO: 38238 - protein, 182 aa, A.fumigatus
IVQYTTAMPTTKSILITGCSANSIGAALALSLAKRGHHVFATARSPAKIPSPLTTLSNVTLLQLDVTSPASVAAAVQAVQDHGHGLDVLVNNAGAGYTVPLLDADLEHAKRVYETNVWGVVRMIQGFADLLVARRGRVVNLSSVGAVVNTPWIGICFPLLSIFFFFLLSHLRLTAAFGWIID

SEQ ID NO: 38239 - protein, 192 aa, A.fumigatus
DVPGTRGWFATNGKRYAFLRPEITPRTVTTIGRQLSAVTTHASTVAMLNATYRQWRASLAAIEDVPGIVWSVSLEPLPPAIYARASTTNCLGLSQTSGALVVTLLNATWEDEADDAKVEQAARALVDRIEDDARQLDAYEPYVYLNYAAAWQDPIASYGKASVEKLQRVSQAVDPKGVFKNQMPGGFKLPSQ

SEQ ID NO: 38240 - protein, 68 aa, A.fumigatus
LTNSQTGHQRDKILTAALFGPFQTNPPLPLPLAPNTSSTIDSANSSTEHPFGPDWPVAHCAMTSLMAA

SEQ ID NO: 38241 - protein, 179 aa, A.fumigatus
QEGKADTNPRRIHYSPHTAQINYPPPTGNQQVRESLYHPYHTPYIRLVDSLRVFQVRIQQGDGIPRSRVIDQHVQPVAVILHGLDGGSDRGRRCHVELQEGDIGEGGQWGGDLSGGAGGGEDMVASFGEGEGESCADAVGRAAGYEDGLGCGHCSRILDDLVAMVYLSVCLRLRLRLTM

SEQ ID NO: 38242 - protein, 64 aa, A.fumigatus
  UNSURE (21): Identity of amino acid sequences at the above locations are unknown.
AGLHADEDRTLGICGVRGGEXLNAKNKCDDAGDDSPAPTQCLFAFLVSGGFTYIMAVEKMIKSF

SEQ ID NO: 38243 - protein, 169 aa, A.fumigatus
LRGLLWPWETCLGGRNGQCDRRDAGMAKQTRAIDETDGLIIQQLLLAYVLIYVVAIPLIKLSIILFYRRIFGMNWVMWICVLLTVGYWFSCTVAFLVCCRPLSYYWTQYRDPGGGKYIFNLYPFYIGNAAANVATDGIILMVPIPLVWKLQMRTAQKVLVSSIFLLGGL

SEQ ID NO: 38244 - protein, 71 aa, A.fumigatus
SESSQNHHQDLTVLLTLFEFSIKGQKMFSTNPADVSARLSLEGLRLEPAAKYSLLPYPILQRYLADTSPDP

SEQ ID NO: 38245 - protein, 113 aa, A.fumigatus
YHLDSYVFPFEPNPNWSKFYVSGPEIQDYIVKTTDKYGLRDKITFNTKLLQAAWDEGDGKWKLTLEQGGSLIEDVADIVVDGSGILKYATITSGRHVRDLLGTVNGNGPMSRD

SEQ ID NO: 38246 - protein, 91 aa, A.fumigatus
RHRDPDYDWTGKGIAVIGNGSSALQIVPELQPKAARIVNYIRRATWVSTNLCGNLTKDGMGTNFEFTKEDKQRFRDDPEEFLKYRKVVEAS

SEQ ID NO: 38247 - protein, 157 aa, A.fumigatus
YPPRVNSVFRLMLSGSEENRFLFKLVDSVMRARLSKDPELADKLIPKYEIGCRRLSPGDGYLEALQADNAEIRFDSIQRITETGIQTDKGIEEFDLIVCATGFNASFIPAWDLVGRDGRRLDEEWKEKPEAYFSVCAAGIPNYFMFAGPNCPDYGIY

SEQ ID NO: 38248 - protein, 103 aa, A.fumigatus
KVTTTSKMPSKESFSASNGHLQDGWSVDPSQFAFTPRKLRVVCIGAGFSGLVLAYKLKHERPIDFVDYTIYEKNPEVGGTWYENVYPGVGWFVLSFLYVGSIR

SEQ ID NO: 38249 - protein, 67 aa, A.fumigatus
LRHLLTYSRSVVVKDSVVSDYNIYAQENLKRAVWSKGCHAWYSKKTTGEGVTVTAMYPGSVLHYKGE

SEQ ID NO: 38250 - protein, 98 aa, A.fumigatus
SQKYSASHYQHEQHEQHEQQVLNNLRRPRDTPLKPPPSTPTTSPPKHHRLPPYAASPEPPPAHKTPRSPTPLSAPSPPKAGYTHPPPASSTDQYSSHR

SEQ ID NO: 38251 - protein, 68 aa, A.fumigatus
LKMANIRNIRHPMFSIACGVTCDIIKLNSHCDAAPTVTPTSRVRLEKISPTYSHGSGPQDMLKLNASA

SEQ ID NO: 38252 - protein, 304 aa, A.fumigatus
DLHGLPQLAKHPNNVPGTAGLGAATVLHLAKHTHPPAHIYISGRNAQRADDLIKQVSASNSATRLSFVPCDLASLASVNEAAEAVLRRSSRLDILMCNAGIMAQPPSLTKDGYEVQFGTNHLGHALLIRRCLPLLQRTAEESSDARIVILSSLAFRGHPYGGIVFSDLKTVQHFTACALGPWIRYGQSKLANLLYARELARRYPAITCVSIHPGVVSTGLVENQTRGNRAFIYVTNIGQLMKPEEGAYNQLWAATARKEELVNGGFYEPVGVLGKLHRAAGDDALAEKLWEWTEGALGEYLEVV

SEQ ID NO: 38253 - protein, 89 aa, A.fumigatus
VDIAAFMQLVSQTTRKATGYETLRKMGKRLGLLRAIYLVSASCMGSFAFAFDTGVISALQSLVPIREEKKEKKKEKRKKKKEKKRKSAS

SEQ ID NO: 38254 - protein, 446 aa, A.fumigatus
PTGGVLTLESFQRDFRYTQAQKTTVNSNAVSILQAGAFFGCFFTTPVASRLGRRTGLIISSLVFTLGTILQVINTHTLGTFYAGRVIAGVGIGAATVLIPMYAAEMSPKEVRGRLGACFQWFFACGVMVAYWVTYAVSKDQPSATKQWQIALGLQLLPSTLLLAGMCTVKESARWLAAQGRTDAAWDSLRWVRGGEETADLRQEFDEILTGLQEEARVRENWTWRELLLPANRYRIFIAVTIQLCAQLTGNTSLAYYATQIFAAVGAGTSAKLVTGFFGVVKVVGVSVFQLLVMDRIGRRVPFMVGAGAMGSFMLIIACVLATHPTKASPGGAETGATTHAGIAMIIMTYAEAFSFNMSWGPLPWLYVGEIFSSRTREVGVTVGAASQWLFNFMMSQVTPHAIENIGWRMFLMFAIFNYSIIGYSWFFLREVSFPSVLVLVGHYDS

SEQ ID NO: 38255 - protein, 136 aa, A.fumigatus
LGPSFHYQADKISLYCSAITQLIQQALLSSRVWEHGCKMVVSHKTEKSGPANVLAADDAVPQARGQQRELPQQFSASSALSFAYVITNSWVGYSGTFPTALMAGGGPAVFYGVIVAGIVCFIISTTCVPGLSVVIR

SEQ ID NO: 38256 - protein, 65 aa, A.fumigatus
FDNAVSALGLAELASAFPSSGGQYHFTYMVSSPKTRTPCAFVCGWLSSLAWCLATVSGTIFIGMS

SEQ ID NO: 38257 - protein, 302 aa, A.fumigatus
EFSEQARLTMRSSSDSCARVVPKRGLLSQAVADIPRLSRSHNPGNGNGLSSRSLVAAIAGGHVLEQHICLCGVSCRGSRDEQKQAVCARCFHPVPERDGMARRLVVPHRTRDLYVHVLCYRRSDPYRRGMSHDFPMAAPRKKTDSSQEVPEPGRNIPKVMCLTPVIGIATTLPFVVATLFATVDLGEVVRSELPILTLYHQATGSKDVTAIFTIWLIFNYFGGTVTGLAASGRMAWAFARDNGLPFSGTLATVHPRFQTPVASTVACAVLMALYGLIYIASSTAYSSIVSMVFTTGVEGSEL

SEQ ID NO: 38258 - protein, 165 aa, A.fumigatus
VRSRAFYILPSSPSCAEDLSAGRSRAFFFVLSSWERLSGTWNRLRTVASTHGISYYEDSPNEYTFDSANTYLTGLGLGLLASTAVSLSPTLADLPLAGAEVVRVAFRLGVLVADVSQNLQPADATGERDSWAYVIPNVAPKEAEEELAVIHTRKVSSTGVLPYTS

SEQ ID NO: 38259 - protein, 233 aa, A.fumigatus
SRLPWQAPRSSCLMFCSLTGMVIILGAFRTFSGCIPTCPIRSTSIPLARAQKPISDGQTFRVEGATVRAVHTPGHSHDHMCFILEEENAMFTGDNVLGHGSSAVEVLSTWMSSLRMMQSLRCAVGYPAHGAVIRDLPSKLDLELTQKARREDRVVETLKQMKTEDQRNGARGKGSVTVQQLVTAMHGHDLDEQVRTMALEPFVDEVLRKLAQDDRVAFEVRGGQKKWFAIEYT

SEQ ID NO: 38260 - protein, 68 aa, A.fumigatus
SAARILRYLCSIGIFKQTGPDTFANNRISAALVSNEPLRAYVQLVNSEGFTASVFTDRGWKDTRSRAE

SEQ ID NO: 38261 - protein, 155 aa, A.fumigatus
RTRIKHHKMERQPKSLCDATQLLETANIISDTVQTIIAEWSAEAKAPQGSGKQNAPMLPSRELFDAQRTILAAAGKLTELVSDPSARILEVATQFQESRSLYIAAERRIPDLLAAGDEGGVHIDQISQKAKIEPRKLGESAPEMRVTSKVSLSWR

SEQ ID NO: 38262 - protein, 273 aa, A.fumigatus
VFAYGHVYMLALHQTQRGVPCSEVHDALGLQGARSIYFGRPTGRSILSDPIRPRPMPTVTVIIYSDIRFLLEFPSVFLCAYVPPVQRTVIMANEKRGGYRQINQALNICAWEGYLNEQHARLPTLEDVEQISPRVLRVLGQNEGEVRIADGYYTCSSRLIEGPQFTLQGTNTYIVGTGRHRLLIDTGQGIPEWASLISSTLAGSSIELSHVLLTHWHGDHTGGVPDLLRMYPDLSDSIYKHTPGKGPEAYLRRTDLPCGRRYCPCRTHPRPLA

SEQ ID NO: 38263 - protein, 283 aa, A.fumigatus
  UNSURE (17): Identity of amino acid sequences at the above locations are unknown.
FRNSVEPSKGEAIRSSXTINGKAASLAQFKNSLSSFAIQIDNLCQFLPQDRVSEFAALTPVELLHSTQRAAAGPEMIEWHESLKKLRAEQKKLQLDNQSDKDLLANLENRQEMQRVDVERMRQRAQIKRKIEMLEHLRPVIQYREARNELNQKKTEQRRLRKELEDLEAELAPALRAVNVKQDYCSKLDEVVKYKKRCFEQADRDAMEIVKKIEQFDDALKDLNNQIEAEKKTGQSYRQQATKIQQTINRLNRELNEQPAEFDIGWYNERIVGARFECDQNVC

SEQ ID NO: 38264 - protein, 307 aa, A.fumigatus
LSSQKEKRLATRELEAKATEIQQARLPLVEELKSKNDQIRRAEQQLQSLASQSGQQEAKLRKASRDSYQAYKWLQDNQDKFEKEVFGPPIVTCSVKDPKYADAVESLLQRTDFTAFTTQTRNDFRTLQRALIIDLRLHDISIRTSTTPLESFRPPVSDEELRTLDFDGWAKDFLSGPEPVLAVLCSENRLHQTPINLQGISDETFATLENGSISSWVAGKQNYQIVRRREYGPGAVSTRVRQVRPAQIWTSQAVDVLGKQEIEREILALKDELSRVKEKMESERSRLHRMGEEKKELDRERVSQRQS

SEQ ID NO: 38265 - protein, 64 aa, A.fumigatus
EGKSTAILELFTLAHSFHQATLEKEKAEKQTALINYRAIPEKIRKSSNLPILSSVDRPRLTSRK

SEQ ID NO: 38266 - protein, 369 aa, A.fumigatus
QDTQDAVENLRRLQEEATQLSIRLIEGLSDCTTLRERSQHHKMRLDQKSSEVKAAHEDVKTRSEAVRKMVDQANRAIRLVNEQEDLREFMPTLVEYTLEQLEADIDSERAHLELVQGGNANVIKEFEEREKQIDKLRDKVSEFQNQLAEYDHAINEIRGKWEPKLEELVKSISDAFSDSFARIGCAGQVTLDKAEDEEGPNGEPGGSNFDQWSIQIQVKFRENENLSILDSHRQSGGERAVSTIFYLMALQSLSASPFRVVDEINQGMDPRNERMVHGRLVDIACAPARNGGGGQYFLITPKLLSGLVYKPGMRVLCIYSGEHMPEDYYLLNFGGAIKRMRALNAEKKGEARAIEGDAHRNNGDVDVYG

SEQ ID NO: 38267 - protein, 157 aa, A.fumigatus
  UNSURE (121): Identity of amino acid sequences at the above locations are unknown.
IRSREVATGAYRYKDCPDASLRKGSEGRSRQDLYGDTNQELAAGDRGTETRKVRSREEDRHTRQETPSNGKSAQRVRNPPPGPSPRERKDRERSSSSTETARKRRKREHTIERRPRAPQGXASLAAQMTTPSTKLERRRKDRARERPIPRTSERTRS

SEQ ID NO: 38268 - protein, 112 aa, A.fumigatus
ILELHLSIGNTYIFMVWGYEGSVRRMYEWRLSTRRRSVSGCGPCTSGGSGKVVRSVHKHLDKIPSKSSPTTRHCEYLERSHKMADEEERIKAEKLAAAKKRVSLENRHADDP

SEQ ID NO: 38269 - protein, 258 aa, A.fumigatus
YTFEQVAQLQKQKKKASKKAASTEAPKEADTPKETAAPTEGAPAEVPAEVKPDETESIEKEAQKEEEQQAELETESKPELGVETAAEPEKRPESPVEPMPEAPTSPSPAPDAEPQTLDVKLDTPRAGHTRQPSLSIQSKMRSSSFRKGSVSQGSASTSPSNALKSPSLPPLTGNGDSVHEVYRKQSMRIEELEKENKRLEKQLEESTSRWRKTEEQLEDLREASVDAAELRDKLEKSEQKAAEIDELVWFCLYPSKHC

SEQ ID NO: 38270 - protein, 219 aa, A.fumigatus
  UNSURE (213): Identity of amino acid sequences at the above locations are unknown.
PSQQKAEIAALQRQNSHLQNRSHRNNASISVPVPSESPPADLVQQLESKSATIEAMELEISNLRAQLSEQSSSSSAHEAQIAALEERLSHSESALEKSQRELTDTKIALTRASEKAVKEGVDKTSTETLIKNLRREIEELKQEKSEAEKKIDTLDKKLQAMGNLHKESETRHQARLRESEKTEREAAVLRKRLASVENENIRLKEDLERLKEXRVWRHR

SEQ ID NO: 38271 - protein, 198 aa, A.fumigatus
ETEPFRNDDERILDWIERDGCRVWPARGVSSLTSSVWGSASGAGEGEVGASGMGSTGDSGRFSGSAAVSTPSSGFDSVSSSACCSSSFCASFSIDSVSSGFTSAGTSAGAPSVGAAVSFGVSASFGASVLAAFLLAFFFCFWSCATCSKVYQPSASFSQGSSACRFSRLTLFFAAASFSAFMRSSSSAILCDRSRYSQ

SEQ ID NO: 38272 - protein, 77 aa, A.fumigatus
TFCFMYIHYHYYFITSASYNVKDHKSTEGDLEVTCYNDKLSTKEVDGVRDSVLRSTEGILRFSKRLFSMAVTVEAAL

SEQ ID NO: 38273 - protein, 129 aa, A.fumigatus
SGKYLSHRKCFPRECINQIQYTFGCPQLGNHDFAEFVTAVTAGSGYRVTHSDDPVPRVFSTQPWINKTWQYSTTSPEFWITTGNGVPVTASDIQVIEGIDNKSGNLGTTGSDTSAHIWYIGNMSGCSTN

SEQ ID NO: 38274 - protein, 169 aa, A.fumigatus
APLPPSSSSSSSSALLHSCPLSAIPTLQQSKQPNLYALVHFYIASRRSLSLTMPKQRKFQIHEASSYRSFLLIRPDDPDLPALTMLREVLKVLQAGHGNFSPRRESFPDTQVGDLIFEIISEDNSFKGLTDAAVQCISQQIENWDYDQDMIRWEQFVEGMVLIDYRYLH

SEQ ID NO: 38275 - protein, 156 aa, A.fumigatus
TEKLTPSIHHPGNVTGFVAIDNTNQLIVLSFRGSRTLGNYITDSKYQQVPAICPGCQVHKGYYWAWGNFSAFIMQPINQLAAIYPSYQIVFTGHSFGGALATLGAALEGGNPSRPIDLVSTSVTANVSLENALIRYSTLLDVPNWAIMILLSLSLL

SEQ ID NO: 38276 - protein, 73 aa, A.fumigatus
AGAQLTELFSSRQEKKMMFLFPRVSILSAFELNYKNDTLCWTVSSLKTFRVQISKPNKINDKLCNIAQPTAYD

SEQ ID NO: 38277 - protein, 118 aa, A.fumigatus
YCRTGSDRTRTHQKQEGDEKVEEELLDRIKTLNSELDKMAPNTRAMERLESVENKLRSTEKDFDEARKRARKAKEDFEEVMRKRSDLFNKAFSHISEQIGPIYRELTRSANYPLGGQA

SEQ ID NO: 38278 - protein, 956 aa, A.fumigatus
GSPLRLSFDPGGDALSESLEYGADYERLKAEAEEAAEQQTIQLNRRRGINSEIKQYQEQKREAENYARKAEERDQAEITHILWKLFHFQRLIDASSADIQKYQEELKEYRRGVEKYEKNVESAKVDHAKVGRDVAKAERNIIKKEKDIEEATNALVPVDEKVDITRKKVERFASRIAEIGKERDSQAANVKQLEKDLKVVEKAQAQWEAEWHKTMSNKGGQLSESDQQEYKMLKEEVSKRSSAEQINLDNLKRQRKTEAEAYNSLKSKFDSTEWQLKSVENDTQTLTERKSALNDTVKTTSKEIDRKKKELNALTSERLRISQMRTELEEKVQVVLKKLLEADDGKKQTERELRAKELISTLKRIFPGVKGRVSDLCRPKQKKYAEAVSTVLGRHFDAIVVDNEKTAKECIQHLRYQRAGQATFIPLETIQVKAFNSNLKGIHRGMRPAIETVDYDDSVARAISYACGNAIVCDDLATAKYLCYERNVDAKAVTLDGTVIHKGGLMTGGRGPQQNSKRWEDSEVENLHKLKDKLMADLANLPKGHRRGTEEETLQGELVGLEQRLAYAQEELKALERNLKSKRTELDFVKRQLEDLRPKYMERQEALEELDQTIAQSQESVSRIEDEIYRKFCKRLGYANIREYEVQQGSLQEEAAQKKLEFTTQKSRIENQLSFERQRLQATNDRIASLQAQHGRDQSLIKELKAEQEQIRNQLDEYNAELDVLRERLQEQKEAYAQSAENLARQRRELQRRSKDVEGVLKNISALEAEIQRNSSSRYAVLRRCKLEDINIPLTENSKSLDQLPIDDIVQTADPDAMDVDEEANDGSGIVQDYGIEVDFDSLGESLKEVSTVAPGQIEQELIRNRRATKRSKRNCSTELKLSTASWTRWRRIHVRWSVSKALKTNCEALRRTSMKHANGLARPKKTSRRLCENDRISSTKRSLTSRSKLDPSTVS

SEQ ID NO: 38279 - protein, 149 aa, A.fumigatus
IMNHRYLDIEDSDEPYLDGIKYHAMPPLKRFRDMEHLSGGEKTMAALALLFAIHSYQPSPFFVLDEVDAALDNTNVARIANYIHDHAAPGMQFIVISLKTGLFQNSEALVGIYRDQVENTSKSLTLDVSLPSFFQPPFQVLTSPAAPEI

SEQ ID NO: 38280 - protein, 64 aa, A.fumigatus
LSPSTHTAALLHCCTATTKHQKLPPSPNKQLQRHWEALTSRFSTVSRHNYIVGSCRGYGPPKLR

SEQ ID NO: 38281 - protein, 164 aa, A.fumigatus
PRFFRKALCGADPRISVRNTTARPSSHAQKTRYIGCSDSRVPANEIMGLEAGEVFVHRNIANLVPNTDLNVMSVINYAVRHLQVKHIVVCGHYHCGGVKAALTPSDLGLLNPWLRNVRDVYRLHEQELDGIQDATARYRRLVELNVIESCRNVIKTAAVQQKLS

SEQ ID NO: 38282 - protein, 64 aa, A.fumigatus
GLAQNWCTMVGSDGHLSYGSTLLTHRSCTDHNVAGFHYDMYERNEVQNCSALATQADRLTGQPA

SEQ ID NO: 38283 - protein, 124 aa, A.fumigatus
VLKRELGCRRPRVMPLAASFSARKSSCMPQADISGPTKECHTAHFSPDPKILVAGFLQDHPENHFISSPSIMEPSDQKVDTVPQYLKQSHERIFENNRAWVATKMKDDPAFFEKLSAGQTPEYL

SEQ ID NO: 38284 - protein, 111 aa, A.fumigatus
ERWPSLPTMVHQFCARPHSGGMDSTERLIDLAIQTRLFSLSNCDGWAIADEPFFVADLGQVIRQHRRWRVNLPDVLPFYGSAPIPLPSQVLASLVLTLIVGGCSGEMQPRS

SEQ ID NO: 38285 - protein, 251 aa, A.fumigatus
ARVRCVWGEFPCWYVASSAIVSQRIHELLSGTGASNASAYVTAIRDAKIVFGYGKSLGFDMNLLDIGGGFQDSNLEDIACVLRPILKEEFPGVRLLAEPGRYYVRSAYTLACKVLSRRRHSGTDHHDRPDMLYQNDGVYGNFMNVLIEKETVRPSLVAYTWPFHSRGNDTRRKLEEHRYTTWGPTCDSMDCVAKDVPMTSEIRIGDWLKYKNMGGESFHARLSGIELKTLTILRSLHYSNGDSVQWVFKPV

SEQ ID NO: 38286 - protein, 165 aa, A.fumigatus
LSAAAAVKCNPDPNLLRLLANLGTGFDCASIEELRTVLSLGVDPCRIIFANPCKSVSSLVFAARTGVTRTTFDNLDELDNIRTFLPNAELVLRLYASDSDALINLGEKFGATVEASLPLLQRARELGLDVCGVSFHVGTLLPAPLFPNVFTSSYQGRGPPMHLPM

SEQ ID NO: 38287 - protein, 137 aa, A.fumigatus
KFLLHRRRLDYISARLDNIQLHEASISRSCILNPIQLLLMQTVHIAHIPEPGIEEPQVRRGQRRFDTAAVVVAADDNVLDLQVADCVINDRHHVEVCVGDQVRNVPVDEDLPGFETHDLVGGDATVAAADVPGLLSM

SEQ ID NO: 38288 - protein, 141 aa, A.fumigatus
DTTFHANQTMFRKWITNGMFADYFVTGCRTEKGFSVLLIPRGEGVETKQIKTSYSTAAATAFVQFENVKVPVENLLGEEHKGFIVIMSNFNHERFTMVCAVIRMCMTVTEECMKWCNQRIVFGKKLIEQPVMRQKYVSLHR

SEQ ID NO: 38289 - protein, 949 aa, A.fumigatus
ISSLSTLAPKIYPRSRWLAPPPTSQLRRQPLFRFLPSILRPSNRDRQTRPGRLLRFFRLLIGPHATRRAQLRLWGLRHETIPAFRHRAQARVYRAIVQQQARRARRRISGKKGILELLLLGRRGLPRRLGAGSVGGSQLVPRLKGLRVAGQAPDAAARSSMSQYESSASTSWGAGGGGRRKKVYEYLKAANELRQTYTAQWAAQRNNQRDYNEDYYNIPCAFSDVEITRSGNEEMVLFPSYARRLVKGKRPEVQARQRRDSTSTIDEYRGVSDDPGPASEWPRYEDEHAVVAVDVRGWVYVPHRGPMTRKHRLLIALARKLSGIPAPNTTSADDGNATVAVGTPTKTSGASEEEMVDQEMQSIINNAEKSADPVWKGSASADRSSSAAFEKATQISQLSKDELTVANAHLMERLRPFLTNPRAAMPVTVFFYNDEQSQSRNIMTDESGHFNLRAALSFVPTHIRVLASEELSATKEIQIIEPTGVSLISDIDDTVKHSAITNGAKEIFRNTFVRELADLTVDGVTDWYNELAKMGVEIHYVSNAPWQLYPLLERYFKLVGLPPGSFHLKQYSGMLQGIFEPTAERKRGSLEQILRDFPERKFILVGDSGEADLEVYTDIVLANPGRILGIFIRDVTTSDHKDFFDKSVDHLEGVPARSHSTSVLVDDSDSTAKRPPLPPRPPRESPGPSTDAASIDNGDLIDLRDEEGEKNVSVTTPKPANLRMPPMKPSKPSSLRAVTTNSESTENGASSQTQDVIRRKPAPPVPPRRQIATGQEESSSSPRAPAQSTSYAGGVPNAAQSVTNSLPAGTKQLPIRPKISDGNGTVDQPSDATRSARPKQAPPPPPPRRTITGISTATSDSPVDRPASQKIVSYPASAAAAAYQFASERLNMSASPATSLRSRASTPSLSRSSTNSVNNQPDSSSVPPPPLPNKREDCGDGVGNGLTSS

SEQ ID NO: 38290 - protein, 224 aa, A.fumigatus
  UNSURE (13): Identity of amino acid sequences at the above locations are unknown.
SLFLHLTPTISIXHNPSSLTMSKTFTRAEVAKHNTEDSFWCIIDHRVYDLTDFLDAHPGGSVVFAQVAGQDATTDFYNLHRQEVIDKYRDQLCIGTIEGETPEIVSPEPGSLSTVPYAEPLWLRPEFKSPYYKESHRRLQRAMREFTDRYVTPEAQEKERDGTYISQKLIDKMAEENVLAMRLGPGKHLHGRKLLGGVVDGKEFDYLHDMIVAQEMVRSNARGE

SEQ ID NO: 38291 - protein, 79 aa, A.fumigatus
HFAGFQDGNMAGMVISLTAVQQWLRNAPLREKVTEEVLSGRKKMCLAITEAFAGSDVAGLKTTAKKTPDGKHYIVNGTK

SEQ ID NO: 38292 - protein, 153 aa, A.fumigatus
SGAISALSSERSSSSSLSCVKSTFPSTVDSLPKCMLLTVDARLARMISLCESNQAWLESIAYQMCNMTYAQQAAHLGGPIGLLKSHATRCAQEIADHATNIFGGRGITQSGMGKVIEMFHRTYKFDAILGGTEEILADLGVRQAMKKFPKAVL

SEQ ID NO: 38293 - protein, 161 aa, A.fumigatus
GVSLPLSEPERAGWIDVVRVTNYPNLNFTIIINPSSGPGNGSQPSPQYAHQIQRLNAYPNVRTVGYVRTGYASRNLTTVLQEVGIYSGWAAVSPSLAMHGIFFDEVPSEYTTSAAEYLATINAAAKNASGLRTDRTVSNLSLFFRTCVSVRCPKPRKCSGV

SEQ ID NO: 38294 - protein, 402 aa, A.fumigatus
QIRRLTDVQVTAVSAEHAARFEGLRTFVPDILEKMAVVPPAHRSLVDTRAIHIYAVDWPSKMDYAHMNPFSVSPDGVDYTGLGCFQMGHDCSEKDISDLLEAQRSIRDLDLLDRIQVEELRRMAADLRALLRSQKASIRAGAMSATIQELIDLLSSGNGAENDRLRIWVGLHSGFRTRSETQVWGMYEADALTGSLDIFISGKTVDRTGTILHTFLSRRNFSRYECFKAEIALADARNTLSPKWDLPPRLVNDIEDLSPAEALLWMQRLTLSTCKESSALVAKVRTCCEYQLLEVPTLSQLRSMASTGYLSGEVSAKQLVEGRLAWYQSQGCASLEPRSALALFQEIDARLPGVLIKADSTSLAKITEVMEAILRPGQIDIRADFLALSVLSHRGLKSVLRK

SEQ ID NO: 38295 - protein, 329 aa, A.fumigatus
GRRQLSTAPAAVTRYLDRLKRETKPLRSRSSAKLELKTFGVYLGSIPSPPSSEQLSILSQWDVVVVDPLQHGVLSGIYNYCSAAHVLGRLHVPSLVNIETSITIDEVIQGLCVVAQTVISNFTHPQARESPFHGVLLADWRKHFQPVVLNQLVQYLNGIGLDVWLEMSPPDYLSERECRDIDGSRILGIVYRNGTIFPNGNQRDYFQMEKMRTVMRVVAAQKTMGGCTHAMWETVEDDVDVSHHVLGRTFKWCAYNSAMTWIGPWSALTDANVAARRTVKNEPLGALMWLKEDVVLKTHDNWRFNDRVSIHSTVADTKTDRRAGYRSLS

SEQ ID NO: 38296 - protein, 66 aa, A.fumigatus
FESCDGSQSPENVSFKIVQRTILCALTDYLVFLFDMLDLRQITYSAEIRSNSADGKEERHALLVSF

SEQ ID NO: 38297 - protein, 638 aa, A.fumigatus
QRRQTLLREMERKNKIGGIVDRRFGEDDPTMTPEERAAARFARESQKKLRKESMFNLEDDDEDDFQLTHKGQTLTLGDDVPQDDFEEDLRGLEEDQSDSEVPRKRKRILDNDELEDFVFDDEDGEDQPERKKSKHEVMKEVIAKSKFYKLERQKAKEEDDELREELDKGLPDLFDMLRGVKPPPKPEPAKDDLESMNPDRAALLKGTADNDPNKEYDQRLKKLTFDKRSQPTDRTKTAEEKAEEEAQRLKTLEEERLRRMRGEQESDEEEDDEEGESETGGEDSNDESIPDDAEAFGLKQPSPQTNKGPEMGVEDEDDFIIDDDLVETRSNVSLSFDESDGEEGSSEEKSEEEDEEEDELINGLTLPTSKSGESTVAADGAGKRSEGLAYTYPCPEDHESFLEVIKDVPMNDLPTVIQRIRALHHPRLHADNKTKLGRFAAVLVRHVAYMAEQPEHPPFNVLEAILRHIHSLAKSHPESVCMAYRNYLREIATDHPLSLRAGDLVILTGIATTFPTSDHFHAIATPAYLCLARYLGQGAINSLGDYATGAYAASLCLQYQTISKRYMPEFINYVLNALCNLCPTEPTSSLGFFPARGSQESLRLIPSKQLNPRKLRFWDIATAQSDRRGLHKPNRDTR

SEQ ID NO: 38298 - protein, 153 aa, A.fumigatus
FGHLKSGAAEFPPGESGEPTFLRTIIEKCIVLKISVEHWTTLLQHQHITMPPSQLKQLKASLRESGVLAPQQSKKQKRQNAKAGVSAQNRAQRNAALQAIRDRFNPFEIKVTSRNKFDVTTRDGGSKPAAGLSKAGVTKSLGEEKVGWMSFKR

SEQ ID NO: 38299 - protein, 117 aa, A.fumigatus
VSATHQVSTLTSSPNKCHPTDGATDSKQKRQPSEPNNHDHETGNKATQKKTMVCAKCQKKLKSTELVTPGVKRKSEMYYGSPATTLGGGGGAGPGPATKSKPTLGNTGIGKVCSISF

SEQ ID NO: 38300 - protein, 418 aa, A.fumigatus
SLYQTREEYLNIPPPTRLGVSQSSKSLPSALNRFQKRLVHQLIEVEYPSLVAISRPDFIQIIDYNEERERSVREQRVKKIQERTWKQTGFRWVAEALAGGDLTNLHSGYFIGIMASSAAVEPKYPLNEFSDKLKQRLKEHRPVLVGHNIFSDLIYFCRCFFGPLPSKVEEFQSMAHELFPVLMDTKYMATHNCGSINPRSSLSELNENLAKKAIPKISAHDFLDRQFELMAKKTTGIHPQHSKYTTQKIDHEAGYDSLLTAQVFIRLSAQLREGGVEPLQQKSTKDAQDTSYLQQTYREVAPDAYAEGRLQPTSGSAQKAFEQKPRPISTESPKPPMSRVLETRFDLLEIEEAIDEVDSNIPINDRRLSLGPTDSVEVMQKAVNGELIPRLGAEFWKVYGNKLRVFGTLERVCVMGAP

SEQ ID NO: 38301 - protein, 104 aa, A.fumigatus
SPAQAAERTLEQSAGVNMNTWMVGYHPVGHHVYNFRHPKTDPATGQQWLGEKTFFIKGRIMAGQADLSANVQGLQDFKWLAKEEIAKFVLPQYYSNIKNMLAER

SEQ ID NO: 38302 - protein, 242 aa, A.fumigatus
LFRTLIRSFSDFYSGPSIVDSRVCRSCQETLVRRNYASTAAPSSASETVSTPASTFPVVKPTHIIKAGVALSRPPQITRDLTPFEKAYFFYQKRLNERLALPFTKYFYFKRGTPADEDWKRKIRERQTPARDIGKYNAYSKEAWNDELLVGAVESEPEHQIEMLVRDAESTANATSQDTSKKEEIPRPFPRVTEADQKNDQRSLNRALQRTLYLLVQTKEGYWKLPSSPVETGESLRVVSSD

SEQ ID NO: 38303 - protein, 427 aa, A.fumigatus
LWRKCKLPAPHTNFLAAKADSVGEEQHYLPGRVDETQRLTRSLDGPFVSQCFSSLSPCVPITSLHPRNNLTKGGNRYLIGCYCFHLASSTPQWHHYLLSRRRRLWTISRRQTAACLPRKSKRCRRGHCELTRICRLLLADRLYMWPKTCTTRTRGSSSSSFRTRKIIGYGHAVSQAEEPFLDLTLHEDHLTVDSNEDGFTENDVRAICSIHQSSKKQTGGYIGHKGIGFKSVFKVAYKVSIQSGPFSFYFEHHQGDSGLGMITPFNEEPQELPPSVNTRITLFFISISDFEARASELREIPDTMLLFLRKLQRLTVNIPSLQSQISFTRFEDKSKHLITLTKETNGEQVTKFYHLEKTTLSNLPQHLSRPGQPEVDLILAFPVQEDYSPLIQAQYVYSFLPMRDEGFNVSNFLLLRTLIEYTPLISV

SEQ ID NO: 38304 - protein, 141 aa, A.fumigatus
FLIQSDFITQASRQGVHRCDRNYAIREGISHLFLQAVAYFCKHTSLRYEWLQYLPGTHIRDPFWADLREMIFDCLKGSKILYSRRGILKSPTQLEHLSSQHCDRHGHPLMDDIEPEVYLAQSYDWNRHAENLMELGVKNLS

SEQ ID NO: 38305 - protein, 104 aa, A.fumigatus
SYKRGQSVLDRLLLFSSCILDSPMAPLSLEQAQAIVDDIQETNGGLPPEEKQALSQRSLRAYKNLQTIAGRSIVHVAEDLYDTDTRFLFELIQNAEDNWLWPCC

SEQ ID NO: 38306 - protein, 61 aa, A.fumigatus
WMTISFSGLGTSSKSAKEMKQFFLAHDRILSVKLDSSSLIDWSSFGMYPLFATIDVFTGEC

SEQ ID NO: 38307 - protein, 367 aa, A.fumigatus
NTRNRFAVMADEQKVTPAATNANAEAEKDVQNVLAELKGEAGEAPKPSEQPTEDKKGEAPTEDAEEARIVAAAAKLGEQSAKAEEQKEGKAEERDTRGRGNRRNNVKFDPSTLEVTDNHDEIRKQVEFYFSDSNLPMDKFLLSKVGGSSNRPVPLELLHSFKRMRRFQPFSAIVEALKSSKTLELTDNDTCVRRKVPLPESVTEKPDPSVTKVFEDQAMSRSIYAKGFGEETPTTQIDIEAFFAPYGPVNAIRLRRTHDRIFKGSVFVEFATEEKQKEFLALDPKPQWKGQDLLIKSKKDYCEEKVRDIEAGRIKPSRGRGGFRGRGRGGPRGGDKRDWRERRAEDQKNGFGKPQGEQRREVQKDAR

SEQ ID NO: 38308 - protein, 96 aa, A.fumigatus
PVAVLFRLKPGVTQDQLTNWVTVAESMVGKIPGLVSLKAGQPLPISVPRAKGFDMGIVAVMESPDAVASYATHPVHLEFVSAYPVTGAFEVADEGL

SEQ ID NO: 38309 - protein, 384 aa, A.fumigatus
ILRGYHDCPLHVTEVGSNIPILLYETMHANLAHRGIFLPVMIVTLPLPVHLRRRFPAQMVLMLQWFAFGMFSVLLIIPWLLCVYRLVTHSPGRTKRIKQVLDDRTAPKTVVVMPVYKEAPETLIRAIDSVVDCDYPANCIHVFLSYDGCLIDESYLRLIEHLGIPITLESYPQSIDVTYKDARITVSRFKHGGKRHCQKQTFRLIDMVYADYLERHDNLFVLFIDSDCILDRVCLQNFMYDMELKPGSKHDMLAMTGVITSTTDRGSLLTLLQDMEYVHGQLFERSVESSCGAVTCLPGALTMLRFSAFRKMAKYYFADKAEQCEDFFDYGKCHLGEDRWFTHLFMGRRSGNVIQSRCCAGAFWQDLRLWQTFPAVLLKPRPVL

SEQ ID NO: 38310 - protein, 72 aa, A.fumigatus
FGTQGNFLACHDRDPPAPGSLETAIPGSDGTYASMVRVRDVFRAAYNPLAFVRLQTGDTFTGQNQAYQASFG

SEQ ID NO: 38311 - protein, 491 aa, A.fumigatus
LSALSSHALPRPRKYQGALYKEKPTKNQRRNQNQNQNQNQNQNQNQNQNQNQKNNTNGKHRAPYVEDGPDSDTSKGSAPPPAPSPPPTSTEKPSATTTEESKSVNVLDYLVTADTPNASKVSLGEPKEQRKMVDHAPSVFEPSKASVQVETDNDDEKKDYDVAYEENGFSYGAGPIQPSVYPGKAPNVSMEFMTPAPKKKKDRTRGENDKASATTSDKKRKRRTDDHNMDIDSPMAEAPSSVVNNPGTPMLKHSGLTGGLNRMMRSPSTEDGNESKEDSRRRYQDPSSPIKRTRRDHKDGDNDSGLGISIKQKAGRLVSSMFGGSAVSGSSNNSQEPEARRSKQSHRVASPSQDQMPSDSRKTKRKVSAQAGGDRPSQRLKQIEYNGSQHGDDGREVVVYRQENIPNDLQRQMAAHFLSLVTKGPESSRGFSVNKVLKRFHREFTDEFDDDRGRGQGRSRADRERRIEDEKDLWRTLRLKRNERGEVVLFF

SEQ ID NO: 38312 - protein, 825 aa, A.fumigatus
GPSTTIRVPPWRPLNNNTPRRKNARRRGRGGRGGRGSVRFTPTVPNTQSEAQETSQLPESEVSSLNVQPNESSRAARGSRGGKRGGRGGGASLDKGRRRGRGRGEDSKAVSGVLGGRTFEGRLSKPERASDEDQPDIAGDLSLRADAPEFVPAAPADGVIPNGITSSAASSTIGKGKSKHIQARPPKVTTKSTAPDIATRIHEDIAHNLYECPICTSELGRRSRVWSCGLCWTVFHLSCVKKWSKNEGSAAQDAARRQAEGEPSAPRAWRCPGCNLPHEIFPSTYSCWCEKEVDPRPLPGLPPHSCGQTCSRPRKGCPHPCDATCHAGPCSPCTAMGPTQDCFCGRNSSTKRCQDTDYENGWSCGEICSDLLPCGEHTCTRPCHEGLCGACEVKIEGRCYCGKVQTEMLCSSKDEEFESQMARGDDGTIDEWIGCFSCGDRCSRPFDCGVHFCEKDCHPQDAHPAHCPRSPDVVSHCPCGKTPLTEMSDFSPRMSCDDPIPNCSKPCGKMLDCGHSCDQTCHTGPCGSCRRKLPVSCRCGRTTVVTVCHQGMIEPPWCFRVCKAGLHCGRHACAERCCPGEQKAIERQAMRRKLKAHLRPSDEDVEAEHICTRVCGRPLKCGRHTCPEICHKGPCNTCREAIFEDIPCDCGRTVLSPPLPCGTKPPACSFPCERPKPCGHPQTPHNCHTDEESCPKCPFLTEKACLCGRRVLKNQPCWLAETRCGEVCGEPLKCGSHSCQKTCHRPGECEDASRPCQQPCGKTKSLCGHPCTEPCHAPYQCPEKTPCTSTVTVTCGCGRLRQSRRCNAAAASKGPVPQAVFTTGL

SEQ ID NO: 38313 - protein, 644 aa, A.fumigatus
  UNSURE (186): Identity of amino acid sequences at the above locations are unknown.
IRQDSQGREIYFIVRGEVEVLTERTDAQDRHSLAASIENPPFEVKARLKQGQYFGEVVSLSLAPRRTATVRSVTAVECLMLSGDVLAEFWDKLPQTVRQQVENTAKERLQSASDGDVVMSDAGSADQPTDGEFKIRAARRQSMPLLTLTETELDSPRAPSAMEDQNVLKPSDPDPFLNVGLDKVRXRSRRGSVAPLTPDEVSGEQQRQSPPSGTRSTRSSLHSLSDTSTLSTTQKAHRESRGDNVGILPDNILVRIFQHLELHELMRLRAVSLHWSEILTKSSELVRYLDLSIYNRKLSDDVLVKIICPFVGERPRHVNISNCFHITDEGFSNLAATCGANVVSWKMKSVWDVTATAILEMTGKATGLQEVDLSNCRKVGDTLLARIIGWVAPGQHKPNGETGKMGKAALKPTMQTEAGTVYGCPQLKKLTLSYCKHVTDRSMHHIASHAASRIEQMDLTRCTTITDQGFQYWGNAQFINLRKLTLADCTYLTDNAIVYLTNAAKQLQELDLVSLSLLQELSCSTADRDQSFCCALSDTATEVLALQCSQLTYLNMSFCGSAISDPSLRSIGLHLLNLKRLSVRGCVRVTGVGVEAVAEGCNQLESFDVSQCKNLLPWLEDGGPLRYKGKIDFETVAQNGRVFR

SEQ ID NO: 38314 - protein, 94 aa, A.fumigatus
LRMLFFDFHFWSYEQMNRRISNKRLLSCFLRISWFLVSAYPLSLDHQNFIMFYRHNIFHNLFVTMKAKTKEGKLKGKSGPIQCYSFNINIYLCY

SEQ ID NO: 38315 - protein, 192 aa, A.fumigatus
QFPWNPPPARQVHAQAPYDVHAQAQAAGQGAGRMPLPANLPPVGQGTLYFTFPPDPPQAGQGPGQMPLPANLPPTQQRTFPPDPFLVGQGAGQMQLPASIPPPGQEVGNLAPPPDVRLAGPGPLNFPPGPNLPPVIQEPANFIPAPRTPSPEQGSSSDQSSGGNPYRTSSEASADNDSTNYGATNTGPAFVS

SEQ ID NO: 38316 - protein, 85 aa, A.fumigatus
IREALVGDVETITDIDVARSFPNKRADYFDQNIIAKFAIVYAQIKITNEFRGFGKNLRPMQRDSSKAHKFVKLQVLENPHEYIIR

SEQ ID NO: 38317 - protein, 113 aa, A.fumigatus
VRLCCEFMPEAQRSAAPLKNSPNSSIPLHGTRHDLIITLERLALLLGPVCEKSPNVIITGTAGVGKTVHCEKLAQEVGLRHLSINQVAKDRGCFESYDQDLETWIVDEDKVRR

SEQ ID NO: 38318 - protein, 73 aa, A.fumigatus
HDHASSRKYKEAKLQENLDSEIFGILSEEAREAFDEQIVVELNSEEDDDVETNCARISAWIESWKESRPENRE

SEQ ID NO: 38319 - protein, 60 aa, A.fumigatus
  UNSURE (6): Identity of amino acid sequences at the above locations are unknown.
RLPWVXNPSNLSPNHWFPSLKLTDYPILREIEIPPRLAEVFNWALGFPFPIKPLVNPPMN

SEQ ID NO: 38320 - protein, 156 aa, A.fumigatus
ESLEFNIYHTWMKVLKKKLYKMIVPAIIESQSVPGFVTSETNRFLGKLLPSNNNPAYSMDNLLSLLNNVYKAMKAFYLEDSIITQTVTELLRLVGVTAFNDLLMRRNFLSWKRGLQINYNITRIEEWCKSHDMPEGTLQLEHLMVSWFPRDSSDFN

SEQ ID NO: 38321 - protein, 73 aa, A.fumigatus
SYLQVHCKFGTAELIMQYSKHFLSALGHDGLNKMLDSFEDRSAEAVCTFAFCRGPGEEPILFQGRTEVNGTPV

SEQ ID NO: 38322 - protein, 119 aa, A.fumigatus
RLIGRFFRLSPNQIQKLLNQYLVADYEQPINGEIMKAVASRVTEKSDVLLLTPVDMEDSGPYEIAEPRVITALETYTPSCECFNEMVSRILMISRAPNSAFETSCRNSLSTGNGPARET

SEQ ID NO: 38323 - protein, 434 aa, A.fumigatus
SPIIASFAAGRFLSFDTLVCDYNYLRQRPLSGLIPAPGLPPFRIRAVEMPSSSADDIPATPRVISPSPVPSSESSSRDGYAGPRTRSAARRQRLVDVSEEKSENVDADSTRSRSRSPAAPARLTRTRRSNPMIPARKPEPSKTNGRISPTDLLSPNSALGKGRAHDISRSPSPLGLIPLHTRYRSFIHRHEIPRKLLHGSIGFLTLYLYSRGVQTLQITPWLLSALVPIAATDFIRHRSETFNKIYIRCVGALMRETEVSGYNGVIWYLLGAYSVLRFFPKDVAVMGVLLLSWCDTAASTFGRLYGRHTFQLRKGKSFAGTLAAWVVGVVTAAAFWGWFVPRVGAFPNDPEGSFMFTGRLNLLPDPIKGLLGWTADSDSSRGVITGPLALGVMSVVSGIIAAGSEFIDLFSWDDNFTIPVLSGIGLWGFLKVFG

SEQ ID NO: 38324 - protein, 62 aa, A.fumigatus
NDDGANMMFLNGFLETQKLLYNWDQERQRLSAASDCLHYDILMRHEQRNSGCLHWGHAGEAH

SEQ ID NO: 38325 - protein, 378 aa, A.fumigatus
FDCTSLQMTYLTTPPSHKFAALKRIVSSVQPTPLKTIFFVSTCSGVDYLSAILPLLLGDDFLLIPLHGKHQANVRQKNFNRFINSHDPAILLTTDVAARGLDIPSVDLVVQIDPPSDPKSFIHRCGRAGRAGRRGLSVVLLHPGREEDYVSFLEVRKTPVVPFSPSISFSDADAAAATATARKAVLADRALHDRGQKAFVSWLRSYSKHQASSIFRVSDLDWEALGKAWGLLKLPKMPELKNFTGDKTLGMSLDWDNYAYKDKQREKRRKELLQEAAESGATQSTSNKRRATESVAWSQQAESKNKKLKRREQKKSKQEKARWEKMTEEEKQKVLETEKMVEELRKKNEEERRLRRAVAKAAGAKADGDDEEEFQGFD

SEQ ID NO: 38326 - protein, 116 aa, A.fumigatus
SSNRSADRSDGPILHSAAVMAPKPPSGTSLRAWDAVTPALSEWVLEAMSSMGFTRMTPVQASAIPLFMAHKDVVVEAVTGSGKTLSFLIPVVEKLLRLEEPIKKHHVGAIIISPTR

SEQ ID NO: 38327 - protein, 212 aa, A.fumigatus
ALISGRAAARIVETLDAEYVIRELASQIYNVLSSLLAFHPPSAAAINPSEDDDAPRPKFPSSTLKVVPQLLLGGSTTPAEDLSTFLKRSPNVLVSTPGRLLELLSSPHVHCPQSSFEMLVLDEADRLLDLGFKETLQNILRRLPKQRRTGLFSASVSEAVDQIVRVGLRNPVKVMVKVKGGSGVDDKRTPARLVPLYFILEQQSNSIVPVCK

SEQ ID NO: 38328 - protein, 127 aa, A.fumigatus
ADTILGFAGNDSPSFVFPTAIASKVGAGSAGSSGSGRPPVANKPSFLGAGSGSSSNLSAKRGTEDLDFFIGDEALAAANGPGYGINYPIRHGQIENWDAMERFWSNSIFNYRLHPRELAGPALNVRE

SEQ ID NO: 38329 - protein, 66 aa, A.fumigatus
HGLATTYLDLHSWFAPYTRHLPSSTVTARLHLPLILIFLHHCYSSVLPTGLPLYSTNCSIDLLFNF

SEQ ID NO: 38330 - protein, 157 aa, A.fumigatus
LAADIGYSPLLSSIEVSHLQYESTTERWRYLCHLRPCRGGISRPWKRESPPSGMRKVSLPATCESMIYVVHVSAFGLTASSACKAAMGILKSGGSALDAVEMAIIVMEDDEITNAGYGSNLTIEGAVECDATIVDHHGRSGAAGAVSRKFLFFSASQ

SEQ ID NO: 38331 - protein, 171 aa, A.fumigatus
QYVLSCFYICHEDLELVSNLMPHLAMLYNNLLSIPVLLVLTFLMEDWSSANIARNFPSTDRNGILFAMILSGLSSVFISYTSAWCVRVTSSTTYSMVGALNKLPIALSGLIFFDAPVTFPSVSAIVVGFISGIVYAVAKIKQSAKPKTGVLPMSNPPVSASSQSMRDSLRS

SEQ ID NO: 38332 - protein, 87 aa, A.fumigatus
GSSVPSSPAGADIKQAVESSGDVTAKVSTLNAGYIWMLINCLCISSNFLGMRKRIKLTNFKDFDSTSFLVSISATKTWSSCLTLCLI

SEQ ID NO: 38333 - protein, 555 aa, A.fumigatus
AEPSLSRNLACGEDSDCINRATKIECVGDCSCGAECQNQRFQRKEYANVAVIKTEKKGFGLRAETDLRPHQFIFEYVGEVINEAQFRRRMRQYDEEGIKHFYFMSLSRGEFVDATKKGNLGRFCNHSCNPNCYVDKWVVGEKLRMGIFAERAIQAGEELVFNYNVDRYGADPQPCYCGEPNCTGFIGGKTQTDRATKLSNATIEALGIEDADSWDTVVAKRPRKKKMGEDDEEYLDSVQHKSLDENGVTKVMAALMQCKEKWIAVKLLRRIERCDDDRVRHRVVKMHGYQILNSQLTLWKDDFNVVLQILNILDGFPRLTRNKIIDSKIESTVQPLTTCGDERVEKKAAALLQHWATLEVGYRIPRMKRDPNAVASVSQFGRREHTTDEQKRSQSRSRSRSRSLDAPRGPANPGRKSNGPRNSQHHGARQFRRQFNPLPPGWFAAESHGRTYYYCARGDVTWTRPIHAAPEAEVPGQQAKNKALQGIIDNILNAKENTPKEKTVTPGTPQASRETASLNEGQERWRSYSEEKQKKLYENTVSSLPRAAVVVLEYR

SEQ ID NO: 38334 - protein, 184 aa, A.fumigatus
RIARAVPQIPLREDIAQEFLGRGAFIAPVALECLLVGHIDEDLAALVVWGPHRKPRLGVPQDIAGRGIDRHRHERVVHYGAHEQAVVTDTPRRKRALVEIEQPEKPLGAVEELGHGTDPEPLLELLPDVRSQSVAIHAANAVVAVVRRRRCGQQVPGHFADVHKDRGVGVSDIAPEVAHAELLA

SEQ ID NO: 38335 - protein, 451 aa, A.fumigatus
RGKAAKGLGNVWFVFLETAAKYPDMVCMWTREGIYTYRDVQNLACQYAHYFLAQGVKQGDLVAFYLQNRAEFMIAWLALCSIGCAPAAINYNLTGDALVHCLKISGAKLVLVDDDEACRARIDDSRAAIEGPLGMELIYLDHSFASQVSSFPTTKPPKEFAQSMSGADPAILLYTSGTTGMPKGCAFTMARLYSTLALRRGSMEDTDGPGGDIWYSCMPLYHGTAAVAMMVCLTTGVSIALGKKFSVRNFWRDIRDSHATVFVYVGEVARYLLAAPPSPDDRNHSVRCMYGNGLRPDIWEKFQQRFGISAVAEFFNSTEGLFGLFNLNKGPFTAGSVGHHGLLMRAIMHNTFVPVAIDPTTGDVLRDPKTGFAMRAPYDQGGEILVNVPNEQAFQGYWRNESATSKKFLRDVFTKGDLWYRSGDALRRQSDGRWYFLDRLGDTFRWKSENV

SEQ ID NO: 38336 - protein, 160 aa, A.fumigatus
ANPSTPEQFESRKSQKSLMDSSATAEVAEILGRYPGIQEANVYGVLVPHHEGRAGCAALHLSPEAREAFDFRGLAAFARARLPRYAVPVFLRIVETSAHIHNHKQNKVPLREEGIDPAKIGSKVPEGRDDKFYWLPPGADGYVEFGKREWETMLAGSARL

SEQ ID NO: 38337 - protein, 158 aa, A.fumigatus
PPDPTSPPLDVATPAPTAEIPAEQASVDASHSDSDSDGKINWTNKLAIEATECVFRGVRLSVPPFPFRQRWNEAACHEIGERKNRGRKRKRREYEECDDEEYEYVDNGNFQRMYDTIAAAALATIAAANTTSHPTKRRKKAMKKKQGGGSPGSAGSPA

SEQ ID NO: 38338 - protein, 68 aa, A.fumigatus
NGNKTNERESFPLLHNLREGKCVPQSNMTRCVSYFYVYKYIVLQGPDYISGNITVSLHYLKYCLCKIV

SEQ ID NO: 38339 - protein, 75 aa, A.fumigatus
GTVDFYDWVDCMSLFVRLGRQHTDETLQSFFYLPQSPTHTKSVLYPRSWYTEREEVIMINVCPTIVPASPVLTDA

SEQ ID NO: 38340 - protein, 110 aa, A.fumigatus
QCDEGTTIQLVCFLAAEFPVQLLTKRFGFKRVLPCMMMAWSLVSWTQAWMTSRASFYVTRALIGACEGGFIPGAILFATYFYKTGELSVRLSFFWSTLNVSPPNSLAVNR

SEQ ID NO: 38341 - protein, 92 aa, A.fumigatus
WNEVARIISSLLAAGILQMRGVRGKTGWFWLFLIEGLLTFTIGLIVCLFSSGWDGNTLTKPSRASSTSPSHQRTPRASSTPGPGTPSARKSS

SEQ ID NO: 38342 - protein, 281 aa, A.fumigatus
PRSNRCMIQRLLRDDPSKGLTHIHDRATLTDILNAWSDKSMWGLYLIGLVAYIPQSPVQAYLSLTLKRLGFSTFDANMLSIPSAALQIILMLALSKSSEFFKERTFHCFIGELWSLPLLAALLALPAHGHNWGRFAITTMISGYPYFHPIVSSWISENTFDVKKRAITAATYNVIVQVGSVISSRKFLRMLALVCPKKADGAEIYRADDSPYYYRGNKVLISICVLSLIVFVAQREFLRYLNRQKERKWSTMSAEEKVLYQSDQEAREKEGNKRLDFRFKY

SEQ ID NO: 38343 - protein, 167 aa, A.fumigatus
LNRLRIPTNILAPPLYVYHMRMYPVWPIVNAESLISVLQEDTERKDLSTYTLATAVAAATLAQLKLEDSTTGDSPTADAFAAECLHARDSCGYRSKPSLDNIRTSFFLHVYYENQQSGGSESLLYLREAITMAQMMRLHQEASYIGLSPEEQQLRRRILWLLFVTER

SEQ ID NO: 38344 - protein, 181 aa, A.fumigatus
RNGNFHLFMIRGYPDTVCRGVCILHQLPVILKTNISTPGLDVNDEPQVLPAFLKLLNLFRLFEKSKMFDVIECESVGPHDLSRAGPDGRFLKLLQDGLQDGSALLDHTSDVQKADLCVTRHWMRLILWKNLSRNRTTYAHSPTSLFSPLFPVMVAKELVAIVTQLPRPAIEAHGLGMVRLS

SEQ ID NO: 38345 - protein, 198 aa, A.fumigatus
VSINMPASRSNVTKRACDGCKIRKIRCGGGQPCVACTNSRIRCTYIRVQQPRGPQRLRSTTKYLIEQTQRGLDAPNGRCASAPVEQAGHQGHQTERYVLNLSSHILEPFLTEQIANTDQHPCPSALRISHAHVSGLAHRQCRKPHLGTTGRYRTKGSVNLYPGNSRRSSHPGSTQARRFDYRRLAHRRRLRGRVLACP

SEQ ID NO: 38346 - protein, 62 aa, A.fumigatus
RWPVSEMKRQEDMLRTYHCDCKLFKVDMKRRFDGATSRNDTTTLKSALDSAKRIVNRTLHLI

SEQ ID NO: 38347 - protein, 224 aa, A.fumigatus
RLTLNGDGSRLYTLCRDGTVYAYSTSHLVLGHAPELSLYNDRPRRSGGSDKEGLGPLYGFRHPRLQVSSFYVRVSVRKAVADKVEMLAVGSSDHCAVLFPTDERFLHSRVQNPAVDLNPQSPGMSFTRSGLRRTNSAVGLSGRLEDTVPIYQSGTPLVEGHKKEVSAVSWSVDGELITVSDDYSARCWREGPDARDLRVGGETEGRRWKCGWADIENQYDDDDE

SEQ ID NO: 38348 - protein, 152 aa, A.fumigatus
RLLDSILVCIMASQTPADTSVAADPVTLPDRSQNPADADKAAPQGETSKNAAKKAAKLAKQAAEKAEKAANKGIGKSEAKKATSKAPKKKIEGAALIGIDVSKEEDFPGWYQQVLTKGDMLDYYDVSGCFILKVRSFAVLHPQAAEGSEQCG

SEQ ID NO: 38349 - protein, 348 aa, A.fumigatus
VGDGTTSVVLIAAELLRRANELMKNRIHPTTIINGYRLALREAVKYMNENITTKVDALGKDSLVNIAKTSMSSKIIGADADFFANMVVDAMLLVKTTNQKNEVKYPVKAVNLLKAHGKSGTESMLVKGYALNCTVASQAMKTRITDAKIACLDMNLQKERMKLGVQITVDDPDQLEKIRERESGIVLERVEMILKSGANVIFTTKGIDDMVLKLFVERGAMAVRRCKKEDLRRIAKATGATLVSSLSDLNGDEKFDASNLGYAEEVVQERISDDECILVKGTKVHTSASIILRGPNDYSLDEMERSVHDSLCAVKRTLESGSIVPGGGAVETALHIYLEEFAVTVVRS

SEQ ID NO: 38350 - protein, 142 aa, A.fumigatus
HILLTFHFANGPSSQGSREQLAIGEFAQSLLIVPKTLAVNAAKDSSELVAQLRSRHWASQRIEESPANKDDKAIAKKKNYKNYGLDLTKGRVHDCIKAGVLEPSMGKVKQFKSAVEACIAIMRIDTMIKLDPERKEDDGHGH

SEQ ID NO: 38351 - protein, 87 aa, A.fumigatus
QGIDILQIYLPEPKDLDLFGMQDEDIHINLWLTKQKIIIGLVVCFRLFDVMVPGVFFLSACASGLSPSSSSGSSVFPMVNGCRNDNG

SEQ ID NO: 38352 - protein, 61 aa, A.fumigatus
KVPSAGGMIAIDPKVQMALGTSLRPGFQRPSCSYRNITMLLLIMHRMGKTRSLHSGISSLP

SEQ ID NO: 38353 - protein, 240 aa, A.fumigatus
ARELTDEKCLHIYISACSVECRLRYRASTPCPTAFNRLLQTVTMDPFPSEPYRSARLLYRAPEDNPADDAFFHALYADPVVGSMATTALLRPLSTKERKELRAKLSDVFMSVMICIIPDEGSDKEPETIGVVSLKKEASDFAHNRTYELGISIARQNQDKGYGSEAISWMLDWAFLTAGLHRVELVVAEWNERAQKVYRRLGFASEGRKRQCLWKAGRWWDLLFMGILAHEWEAKKAAGS

SEQ ID NO: 38354 - protein, 142 aa, A.fumigatus
PPVSRTPPWVPSPFIILAPSHRNAFKMSTDHSARSPRPRACVRCQQRKVRCDHKSPCGNCVASETQCVTATLTPRRRRFQEKVLLDRLRHYEGLLRQHNIDFEPLHPQAKPDPVGAAVSRACGRSEPARAQTPVQSQAVFDT

SEQ ID NO: 38355 - protein, 66 aa, A.fumigatus
FRRVSTHQKGASGLACISNSLELHLIFPVRFNLETTPHHYGLARIRFDISCSIMQPHQKGKKLLGI

SEQ ID NO: 38356 - protein, 225 aa, A.fumigatus
VSVSPQTDPRSLSSMLAAALRIAQRMGLHNESTYTPYTAVKAEMPQKIWWSLVIFDHRMCEMSDYKVTTLTPTWDCQIPLNVNDVEIRPDTNSWAPNNEKPTEALFAVVCSELADRIRHTTFHINFVNPVLAAVAKAKNPGRMSIPADDEMLTIQKTIEEKYLAFCDPTDPLRYMAIWTTRGYLARNRLLEHYARHLTSPAMQQTDAQRNAALFYALQMLECDTN

SEQ ID NO: 38357 - protein, 270 aa, A.fumigatus
AAGLTHYAQALETNRGELKTLKQELDEKVAELNETRATEIEMRNKLEENQKALTENEKRQRYWSEKLSKLTLQNVSDLGEEQQPTELQMYTKDELSEMNKESLKAVIAALEEKTQNASVDLSVIEEYRRRAAEYESRAADLATALASRDSAKARLDGLRSARLNGFMEGFGIISLRLKEMYQMITMGGNAELELVDSLDPFSEGILFSVMPPKKSWKNIGNLSGGEKTLSSLALVFALHHYKPTPLYVMDEIDAALDFRNVSTFTTSGQD

SEQ ID NO: 38358 - protein, 152 aa, A.fumigatus
SPSAGPSSPVVKTLEEEIEDLRAQKGGIEEEIQTLQNKIMEVGGVRLRSQKAKVEGLKEQISLLAEEISNAEIGKSKNEKLIMKHQKARAEAERELEQVAEGLEKLNADVENQANDASGWKQGVEEAQEVRVQQSPMVSSRTNTLRAGLGDE

SEQ ID NO: 38359 - protein, 100 aa, A.fumigatus
TMASEYMDTEFMVQSRVSVPSLFTSLFTFLSPSFSSFFLTFLIHASLPECVDKSQVTLGGYVFFFFILIPLRCLLTYIAFTPAFNVNYEGRQGLPALGSS

SEQ ID NO: 38360 - protein, 481 aa, A.fumigatus
HFHISRGFWVLMEAFSVRKDSVLTMPLYQLSLTHFCEVHGPTSIICSQVLPFSCSQCYPETSDFSPDDTPATSHDTQSSHGMRNRLGDARDTKATKRPDASGATVGKSPKIEDSPYFLKNQPNSSEPSKLNILGGADGDTCASCSLTLPDDVSRQLPPGAPGTASRDGKGRNSSPVLRSREVVYSCGTSHSDGDDSAHDLHGHASLPDSIHSSSVASDASCHTHILTYLSLRGPPNPSDYALLRRSSIRTLSCELLPRGLSSGPLCFGDATAGYTIAYVFRLPDPMARGKRRSYALVALAGKDAGRAFRACPVIWRAFGRIATGIVNSAEKYQEEEAKRLEEQNDAANRANNRHYTPVSSFLTGRRVDPDGQPRRLGQIRARNLSEIVGNQYIFAEIHAHFVALLQQLGSMFGAVPISEERFICSTLGDDVDVKSRRGTSIDNGKDSTSKGKSESDFGLSGLDLSSGPKPIPIAARRTVIA

SEQ ID NO: 38361 - protein, 80 aa, A.fumigatus
LLILGFSDFCIRNFFCEETDLFLQPLNLRLLTSQPNSANFHDFVLESLDFFLNTALLGSEVFDFFLKGLHHGAGRTRARR

SEQ ID NO: 38362 - protein, 228 aa, A.fumigatus
LIPTGEYIYKGRKFNARKDTTDQKYLNIPIYRFYIRCTRCSGEITFLTDPKAMDYKAEKGAKRNFEPWRDAKNDIEETEQETLDRLEREENEEQERLERDKMAELEEKMLDSKREMAIADALDEIRTRNARIERNEALSGDVALAHVRNEVDEARLREEKEIEEAARRAFTTETGEKVKRLVEDDTIAGTTPGSSQTETPPPPSFARVKKPKKPLSSPRGCEERSELR

SEQ ID NO: 38363 - protein, 720 aa, A.fumigatus
TDSWKSNRLTCSQDSDSDAFWLAQVHFSNNNYTRALALLSRKDLISRSTACRYLAGHCYIKQNQFDQALSVLGDHNPTHLIRSSNSRRKLQHLTLRNGKTTASRIDRNEEREREDANNIRFEAAMCYLRGLCFAKQNAFDRARDCYKDAVRIDVQCFEAFDQLMKNSLMSPAEELEFLESLDFDAVSSPDPSVAQEAAHFTKMLYTTRLSKYSSPAILSDATETLSTHYNLAENPDILLSRAEALYTQCRFAEALELTSSILATEASTTPNVPALSHLGHPPAVYPLHLACLYETGATNALFLLAHTLADHAPEEPYTYLAIGVYYLSVSKIAEARRFFSKASLLDPHSAPAWIGFAHTFAAEGEHDQAIAAYSTAARLFQGSHLPQLFLGMQHLALNNMSLAHEYLSAAYAMSTGAAAGTVPSIPANPSGDAHGGDPLVLNELGVVLYHQNHLEGAVELFNQSLALATALHCEPGAWVATRANLGHALRRIGRLVEALAEFDECLRIGAGGAGVAYGPFLGGSGSSASGVASSGVGGYEDRGLIGSLHTSRGLVLLELGRTMEAVTALHEAVRVLGASGGGDAAGGAGIAGTLLSRALEIWALECHEGDSAPPEDLERVTTSRSSTRSRDKGKGKASRRRGMTEEEWTDEVPTTGPATETLEQKVEMELDDEADGLLRHAMSRVRGGRGRRRLDFSPDAEATETPGPAGARSRGSRARS

SEQ ID NO: 38364 - protein, 212 aa, A.fumigatus
IEKEVADEFPENPILSGVVYLPTTQTSPGVIDYPEMLNLIELGTYPANAPPTHKAAASKLVDLMNQGGGEAKLHDDIQIARWTKLLINASWNPICALSMCSDGDFLLSSEPFALELVWGIMMEIVALAKKLGIPQVDEEAARVRLQIATRRAKEGTGRDPSMLQDVKQGRLFEVEAIVGNTVRLAREHGVSMPRLETVYALAKGRYEALSRK

SEQ ID NO: 38365 - protein, 188 aa, A.fumigatus
GTILTEPPRITMSTPPITDEISIRLAHQDDIPQLNIIETSAAQLFRRVHLAWIADSPPLDPATLRSMIAQKNVWAAVTSNNTAVGFIAVQDLDGMLYIAEMDVHADWQRRGIARMMLEEVEGQARDRGYEYVSLTTYRDLEFNGRFYARMGFEEVDVDVAGEGHARELEEQARGGHARDRRCVMRKRV

SEQ ID NO: 38366 - protein, 62 aa, A.fumigatus
TQMQLTYPSRIFSPGRFSRDRPRFTDNLDVIKFLCKDLWTILFKKQVDNLKTNHRVSTRKRV

SEQ ID NO: 38367 - protein, 130 aa, A.fumigatus
VREQTRDNVELKVVLTPTVASRLQADPNLRVMVYCAADSGLNQYTKSDIAFPHQVELKANLDEVKANLKGLKNKPGTTRPADVTNYIRKKPGYPNHIVMTYALTQKASRPFQTHLCSAHSIMSMPIIYSS

SEQ ID NO: 38368 - protein, 78 aa, A.fumigatus
FAVKNRAEDSDIVATSTVMSLKCPLSTLRIEVPCRTVVCTHNQCFDASSFLQLQEQAPTWSCPVCSKATSYESLQIDQ

SEQ ID NO: 38369 - protein, 250 aa, A.fumigatus
LSEREAERDLEQQEIDNAVPLTEEEQAEKARMSEEGFATWNRRDFQQFINGSAKFGRTDYEGIATEVDSKDAAEVEEYAKVFWKRYTEIQDYPKYIRIIEQGEEKLRKMSHQRKMLRKKMEMYRVPLQQLKINYTVSTTNKKVYTEEEDRFLLVMLDKYGVDGEGLYEKIRDEIRESPLFRFDWFFLSRTPVEIGRRCTTLLNTVAKEFEVGANGEAGKGRGRDREEEDEENEEVGAPAKKKSKNGAVVS

SEQ ID NO: 38370 - protein, 760 aa, A.fumigatus
EDDSIRRFRYLLGLTDLFRHFIETNPNPRIKEIMAEIDRQNAEEDAKAKKKGSSRTGGAGNDRRRRTEQEEDAELLKDEKTGAGTATVFRESPPFIQGEMRDYQIAGLNWLVSLHENGISGILADEMGLGKTLQTISFLGYLRHVCGITGPHLVAVPKSTLDNWKREFHKWTPDVNVLVLQGDKEERHKLINERLLDEDFDVCVTSYEMVLREKAHLKKFAWEYIIIDEAHRIKNEESSLAQIIRVFNSRNRLLITGTPLQNNLHELWALLNFLLPDVFGDSEAFDQWFSSQDADQDTVVQQLHRVLRPFLLRRVKSDVEKSLLPKKEVNLYVPMSEMQVKWYQKILEKDIDAVNGAAGKRESKTRLLNIVMQLRKCCNHPYLFEGAEPGPPYTTDEHLVYNSGKMVILDKLLARMQKQGSRVLIFSQMSRVLDILEDYCVFRDYKYCRIDGTTAHEDRIAAIDEYNKPGSDKFIFLLTTRAGGLGINLTTADIVVLYDSDWNPQADLQAMDRAHRIGQTKQVVVFRFVTENAIEEKVLERAAQKLRLDQLVIQQGRAQQQVKNAASKDELLGMIQHGAANVFNTKGATGALSNDKQLSDDDIDAILRKGEERTAELNKKYEKLGIDDLQKFSSESAYEWNGQDFTEKKKDIGINWINPAKRERKEQFYSIDKYYRQALATGGRTAETKPKVHARRSRKYPTHDGNSSHRGFKNFKRRKQLTSIKKLGTKHSFLRALKNSSVSEKRNVTWSSKKLTMLCP

SEQ ID NO: 38371 - protein, 207 aa, A.fumigatus
RLTVVLVDGVKLLLSLPLCWVDPVNTNIFLLFCEILAVPFICALRAEFLQIIDTQLLVLLVEFSSPLFTLAQDSIDIIIRQLLVIRQCTSCTFCVENVCGSVLDHAKQLILGSCVLDLLLSTALLNDKLIQAQFLRGSLQDLFLNSIFCNKSKHHDLLSLTDTMGTVHRLQISLRIPITIVKNDNICSCQVDTQPSCSCCKQEDEFI

SEQ ID NO: 38372 - protein, 71 aa, A.fumigatus
RRIWQLTSTLAFISIISAVIICMIGVIIKHPGGKVMATVDTDLVHGFSAVTNIVFAFCEFLSFVELELQPD

SEQ ID NO: 38373 - protein, 98 aa, A.fumigatus
IIGALQHFYSFVLYTKLGILLFGFTKKLLDQGKTPIMIQSVNDPPLSNPENLQEKGIASRDASLAEDEKKYAATLAYRQDAFGDESNAEVKYKVMKWW

SEQ ID NO: 38374 - protein, 96 aa, A.fumigatus
NSNSNPTNWHAAGHAAYFGLMAELKDPRDFPKALMLLQSVDVCLYIIAAIVIYVYGGDEIASPALGSADPLISKVAYGIALPTVGPHRHLKTCLQY

SEQ ID NO: 38375 - protein, 80 aa, A.fumigatus
LVHLQTALFASWFTYGLSGIFWLYLNRGQYLSSPRKMFLTIVNLFCLVFGAVLCGLGLYVSGKAIHDNPSSMSFSCANNA

SEQ ID NO: 38376 - protein, 174 aa, A.fumigatus
IFFCFSSVILLVSLGIIATYTGYVLGQFKLQYPWVHNMGLAGEVVFGSWGREILGAAQMLLLVFIMASHILTFVIAMNTLTDHGTCSIVFGVAGLIVSFILSLPRTLAKMSWLSLVCKMTCCLTPDLAANFHPSFYQHYLRGDYLYDRRNYKASGWKGHGNCRHGLGPWVLCRH

SEQ ID NO: 38377 - protein, 337 aa, A.fumigatus
  UNSURE (48),(53): Identity of amino acid sequences at the above locations are unknown.
DLTKPLTIHSSTPDSKSPVGTLLLKLNDCEKISLPKQEPEPRSDAAPXDVKEXDPLNDGYYFRAHRRMERQENKLRNIERERAQHEKMQLERLLDELKGHDWLRVMGITGVHEHEKKLYEPKRDYFMKEIASLIEKFQIWKEEEKRRKLDKDKPSRRAEISPSTAPTNRDHTTSQKRKRSDRTPDTTAERPTHNGAATADGESDGEPPDPSDVDAWAAHQLQQEARSATAGKRPKSSTEAPRRRKSSANKSSTAPPAVAKPATPPPPDKPFTSFYAKPHLREAALSPHRKGRVRLAFGHPIPKMEVREFQPPADILTPEAIDSCRRKRRRMRRESRG

SEQ ID NO: 38378 - protein, 182 aa, A.fumigatus
SRNSKSGKKKRNAGSSIRTSPRAAPRYHRPPLPRTETTLPPRSGNVVIAPQILPPNAQPTTAPPPPTAKATANPQTQATWTPGPRINSSRKPAPQQPANGPSHRPRPHDVANPPPTNPPPHRPLSQNQQPLPLPINPSPHSTQSLICARLRSRHTARAASAWRSATPSPRWRCANSSRLRIS

SEQ ID NO: 38379 - protein, 1675 aa, A.fumigatus
  UNSURE (86): Identity of amino acid sequences at the above locations are unknown.
WFHRPTPRANNSITLAANGSIESHETAIPLLGPSDANSRGIKFGSPTLNLSLMEILSTLSSGGTLCSASRRLTLTDLGGTINEARXPVMMATRSLAALIRPAQLNTLQYLWTMGEKLNRTVIENFTQKAHSNDLNGDSVPALRLLVNAYGPTEAAINCTFFAPVEYHTRGSIIGEPLPTCSIFVLDPASHTPKPIPAGLAGELAIGGPQVSQGYLNRPEETANSFVHSPEYGYLYRTGDLARIVWDEKGAQVIEFLGRITSDQVKISGRRVELGEIESVLATLTGVREVVAVVPKRDASVQGSEQIVACIVADSLSEDTAPEFVRLADECAHRHLAAYMCPSSYVFFDSIPRTSSGKVDRNSISSMLQQGKDSGMKFYMPSNDVPEARGMARAEWDPLEDEKALELRTLVLDLVAQTTGQDISVIKPNTSLYTLGLDSLGSMQFLQKLRDKSLHNLSVGDVLQSNTVNGLLTLILNGKTNLRGLTNGQLADDSRMSLAEHLQAFNDTNLSRCAKRLSISPERIQTVLPTTETQSGMLTSFLRTSTDSSFATRSYIYHSVISLEPHVDIERLKKAWESVIASYDSFRTRFCWIDDDMAPFAQCILKEDAASAPMWAINHTFGDSMHEDSLTRALREAENTISLDSPWKLSLLESSGDKVIILSMFHGIFDGGSLQLLLEDVSSVYDGQLPAPRTSLEHVVVNHFQANQTATSNFWKEYLNKYSPIAFPSLTAYRPPAVNATGCVEITPRTTHDILKQQSRTIGSTPLSVLQAAWASLLLAYTGTQDHDVVMGSVISGRFDPDSEICIGPTFTTIPTRLALGQVPKAGGFWTNKSVVNHLASLNAKALSHLQPRLGSLVTADSKLPYDTVLAYQDFSAGSSTSSIWKSIDHPPMANDYAVMIEVWPARDSSLTLRASFALSQMDRDGAKVMLHQLDDIIAFILQNPDGDFENALLYTRPDLKASYNPMPKEADEVSDGDLIHTKFENHANSHPDDMALLFKYDLEDDGNLQNISWTYGELNARADNLAAYLCETYDKLTNKVVPICIEKSPAMYIAILGILKAGGAWCPIDTFSPAQRRHDLIKRTGAGVLLVSSEDGEQPKDAIPIGIDVVDVKKYADPLVSWPSVGRWSSKKLSSPAGLAYLIWTSGTTGAPKGVPITHSAAVSCFRSLKKDIPSDVSGGVVRCLQFSQYTFDVSIQDLFYTWSLGGVLISATREIMLGSFAKLANTTRATHAHLTPAFAAGVPRNSCETLEVITMIGEKLTQHVADDWGTDMRAYNTYGPAEVTIVSTVREFGNDCLNIKSANVGWPMESVSVFVTRNKQIVMKNAVGELALGGPQLSPGYLDQEDVTKAKYVWSEEAGQILYYTGDLVRMLADGSLEFMNRVDDLVKIGGIRIELSEISFALGGCHPLVENIETLYIDRPDRPSKVLVAFLSASNATGADAGDDLLLLNDSALQIALSTREKAHTALPAYMVPSVYLVMKRIPRTQSAKTDRRALQAAYASVDIEDWENRMNPENNATGHPTDDLVASDAMEKIVHMIASLINISPSIVAKASRLRSLGIDSIHAIRLASRLKEAGYRLSFIEVINCVTVQDLARLCTSSSEVDALPAAEFDINLFNDQWHDIVASKVDGEFFTVRATPIQESLLSETMGTYHLYSSNHFVPPRAWKDPRIAY

SEQ ID NO: 38380 - protein, 485 aa, A.fumigatus
IAFFQPALRADIDSLAGFGGRNSRNEFLKPISRISTQGSAQFRHTPLPGIFGSIPLPAALVAGLWACRNVAYQRLKLRAHVRGVFTGECLVGLLDVISALLALSTVGYFAFVAKPWWLTNFLGFSFCYGALQFMSPSTFKTGSLILGSLFLYDIYFVFYTPLMVTVATKLDVPIKLLFPRPPAPGEAPDVVSLAMLGLGDIVIPGMMVGLALRFDLCLYYRKKGIEKARLESKGQDIIKPQYQCATGGWGERFWAWPVAPRGHELEPPYRDAKSFPKPYFKASLFGYIVGMISTLAAMQYSNHAQPALLYLVPGVLSFLWGTALLRGELREMWEFSDAEESDEEGMNEKEEKKGDEAQAKNTKSLLMRILSGDIKAVYSEEPEGATEKKEERKSESMETKDSAQADGGSDDKSQGADEGKELDLVSISISLPRKGKTRSGKTQTNRVELPTSKKSLSVPSAANRDDEPPAKRQRRSPRIAEASAS

SEQ ID NO: 38381 - protein, 416 aa, A.fumigatus
FSYTRMAPAAASTAAPSAPPSLSLPPSQFARLQPHAYLLAHLSPPPSSNQPSIRANGRATSQFRVTSANTGSLTHTNGSAVVRIGDTAAVCGVRAEILHTDDIASWSVSRASAPASINKRRKLIDTTEKPTVTANDDNDDEDDESHIQDLNLLVPNLSLSTGCAPGFIPGAPPSALAQSLSHQILSLLHSTRLVRAEDLRIWYQPPNWGAEELERHNEDEQMDVDAQEGDTSAKSREIKAFWVLYIDVMIISLAGNPFDAAWAAVLAALRDTKLPKAWWDVDNEMVVCSEAVSEAHKLSLRGMPVASSFCVFEADAASGWRKVIIPDAEEERKIEESDRKGIQRRWILADPDGYEESLSQERICIVVDKENGEQGKTVIVKMEKNGGWAADTRELKQLVDISAQRWDDMKRILDSC

SEQ ID NO: 38382 - protein, 62 aa, A.fumigatus
IDECSLIAIQPSPTTYGLDALPHKSARKFAACYEAVYIWSSKLCHSAHCTKILWNRWVLRGR

SEQ ID NO: 38383 - protein, 94 aa, A.fumigatus
PSTCPEQKKTFTRKRYAPSNVYSKSLLTHQIETGNTEASLIANEAAYFAEAVRLREKYADQIQILIGFEIDWIRPESRTLSLHPGGPKEPRYAY

SEQ ID NO: 38384 - protein, 65 aa, A.fumigatus
LAMGVMGTLFGGIYLSTRGGGQKKQATPPIQASSKDEEKFIQYVCVHSRHLLSNVAVPMTPSDLQ

SEQ ID NO: 38385 - protein, 123 aa, A.fumigatus
VTCLLSHALLKTCAAMPFSHHSHSGQFCPGHAKDSLEEIIKLAISKKFKVFCLTEHMPRAKEDFYPEEVRPKQRLFQISIDSSDRNRQHRSLTDRQRSRILCRGRPATREICRPDPDPHWVRD

SEQ ID NO: 38386 - protein, 122 aa, A.fumigatus
TTIVFNSDDYWVYERLKRYATRMEVIPVCDLPKSQAMAALKRYRKQYFNEDLSDQSLQTIYDKVGGRLSFLNRVAKARDYMKLCDSICEAEKTWFLNKCWILGEEMDDDVMDQQKYAVRLQL

SEQ ID NO: 38387 - protein, 78 aa, A.fumigatus
AFLASVTMPLWILSADAPATTGRDVLSFTFLAHLPNYSLLWSFYGIRPTTILGSYGITLISTAIPFILLRRPSSGPQS

SEQ ID NO: 38388 - protein, 164 aa, A.fumigatus
QKDYRIAGYSYHRYYKYLILQKMDNAFSPGDPALEVAGVEYGKHHYHHDEHWVVRDEQEKLDRIIQGRSGGHYYLIIGEKGTGKTSMLLEAMRKTNGDGVAMFEAHGDLEIFRIRLGKALDFEFHEEYVPAATLYSSEQLLIEFLQLYRKSVQHQRSTRHHCPA

SEQ ID NO: 38389 - protein, 157 aa, A.fumigatus
PIRLPWLTRKQSAAMVLAKALVDKEKEMEQTYDPEKGHIIPEIPLHEARQIMTRADFIQSYDHENIFTIDSRGMVRADSVPMQNAFREICSWPGFEEHLEATLKRIGDIESLGRTRELTLKDLWDKGKYQITMRDPKGRENGTVEFSVKEREEGDDD

SEQ ID NO: 38390 - protein, 60 aa, A.fumigatus
MLRFHNIFRGYLSGTAHPKNKNRNNDQIQDEDLYKTMKRSFTVSCYASEMTQQILKYQNN

SEQ ID NO: 38391 - protein, 212 aa, A.fumigatus
FYRLQVSSQEQVQDVRQSIVELPSTFQYTCFHLEFNGKRINDFVELSEVEGLKADSEIVLVEDPYTEKEARMHVVRFRDLVGAAGDRSDNLHGLNAGLSLHDAVTAEAATDDVKEHSLSKYDIAASPSLETILPRAEAPLPKTVKSISLSAWNPPPYHLRQKGHLLYLQVTTNEGEQFQITSHVSGFYVNKCSNHKFDPLPSNAVRSQGAVS

SEQ ID NO: 38392 - protein, 68 aa, A.fumigatus
NNNNDNNTYMDMLKVWSELSNLIYKLAMNSSLCWFYLYDPRPQLHFAGVQKEGSRLSSQKGLRASGGK

SEQ ID NO: 38393 - protein, 122 aa, A.fumigatus
AANLKTYIEETSQRHEVKTGWNIFNDKCAATSVVVKISGEYASWAAFLSDWSTANRPIIRQALLIYSSRSVSGSADFNVSLSVQGADFRTAANLDITGSTAGYPNRGEACCMWGQLPAIRCV

SEQ ID NO: 38394 - protein, 337 aa, A.fumigatus
IIISPSDTDYIDQLIPSIREYSVSNRTSQLLQSLSKFASDQEAEIEPICNTNHQEFVSSINHLLRIREGTVSLTAEILDLNQSIQASTERLAEQKKALVESRSHRQNIDETSRAIQDCLEVLRLANQVHDLLAKKNHYAALRALEELQNVHLKDVTQYKIADMIQRSVPATQRAIAEAVLSDLNTWLYRIREMSQFLGEIALYHTECRKTRLKERAEKLPYLRHFKLNSAIELVSDEHEEFDLLQNEELQVDFTPLFECLHIHQSLGQMDKFRTEYANTRRRQKELLIPSTITLVDEDGASLHNLLEEMAGFAIVERATMKRVPDLRSSVDVESPFS

SEQ ID NO: 38395 - protein, 476 aa, A.fumigatus
RGEGEHPEWEIDSSPYESSSDDSTTDSSDDSDDEDDDYPILSAEETARILMMAENGSDDEGEGKGRSGGTLRTANEIPEEAPPIPEITVTPDMKIVHLGHVESIVENTILIAANISGEYQVLESGSLLCLEDRTVAGVVSETLGRVEKPLYAVRFPNAAAIEERGLSKGKNVYYVEEHSTFVFTQPLKGLKGSDASNFHDEEVGEDEIEFSDDEAEAEYKRRLKQKRQERKEARNENGGPSRGRRGPPGPSKLSQTELNYDDSPTAEDGYTPLARPKNLHEMMSQQEAPVEGEGSSRNPAFRGGRGRGRGSDRGRGNRGRGAGGSRETREHSSHHDRSSYSQQPRPFDAQAQPSNYSQQPSYPPAQQNVYGMPQQFAPFQPFAQQPQQAFPQSASPTQFNFQMPFQQAYQPPNLYQNFPAINPLFLAAMQQQQQPQRHTSEQSQVQNPTMNFDQVKAQLDLLRHLSNANQGPPGPQ

SEQ ID NO: 38396 - protein, 294 aa, A.fumigatus
ALFFQRLVKTSIITLYVQHPVLLEPPQEKHMPGQKPMYLTPKEQAKIRRQRRMADLKEQQAKIRLGLEPAPPPKVKKSNLMRVLGEEAVKDPTAVEARVNREIAERREKHEATNEARKLTKEQRREKIAKQQEKDAEMGIYVSVYRIDSLANGRHRFKVSKNAEQNALTGVCIMHPRFNLVIVEGGAHSITNYRKLMLNRIDWTENAGPNSVREGNREASASWLSAEDEKTGALKDLSSNTCSLLWEGQAKSRSFRKWLGARVCETDSQAKDVLARAKMENFWVLAKSAKPKEV

SEQ ID NO: 38397 - protein, 278 aa, A.fumigatus
GVEIAVDYLFFQKFAIVPWNIVAYNIFGGEGRGPDIFGTEPWTFYIKNLLLNFNIWFVLAVSAAPILVLQAIFRSQATNVQTLLRTVTLVTPFYMWLAIFTIQPHKEERFMYPAYPFIALNAAISFHMILSYVGSSNPKEIIGRLSPKVKLTMVMAVILMAINAGLLRTLGMITAYNAPLKVMEPLQQLEMAQSGGFVCFGKEWYRFPSSYFLPNGMRAKFIKSEFRGLLPGEFPEAPSYSSLLRGTSQIPAGMNDRNEEDLGKYVSDDCLILVLVQS

SEQ ID NO: 38398 - protein, 297 aa, A.fumigatus
FLRVSVLENNQYGSGQKGDPVNKWLSKDEATVSQPTIASLAFQLTIRAPRSSRPVPFYLPLNVTLYVFLISNFVAAALAPIQDCDEVFNFWEPAHYLDHGYGLQTWEYSPAYSIRSWLYVSAHAGVGKIVSIFSSDKTSEFYTIRFVLAAVCAACETRLYSAICRTLNPRVGLLFLIIVAFSPGMFHASAAFLPSSFTMYTSMLGLASFLDWRGGQKTAQGIMWFGLGAIMGWPFAGALIIPLLLEEVAISFIAGTLGNLFVDIFKGIIRCLAILVRFFRLLLLRFSLSDIGRRNRG

SEQ ID NO: 38399 - protein, 187 aa, A.fumigatus
SWHCWCSSSRHGPSTTRPSRPPPTTMNSLSSAAPTWPRQTNCPPESASTRSASPLWSAPPPDASSPSPRAADTPTKTLATSTLSTSAPRQPPTTAPVRPTGSLSGKSSAPAPAPGAIRPRSSTTTTPSTCFSRGTAPPTARTARTSSPTARSPRKSTPLGKAADTCTSPSPETTATPGPSPSISPRN

SEQ ID NO: 38400 - protein, 229 aa, A.fumigatus
IPSLPQRQHGLARQTVHRNRLPLVPHPRCGPHHHRTHPRLRRGPPTHQPRLWRHQPCLQAHQDNRQQRRQSVRLGASPGSRRLRRRHLGQSDPGRRRRQHHLPVSLVERRHLQPERQGRPPRRHGHQENRLHLGRPPTPVPHRVPRRRQHLVQARRSHQGTDPGRLGMGRGRPRQRHPPHDRRAGHPRHGPQHHRARRAGQPHVERAAAVRGRGGGDDRADARREAVPQ

SEQ ID NO: 38401 - protein, 413 aa, A.fumigatus
CCPATSKMQSMRFMILALLVQFLPAWAINDPAKSAAPYHDEFPLFRSANMASPDKLSTGIGFHSFRIPAVVRTTTGRILAFAEGRRHTNQDFGDINLVYKRTKTTANNGASPSDWEPLREVVGSGAGTWGNPTPVVDDDNTIYLFLSWNGATYSQNGKDVLPDGTVTKKIDSTWEGRRHLYLTESRDDGNTWSKPVDLTKELTPDGWAWDAVGPGNGIRLTTGELVIPAMGRNIIGRGAPGNRTWSVQRLSGAGAEGTIVQTPDGKLYRNDRPSQKGYRMVARGTLEGFGAFAPDAGLPDPACQGSVLRYNSDAPARTIFLNSASGTSRRAMRVRISYDADAKKFNYGRKLEDAKVSGAGHEGGYSSMTKTGDYKIGALVESDFFNDGTGKNSYRAIIWRRFNLSWILNGPNN

SEQ ID NO: 38402 - protein, 457 aa, A.fumigatus
DPPWRIYLLYPCKHSHHRDANDDNLIVRTIQDPRQIESPPDDRPIRILASAIIEEIALHQRPNLVIPRLGHTRITPFMTRPADLGILQLAPVVELLRVRVVADPHAHRPPTRPRRGIQKDRPRRRIAVIPQHRSLARRVRQPSVRGKRPEALERPARHHPVPLLAGPVIAVQLPVGRLHDRPLRPGPGQPLHAPRAVARRAAPDDVAAHGGDDQLAGREADAVAGADRVPCPAVRGQFLGEIDGLGPGVAVVSGLGEVQVSAAFPSGVDFLGDRAVGEDVLAVLAVGGAVPREKQVDGVVVVDDRGRIAPGAGAGADDFPERLPVGRTGAVVGGCLGALVDKVDVAKVLVGVSAALGEGEDASGGGADHSGDAERVEADSGGQFVWRGHVGAAEEREFIVVGGGRLGRVVDGPCREELHQQCQDHEAHRLHLARCWTTLWWETVEEIYSHRVKSHPD

SEQ ID NO: 38403 - protein, 166 aa, A.fumigatus
  UNSURE (158),(163): Identity of amino acid sequences at the above locations are unknown.
GLDSATKGANVEVNVEKEEKEEKEEKEEKEEREERGDGRDPPITAPGVHDVNTRQTHTRRVATTARENERTATPAGETTVNGTGTVVIAATADAEISMTDHLDVTVIETCLTRNPGENEGETASATGRGKNGKEAQPPHARREPTPDLTDVPSVLTRXRRLTXVGH

SEQ ID NO: 38404 - protein, 221 aa, A.fumigatus
  UNSURE (19),(114),(157): Identity of amino acid sequences at the above locations are unknown.
VATARRVCLSISKLWLTFXAMFPFPGALRQQPMNPSRFQAFMNQSGGGSADNSALKPPNSRQARRLFVYNLPPGVSSEHLVSFFNLQLNGLNVIHHVDPCISAQISEDHSFALXEFKTPNDATVALAFDGITMEEHEPVSGAENGAPKGLEVRRPKXYIVPNGSADQEYQEGVLLNEVPDSPNKICVSNIPQYIPEEPVTMLLKSFGELKVFTTRLEGQIS

SEQ ID NO: 38405 - protein, 153 aa, A.fumigatus
QRDERRERGGERGERGERGERGERGERGERGERRRSRSPHYSSRGSRREYEADSYSSSRDYRAREREDRYSSRRDDREWDRDRGDRGDRRRRDFDDRPSRRDRDRDLFDEKPRRERGGDRERDRERKERKRSTTPPRKEGAYTRPDRCTICSD

SEQ ID NO: 38406 - protein, 445 aa, A.fumigatus
LFRASRWHNVPESDEWRCVLHGRLLSLKQDPQYLYYRTYRSLISQSTTTPRIQPSSSSSPRAESIGAVNGPHGEITQMGSSNDFHDDETLELLKHYLNLSSNLTDLYTQWSSQDPNFKKKAPQFTGIRILRQDAWEALVSFICSSNNNITRISQMVEKLCVNYGPLVATVGDRAYHDFPPPEALTADDVEGRLRSLGFGYRAKYIHQTALIVAKEREQGWLDSLRNPESPVLGVQPVPGDEMRPEGRQGYRHAHEQLLGLQGVGPKVADCVCLMGLGWGEAVPVDTHGERLSTCLLWITYVNSLFLVWQIAQRDYKFGRGAHKSLTKATYDAVGNHFRKLWGKDAGWAHSVLFTADLRAFSDRLAGASGKIDVKVAVREEGEDKESVKVETEVTTSTAYALKRPATEKLLESKDMKEESKGNEKAVIQASQTTTTRRMSKRLRNR

SEQ ID NO: 38407 - protein, 183 aa, A.fumigatus
GSLFFPAPRVRRHGRTASGMHGKGEDGVGARGDAGSPDASNGSADDQGHGVFGDGADQRSNLEEQDGGEKAQLEGKVAVDLAPGALEGGERQKEGGPIPPDIRHRVELVGDPGDRGGHNGGVERDEEDGSQQTGHDDTEGEARGILHLLLGGRVFAHDGIIGRATQLLLRLFDRRTGHNGRCQ

SEQ ID NO: 38408 - protein, 324 aa, A.fumigatus
FTDPIERLSWSPNRTIKVVRRPKSGYVSICLRQCSVYVSECSHQQVCNPRPQAKLTSKRTMAPGLLENNTLSGTAAPRTEFKAIVNDLRELQAHVQRVQSAIEAPEVQSWLNEQLHHPDQLPDKELEQLALDLVDSMDKLQLQLVPSVSLLTDGFFGKRGVLQAHGVSVLTVCLEAISTVRRSGPSSKRKWQTDWRKTVPSLYQRSVCGAAFSPSGSPSCWTPSSAMASSPTIRPTTPTATTVHLSSSATTTGPSGTSGPICTPTSSSTSAAPCPRPSDSARAAPPPRSPTAPTSTSSSTSPRSRSWQSSRRHWARAPSRKPAA

SEQ ID NO: 38409 - protein, 183 aa, A.fumigatus
IIPGRRSAANPSWTSAAGPEHSWPRCSGRIPTLRGSVMDIQSVTELITPEFREPHGRFSDIGSRVQQLVVGDFTKQIPPSAVYTMKWCLHDWVDDDVLTILKNVRRSIVPSSVSRFLVVESIKSPGRSGRLPRYGDLIMMITCNGKERSLKDWKRLGELAGWKLYQVHRVRRAWPCIIDFRPM

SEQ ID NO: 38410 - protein, 193 aa, A.fumigatus
QGQKPQILYAPTLANFTNHYQFLDCSTLVRMSERPSDLVVNRLVLFVVKGESSRRISKSPLMQSTTGTATSTHNTVKPLILLEELGVPHDIYVVEKVSAPWFSEINPHKMVPAILDRSPDGRDTLRAWESTSTLMYIADAYDKDGTFGGRNVQERSEINNWLTLHTAALGPTAKYWLYFYKLHPEKLPKTIEK

SEQ ID NO: 38411 - protein, 192 aa, A.fumigatus
DALDRRRSASGRPTGGKRSPACINARSAVRHSARAARPAAGHPRQQWHLRLQSGRRHLQQQPCISPPLPRPLDPVAPLGRSVPQRVLRRQPRHAPGRPTRREPHRRPDRLRHRPRPLRVPRQGAEAGKVPEDTGRGRRRASPRLDSRLSLGGDRQRTHPGHRRRVRSIPGLGAPGASPPSGGVSWISSRSLS

SEQ ID NO: 38412 - protein, 143 aa, A.fumigatus
LCIRRRWGPRPSTGCISTSCTRRSCPKQSRSNSGLSHLPGNSLSNMGCRLRSNITVQYDILERRLNEPGQQYLALKDRPTIADIATLPFAMKSTAELFGLEFEKWPKLQEWSVRMGEREAVKRAWQRVAGFGHGEKEYGMLEA

SEQ ID NO: 38413 - protein, 213 aa, A.fumigatus
AGSPPSTWSFRTDSVSRGYLNSKTLWTVVEAQVADRLAENGPQPVSTLGLRCGIQPERLAQLLDTLVSNGIFAYNPADDTYSNNRASLLLCHDHWTQWHLWADLYPNEFFDVSRAMPQAVRLGESRTAAQIAYGTDLDLFEYLAKEQKLAKFQKTLGAGAVAQARGLTVDYPWEEIGSEPILDIGGGSGAFLASVLRAHPHPPGECHGYPVGH

SEQ ID NO: 38414 - protein, 211 aa, A.fumigatus
VDIDAFRAVCLLLLSPVYHYRHVKSSSLLTSTIMSRPSIEESKQELSSSPNDSVMGKDPAPEEEMQYPSGFALSVIMAGLLAAIFLISLDTTIVSTAIPRITDEFHTVADIGWYGSAFFLTLASFQGTWGKIYRYFPLKLSFLAAVLLFEVGSLICAVAKNSVTLIVGRAIAGIGAAGISSGSYTILAFSVHPRRRAAMTSYPRGWKEERS

SEQ ID NO: 38415 - protein, 240 aa, A.fumigatus
  UNSURE (63),(69),(71): Identity of amino acid sequences at the above locations are unknown.
AVAKIDRETIPWSPCLQNAKSMQHGESSVVKTLMGGIWYFAYGSNLRLSVLENRCIKAMDIKXVIVPRXYXTFDIFGIPYAEPSFASVAPFAREKKTTLRLGDSPASRDVPPVQGLAYLLNPRDYRQLVISEGGGVAYDEVEVHASILDKDGKPDPGATLIARTLQAKYPWRPNGAPSARYLVSGPGTESCSAILIGNRASSRRGANRMSRSRHTATILIPYRPMSRRHPSMPRWEVFFS

SEQ ID NO: 38416 - protein, 137 aa, A.fumigatus
NPGGILLISSRPMLSWTLKRSTSTTRTGSTERNTILDGSSVSTSLMYGRRPQFLVSTSLTLQVRHNMWRFGFGPRQCLGKHIGERMLKAIVAEIIRQYVISISADSALKNDLQEDSWVGLPATRIQCVPVGREVEKN

SEQ ID NO: 38417 - protein, 812 aa, A.fumigatus
FPQRPVSSLLSHFENLSLRRSPSAFTATSPHDSTPFLRTPEPVDEVRSARASLDLPRAQSPWNATGKPQNAQRYDRTNGGFSRRSGSPGRSPGRRQSRPMSMNFHSPPQLAPTLTVDSPRSPPRGFGSQNHTERTINSRMSRSPPDPSRGSLPPPTNRPTTPSSSTFQHLPGHLSPAHSHSGSFIGESPPDRKQKSSSLPPPIDRAEKPKVPAKPAALASLEGATLALKPEKTTSEDRISPFSTPPGSPEKPSVKPSSCGRPQMPRSPSRPVTEPPSRQSFDDRGPVPSAHALRDARELGFSRRRPIPEPTRDMKPLMVQVPPHSMKQTEPLSAAPLSARRLQATDAPTEPPSLPPRHSSLARRSGASPSRPSPHLEGSSHPEPSPRPQSFQPPPRENQTPLQIHRQPSFSRDAKPGQASSVPERQLARADTFGQDPVDEPAISRTDYPDASTTNRRPPLLKNGPREIHTRYDTRLMDVCGRHVCTTGYLTRVWDLTNGEQIMSLSHGETVKSLSIAFKPGTGLEDEGQRLWLGMSTGEIHEVDISTRSIVATRFYPSRREVIKILRHKKEMWTLDDEGRLLVWPPDESGTPNLQYSYHNPYDRVARGHTFSLVVGDTLWLATGKEVHVYRPNARDDVSFKVLKKPLGSQHTGDVTSGIYTTRDGGRVYMGHADGKVTVYSSTDYACLAVVNVSVYKINCLGVVGDYLWAAYKTGMIYVYDTRTNPWIVKKDWRAHDGPVSSFLLDFSSVWTMNRLQVTSLGDDNCIRLWDGMLEDDWLGKLIFCRSDGRKAKTNVNRNSHAEQRCRILQVP

SEQ ID NO: 38418 - protein, 106 aa, A.fumigatus
VEVWAASRVSFADSSIESLLLGSKKKDGGEKEHMSRQYRVWMEHLTRCINDCMPLEESYVLLHSANLIGLFTCVFVKHKERQRIKNIGAAEVKRGMGGLHGNKVRI

SEQ ID NO: 38419 - protein, 236 aa, A.fumigatus
GTALILVRLLIAQGALILRFILDDSSLCFVNCHLAAGQSQTAHRNNDIAAILESEVLPVENSLTTRANHFVSGGDGTMIMDHEICILNGDLNYRIDSIPRNVIIEDIRNNNLAKLLERDQLLASQRKNPGFRLRSFTEAPITFAPTYKYDVGTDEYDSSEKKRSPAWCDRVLYRGLGRIKQLDYRRHEVRASDHRPVSASFKLRVKTVLPQERAAVWESCQQEFQKEKRRLASEAR

SEQ ID NO: 38420 - protein, 87 aa, A.fumigatus
YSAGPMDEKRKLTSTETRMQSRDVEFCKFREISAAIVTWNAGASTPGSVRSSNFIQEAIHPENPPEILVFGFQELVDLENKKITASE

SEQ ID NO: 38421 - protein, 69 aa, A.fumigatus
QARLLLGTCHRRRFCLLVLNQIKNNVPLGTLFHVKLMIRSGLWNILFNQAFETIGFSRFRMYKSHSMRV

SEQ ID NO: 38422 - protein, 182 aa, A.fumigatus
LIWTFIIPRKGNMSTVILGGGIIGSSIAYYLSENGSSDEIHIVEASSQLFSAASGYAAGFLAKDWFTPALASLGELSFNLHQSLADKNGGRQEWGYMKSTALSLDFSKNNNKRGASGDDWLSTGASRAEAATSSSSPVHVEVPAWLTKQKKGIIEKISDDDTVAQVLVMIIANSATWRTDGI

SEQ ID NO: 38423 - protein, 298 aa, A.fumigatus
LLRTLPHGELTAFRDPLRLARFLMESSLSRGVKLHNPAKATSVITDQVSGYITGVKVMNLDAQTECTLPCANIIICAGPWTPQVYHELFPLSRLPIPITPLAGYSLVVRSPRHTLQDERVTYANRSHAVFTTHPDSCGFCPEIFSRQGGEIYIAGLNDTHIPLPAQAGDSCKLMDQNEMRRLKKAAVHLMGAQEEGNVESTDGIANRNDLEILREGLCFRPVSAHGVPFVARIDDHLLGGPKTGSINRCENGITRGGVFVASGHGPWGISLSLGTGKVISQMVEGVEPDVDVGGLAIV

SEQ ID NO: 38424 - protein, 134 aa, A.fumigatus
SFLPNQVTPDSFYCRLITMANYLASIFGTEQDKVNCSFYYKIGACRHGDRCSRKHVKPSYSQTILMPNMYQNPAYDPKNKMNPSQLQNHFDAFYEDVWCEMCKYGELEELVVCDNNNDRKCYVANQALERTIAN

SEQ ID NO: 38425 - protein, 113 aa, A.fumigatus
VHNADLIGNVYARFKYEEDAQAACDALNSRWYAARPIYCELSPVTDFREACCRLNSGEGCVRGGFCNFIHRKDPSPELDRELRLSTKKWLKERGRDPRSASRSPSPEPTRRRY

SEQ ID NO: 38426 - protein, 66 aa, A.fumigatus
LRKIYFSTQALLDFTHILFFVFLSETTLLYYVRHHISTLVEMANYLYSSTHVTLSWPVKILPRGLG

SEQ ID NO: 38427 - protein, 61 aa, A.fumigatus
  UNSURE (54),(55),(57),(58),(60),(61): Identity of amino acid sequences at the above locations are unknown.
DFYSLFCLLDLSAAVDVYSDWVDACDAVAKDTASKFDGDDDVLAVHSQEHSFPXXLXXQXX

SEQ ID NO: 38428 - protein, 69 aa, A.fumigatus
RLVGGSATLAVETLKAKGVPEDRILFLNLIASPSGVADFAERFPNLRVVTAFIDQGLNEKKLVEISPSG

SEQ ID NO: 38429 - protein, 143 aa, A.fumigatus
ALKSYGEAYPLTNCSMIRDKNTSRADFIFYSNRIIRLLVEEGLNHLPVVERSVTTPVGREYLGVRFEGKICGVSIMRAGEAMEQGLRDCCRSVRIGKILIQRDEETCKPKLFYEKLPLDIANRWVLLLDPMFATGASGPVFSI

SEQ ID NO: 38430 - protein, 62 aa, A.fumigatus
SGNRNKRLSKGKKGVKKRTVDPFSRKDEYSVKVCRRGLCKSTAANLYQAPSTFQIREYVARI

SEQ ID NO: 38431 - protein, 183 aa, A.fumigatus
LNYSVGKTLVNRTSGLKNANDSLKGRIFEVSLADLQNDEDHAFRKVKLRVDEVQGKNCLTNFHGLDFTTDKLRSLVRKWQSLIEANVTVKTTDDYLLRLFAIAFTKRRPNQIKKTTYARSSQIRAIRKKMIEIMQREAASCSLAQLTHKLIPEVIGREIEKATQGIYPLQNVCDPVILTRDED

SEQ ID NO: 38432 - protein, 435 aa, A.fumigatus
SRKQKGGLEEQLGDGLDSAVVFTVGLNLLLQLLDDGGLGRDLEGLLGGHVRAHGGVTQSLSLHDTLHVGGPAELASTDSARRADELMGHDDLLNLVAKNVLEALSQVLVLLLLLLALSLLLLGLLELEVLGDVHQLLAIELLQLSESVLIDGVNQEQNLKVLLLEAVKEGRLCNSLDRLASDVVDLLLVLRHAGDVVGEGGGLVTRLGRLVAEQLGKSLAVLSILVDTELDVLAEGRVELVELLTILGNLVEELQSLLDNVLLDDLHNLVLLESLTRQVERQILRVDNTLDEAQPLGDEIGGVISDEDTTDVELDVVLSLLGLEEVERSTLGDVKDSAELELTLDREVFDSKMVLPVVREGLVEGGILLLGDIRRVAGPDGLGLVELLLLDLALLHSLGLLLLLLLLLLVIDLLDLGLLLLIRLHHATGRIRASR

SEQ ID NO: 38433 - protein, 517 aa, A.fumigatus
  UNSURE (384),(388): Identity of amino acid sequences at the above locations are unknown.
VASNVRVGSGKTSLIKSIVQACEDIVHVDPFPSLSPSNLPARAQPPTTAAVISEIYASTKPYPAWWSDLEDSRVLRRRKSSGDIVLERNLCFVDTAGNGLTRVGQTDAIIHHIQQQLLRATTAVTSSNTDFENLLAGNGGAQVDAILYLISESKWSTLSYLHCSNSADLQDTLDEDIECIRKLCVWTNVIPLISKSDLLTPDQIATLKSSFHAKAQMASIKPFHFGDATSAAADGFSSHSPFAVSSAKVDDEDVMDASTLMSPDYVQPLAPSELSLLVKKLFDLDNMAWIRHSAAKKLVQRQHDQGPQWEVSRHSTNPFDGQSTVSRCTSSIFSASYLEGTMSPPSGRFPSYTMARISDYTQREEKMARVQLAKWASDLQRSLXNERXRYAALARGERAVWLTERLGECVVDGSLVPITKTPGFCGLRFPMDNAGGRLFVRTQDGKNMEYRVTSISPHDPLGIVWWSDDLKQRGWAIVQIVGSLGVVGGLAFLLARTWGLSSRSLSEWRFDCCSTCN

SEQ ID NO: 38434 - protein, 453 aa, A.fumigatus
SAYPASRVVKTDEEKKAKIEEVDDEEEEEKKKKKTKTVKESKIEEEELNKTKPIWTRNPADITQEEYASFYKSLSNDWEDHLAVKHFSVEGQLEFRAILYVPKRAPFDLFETKKTKNNIKLYVRRVFITDDATDLIPEWLGFIKGVVDSEDLPLNLSRETLQQNKIMKVIKKNIVKKTLELFNEIAEDREQFDKFYSAFSKNIKLGIHEDAQNRQTLAKLLRYQSTKSGDEATSLADYVTRMPEHQKQIYYITGESIKAVAKSPFLDSLKQKNFEVLFLVDPIDEYAFTQLKEFDGKKLVDITKDFELEETEEEKAEREKEEKEYENLAKSLKNILGDKVEKVVVSHKLVGSPCAIRTGQFGWSANMERIMKAQALRDTSMSSYMSSKKTFEISPKSSIIKELKKKVEADGENDRTVKSITQLLFETSLLFPASPSRSLPASLSAFTSSCLLV

SEQ ID NO: 38435 - protein, 75 aa, A.fumigatus
KRPHCQVHHPAALRDLPSVSGFTIEEPASFAERIHKLVSLGLNIDEEAETTEEKATEEAAPAEATTGESAMEEVD

SEQ ID NO: 38436 - protein, 67 aa, A.fumigatus
SCAFKTDFYPVLAIMMIGHNIYINYLSTPLTALYLPKSETSHGQAPVDDTIRIHPWVMHHFDRATAG

SEQ ID NO: 38437 - protein, 420 aa, A.fumigatus
LQILPNSVIRAQKLCPSHHGINPYIVANICSLIRKEVTEHLDVIDWYSDNLDQSHVRLVRALQSMQGMWSLVPLGTRPPPIAPAPYQENRCEACILARVVQEPMFLQNLRVALISRTRTRSKHRAPRLLAFIDQAINYYGDRALQYWHASGQAAFDFKAARKAAVRAYKKRPQRIHRREDYTDHLRKHPKNKGRSIRLEPGQRESAGFAEAPGYVTSQRSSDDDGDDMQSIVVYMDHSSAEQQGLYRNASQRARVHSHHAEIVNERDTVADEIIATYEAFGARDWAPRSTTNLPAGVPPVHPLSVPGADHSVISASRYDEDHPMGEPSYMPPRNNSDWRSAGNGAALGTLEALSKEIGELALGGPPGEDTEELADRYCELLSPVAYHSDSEYSETSWMDDPVRDAGPGDTTWDLVCKESY

SEQ ID NO: 38438 - protein, 199 aa, A.fumigatus
QFTVTFHSRHHRLYVPYAFGALYNHPVEGFLLDTAGAGIGFLVTRMTNRQAMWFFTCSTIKTVDDHCGYAFPWDPLQHFTNNNAAYHDIHHQSWGIKTNFSQPFFTFWDRLFNTKWEGDVKLRYERSREAAQKQVDQDASSAAASSNEENSYEGPVVSPDAPADSNARARLRRKTVTLSPHVDSLKGVNHGVTSSVLQA

SEQ ID NO: 38439 - protein, 110 aa, A.fumigatus
  UNSURE (5): Identity of amino acid sequences at the above locations are unknown.
IVLPXSLLKLSMGSLIYWYFIPAVQFTVGVFIVDTWQYFLHRAMHLNRWLYGMYFDYEALVTRGSPTNSLQSLSTLAIIGFMSHTPSAPSIITRWKASFLILLVLALGFW

SEQ ID NO: 38440 - protein, 117 aa, A.fumigatus
VFNTFMYQLTHGATEAAGRLRSMRKMLFIAILHVTESCCTNMWTMHSWSFVLYNELYLDIFTQCNVYISQLDFPKLRNCYRNKASNILPSPLISLAFGVQPMIFLGTTPKNQSPNRP

SEQ ID NO: 38441 - protein, 75 aa, A.fumigatus
VRVIRHWAQQFAVSVRKLFGVLARGSSKRQFPDLLRQGFQGAEGGSVTGTPPVRVVARRHVARFTHGVVLIVARR

SEQ ID NO: 38442 - protein, 311 aa, A.fumigatus
QTPAKIAISKFFDGEGPDPVEEARAALNNPPPPRPIRQTRNLMSDDLSTQLSPAARASEPAPRIVTQSEDHSVYRPPFLLALLFTPFNIIYRLLCTSFRLFSSLFPFLPRLLNTTANPALQGARGHNYGRRPLGPQDTAARFIREFEEEYGSNAVGFLENGYNMALEKAHRDLKFLLVVLLSSEHDDTNAWVRDTLLSREVVEFIKDPQNEVIVWGGNVQDSEAYQVSNSLRCTKFPFAAVIVHTPNVSSTAMSVVCRISGTTSPSEFVEKLRAAISQNKEALERIRASRADQQASRTIRSSPRGWKIRVQ

SEQ ID NO: 38443 - protein, 98 aa, A.fumigatus
TRADTQLPAQIDYFHSLVPLDLNHQKNATIFGFPSWVYKAQSSKDGNYYALRRLEGVHPFIPHLYTAKSVKAKWLSRLSVDEREGDSIRPGLEAGVQW

SEQ ID NO: 38444 - protein, 85 aa, A.fumigatus
MLLLMILTLIPFILLLFPRLSDNALDIAPPLKADPYHLWNLFGLVQEGANADLVYGFQSLIARFRLLSKEMATALSHLRARLILS

SEQ ID NO: 38445 - protein, 207 aa, A.fumigatus
KVCIPSSLICIPQSRSRLSGSPGFRLTNEKAIRSVQAWKRVCNGSVVTVHDAFTSRSFQDSSLIFVTDYHPLSKTLAEQHLGAGQQRFQGRHNVQHIPEQILWGYMTQIANALKAIHSNGLAARVIDASKILLTGKNRIRLNACAIMDVVQFDSQRTVADLQRQDLVNFGQLIVTLGANSPTVMHNPTKAMEHFTRAYSPSSPPGRK

SEQ ID NO: 38446 - protein, 77 aa, A.fumigatus
MKVGTFFFSTSSPEIKSPRNHIADIGVLLDMDVDTMSVKHTQSRSKKPGRVQKRKKARSSIVFQTHPLKTKKGSRRK

SEQ ID NO: 38447 - protein, 109 aa, A.fumigatus
LRHFDINSLIRSGAALPFTAHASSPTVTMPRLKAMTTGSVPSFLDVILNIAESDTSSTLAYQDTWLAQIKAQGGQLVMYGDDTWIKLFPGVFDRCDGTTSFFVSVSHNH

SEQ ID NO: 38448 - protein, 153 aa, A.fumigatus
YRSRHMMTKQREMDSIVALIYAAMEEQEHLQSTLFVLCGDHGMNDAGNHGGSSPGEISPALLFISPKFQTKTTPEDSPVEAFSDLQYYRTVEQVDITPTLAGLLGLPIPLNSLGVFIPEFLMMWDNGIVVSFLLSVTYLKTDMLPLGSRCSQN

SEQ ID NO: 38449 - protein, 431 aa, A.fumigatus
DSGFDAEIISTDGPSIQADIPRDAQDAKPRFSTTTLAVEGMTCGACTSAVEGGLKEVRGVKSINVSLLSERAVVEHDASVITPEQLADIIEDRGFGATVLETSTPQDVPRGSLEDADATSRLMNTTVSIDGMTCGACTSSVQSAFDGVDGVVQFNISLLAERAIIVHDPTVLSAQQITTIIEDAGFDATIIASEPKLSTSSSMNSVTLSLHGLRDVVAANDLEDSLLRRPGIYSASINMGTYKLAISFDSAKIGIRTIVEAIEAAGYNALLSESDDTNAQLESLSKTKEVQEWRHAFLFSLSFAVPVFVLNMLLPMYLPKLDFGKLPLCAGVYLGDVLCLLLTIPVQFGIGKRFYVSSYKSLKHRSPTMDVLVMLGTSAAFFYSVFIMLVAMCTMAEKRPRTVFDTSTMLITFITLGRWSSPRGWKEPRMR

SEQ ID NO: 38450 - protein, 101 aa, A.fumigatus
APDNQAQMDQIHTRAIEALQPFIHLANSNSATSPRFIANLITNATSNPHTYVFAELLETPTIQALRSPNTPEEFQGYLTLLEIFAWGTWQDYQSEHASPSN

SEQ ID NO: 38451 - protein, 333 aa, A.fumigatus
ALSSSEAFPADISSVWFSLVLTLIDRLTHTVPSNGLQRIVKTWKGPADSLAALSPWPKDFSQGIVPVQCHSHNDYWRSVPLYEALAAGCTGVEADVWLEGSDLLVGHGKRSLTPDRTLRSLYIEPLTTILSNLNADSSANSSAGVFETDPTTSLTLLIDIKSDGNATWPVLLDQLAPLRSGGWLSHWNGTSKTLVNGPVTVVGTGNTLFDLVLAEEDRYVFFDAPLDELAQNSTYTAENSYYASVSLQKSVGVVWPWGPTDNQKQAMQKMISAASERGLLARFWSIPSWPVSLRMRLWRFLVDSGVGMLNVDDVVEATRWNWDWCIVAGLVLC

SEQ ID NO: 38452 - protein, 161 aa, A.fumigatus
RNSTTCSFLKMVASGPEAFAINFSNRFTLSNMTGSFPPHLVDDIRSLSNSDGYAVKEELLKRGVGAAYAAYTVPYPLQSGPTKYAPMAKEPGSTIPVKTKAPAPQFTASVYTIATTRLPPATVQATLSASATYSIVSVENTVSGLLDGLDNKRASSDRHFP

SEQ ID NO: 38453 - protein, 119 aa, A.fumigatus
IRSCLDLYHIQLLLDYCVLHETYILNMNILQCLFTLLLLPCTLADVDFTVPTIGTNFKGGDVVTVHWCESGQPPRISELSQYDLSLYAGGDKADTQVSSWALQTAHGLLLTEREPTSMK

SEQ ID NO: 38454 - protein, 98 aa, A.fumigatus
SSFLLALLALVCGGWMWTRDPNIFLAYRYKPAFSSPARVDVLTGYIFQALAAVGQCRLMSLWDGLFSHLRLPVAQILLTRNDIADVRTHSLQLWTKDI

SEQ ID NO: 38455 - protein, 282 aa, A.fumigatus
SDKTHKEIKFGDNDTLSAITAAMVKADYLFLMTDVDCLYTSNPRHNPDAKPIEVVSDISSLEADVSSAGSSLGTGGMSTKIVAAKLATSAGVTTVITKSSKPGNVLEIVKYLQQSQRGILGQSSTVETTPSESQSPLSPPLHTRFLPSDTPIQSRSFWLLHGLKPRGSLYIDHGAYSALLNKASLLPAGVVGVDGHFGQQEAVRLVVVERLSPDSLNGDFLHHGQEPREVGRALVNYGSTEIARIKGHRSTHIYSLLGYADSEYIALRENISFFRSDDSVRQ

SEQ ID NO: 38456 - protein, 65 aa, A.fumigatus
IGTSSIVDENTHEPILSILTLIVETAAKLRRDGHNVVLVSSGAVGVGLRRMDVDERPKYLPRIQV

SEQ ID NO: 38457 - protein, 60 aa, A.fumigatus
ENGNLTAKASRPMEMWWRHDYSVEPAVVGNKLELQLFCTTPYVEDGAHFDLILFLKLLLA

SEQ ID NO: 38458 - protein, 248 aa, A.fumigatus
LESKTSRLAKATQTTHTSQTSTSAIVSLPPSVPTASNRYRSVNDYSVKDVSKNPVRYRLKDTPGHGKLREAQGLSELVSMATAKDKKLKLRAVIFMVDTAALTEENTLRDTASYLHDVLLALQKRALKRGKSSAKVASEIPVLVAANKQDLFTALPPGSVREKLETEIDRIRKSKSKGLMNASEDTATVEDEDDTLGSIDAQDNFSFRLLEDEVGVKVDVVGGVVKGDEEGNIGAGVRRWEEWIGQCL

SEQ ID NO: 38459 - protein, 297 aa, A.fumigatus
TLILTFTGLLRGGGNNFGIVTKFNLYTIPSSEMRGGTRVFAEDQFSNVISAFVSVVNGASDDGNAQHWVAFVHTQGQNVAAAEITYVKNVSEPVIFAPYRAIPAVQDTTAARTLVEYCDAVQELNPDGLREMYWTLTLHLDEDFANWVTGYFYSVLPQVLSIQGINPALVNQGITIPMLKNMTRNGGNALGLDASQGPFHLLMMSIWWENADDDDKVLAWAKDFWETVTAKAKKDGVFHDYVYMNYASQYQDVIAGYGAANKAKLQSIAARYDPKGVYQTLQPGYFKLAGAPASDSL

SEQ ID NO: 38460 - protein, 75 aa, A.fumigatus
YQSYFMCSTDEEYISAFIGYYYYLTFQSVILGRYNPCTNNGYNMPQCSHIKRFLIYRWVFIHINQVNQYIMHVYT

SEQ ID NO: 38461 - protein, 269 aa, A.fumigatus
HPPLRFFSTPSLILSALWCSMLRLPAFLGVICAFALGQTSKASSSAFEPDNFDVNAALYNLGVGCSTIPALKALQPQFNQNCLVVQLSVTSIGKSRTYIRRTDVSQCGALGFLYGPSRAFAQNTTAYSNATGSYWSAQQEEVRPDCIFQPSVNTDVSMIVLLARYTGCPFAIKSGGHAAFARASSIQGGITVLLKDLNTITLNDNRSVVSVGPGNVWVQVYSALEPYGLAAIGGRVSTIGVGGLTTGGGISFYSNLYGWACDNVESFEV

SEQ ID NO: 38462 - protein, 157 aa, A.fumigatus
RYSSILTGLPAGTYGSGNNWMESEWHVQNSPFPNLYWATTSWNMGAAFWPLIFVPLTESSGRMPGYFVSYIILVATLFGSAFAHNFATIVVTRFFGGGASSVSINIVGGSISDVWQGGKARSLPMSLFGFTSVIGIALGPFIGSAIVQIKKDDPWRW

SEQ ID NO: 38463 - protein, 233 aa, A.fumigatus
  UNSURE (24): Identity of amino acid sequences at the above locations are unknown.
TCPVPKVCLSVWLQGGGKKPQGLXHLDLTSPSICLSYYMTLFLELFIAIMKEYQQDHRADAELLSSFAAHMNFFSAKSSPTSQASKAAYMTSLCTDIALAIQMLDDGFPQQTALSRPNSVPDSPGLTTTSTASTFGPEILESSSWPAGIPTSYIGDPSWELSSFATDGNLNMKMHETQAKSYEQYGLSAESTPTAGFAYRSDLAGMGSMEFDAMLDTFASYDHVGALLHSDRI

SEQ ID NO: 38464 - protein, 99 aa, A.fumigatus
DSRQIPRSESRLLGFSHRCWQVSLPHRGMWINDRGCWTVSYHIMYSLGNRVTKHSPTRGYSMVLRAAMTVRLASWLGLVSTMQCIPGAVVGVALVNMDL

SEQ ID NO: 38465 - protein, 93 aa, A.fumigatus
LPSGPICMHNNPLWVPPYKIQTSLLHWNNMHEHKLHAAHNPVDQAFISLQSRAQRSGVTTVRRLTQIDLNNFISKHPPPIVAKLLDPTVITPR

SEQ ID NO: 38466 - protein, 192 aa, A.fumigatus
IYYCMLVLAIVGAGGIYTGTNPSYTTRELVHHFKAADAKFVVSEPEIVTSILAAVKERGIPEGNLLIFNVLGQEVPAGRRSWTDLFSHGEEDWVAFHDLQRAKETTAARLFSSGTTGLPKAVTLTHHNLIAQHELVFEAHPRPYQVSRITAMPVFHRRRGLCTRRRHQNRAHHLHDAPLSTSNRTWCGTRNT

SEQ ID NO: 38467 - protein, 70 aa, A.fumigatus
  UNSURE (70): Identity of amino acid sequences at the above locations are unknown.
TFFFRLLIDTPSKLARCVDHVPVIFGEIVPQSICVRYGLPIGAWMAPCVLVLMYIMSPVAWPLAKLLYSX

SEQ ID NO: 38468 - protein, 99 aa, A.fumigatus
FPSLRRTCVCPLRTPSPPTNTRPPHQPTVPIPQVQPGSPSPRPEGNSFLHCPPYPWRAPCACPSRTPSPPTFRNTRCPRLPYATARIPSRKRQHLGKEE

SEQ ID NO: 38469 - protein, 900 aa, A.fumigatus
  UNSURE (417): Identity of amino acid sequences at the above locations are unknown.
MGDIHSGPVSGPVLLLVSQFHPPKASLDRRTFTRSRLPVAGASLVILDTRVVFPLPPAHYLSLLFCSLSLSLSLLLLSFSAKSSHITIFQSSKAIIKQILTRQSRYLHIKESHQGATKRFSSLGNISKDKNLVLSNSFPSTTLPSTMTSHVEMYFLYGEAYDETAPVTRVEAWISQFAYADLTTGAALSFALVTLLGVMALFWEDLAPWISAVAKRLVSPILAVVAAASSLVMQLVSIRSRQELGTIVQGWVKQPIVDCRLVRLVSAVVSWWFPSNQPLTTVCRLAGSFVCGMTAYVWLFFPLSQFLSGFAGGLVTETKEMSLYCMGIHGRWTVASRLTWRQWGMVAFCNGEETGLELRAIIEDDWQLPRLFDLDGEIHHLRILAFVVASVSLAITAAWSFRALSETALFARVVVVXQQPSSPGQRADHVAGSETQLSGSSINRRQDDLMNLISRYEGILSEKERLLSATTQKLRATEQRLEDGWAQAKRLAALHVKRDEETRARESTDVAQLRRKLAETEARLSLAHGRARAVEDDATARVRSLCNQVAELEQQLQAQREQAGNISLGEVHSLRAELEVRNDQLVAVEHRLAAAETRERDSRGRANDSEAERRQLADRVHELDAQAQELTAQNEVLQALCDSLSRECGSLAAIQRERDNAFGLISALQHELVSTRATAETAFRESQESLAQTRAAESTLRQSMQELRHTCDLTLAQERAASARAQARASELGAEVEDLQTKVGLAMRDAQRAQERAESAERTIGILQTRLTRHEDAARGALQEIPKRQIGNLGSISTALAESEVKVAQQQAEINALRCQVEQFKLQGPSGPIDKAVQEDVQKLRAALDRVRRERTEDQLRWDKRVRELEEDNRKLRVSLSNAEAASGRRPGGRRPPTLP

SEQ ID NO: 38470 - protein, 272 aa, A.fumigatus
  UNSURE (268),(271): Identity of amino acid sequences at the above locations are unknown.
RTFSTNSTDTALSPHDDSVAMQEKSTTIAAYAAGASLAAVALFYVFGPNYTIDGDDSNDSNRKKSIVGLSNPANDCFINSVLQALAGLGDLRVYLIRELHRRELDGPDVYNSLPEANETPRGMTPERIRELQQGTITRALKEMLDRLNERPIYKKTITNRAFIQALEYAFRTRISRNQQDAQEFLQIVAERLCDEYHAGLKARQRAQGLPATLPGSGGEESVQSSAVEKGSAEIEVRIDDGTEMGLPAIIDNKLKEIDKRLHHGGRPXRAXH

SEQ ID NO: 38471 - protein, 107 aa, A.fumigatus
GVGAVKSRFVHIPFFGRHSHAIVVQIGAPLVEEGSWVKDAPKDAYILGLKELPEDDFPLEHVHISFAHCYKQQAGWEKVLSRWPRGGGTLLDLEFLTDETGRRVAGG

SEQ ID NO: 38472 - protein, 84 aa, A.fumigatus
NYLGLLCVTYWGRLTLCTGSALAIKNWAWQLTHPEGEPLPGETPYANQDLLIESVKESLESGKKLSGRPPKVLVIGAVSVHLMS

SEQ ID NO: 38473 - protein, 68 aa, A.fumigatus
SSFLGGPFREIVEDADIFINCIYLSAKIPPFVNTETLSSPNRRLSVICDVSADTYVSLWTLEEKGRSH

SEQ ID NO: 38474 - protein, 102 aa, A.fumigatus
HSGLVLLRTNPNNPIPVYSITTTFDKPTVTVPLPELAQGPPLSVISIDHLPSLLPRESSEMFSEALLPSLLQLKDRKNARVWKQAEDLFNEKVATLPESMRA

SEQ ID NO: 38475 - protein, 123 aa, A.fumigatus
  UNSURE (8): Identity of amino acid sequences at the above locations are unknown.
WIACPASXRGRRSEPLHGTVIDLFDQWIKKSPERVAAEWQGKSLTYGALHDASLHVSRALLLAGVLPRARAPLLTQMSLEILPPVIGILRVGSCYVPIDVAAWSRVRIEARALRAGLPGSGHH

SEQ ID NO: 38476 - protein, 85 aa, A.fumigatus
LGSGTSLLKGGPASLFIEYLISSSILWSVLQCIGEMAVVYPLLSAFVQWTMIFIIPAAGFALGWGYWFSYWITITNELQVQITTL

SEQ ID NO: 38477 - protein, 84 aa, A.fumigatus
SFINGFEGFITILPTCVFAMAGSENAALVATEVANPRRSVPKAVTSTWLRPGLFYILGSLMITLTVDPKDPNLFGGFGSNDSPL

SEQ ID NO: 38478 - protein, 119 aa, A.fumigatus
GDEGVQSWQGPNLRAWFGCWISQQSYINSKKNIKWNGERFYRTGDLARTTEDGQLIWAGCADSLVKNRGFLINMETEVEPAIQAYPQVNLSVAFQWRDRLVCCVQPSTVDVGRTTQIYA

SEQ ID NO: 38479 - protein, 98 aa, A.fumigatus
REQVQYAGGPVYTLALLGFKVSLLASYLRIGGFVKAYRTVIIAVIVACVCNQLAFTFVLCFACRPIARQWDMSIQGSCIDTVASYYGRSARSGAAVPD

SEQ ID NO: 38480 - protein, 163 aa, A.fumigatus
IVFVDHGPLLHQRHLRPVPPGLEALHAGQLRGLRGQREQTRAHTHGHAVRHETQHPRGCPQHRSRLQRQVHGGRRSGDLDAPPQGHRDQGLVRPALPGQGDQGGRRRARHRGVPGRRHERPRGRRRRVSDRRTGRRLYPRRRALGAGVQARTGGRPGPRVGGD

SEQ ID NO: 38481 - protein, 284 aa, A.fumigatus
RTGQFPRGQPRQRARGSVLGAERRRRRHLRGGLVDDVQGARGDAGVGLEPDVYQCRHLAGYVLRGGCAVPFDAAGHRRRRRHECLVFHQHQLLHLAADGAEYPGRQAAGAGPAVHRRTDPAGDHVYHLRGAVRQLLGGVRGHAEPDRGRHRAVRRLADSPVGRADQQRRAHRRVPRHHVRWRHLHRRGTQRLDRGHRRRLQRGAARLARHADRHRHHDALELDRSDGRHDRAAAQDDGRVHSPAGGVGAAVRGVSQRGGFPAAELPDGVLWCELSETAGHQGQV

SEQ ID NO: 38482 - protein, 120 aa, A.fumigatus
PGTSLAFDCIIIALPLPVLITLRLQRRQKAALLAVFALGFFVTIIQIIRIFTIKNLKTYTDSQPIVLWSVIEISLGVCLPHPFPPSSPNHHLLRSSHRSLQSSLATLLSLRKLANLLTGR

SEQ ID NO: 38483 - protein, 486 aa, A.fumigatus
ETDKASYESSSSIMGPFFTNGTCDPFHPVSKPCTLGNYVVYAVNVSRPEHIRTAMQFATKHNIRVVVRNTGHDYNGKSTGAGALAIWTHHLKDIEIKDWSDQHYQGKAIKVGAGVQGIEAYRAADTNGLEVVGGECPTVGLAGGYTQGGGHSALASRHGLAADQVLEWEVIDGQGNFLVANRDNEHADLYWALSGGGGGTYGVVWSMTSKAHAGTPVSGLNLTFTNAGISQDTFYEAVALYHSTLPAIVDAGAMSVWYFTNTSFSISPLTGPNIPVAKLRELVRPFTDGLTRLGITYTTYAAQFDSYLAEFEAMQSPIEVGIAQYGGWLIPRSVVQTNNAELTAAYRAITSDGATFIGVGLNVSTAVTGDVSNAVLPAWRDTLIDTVITTPWNWTAPTADMIALQHKMTDEYIPRLEALAPQSGAYLNEADFRQPNFQTAFYGANYQKLRAIKAKYDPNSLFYGTTAVGSDEWTVTSDGHLCKATP

SEQ ID NO: 38484 - protein, 99 aa, A.fumigatus
IPRCNASVASMGWVYNLKTPDPHSQVPRVIAICLVFPIVAFLAVLLRLYVRIHTKRAAGVDDYAALFSSILAIAYGAISIARESLQHNTGVAMAMMLTG

SEQ ID NO: 38485 - protein, 70 aa, A.fumigatus
QVKQTKNPHPNVDAASGVLFYHYGFQQPLYYTVTFGVSRALGPLVQLIWDRALGLPIERPKSINLLGLKK

SEQ ID NO: 38486 - protein, 114 aa, A.fumigatus
TSGSSPTPASPRAPWTSSTRPPRRCRRRRRSAPSTDPRARCRGWPRGNCPVRQSPPTRGPGRPPVRAWTPAPSARRLGYSRRPVRRSDTRRRRPRGRSCRRPGTPRCLARRRPP

SEQ ID NO: 38487 - protein, 506 aa, A.fumigatus
SIAPSHILLQVYTVRLPYGLWRGLAQVSIRRDGPLVRSHSGRPIKQAIRIILGLDGPQFLIVRTIKRRLEVRLPEIRLVEIRPGLRRQRLQPGNVLVRHLVLQRDHVGRRSGPVPGRRDDGVDQRVAPGGQHRVGDVAGDRGRDVESHADEGGAIGRDGAVRGGELGVVGLHDRPGNQPAAVLRDADLDRALHGLELRQVAVELRRVGGIRDPQPGQSVGERPDQLPQLGDRDIRPRQRRDGEAGVGEIPDTHGAGVDDGRQRRMVQRNRLVERILRDAGIGKRQVQARHRRPRVRLGRHRPDHPVGAAAAAAQRPVQIRVLVVAVGHEEIALSVNHLPLEDLVGRQSVPGRQRRVPAALGIAAGQSDGRTLAADDLEAVRVGGPVRLDALHAGAHLDRLALVVLVGPVLDLDVLEVVRPDRQSAGPRGLAVVVVTGVADNHADVVFRGELHGRAYVLGSAHVDRVDHVVAQRAGLRDRVERVAGAVGEEGAHDRRRRFIACFVSF

SEQ ID NO: 38488 - protein, 405 aa, A.fumigatus
PAGSFQPRGEDRYYKIEPTQRTAEQKTLETGLSPKEEIAIASKLITPLEGLEQYGYVTRKPTKEEVENARRGVSESKGWEKCDRCGGRFQVFPGRREDGSLTTGGQCTYHPGKPYYPPRRQTDHITGARDAYFPCCNESIGTSSGCTKGNTHVFKVSESKRLASILQFEETPTQADKGPQQPVCFDCEMGYTTLGLELIRLTAVSWPQGKLLLDILVRPMGEILDLNSRFSGVFPEHYQKAIPYKSTSSPSTTGDGALQVVESPAAARALLFKFLQPDTPLIGHAIDNDLNACRIIHPTIIDTVLLYPHPRGLPIRMGLKALVKKYLDRDIQTKGSQGHDSKEDAIATGDLVRVKAAETWKILKSKGWRIEGSKLIPPPGAKGASEDSKLGPGAGHKRKDTEVMP

SEQ ID NO: 38489 - protein, 82 aa, A.fumigatus
TTENWAILYYSNMRRWLSCLHDAMLTNLLLCHRHVVLSSGWQLVSELDNCGDFYNNDCFRESDMILDAFIAPPDQLAPRWTC

SEQ ID NO: 38490 - protein, 100 aa, A.fumigatus
HLRSDFAVIYLCDIDEVPEFNSMYELFDPMTIMFFWRNKHMMCDFGTGNNNKLNWVLEDKQELIDIIETIYKGAKKGRGLVVSPKGQHSLLLRISFGLVY

SEQ ID NO: 38491 - protein, 66 aa, A.fumigatus
YIINASQPASDKIFDVSAFEKFLHDRIKVEGRVGNLGDNVVISQVGEGKIEVVTHIPFSGRYLKYL

SEQ ID NO: 38492 - protein, 78 aa, A.fumigatus
DSTASEKFHLHSSLKAQDNHLFATTYSLLILPKKTPHQSQWPPLLYVITPQTALLFLHEDRTWCASRLQSRIFHKTRF

SEQ ID NO: 38493 - protein, 241 aa, A.fumigatus
ALPSGVRVVLTGQPTYQCMEQWDALHAMLLYEILEMGIAPVDESESWKQKRRTKGLKSPFLSKMTQCFSRSHLELHDTALLPFPNGHSTANSSWVTWAVAETVRRTIFLANIVHFFSHRDLHSRRQSPYYEPLNDELILKMPLPCDQALWSARTEDEWRKATPASPGSPGITDALSTLGPVGDLTGRGQLPNGQYQQPSLEMLFSKFAIDDLRATCVTNAGFADSDELRSLIILCALEQFA

SEQ ID NO: 38494 - protein, 82 aa, A.fumigatus
ALSQETKTQGTDGTWDSHATSNSSPDIGQEDSQGYIDGTAFINARPRAYHTGDGFGSFVNLTCSLSVLLTNPLSVFLPRLQT

SEQ ID NO: 38495 - protein, 357 aa, A.fumigatus
CLDRWTPGDLLLRHRRRCLRANKPKIRRRACNACVLAKTKCCCTQPICSRCAKRGIPCEYVCTVNTATTIVSDSSDSSPPSTRDHPRPDETRVSTTDFPSIWSPRSMLGGPSAEIFDSWSSPNVIWTVDPLDFPSLPSSAGLVDEVTVDPALAIPTSHPSLTFPRASASSQPLSTPREISMVPPGPGTTNTSLTGLGGSPDVPGVQPSNYIRLLAQYPRLLLQDDFYCPFVHRTLFSEQVADMTILPHTSMAICCGSALGVKDAAGYVKRAMDAQRQSLIESYVSTSFGCSGRTDWPAHLPVHGTVGRFARHAPLRDPRDGHRARRRVRELETEAPHKRAEIALSLQDDPVLLAVAP

SEQ ID NO: 38496 - protein, 411 aa, A.fumigatus
  UNSURE (4): Identity of amino acid sequences at the above locations are unknown.
RRRXQEDRSRPGPVWYRPQAGGGTEAYIKEEPVSPPPFADTAPAIHPQERPIYIDIASPRPPYTPVYERIEPVREPAYELDPYHEAHVEASYPRTVSRLSARRPIRDDQDLRRVASLHQARQPEYTREYIERPSSRSLRAASYAIVERPPQERVRYYDDPPQTYARHYAPAVESPTSPRYQEAWIQGSTTAPPRRILIDEHGNHYRERTPPPRMQAMPPPPGRIPRGDVYDDGVRPSGSVRAVSVVEDPYCGRRYVQEMPPPPLAYRRVTDYPRPAPSERRSYVTPLVDDREPYRRSSSVQVAGYPTARATYVEEAKIPRERIIRMPSVRPPAPRYEEPREMVPRIGSVRPAERDVSVYVDDDARRPREYIERPVYIAPRPLAREERYYEGEPERVALDGREAVHQVPQRY

SEQ ID NO: 38497 - protein, 65 aa, A.fumigatus
  UNSURE (40): Identity of amino acid sequences at the above locations are unknown.
KKNSYFSCCILWNILISSHKVLYTECYEQHLPESPAEGIXLTPPFKLKRTIPVFLIILKQPKPFS

SEQ ID NO: 38498 - protein, 110 aa, A.fumigatus
IVIYVFARVVLALAKLSVQPNMHPLSSLITPESRARIEANAWPVFASLSWALVMYIFRWHPETLMSSLRSSMVYMYVLTPTAQYVQVLMVFSYSDSDHWDSFRNFLIYNK

SEQ ID NO: 38499 - protein, 330 aa, A.fumigatus
VFLNSKPKNPRTARILKAREPQLIEPPKRTLFMHGSKCPTALNTVLKTFHSLTVPHSVLFHKKNENIHPFESAESLEFLANKNECGIVVFGSSSKKRPNCLTVARIFDSKLLDMCELMLLPNPDGDSIPPINNLKMQIGIGLRPMLLFAGTAWDDSTSTAHVMLKSMFIDMFKGEESDKIDVEGLQYVLMIAAEEPTDGLAPVIHLRWYKLRTKRSGHKLPRVELDEIGPKFDFKIGRLHEAPESALKEAMKQGKRPNENMKTKKNIGMDIMGDKIGRVHLGKQDLSGLQTRKMKGLKRRAGVESDEEDAEMMDVDEVSDDEGRKKARTE

SEQ ID NO: 38500 - protein, 158 aa, A.fumigatus
  UNSURE (3): Identity of amino acid sequences at the above locations are unknown.
TVXFHAALRYWRTCSLHLCSRLVGIFCSSGYDFRSVVFAVDVLINLQVARMIMLGIKLTGKVPFKEVYCHSLIRDSEGRKMSKSLGNVIDPLDVMEGIELQALHAKLLTGNLAEKEVATATKYQKKAFPKGIPECGADALRFALVSYTTGGKFGYCLA

SEQ ID NO: 38501 - protein, 347 aa, A.fumigatus
DCRIKELTDSGLGGDIAFDIQVIHGYRRFCNKIYQATKFVLGRLGDDFKPLPAPSKTGRESLSERWILHKFNTAAKEVNEALAQREFSVAASTTYHYWYGQLCDIFIENSKYLLAPEVPAEVQESAKQTLYTALEGALTLIHPIMPFVTEHLWQRLPRRPGDKTISIMKARYPQYNPEFNDPEAETAYELILNTSKAIRSILAQYEIKTKGDIIIQTYDPVSYKTISDEVTSIKSLGGKFLGELTVADLENTNPPSGCVVAPVGAQAAVYLRVSKEVALEQEEKAKASLEKARETVRRQQTLVNAAGWKEKVKPEVREQEERKLRDAESEAARLEEQIREFEKLRLE

SEQ ID NO: 38502 - protein, 392 aa, A.fumigatus
QVVSADPRAEVLECSNIAWPNSGMWSRGQRVFKYNAGSVLSDAKQEEDLHAHSPTRHENRSVVANSNRVSNPAAYTAWPYRNYPPPPPQWQNNNRETTWTYQSTQEPLMTDPFIDPHILDPTARHRGARPSWEDVCMPDYISNSSSSRAISSMTGISYEHSKQPSIVAPIDEETYSQLFEGVSPPKPLACISQAPKNTSSALPPVASKLSAAGEERSSSCVKTARRPSILKELSQPVSRSVSGSSAKSSLPAEALLEATATCKLHVSPTTQIRSKKEGNCSDNKENEASSETPRRDNDKVDRTPAKLTVRTSGNFETPVESRRRRSTTGSARGGVSLITERETVLLSPSKNLPVVENHVTVVENHDQHTSFDDFLDTKLQIVDTAADTIEIN

SEQ ID NO: 38503 - protein, 116 aa, A.fumigatus
SSIREINMATKIAGGLHRAQEVLQNTSSKSKKLVDLERDTADAHTQQPLTTDHGVRVSNTDQWLRVTNDRRTGPSLLEDQIAREKVNILHVNTLNKYGIDDIRRSIALIMNVFLKE

SEQ ID NO: 38504 - protein, 166 aa, A.fumigatus
HPDQPPGHQLGRAANQPSSVPCAQPQPRRTDAPSNHARHGQLLAQPLRSRAPDRHQGLRSGRRVHNLPPAGGGHQEPRPQRQISRAPQPSPALLQLNVRAREAPLEERFQLRPRPLRRPPRSRTASPANRSPISNSSSPQKFPKLAGPPIPPKGPQAQTIGRRASA

SEQ ID NO: 38505 - protein, 378 aa, A.fumigatus
LLLLIPSDLTVLSVHAVKPEPHNEVPQAQTAHNNFWDFVYLHPEATHMFMWAMSDRAIPRSYRMMQGFGVNTFALVNKEGKRHFVKFHWIPHLGVHSLVWDEALKLGGQDPDFHRKDLMEAIDNKAYPKWDFAIQVIPEEKQDDFEFDILDATKIWPEDLVPLRVIGELELNRNVDEFFPQTEQVAFCTSHIVPGIDFTDDPLLQGRNFSYFDTQISRLGINWEELPINRPVCPVLNHNRDGQMRHRITQGTVNYWPNRFEAVPPTGTKGSGVGGGFTTYPQRVEGIKNRALSDKFREHHNQAQLFYNSMSEHEKLHLKNAFSSDLDHCDDPPGLERLPRPIAPRFRTRAPPKNSPNWRGPQFLPRALKPKPSGDAPR

SEQ ID NO: 38506 - protein, 114 aa, A.fumigatus
YSQIHRFDHERIPERVVHARGTGAFGNFKLKESIEDLTYAGVLTDTSRNTPVFVRFSTVQGSRGSADTVRDVRGFAVKFYTDEGNWDIVGNNIPVFFIQDAVKFPDFGTYSSCC

SEQ ID NO: 38507 - protein, 146 aa, A.fumigatus
TATSTNSSLRPSRSHSAPATSSLALTSPTIHFSKAETSPTLTPRSAAWASIGKSCQSTVQCALCSTTTATDRCAIESRKARSTTGPTASKPCPRPAPRAPEWAAGSQPTPSGWRASRTAPSATNFASTTTKPSSSTTQCPSTRSST

SEQ ID NO: 38508 - protein, 92 aa, A.fumigatus
SFRMRQCHAHGLLFQEYVHDQSDGSANIINTIFIESIYMQYVYLFSGNLILQQGWASSAVIRNSKPLIGVADSYTVIRSQWLLGMRIGRISF

SEQ ID NO: 38509 - protein, 295 aa, A.fumigatus
VVEELGLVVVLAKFVAEGAVLDALHPLGVGCEPAAHSGALGAGRGHGFEAVGPVVDRALRDSMAHLSVAVVVEHRAHWTVDWQLFPIDAQAADLGVKVGEVSALEKWIVGEVNARDDVAGAECDLLGLREEFVDVAVQLELSNHTKGHKVFRPDLGGIQNVKLKVILLLLWNDLDCEVPFRIRLVVDSLHQVFAMEIRVLASQLQGFVPHERVNTQMGDPVELDKVSLSFFVDESKSIDTKSLHHPVGSGDGAVRHGPHEHVGGFWVQVHKIPEVVVGCLGLRDLVVRLRLDSMD

SEQ ID NO: 38510 - protein, 721 aa, A.fumigatus
IQSRSSPTVITHQRLTRDPSNSVKMLPKLPSKIDQAPEPYISHPGADHNQQSSLSRNGSLLKSKQNDKGPAVLKKKLSKRKAYEIAREQEIRLMASSPIDIPWRPGTLPGERVSVETRRAPRTHSRRSDRHLSDLSLPVRDSAASSVSDCSESYTFKVNSLAAWTPRPIIRYVEAPRSSAARSQKSAEVPGRKENALNFSISEEELYSKQRVDALADSLDASALRELLERDRRRKEKQRIEEQKRLRRRLQRRAERQRREEEQEDESQRQHSHAQGPSAINRGQAIVGKNAESTPDDTGTMCKNDETKIFLSGDTAGSWLRDASKERSRHTSFESVHVVGNLDDSSVTKLKLAERPSFTQSHDMGMSHTTLSPSPSRRGLSSPTSSQVYGVARESTSDVSRTVESERRLSDHSSTRGGALASLFRRSSSRLKRRYRERFQDQSSELSNTSHESFFKVPTQSSGPPPYSPPKPFLRSGVIKRSQSKFTEHFGDEPLSPPDSRLQSPEIPEEPSDQFGKENDTLNLHVESHYPIPGSESDLQDASKIPHRSWGDESLEDGADNVPLSQSLASIDSEGSWMSGQFLRRISQRRSNLIHRSTSLSHNHTEEGHEDSVKDDAMPQKEHFVRFESDHDDTEGPSSSVLDNQEKDSNVRASQDGTWHSEIARRPVVVNPTIRPKSNEGLLIRSIQSLSPISADEEVSPIEEHPSEHEYMHDEGCGQAC

SEQ ID NO: 38511 - protein, 180 aa, A.fumigatus
  UNSURE (49): Identity of amino acid sequences at the above locations are unknown.
QYRRAFEKGRQPANTRIGAKRIHLVRTRGGNRKFRALRLESGNFSWGSXGISRKTRVIVVAYHPSNNELVRTNTLTKSAVVQIDAAPFRQWYEAHYGQPIGRRRQQKTAETTTEKKSNSVVKKQAARFADHGKVEPAIEKQFESGRLYAVIASRPGQSGRVDGYILEGEELAFYQRAIRK

SEQ ID NO: 38512 - protein, 396 aa, A.fumigatus
SSELSINGMILTFFFFSFSFSKELMVSPVELLFHLTYTDQGQATGIINSTPPVRALGNYNNHIQLSTLLNYPLTTVMSNKTIKTRLLLISDTHNTSPHPPPSPHPYRHPLPEAHILIHSGDLTTIGSYQEHATTVATLKCHPAELKLIIAGNHDITLDEAYYAALPPSSFKTRSGREDPAAIKQLYCGPEAYDAGIRYLDEGVHCFSLSTGAELRVFASPYTPAFCSWAFAYPRGRDRFNPLPEDTTASSALSSAGADAPDGVVPDFPSVDIMITHGPPAGVLDTVVHGGSVGCEGLFAAVKRARPRVHVFGHIHEGYGALRGEWGPDMTLGGTKVVCDPDKVREERGAYVDVSADSGCPLRFGEETLFVNASVLNERYKAVNAPWVVDLDLPVSS

SEQ ID NO: 38513 - protein, 63 aa, A.fumigatus
FPTSTANMGISRDSRHKRSATGAKRATYRKKRYDPRVILFLTSLTIPQGVREGSPACQHPYWC

SEQ ID NO: 38514 - protein, 216 aa, A.fumigatus
  UNSURE (161): Identity of amino acid sequences at the above locations are unknown.
YFLENIAETPKPPFYTTRKRNTPNKFFLLLADSTLVESQLLTLQDVTVDTTALARAGGDDGVQTTGLKLLLDGGLNLAVVGEASSLLLHDAVALLLGGGLGGLLLASPADGLAVVSLVPLSEGSGINLNDGGLGQGVGADQFVVGGVVGHNDDTGLAGDAXGTPREVARLKTEGTELAVTTTGADQVDSLSTNTGVGRLATLLERPAVLSEMSEKG

SEQ ID NO: 38515 - protein, 451 aa, A.fumigatus
RQDYEGQFLQITSVSAHRDMTHPVYQRSRIPLAVRDHLLISEPSQFSSTLKRHVQGTDVREQWVEKTIFTTAEPFPNILRRSEIVAVEEVALSPLQTAVERTWRKTQELSLLERRAASGEDQGLSSLTEALQQLLDLNSPSASCVALYRQFLAEVDEDDTEKVEESTDPMKNALAVALMDHALAIKHALALYARPAHQATQAELMRQFEEAFAPELVSLNPVVAESPATQRQSPVSAENRQKQSQSRSISPRNHVRKPSEKPSVSQRISIMNPFKRANHAPNGSVATVIDMKTEGKDHDDDTATIYSRTTAQSGTTHTKRRSFFGEMVHKHGSSIAASTEDVQEQLSRSGSRSQDNRSRSGSQHHGPSGDDSISSIKGGGVAKATSVRDNHSVRSSDRSQVGSPGGHSYSQSHSGGVRDSVMKRLSLFKGVGRKTSRLEIRPETNGVLREE

SEQ ID NO: 38516 - protein, 106 aa, A.fumigatus
SVLFNHAVRDSRRSISVSYLTPDINPRRNRHCRPSTFRPFPYHSLTPSSTEIICSTLSLYIAYEYAVLQVLKPIQTAHDPYMRNAPIFDGFPSLSPWISSRAGGFG

SEQ ID NO: 38517 - protein, 68 aa, A.fumigatus
NRFRRPMILTCAMHLFSTAFLLYLHGFLLALVALGSADSDVDFMSVRAKFLKDYSGKGGEPGEKYFSK

SEQ ID NO: 38518 - protein, 164 aa, A.fumigatus
QTLIRAQIFPWDNDLDVQVTEPTIHFLAEYYNMTEHHFELPGVDGGRNYLLEINPQYVVRTIEDAANVIDARWIDTSSGLFIDITAVRKDDELRKKGQQGALMCKDGHRFDVSGRGTRVTRDGYLPLSRRPISSHFGIVTLKTFLSKYPTSTLISLWKNMAPRH

SEQ ID NO: 38519 - protein, 60 aa, A.fumigatus
IDKCALDISICIALQPSSPPAVPRPSHSETRKKKSTFKKNNNYDNYGIIISENHHGCEPT

SEQ ID NO: 38520 - protein, 262 aa, A.fumigatus
RTLILLGIGALVTTFGVGELSAVNAIAGAYAERAPVVHIVGTPMRASQESRAMIHHTFIDGEYQRFDRMQEHVTVAQVSLSDHRTAPAEIDRILLQCLLHSRPVRITIPVDMVPVLVPTAGLASKIEIPPPVRQPQVEEAALTAVLERIYNAKKPMILVDGETRAFGTVNEVNQFVTTTGWPTFTSGFGKGLVDETLPNVYGVYRPAHKEFVDSCDLVLAFGPHFSNTNTYIFMVRPQDETSVLFNPTSVQVNKDIYRDLPA

SEQ ID NO: 38521 - protein, 66 aa, A.fumigatus
PYERKMKLFLSSVRFWPFRGLLLPLNTPSEPHDVMSNACFYPISAEYRKPEKLSTITPKLGSLPSI

SEQ ID NO: 38522 - protein, 111 aa, A.fumigatus
SSFWHISRNGAKSDGPRRERHRTHSQKQRRLNMDSDTLPLAQYLFKRLRQLGVDSIFGVPGDYNLTLLDHVVPSGLKWVGNCNELNAGYAADGYSRIKGTCHASSYCLDGR

SEQ ID NO: 38523 - protein, 118 aa, A.fumigatus
FLSPESLGPRCLLSIVCYCQNCACTENRFSSRQQLDYNGGVYKRTYFYEPHCTNKDTYILGVYPQALETCSLYGRSSSPRSNSNGNLSFRRFMNRQNSTWTQTSPFGITSTVRLKRIP

SEQ ID NO: 38524 - protein, 362 aa, A.fumigatus
CPSFEALRLKVAIMSEVNLDNFKSLDALRKVFSTYRELSLTERPIVFIVIGNFVQKATINGGGHAGSIEYNEYFDSLSIILADYPELLQHSTFVFVPGDNDPWSSTFTAGAASIVPRQSIPDMFTSRVKRAFASANSESRLSQASEPAGEAIWTSNPSRLTVFGPLHDIAIFRDDITGRLRRNAVATKQGENERDSAFSQDAGAEAGLATANNETDAQAYPADAKARQSFSSAHTARKLVKTILDQGSISPFPQSMRPVLWDHASSLQLYPLPTAFILADPEVAPFCMTYEGCHVMNPGRFISEEGSTCMTWVEYDILKNRGRVKEERLYQIITAILLVLRILFHVLRPTELSKAEKLIACN

SEQ ID NO: 38525 - protein, 64 aa, A.fumigatus
PSIMLSAGETSIEGPNNIADSLSVCNHSISKTFPTVSLGMIQCASQPGFELVVAWPSLRATQFP

SEQ ID NO: 38526 - protein, 865 aa, A.fumigatus
ERVIFQPRWWKTINRIISARLALHDLIPHPFRTYRVHDGRVTFVVRGEFELDLSIGAESELSQFFFVDIRFLYSPSSNIPKGRMSNEIDAKINEKLRDSGLTGCFNFLHGLVLTNKIHILFKQAIELAKGLWSETLRVELLHRTLVIQYWTLKPGPKSWIEIGVKSGNGDADSQGLGVPCLGLRWMRDGQEVNSRDIEFDPEDLSMECLLRSVIALHISYLLSSAYGILSEYSLFSSGTLSSHAILNVTEPGECQLSVQLTGSRHLRVSIEPMSGAVILSATPGLLERFESDASLDRSTIDDLVARVSRLRCIAAIEELESNVRILGFETVSPKGLRNDIRKVFPANVLRFSLFWHPLWERNWVVAATSSITSDNWWVVRLRRSSEVATDFSVSDTSVPLCSGHSMSDTFLATSHQTRSSSFPDLGYCLSGMVAIYANVSYLSDLHSVEFHPPLCALKVESDLQIPDIFIRYQVSNLPRALQLVLPAGLKRKNLLKDTVRLAFHGIDRHKNSAIFVAYGNLVGPWTDLCTLISKSDSSLVFKQGGSGFALRLLAPAGRPVIVQLFKSLQTLECTLSILDFLRQRRLTPQSLSLTHIAFAYGPGRDLSATIEMGLSEVPSSAELDPVRVLARTDPLLCLTLGIRFKHPNPHRRVQGSLAAILNHASNEAGLDFVTEVLSFTLPLMRALEQITSNASRQEPFRLQVIVRNAYTFLLHYTYQGFRFQLTTRQHSGQLTWVLRELSSPEAGPGHDQFKARLRGTLYHSKGNGWKGLGNGVVADAEGVSNVIRALDGCFTGAQHNTWLPRETKSEQDYSTQPAPENQSQTGAPSQAGMANDTKMTANFVNDKSLQRNPVVSNAADVITID

SEQ ID NO: 38527 - protein, 173 aa, A.fumigatus
HVCHVRLDRRAHPPAQWSAPRICPGDPQPDRDQSGTDHAPTGTGGPVGSDYTTAPRPARSPRWPSDNHHAVGRGSGRDGAAAAHPRRAESRPHAGLDVRPLSRQYHRHALGDQDPLCRDHRPGGHPHLRGSSSQRVVHGGAPPGTDGRIRHRVRGRLGHFLRAGLDDKLPQSV

SEQ ID NO: 38528 - protein, 455 aa, A.fumigatus
  UNSURE (68): Identity of amino acid sequences at the above locations are unknown.
QIILSMLSPDLQPGKVPPPSQNGVELGSSDGWTPQSWRKRPAIAQEIEYKEPLQLEEVLRTFVPLPPXFSPVKIELARKHFAAAARGEAFIIQGGDCAESFQDVRPLIVQQKVQLLHEQSRLLRDSLGLPVITVGRIAGQYAKPRSCPFETLADGSQVYSFRGENVHGFHPDDRTPDPSRLLQAYFHARATLDLMKACPPLRTPPSVDAIASPGRDLFRTNLPGEPGQGPIFTSHEALHLPYESAVTHGRYNTSATFVWIGERTRQRNGPHLEYVRGIRNPIGIKVGPTMHPQELVDLLDLIIRQPQDRHDPQDGRVTIITRLGADQVETVLPPLIHAVQKAGHTPVWMCDPCHGNTTVTPSGIKTRCVETIVREVIRTFEVHRASGSFMGGLHLEQTGEFVTECVDAWDTSCERDLTTNYRSLCDPRLSYIQALAVVRSFLDHVCCSTSKAHGL

SEQ ID NO: 38529 - protein, 202 aa, A.fumigatus
LKSPGREDEAAYRPANLQLPVKMKHLVAFTLNAALVLGVVVLQRRDESTQQQHPLLDSFRHSPGIATDDALVRQCIAPGVVCVDKHGANLPYPFWRDSPNGTYATNLADIEFTGGRGQPKSTSWEQVERADFVVFDEERGRKLLGENPRVDFVFSVNPWALHEAPTYVPGLHQIFFSELSPMLEQFVIELKVDPPTLSTFRA

SEQ ID NO: 38530 - protein, 192 aa, A.fumigatus
DDRRRDRPAPGQLSLHHPPDCSPPGARGLPGVRRRRPECQVAPHGWRPHARQPAADGFQAIRGRSLGPRMGHLRDHAHCHPARRRLPPQWVQWHPRERNAGQSHQPGHRPGTGRGRGGRDPGAQSAVSIQGLQGQRGGQSRLRRRRLVPHGGLWAPRRELQRLHHGSDQGAPQGRRRLRDAHLRGGAGDRGV

SEQ ID NO: 38531 - protein, 406 aa, A.fumigatus
  UNSURE (367): Identity of amino acid sequences at the above locations are unknown.
GLDVRQSRITQTAVVCRQVPLARSVPGVHALGDEFARLFQVEPPHERPAGSMNLEGADDLPDDGLDTAGLDPRGRDGGIAVTGVAHPDRRVAGFLHGVDERRQHRLDLIRAQPRDDCHSAILGIVPVLGLSYNQIQQVHQFLWVHGRSHFDPDRVADPPDIFEVRTIALAGALADPDERGRRVIAAVGDRALVRQVEGFMRCEDGPLSRLPREIRAEEVPSRRRDGIDGRGRPQWRAGFHQIQCRPGVEICLQQSAGVRGAIVGMEPVDVFAPEAVDLRPIGQGFEGTGSRFGILAGDSSHRDHGQAQRVPEQPRLFVKQLHLLLHDQGPHVLEALCTISALDDKGFSASRCRKVFAGQFNLDRAEXGRQRNERAQDFLQLQRFFVFNLLRNRRTLSPTLGRPTIR

SEQ ID NO: 38532 - protein, 665 aa, A.fumigatus
APPKVKENAGVTSTASLIQIVLVVTQGVAGRRTLSGPSPTPGVVGPSGLSASSLHMAALAMDRHCGLADIQSGDTALDPYLIAFRSSRCSLESTLSKNRRRTEDTGTHLRYQQTSTAVANLTVVPVSHLQIHSTGLAASTMIFESKLPLPSVPKTDVFNYIFHQGRRPYPWSRVLYRVDQTGETLTLAELEEKSRRLADALRSEYEIMPKDVVGIFAKDRVCWEQSLSLSLSLSLSLSLCVVSCLRLTAWEQIQYPIAYFGALAAGATVALIPVQQEMSETDIATRLVQSQVKLLITDSDLLRLAEVSTDLAGAVRLITLDDSPNQLWASLERLLARGRPDADLFRLESEASAEEYDAFLNRTSGSTGNVKSVLTSHAHFIATMEGTIGTIPDNTDPDHDVWLSPLSLGFFINAKLHMGLNILLGIPVVLMNGPLDETTVDVIGRHQVSFLFITPPIAARLARADFQASGVDVRSVKWLLTAGAPMHDNLRQTVSKQFGGVPLDLEWGTSETMLIAIQRDADSRRSGYSGTLVNGMQAKVISRVTGQELGVGEAGEILVRNRLCRFKGYKDNEVANRDFDAEGWFHTGDYGHLDENCNVFIMDRIKELLKVGGGYGTHISAAELETVVFEHPAVASVVVVGIRNDFTQLDEPTACLHHGAGRSRA

SEQ ID NO: 38533 - protein, 106 aa, A.fumigatus
IRRIRDNQQIDMNHNNGYYYLNRPDFYDAVTQPSDFLHTLGGCSPWMEHRFHYGDSRRADSSFCTAMAVVLSAYHTAYYPTSAGELSTNSDHVPTTALLSSSTTSL

SEQ ID NO: 38534 - protein, 244 aa, A.fumigatus
CCDSTFGFSPYSGWMLPVDGAQISLWGLKKSRQFILHSDGGGPVSLSYRVLSDIGRGAQHQLRSRAYHSSTVVLDNELISLTTSVLKETSLSSFIIFLQSIKSLTNLLSSSFLDSLFLHPHILRITMASRGLPRALRLARVAAPRTVISAALPRPALAKAATRVAASTAPVRGVKTIAFADSKETVYERADWPREKLQEYFKNDTLALIGYGSQGHGQGLNLRDQGLNVIVWGPQGWCLMERGP

SEQ ID NO: 38535 - protein, 840 aa, A.fumigatus
KHHLRSSYHVHTMSLLSAFSALPTVQTRKALLLLDFQNDFVRPSGALHVPNAAEILENIAQLVTAFRRTGDVIWVRSHYESHRPLIDSDFQDRIVLGRETDEQRKRAERPSSKTPVDEEAFLSSESSQCCRPQSSGFQLPAPVLAAIDAENDTLMDKSDYSALQDEGMILSLRTRFITELYLCGSLSNVSVYATALDAVRHGFSVTLIEDCLGFRDFVRHEEAMRRMADIFGASGITTQELFEELDWQETDAIARQSTHRPVRAVTPAGIEGVMDELDVKTIRGPTANEGTPESLGSRRRRLDALLAEQTDGEDDDPLDLTSLARSRSRYGPSGSPGSSSQAHGAGEKKARVRVRRTRRQDHKVDASNRTEERRSGKTKKSRDIRGPGDKIGEGDSRIIYDLDLPEDAFASIRSEVAWQKMYHMSGQVPRLVAVQGQTRDDGSIPIYRHPADESPPLRPFTPTVNQIRIIVERILGHPLNHVLIQLYRDGQDSISEHSDKTLDIVRGSFICNVSLGAQRVMTLRNKVKAADEDQRPTQRISMPHESLFILGEKTNMRWLHGIRPDKRQAAEKSTEELAYGGERISLTFRHIGTFLNEAGDAIWGQGAVSKDQSQANTVIHGDPAETERLVRAFGQENQATEFDWDAVYGGGFDVVNFVTTSTAKLVEDSDPVTNLRVRLALSENGIRYEVSASSEDENSTEGKARPVLITADGTEVAGELDIMNFLAKHAPELTRAGVEVLRGGSQLLKINELLQDWRTSHSNGEKINPESLDLWEKALDGQYYLGGAALGLDDCFLWPVLRDIVQTCGPFSSDEYPNLAQYYRRVEKRGIVKATLEELK

SEQ ID NO: 38536 - protein, 157 aa, A.fumigatus
  UNSURE (35): Identity of amino acid sequences at the above locations are unknown.
FQNDGKFVLYYSGELKNWKRHHCIGAAVSEKEDPXGPYQPMSEPLACPREHGGAIDPSPFRDTDGKLYVTYKSDGNSIGHGGDCNNGKKPIVKVPIMLQELQDDGITPVGDPIEILKNEQEDGPLVEAPNIIRTDQGYYYLFFSSHCFLHNGVEGPR

SEQ ID NO: 38537 - protein, 67 aa, A.fumigatus
LNVQSILAVMIRLFFRNLPETYTRIHSLLETGDRRISTTDFKNLKDIFVFYKVLCILSNRLQTNGLN

SEQ ID NO: 38538 - protein, 419 aa, A.fumigatus
IELICSLLSNRILSSCIDRLRSLWRISWRRSRSIFTTHLSNRLPPRYCDSSLRATMLTFRKSLIVAVVLITFVVLLRSAHSSPSAEPAVLNTETTAHDTSQAADEHLTDQKQDIQQQPLKPPPTAPLRERLRYQFPYDLENRFPAYIWQTWKYTPASMWFSEDLRPAEASWTELHPGFVHEVIPDDTQRHLVKYLYGSVPEVFEAYDSMPLPVLKADFFRYLILLARGGIYSDIDTYALKPAVDWLPGELDLATVGFVIGIEADPDRPDWHDWYSRRIQFCQWTIQAKPGHPILRDIVAYITEEALRMKKKGILKEGKMDKTIVEFTGPAAWTDAVFRYFNNPEYFSIEPGSTHNVTYEDFTNQRGYKKVGDVVVLPITSFSPGVGQMGAGDLDDPMAFVKHDFSGTFFFFFFFFFFFF

SEQ ID NO: 38539 - protein, 339 aa, A.fumigatus
DKRYEVTSKTTFEEFQSIMLSDRRTANLDSDILQLLFDRIKEKAIRRSEEEKHAADRHQRRAIDALRSRMKRLEPPIRPSDTWDQVRPRIEKLEEYKALESDELRQVAFDKFMRRLKENEEDVDRERERDRDRHRGSRREHYDRDHRRGERRGPPSRLSRTPEPDAYEADRRKAQADRERSYRKVSGLSPIREKRDDRDRDRDREREKDRDRYRDRDWDRERSSRSLSHYDRERRDREEERERLYRTRGDPRGSRDELDYGADTRSTVSNDRRRRRDSDTESVASRSAKRYRRESRERDRSRASKRDRERQEPTPAAEEDKREEKAVHSGSEEGEIEED

SEQ ID NO: 38540 - protein, 119 aa, A.fumigatus
ARETNGRASSIVYIFRASGSSSIVEQLSFLGNICSSSIMNPMTGPAAAAPLWQEARNADGRVYYYNVQTKATQWQKPVELMTPVEVCCYYESRCTHVCANTFLTFAASSSQSAMERIYC

SEQ ID NO: 38541 - protein, 371 aa, A.fumigatus
PVFARRAPTFVAGGVSSFPSLPQQRDRDDYDRGYGDRRGGYGSMDVNGISAAPALGTAQAEPEYNSLEEAENAFMKMLKRHNVQADWSWEQTMRATIKDPQYRALKDPRDRKAAFEKYAAELRMQEKDRAKERFAKLRTDFNTMLKSHPEIKHYSRWKTIRPIIEGETIFRSTNDENERRQLFEEYVLELKKEHVEQEAARRRAALDELVNILNSLNLEPYTRWSEAQAIIQSNDKIQSDDKFKSLSKSDILTAFENHIKSLERAFNDARQQQKAAKARKERHARENFIELLKELKAQGKIKAGSKWMNIYPLIHEDPRYFAILGNSGSTPLDLFWDMVEEEERSLRGPRNDVLDVLDVRSLTPCFLEQLH

SEQ ID NO: 38542 - protein, 77 aa, A.fumigatus
LLSRFVAITSLAVLMSVLILSSRLQRALANQPWKEYTAEGGRKYWYNTETKQSTWEMPDVYKNALAQVQTPQSAPVA

SEQ ID NO: 38543 - protein, 76 aa, A.fumigatus
SSPIGFPCLVYTVGDHLTPGPTCRLISLTDFQNDQTSTAYNSTNITLIKAALEVIKLLELGKLINYTFFANKYGVS

SEQ ID NO: 38544 - protein, 101 aa, A.fumigatus
IGRSLVWSREKSYSVTARQNRFHIRRCLAGNDQGRLSNQSPSAMANEEDGSSTLLSKKSAYNSVYKHNMTHSAKSPLVELIQQIMSQRGQVVTNAGLSMII

SEQ ID NO: 38545 - protein, 85 aa, A.fumigatus
DVTCRSLPHESDDGRYMYVLLDGSLLNGFILRLFFQVDIGHSTATTRGGSELWRRISPKATSEVDSLLGILSILQMSSKPKMPLN

SEQ ID NO: 38546 - protein, 161 aa, A.fumigatus
SWNSMMGAVEVASSPVFPSLDPIVVDDEMENPYQDTDLNFLDSTRLQMNEAAGQDFDDLFARSHSSHTVTDSESVCLSPSELSIKRHFQEHDALRQPKIVASDSPAESLDNSSPSSSSDSPRNHGRNTSVATTISVLIATKPPYCHLLPHLRMGSPRTSIH

SEQ ID NO: 38547 - protein, 298 aa, A.fumigatus
KCPRLKRNNPEGNIPPKPARSVVGGEQRYLCHACIYSLYLVLTCKLCKCDGKKPSCSRCLQWSISCQYSSTEDGRRPASKSYVDLLRQRIQFLEDFLAKRGLDPDAETSLGEDSAEVSYMEALCDQFKGCLALDESLNFDADGEMRFFGPTSGRLQFAAQGVSPEKDSNARVEPEPLASTAYDAFVPTELETHLIDLYFAWEQPWYQIVDEDLFRDSMANRGRYFTPLLLYSILAMGSRYSDRIKTRTDANDPNTAGRFFLEQAKTLLHREMERPSLTTIQALRLIGMFNIVSSLYTR

SEQ ID NO: 38548 - protein, 98 aa, A.fumigatus
  UNSURE (84): Identity of amino acid sequences at the above locations are unknown.
VRYTLDEDLLTILQATGADAAGWLHHGMANRLNLDMGLNLDPAAFEGAVSMSTKEMQLRRQIYWTLYCHDKLSASYTGRFCSMXVRRSSLVLLNTTAH

SEQ ID NO: 38549 - protein, 199 aa, A.fumigatus
GARGTAIINVEWSKQHTMKSIFALTGLLSLVLSASAADPRLCPKGNDPLPASAFTLQQSKDNSHLASLSHIFSVAGKNVSIARVLDSANRDLAKGKPPVGTTPVEAWKWNPGDMATKKWVPQGITGSADASASGKWDGREMWLVSWHRDDDKSVRVSFVDRKERTKYPAMCLLGGAPLAGRTNFACRGPVPCRGGHRAG

SEQ ID NO: 38550 - protein, 176 aa, A.fumigatus
QLAQDGNVFAADPYKSEVIAFATKQQLTPDFHQIFIRGIGCNWLVCLACFLGVQGRDLASKVVGIWFPTFAFVSLGFDHVVANMTFIPLAIWLGAPKITVALYIWKGIIPTLLGNIIGGGLFVGRCTSCELATVANQTSDILLVHVPRERRDGHSHGDAPVRHDDASFTGYRGHGC

SEQ ID NO: 38551 - protein, 351 aa, A.fumigatus
EREIAQLRKTLEEERLARRRRQSISTKVQSTDETANSTRQSVSNSAAPRKSSMKDSKAPITRPASAMGDLTATSKVSMAEADSNLSVPIERPRRHSDHSIIPTTQRRRRPVTDDMTSAFILPDITIRHAELAAEDPSRLPQAAQKALDSATQHDGKNCTVCKRCIPGNSQCDHTHETVKIPKPVPVSERMPEHSVYNEEPTLRPAQSPGAALATVLKALEDELSHLKMQLVTYQGAYNKLDASLSKRQRKSLAAKIEKLLKDIDLKADQIYALYDVLEGQKQNGHEMTEQEMEVTLQSIGIDTAATTRATDVTATTDKSSHKNNDTDLDDDEELPWEGIESTMDVTGRIGN

SEQ ID NO: 38552 - protein, 443 aa, A.fumigatus
DAPYVWTMSQENTRRSEATTNSFASFGSDFDPEHEALASTKHFENSPKLPEMKGSARKQINNFADEEPDYAIDTSALERAFPELSPVGTSEDDTEESISVEAGRGINKPTRRLDDSRNSLMSIENSVRSSSPAVRLDYPTSHTPQKSAMRVSSRRTASESLRRDAQLRQASLAHKENRDPLSSKTARKDQRRTLSEMHAKVRDSYDGSFIADERPQPVATSTRATRFGNVNLSHQIADAVERASQEAYAKEMRRGKLSSNLRNGSGNGAGDTGTMQSFLLPDLPNLSELVSGVYEDGTPVYTRQSRARATRFVSPPNDGADVSMTREHIPLDAIPIPEDEKALFVSLRLLQDKVSELERAKSDAERKIDEMRQENAALKAGRSNRKDKHGRSRVYESEDDDHRRDAGSHYQSQFPFAVREPHANHCSRARSFESSFAKPVGYG

SEQ ID NO: 38553 - protein, 151 aa, A.fumigatus
RRPCRILPRHRQPHRHQDRPQHDPRRARPPSRHRQPQPRNRQGNPDLPLRRQQDQPAPSRPHSRRPTLRPPPRLAMRPHAWQHADYPFRRENTTLQRHPLRAAAGARDPPRRAVLPRRRAPRTHRRGRHGVCRRCGRADRGGAERAVHDVL

SEQ ID NO: 38554 - protein, 204 aa, A.fumigatus
QATKAPPAQFFWMGDRRRQLDGAHVEFFRGIANPIGIKIGPSMTPDELVRLLDIVNPNREIGKVTLISRYGASKISQHLPAHIAAVQRSGHLPVWQCDPMHGNTQTTPSGVKTRHFSDILSELRQALEIHRAAQSFLGGVHLELTGEAVTECVGGAGGLTEEGLSERYTTFCDPRLNEKQALELAFLVAGFYRDMDDVEGMNSI

SEQ ID NO: 38555 - protein, 70 aa, A.fumigatus
RSYLCSFKYIYANYFIFIKYSINILLYIDNILILSNFNNLINNFLKQLGKLFKYTNNSKVSVYLGINILY

SEQ ID NO: 38556 - protein, 62 aa, A.fumigatus
LILGTYLDITFTISKLTYFTRNLSPNYFIIVKYIFYYLVGMLLLLLFYPSILSNLNSFINTN

SEQ ID NO: 38557 - protein, 377 aa, A.fumigatus
LILTMSNVDITNDGFIGLDYDSRSYIQAQSWPVAVDHQSSQRTEGSRDISSGHAYEQSVAQDPNLMVDWHFQQLQPHLQYTQEDHSSAQQYTTSSYGMPIHSSPVDVMAPPQGQMSSGLLESSYMPLPAPVDMVPFGYQDLQTELMSFPDGLPDLSSYAAPRNLIGSSSPTDTYLEVRSLSSSDNGWSAIEPRHSHEFMFPDQGIFINPTQTLHDRSLSESSYSTSYGSFVDISNPINSPTSDLNFESAFSMPRRVSYDHTSRGSRSPTAVSPVAIVRPIPVPSKKSTSPTRSAGSQASSSSPPSRKPSRKSPIAAKTAETKIRKQSQAGKPEGEKRVGKRKGPLKPDQRKQASEIRKLRACLRCKFLKKTVSSSDP

SEQ ID NO: 38558 - protein, 82 aa, A.fumigatus
NSVVSLRLGIGVVVVITYIMALMICSCLVIIYYNTSNFTLSSLIYYFNIITSLTFACIAYLYFYLTFITSSLYKELLLYIIS

SEQ ID NO: 38559 - protein, 295 aa, A.fumigatus
  UNSURE (166),(167),(170): Identity of amino acid sequences at the above locations are unknown.
LTGQPSQCDKGEPCAGCQPSHARLWQVPCTRIDIKEIGYFMKDWKADYERHITLGFSVGNIKGFSEHERTLFITHGYGQILPINAREVYVRDDQCFSVDWVESMHREPTQYEVETAKLSAGMEGISHAMLSDYLDRHIDGNGTFEKFVDDYFEGTPFLTQMLKTAXXYYXRTKLPVIRKALELIIAYTLTLHVTMVEGIGEEDGFLGKIEDPSSKFKGKIMAPVMINFQVKCAMANMWRELQKDVLEELSSLYSSVYSGEKLKNWPTIFILACILLAVWEEMQFDCHYRTPVSGN

SEQ ID NO: 38560 - protein, 83 aa, A.fumigatus
KVEILTSRKDPAAVEKFCNDMENIPVGVIVGLFQAISQKLPAFTDWETQKHHHLLFSNPDVCNTMTEVREHVRQYGKRPSVSP

SEQ ID NO: 38561 - protein, 387 aa, A.fumigatus
AFAMTVKVSNPSIRWKKDPTTDSLDLYSLALTAVSSLLRKYAIDPNTIGRLEVGTETLLDKAKSCKTVLMQLFGDNTDIEGVDTYNACYGGTNALFNAVNWIESSSWDGRDAIVVAGDIALYETPAARPTGGAGCVAMLIGPDAPLVLEPVRGSCMKHVYDFYKAYFKSEYPLVDGQFSNTCYLGALDACYQRYQAKQRARQAAKTNGTAISNGHQGSFLDTFDYFAFHAPNCKLVAKGYGRLLFNDFKLESGSFDEVPAQVREADFAASLTDKALEKLCVSLTKERFVQRVEPSLTAPTNCGNMYTASVYAGLISLISNVPSDRLQDKRIGMFSYGSGLASTLFSFRVKGDTTEMARKIGLQDRLSARTAVSPEFYDQVSRLIWMF

SEQ ID NO: 38562 - protein, 67 aa, A.fumigatus
VRQCFSCGSDQEPWLRELQYVPQTELETFLGASAGKYTIGLGQQNMSFCDDREGEQPIHPMEEGSNN

SEQ ID NO: 38563 - protein, 264 aa, A.fumigatus
SSSSTCFLLFSSLYLTETYSKMSSWTGAAAMISSPSSFHALPLECRQQILCDLPDIQSLKSAILSHSALYAAFYNYQSPIILQVIQRQIPADLLAYAVLCSHARNIEPWTRTKVLDILDLYFNRRLVESFQWTIRAALDLVKFHESVTFFANDYIDNALGLVAPLNFPIHAPSETEWCRVARAFYLQETIGHFFCFRNGGERWITGGIRYARPCPSEFHHREKFDIFFGKHAPWEMEQVGAVNEYLYWRISPGMSIPCYISVFV

SEQ ID NO: 38564 - protein, 447 aa, A.fumigatus
  UNSURE (318): Identity of amino acid sequences at the above locations are unknown.
DLKIDREKGAQKKVCYLVEYIWNSQGLMLTYLMLFRRTTVMKRLRKWYVILIATSRAIIRVHANIPHVDQTNNQNNVTNTTQLSKGNKRLLHLGDNETRPSKQTKTGDVAANSDNDPDFDPSEDSDSDGGDISPAGNIGRSPTARQLRNAPRKQLNDTVVGSASGLKRPSKSTKLQFTGQPGARNSFSTTPASPDPRTLQNAKKSIKTTELAPNSSQPTLPNSRTPDNAADTNKSDATSEIVSTVQRAPPNSSPANTHRSLPNQESTTDEHLPSKPEDKMAPRPHTPPFPATTGFTESGNNGYPLMQHGALLFVQAGXAMRELPRERARNAQLDERYENLVMEGTELKEKEAEWRREIEELQLHNKNLEGDLKKQIDQNKKLEAGLKELSEKKNQGALDSANGATNAKCEHCLEHLTRINALTEENKKMKQRCKVLAEAFAAGNDQA

SEQ ID NO: 38565 - protein, 80 aa, A.fumigatus
KFSSRQLPFPFLSQEKHPLDVLIKAHVTKRNLWHRRPLTCFSFSLEREPTVNMSGWNSGEADAWNTNESSGWNNNNGTGT

SEQ ID NO: 38566 - protein, 61 aa, A.fumigatus
HIKRLYTHFSLADFADENVNPISSAPAGDFREGKWGGDQIGGQFEPTFSAGEEGNDNKCRK

SEQ ID NO: 38567 - protein, 86 aa, A.fumigatus
LTRGVPGHKTIECTENRKFDLNDIPDKLPEEAWAALKKASNERDLEDFREVGNGIDLYAFERQQLMADSPLGPQGLFQGGSSGHLC

SEQ ID NO: 38568 - protein, 129 aa, A.fumigatus
CEEGKIPFAGMAGHSLYPRLMDDVLVGHFSRDCPQKKDWSKVKCNNCGESEQSAKDARHKGQMLTNVTVGHTIKRCLQAASEGFGQGNNDIQTNGAGDDWNTNTAAPLSNENTDGDAEKGGWSAGGGGW

SEQ ID NO: 38569 - protein, 105 aa, A.fumigatus
RDCILILAWQILLTRMSTQSAPPLLETSERANGAVIKLVVSSSPPSALAKRAMTINVASKCLPPLGRSTKVLLLTRPSCGGDGHFARECPAPRKGMACFNCGEEG

SEQ ID NO: 38570 - protein, 90 aa, A.fumigatus
LSLQEKPVEDSISLINLQGKLNCKYVVAFYFSPKPQRANLKERWPADPEENLERLEVAGFPYDKQIPKCGNCGGKQKLSLGGYRYSQKEC

SEQ ID NO: 38571 - protein, 66 aa, A.fumigatus
SIIEMGHTARGCKEERALVDRVEVKCVNCNASGHRARDCTEPRVDRFACRNCGYIVFPLFIFRVLR

SEQ ID NO: 38572 - protein, 198 aa, A.fumigatus
LVLRHFGHSDLRPQRSFEGLESSSSILLLGFVHTGSSALTPPAIGITMASLGGSVPMFRSLAPRFSKDFFTCRQCLGRTQTYATKSLFRKQFAGLSFGQKSSNATPKAFSVTATKFFSPILRRSVAGSAVAGALEHGASQAKSSFPKVSDKIVAYWLLGSAASVFGIVVFGGLTRLTESGYVLPYASQFERHLLTLSE

SEQ ID NO: 38573 - protein, 375 aa, A.fumigatus
PYLNSLSITEWRPVTGSLPPMNAEDWESEFAKYRASPEYQQLNPNMNLSEFKSIYYMEWIHRLWGRFVGLSFVLPAIYFVAKKKVSKPMSLRLAGIAGLIGFQGFIGWWMVKSGLKEDLFAQGSHPRVSQYRLTAHLGAAFICYTAMLWNGLAILRSHRLLADPEAGIKLLDSLRDPKLKIFRRSVAGLALLVFAPAMSGALVAGLDAGLIYNEFPFMGNGLAPPKSELLDERYSRHEDRSDLWWRNMLENPSLVQLDHRIMAMTTFTSIMALWAYSRRSPTMKRLLPPAARKGLHGVVAFAWVQVGLGISTLLYLVPTPLASAHQAGSLFLLTWVLVLGSRIWHPSRTAKLLQMAAKARGQAVRNATAQAAHKL

SEQ ID NO: 38574 - protein, 70 aa, A.fumigatus
KVKLLQGIWDMSKDYSYRGEMQFVIIYYLASRHGEEQGTVSSVLAYFLALYSRMRGDMDKKSKIYSTMRA

SEQ ID NO: 38575 - protein, 60 aa, A.fumigatus
VWHLCLDSIVVNSSTFNDVDAKILHSATRPFESMYDIIVYAMELVKFCYFQYVAGRRNQD

SEQ ID NO: 38576 - protein, 271 aa, A.fumigatus
FLICTGLPVIQRTNIHSQQSHELWFGSSQFHRTSYQHLQLPGDAPPHGHPRRNGHNALNGRAATTPGNSLSSLQLEERALHARKNNIASFGYSWIKPAGCSKTMLGMKEEEAEREEALAAAAAEMAAAAAAAADPGLDEFGNPMHDQTDDTGMERDLDDDIPDADADGLVEEGEEGLEEDEDVDEEGYMERDLDDDIPEAFADDDDERDDEDGEENVEDTVDFDNQADLDDEIPSAADDYEGEDMSDVVENGDEDAFGMVSPRAGRIRACV

SEQ ID NO: 38577 - protein, 175 aa, A.fumigatus
RMRGSFQPVVRPSRMHLRRRSRLRRSYLRPRNHLLRWGSHRPGRLGCRSPQYLPHFPRHLHHHVRRHHQRTLRECHRLDPAPCIPPHPRLRPLPVLPLLPPRVRPHRHREYRHPNPSPYPYHPSGHASDSQTHPTRDRPQPPPPQPSQPPPPRGPPPARPPPPSYPAWSWSIRPA

SEQ ID NO: 38578 - protein, 200 aa, A.fumigatus
SSAALGISSSRSAWLSKSTVSSTFSSPSSSSRSSSSSANASGMSSSRSRSMYPSSSTSSSSSSPSSPSSTSPSASASGISSSKSLSIPVSSVWSCIGFPNSSNPGSAAAAAAAAISAAAAARASSRSASSSFIPSMVLEHPAGLIHEYPNEAMLFLRAWRARSSSCNDDRLLPGVVAARPFKALCPLRRGWPCGGASPGN

SEQ ID NO: 38579 - protein, 133 aa, A.fumigatus
VIFQSDAKDGSILIFLQPSLLLLSPSRNPLRPRRRPRRKRLLLLRKPRILRKPPRLRIRPRADLSLARGPASSAPSSVRRRRLRRRRKRRPRTPSPSKPPLNLSPRPPLLLKLLRVSFINIQNLPRSQKADCH

SEQ ID NO: 38580 - protein, 220 aa, A.fumigatus
AAAPASAEEKKEETEAKKEEKKAESPAPKSKRTSLFGNFFQKVTSPSHEKSEKEAAAHAETSAVSSTAPQLENPVEEAAVKPIEPENVTAASATEAEAPKEAAAQSPAAETPAGKDKRRTSFFGNFGKKKGDSDNEGTDGDAKAKGNKLGGLFRKPSKAVKLDNKEAAAKEEDKAEPTAQETSAEAAPAEDASKPAEAPATEEAKPATVAATTTPVQAAA

SEQ ID NO: 38581 - protein, 134 aa, A.fumigatus
LFHSLRLGRLGCCNRSVPARDYTRKGDLCSSVSCCWQVRFARSLPPAPSKSGVKHSTVAGVNARQRKPLPPIKVDPNDPVALKRARNTEAARKSRARKLERQDEMERRIRELEKSLEEAQQREQYWKALAQNRG

SEQ ID NO: 38582 - protein, 496 aa, A.fumigatus
NHPHLYFFNIFTIHPHNYQEYQSQYPLQNGCLLSSSPRTSSSFSRETDTIDPLRSSSLSTISSQPSSESPVPGPLNLSIASRSSSSSLNNILPFDVTSFTTDNHQQTWLPTPPPQQPSAQNLNSNSNNDNNSSPQEDFVLYPAPCPQPRLRDSRAPVLPSTAPRSVSYHPFLVRPQYQQPRRHSLSLYQQLQQQKLSGSPGQVPRATRLHSQSTGYPLSSSLRSSPSSRTHFHRVHAASAPSNSPNPNRPPVPLFSAANGTQFTQKQLQQLQQLYHRRIMSTPNIAQGELIEIMSASTWSNSAADMPDFFGLPSNDFGDDFELSTEPTMLSPNQIPTGLMAVKDSVAGAPSGTISPKDLFMDASAPPSTSFTDLSTPSFESPGYFSQDTSPMFPTDLELGPGSEEWGPLFPAQDDFSTAFDSAALDAAIALSQPETIPAKEISVPPSPAVGKSASPAPFPLRQASPVLSTPPSPVSMLVNASHCPLSRLTPTTLSR

SEQ ID NO: 38583 - protein, 131 aa, A.fumigatus
VSDLPIRCQRRINSNFLAAKPAVAEPVKKPVEAKEEAKKEEAAPVEETKDSKETTEVKDKAKSRSQSRKRASIFGSFLGKKEETEEKKEEKTEDAKPVEAAAEPVAATSATAEATEGEFHQYSESASEPKS

SEQ ID NO: 38584 - protein, 292 aa, A.fumigatus
IFSHSFFSQHFLVFVFGHGNDSTACKGVGRRITLIPPFLKLDGTPLRMSTSCCSLDGSRGSSDSRRLGLLGGGSFSGLAGILSGSSLGGSLLSGGLGLVLLLGSGFLVVELHGLAGLAEKTAELVALGLGIAVGALIVRVALLLTEVTEERGAALVLAGRSLGSGGLSGSLLGGLGLSGRGGGHVLRLDGLHGSLLDGVLELGSSAGDSGSLSMSRSLLLRLLVGGAGNFLEEVTEQRGTLGLRSRALGLLLLLLCLGLLLLLLGRGRSGSLMTISFLAPRQILNIDETHPQ

SEQ ID NO: 38585 - protein, 167 aa, A.fumigatus
QRQSQAWPPRWRELQRACWHPQREQPRRKSPERWARPCPPPWQRLPCCRASRPCWACGKDRRACCPWPWHRRRCPHCQSRPSSYRSYRRKRCGACPCRQESRQRGTERQPPWGPRPQWQRRRSRSQARWASRQPPRRGSRAGEQCWRQRKSQHEPQPPSQTSRGRGW

SEQ ID NO: 38586 - protein, 120 aa, A.fumigatus
ISQHGLNSLWALLEIILPTTNPHSLLAFPVLVLILLLYVALAYLTYHTEGFYTYSFLDPGPDGEHSGRVTGYCFGIFAAILVIFILSWAAIWLRRRLTHGKIKRSVYDKEDVPEMRHVGV

SEQ ID NO: 38587 - protein, 82 aa, A.fumigatus
HLFLFQPQSFVLRAYINTAMAASPAAIAPTAPESKVEGLGLYSRFAFAGAVCCSVTHGAFTPVDVYAVHLGSAPKFNKCMTC

SEQ ID NO: 38588 - protein, 150 aa, A.fumigatus
PSYSVKTRIQLDPKTYNRGMIGGFRQVIQNEGAGALLTGIGPTFAGYFMQGAFKFGGYEFFKQQSINVLGLETARQNRTAVYSVSAACAEFFASIALCPLEATRIRLVSEPGFANGLFSGFGKILKHEGVGAFYRGFGPILLKQYVGSTT

SEQ ID NO: 38589 - protein, 147 aa, A.fumigatus
YRVPYTVTKFVVYEKVAEAVFARLDKSKLSNSAQTGVNLGSGLIAGFAAAIISQPADTMLSKINKTKGLPGESTVSRLIKIAGELGFRGSFAGLPTRLFMIGGLTAGQFAIYGDIKKALGKSDYFLGGSQRLTFVPLGATNGVEIAK

SEQ ID NO: 38590 - protein, 111 aa, A.fumigatus
SGPFYCSLHGRARCTPCGEAKFIDPCTPRAGSPYDITLEMSHNPNKNPLITVKLQKKRYGPKDAEAVTDAHLLIVSIFSRNPVLRVEDEMLDQGPNRGLDVPTVQGIYFFS

SEQ ID NO: 38591 - protein, 204 aa, A.fumigatus
INSSSTPFPPLPPGATSHPHARTTATAAAVANMKLSKPSFGVDSSLDSRHCYETSWLLPPLPFALLRALIALYIFVTIFFIWGWNGTHGDSDAIGQSFSYFTWLTYWGLGFYYLVAAIHTACYARTGRSVLFDRLPRALRALHAIFYTTITTFPFLVTIVFWAILFEPPWYTRTFQAWSNVCCPCLKTQKKKVSQSECPVSLTL

SEQ ID NO: 38592 - protein, 62 aa, A.fumigatus
QVVQGSCHVIYPVKLPQSWDLQFCFQQRTKLFQTQYCIDCGPRYEIRPYLTDAKFSGGSTTH

SEQ ID NO: 38593 - protein, 652 aa, A.fumigatus
SAIKHVWSVASTSSSSSSSSSSAAAAASSSIGLSSTMSLSLSSSAIPSVTPSATPVSHGSVLSNILVIAKDSSAASSATSGLNAYGIPYTTLLVPQAGVGLPALNSSNVGNYGGIVVAAEVSYDYGGTTGYQSALTTDQWNQLYAYQLEYGVRMVQFDVYPGPKFGASAVNGGCCNTGVEQLLSFTDTSDFPTAGLKTGATVSTEGLWHYPATISNSSNTKEIAQFAPNAVTSTASTAAVINNFDGREQMAFFIGFATDWSATSNYLQHAWITWLTRGLYAGHRRVNLNTQIDDMFLVTDIYYPNGSTFRITVEDMNGISAWVPTINAKMNPGSSYFVEVGHNGNGNIEQSSSTDAGAAACNGGGIEYDSPPDTPLEFKKPLGTGTDLWPSTPTTYDWTVACTQLDDLLRWWTTPANRDAFGHISHTFTHEEQNNATYADVFKEISFNQAWLKQVGLDQAKWFTSNGIIPPAITGLHNGDALQAWWDNGIRNCVGDNTRPVLMNQQNAMWPYFTTVESDGFAGMQVNPRWATRIYYNCDTPACTVQEWIDTSAGAGSFDDLLAVEKADTMRHLLGLRHDGYMFHQANLRNADVTPITVNGVTAKYSIFQAWVETIVQEFVRLVDWPLVTITHQEVCPYPFSYDVYLYKLQPG

SEQ ID NO: 38594 - protein, 88 aa, A.fumigatus
MSENFLARYQRDQCGYGLSYAVADKKITAVTVTATGNTCSRPIPVTFPVAPTSTQGYATEQLGSDPLTVWVQLSGSPVTFTLSTPIAL

SEQ ID NO: 38595 - protein, 89 aa, A.fumigatus
TSRTPCGRISPRWSRTGSPACRSTPAGPRASTTTATRRPAPCRSGSTPPPAPAASTTCWPWRRPTPCAISSACGMTGTCSTRPTCATRT

SEQ ID NO: 38596 - protein, 648 aa, A.fumigatus
FVQVDIVRKRIGTYLLVGDGDQRPVDQADEFLHNRLNPRLENRVLGRHAVDRDRGHVRVAQVGLVEHVPVMPQAEEMAHGVGLLHGQQVVEAAGAGGGVDPLLHGAGRRVAVVVDARGPAGVDLHAGEPVRLHRGEIRPHGVLLVHQHRAGVVAHAVADAIVPPGLQRIAVVQTGDGRGDDAIGGEPLGLVQADLLQPGLVEGNLLEDVRVGRVVLLLVGEGVRDVAERVAVGRRGPPPQQVIELGAGDRPVVGRRRRGPEVGPRAQGLLEFQGSVRGRVVFDAAPVAGGRPRVGGRRLLDVAVAVVAHLDKVRAAGVHLGVDGRDPGRDAVHVLDGDAEGGSVRVVDVGDEEHVVDLRVQVDAAVARVQPAGEPGDPGVLQVVGGRAPVGGKANEERHLLAAVKVVDDRRSARGRGDRVGSELGDLLGVARVADRGRVVPEALGADRRARLQAGRGEVTGVGEREQLLHAGVAATAVDRTGAKLGAGVDVELHHAHAVLELVGIQLVPLVGGQGALVAGRAPVVVADLGRHDNPAVVADIAGVESREAHTRLGDQQGGVRDAVRIEPRGRRTGRRRVLGDHQDVGQDRAVADGSRRGGHRGDGARTEAERHGGGQANRGRRSSSSRRRRRRRRRRSRSHRPNVFYRR

SEQ ID NO: 38597 - protein, 114 aa, A.fumigatus
PASYVSPRTRAQRTLELLEIGCKERLPWTEARKSEEEEPIRTEAKVEITDAIREWDYGDYEGLTSKQIRELREKNGQGPWDIWRDGCPGGEYGTHSVSSCKPECPFVVGLAQRS

SEQ ID NO: 38598 - protein, 127 aa, A.fumigatus
LSACMTQLPTKLNNVFPHPQRNLGFLTYLLSVATKVDSIKRRTLKSVIANTRGKEMTPRCFIVRHGETEWSLNGRHTGSTDLPLTASGEKRIKATGKALVGNDRLIVPKKLAHVYVYVFWNYSRMKL

SEQ ID NO: 38599 - protein, 63 aa, A.fumigatus
YASPHTRSATSQNVFGTSPKKQSYAAPAWWQVRLGYDDTSWAPWVSYARNVKATKRTTRSTFG

SEQ ID NO: 38600 - protein, 466 aa, A.fumigatus
RGLQSRRPMEIETYLGSPIKLATESGIRVPRIETLYAALHHINTNNLNRPSTNDTPPPILAQPPPRMSSAPPPRNSPMRPPPGGRSGSGMMIPPGRRGYPMPGMSRPPSGQPVPPSARIPREPSLEGLEEFSHLVVYDEFAEGGMPRQNGSNGMHDMPPGPPPAAADLALRERELALRQRELQLREQEMQMRRGPRSRAAPSRAAAFDEDDEDDYFDPMDNIPIPHIDPDSVDMMSITSRRTRKAPSASQFRKNPEISVNGRPQSSFSRYLPGRKRTSERIMQEIPGLHDSLMDNPMMAYSSNRYGSVDRNQIQAGSRANSMTASRMGDFPPHPYPQSRKNSQSPATPYGGPGPRMGRPSTAQDQPVGPPGPHGGHPSPPGNMRAPVPKYPPGHGNAVGPQQVEQHYGVSNPYPAKGTPKHRSLTGSASASAESGDSGASANLDSEASAHSSQISLGAQQAAMPVR

SEQ ID NO: 38601 - protein, 98 aa, A.fumigatus
PSLLYTTCTGASSLQAASHVFYIILPSFSTRYFFYLHSLLSEFPCICSDFFYRDFAKGSAAFNTRKFMVWFWRIKKSRGSDLFGRSIDLIWLSSRLAR

SEQ ID NO: 38602 - protein, 137 aa, A.fumigatus
  UNSURE (120),(130): Identity of amino acid sequences at the above locations are unknown.
IDLRSKLQISTYKTPRNPDPSTMSDVAETKSDPATNAPEAQKPEETTTAANTEESKPAEEKTVTEAAVDTVKDTATKTSDSVFSMFGGGPKKERKKKAEDAKDEPSGSSKVHKGEEEVSXLFLHWCLSCXDACCWLS

SEQ ID NO: 38603 - protein, 87 aa, A.fumigatus
DEAPESPDVHFEPVIRLTEKVEVKTNEELEEQVFKMRAKLFRFDAESKEWKERGTGDVRLLKHKENHKTRLVMRRDKTLKVCANHYG

SEQ ID NO: 38604 - protein, 112 aa, A.fumigatus
VDCLAANGCSVVPDMKLKPNVGSDRSWVWSVAADVSEGEPEAQTLAIRFANSESKSWMMISLGFIQCLLIRHYRGHFFSRKPSRRPSRRTRSSSASSKKLQLHASWRLRCLL

SEQ ID NO: 38605 - protein, 77 aa, A.fumigatus
RRPWPYSSTLVAVNTAHCSLPTFPPDSIDEGFHITPLLSSHVSVSSIHPYSRYLKVELTCSSLQLVDIEHLYFSSNY

SEQ ID NO: 38606 - protein, 94 aa, A.fumigatus
SWWCCLVCLVVMLTLALAYSRNKDSGVEGFPLRSWSIEIYLVNEHGEQVPANVFDKVTYTLHPSFGDRAVQSTSLPLRPCYQILVTPRGQRDDQ

SEQ ID NO: 38607 - protein, 111 aa, A.fumigatus
IETDTQRVKQTAFKNPPFRISEEGWGEFDLQIGLTAADKEHFLTHDLNFAQPRYESKHVIVSTTPCVLARLISPSGTCTHSFYLCRRSRTPSQRCWLYCASRDQYPVTRTE

SEQ ID NO: 38608 - protein, 124 aa, A.fumigatus
VWFLSSQPRRILSGEDSTSTNLTSSRTRSTWTNWQMASKDLEKTTSSRSCRWYTTTKRQTHIPRTMSSVRLAGHIFFQIEVIFEKQLLIGIHWLAEGEFHVDLYTLPDNLIKMLWDFTQEKGAL

SEQ ID NO: 38609 - protein, 240 aa, A.fumigatus
MHIFFAEVARDKLFVWKVRETYRERLPLAIAMPCEPVYPAGIDACFGVRIPRGKEVTCGPRHPAGLDAPYGVRTPRGTEATCGPRHPAGFDAPYGVRTPRGREATCGPRHPAGFDAPYGVRTPRGTDATCGPVYPAGVDAPYGVKTPRGTEATCGPGCPAGVNHPWEDTCYWEERLIGARLQMVRARLIWVPRHFRRAFRSRLYRRRWTFSPTVIALHLQILSTSFSEETPTKFFRGSVK

SEQ ID NO: 38610 - protein, 239 aa, A.fumigatus
SGKNLQMQGDNGGAEGPPTPIKSAAKGAPKMAWHPYQTGPDHLEASTYEPLLPITSIFPGMIDSSWTPRSARSFSSTWGLHSVGSIDSSWIHRSARSICSTRGPHSVGSIESSWMPRSARSFSSTRGPHSVGSIESSWMPRSARSFCSTWGPHSVGSIESSWMPRSARYFFSTRDPHSEASINSSWIHRFARHCYCKRKSLPVSLSHLPDKQFIPCYFSEEYVHSNIPFDSEDSMVSEP

SEQ ID NO: 38611 - protein, 77 aa, A.fumigatus
GNTFDSHMHSIGVGVPNFGTLHTKSSGYATFFPLLLCTIYIQNEHDKQGYFMAPLIIAELSKHLSFSFHVKHRTLEQ

SEQ ID NO: 38612 - protein, 144 aa, A.fumigatus
KLDQPRKYCTRANQFIVVQRVFYNDKEKKVISVVYLGSGLEGWPTVVHGGVLATVLDENLGRAAIRHFPARTGVTANLEINYRAPVYSGNFYTFHSQVDPERSTERKAFVTGEIRDPVGRVCAQASAIFVVPKGFKLREIGERF

SEQ ID NO: 38613 - protein, 84 aa, A.fumigatus
LCLYSTLIHFIMQVLANLLALAGVCPFVGSLSDLIGRRYVAIIGASLICLGMIVTSTAHTMNIFIGMSKCTTYLAKGTHANKED

SEQ ID NO: 38614 - protein, 206 aa, A.fumigatus
RSAHQAAAQWQSPVKTISTSSGESSSSLAWVSAASSSPLPSSPQSFARTYVPTASIFLLTRKANRLVHQDLIATISALTLSIRVVGGSIGYTIYYNIFISKFVPNAKHFIGGVMGTKLNITNPAYIGEAIELTGASLLEELKTIPGIAGSEAAYNAVVAAGQLAYAESYKWVYYVSIAFGGISILAACFLGSISQYMDDHVAVVMH

SEQ ID NO: 38615 - protein, 378 aa, A.fumigatus
TFPPLMFLNALRSVFPQFAQKDRNGHGYAQQDAEEAWSQIVTQLRSKLVIKEGEGDSATEVSFVDKFLAGRFESVTECDDPAAKAAGEEATKSSDIFFKLDCHIGKETNHLHDGILAGLEEKIEKRSPTLDRDAVYTKRSRIARLPKYLTVHFVRFFWKRETQKKAKIMRKVTFPAELDVVEFCTEELKKQLIPIRDKVRDIRKEEVDIERARKRQKLAHQREEELKRAAESDAGLEPLQKKATEGQKEATKSGEQDGDTAMTDVFKSDAEYEAEKYASILAAKKELAALIDPKLASDAGTNKSGLYELRAVITHQGASADSGHYTSYVKKQPDGKGVEDGKWWWFNDEKVTEVDGEKIETLAGGGEYIACFCLLLEL

SEQ ID NO: 38616 - protein, 83 aa, A.fumigatus
LLEWSTVTNEMNRFIFAGDWLAPIWSHIRFPPPSQSSSLNSVKVNMELVSPPIARAMPTGPIPRSLHSSDEPSWPREPLAGNY

SEQ ID NO: 38617 - protein, 153 aa, A.fumigatus
QRRLAGMAIAGAGAGVNELTALAATSEMAPTSQRGKYVAILIFTIVPFCPSVLWAQLIAAHSGWRYVGAFCGAWGGFGLLATVFFYFPPPRVNSQGLSRKEVIRRIDFVGGLLSITGLILFLAGMQWGGYQVRIVFYMQISTPPDQQLNPVIT

SEQ ID NO: 38618 - protein, 205 aa, A.fumigatus
YPWTTAHVLAPLILGFVILVAFAAWEIYGAKYPIFPTRLKQEPRTLGLTLVITFISGANFFSVIMFWPTQSFNVYGHDPVQVGLRSLPVGFGIMAGACIVLWLLSVLRGHNKELLIISSVLMTAGQLCSPTPQHLLEIVAFLTLCSSGCGAMAVARQDNLYQLWGILVLAGLGIGGIVVPASIITTIICPDVCSNCLYLSTYAEG

SEQ ID NO: 38619 - protein, 60 aa, A.fumigatus
SRSNAYRDCFLKYLWIDKDRVWGVYGVYLAGASFKGQGDCTQAFRVLSFQGRRSLIQWSS

SEQ ID NO: 38620 - protein, 228 aa, A.fumigatus
PVSGRSSSLSILSREGIEWIKHKTGEVDFLRLLVSDTKHDSPWDYWRPDVFHDVFASKVFKPLPPRAEVFSLLGDYFRTINRLFPLYHEAYFMEMVEWQYTQQTCDDAARWASINIILALAYEYRYSNSLKPEKDKERAWLYYKNAISVLTELTLRRTDMLSVQALLGMALFLRGNSGTQSAMPLITAAIRTCHRLGLHRDTPRPHLAPAEQEQRKRVFWIAFILDQR

SEQ ID NO: 38621 - protein, 186 aa, A.fumigatus
CSTCIRTGNAPTQHPDDFDVEIPAVDPENDLLLSDDKPFFQQLCRITIIKSRIYTELYSEKALQNKTAAEVIKIVKKLHAELGEWRAANTFDDQLKQGAAGEDFLRGFASAGMQFVYFNSLILIHRMVLVIAFIYRQRLANGGPAPDDANLILRESSSSIAFCSEAARDTLRLVNNLPWGDIAWIW

SEQ ID NO: 38622 - protein, 315 aa, A.fumigatus
GNDSIRHRFTFYFDAHYSHRSLLYYVFLAVMTIFINILRDSRYPNVREDIQSLNMASTFFATLIPSDGPSNYARFMTQMSANFERIARSVVERDQKATKLSQRATSRTSMTRAEGHDLASEEQRSQRSQPAEAPKSSPSSSPVHSPSIIDIPHLPGLPRINSSGYVVPDSSPSASDDLQPSNSYPPIENACQNGAASSESSASPQVFNNPTYPFDAFFPMPIANHIPQSEFWQTIPIADWGPPGSNQFSDDPYMQGFFQGRAPSFAAPTTTATPSNMPSVPPDLGFSTENPGQFVDDQGPSQSIWPGGGFGNPFS

SEQ ID NO: 38623 - protein, 167 aa, A.fumigatus
EWGILIMYLVSYGCSEGVHSPAAFRIAWGVQAVPGLILAVALLFFPESPRWLASKERWEESLDTLALIHGHGDRNHPEVQVEWEEVQEPVRIAREAKDVSLFALLGPRVWKRTMCGVSVQVWQQLLGGNVAMYYVVYIFQMANMVNLFLLLPDVYLGDRLADMFLAR

SEQ ID NO: 38624 - protein, 127 aa, A.fumigatus
APAAWIYASEVFPLKYRAKGVGLSAAGNWIFNFALAYFVAPAFTNIKWKTYIIFGVFCTVMTFHVFFMYPETARRSLEEIDMMFDSKVKAWQSHKVHDKFGEEIEKHRQQSVVEAEKPVESVHAEVV

SEQ ID NO: 38625 - protein, 169 aa, A.fumigatus
TQHVERKHHDPLVYVPSGWSLDIYGKIVRSVVLRVRAKPLTCIANRISSNPDVQFTIIINPDNGSGPTALPDENFLAAVPRLTAYSNALVIGYVRTDKGTRDISEVKKEIDTYEGWPSASGNPSFAVHGTFLDEAPSEYDAAAVEYFQQLASSIRGSNGLGPNNHVSNC

SEQ ID NO: 38626 - protein, 174 aa, A.fumigatus
PGDTVLYSSAIQYVIFLVTTGVILPYIDRIGRRLLLLSGSIICMALHYAIAGIMATYGNPVDEIDGNKNLRWEIKGAPGKGVIACSYIFVGIYGLTWVSASILCPECRTNKAPRPPLPGSTPPKSSLSNTAQRASVSPQPATGSSTLRSPISWRPPSPTSSGRRTSSLGFSARS

SEQ ID NO: 38627 - protein, 101 aa, A.fumigatus
VVMNPGTVPDAAYLGIPDTTVIFESPYSEFVRAVSSDQFQGIKGQDLSRFASMVYDVPDNVDLENLLSQLRAISSQTYLSNLNTYQAFDSVWTKVVSLLSA

SEQ ID NO: 38628 - protein, 95 aa, A.fumigatus
VYGSFPLLMVLSGLTGLDIEKPDESLRRVSLPTLHVHGLKDPFLMLGRQQFQGYYNPNAATLYEVDYHHAMPWARHEAKQLADHIRTIYKNSAKQ

SEQ ID NO: 38629 - protein, 70 aa, A.fumigatus
LADVLDHVLECSIVHQNVNSSQTPKGDVDYFLAVLPFSDIYCQAVTFFSGFLHSSLCFLSIYLFLWQVYN

SEQ ID NO: 38630 - protein, 701 aa, A.fumigatus
TTARADALSDISAMDQTVMQDQSETIIQCPASRSTRDGYNMPIESALSTPWVFLSPTTSLHANTVDCAKYFLDSLALSVSNAQLARQRVMRKRKRSDYEQETLHHVLQLKELFVQGFTSDQIWEQATRILDSAKQEIEQDSALIAQHVEPAFLDARASPFLSQEANSEDISNFSDISDSAADRSDRDSASDDEREDMGSVPESPSMAEGRSDGDSRTDVEESDNDNHNSRGTYVQDPFGLNDGFFSIDEFNKQSEFLERQDAKGEIDDDLESDEEEIDWHVDPLAGGVSVPSQTTRPTAQRSKRSFENGSESSSDEEGPTFDNVAIENDIDSEDDDAYAISADTTNWMNTSDIKYSDFFEPPPRRATSTKTRPLPKTQPHGAPVETDIDRAIADVRRDLLEDDESLDGNDSSDNELAGSKQQHSAHEKQRARIADEIRRLEAANVAKKDWMLAGEARGAERPMNSLIEEDLDFERVGKPVPVVTTELSGYIEELVKRRILAKEFDEVIRRRPGIPEAQTAKKVRFELEDTKPQQSLAELFESDHLRATDPNYVDPKNHKLLREHTEISNLWREISDRLDTLSNWHYRPKAPQANINVITDVPTIMMEDAQPAASSAVGGSATLAPQEIYAPGDNGKVAGEVTLKSGESIAKDEMTRDEKSKLRRRQKKQRKSDSDPAKQQSGTAAEKQQIVLKRGRRAVSR

SEQ ID NO: 38631 - protein, 189 aa, A.fumigatus
LHLERFERRCPCRARKRKRVQCNMSCSCPASFTCMHTKCLVVLTLSCSTTLDQVANWARQSSLWPMTFGLACCAVEMMHLSTPRYDQDRLGIIFRASPRQSDVMIVAGTLTNKMAPALRQVYDQMPDPRWVISMGSCANGGGYYHYSYSVVRGCDRIVPVDVYVPGCSSIFPLDSQLRFFWCESYADGI

SEQ ID NO: 38632 - protein, 192 aa, A.fumigatus
VPIFESNLAILISTAGHRIPIQHQKKPGLQAELEDPKPASTRIPTDDYGYQTYKAAGKLAGKRAIITGGDSGIGRAVAILFAMEGASSLIVYLPEEEIDAQETKRRVQETGKECHCLAVDIRKRENCQKVVDVALRCLGGIDILVNNAAFQNMVQDISELDEYALISQQSLLSPSSLPAPPQHTRRESSPIS

SEQ ID NO: 38633 - protein, 172 aa, A.fumigatus
DYTNAVLPRVELGAGGGLVGLAVARGCDVGPCPIYITDQEPMLHLMKTNIELNNLSTAVAATVLNWGERLPDCIPTHPEIVLAADCVYFEPAFPLLISTLQDLLGPESVCYFCFKRRRRADLRFMKAAKRVFDIKEVRDDPEADTYRRENIFLYSLRLRFRPENGSLRAIKE

SEQ ID NO: 38634 - protein, 169 aa, A.fumigatus
APLHYQRPHNTREGRALPLADQVDPLLRDQWHRTFDTNIHPYYYLSKYSLPHMRSGATIINCSSVNHYIGRGDLLDYTSTKGAIIAFTRGLSNQQIGKGIRVNCVCPGPSMYRYRIIAKVVSYIGSSLDSFDPIHHGYFCNGTIQLRAHGVARANLREVATCLVFLASS

SEQ ID NO: 38635 - protein, 106 aa, A.fumigatus
CGRGASVEGRKAGSHRVIGQWLEILIGKGWITDANARSPTACGSPAFFLLFLLRAEPFFLFACLFFLVTLSSSSGLSAEALQYFWDDHISPIAFEKVYLTSLWKMA

SEQ ID NO: 38636 - protein, 79 aa, A.fumigatus
SSLCARKLPLYCESHSKLSCAGGECRCSSGLGFGLTGLGLGTNPIHKLSYLFIYARSSSDGSVWSHILPTVSDSLYALY

SEQ ID NO: 38637 - protein, 659 aa, A.fumigatus
RVQRNCMCFKTNHSFFKIFGQKTKIRYSGAQAVMRSTTSRKGQTSITHLMNFSLPPRPQYQPPPRNSRRYASWGLGSGYHAMDKARYVHANYRFIVNPTRSYHAQAANADVHLDWDSVLQVLVSAQTQSTSCPICLSTPVAPRMARCGHIFCLPCLIRYMHSTDDDAPVPEKKARWKKCPLCWDSIYISETRPVRWFRGQEGDIPVEGGDVVLRLVKRDPGSTLALPRDGAESLNPGEDVPWYHAAEVADYARIMKGGEDYMIAQYDAEVEDLRRQEAEDELLFGDDNTWTKKAIAAINDAKTKIKGIGNPPNVQRQPATDKSLKDAVSAQSSQSSPNATQTEEILAAESVSSSGVGAGAATIPVTNGEVERVAEAVANVHLKSTPEAKLKQKDAGHSRSPHKGDRTREGNGPHPPDHPFYFYQALPQFYLSPLDIRILKAAFGDYATFPATILPRVERISSGHIVDDELRKRVKYLGHLPQGCEVNFLECDWRDVVVPEILERFSAETGRRRKRNKEKEAREEKERLRAEKEEEEKRWAAARRRRPSIGISDPPFSDQDFQPLSNDPMAAGFPPFDAGSSSASPPRPSSQFGALASPSTTPPGVRTVWGTTVAPFIAESSEVSPRPARHDGWREDWEEELLAHQERQLLAQTSLEGNQ

SEQ ID NO: 38638 - protein, 194 aa, A.fumigatus
SLAESVFPPLHNTYWRESSVRLIFFRSRKLERPGYVETPGRRVTRSRVVVASETSADDVSDSATEIRGRSKSTTRRRQVKTEEASEGEEKGRANGHINGNTNGHTNGHTNGHTNGSTKKPRVIDGWVEGSDPKIDYSGEFEFGGSWGVLSMMIGFPLLMYYMWIGAVYYDGKFPRPFGRPEHVGISRAHGPFSL

SEQ ID NO: 38639 - protein, 160 aa, A.fumigatus
  UNSURE (103): Identity of amino acid sequences at the above locations are unknown.
CTTCGLVPSIMMANFPVPSEGQSMSEFLAHMGHLVCEGAYPSLRAWIIYWVFFIFEGLCYVLLPGVTVMGPCSAPLPGETTALLLFRCLVFLPQHCSCWGSSXLPGFSGGTPSSNEFRAPSERWHPLWASRVVPPSHTPPRLAPWVPHLPLNGVTNPKNS

SEQ ID NO: 38640 - protein, 72 aa, A.fumigatus
PQRGFIPGLIVIGVNTGQASKSGVFARHGIHTCGSTAKKEHNHTTHSSTVRKDNKYSGMMYQTVITCMGYCK

SEQ ID NO: 38641 - protein, 112 aa, A.fumigatus
LKSLKISMENFITGYPGHESQHRAAMRRVLGPEKYEFFFDRWLEYFFTEADAKFFAGLGLNCIRIPFNYRHFEDDMNPRVLKESGFKHLDRVIELVRVLQRDDRMMLMCYSP

SEQ ID NO: 38642 - protein, 219 aa, A.fumigatus
CAKEKIYTILDMHTAPGGQNGDWHSDNPTSYAAFWDFKDHQDRTVWLWEQIAARYKDNPWVAGYNPLNEPCDPEHVRLPAFYERVEKAIRAIDPDHILWLDGNTFAMEWKGFDKVLPNCVYAMHDYSVGHFPSEQRVHMLIFPPSVNGFSYRRAIQGNPRAKGTPRTAVPSQSRIHEQKRDSNLERRVWPRLRQSPYGSRGRNHQPRTLQPSGRAASYL

SEQ ID NO: 38643 - protein, 499 aa, A.fumigatus
  UNSURE (434): Identity of amino acid sequences at the above locations are unknown.
EKFSKMSEASSASYPSSLDVLFDGTSPLREQYDPVKLAHAEIVPILQLPLARELLGHNPTDASAISRVSNGEICYTTFLAEKAKATAQMPLDGLTAGQQRSQILHIGLAALFSFMQSNITGPPLDFNSADVIFPKALHSDATKLRAARNHIIRELSVDGEAAYKLTPNVELFAVAMALLVDADILVADGPLVARTARLRVNFLHQKMLSEATSTLQDAIYSDLEELNRILLGEKSVFSTAQEKGRFLVERATIHSHHGFDAKARADLEQAAAVRKFEFALTGRLGKRTKFQEHDISQLVVLAKSAEELTTTGNSALPEDKGDTFQAGPKNLDLNDDTLLESISFTKDTQTSKDKSTTVQEESTLPPALQSLDPGNQPLLDPVDSAILLGLASTITNTSPDNGLTREETHPYAIRVLEGGSSNWQVYTQALLVRXRVEGYRARTVERSVLQMQALVDQVIADTATLDTQTTENGNQATTFLPRPEKSESASAAERLEYIW

SEQ ID NO: 38644 - protein, 434 aa, A.fumigatus
LPIVPLGAVPSAPVVKIVFCENSRILATGDLSGCIDTWLLKDVKDSSAVASNKRNGAADSDDESSDDEDERPVIDGERWQYANADSPIPRLKSGVLLLSFRPQSPAEAKLLTNGADQSSQISLRGESRLMALTSEHQLVEFDTLEGKLSDWSRRNPKAYLPEQFKGVKDRAMGCLWDLSESRDRLWLYGTSWLWMFDLNQDFPSSEEMKEAADGHEGDSSTQLVKTSSAHKRKREQMEEEEKRGKANSGAGDRMSLAQSDVHLGSKYRKIEGHDDSKGEWVSLDKERPQAAGDEEAFEYDENSAAVHDTALARLRRGKLEEDGISTPRKRVSLGPRDNLLSLNGSNDTPSRKPNDHDMPDTPQTRLVQPNGTQPARRWWYTYKYRDLLGIVPLSPPSVEDGVEDDTAGNTLEVAIVERPMWDVELPGRYVRDYA

SEQ ID NO: 38645 - protein, 70 aa, A.fumigatus
TSYSAHPFIWSFVYFFSSSCPFQLLYSLGELDRSIYKWIKVYSWNEPLPSAYTSVYEAAGSDISSFSIRH

SEQ ID NO: 38646 - protein, 73 aa, A.fumigatus
IILSYQSINLSIFIDQSLDGDIIHNSPDSETSQSLPPPSLLLMVKSRLQNLLSSPSRLTRWQKTYLLFQVWVF

SEQ ID NO: 38647 - protein, 161 aa, A.fumigatus
VWWGVAIGLFISVCIGAGMIGAFYGYGKDHFASTEDLWEGIFSLIASVIITIMGAALLRVTKLQEKWRVKLAQALEAKPLTGGTFKNNLKLWAEKYAMFLLPFITVLREGLEAVVFIGGVSLSFPATAFPLPVFTGILAGVAIGYLLYRYVETPESAVFLK

SEQ ID NO: 38648 - protein, 178 aa, A.fumigatus
TTMLMVCRGGNQASLQIFLIISTCILYLVAAGLFSRGVWYLENNTWNHVIGGDAAETGAGPGSYDIRQSVWHVNCCSPLVNGGGGWGIFNAILGWTNSATYGSVLSYNLYWIAVIVWFVAMRHKERHGRLPVVDPLLNRLRGRKSAEPGNGEQDVEVSTIPSDLQTESKIPKSGASLV

SEQ ID NO: 38649 - protein, 62 aa, A.fumigatus
VLFRILGTRSLQSALYVSPLYIPILFVSALTRLQEIGYCSSFITLQFFLLPCNLTPLYAICP

SEQ ID NO: 38650 - protein, 85 aa, A.fumigatus
LAAHSKTTSNFGRRNTPCFSSPSSPFSEKAWKQWCSLEASVSVFLQLPSLYLFLLAFSQEWPLGTYCIGMLKPLNQLSFSNRPPC

SEQ ID NO: 38651 - protein, 101 aa, A.fumigatus
LTFLHLPSVFFICFRECVETSIIVSVLLSFIKQTLGQEQDATTRKRLIRQVGRFYSLALSFSELQADSVDSVLLGVVGGCHWVVHQCLHRSWHDRSVLWIW

SEQ ID NO: 38652 - protein, 201 aa, A.fumigatus
FLSSSQFLTTFLVLKMPPHERLVHLKEYDIQDSNVELIGSDIDHRVKYKSAASEPAWNNELVGRECGSSSGALRTSRSSPGPRNERVSFTTATAISSCTPTRPRRSCATISSSGWGARPRRTRRARPRTRPSSSMSSCAELRHSIARCRRTPRRSSWRFSAGSVFGLGACDRASTTSRQRRRRPRRPSPCFGSSCTLVLRE

SEQ ID NO: 38653 - protein, 87 aa, A.fumigatus
WTCRAPFSPVVKTYIYSLYISSLPHCHFTTIQLIPFGSSPILVSASVIETTFLSSAHHGRSSFDLAPRRIHTASVPSCRLCSLVCHC

SEQ ID NO: 38654 - protein, 87 aa, A.fumigatus
RSQHFGLLVYVWPIWNGFRTSTVVANTPLGRIPTDTKQESRIYPLPHTYVVKDLVPDLTYFYKQYKSIKPYLQRDTKTEDVSTSRIL

SEQ ID NO: 38655 - protein, 107 aa, A.fumigatus
GLENRQSPEDRKKLDGLYECILCACCSTSCPSYWWNSEEYLGPAILLQSYRWLADSRDEKTAERKHALDNSMSVYRCHTILNCSRTCPKGLNPARAIAEIKKMLATH

SEQ ID NO: 38656 - protein, 171 aa, A.fumigatus
LKRPSSRPPTMAALRSTSRLVASTRPLFRPAVFARSYATVDPATGVGRTGSAEAKVTPETRTSNVQDPSPSQAPRIKKFHVYRWNPDKPTEKPKMQTYSLDLNKTGPMMLDALIRIKNEIDPTLTFRRSCREGICGSCAMNIDGVNTLACLCMFGPFGTDSGHRPWLLTPR

SEQ ID NO: 38657 - protein, 87 aa, A.fumigatus
YLSCLGCNIFKPSTPIYTSQANKGSLTCLYWIKNSQPHKDLIYCMMTVLEADLNDYGHSHRYTSCINLSCLVWYMYSAAQSYSPLLI

SEQ ID NO: 38658 - protein, 68 aa, A.fumigatus
WRSPLSLQIILSLAHSSALTQPPVHIVSFLFSISNYIPSIENASARKIGSSERVRHPRQQCGTDRFRH

SEQ ID NO: 38659 - protein, 371 aa, A.fumigatus
PPRQIQVSRIRTSLEQRTGRPRMRLFIWRIENFEVIPWPKERTGEFYDGDSYIVMHSYKAEEKLCHDIFFWLGSKTTQDEAGTAAYKTVELDEFLRGTATQHREVQAHPSPEFVALFRRLCVRSGGVRSGFNHVETEETSSTEAITLLRIFMHPGAARVDSVIVHEVEPTWGSLDDHDVFVLDQGQKIWVWQGKSCSPMEKAKAAQVVNDMTLAKHLDVEVLSQLESRSRIIVDLLGGKDIQQSSFKAPRPVSFPAGGDRDSDESQSLKLFRLSDATGAISFDLVKDGQRISPSDLDENDVFVCDTGSRLWVWQGSRASKLEKALWLNVAQSYARQIQEARTNLAAHLTPISNVVQGHESPAFWKAIRVRD

SEQ ID NO: 38660 - protein, 66 aa, A.fumigatus
SSDLNEPSPAQVIQDIMTPPASRGSGFPQNPLSHHGLILMTSDGDEYERTKVICAPSSWGQKLSRK

SEQ ID NO: 38661 - protein, 129 aa, A.fumigatus
SHGLETDNEPQGKGYPDLSTRAFVRRLLDETRHLPAEESPRFYALVDSDPDGMAIMSTYKYGSMAHAHDNEKLNVSKLCWLGLRTSDVIGGADSFGDEAFIRLSLRDRKKAVAMLSNNRLTTGLEGSAL

SEQ ID NO: 38662 - protein, 82 aa, A.fumigatus
PVALALGTYCYQYTFSCGCSSVIAASRESTVDCLRMRCYRTVRSGWYVGDISSPTSFSKIKTHFTSEASIASMSSVFGIRTS

SEQ ID NO: 38663 - protein, 187 aa, A.fumigatus
HLSPLPPRTACLPFTYLTIIQQELPELPKAKTPLQCAENGLEFFSKLQLPPGNWACEYGGPMFLLPGLIITYYVTNTPIPPEYATEIKRYLFARQHPEDGGWGLHIEAHSSVFGTCMNYVALRLIGVSEDDPRMIKARGLLHKFGGAIYGPHWAKFWLSVLGVMEWECVNPVPPELWYVPLHLHILL

SEQ ID NO: 38664 - protein, 486 aa, A.fumigatus
QRSRLLPDWVPFTPWRWWIHIRQVFLPMSYLWSKKFTHPLDPLTKQLRQELYTQPYDSISFANHRNSIHAADNYYPKTWLLNLINQLLVSVWNPYFRIPALVKRAEEWTWELIRMEDENTDYAGLGPVSNPMNMVACYLHDGPDSYSVRRHRERLNDYMWMKNEGMLMNGTNGVQVWDTAFITQAIVVAGFADDPKWRPMLTKALEFLEDHQLRENVPDQEKCYRQHRKGAWPFSNKTQGYTVSDCTAEGLRSTIQLQEMHNYPRLISVERLKDSVDCLLLMQNPSGGFTEYETTRGSEKLEWLNAAEVFGGIMIGYDYPECTTASVTALSLFSRFYPDYRADEIKAAKDKAVKYIKRVQRPDGSWYGSWGICFTYAAMFALESLASVGETYETSEYARRGCEFLLSKQKEDGGWGESYLSSEKHVYVQHEKSQVVQTAWACLALMEAEYPHKEPLQKAMKLLMSRQQPNGEWLQESIEGVFNQSW

SEQ ID NO: 38665 - protein, 273 aa, A.fumigatus
LSGLSPEPPPSLCQLTVAAMMNGCRTHGEGDQVTPDSNAQTDSNLSKGEGEMGFSHVSEVFDILPATALELLCVNVEFLARPSVGKVVEPVLAAGSTPATMARSDSLSSGEATPTRIIELHCSPISHEEGARDGIQQLMLSKRFLSKREPPISLRDYLLRLHRYCPMSTAVYLATSIYITRLATVDRVISVNGKNMHRLVLAGLRVAMKALEDLSYPHSRVAKVGGVSERELSRLEISFCFLTDFELRVDAQMLADQAQSRRSSMDLVLSEMA

SEQ ID NO: 38666 - protein, 431 aa, A.fumigatus
IRGSFRPRGENHSQATLDGIMGVNAAESSDPLHQEPHRLSLFSLPTGQVFLKLELNHALSDGVSTALIFRDLSLAYSKALPSSPAPSFGGFIRRLNLGEAEASSTALKYWTDRLTGMVPCLFPVLREAAWTGPSTVQHVEIPIHGSQGALRRFCTQHGTTIANVFQTAWALVLSIYTGTNDVSFCYLVSGRDASVDNVDEIVGPLISIMVHRLTLSRSLALLQVLRQVQSDFTVALGHQHCSLAQIAHSLNLRGQPMSNTVVNVQRRFSQGGPDGVADVYIRGIDCCNPTEFAIAVDVEDWETYMTARLSYWESCISQTQAEGIAETLAEVIRNIQTNPLQTVGEVALVGDAVLAKLSTWNAVLPEANEACLPELVERQVISQPSAVAIDTDAEQITYISLWNLSGLLAGRLIDSGVQPRDLVAVCVPQSS

SEQ ID NO: 38667 - protein, 71 aa, A.fumigatus
AVIAMLAIQRAGGACVPLDPKAPAQRWWEIISRTGISTVVTSETKKHIMSSQLPGLQVVSADGTEIDQHHL

SEQ ID NO: 38668 - protein, 198 aa, A.fumigatus
GSGRVLPVLSVDSTAYVLFTSGSTGSPKGIDVPHRAICTSLCAHCPVLGITNETRSLQFAAYTFDASIEETFGVLVHGGCVCIPSEDTKMNGRLSAGPSSHHRWSGLSTLISYRLFKRLSWEVKPLGTTSSIRGVTEWTSSMVMAPQKHPSVAPPPIYLYGRRSHHPQLAVRWDVGSGSSTPRISTGYCPQTALESSL

SEQ ID NO: 38669 - protein, 1228 aa, A.fumigatus
  UNSURE (389): Identity of amino acid sequences at the above locations are unknown.
AISWAFFTPSLVRLIDPDLVPSLQTIVLGGEAVGNDIFNTWSHRVDLINGYGPAEASICCAAAHLSLRQTQSPSTIGRAVGCRIWVVDPQNINRLLPPDCVGELLIEGHIVANGYWGDEERTASSFLSPPEFLQSLSLEYPADNFRRCFYRTGDLVRQRHDGSLIYVGRSDWQTKVNGQRVEIGEVEAQLSFHMAKNHSNHLSMVCVPKSGPWMKRLVAILSLDPEECTVGNRSNVVFCLDKPETAAMIRTISKGIESSLPPFMIPTVWIPVKQLPTLASGKINRRCVQEWVETSNEGIFLSVSRINSEAFGTSSTETTRGLTPTETVIRAIWSRVLNIPLHSIGLDNTFFSFGGDSFSAMQVVYQAHREGLTISVQDIFHCKTVAKLXRHADHSSKNTSSSNLLAPPVDEVEVPFALSPIQQWFFESVPHKPAILNHYNQSAHFRVMKEIDHSQLFKALQHVVQRHAMLRSRFILDSWSWQQKITTDIEGSFRLEVESIDAITAFRSCCERAQKMIDIIHGPLLVAILVKVAEPAQHFLVLIGHHLSMDVVSWSIIHRELEAFLAGSQVIAPLSSTSFQQWARLHYEPNIVPAEPREVLPFSVLEADLDYWGMRDTANEYRHGEYITTSVDEETTASIFKEANIAIGTEPVELIMAAVLYSFGRIFHDRSLPALYMEAHGREGDEFGLDLSGTVGWFTTICPLQLHRESLHTWARAVAQVKDRRRSIPAKGWAYFACRTVSPKGQASFNHHQQMEILFNFTGSTGDINDEHDRFLSPVRLMEDSRSDFDPKTPRVALFAIEASVENRQLRFSVSYHRSMRHVPRVKQWIHSLPSTLQEGVQMLSTIGRQPTLYDCPLAALNYSDLDSILARIQQSQADMVVEEIYPCSHIQEGILLSSMRNPGHYQVRWLVKVEARRGLPVSTQRLAKAWQSVVRKHSILRTIFVDDPSGTSSFLQVVVEDPRYPASIVEVQHRDSVASLDEDIDFTVGELPYRATIYQLHDGNVFFLLDISHAILDGTSMGILAHELVRGYDGSLTGDEAPHYRDYIRLLQTMPRNETLAHWKAYLQDIEPCKMISRNNCVEKVITPEVRKVAVQLPSTESLQQFCKTYEVTFANILQAVWAVVLMHYSGSETVCFGYLSSGRDLPIPHVDRAVGPYINILPCAVRLQQSSSRLDVVKAIQADLYQNLAHEHCSLWQIHKELGLKGTILSSTTGRRTIRRRDLPQG

SEQ ID NO: 38670 - protein, 62 aa, A.fumigatus
SLINQTEGVGYVTHGLQDTLFPGDEVVKTQYGGCHGAMKACRGEVSLSSYHMVSLDLLNSQA

SEQ ID NO: 38671 - protein, 293 aa, A.fumigatus
GARNGHIAKTFPIRKPVSYWLDCQLRSCQFNMTIDSDLDQNSAHSIVVESVNPDGMSLDKSGTELYNAAVAFCRYESEQQLHLHTAHHRLSIPDLHIMASAAQTQCGNRPLLATTEICAGGTYIVTGANTGLGFEAAKHLVGLEAAKVIVAVRNISAGEKAKKDIEESTGRIGVAEVWPLDLASYDSVKTFAQKATTELDRIDAVIGNAAVAVSERVFAEGHSMSVTVNVLSTFLLAVLILPKMRETAERYGIVPHLTLVTSLVGFDAKDLWDKIKDDPVNKVDGDDIPPMRT

SEQ ID NO: 38672 - protein, 101 aa, A.fumigatus
  UNSURE (96): Identity of amino acid sequences at the above locations are unknown.
ELRSLLGGVVVTEDFLVVHDLVGPTKTKALSTVTAIYDVGCFLGSILAFIVSERLGRKKSILLGNNIMAVRNILQASSYSLAQMFVGRGYSGVGKXFSNFI

SEQ ID NO: 38673 - protein, 116 aa, A.fumigatus
ALLRQRNKMTVPSSSASCPFCRIAAAYPPIPPSIFRPQHKQDSAQELAIIPTDTTQETHAHLVLSTPYVLAFLDIMPLTRGHVLVVTRDHHEKLKDMDVEVSREVSISSNLCLRVT

SEQ ID NO: 38674 - protein, 349 aa, A.fumigatus
VFFSGFPQAAVPFHVRSVTILEGIQIGIFVPRAYIIRQRYHIICIADRKEQSPYCIVKLANEEAARGLIARSILAKDIFELWAQGTNYEEVHSDVRRRTQHRWNNYKEVSFRFTIESFAGKRSNEEKREIIQSFAYLDFQGPIRMKNPDEDFWVLEEYIPDVAISKRTTSPSKTRPAELQTPQKIYFGRWVANSSREAINKYDLKKRRYISTTSMDAELSLVTANMAHAAPGKLFFDPFVGTGSFCVAAAHFGALTLGSDIDGRSFRGKEMGKGKPMGVLSNFQQYGTQSKFVDVFTSDLTNTPLRSSQFLDGITCDPPYGVREGLRVLGTRDGRGKEEVLIDGVPAHL

SEQ ID NO: 38675 - protein, 156 aa, A.fumigatus
TTWSGTFQPRGEDTEKKFSPTHAFIKLLQDQGKLLTNYTQNIDNIEANAGILPEKILQCHGSFATATCVKCHHKVKGEEIFDDIKKGIVPECVACKESLEDDSLKPQGLKRKRMSNGTQKSRKKDGEDSSEEEDYEIPTPGVMKVSRKYHEGAKSN

SEQ ID NO: 38676 - protein, 88 aa, A.fumigatus
PDITFFGEDLPDEFGRRLLHHDRDKVDLVIVIGTSLKVAPVAEVPGVLPRNVPQIYISRTVRYASIPWAILALELTHFLACDAYVLRY

SEQ ID NO: 38677 - protein, 83 aa, A.fumigatus
TSGTSILGDHPYSGTPQNQKVWSDEKDDVYAMEKNHPERYGQRVTDVTVVETGLSLGVKTYIVVPPTICMLFIPVKQYQGGLN

SEQ ID NO: 38678 - protein, 105 aa, A.fumigatus
IWNHVHILDLANFYLLLFRAVREQPDWLPSGPKAIFFVESGEHTWLQVSQGIADALHKQGLLDSNKVESISMKDAAAEITRGNESLVEITLASKYVRDLLGTYRY

SEQ ID NO: 38679 - protein, 145 aa, A.fumigatus
RKGIKGQRHLSSAAESIKYSIGQSHSTVNNPSSSNIMVSFSYLLLACSAIGALAAPVEPETTSFNETALHEFAERAGTPSSTGWNNGYYYSFWTDGGGDVTYTNGAGGSYSVNWRNVGNFVGGKGWNPGSARYRALSTSDVQTCG

SEQ ID NO: 38680 - protein, 188 aa, A.fumigatus
LLLRQLQPMAGRSQPSVGSASANLSQGNDDQMFWGLASITASETGFPEISGKPTWTSLARVVFNMQVARWDKVACDGGMRWQIWPYQAGYTMKNAISNGGLFELSARLARFTKNETYAEWANKIWDWSASTPLLQTDRWYIADSTSNEANCKDAGNTQWSYNYGTYLSGASFMYNYVSRSSTLARLVS

SEQ ID NO: 38681 - protein, 196 aa, A.fumigatus
CSMAGKTNGEDKWLKRVNGLLDSLIGTFCPKDKGGNVLSEVACEPIMTCDRNQIGFKGYTAMWLAHTAILVPSTAARIFPVLQGSALALSKQCSKAPDNTCGVRWWQPTWDGFTPGLETQMAALAGITANLMYYKSSAPKTIQSNPDGKEHQIDTHEDEAPDALAPINTGDRAGAWILTVIIVVAVGGSVGWLIKT

SEQ ID NO: 38682 - protein, 181 aa, A.fumigatus
PTPMAPVARTPSTGGTWATLSVERAGTLEALGTELCQRRMCRPVADRSRTINYGGSFNPSGNGYLAVYGWTTNPLIEYYVVESYGTYNPGSGGTFRGTVNTDGGTYNIYTAVRYNAPSIEGTKTFTQYWSVRTSKRTGGTVTMANHFNAWSRLGMNLGTHNYQIVATEGYQSSGSASITVY

SEQ ID NO: 38683 - protein, 132 aa, A.fumigatus
WSDSLKSAAKTVAAPMMDFYDKNQTEGIPGKLTGTWYVAGAMFMTLIQYWQSSGDDTYNSIVSHDLMFQSGENYDFFSGNYSQWLVGRNHLSGLPLLTSPRVTMIRCSGVSPPSRLRRRDSRKSQANPPGPL

SEQ ID NO: 38684 - protein, 102 aa, A.fumigatus
SVEQPIHVLIASTQYGVYYRRPYVTLSTTDSAQLKLIVADLRAKPDPECISKLHAKLLEASAVYSKDKETLSWFVMQSVHDKQDFCIVERYLNEGSQKYHLE

SEQ ID NO: 38685 - protein, 86 aa, A.fumigatus
FGEFNCHLGCALHVGLDQRPVGNHTLSATKFLYFCKYERRVVASSVTLDFGQTDRLFYYYVHFAFGDRLFRWHWIGKMDTRAYRKL

SEQ ID NO: 38686 - protein, 141 aa, A.fumigatus
MLAGRDEQSISAFYAETFFHTGPPSLHIRLLSRTVGPDRIVDEILLVFRHTEEIPWLLPRVPPTDRDVKIVLVMTASFRAGKLSRQNIYWDQASVLVQIGLLDPALVPGSFRATGKTREGRQDVEMLPVVGAEAVERVLNG

SEQ ID NO: 38687 - protein, 136 aa, A.fumigatus
IVYSGAVCSKRPPIVTMRPSTVVAALCGLLFSSSLVCADSSTSSRVALPADFKPQQVFKNVNLVRNTNLEKGYVRETVNVIVENVDKQPQSDYYIPFPSDVFGKVGGLEVRDKKTPGKGRFAVEALEVESPRYVCN

SEQ ID NO: 38688 - protein, 436 aa, A.fumigatus
SPRNARADQATSETGVGHKPLTKSSIEQLGKADVLVAGSLAIDLSCDYTPFAIESDKITPVPQTSNPAVIGQSLGGVGHNVAIASHYLGSSVLFCSVVGDDLSGRAALSTLQEEGLPTAGVQILPASSGARTAQYVAINDAKRDLVVAMADMGIMELPEHVLDFDGFWDPLIRHTQPQWVVVDANWSPAVLARWIAVAKQHGARVAFEPVSTAKSRRLFSKTSEADAVIQPAKAVPNNAISLAAPNQYELSAMYTTARESGLFEESEGWWRIIDAMGMSATGSRDRLVAMTTAELVDQGIPQQSIQLIPFIPCIITKLGAQGVLVTQLLRPGDARLTSPDSAPYILSRASPTDELIGGVYMRLFPSAGVLADREIVSVNGAGDTLLGAVVAGLAKWSGKSVEEVIPLAQEASLRTLKSPGGVSRDLVTLRSLMAAL

SEQ ID NO: 38689 - protein, 166 aa, A.fumigatus
QLCTDTRCRMIHTIGTTALLSTHSGPSLPLRRQPLATFPHPASPPSSCPSRGNSLARAPDPTTQSAPAHSPDPSIYSAGRACPRGNWPSSQAQSSRRGPWAVPAAATRVSPRYAETPAGSRRRCGPARRCARASGCAVMGGRYGRTFPRKKLKSTAHPFLPTFSKR

SEQ ID NO: 38690 - protein, 80 aa, A.fumigatus
YCSALRTALVMLSQAATRLCCRVRGPAIRAPRAIRSYHDVAQSKFLKVSEEIRDAVATGKPVVALESTIYTHGMSGSIQI

SEQ ID NO: 38691 - protein, 60 aa, A.fumigatus
RSRLYMRPGTMTSKYGSLIYLTDLFQGMAGRRLHGGTTVSGTMVLAHLAGIKVFGTGGLG

SEQ ID NO: 38692 - protein, 96 aa, A.fumigatus
PERDAADLTELGRTPVAVVSSGCKSFLDIPRTLEFLETEGVCVGTFADGREGSVDFPAFFSRDSGIKSPRVIRDEAEAAAIICKEPGLSSSVGLSY

SEQ ID NO: 38693 - protein, 80 aa, A.fumigatus
QARLISLVGFPYPENVALASLLESVVRVNGGIPATIGILNGVARVGLSAEELTELASTAEKKDALKVSRRDLGYICGLVR

SEQ ID NO: 38694 - protein, 130 aa, A.fumigatus
SEMKRKQLRSYVRSQGSLPQLAYRTDTKTDAQSKLPVSSGIHFANPVPAEQSIPKGEMDIIIEEAIRLAEVEGHRGSDNTPFVLAKIKELSGGKSVIANRALVEANVKRATKVAVELSKLEQADRGTGGR

SEQ ID NO: 38695 - protein, 199 aa, A.fumigatus
VYHHASTSHELSLINTRWKKEWWSQPDNRADQHIKIKYGWSEDWGYWIKVMDDRLEMADDWHSRYNTLAELDRFRASVLDGGREGCYLSVYTGPRGRGKRVDFEVMMDLWELYKVANSHILSEFRNLSKREIDEVSDTVEAKIIDEWVNPWARKCECQDCEAFDALVAANNKKNESDENDNDEEEDEDEDEDEDEDEDD

SEQ ID NO: 38696 - protein, 233 aa, A.fumigatus
EPMMVGTGLSLTKALFLPSQDVTISTLVCRPFQSRSLTNEATGLFCPFAHRPNLVRHVSVLTDIISLSVVRPYPNIKGEGLRFPKTNDEYPGATVDHLYGSEFLREIYLRADKDYKGPYSVPVLWDKETETIVSNDSAEMLRWLPNAFDPILPVVHKRVHLYPEALRSQIDEITAWMQPDLNARRLKGRKRGHSSRLRTIGSAGLSNAQPTPATHPRQWGSVHSRLAYSPKSI

SEQ ID NO: 38697 - protein, 291 aa, A.fumigatus
IAFQNAESRGQIYKYLRSSCDRRYCIYPGNQNISRNHGGDSTLLVTTVLRKMGRPSGLLLSISALLAAVLSPAAAAKNGSTLFKGGTIIAFNEKKQDLDIIRGGSLLISDGIVSAITEGAYDKPLPPGTEIVDATGDILTPGFIDTHRHGWQTAYRTIGSNTTLAEYFNRYGEFAADGIWSADDVYVSQLTGLYEALNAGVTTTLDHAHNTWSKATTDAGVQASIDSGARVFWCFGFHNVSNFPFEQQLAKFQELADSRRFSGQASSLGIAYDAFNPGSAQQTESIIQLAM

SEQ ID NO: 38698 - protein, 170 aa, A.fumigatus
SLTMCAVINSPEDLHALGFLNSSVPIVFSHASFLTPTGARLLRETNQYISITAESEMHYGHDHPYNHMIQDQASLGVDTHFTFSTDILTQARIWLQYVRLTLYRWLAQNYEVATKNPMSVDQAFLLATRSGGLALHRPDLVSSRLVPLLMWSSGMVRVRECLGGTIQLPR

SEQ ID NO: 38699 - protein, 133 aa, A.fumigatus
PGLLAGHSERRTGPSPTRLSVLSVGAAADVVIWDGSSPGMLGWHDPVAAVMLHAGVGDVKHVMVDGKMNKKDGKLLVPKYQDLQRKFVDVAERIQSTWLAMPPTVLEGDFAMSGYPLAVPPLADVVRGDESGY

SEQ ID NO: 38700 - protein, 100 aa, A.fumigatus
VYSRLTANMPTLLVDQTDHFWRIIQMLLAEATFPGHARLLSDLYSLHNVEQREPTGPDILVKGSQRRLIVIYVAYIHMERYICVLGHVSPINCIWTSHVY

SEQ ID NO: 38701 - protein, 68 aa, A.fumigatus
WHHGLNESCVPLRCACSVRKYTKESKTVSMVITCNQWIYCFYGSKLEKDCLGEHHSSLMIVHALISGL

SEQ ID NO: 38702 - protein, 163 aa, A.fumigatus
VCVAVFLSVQEVARMTSNKKSRLPPYQPGEHVGPSVHLNCVLLTTTVVNFLDLFQLSSVLFALPNIQQALGFASEDINWVLIVYNITFAAFLLIAGQLGQRFGLEKIFIAGTATLTISNVINTTAPNKGALLAGRAISGVGAGLTVSEFQQGRTDMILIPHRS

SEQ ID NO: 38703 - protein, 168 aa, A.fumigatus
  UNSURE (99): Identity of amino acid sequences at the above locations are unknown.
LFIASAAGWRSIFWLCLILTGLSTILACLFLPRFAKRKDIPIDIPGTVVFTAGVALLVYGLNDSSRSGWTSAAVLTGIILGVCLLFVFLWVEAKVSNPXIPGYLWKSGPFLVMLVAIFAFGGSFSTWFFISTQLCVNLLGYSTILTAVYFLVCLPPFHSLSLRFGARA

SEQ ID NO: 38704 - protein, 68 aa, A.fumigatus
  UNSURE (30): Identity of amino acid sequences at the above locations are unknown.
PAAFAAIASGVFATPLIRLAGEKNILVAGXAITAAGAVAWAFAGPRIGPAVPTTGRDTGIPSLQPSSL

SEQ ID NO: 38705 - protein, 575 aa, A.fumigatus
LYGGSPVVEVALSGYAMLDQIGTGLRQRIYSRSFIFANPNQPDDTFIYIVIDAVTGDTAVRHGVLQALASLGGDYARYGERNVALTGTHSHSGPGAWNNYLLPQIPSKGFDKQSYQAIVDGVVLSIKRAHESLALGRLSFGSIDVENANINRSPYSYDANPEEEKARYSANVDKTMTLLRFDRESDNRTTAILTFFPVHGTSLYNNNTLTTGDNKGVAAWLFERSVQDDANFADDFVAGFSQSNVGDTSPNVLGAWCEDGSGQMCRYSDSTCGGKTEDCHGRGPFFREKDNGAKSCFEIGRLQYAAAKQLYSQMDTSNTRITGNSNVRSFHAYRDLAGYTFQSPFNSSMLTTCSAALGFSFAAGTTDGPGLFDFTQNSSGPAESNPLWYVARAFVHQPSAKQKACQAPKDILLDVGANTQPYAWEPNIVDIQVLRVGQLFLIISTSEATTMAGRRWKEAIAKSAKDVLSIDSPLVVLGAPSNSYAHYVTTEEEYSRQRYEGASTLYGPHTLAAYINLTLTYLPYLGDSPNPATLPEMPTGVQPPINTDKSLSFIPGVVYDSAPSLHHGAEGARNH

SEQ ID NO: 38706 - protein, 74 aa, A.fumigatus
PCNNVVDIAGYGRGPRRDNQLDDFNIGSLRLDNTNTDKRGALAASISPRVQADKSAYHLRMSCVWSLVFFDNQE

SEQ ID NO: 38707 - protein, 205 aa, A.fumigatus
  UNSURE (68): Identity of amino acid sequences at the above locations are unknown.
PDIDAEPSAQARAAAQQLIAAELSPNHASTLHPAIPELPERGFSPLIQQEIDRKPAGLPLTGGIDLSXYEAPEPPARSTDGEVPDLDAWRRILQRAYMASSHLSMRHENLALLEEYGKNAWLIGNSQLEDILRGLEKELAETKEAAEAVNKQRKLAQEASQGEMVSLEETWKRGVSAILDVELASEGLRLQILEQRRRLAQQQAR

SEQ ID NO: 38708 - protein, 472 aa, A.fumigatus
LTSVEPNTLLTLEDKSNSILPQGQRLILRELGHRSGPKVYLLPVPPQGVSGKKFTLLTDQRFDKTGEHGNLEVLFCSVFPLQNGKFATVFSMNMDFSGGNTGSTRLACKNAAEDGIHLPASTPVSKYPFDRVQPFSYLQYELEDLSEHQFVAIVDKADSPTKGWVLAEFSDSSDAVIRVRGGLGGLLSAGLKMRLPANRPMLTEIKIPALHSSLLDYKLQIVRHNHDKRQELFAPLLRQSISDPHESKFFVNVDKVDVNLHGVAPFMPPPLREQATLGGVSFQLWTDPSCGSTVDVSLKVDIAGSLGELVMRYRTVFAAFPLLVVALVLRKQFQMYDETGYFITFAEGLDTALRSSFPILLLAMSLLASSLATSAQIPPIDEPFQWPVNATETPIDFTKNDLLLGSQDAFFWFLVPVFGLISVGVCVILNYIALILLSVLSFIYGCLITRSGYIKRNEKGYVNDTLAFYETR

SEQ ID NO: 38709 - protein, 121 aa, A.fumigatus
CLVHHAFHPPCGNHDQRGHDPQSHHKVCAIISSLQCQSTNHRRLKHVTSMILFAIAVYSAVYGVSYAYLLHHLANILAAWFVVIYFFSSGFSLRRLWLILEGDDATQGKSEPGGSHQKKKP

SEQ ID NO: 38710 - protein, 256 aa, A.fumigatus
THPTQGLRLRSAFPPQKASIRACVLNELRISPPPPMHRRSSGSPVEDDAEDSPLVSRSPTESTAHGPNNNAFETAEKSRSQIAKRGTSFDLRRDNGASTPRSRNSGLWRTPSSSSTSSTTAMATASTETKSSSASFLMPLASQRLPMGTSPESSRFRSSRLRSPWTCSILTALTTLVASVFLFFIVRSFSARQAGEDGCGIPVMSPTFLHMVGFDTEHTRFASKYNLYLYREEGVDFYNQENLGVCCPPLILQLQC

SEQ ID NO: 38711 - protein, 67 aa, A.fumigatus
TGAPVLFLPGNAGSYRQVRSLAAEASRHFHDVVRHDQERIKAGTAELGFLHDRLQRGYGCVPRPNPP

SEQ ID NO: 38712 - protein, 93 aa, A.fumigatus
RSTAHYNFSNYAHSIFILMLWILPINILVLLVWAHNLVVHWFMPFSSHHNVLSIMPFILLVETMTSGAMIPRVTTRYAPSFPRFSVSRLITAG

SEQ ID NO: 38713 - protein, 299 aa, A.fumigatus
SFSCSANEPKVERGLPSCSYREMPVATDKSDHLLPKHRGTFTMSSVTTKSASRPVPRSLDFFMIDFNEDMAAFHGQTLLDQAEYVNEAIAYILSLYHDPKRSRRDPELPDPSSVILIGHSMGGIVARTALTMSNYQANSVNTIVTMSAPHAKPPVSFDSDIVHTYKQINDYWREAYSQTWANNNPLWHVTLISIAGGSRDTVVPSDYASISSLVPETHGFTVFTSSIPDVWIGVDHLSITWCDQFRKAIIKSLFDIIDVRRASQTKPRAERMRIFKKWYLTGLEPVAERTLSQKGWCPC

SEQ ID NO: 38714 - protein, 93 aa, A.fumigatus
EWRHQLRSSIHPLLFAAVYSAADVVAQLLRLSLASRADLLVAAPKTAQAVIAGLGDFYTWKLARYVYGARSYEAWATVCSSHCLPNYRYEDRG

SEQ ID NO: 38715 - protein, 137 aa, A.fumigatus
LSKLALTVVSPWQWFCSTRTLSNCLETTITIVALYLWPWSWSFETPVRKKATRAASRERAQRGPEGSDSLQRYGGRPFDHTYLTRQRRLRQCLSLAAVACILRPTNILIWMGLASVAWFRTSWDRRAILVREVLLCG

SEQ ID NO: 38716 - protein, 479 aa, A.fumigatus
IHRCAVLGLSCVVDRLFYGSWTFPPLRFLYFNIAQSLAVFYGRNDWHYYISQGFPLLLTTALPFALVGLYRALAQVRTFGLGHLQSLVQAQLALICVIMPFVLSLVSHKEVRFIYPLLPSLHILSAPPLVDYFLPAVIRSSRSYTPRRLTLIFLLLVNIVIALYTTIYHASGPSNILSYLRQQHELHAPAAQTPSNLRPSVKDPSPHGITAGFLMPCHSTPWRSHLIYPTIHAWALTCEPPVDQTAAQKATYIDEADQFYANPARFLREHMAGGLRHISRKPSYLSAQPRPQHPSTTSTNDASHEWPDYLIFFAQLEPTLQSLLRASSYAECYRTFNTAWHDDWRRKGDIVAWCLDPAEQQAWRSATRQRDLENRERQFDRIIESFRKEASGKRDGKLSPFRRWFSSSSSVAPSSSLSLSWPTSWRWPWGQRKRTAWLGVQIPQWTRTRPSWTAWGGDWFGGWRQKKKTKKLLERDLWS

SEQ ID NO: 38717 - protein, 170 aa, A.fumigatus
RVTAVGGTVGTRLNGEHDVFATQDTRHRVHATGNSLAQQNQIGLDSAPLMAEQFACTGNTRLNLITDEQDIVLITQSSRLPQIVIVGNDNACFALNRLYQEGGKVGSRVLKGLPQGCLVIILEGLIGSRDCASDTWQIRTVVFARLGIARQRNSGELDEEGWSIHHDRVD

SEQ ID NO: 38718 - protein, 137 aa, A.fumigatus
NLPTTMSSSRRRKSFTSSSSSSSPSFHSPPPISRLRPRSPPSSNTKTSPTSTTPLATNILLSLIAFRLVNAFTVRTFFQPDEFFQSLEPAWQIAFGENQGAWITWVSGVASPQHYRVQPCLAFEFVANSHIIPATNL

SEQ ID NO: 38719 - protein, 201 aa, A.fumigatus
PGGPLSLAPRPAPRRRPRQRERRRRGNRRRRRKPPTERRELAIALPARFFPETLDDPVELSLAVLEVALAGGGSPSLLFGGVEAPGYDVAFAAPVVVPGCVEGAVAFGVGAGAEEGLQGWLELREEDEVVRPFVAGVVGACRRRVLGAWLRGEIGWFPGDVAEAAGHVLAEEPGGVGVELVCFVYVGGFLGGGLVNGGLTG

SEQ ID NO: 38720 - protein, 312 aa, A.fumigatus
KPSVHLKFSSQGNKILFPKRVWRESQDPFFQFGGPTGKRPFTSKPVNPEPWVGPDKPFFQPVGRGGGIQGSNNLSQSFGSAVPNPPQHANIMPALSSTSPFSQVFYQQQQQPQPQQQQQQQQQQQQQQFMQNQPHLQGQGFASQNPFQSMAAPNTPPNAIYQNQYQPQVQAGMQQPTQYMAPQPTGRVDKDTILSLYNTSSPQASGMQQPSQMQASMGMSLNQAAQNQPMPSISEHQNNGPQASAGPQLAGSRNPFMGGQGNPGAGTDLTPKASQPNGNFPRHMSQQSVDINGFQSGRHSPDAFADPSARYQ

SEQ ID NO: 38721 - protein, 219 aa, A.fumigatus
FAAISLSCDPESRENYGPYLPGIGCTIPGTDKPLKYNDKAALREAFENAGPNLAAFLVEPIQGEAGIVVPDDDYLREARALCDKHNVLLICDEIQTGIARTGKLLCHEWSGIKPDLVLLGKAISGGMYPVSCVLGRKDVMLTIEPGTHGSTYGGNPLGCAVAIRALEVIQEEHMVERAEKVGHVLRKGLEAIRSPIIQTVRGKGLLVFTTGVEGSALSV

SEQ ID NO: 38722 - protein, 249 aa, A.fumigatus
SRTISFKLTSSLRSASMSANGTSFYHASSTQEAIQAEKEFAAHNYHPLPVVFARAQGTSVWDPEGRHYLDFLSAYSAVNQGHCHPKLVAALVDQASRLTLSSRAFYNDVFPRFAEFVTKYFGFDMVLPMNTGAEAVETGIKIARKWGYKVKGIPENQAVVLSAENNFHGRTVSARENQSTRSWCIDQPSSSSSPLFLCLAIPSRAKTTVRICQVSDAQSLEPISPSSIMTRQPCGRPLRTRDPTLPPSW

SEQ ID NO: 38723 - protein, 125 aa, A.fumigatus
VLKQCLLHVLLFRSHPQILFNSTRFVQGFKMRELNPLVSEVQHDKHRPREAEALLMLRKIASLVKPIMRQRAWRVGTLCEFYPQQRNLLGLNINAGQKICLRLRYPSDERQFLPLEQVVDTMLHE

SEQ ID NO: 38724 - protein, 74 aa, A.fumigatus
HTFPHYTTAMADARRTSPYLPAKRSYPDSVSHLYNGPGCHYSTVNLGRYHQYSTPFSYTDHSDLPASSYTSQHQ

SEQ ID NO: 38725 - protein, 284 aa, A.fumigatus
DTSLIPGTNTTNTMILLQLLLFPSLLSHSLAAVLPRHSQRILNPAADDLTKIFTFSNDFPAPNSGNLQVHDPNIIEEQDTLYLFRGGLHIPYWKASSISGPWTKVGTVLSKASVISKKNNNHPWAPTVTKYKGRFYCLYAISQTGSQDSAIGYASTSDLEKEWTDHGALINTGSGERSQIAPGKNTNAIDPAFQVDQKTGKPYLIYGSYWDDIYSLPLQVNQDGTLAIKNENKPDATHLSYQPGNWRPQEGAYMSYHEPYYYLWFSQGICCQMVQKGFPLKGEE

SEQ ID NO: 38726 - protein, 86 aa, A.fumigatus
HLTSRGTDAPFRYRIRVGRSKSITGPFVDRSGKKLLEGHGETVYGSNNGNVYAPGGEGVLPGNGKRGDILYYHFCESFPIPMGLSG

SEQ ID NO: 38727 - protein, 896 aa, A.fumigatus
GLTEYPDLAYGREAKLLCKKIVAFFALLSKTQEAGVRKLGVTQELLSLVTGLAHYLKLLIRIGLQGALKLEREKESPEGLYHFLNHLADIETLRPPEQEESPADLMAGVASLADQLSDCCAACKEPIDDECVMLGESRWHIKPPHLTCAACQTDLTDTCQEALWSPRIKKVFCNNCASQQGLANETQGGFTRVSKLKQFVFLLRVALARLLAVLHAGGTLQPTSGMLFRRNANTGQLWVNTFLPLDDPSFAGSETQDGNQTQSGGNIHRSTTRSKYAGRDGAAESSLEQTVGEMRRLRSIRNERTLSTTYKRARASRIIDGPEGRSVRPGSSGGEGSDARGHGFQIVEERDANGETVTDLTFGNQDALTLDDIPRIVAAEQAKEQRPNAYRHAGTKLVGTTEPLPRYNQGHQRGVSSGNLESHLAERTTKTKKYFSELSALEYFIVRHVAVLSMEPLLEGYFTLDELLSLIESRKPTIWNIFGRAFNKDAKKAGKKKGVFGVSLDFLVEKEGTESTHGVGPGALRVPALVDDAVSAMRQMDMSVEGVFRKNGNIRRLKEISELIDNKYDQVDLTKETPVQIAALLKKFLREMPDPLLTFKLHNLFVISQSKLSSRIPDSKPLLTSPFTEIPDPEKQKRLLHLTCCLLPKAHRDTMEVLFAFLNWTSSFSHVDEDTGSKMDIHNLATVITPNILYPNTKNSTVDESFLAIEAVNALITYNDTMCEVNPSTTQCPVDQLADCLIKIPEDLQAVLSDTTFFKDNNEVSTKEILKRYGDIARGSFSPKPNNGGETVTITNPHNRGANTPTSARIETDQSQDGPWQAQNPVRHVQNTGGHNHASSASAPYNGMELAPGQSASYRERSTSNGSQQNPIPQEGQPQQMPYRSRPGAGPMGVAG

SEQ ID NO: 38728 - protein, 193 aa, A.fumigatus
WNVDAPAPGEDPTVCGAQDSYYEHEGRVYCHFHYSTQFAQRCHGCHTAILKQFVEIFRNGQNQHWHPECYMIHKFWNVRLAPNGQPLEHPEAGLDATDEERNRVREEEDMMEEKVYKIWSILSGFEESSAACISDMLLHVSNGSYLDGVLVAKRFIGHVEVLFRAIDELAGYIKAQEMKGKYRLARTENEVED

SEQ ID NO: 38729 - protein, 296 aa, A.fumigatus
RLFQWFLSPRYAASKTSMGADSKTRKQEIEDWSNDIYRPGPRLADQHLPDRPNKRASFLPTTSRFSSPYTVSNGGKQKPQYITMASQNSTSRLLPSTAGSMYKQSHNSSGGSLHLEPSRLNPAASGTSLAVGAESDVLGSSAYIHEAVVPQPPPEWQPYGFPLAHALCLVTCYSEGEEGIRTTLDSIAMTDYPNSHKTIIVICDGIIKGKGEEYSTPDIVLRMMRDPVIPTDEVEAFSYVAVATGSKRHNMAKVYSGFYDYGETSVIPPEKQQRVPMMIVVKCGTPAEATQAKAWK

SEQ ID NO: 38730 - protein, 61 aa, A.fumigatus
PERGITAVVSLFIHRLPSASVSYDIARAYGLSETIAFLRTYPHTNCDTAPHHFEINHLPRY

SEQ ID NO: 38731 - protein, 419 aa, A.fumigatus
SAVHQLRQLRPKPGNRGKRDSQIILMSFLQKVMFDERMTELEYEMFNGLWNVTGIPPDFYEVVLMVDADTKVFPDSLTHMISAMVKDPDVMGLCGETKIANKTDSWVTMIQVFEYVFPFLLHLSSFGLSLSFISLSNKTCRYFISHHQSKAFESVFGGVTCLPGCFCMYRIKAPKGGQNYWVPILANPDVVEHYSENVVDTLHRKNLLLLGEDRYLSTLMLRTFPKRKQIFVPQAVCKTVVPDKFMVLLSQRRRWINSTVHNLMELVLVRDLCGTFCFSMQFVVFIELVGTLVLPAAIAFTFYVVIISIIKKPVQIIPLVLLALILGLPGVLIVVTAHRLVYVLWMFIYLLSLPIWNFVLPTYAYWKFDDFSWGDTRKTAGEQDKGHEAGEGEFDSSKITMKRWRDFERGMMLSTPYER

SEQ ID NO: 38732 - protein, 398 aa, A.fumigatus
  UNSURE (393): Identity of amino acid sequences at the above locations are unknown.
SPTRNNVVGYLSVCTTLGAVWCLSISTWNNTLCDLLALSAATWLDYPSVACASLRLGKKQSVYNQGMPGPSDFAFTTSASSSPSYFFTSPSEHPTHPRYRNRTSHASSCDAPGPSRLRPVDMSFGQASFYDDQDSDEMSREGDEHAALRTDIDEFPIVATISESHQVGLTPTNDLGSSDAGISAFTAVSQYPNAFDNDSNAFAVTEVVNAVIGREEYLRGEGRHVRAASVGRSSSPPADLYMSDSETTDVLGHQGGVPIGPYMADGGMTMDNILADDPTLEHHFSTIPEESDEDDVGDLIMDYESPMTRDGFSVSDHEEDPDDTQKFYVDHDDDYYEEHIDRPRTREATAQLTDVDFNDFYRAFDYDPFLVMEAAPTGNHGDHNKSSPRGWKXPRSFL

SEQ ID NO: 38733 - protein, 199 aa, A.fumigatus
CLMSRDVDVRQEILHKTLQEVAQEDNGDELANPCVICLEAITEPAVTVPCAHANFDFLCIVSWLEQRRNCPLCMPPYLCNRPSLSVHFVLTFLGKSDVHTVKYELENPQGPKLYKLPAVPPSAANAPDSTSQHRGLLSRGPRHRRQPAESPRPREPDDPIIRRQYVYRHQLYSLRVGSNRLSQYRELSPESFNRDEELV

SEQ ID NO: 38734 - protein, 80 aa, A.fumigatus
ARVMFTLSSTSLRTPKVRSFTNYLLFLHPLQMRLTLHLNTEGCYPVVLATDVSPQKAHDPESRTIPLYGGNMSTVISFTH

SEQ ID NO: 38735 - protein, 68 aa, A.fumigatus
TFFVRTISTRFIPPICGFPYISAMWLTRPLLTLNQNQFTGRGNEFISLRNEYNPKLWLKSQAALNYSN

SEQ ID NO: 38736 - protein, 110 aa, A.fumigatus
TDCVTRNVLYGLVWFADWPQVRLVELSMEQKDALTVLLTGRSENGFADIIRRMVGSKKLEFDLICLKPEVGPNSERFSTTMEFKQTFLQDLVLTYEQADEIRVYEDRVKQ

SEQ ID NO: 38737 - protein, 81 aa, A.fumigatus
ETNTIYFFNALGFNTGSSPSGHILVDFSPRRPNQHASGLRSPSLPADFRLQGTPRFVGDSSSSTWRFIQNLRGLQIHGASS

SEQ ID NO: 38738 - protein, 377 aa, A.fumigatus
NSKPSVRRPCLRDYSFGASVKGFRDFFEDLNRSLQVVPAPRKPINAEVIQVAEGCTFLSPVVETAEVQRMINSHNKSIRQATSNATQSPYGRLRIKRTIFYTGYLISNADSNQLISQLLTPLLPSGLAESNDLKYMANSILITPRPAPRSILNKVGGIGKKLTWQVTGTAVFENKVWAARVAPVPATEKYYTENPLPVIVLAVRKGARPIDAGKIQNWHPVPAEKALTFETVVGEKVVLRVEEENPHEGEWESQFLNKNRKRRHQQERDQDILYPQSCQNDEPLSQTRPQPYYNSRHGGSSRHHDDGLRRGGSHRSGRGRGGAPRGKGHSSRGGTRGRARGRDGGPAGYRSLDDHVGYDGGYEDKPGPGGAGPVMNY

SEQ ID NO: 38739 - protein, 381 aa, A.fumigatus
  UNSURE (346): Identity of amino acid sequences at the above locations are unknown.
RFIGEVSLYCRTILLPNRELSIRRLSFCFNTRRWYENPSINIIEMMMRSFVLGSIVPTVLGLVPHHVSVANEKTSLTLLYQNNLNASDASNHISAILLDPMHQHDVREACQQFGETLISQTSLRDHKEDFKNLFTWLAHTGKTKSDAHFYIREGVLSVPKDSDDFAVSSFPRQNARLPVLCTQTGNDSVIEDADSRPKQLRVISEGNSYIGFRDQKSFRFLGIPYADPPGRFKHAIPYSHRDQTIHATKYGSACAQSGGGSEDCLYLNIQTPYIPKKGSQEGLKPVMFWIHGGGFTGGTGADPLTDGGNLASREDLVVVTFNYRLSTLGFLAIPGTDITGNYGISXQILALEVLFPLLHIDASETNITVTGDYKRYRANSK

SEQ ID NO: 38740 - protein, 485 aa, A.fumigatus
LHPLLQHLDIHLSLFPKKKAFFLPIFIPAPLSCFRQSSTCHRKMSILSDAIVVVAVVSPMFISAVKSILEYLACANIYISKAFRWMSAFKLDGILKKLDLWRELHTSNVKPFSASTPVPEFDNACLGTDNLHHKNHTFFDLDLGDLGSLWLGRISQNLVPTSGHLNNGPTFGSLHSEVLLLNWQVLLFMMIFLLIIPAVTSICTWYSRRHCFQVANIEILDFINEVRSWREFLFKRMSAAVSILNGKIDSMIKQIVMEHERVSAELPTFLDAEVRELRDALDTQFQNEDDHHILGVKNSADNLERARRRFPDPGGIEAECKGLQSVFQRWRQRMGNFLEHASSEAERSDNIQIPVKRIMELPEKAPTTQATQTKYEAMQDKVDKNEPASLTVSEKQCSEAEEPISTMGLWATASGYPAPTPAEIEEGRRIRRERVAKRLTENNGQRYVRSESGPRKHRCLFRNRLHGLHKQDHAAARQSLNLTLH

SEQ ID NO: 38741 - protein, 66 aa, A.fumigatus
QIIKCIINCWTGNMTDPRPYHLLRYRIPGYQDVNMSLTSGASYGTLLGVQVSQVNFILPARYPLRC

SEQ ID NO: 38742 - protein, 99 aa, A.fumigatus
WQEELRPCTPLKGDDGSEQEIRQTSWSVKSDQHGQPYCYSLLRCSSQQALVLKGSLNGTFLLIANLRIAYQSIKLFLYVLNALYISFQQGDHTSTRLQV

SEQ ID NO: 38743 - protein, 63 aa, A.fumigatus
SILIMAEKEATVYIVDVGKSMGEKRNGRSMTDLEWAMQYVWDCITATVSIALSMRGYGREANC

SEQ ID NO: 38744 - protein, 149 aa, A.fumigatus
DKDTEHPGFVPRTRLVLFVSRRWGCLRHVIESAYVMHRPGRSTAALNCITKDKSCRGSVVGSDQKMPSTRVRPIEKFAKAASKCSAEVCSCSPCCLYCRCLISPQAATYGKCIVADYNAVHKDMCAKEFMKLKDCFLVCCLEPMVDAAY

SEQ ID NO: 38745 - protein, 246 aa, A.fumigatus
TLAAGQDPAVHHVSIGSFSLGVEDKVNAIVLLEQSGLTLEELVAVPQREENLGNDLLHTRLLESERLRTHNGRVDQIESKGIGTVALHDQRRIRVVLQSFRHLLSIFSKNNSVHNAVLEGQSAEEMCSQDSQSVEPTTRLIETLGNEITGEALLKLLLVLKGIMLGCVWHATRFEPAVKHLADTSEDTLALLTWDSDLVHLVTMKVSDFSFVATQLLELLDTSYSHDFLEVVADPQRKWCSPEAVS

SEQ ID NO: 38746 - protein, 67 aa, A.fumigatus
VRNRQETRHVGLEAVEKLGIEKYNEECRAIVMRFASEWRETIERLGRWIDFDNDYKARYPPCEYISV

SEQ ID NO: 38747 - protein, 156 aa, A.fumigatus
RSLLLKRRCLLTASSSSKGDLVVKRGLKEDVASEGMEPNADADVLTILDANLYPELAQQGLGREIINRLQRLRKKAGLVPTDDVRMEYAVLSDPDSVGIDEAFKTQAKAIEKAVRRPLEQVAVVDGKVPSGDKEALIMEEEQEVQKATFLLRLLKL

SEQ ID NO: 38748 - protein, 156 aa, A.fumigatus
VIAALHLSSFFIYPATHPSLPATDRTDSHYLTTVPSPVMSIDFPAEEEITLKRWREINAFGRQVELSRGRKPYTFYDGPPFATGLPHYGHLLASTIKDIIPRYWSMKGYYVERRFGWDTHGVPIEYEIDKKLGMWAWRLSKNSASKSTMRSAELLS

SEQ ID NO: 38749 - protein, 775 aa, A.fumigatus
TMNSSFMESVWWVFKQLFDKGLVYRGYRVMPYSTALNTPLSNFEAQQNYKDVQDPAVVVSFPLVDDPETCLLAWTTTPWTLPSNVALAVNPGFEYIKILDEASKKHYILLESLLRTLYKDPKKAKFKIVDRFKGVDMKDWKYQPLFDYFYEEFKDHGFRVINGDYVSAEDGTGIVHQSPAFGEEDYNVAMASGVISETRLPPNPVDEKGCFTAEVPDFVGQHVKAADKAIIKHLKGTGRLIVDSQITHSYPFCWRSDTPLIYRAVPSWFVKIGPIIPQMLQGIEESHWVPSFVKERRFASWIQNARDWNISRNRFWGTPLPLWVSDDFKEVVAVGSVEELKQLSGYEGEITDLHRDKVDKITIPSKQGKGVLRRVSEVFDCWFESGSMPYASQHYPFENKEQFEKSFPGDFIAEGLDQTRGWFYTLTVLGTHLFGTLPFKNCVVNGIVLAEDGKKMSKRLKNYPDPTLIMQRYGSDALRLYLINSPVVRAEPLRFKESGVKEIVAKVLLPLWNSYKFFEGQAALFKKNNSIDFVFDPKAEATNTNVMDRWILASCQSLLKFVNEEMAGYRLYTVVPRLLELIDNTTNWYIRFNRKRLKGENGIDDTLHALNTLFEVLYTLVRGLAPFTPFITDTIYQKLLPHIPQALRGEDSRSVHFLSFPEVREELFDEVVERRVARMQKVIEMARVSRERRSIGLKSPLKTLVVIHQDQQYLDDVKSLEGYILEELNILELVLSSDEAKYNVQYSVSADWPTLGKKLKKDAQKVKKAIAIPHE

SEQ ID NO: 38750 - protein, 110 aa, A.fumigatus
AFVSSCFRLLLIACSVVSYKTPIMDPSQVKIPPMKDLTVDNITENVIRINSLCEDERMKYVLERLVTHLHDFARETRLSSQEWMAGLTFLKEVGQISSDVRQVRISPALL

SEQ ID NO: 38751 - protein, 203 aa, A.fumigatus
YEHMGNQPQGWKTKEFILLSDVLGLSILVDSIDHPKPPGSTEGTVLGPFHTHEAEEITQGGLMSHDPKGEPLLVVCTIKDTNGKPIEGVKIDIWETDSTGHYDVQYPGRDGPDGRCIMRSDKDGVFWFNAITPVPYPIPHDGPVGKLLKKLHRHPYRPSHMHFMFEKEGYDHLITYVCALLPASLSAERNGANEMRQSSLPPK

SEQ ID NO: 38752 - protein, 91 aa, A.fumigatus
GRALYLRNDPYETSDAVFGVKDSLVVDLGKAGPEYAKKYNVPEDRALLTYDFVLVTDQETADLRAKNSKEALDKLGRKVRIVNGLPVPDLD

SEQ ID NO: 38753 - protein, 234 aa, A.fumigatus
FTGPHTLHSFMESRTPAAAEPSNKRPRSPSGDYHPIASKVPKSHSNHLQINYLARQYPDNLPLVSLDDTMPAILHLVGEYDGVLHRHESIAGNLGACPLGPILIKRFERLFDGPPRVLKSHGKEPPNITWLDVVEFAKSKPEQFNLEKSRNGVRVCQFYTKQCRVEISEEDYVLIASGMPQKMIPPQPIIEDEEKELGALEILEKNLQQIIQVADQGRSMSSFKCGHMFSFSGI

SEQ ID NO: 38754 - protein, 307 aa, A.fumigatus
YTQYADDLLSYYLDTVLSVLESSPTARESLAESYSTYRALRPPKPSYMNFIMENTPAEPWWQSRLRLLQLLGGGSSSQFSSMPSPSKLTYSIPAVLARIEPFQNELVSESVILDGLQGRHREALRLLTHGLGDYDSAVRYCLFGGPRSTSSAGTVELPDRSHQSELFRYLLDEFLQIQDVSERIERTSDLLARFAAWFDIKDVLQLIPDDWSVDILSGFLAHVFRVLVSQTREARIERALSASLNLRIGAEYIDGMEKVGGWVEDDSGVRRLKDAAAGDASSNTAAVQVAGGGSDFGDMVEASQSGP

SEQ ID NO: 38755 - protein, 1082 aa, A.fumigatus
  UNSURE (533): Identity of amino acid sequences at the above locations are unknown.
NHDLVWPPDRTAYMVGGLFPFCFALRIAAYHISTAEVFGKNQTGDTVAAEWLTQYQKDAKAAMHAMINFILKCAGTDLEVSDADIDDPDHAPERINDLSTEYHALGIFEYPLISKARTFKAFQPILEDFFAALVQTLHHSSVLYKQQELYENLQIWLAALSTSGCRPFRHTSTVISLTIMNALCDVAREVMTTVSASRKQLEAEKKKKTVNQGRVNAITSTVEEGESKLEAIDEYLKDGVNIVFVHRYRDIDPKIRSECIAALGRWMHTYREYFFEGQFLRYFGWILSDPSAETRSIVVTQLQRLYSNKDNIAGLRSFTERFRQRMVEMAAHDADVGVRASSIELLDLIREAGLLEPADIDTVGRLVFDVEPRVRRAAGPFFVANVEDVFESTTEEVGDEMNEMFGDEDEDDYESPKRSWIKFKCLVDILQAYDEQENELAPERKSSTARDALFGASLDSRFVLATEAIYPHFAELSQWQSLAGFLLYDHSQIPDDPTGDSATGMVKKLYKMQEGQEVILLEVLCCAVKLRIXDVAKSDIDKRGRKVKALTDKIPELQEEIAHSLAQIIPQLLNKYGSVPEAASAVLRLEHLVDLDKIQDLQKDATAYTSLLNDINKQFLTHSDQDVLAEAGVAFLHAKSSDDMREALESKVQELWDDIIDALEALSQKKGVVEGSSIPMPTLNDLANTAMRILNLASVTDCTHVLEKKPASKSKGRKKENPEAPFNVLIHLVKRGLREEEEDDESAKAETELVTSSIRTLLFYFMWKVQALTTALSAGKAAFTTAYFETLTKSREVFVASLVAVMRQRSGLDDIRFTATTTLLDLQTLFGTLRHAGLNTGNDEEVIMQTQSLVHEIDSNTQALIAKIHGIAERTYARKLRQPLEPAEDDEPASESDVEREPSDEEDETGAEGESIANERLRATILAEQRLCELTGKIVLAIIGRIIDASGSERGQLKQRLVRHKSRLGQNYREVLSFLDERKPKVIGPRPSRSKGKPPPLGGAQQDRASATKLPKVSKSAERMDDDDEEEDHEPDVDAEQDDEDDLRARGLVEEDNVDEDHEEEDDNPTAPDPDEDEVMGD

SEQ ID NO: 38756 - protein, 248 aa, A.fumigatus
FILQRAILSPIRMENESPLSSPEPGLTDLDSPQASIRRKSGRVSRKPEFLSQSYSDSNPGAAKRKRDITRDEDEEDDADEDDASESEEISDGEPDEEELREKRRAARKASAKKATSGVKSKTTKSQATHGAKRPRVAGNGIPNQLAIRPAVNGKKTVSRPRKVKPRPSLAAGQNGLYGRWLISFLFRLAHRGLPYLNSGGLWEKPDWRHCCCRMAYPVSEGCQGCDACHDQLYTQVCRDRFGSERCGY

SEQ ID NO: 38757 - protein, 62 aa, A.fumigatus
SFLYHSLTSLRSHSGAYLSTSLLEISSIAPSDIPILLLSSFFTSLVIINSIVSQASNLNRAH

SEQ ID NO: 38758 - protein, 153 aa, A.fumigatus
YNDIRQEDGFKNIIFANRMIAESQRARGIHMIHESERKVFQEHRFTAYYIWVVLHEILGHGTSKLLQEDSQGHFNFDREHPPLNPLTGKPIDSWYGPGETWTGVFTDLSTTVDECRAELAGAYLIDVAEILQLFGCTVDSKIKPADGKSPMGA

SEQ ID NO: 38759 - protein, 361 aa, A.fumigatus
YNPWWCIQGTMSASSDVMPTDGGHSQQTAPPQQLNRSCESCRGLKVRCIPDPTTANQCQRCTKTGRVCIFVAPQRRRPRKRTDSRVAQLEREMRQMRSLLKDRLHADDSSGESVDSDHDESPEHDSGVESKDHLSSIPEAPSSVSTSTRHTDQSYGGVPLSSYPTVVESSSVSIPSFTPGFSDNSPEMPIGDDVIDRGVIPLEYANELVAFFIRDLMAFAPVVVLPPETTASHLRHSKPVLFLSIIAAAAIAVDATVAAVLNRELVRLYAERFFIQGEKSLELVQALVLMTVFYYPPDSPMKLQHFQYTHIAATMALEIGLASKRRVSPKAGGKKDKRNAYDEQMAEQARAILECYHLAST

SEQ ID NO: 38760 - protein, 64 aa, A.fumigatus
AVSSPEALLDKARRQNDSINEALNDPEQNTTGAQFDKSKYPSEAVFDKGSTTKVAVDVPPTGRM

SEQ ID NO: 38761 - protein, 82 aa, A.fumigatus
NSIVSLRLGIGVVVVVPYIIVLIICSYLVIIYYNISNFTLSSLICYFNIITFLTFTYIAYLYFYLTFITSSLYKELLLYIIF

SEQ ID NO: 38762 - protein, 71 aa, A.fumigatus
YCNPRSSGKTTSIALCSSAPDLAFFQDFNFLRWHVFLIYVGFNLIAFLVNAFWNSILSALNRATCKAFLSK

SEQ ID NO: 38763 - protein, 146 aa, A.fumigatus
STLLLGTDKSPESAYQQLLRVKSCTNCSCRDSGLPFSPIWTTVHARLKTPVNALVLNAAAVFCCGCIFLGSSRYSLLLLEPCLSNLNFVERPTYCIFLLVHSTHSALRPSYALIYRIAFRFSSIAYVAANCSLHAHGSSIPPLDGL

SEQ ID NO: 38764 - protein, 307 aa, A.fumigatus
CPRDHWSVSSNTPRTNESLVANYLIFSGRVAAGAIAEKYLRLSHGVEIVAFVSSVGNEHLFPPTPEHPSPSTNPEFLKLIETIDRKTVDAFVPTRCPNEEAAARMTKVIETFRDNQDSIGGTVTCVIRNVPVGLGEPCFDKLEAKLAHAMLSIPATKGFEIGSGFGGCEVPGSIHNDPFTVSEVQTRTGSTQRLTTKTNNSGGIQGGISNGAPIYFRVAFKPPATIGQAQTTASYSFEEGILEAKGRHDPCVTPRAVPIVEAMSALVVMDALMAQYARESAKNLLPPLPSTLPTKPTLGSSGAPASS

SEQ ID NO: 38765 - protein, 197 aa, A.fumigatus
PVFACSYGESHCRSVGCIVDGCPPGMELTEEDIQPQMTRRRPGQSALTTPRNEKDRVEIQSGTEFGITLGTPIGMMVRNEDQRPKDYGGSTMDLYPRPSHADYTYLEKYGVKASSGGGRSSARETIGQFRATPPEQMNRLLLTTSSFQAVSPQEPLRRSTYACRMVSKLSPLCPPLVTNTFSRRPPSTLLHRPTLSS

SEQ ID NO: 38766 - protein, 243 aa, A.fumigatus
ILCTFAGILGHERIHDDEGGHGLDDGDSTRGNAGVVAALGLEDALLEAVRGGGLSLADGGGGLEGNAEIDGSAVGDPALDAAGVVGLGGQALCAAGAGLDLGDGEGVVVDGAGDLAATEARADLKALGGGDAEHGVRQLGLELVEARLAQADGDVADHAGDGAADAILVVPESLDHFCHACRRLLVRAASGDEGIDSLTVDGLDELQELRVGRWRRVLGGRREKVFVTNGGHKGDNFDTMRQA

SEQ ID NO: 38767 - protein, 191 aa, A.fumigatus
MGAPLEIPPWMPPELLVLVVRRCVLPVRVWTSETVKGSLWMEPGTSQPPKPEPISKPLVAGMLSMACASLASSLSKQGSPRPTGTLRITQVTVPPMLSWLSRKVSITFVMRAAASSFGQRVGTKASTVLRSMVSMSFRNSGLVDGEGCSGVGGKRCSLPTEDTKATISTPCDRRRYFSAMAPAATRPEKMR

SEQ ID NO: 38768 - protein, 438 aa, A.fumigatus
GRKRDEVGLFNNSHRCCLSGFSAPAIGDIFHQQDLTLQYPASIFHLRLGDRQFTIRYIVSPSDLRHGVRISNSFNHAHPVPEPRRSSMRRLLRGQCLLTSALAPRRSGSSPYEGAVRYNSALSTDHFAHLASRQSSRHQIYQSLSSDPYVNLSIEHFLLEHAPVDSSILFLYVNRPCVVIGRNQNPWLETNLEALYNDRVETQKGDDESEDVLLVRRRSGGGAVFHDFGNLNYSVISPRTTFTRNKHAEMVVQALHNIGATNTSVNDRHDIVMTSGTSEHGGSGASMPRKIYGSAFKLTRHRALHHGTCLLDSPNINDLGFFLRSPARDYIKAKGVDSVRSPVTNVSTAFEDAFAPFSIQAVMEGIMEQFAQLYQVSPDAVRRAQRAHANEPELYAGSDWVAGVVGAQEGYGELEIRKGIDELRVRRMHIVYETLTHV

SEQ ID NO: 38769 - protein, 150 aa, A.fumigatus
WMLLAPGWTNLWRMYHVRKGKVHILTTELHKKYGPVVRIAPNVVDLDMPEMIRTIYSTRGDYRKTEFYHGSSAKNNGKIIYNLFSECDPQVHALQKRPIAKYYSMSGVLPLEPHIDETIGFLCRRLEEEFIDGPKAGRPCDLGQWLLYCK

SEQ ID NO: 38770 - protein, 767 aa, A.fumigatus
  UNSURE (53),(59),(61),(69),(677): Identity of amino acid sequences at the above locations are unknown.
VQLRKSPPPLGRKIPKVNKSSEDYPKSEGVSTWHVPPVLAESKNRVAHKISVXQELSQXGXTEPAKDIXRKLRPQVMVYKMSRPVATSTLWPDIRSGPFCNDNGSTDPDRLIVIVDAEDLRREGIELSRHLSWEKTCEDFVRELACNGQVVSLLECAHLIVCFDSDGVIHHDRIKGKDTLYFSGSYAEGDYIKSCAENSGDMPGLITTFTAGFVSKIAEFDLSETDAMDNCLQEGILNGLRCARRLCWHGFRSNLDGQPDMSWEYIMTGLEQYSNIFTNASVDNPENDLRFEAITIPTDRIIQGLHWTTLESIAGDPAEVAYRIVKDGPDILSRVPIARFGKIVTADRGEIESYRAITNLIEEYATANPRRMTPLCIGGFGPPGSGKSFALKRVAETALPDDDLPTLEFNLSQFRDYSELVVAFQLIRDTALSERLPIVLFDEFDANFGGKLGWLKYFLTPMNDGKFLDHGTTHPIGRAIFFFIGGTSSTLEDFKSDTNSKEGVTAKGPDFISRLSGYVNVRGVDPIPDEKRDQKYAIRRALILRELLRTYHLEGAIDDAVLNGILRVSRFKHGARSLRAILQMSRISGREKFERAALPSDAQLRLHVDPGDFLQWIRDPRLQWDLPIYTCPSADHLAAPNSSPLREAIAIRLHRRYCDGIKRIQKQDPCLLERGIXITIKEWHELEDMHRKNSRAQADDIASKLRLIKCYFSRKDIERPASFEFTTHQNEILAQRDHERPCYSEIGKWLEIWEIEGDSEQSIPQLG

SEQ ID NO: 38771 - protein, 88 aa, A.fumigatus
LVKLLITSIVVNTPYDLGNYKPIYSLLLEYLLDKTESLEELLQVRVVILTGWAGFSHLSNPTQTRRVLRKANLLGSILPKNQLSTYLI

SEQ ID NO: 38772 - protein, 126 aa, A.fumigatus
CQVFLLLYTVFLTLSSQHGFGQPIMTLSMDEAVHAIYLEMVGQTFAVLGMAIAKLSLGIFLLRIVVKTWHRVSIWASMVSLSIVSVMTAVLFWTQRLPSRSIYDPRVPGRTVVNIVPFSVLLGCKS

SEQ ID NO: 38773 - protein, 65 aa, A.fumigatus
QECATRLELTDLAWCAAVDFYFAILPWIFIWKLNMKQKEKLVIAISLSLGFMSVAILPCLAVDAH

SEQ ID NO: 38774 - protein, 142 aa, A.fumigatus
HTWYIPEDTIDLIIWSAVELAATIICVGIPTIRPLYRHIVHGSRFKESNEGYKKHDESGESNPGFRMKPLGRKARKGDLETTISTVVGDTVFDMPGGETSSHVQTARETDEERLVSPPRAPHVNSIQVHEEVTVERSTMLSR

SEQ ID NO: 38775 - protein, 114 aa, A.fumigatus
PGHISRIFSARFDVISLCVRATEVKSILPLNSIMVDDSIRIEAHNKMGAFEQRHDLSVAGKLPNKIFAGLFPREMATQLYSFSAEVFRIDYHNKTIRISGPVIVTERTGADVRP

SEQ ID NO: 38776 - protein, 64 aa, A.fumigatus
NLAVYCDSNSQQRTGEVKWTDIDSIRLQHPEWNDDASSCRKSDSNGHPNSSFDAFTGTKCFERQ

SEQ ID NO: 38777 - protein, 1292 aa, A.fumigatus
LKDGPKKLGLNGSSDTNGCFASLILKPFEFRAYVPKNRFIAPRPMITQITPGHDTPLLSKVAPDQAEEIDVSIYFSAEMDCDSVTKSITLNSTTESGKTPSVDSKSASCRKIPATDTQWTGQLPNVWVWTGKLTGVYNGIHRLTVTNASDSAGTSATNAIDHFLFRVGQSDNPMVFTSANYSSSLLHEHENGTLFIQHHAAGADKYRYSTNWGSSFSDWMDYKGGNETIEELPWSGTEKQKWQGKHVRVEYWSKLTGSSDYVQEGDSGWDSNRPRRFPHLFFNGPYNQYGYDAGLDNAVQLGDDGLWRFRFVAEWPAQGQFNVWGINPDGQPDQSFVFGDADMDGVLDRMPPSSLSTTLINITDHPPAPHLAWVLHLDDSTLQFQLEPTGSRAAQMAAFFLLWLIPVLTAAACVYGFKKSFYQVKFNQVGVSEKKKLLPLWLRRKIKRADLEDGEPMNPLVRFANRSSFVQSRSAFNEGTLKRRTVLIATMEYDIEDWAIKIKIGGLGVMAQLMGKNLGHQNLIWVVPCVGGVDYPEDQRADPMFVTVLGNSYEVNVQYHVIKNITYVLLDAPVFRQQTKTEPYPARMDDLDSAIYYSAWNQCIAQAIRRFSVELYHVNDYHGSIAPLYLLPQTIPICLSLHNAEFQGLWPMRTQKEKDEVCSVFNLDLDVASRYVQFGEVFNMLHAGASYLRLHQQGFGAVGVSKKYGKRSYARYPIFWGLKKVGNLPNPDPTDTGEWNGEPTRQSDIKVDAAYEASRGEFKRQAQEWAGLEQNPNADLLVFVGRWSMQKGIDLIADVMPAVLESRSNVQLICVGPVIDLYGKFAALKLDRMMELYPGRVFSRPEFTALPPFIFSGADFALIPSRDEPFGLVAVEFGRKGALGIGARVGGLGQMPGWWYNVESTTTSHLLHQFKLAIGSALDSKPKVRAIMRARSAKQRFPVAQWVEDLEILQSTAIRIHSKELAKSSGQTLTPSGCNTPSGTMTPPVAGNLTPTGIQTPPLMHSREPSVSNASRLSVLGPQQRNTIVYSRDPSPGMIEKPKSGLSRQLSLGVRAGPGHLERRGRRKLKKMNQAGSDDNQNSTTDVESSSDDDIIPSYYGDDEYTLTPEQAEAGRQTEISQQQGHHSVWTPRDFFSQRHSSQTSISFNTPLSPTSTGVTEADDAIFPPARRMLEPANPSHRLSSASVLSVDSIVGAKRDYRLQRVDPFFTDSTGEFYRIFEKKLETLNGLNSESQLCIEEYLVKSEKKWFNRFRDARLGRNQSPASSVFRIKRDYSPSSPRGWKGPSVVYS

SEQ ID NO: 38778 - protein, 173 aa, A.fumigatus
APILLRLQSHPAPLPPRHPPPPPPHPLLRPIPPPAHLHPRCPHHRTCLRLQSHLRVRLRPSPLLNYGNDPFPQQPVVLQLNRPRIWHQTDHRLPVLYWYQLKFPRPRSLHDASYHLGESHCLRRHRVVVDFVVLEHLHIHALRLSRHLPPRLTPLQLTLLLAPFLTALPTHLR

SEQ ID NO: 38779 - protein, 165 aa, A.fumigatus
TRYLLAEKCFDKIDVFEQRGSVGGVWNYTPAALKASLVTQVPQLNPDGPIEEPIWYRFGETEETRQLTFTSPIYSTLDTNIPKELMAYSDKPFPADCQALPRHSTVKKYLEEYAEDVKDLIQFETQVLDVRPEGQTNKAWALTTRNLRTGAKETQSRHTGLEYRG

SEQ ID NO: 38780 - protein, 209 aa, A.fumigatus
  UNSURE (39),(40),(42),(52): Identity of amino acid sequences at the above locations are unknown.
AYTLRFPSNRGRNGPSRRRMLLSQNKERGDLSATLAQRXXTXPSPRTDPTIXVAVLSADAKRILFGRSKRFPPNWYSTLAGFIEPAESVEDAVRREVWEEAGVTLSRVVIHSSQPWPYPANLMIGAIAQVSDPEHEKISLLHDPELEDAKWFEIQEVEEALRVGTSALGETPGPEYKGGLRLPPPTAIAHQLIRAAITGDYIISKESKM

SEQ ID NO: 38781 - protein, 83 aa, A.fumigatus
LGFRIRTVIVILVRLLLVLKHRSFFVFNLILLLFLLVILLLLLLILFFAQYLRPPISTLDALIIERAFVFKVTFVFVFAPLLF

SEQ ID NO: 38782 - protein, 134 aa, A.fumigatus
KRRGAKTNTKVTLKTKARSMMRASRVEMGGRRYWAKKRMRRRRRRMTRRKRSRMRLKTKKDRCLRTSKRRTRMTMTVRILNPSHIQVKIPQLGPRKLFIRRSSSWTATAKTRLLSVLRQTLICHRPNMLLQLMM

SEQ ID NO: 38783 - protein, 1254 aa, A.fumigatus
  UNSURE (906),(1059): Identity of amino acid sequences at the above locations are unknown.
IWRSSQHFSTVKLDPSTVSTQDTENVFAPPATPITNGCVERDEATSAARFESGRSPAFVERTRTSFGGLVDSAYDPFAEADGFVPGKGRKRPRFSFKGANWRLVDEPASPGETEAPADWTWMFEEAETHESDIGGEDHIDSATVPQEVSAVTATVPNTPEAADTVADVDNESLDVGLMSTERMAEQPTRPSFEFSQPLRAPGFPQHFARQQLADSDFPYPTDTPRLYPIPSPGLPIPSPLVTRSSSAHDYFPTVASNVQTPSAADGENVEMTEKENIVVYKVQPDVPTSKELQPLVTTPQPAIARNTLDLTSQNASIDLEADRQGDMKSTSTADTMPIEYRAPAQHPEDVEKQISNAPLVSLDQSYAGKPAEFANSDIRNVVEEELEQSDINQENGEIQVEESNGTSEDELEEQSEMELTEESVEEESAEEEDDDLVEEHGYGDVQEQRSQRPPDAFGDNDFHQDDTRRHEDSEVEEISIGTNRALEDDDLSDARSEAYSAAERQAAEERGHFHNLEEERGEDEHEGDFEDEGTFDDEGIEGGDGRAEVLGEEEDEEEEEEDDEEEEEQDEIEDEEGSVLKDEQEAYEDDYDRSDSESESYTGEDSPARPEKVVHPEVIVLDSDSEDEAVVSPPTNTHMSSAKYAATVDDVDSSATSAGENDGYDRGSVGSEAEEGPEDELAEDDQTGDDKTEEESTQDEVDVRDNAEDELMEDAPSDEDFVSEEPIEVQADAEENSASADPVQCEVQQEADIENELISETLNVLQATSGAPQSIEGQSMASLGVSVVQSTQGPYTDSVYGPQPRDLAIDPELYRLGGTGEDETRRPETDARAESGPDKSGLEDEGIREPFFQCAVSPQPVDSSAELASPVQEPSTQAPQLVTPDASQLATHSRRLPTAIPVAEFXPTPEQTQEVPQGLSTQYDGHTDAPERTLLHISTTSVETDVSSTNEYNVQMSSALAEQQRQMQTDGVSVHDEEYAISSVADEIASGVHDWEVSALHSERLSSVVNRDHPGLRSKYSYFAPLAMLIDHYNSLIDTISVVSDASPISRAPTCKEDXTWSLLFTDPSMAGTIVHVEIFRPHKYALPSVTEGDAILLRNFQVKSFNRSMMLVSVDTSAWAVFHNASKEAQIAGPPVEHGDEETAYATDLRQWYHEVGVAMVADYQLQASVLTASREATPVSSAAHSDAGSVDSASREVRGESSVSNRGSKRRKSHRRITIHELRDGRRYTEVGSPSDKESIHELRDGTLYANL

SEQ ID NO: 38784 - protein, 101 aa, A.fumigatus
FGCRLGNPVMYFVRGQALYVYQLREFFFFFLSDKWFRYDRTGSWLLGDGDQIAGAHHRLKVRDYYDQKNFVHKLRTSLSPRSMARCSYNMIYGSNTVYTRH

SEQ ID NO: 38785 - protein, 72 aa, A.fumigatus
GCDATCDLRGEYFFSAILRGVHLSVTAISTMLTHRVRVSGNSSLEAEARTFAARFLFFVSDFDTGCAGASTD

SEQ ID NO: 38786 - protein, 79 aa, A.fumigatus
SYLSDKIVHNVDVTLALIAGSRCSAYGDNMAYSLDLKQHHSSRLRRYRPTATESATIKSVNQNGSGGNEVVGMRVGSLQ

SEQ ID NO: 38787 - protein, 62 aa, A.fumigatus
  UNSURE (8),(56): Identity of amino acid sequences at the above locations are unknown.
ILSEETAXGNHVTSKSGKRLYNSIVDKRGSAAEWLVSDNYSGLDQLDRDCDMGDAXLSLFGI

SEQ ID NO: 38788 - protein, 74 aa, A.fumigatus
ELLMIASFGAPPLDQLHTTRDTVTRANPDQITRTPITTMAKQPLVKTLQFEKKNKDMLKLPKCTVLSCPTQLDA

SEQ ID NO: 38789 - protein, 330 aa, A.fumigatus
SGGSRRGSERTFYKRSALLISLSVSRSETDQPAEIDEAFEKAFLYSLYKLKQDNPTAPNHGLSLPVQPSALVSNMLTPYLPIYSSQQAQYYQIKKTSWKNVKKFIKYLDKQRLVKSKDRSGQETVIIDVDFNDPRVEQFVPYKLPSKNAVENAGKSVPGNKTPATSEGDPSVGQTITVQTLYRPTGKLTPTIFPALSSGDPRNYYKYSEVSNRLDEYIQSQNPPIVSSENRRIISLNPFLANTIFTSSSAEDKTTIARGMTTRDGLLKRIVEDSAFLTPHYVILRQGQAPSDVKPKAGATPKINLVLEKRTGSKTVTKVSNLEIFGIVPS

SEQ ID NO: 38790 - protein, 271 aa, A.fumigatus
GINFVKVITYMANCNGDCASVDKTTLEFFKIDESGLISDSNVPGTWASDNLIANNNSWTVTVPSSIAAGNYVMRHEIIALHSAGNQNGAQNYPQCINLKVTGGGSDKPAGTLGTALYKNTDAGILVNIYQSLSSYEIPGPALYSGASSGSSNNGGSASSSATAPSATITQPSTAVPTSSATAYQPSTTTEAVTVTSIPAQQSYVQAPTATPSSTAGSSGSGSGSSSSGTLPSSSNLTEYFNSLSAEEFLKVLKQTFSWLVTEKVHARDLSA

SEQ ID NO: 38791 - protein, 320 aa, A.fumigatus
IKNLAPLRSSDRRKIADQIISDYNISIPSAAPAEDDSNTPTTSNQTSPSITAIRNSLLPENSLSARFTTTAGPQLREVQGTVYVGTHPEGEERILWFKVEHGPGADGRFYPTVYTLWHNPKLVPLLHTPEMVMQKLRGGADLMTPGLADEPPFPESAVKGAVVAVAGLDRHTVPLFVGVCEIDIAGLGEVQGTKGHAVRGVHWEGDELWAWSSSSRPGQPAPEYLAGWDLEAGEEDVAEIEERATELSLDQGQQTQSAEEVPPVDSAEQHEVGAPVEEVKEPSTKGRRSLFLFRYLVRKLTNLQRSTRLLRKPSSILCTN

SEQ ID NO: 38792 - protein, 206 aa, A.fumigatus
LLQPFWRYKNCLRHDGGQLSSVLPISIPFSRSQHLPFSHSVLSASLTEVLFSSLFLSSLVRFEPKITLCVDRLDNPTKAYNMSVPKIAAALLSSAALVAGHGFVTGAVVDGKYYTGYLVNQYPYMSSPPDSIGWSETATDLGFVDGSGYSSGDIICHKDAKNGAISAEIKAGGKVEFQWTEWPESHHGPVCLRKTSMEQLVRVLTS

SEQ ID NO: 38793 - protein, 231 aa, A.fumigatus
DLQELFGAEGVEVLSEVAAAGKSATGARTGAGAGAAGSGARGGGRSLDVALLGRNAGDCDSLGGSGGLVSSRRASRDCSRGLSDGGRRSSGAGRGGTTVVGAARRSARVESGTRNFIGAQALVDVDQDASISVLVERSAEGTCRLVAATTGDLKVDALRVVLGTILVASGVEGNNFVTHDIVTSGDGAGNSHGPAVVVGDQVVRGPGARNIGVTDQTTLINLEELQSSLVN

SEQ ID NO: 38794 - protein, 70 aa, A.fumigatus
RTKFHLEMSPSILYMFPRIIIPNKSPSIKVQNFTRSNVTFTFSLSLTTNALGDTTLRLTFDFKAYMCNSI

SEQ ID NO: 38795 - protein, 82 aa, A.fumigatus
IVRHPGHHSKFDVNPLVFRRSGSVCLDVINQTWSPMYDMINIFEVFLPQLLRYPNPSDPLNGEAAAMLMREPKSYEAKVKGE

SEQ ID NO: 38796 - protein, 63 aa, A.fumigatus
KVSDTAIGSGQHLLIGSTEYVAKYASKEAVDEAGEDTESEDELSSAGSYESGGEEPAGTMDDV

SEQ ID NO: 38797 - protein, 252 aa, A.fumigatus
SRLCTERRYNPVPSVVVSPLVMADPASYCPSTNGSDSFTYNYPSLLQACSYIVTTPPTHLSIMPGRLEEKVAIVTGAGSGFGYGIAKKFVEEGANVIIAELSQQSGEKAAAELNCKFVLTDVTRRESWQALLQATLDAYGKLDIVVNNAGATYSNKPTVEVTDADFDLCMNVNIKSIYLSTSVIVPYFLQNNRPGSFIQISSTAALRPRPGLTWYNASKAAVSNATKTMAVEYGPKQIRFNCVCPVVGSTGM

SEQ ID NO: 38798 - protein, 124 aa, A.fumigatus
SCTPLMRRLESDSPCYVFRTHLFLGKPDTEENRAAFVSTVPLGRPSTPRDVANTCCFLASDEAEFITGVNLEVGTDLICSISALTNGYWDSGGRWTLCLANIYDVAIYRAYVEGIECSTGQLAI

SEQ ID NO: 38799 - protein, 256 aa, A.fumigatus
CAISRFAGPHGNFSAAFTQPPVPATLSQFVPHQGTPTSNMSPSAAQNLTQNMASVAANSMLPAQQQQQQHHQQQQQQQQRPSQQPNQQQGSVPTAAQSPAAAAREKARVSTLLDINSILLQEVINLQAAGKAGGPPSQQASQENNPSPTSDQAADAAKGPTQKPSLEYVECMRRLQANLAYLATIADRAKKSGGVAPAAPAIMTPPPNLPAVNELYHKLNELFRPLKGAVGTPQPSPQGMPGNTKPSPSPAAESAV

SEQ ID NO: 38800 - protein, 90 aa, A.fumigatus
SLGRVLTGGQKPRILFIAITRLFYSSVSTKKQYKGSLSSNLLIYNKLAPAGHRVEPAVFNTKRWKGLRDLFGAIGTVLSLSCVCGSGTWD

SEQ ID NO: 38801 - protein, 266 aa, A.fumigatus
MSCVLFLFYRRSPPVATTIADITATSASAPPSSLYSSAPRISTQSVRFSWSGSQSPSVYSVTSVSPHKQFARRRPHPHLLWRWTSVATPVIHSNPGANNRLLSSLAPFARSRPSLSQPASRKSMDLNGETSTKRKRSSVAAPAERPAKHLKPGNSTLTPGDATPANGTVYNVEDEEDTGRVMPIGPAQADSPEWQATIEKVVKSVVSIHFCQTCSFDTDLSMSSQATGFVVDAERGYILTNRHVVCAGPFWGYCIFDNHEEVSRVL

SEQ ID NO: 38802 - protein, 95 aa, A.fumigatus
GKMDPNATGYPSLQQQQQQQQHNAGYPVTSQSPHAQQFPFYPNAMPTSSFPQSKTPVQQPHQQHSFGPVPLQPGGPGGAMMPSGTLTCDPLGRFF

SEQ ID NO: 38803 - protein, 154 aa, A.fumigatus
HRTWLRSLRTACFQHNSNNSNIINNNNNNNNALPSSQINSKDPSQQQHRVRRQQRERRLVSQPSWISTPSCCKRSSICRRLVRLEDLPANKHRKRTIHHQRPTRRPTQPRARHKSPVSSMLSVCAVSRPIWRTWRLLPIERRSRVVWLPLPLPS

SEQ ID NO: 38804 - protein, 267 aa, A.fumigatus
  UNSURE (259): Identity of amino acid sequences at the above locations are unknown.
CDVHPVYRDPVHDFGILKFNPKAIRYMELTELKLRPEAARVGCEIRVVGNDAGEKLSILSGVISRLDRNAPEYGDGYCDFNTNYIQAAAAASGGSSGSPVVNIDGHAIALQAGGRADGAATDYFLPLDRPLRALECIRRGEPVTRGTIQTQWILKPFDECRRLGLTPEWDAAVRKASPHETSMLVAEIILPEGPADGKLEERYVLLQVNGELLTQFIRLDDIPDSSVREDGTFAGSNRRSTMLKVQCEGGPICLAITPXPFCSRYPG

SEQ ID NO: 38805 - protein, 63 aa, A.fumigatus
LKVDFEERATGTYRLQLERIVVRIELLFYPGLLHVKQHKSHDYCHGNVTSGTDPKQPGPLVEH

SEQ ID NO: 38806 - protein, 67 aa, A.fumigatus
KSKYRLDPTKAQYCMDWEILSNAPPFVRGLSNQATGNLPHGFSYLQLEEQVGHNRFLLKSRWEDIGR

SEQ ID NO: 38807 - protein, 61 aa, A.fumigatus
LNLVLTIKWPLTVAFENISGSPMANVQGEDYSNLRKFYFLLEAAITPDLYHTQIHTATCSR

SEQ ID NO: 38808 - protein, 65 aa, A.fumigatus
SLNHAGSTSTIDLAVTNCATKLIKCHLYHENYGSDHRAAYSEWSLQPSNYNGKEGSGNFFYTVNR

SEQ ID NO: 38809 - protein, 61 aa, A.fumigatus
YNTSKETTLLLAGNFNRHHPAWETNSVTPRSMLCAEELVNFFFQQLASNGAFHWGYQHTSL

SEQ ID NO: 38810 - protein, 615 aa, A.fumigatus
DYCTFTHVTCLGSDNRATIDPLARSRNMAATSPLSPVLDFNRPGHTETYDLFSSHLPTPGLNQTMYAPYAPYEIDVKTERQTFINDVPLRHDSSISTFSTFTAPQLSAPLPTFPSEDWLQDEYFSQAPNLSGIDPAICEQNFGQTYTTLQSNIPVSDHDRPLLDHFIHNVLRIIFPVLEAHQRGHTRAQAILQALETNKCYLHCCLSVAAIHLKTTEGFVGEQIDHDIMRHRFEAVSHLCQALSEDINHEEILDATLAMIFFHCSVGPADDYLPDIPWFDHFQAASNLVNRLGLPTAVPEGNPYVLPPFSMTLTSWIDILGSTMQGRTPQFAHTYRAKHLSGSSSGLRELMGCDDRVMYLISEITCLDALKTEGRIDAMAVCSHVSALGRQLEFTEPVDQTLEHPFSPTTGAIRPEILTKNMTTVFRIAARIYLCSLVPGFDRNQPSNLNLVAAVANTLNYIPSGPNGFDRSLVWPLLITGAFSAPTSQFRAVLAERASLLGDHADLGSFGRMYRLLQEVWRLTDDPADSYYTPGGNGAILASAGSPGPKNERVGISERNRTGARLRKNKKQRATWRDLRHPEGLPINCWIKMGKGGILGVPFWSSPENETSGGP

SEQ ID NO: 38811 - protein, 125 aa, A.fumigatus
GHKRRPRSCTSVLDLVGYSVGIIFLPFLFGRIVLLTGLGCFTCRLRRKKCDEKHPACGACSNLCVKCEYKRPIWWGNAEQRRIQKERIKNKIKQTKMNERNGSATGRTTAPSLTLLVLALTIGLR

SEQ ID NO: 38812 - protein, 75 aa, A.fumigatus
SFIIGKVTSSLHTFSTEYRTITQPFFFFFFCWVIALAKYLLFASINQEEPTLECQHTICFDSAILRYTKSSLTQK

SEQ ID NO: 38813 - protein, 318 aa, A.fumigatus
HCPGPESEQARKGDACAGCPNQAICASCPEGARSRHPHHHRTSLSNPTQDPCTIRAKAVSANPHSPRSLAHAFASNPEFTVGLCDTDICGPSIPKMMGVESETIHVSNAGWSPVWVTDNLSVMSIQFMLPNRDDAIIWRGPKKNGMIKQFLKDVDWGDLDYLIVDTPPGTSDEHLSVNSLLKESGVDGAVIVTTPQEVSLLDVRKEIDFCRKAGIRILGLVENMRGFVCPGCSNTSEIFRATTGGGKRLAKKMGIPFLGSVPLDPRVGMACDYGESFVDNFPDSPASKAIKQVVRSVGEMLGEDPNTVLPPDENDMVE

SEQ ID NO: 38814 - protein, 144 aa, A.fumigatus
VEDWKYRQYRANMHSLQSFLFLLLLGYGVFAAPTSPQAQSQGRSFKVERIKRGNSIHGPTALRRAYRKFGIVPTTFGVDLSDFVPFNTTSISGTAANLVTDVQEPEQTGAVSAQSVQNDAAFVSPVTIGGQKIVMNFDTGSADL

SEQ ID NO: 38815 - protein, 61 aa, A.fumigatus
LIYLIAGRSDTAVTVPENITPRPIATKSLSSDIGLSSSDPPLFIKTSFVQINSTHLLDLGI

SEQ ID NO: 38816 - protein, 217 aa, A.fumigatus
ADQAWKLHSRSDCSTQSLSEVWYSSYDLWRRSVGLCAFQHDIYLRHSCQSRNRCPGARADRCSQCAICPERCGFRQPCDDRWAENSDELRHRLSRLVSSSELLYQHSLLTGDFASWVMNTELPASAQVGHTVFDPSKSSTFKKMEGATFEIKYGDSSFANGGVGTDTVDIGGATVTGQAIGIPTSVSNSFVADTYSNGLVGLGVFHTEAGRIRARHP

SEQ ID NO: 38817 - protein, 193 aa, A.fumigatus
PPKMGRTSWPRFPVGISSLDGTGPRPRWPSWTSVGISSCLREAGRWLTPSAVKSHSTTPVSDVLAWCADDSNPVRSEYIVLEPSVGELLTKAWDTLAEHERVKLIRNFASLESKLAATQFPGYGALYLRNALPPALQQPGRTIDVDDTYCLGPMYHGSWPGGFAANADDYAKYSGPCPSSSAICFGWSSTEQR

SEQ ID NO: 38818 - protein, 153 aa, A.fumigatus
CRSSQKPSRFAGTLSPSFATPTFTQATSSSPPTTPPSSSASSTGNSPASFHASRRFAGRCSSLRRKATNPARPTRNARPPTTTTRNKRRTRPFAPSATRPRSSSPIWNRTWLSPNPTPPSAASSSLAPSPTATGFCPYATACSSSRSTGRVYR

SEQ ID NO: 38819 - protein, 111 aa, A.fumigatus
MPGKPATEKDLFGYSKGRFLVNEGYERAKRYSPFDIRELCRMVSALPRVAGSPITRIEKKEGGYNKALLMTAENGTNILAKIPCRNIVPRWYGTASEVAVLDFGRYLVLSP

SEQ ID NO: 38820 - protein, 294 aa, A.fumigatus
TAIGRTLAELGRDLAHQGICQVRNYKTSYAGRGPHYGTPEEHIRVLETVMQVMPILTEAVPIRRHTEPVLRHPDFHPGNIFVSADDPTVIVGVIDWQFTCILPRFTQVRWPLFLAPPEGYQPGTPNPERPPTDNDNTQQAQDAALRAKCYEAALLKSHLESYLALTEPDAAISRLFISCPFTYRDGILPVRDCLLKLSQHWARLQVSQECPYRFTAAEVAEHEHQMAEYEGWLKLREHTQQLLRSNDGGWVPSGVDFEEIQARHDKLYRRFVKTKMEHMSEEDAKRQWFFRERG

SEQ ID NO: 38821 - protein, 472 aa, A.fumigatus
  UNSURE (325): Identity of amino acid sequences at the above locations are unknown.
GSTPEPTMSHLTIANCYEILGINSDATIKEINTAYKKLALKHHPDKTGGEESSHIEFQKVQAPEQDTEDSKPIMLTKSDHQIQQAVEILRDPVRRKNHDLELFKLGRISVHGTNSPHAGGSHWSASAFKRYDENSRYMYSYEQSVHVSPQKQESKEDMEWVEQMLKAEEEFRRNLARQQEVEQMRAQMEAERVGQEEDCKLQSTWEDHPSERLEQDAHTEDVLEEESDYFESYTESITRKEQDIWDKCAQRAPRSTDYTEEEYYQDMYQKGEKQPELYDEDEDPEIDDDDDEEPPHLHGEEVEDQPELYEGVDGHENVFPRRSCXSPPALRKRGHDFDDYSLCPDNQLSEYIPSVCGSDLDNATARSSGSEFNPRFHMESIRAACADLYDNKSTSVEEAQKTDDDTATLYDVSEADSSHKFYSTNPYLSETESVNEAVHNDVDEQVSEGVDNDDSVNRSSLHDLLSPFVPYL

SEQ ID NO: 38822 - protein, 205 aa, A.fumigatus
NRWIRDADLFGSTAPPNAANFATLREIEGRLKSIKNIEKITNTMKIVASTRLTRAQKAMDDSRVYGQTSNKVFENAETKPLEDKKTLLVVASSDKGLCGGIHSGLSKATRRILQENPNADVVILGEKAKAQLSRSNADAIVMSFANVCKDIPTFADAQVIADQIAQLPTDYASVKIIYNKFINAQSYEPSTVEAYSEEAITKSGQ

SEQ ID NO: 38823 - protein, 133 aa, A.fumigatus
KGESTHPSQIPAVIWIDRLGRKPVLVVGAIGMAACHFVIAAIFGQNENQWDTHKAAGWAAVSMVWLFVIHFGYSWGKRLPTSEEDSTTNHKPKDHAPGSSLLRFGRSVFGQRAPRWVLRRVSALFLLGIISRL

SEQ ID NO: 38824 - protein, 84 aa, A.fumigatus
VLYFSLASYLDSDTDFFFAPDWMNNFIVGQVTPDMLQNIRYGTYIFFGIITFLGAGFIAFMVPETKQLSLGKLLDPVIVEFRVF

SEQ ID NO: 38825 - protein, 63 aa, A.fumigatus
SSNFGSSNEITEEMDVIFGSEGTAISDYERQAEISREIGLDEALARLTNTAPVEVHDVEAKQT

SEQ ID NO: 38826 - protein, 88 aa, A.fumigatus
SQPNRHAKEKQETTKQQQIIKFAQITNMFKRDYVDCPQHIYYSITPCKCWSRHRPRDIHYAIVSHCIASSLGKIVHTEERLRIASQFP

SEQ ID NO: 38827 - protein, 194 aa, A.fumigatus
  UNSURE (3): Identity of amino acid sequences at the above locations are unknown.
PVXYKMAKPKDKKGSSGGVNSHLRARLEYLHNAASLIQSVAVSSKKLDGQRADNGNPEISDSKRIVPHVVRPDIAAQKQSFATGPSNDTDRLSQLARVYVSHLRGVSLKSQLRLPVEVKHSFCKRCDTLLVPNVNCTHEIRNDSHGRRKPWADVLVIRCTTCGTEKRFPQTEKRSKKLAERRKEKAQAEKPDVK

SEQ ID NO: 38828 - protein, 95 aa, A.fumigatus
STPPYLAVLPTMSHEEDLIDYSDEELLTTDAAATTSAPAANGAQDNKGDLTVSGGRPDKKGSYVGIHSTGFRDFLLKGELLRAITDCGFQHPSEG

SEQ ID NO: 38829 - protein, 177 aa, A.fumigatus
HTAPPFTVQQVCIPTAILNVDVLCQAKSGLGKTAVFVLTTLHQLEPVPGECSVLVMCHTRELAYQIKNEYARFSKYLPDVKTAVFYGGTPIQKDIEVLSNKESYPNIVVGTPGRLNALVREKKLSLRNVKAFVLDECDKMLDQIGKQAQIARTEVPYLRLARHAPGCPGDFPCHPRR

SEQ ID NO: 38830 - protein, 108 aa, A.fumigatus
  UNSURE (10): Identity of amino acid sequences at the above locations are unknown.
KMGKGSETSXQKNVLSCRSLEWSSHWFAGLSSGSKIKLVVWNCRSSFAFSTFVYRIDYDLGTTRLIANCYLNIIKDHLNTYKVGSNLEYSCNIYQSSWVISLARIIST

SEQ ID NO: 38831 - protein, 95 aa, A.fumigatus
SRRVLPPMTGQFSSLCRAKSVSVWDTIARPTCVLAKPVVDAGSNALYAPFSNDSGMDGQCDTDAFFVFQVLWIEYKSNIPLRLLQSSKSAFLLQS

SEQ ID NO: 38832 - protein, 153 aa, A.fumigatus
RRSCWMNVIRCLIRSVSKRKSLVRKSLTYVSPDMRRDVQEIFRATPADKQVMMFSATLSQEIRPICKKFMRNPLEVYVDDDTKLTLHGLQQYYIKLSESEKNRKLNELLDSLEFNQVIIFVKSTLRANELDKLLRECNFPSIAVHSGVSQEER

SEQ ID NO: 38833 - protein, 103 aa, A.fumigatus
FMFSIKRYKEFKEFNKRICVATDVFGRGIDIERINLAINYDLPADADSYLHRVGRAGRFGTKGLSISFVSSEEDEKVLKEIEKRFEVALPYVQFSPGLMLCSD

SEQ ID NO: 38834 - protein, 192 aa, A.fumigatus
VFLRTQCLRGSISCISISSGSIAATPFSAVISDRLGRRKCMFVGAWIIIAGSIIIATANHLPQFYVGRVVLGFGIQVMVVSAPAYAVEIAPPHWRGRAVGKSPHNFRNVPAIAELGRFLQLRLVRWFYPRCGCHLRLQQHRQRLLVAYSFHPAVLCLYYCRLFHLVHSRVPPLADRPWPGGEGHRFPDQVPR

SEQ ID NO: 38835 - protein, 310 aa, A.fumigatus
VLSIRQTLHLQELIDRLDRPFFFTHSGRWRFLQVMMISVFGQWSGNGLGYFNATIYNTLGYTSSSMQLLMNLVNSIVSAIGALSAVALTDRMPRRKVLVWGTFGTFFSHSPPRIAADSLACAITMAVNAGVSEPLIKQTATGNINKTYGQTAVAFYYLFNFVFSFTYTPLQGVIPAEALETTTRAKGLALSGFMVSCISFVSQYASPIGLQNISTHYFWIFVGWDLFESLCWYLFGYVLFPVFRGAILTRIVSNPRVVRWRNSSGFTSSPSPSRPRSRSTRLLSSPMDTSSRRSPTRLNCPVGLSLVNGR

SEQ ID NO: 38836 - protein, 160 aa, A.fumigatus
WSCLPPRMLLRLLLPTGVGVPSVSHLTTLEMCQQLLNWVGFYNCGWFGGSIPAAAVTYGCNNIDNDYSWRIPFILQCFACIIVVCSIWFIPESPRWQIAHGQEEKAIAFLTKYHGNGNRNARLVLLEVEEMREGIRLDGIDKRWWDCEYFPSDKPFICRS

SEQ ID NO: 38837 - protein, 594 aa, A.fumigatus
DEDFPRFVWDTASTMMSPRSTKFLWILQLLVIGNVPLVFSSVKPYPLSWNTTHDFGYDGPWHAIPLRIGRPEQTINLYPGGSWASVVLGTHIQDAWGNDYPNQDWLKGSEVWDASLSAPQRSGSSQNNNIAQANRGGVSGSIDGNWGGQVAMNMTGLGVQITDRVYFYTPDNGIAIPNGTLSVLASANMTYPDGKVVPLDMGFLSLGAREAQRWDPYVGNVIPDYLSINGYTPSSSWSLHIGSAVMGIPGSLIFGGYDSTRVIGDIGTYDTTDGFGGMFTELVDVQLGVASGSGSPWSFQNKTNLLQDAGSKTQVITTRMNPTVPYIFLPNRTCQLLAENLPVTWRWDLGLYTWNTEDPQYERILNSPAYIKFVFNRPAGASPIEIRVPFALFNLTLTQPIVDRPTQYFPCRPFQNNGAEYHLGRAFLQAAFLGMNWVTSKWWLAQAPGPLGLASSIVVISNSTETITTSAPSSFWTDSWKGILTSLPIDGNPSSSGSSFQPSSAGNGTESKGALSSGAIAGIAVGASVGGVLILGMLFFFWRTRRTRFTKQIPSPTVSQAQPTTPANTSTDAQKYELPDRQPVAYELMSREQY

SEQ ID NO: 38838 - protein, 299 aa, A.fumigatus
ISYVAQRARSLVCDVDPFDQLDSPVLDDRAVDNHGQSLCCDIGAVDWCSHAGQLCRFQQHHAHGPRLVQHHADQRISIGDRPDRPNHPQHQRLLHLLRRRGPPDPPRRLGQHSHHRRRQHPQPQQARQLGLRLPRSIVRRWRSCRPCRRYPAPREPPRNKLHVRGNRSRRRRRLHLQPHLTIHHPRTRQRPARSEGASPGQQPERPRVLRLYRPRRPHHRRHRRLQPAHNFHSETLPRHCRGGLLRPTERNTVHRDVHPRALQRLGRHPLAEHHRRKAGRPGGVNRPHASHRPRRHPPA

SEQ ID NO: 38839 - protein, 638 aa, A.fumigatus
DIRVGLTSIAKMRMIYRKNDEKQRLVSQRRVSEDSVQKPSRQSHATWEQLLFCLLLIPAVLSILLVLSDVRNWHMPSGLNALVDEYRTSIQTAVQIVATILSTIQIFALCRLINWATRILFGKYPTSLNVLGLWSAMSTPSINWTLPFWMIVLSIIMVNLSAVISALWTGALTPANSVAFNSTTLMVPDWSNTTLIKEYPSEIDQTGPTIRNTKGYFTYSVGVGLLTPLVASASTATTVDGSIRNHNKLDNSGYAYHGRSYGVGAPVGLVDDILHRENPRATNYTYEETGLAADVACIYNRTSQFTIHELGSVLHALKGPLPDSNLSAPEYSVYIGRGDRTIVGIGVSSQPTTFTARRYLAIAAGDYYAPLNATQCTVTYIPARFNVSVDIPSRNITVAKLDGPAASIDPTHRIAHVVTRQLELISNDLTSFYRSTLGDALNASISDYRTAVAATSPNASLSEEQIALTGLENAIVAFVDDMLVAYASAQLVVGGFATPASAAVHVSALRLGSRAYICATAVITGVIVLLVVAEMVRTKGWRGLPKFDYLDNRMLVLGASAGGGEIAEYAAERRWKATGRIPVVLRTEGDHEVIALGVERGSDRQQSESTLAEETEQSTAVSETRQAGSRRVAEAGWI

SEQ ID NO: 38840 - protein, 136 aa, A.fumigatus
PGRHGLSYTTFHVSPEATVSPIVFSSDSPPTATVLVKNTGPMAGAQTLQLYIAAPNSTTPRPVKELHGFTKVFLQSGEERSVSIHIDRYATSFWDEIEDMWKSEEGVYQVLIGTSSQEIVSRGEFRVEQTRYWRGV

SEQ ID NO: 38841 - protein, 84 aa, A.fumigatus
QYSRGTIQCFSANWKWESPEAWVLKRWPVAAILFASKMGYLFDIITGHDFQLWRFGRSMGSPGRALRGLEKSGAFRSIHENGWT

SEQ ID NO: 38842 - protein, 675 aa, A.fumigatus
SLIGSDFWHTHAIPKFNVPPIRTTDGPNGIRGTKFFAGVPAACLPCGTALGATWDRDLLHQAGVLLGKECLAKGAHCWLGPTINMQRSPLGGRGFESFAEDPHLSGIMAKSIILGCESTGVISTVKHYVGNDQEHERRAVDVLVTPRALREIYLRPFQIVARDAHPGALMTSYNKINGKHVVENPAMLDIVRKDWHWDPLIMSDWLGTYTTIDSLNAGLDLEMPGPTRYRGKYIESAMQARLIKQSTISKRARKVLEFVERASRAPVSADETGRDFPEDRALNRTLCANSIVLLKNDGNLLPIPKTVKKIALIGSHVKTPAISGGGSASLEPYYAVSLYDAVVEALPDAEILYEAGAYAHRMLPVIDRMLSNAVIHFYNEPPEKERTLLATEPVVNTAFQLMDYNAPGLNRALFWATLIGEFTPDVSGLWDFGLTVFGTATLFIDDEMVIDNATRQTRGTAFFGKGTVQEVGQKQLTAGQTYKIRIEFGSANTSPMKAIGVVHFGGGAAHLGACLHMDPEQMVANAVRVAAEADYTIVCTGLNRDWESEGFDRPDMDLPPGIDALISSVLDVAADRTVIVNQSGTPVTMPWAHRARGIVQAWYGGNETGHGIADVLFGDVNPSGKLPLSWPADVRHNPTYLNNMSVGGRMLYGEDVYIGYRFYEKVGREVLFPFG

SEQ ID NO: 38843 - protein, 140 aa, A.fumigatus
VLCSVLKWCWSRLPGGVVTWDAYELFKVGEQGMGLHYIAAAGRLHKADRIADSQLARDAFSTFIPISVDSDARTKIIFDFFDLLAAIAAHGKSNGLGGRKLSRYAGWWAFEHSDAGNGFEAAYKNWAAYVFLQSNIPGLS

SEQ ID NO: 38844 - protein, 362 aa, A.fumigatus
  UNSURE (233): Identity of amino acid sequences at the above locations are unknown.
QGTSLRGGLRSAPHSVAGDLGRPTTPSWADFMSSGFNDSNDFKPQVAPLLLPPHKVLPPIATVRGQSSQSHKRTLDSEVPAEPAELASITTLDLDDSFWWVWISSLTLEEPASRKAVFGRCALIETIIKDTKWLVLEEQVKGAAPEPEPGAYIVEKKRFFTFSSRKGMIGRRKSSAKKVSAVEESYNRANNLAPHSKTSIAPDQHARIQAAAAALQKKHREQEQEAVNRSKAXVPNDSRYSKATSVMSLQPGIMSEASQAMKWARNYDKNAYRAAYLKDSRAGTGALTDENEAAVNGKVSEPPASPALSSSTHQAPPPVPKDSVPSSPTPIEHMQRSSVDENAASRQDNISAAAESLPQAVN

SEQ ID NO: 38845 - protein, 248 aa, A.fumigatus
NLLGAQPSAVAAARAALEGKAKEAQETVRPNGASTLRKPVPAPAAAPPAAPAEVASPPARVEKPVPEPQTVTTDEQHDGPPMTRRDAEYDALSRVDTNERTAADREFSRFDQGPLVEQPAFAPEDSPVSEAFADKSAPAATVSEYPNRTGVSERSTSPTAAPANSSYDRWAQIRKNAAERAARLEQSGSYRYSQDEGNTSEEESKWRRPLELAITMLILSRLRVSCCSYQGESGRIDWKYAGRKLKDV

SEQ ID NO: 38846 - protein, 99 aa, A.fumigatus
NGKAGAIPAASSSSLEKPVTPAPASKDTPEGAVAFSSAAGPWLTAAIGFPAAATFCIRASEAASLTRSNIATINININIIMSTSDCRSLDIDIPPRPPT

SEQ ID NO: 38847 - protein, 261 aa, A.fumigatus
  UNSURE (9): Identity of amino acid sequences at the above locations are unknown.
LLVTRRWLXTHFTTHSSQQGKHPQSELAHPYSILEPKVTLTMASPQGGEAPFDPASASASARPESDTTDITALARHWEAWTHTYKIRELVARAGAGEFDAVFYVGGRGGMSMSNDLQSEVDIMMLMLMLMVAMFDLVRDAASLALIQNVAAAGKPIAAVSHGPAALLNATAPSGVSLLAGAGVTGFSREEEDAAGMAPALPFQLETELERVSGGGYVKADRSGTKVVVSTTAGLCSPLITGQNPASAAGVAREILRVLGCD

SEQ ID NO: 38848 - protein, 181 aa, A.fumigatus
QFCAYLVNSVHPTLSLHIFKMGAVRKIKTKRRTRYDIQECTHRAIGALEGPIALTLLVSCRDYDQVRADIDSPKHLTQYKATKDAEDLPGLGKHYCVECSKWFESEYNLVAHTKGKNHKRRSVIMDSANVFLDRSRLTQGCLNRLRLLREEPHSQKIAEAAVGLSTDNGLRQQETVVDMED

SEQ ID NO: 38849 - protein, 364 aa, A.fumigatus
AVKWLGKDAITPFAIDGKASKAELTSQIKQWAIASGRAVVRPVLIVSYETLRMYVDALKDSPIGLLLCDEGHRLKNKDSLTWTALNSLNVTRRVILSGTPIQNDLSEYFALLHFANPNLLGSQNEFRKRFEIPILKGRDAAGTEEDRKKGDERLAELSGIVNKFIIRRTNDILSKYLPIKYEHVVFCNLSQFQLDLYNHFIQSPEIKSLLRGKGSQPLKAIGILKKLCNHPDLLDLTRDLPGCEHTFPEDYVPPEARGRDRDIKSWYSGKMMVLDRMLARIRQDTNDKIVLISNYTQTLDLFEKLCRSRGYGSLRLDGTMNINKRQKLVDKFNNPDGEEFVFLLSSKAGGCGLNLIGANRLVLF

SEQ ID NO: 38850 - protein, 292 aa, A.fumigatus
IDKNRYRPRPAVGTEGGNTPLSKPLQRNISSNSIDRLSKPFKCPGSAIPTRTSDKPARKRRKVNYAGADGEVEDNSVKPWTNEERLALATRDANKFPVFKVKDKETTFKQRFRIPLINKSSNDYNPSRPAPTLGMRQGATFVVKPLHDPSGEFAIVLYDPTVDDIGEAPESMPEDKGIEETKAKLDEPLVHKSLADILGLKKKVESRPKVPVVIDPRLAKVLRPHQVEGVKVVTPLTSTRTRIQKLTCLLRKFLYRCTTGLIDKNANGCIMADGMGLGKTVCGSFFRDIDQA

SEQ ID NO: 38851 - protein, 172 aa, A.fumigatus
LLAPETRLAMDFSMHNAFPGSFRDRFLVGRLFTYGTHSFCSYEYRRPLMSSEIDNAHEIALKVLFCGGIAGVTTWASVYPLDMIKTRLQAQTIAIAPESRPLIPIQSKPQTLNSYQITKAAYQSEGLKAFYRGLGICSLRAFIVNAVQVCDSNTTEWHLLIMRNSGQHTNGL

SEQ ID NO: 38852 - protein, 61 aa, A.fumigatus
RGVSTFSSYSWARAIPIFVNSAHWNAESLEWTHIDSFFYAGIASQVAGWIALSLSVVINQG

SEQ ID NO: 38853 - protein, 75 aa, A.fumigatus
AATAQALDLGKLFSMSSDFWAGYLSGAIGIIIGNPLDVVKVRLQAGGVNVAGSTSRNIGSFENVSSLVRGRLALS

SEQ ID NO: 38854 - protein, 119 aa, A.fumigatus
TLTWVRGAAAPILGYGAFNALLFVAYNRSLMFMDDSIKDPTNPLGVSLYKIWHVGAAGGAASWTLSSPTEFIKCRAQIDSRLGVSSWTVAKDIFRTRGLTGLYFGGMITCARDSIGYGF

SEQ ID NO: 38855 - protein, 375 aa, A.fumigatus
VEPQSQRDPIGLLAGWSPDRWVFYMILLAGFEMQEITIPPLTTGTIPENEKLSTRDDEKGTQDDHVYIADTLPLRRQIPFILTICSAMYTNQLGLGQTMDIVRIIGDWYGITNSNELSWLVAGYSLTIGTFVLIAGRLGDDFGHKRMFVIGMGWYALWTLVCGLAVYSTQVLFIFARVFQGMGPAVTLPNAIAILGQSYAPGPRKNMAFAFFGGSAPFGAISGFATGGLFALAWWPWAYWSAAIALTGLAVFAVWSIPPQPVSATATTRTVGQKIAHLDLAGCVTGVASLVLINFAWNQAAGVGWQEPYVYVCLILGFLAAAAFFWVELHWSEDPILPLAAFNSDIAFVLGCTACGWATARIWVFLQPPAGRTTL

SEQ ID NO: 38856 - protein, 309 aa, A.fumigatus
APVSRKKVPGLHQIVFFGATPPMLGPFFMEPEVRPPQTCPHSRPDPPIERPPTAGLYPGRVILINAWPGSTNHNKQRPGFVTLDPWEKKSSTLLNNYYGLTFTDCDDVIVDPVTGFVWFTVPYYSWWLEVADTPPQLKSATYRFDPATGSTVVVNDEMRSPNGIALSPDRRHLYISDTEAAGQSAPISLDLPSPGVAGLLFNTTGKRTIYKFDLIDQGHAIANKRPIHYDAIGTVPDGLKVARNGWVVTASGNGLSVMDEYGEMIARVQVNFTVNNFVWADVDDYREVWMVGQGGVGRVRWELQGQKAV

SEQ ID NO: 38857 - protein, 333 aa, A.fumigatus
YEPPTERSSTRPSREINLDEPLHRNVLKALRKSLELQYRNENAGLWYFVDPPPPYPPYGNLSYSDGMYGFAPFAALYGMTYGDPGVNLDAALLQLDLLYTQSIEPSTGLIKHGYDASRDAPWAHPITGASPIVWGRSLAWYLIGTVDTLEIIASRSGDHSEDARRTDKTVQRIREIFQRLARATVDAIEDSAGKTGRYAVWQVMDRPGEPGNFVEASASAMIAYVLAKGVRLGYLPGRSPSSETDGKHRAASSLWVQGPRPGFRDPVQSQDVLAVARALYQDVVAQFVVRRHEDDTLDFLGTSIIASLHEEKPYYEVCFSPFSRSDVFVFGLT

SEQ ID NO: 38858 - protein, 369 aa, A.fumigatus
TLRFSGISSGTAVSLSLCPTGLFGGLSVPSQRTRSDRDHICRRLRRGWNGPFVSAIPTTLGNATNHGRMLVTIRDQGLPLPAGAILISPWVDLTHSFPSVLSDSPGDYIPPSGFRYRPSAAWPPPNADELRSIKDAKQESPESAVEKAVPGEDTPAQETAVQGYTVEKDGSDRTEPTPAALQHSEDDETKLVEIPIDGHTVVVKDQIQMYTPNHLISHPLVSPVLQPSLGGLPPLQILVGGGERLRDEQFYIAHKAANPTAYPPSDKTLDEYDPKREILHKYPGTYVQLQVWDDLCHVAPTLSFTRPAKYMYRSIAQFGAWALACSHPSEIAILDDNDISSISSSSETDPRDAETHGEVFTTGLEGAAP

SEQ ID NO: 38859 - protein, 72 aa, A.fumigatus
PHANCAVSYARATEYRMTAKLYDLAEYRLAPQFPFPCALQDCLAAYLFLLNEHDPTEIIFAGDSAGGGMVLS

SEQ ID NO: 38860 - protein, 135 aa, A.fumigatus
VPLQQALLDVFKPVSYRNMSGHPSGTLHTVCQVECIRCNDLPDAMTDLLDSAMQIISAVMDFVKYCDQEDSIRQQYTWIVSPCNLSLIQLQMPNLSGSTFLFYTLQQQVLLQLHPITVQCLACHYHVPSRGRIYP

SEQ ID NO: 38861 - protein, 160 aa, A.fumigatus
YLHRKSHRTKPTVHISYDEAIQIIRQFLNYAAKHTVEDIQSFTAQRVPAPHWVKTTKVVIPENYLSSAATALIKQLGPKGIARVGGDKWWQWRGPAEDLRGEWIEMKSDYHERRRTNNHPSGKRIMLYLHGGAYFFGSVETHRYQLQRHARKLKGRVFAR

SEQ ID NO: 38862 - protein, 390 aa, A.fumigatus
CFLTVAPRRNPRTLNQVPPEILDDPEIQAAIELLPKNYSFEIPKTIYRIRTSGAKRVALQFPEGLLIFATTISDILTQFCPGTETLIMGDVTYGACCIDDYTARALGCDLLVHYAHSCLIPVDVTHIKTLYIFVDISIDTSHLIATLERNFQPGKTIATVGTIQFNATLHGLKPVLERAGFKVVIPQIAPLSKGEILGCTSPQLSPTEIDILLYLGDGRFHLESAMIHNPTIPAYRYDPYSRTLSRETYSHDEMHALRRDAINTAKSAKKWGIILGSLGRQGNPNTMAMIENHLNERGIPFVNLLLSEIFPGKLASMSDVECWVQIACPRLSIDWGYAFPRPLLTPYEALIALGVREHWDSANSGVYPMDFYAKEGLGRTKPQQALQGAA

SEQ ID NO: 38863 - protein, 182 aa, A.fumigatus
LDAISATPHFHLFHTSLTSRLTQLCISSIDNIMAFFFVPRRVFVRSSSGLRISSRSFSCFSVLRNDKPAFAFGRGPAPPRLPKEEQELFEELQRRSTGAFSTPRAPPKVYQSPHSQPAAEREPEFKAMGKGEELHPDLRGGLKPEFEGEKNPKTGEVGGPKNEPLRWGADGDWSYGGRVTDF

SEQ ID NO: 38864 - protein, 187 aa, A.fumigatus
RSLFLNSRKNCLSRPALIEPAQLAANPGANLGHLFQVDSSMHAKSMQRVDKIFGRYIASSTLRIRAATETSDTAVEYPNAVLQAHYGIHEGLAVRIVKMKCQICVCDTGSLECLQELKCPWSRSHTSGVGNRHFISAHFKKCSRDVRDFGGGNIWTFIWAAQRHRNISSDPDIFRLGQRYDGADPLE

SEQ ID NO: 38865 - protein, 203 aa, A.fumigatus
IMNDVTMHKHASIFAKPLAERDAPGYRDLIYRPQDLKSIKSSIHQGSRAVAAATEAASTPAADGESPAPNAGTTSKNAVLVLPKTEDVIPPKAIVNSAQLEKELIRMFANAVMFNPIPQRGFGPAFPMISDGGSRESTQVPEPDEGGIIKDTLEMFEDVEQAVTRWRAAERTADELASKSILSLRRGSTSDLNTDSADEVKGP

SEQ ID NO: 38866 - protein, 112 aa, A.fumigatus
LALSFGHTAFPWIMAFRPRLNLFSTFRAAPPARLFATEARLTSDHVRIVEVGPRDGLQNEKKSIPLETKLQLIEKLAKTGVTTIEAGSFVPAKWVPQVYTSCLSAVLFESSA

SEQ ID NO: 38867 - protein, 281 aa, A.fumigatus
SFLSDRSGSHQMASTAEICEHLLRSPPQSQHAIAYNYLVPNVKGLESLIKVMDATCSTAETPGSATKPPTTTEISLFAAATEAFSKANTNCTIAESLERIRPIVALAKTKDIRVRGYVSVALGCPYEGPDVPPSKVADITATLLEMGADEVSVADTTGMGTAPRTLELLQALKAAGIANTDLALHFHDTYGQALVNTIVGLEHGIRIFDSSVGGLGGCPYSKGATGNVSTEDLIHTLHGLGMHTGINLEEMSKIGSWISSELGRFNESRAGKAILARIQEQ

SEQ ID NO: 38868 - protein, 94 aa, A.fumigatus
KEAVLPNPDPAAESATAAFIRERTPYMVPTYVRPTPVMIKGQGCYVWDMENRRYLDLTAGIAVNSLGHCDPEIAKIIAEQVRILGLIDHTTRGL

SEQ ID NO: 38869 - protein, 182 aa, A.fumigatus
GLEADWVLRFWRYVSLFLPFLTRAALTNRRADSCKFLHAREDYKQGWELDREWEIGTKGKQLSGRVVSKRSGDAKTAEDDEDDDDEELLESIPFACIICKSSYKSPIVTKCGHYFCESCALQRYRKNPSCAACGAGTGGVFNVAKKLNHLLDKKRERARKLREQAIAEGEEVSSDEEGDEES

SEQ ID NO: 38870 - protein, 269 aa, A.fumigatus
MMCFLLASIHGSYCPRHSTIVLSKKLFVQIKMAEETQGADAVPQISFKKRTNKAKANFRKKPDTPPPASDSDSDFTSSDDEEGRRIKRRRKNAAVTASSTTAGPRRNVVEDQPATETAAIPLTSSNDATKHSNWYDEELSEKNLLGTTRARPASNTQSAPDGTYKGAANYSSFIQKNPNAPTKQFGPIKAPTNVRTVTVMDFAPDVCKDWKQTGFCGFGGMYLFFFLFSLEQLLLTVAQIPANFFTLERTTNRAGSWTENGRLAPKASN

SEQ ID NO: 38871 - protein, 384 aa, A.fumigatus
EEEECPQEKSVSLERPLWLTAAGLRVHEIGMGQDSPKIRAPTEGHSLFEELAELEGGEDEDGTFGANSQTSTPRMRLTADSRRPSEAILDVPAKPAMVDSGVMTDPWQPTESANPVNAGVEEALPVAPVTPTKATVPVAEAGMAIKEPPKLVNSATQWTPLRSGAESNGDQVSSVPTPPKMAWDDASGAEGETTRVPTPPVAKPDFSPISYQETSPVAPVLPQLTTSYFIGGVTEPVALPSSLPRELSLSSISSQSTEPLMAQLPEPEQVYSPQMVISAVFSEHTVPIAVTLPEPEPLPVLSFAEQATNTETPHLKVSTIFSEHTLPVAASLPEPEPVPIISVADHSTSTENSGPRDIFHTPLSRPKLSQLFHPNHFSGTRNPF

SEQ ID NO: 38872 - protein, 588 aa, A.fumigatus
SSELQSPLSPVLFASQATNSPSKVSVPSRKQRNQPSSRVHDIEFATEISTSLLAQVRQLQAMLAEREEALKNANLEKSRLELEAEGYAQRIRALDESEERYKDENWNLETRTHELMTAMKEAADRENRLNSALGTVTSEKNAIERELEEVKQANARLIEEQAAAQKANDAEIHLLRRNLNAQDAEKLALHKKLEELNSQNEELAKVVTMRLRQQEAQATLEVPRDHHSSDDDQGTPENSPPPSPNKFTPRHNHLETETLRSSLGHAHRMIQNLKSTIHREKTEKIELKRMLQEARDEIEQRRREAVAPAGPSTKRQKTRPDASRKPARPDLLGAGRKGKTEIEIQDAEWEDNVVDATPTRHASTSLTRDRSGEESSAYPSDAYQTATEADDAFETANERETATESEAFQTGIESMADGSSDTDELTETEETVQRTPRLRVSSSLIMAKARDRSSYHSTASTSADEDEGVDEVLASPSQAHAPRYRVRKKRNVLRKNPSVWRGPYGLQQPAFECTRLAWDRIRPRFGLPQKDTVFSRNLQNSKAARMRTEHLVLTPRRLLPVCVLRLIRDDPRRPFWTCRPSPRWSIQA

SEQ ID NO: 38873 - protein, 211 aa, A.fumigatus
DGCFPHSVKFDRNHPVVHRTPAGNKITDADRQDLTSRMASMDDPFVSKTEERVPRDAHRYSSFDTQLFSLNAPSPAQAKRALEAHLAETERRLEEASKLGTALIEQQRELEEKLKEVEQQQDENQIGPDLRQKLVELEREYNEIGRETARALLAPKRLAGGDDGHLGTPSLDQKVKPQRFLYRRQDTDLLNYSHRSVPSYSPVKRPTLPAK

SEQ ID NO: 38874 - protein, 101 aa, A.fumigatus
SWPRLVTVLHITAPHPLPQMKMKVSMKFSPLPVKHTLPDTGLGRRGMSSGKIRQFGEAPMAYSSRPSSARDWHGTGFAQDSGSHRRTQSFRGTCRTRRRRG

SEQ ID NO: 38875 - protein, 365 aa, A.fumigatus
TSIRPPFPLSMASADGASPHVKSPTERNLKQVVLGDLLFKTWYQSIYPEDLVSKDTDRLYVCCWCFCYSCDVNSHVKHMRLCEHRTTPPGAQVYEHGGYSVWEVDGDEHKLYAQNLSLFAKLFLDHKSVFFDVATFLYYILTFTDPGNPEKYHILGFFSKEKLSWDANNLACILVFPPYQHKQLGKLLMGVSYKISAWEEDAGFIGGPEKPLSDMGARSYSRFWQERIGRRLLLDDTDASGQETQPARETRKRHSATFMTVRDIGEATGMLTEDVITALRGMGVVQPETPSKRRKAKQAADVPDHYATIRKSDLLRWMENRKVSLRDPVRDERFVGRWALRGTPDENDSIAGEGEEEEEEDSHTA

SEQ ID NO: 38876 - protein, 111 aa, A.fumigatus
SQHRVLPLDLIFLLGRLGIAVVLALLFLGFAFANVGLPLLLLLFLLALVLLVLLLLLLLLFFLFLLLPTSLSSQPCHRRPASPCRCHQRRCPYRLERHPWQISVMVSDLAI

SEQ ID NO: 38877 - protein, 89 aa, A.fumigatus
LFFRVILRKLRRFAMADYLLFEGPMGYSIFKVTHQGDSVGNRLKEVQDGVNDLAKFGKMVELASFLPFEYVSDHLFNFFSFKCVYADKF

SEQ ID NO: 38878 - protein, 439 aa, A.fumigatus
MILQSSAKWSSSPVSCRLSMFLTIYSIFSPSNAYMLTNSRNNKQALSEINDVSEGVASDTLINFLELNLPKASKKKKIVLGLADKALASSIKSAFPFVDCETGDTSEVVQDMLRGIRLHATKLLKQLREGDMDTAQLGLGHAYSRAKVKFSVQRDDNHIIQAIAILDQLDKAINTFSMRVREWYSWHFPELVKIVSDNQRYAQIALFVKDKKTLTDESLHDLAALVDDDEGVAQSIIDAAKHSMGQEISESDMENVIAFAQRVVSLSKYRKSLHAYLVSKMSVVAPNLAALIGEIVGARLISHAGSLTNLSKYPASTVQILGAEKALFRALKTKGNTPKYGLLYHSSFIGRAGPKNKGRISRFLANKCSIASRIDNFSEQPSTKFGEVLKKQVEERLEFYASGAPPTKNEVAMVCWISSMKILYGQVTNHHRNLPWMPF

SEQ ID NO: 38879 - protein, 81 aa, A.fumigatus
SRLRVGQLICYHSMKELHSILKTRADSTIYSGRELREINFNTGLYIGGFPAMDFFGDGSFYLLDAPGVSIISFLVQSGSKY

SEQ ID NO: 38880 - protein, 78 aa, A.fumigatus
MLKAPHDADAMHDRLYIQKPLGFSYFPNEIIPAPKAWVSTTGNLVFWRQHDKVRLNIKGLLVICYRVGISPHLKDPTT

SEQ ID NO: 38881 - protein, 93 aa, A.fumigatus
TKQGHAQIARSAERELLPVETKDKLSNGNIGNSIFEVLQKSPTASVLPTLRFPLIRFIREKVYNFQQTFVMRQNYKYVITCVKRDHFADSRLR

SEQ ID NO: 38882 - protein, 257 aa, A.fumigatus
TSHSPKLLHCLRVSIFVAKQLWLLEPVQAGIGLKTARQLLKLHLSHLILTVRNVSKGEACKQEIQQLNRQAQITVLELDMNNYNSVLSFAKTLEEEVPTVNILLLNAGIGLLKLERSPSGHDCVTQVNYLSNALLIAALLPYLKASAETSGVPSRITWVGSRMYFTTSLEEKAPIKTGESVLEHMDSKEFFFPKERYNDTKLLCAMFMYSLAQRLDKSKVILNMVCPGLINTNMTNVLPFHMRMVMGVMKFFPSAPG

SEQ ID NO: 38883 - protein, 86 aa, A.fumigatus
YSYRCVPVLSLSSGKFIKTLDLITDAAFEFNSLISRTDAAFCVVLRQSDIHTVTQDGMTKGFELPIGVVTRGTDLATGSTFDPILC

SEQ ID NO: 38884 - protein, 207 aa, A.fumigatus
ICQSSKTEQGRSGRNTISCLSYRLRIQLTSGSSQRCMNCVQSHTDAEPVLEEPKLLTESELSTAPDTYTAVSHADPSSKCFTNAYILVLTQFQGQIDSLSLIASTQRLTVKAAPTAQHIDSSGAHDMDRVSLIEDHNGKANSVRGGQPFTAFNSKGVVHRRSGSPPGTARSVHGGWATWGVDFNYTVTKPIKKGRSSKFAKVPVSPL

SEQ ID NO: 38885 - protein, 66 aa, A.fumigatus
AVIIPQLHFLDVSSLELLASVSTIVETLTLCDSHPRVSSLNPSQDKMPPSFRSAYAGGYSDEIKKR

SEQ ID NO: 38886 - protein, 255 aa, A.fumigatus
  UNSURE (24): Identity of amino acid sequences at the above locations are unknown.
TCRSPKCLRRLRRQLKANMRSHLXNTHGISSHPLELSMKAVSSAFHKAETPTYLSPEVLSQITATVIQQLKATGLDNFQAQHAPQSPQPSPQPPSGPTPSQWVPPPPSSAPQYSYNEYESPPPVPPKPSSPQPVAVSDTPDYQQYSQTSPYPSSVEPSARPSPVPPVERRGSPYSQASDQGQKMEARPKPPSRETTVTEMTTLEKIWGKLFEEGRPTKRLGQLLRGIAVHLVSMDVDDWRIFASDSVQDRGLPSR

SEQ ID NO: 38887 - protein, 241 aa, A.fumigatus
  UNSURE (101): Identity of amino acid sequences at the above locations are unknown.
AGGRTHGVGRGRTARVRCEIPAPTASMLLTTPDSWQRAIYTVNPSKATVADTKKLTTPLNKGHESMAYLTYLIDHYDSLPSTIAFFHSHRAGFFMAWHVDXPLHDNVAAMRALQLDFVQRNGYVNLRCNWNPGCRAADRLNRHVTEQVWAEIFDGTSTPPLNATTSPARAAVPQQKFLAKPKEIGAACCAQFAVSREQVLQRPREDYIRFRQWVIDTDKDDASSGRVMEFLWHVIFGQEAV

SEQ ID NO: 38888 - protein, 63 aa, A.fumigatus
VAPLILHSFEVNKPHIQQCLSTRWLVGRQGSKSMRDATATISFLCLDSQNNKEEESGLKVHTC

SEQ ID NO: 38889 - protein, 151 aa, A.fumigatus
  UNSURE (148): Identity of amino acid sequences at the above locations are unknown.
RCTWKISATSTVQAHIWSTGPNRDISRRLSPPSLMDKQATKSSSWLSWRKNTRSGSRKNCQSTLRNPRTNSVYVTNNPRQLAARNLHRQPLQSNRRRHQEAHHPAEQRPRVHGLPHLPDRPLRLPPLHHRLLPFPPRGLLHGLARRRXAPR

SEQ ID NO: 38890 - protein, 241 aa, A.fumigatus
ASSLRYLSQGYKAVRDAVLFAIEVSDSMLTPRPSSDPKKRVEESPTTAALKCAYYLMQQRIISNPRDMIGVLLYGTQASRFYDEDENSRGDLSYPHCYLFTDLDVPSAREVKELRALAEDEGKARDVLVPSKERVSMANVLFCANQIFTSKAPNFLSRRLFIVTDNDNPHGDSRSQRSAATVRAKDLYDLGVTIELFPISQPEHEFDSSKFYDVRPATVDCQWRQLRGSHRIGYHLQNLTN

SEQ ID NO: 38891 - protein, 337 aa, A.fumigatus
DIIYKTSPTDAEAPVYLKDDSKVSTASGDGISLLNGLLSSINSRSVPRRAHFLNMPLELGPNFKISVTGYLLFKRQAPARSCYVWLGGEKPQIVKGVTTQIADDTARTVEKSEIRKAYKFGNDQVSFTPEEQKALRHFGDPVIRIIGFKPLSALPFWANVKHPFFIYPSEEDYVGSTRVFSALHQKLLKDHKMALVWFIPRKNAAPVLGAMIAGEEKVDENGVQKFPPGMWIITLPYADDVRQNPETTLNVAPEPLIDQMRTIVQQLQLPKASYEPQKYPNPCKLGKFNLLTSNADLLPAALQWHYRILQALALDEDLPEKPEDKTIPKYRQIDKVG

SEQ ID NO: 38892 - protein, 139 aa, A.fumigatus
GRKLCFQVSLVSAHASVNLLNNGTSSRYTTKAFGPVMAKAATLTIVEAENIVPVGSIDPNDVDLPGIFVDRVVPATAEKHIEIRKLRTPENEDVTKTLSDPAMAQRNRIARRAAKELKQGYYVNLGVGEYASLLKLLKR

SEQ ID NO: 38893 - protein, 148 aa, A.fumigatus
LACRDIINAGKETVTLMPGAATFDSTESFGMIRGGHVDVSILGVSEADYACERIEYRVNDKQAVQVSAKGDLANYMIPGKVFKGMGGAMDLISNPDQTKIVVATSHTAKDGSPKVVAECSLPLTGANCVSTIITELVSLLTRVQPQTL

SEQ ID NO: 38894 - protein, 145 aa, A.fumigatus
SHGPAFLSWVAYFSSCCQGMATLRGSAIVSPMWRTHTVTRPRLHLGTCYKACARPGLLTTTIRYVRYSTATPPQQTLAPKIERGVSKLFRDADEAVSDLKSGSTILSSGFGLCGVAGKFLPNKKGSTDKLTLLRYTSISDQSQRS

SEQ ID NO: 38895 - protein, 75 aa, A.fumigatus
  UNSURE (11): Identity of amino acid sequences at the above locations are unknown.
IALTVLILLYXADTLLQAGEIPVRLDESGKVLERGTPRETRIFNGKTYLMETALTGDVAILRAWKADEAGNCVFR

SEQ ID NO: 38896 - protein, 75 aa, A.fumigatus
  UNSURE (39): Identity of amino acid sequences at the above locations are unknown.
SSSSADTRSGIPTLAPSFLPEGTKVWVQSENGILGMVGXPANLAKQHQLTDITRDRIPLRTKLTRKFYPLNLVYA

SEQ ID NO: 38897 - protein, 77 aa, A.fumigatus
HYSDTLLSAINRRGVENLHSLTAVSNNAGAPGRGGLSTLTQAGQVDRLILSYLGNNKALEKKYLTGKIVIELCPQGT

SEQ ID NO: 38898 - protein, 76 aa, A.fumigatus
SRLPCRDHIQKGTAQFLRIDVVYPMQSTSLCQVSLEDGNGANLRFPLKIPKDGWIEVLYMMSTRNVIYMTASIDQV

SEQ ID NO: 38899 - protein, 63 aa, A.fumigatus
CLGRIMMLMHSGYFPGEVTVGWTAIASTEQNRTENNLILKSDMTNLRSTIEYNAQNDALKPRN

SEQ ID NO: 38900 - protein, 212 aa, A.fumigatus
GTSSLLSSPWPPPQPWLRIPAHRLQPLSAASHMATTGRTRTKAIDPVKLTTYRHCDGPATGAATAATELSLVPSPTESVGCEPHGDHWHCDGPASATAVPTATSDDHDHDHDHDHDDDHDDHGTATPTVPSPTASVGCKPHNDHWHCDGPRETGSPSASVNEASASTLVSTTSSTTASATGAQQSGGAGSLGVELTGAVGLALAVAAAAFHV

SEQ ID NO: 38901 - protein, 315 aa, A.fumigatus
ARTKVFTMDSLNSSYPQSAMATYSDLLDLAAQQQPHLSGLERLWWAHYAYWDNNIVATGKWHKPNGPPSSILIATGIITFLAHEIIYFSRCLPWIIADSLPSIFLKYKIQDQKPPPSAAEQWACTKYILLIHFVVELPLIVLFHPMMELCGLSFTIPFPDLRTLTAQIIIFFLLEDTYHYWLHRAMHWGPLYRSIHRIHHQYAAPFGLTAEYASPWETLLLGLGTIGPPLLLALMDCNVHLVTVLAWVTLRQFQAIDSHSGYDFPWSLRRILPFWGGADWHDDHHRYFWGNYSSSFRHWDGKCFLLSFGISANGV

SEQ ID NO: 38902 - protein, 87 aa, A.fumigatus
VHLILILSGNNTFYKPEVLPQILTFSQGKQLLIKELRSPRGHKSQPSNPPPQQPLISFLPEEYSLRFPFHHCSMCYHWDWSSSMIHR

SEQ ID NO: 38903 - protein, 80 aa, A.fumigatus
TKLCLVPPTYLSTRFPHSAFPPLQLFPPSSFSSSTPTSHNRLIYNTESYQPTMPQNQDYTYKSSGTNSQVNPPCLSPFTI

SEQ ID NO: 38904 - protein, 73 aa, A.fumigatus
LRYLHVGSRALPIPTKLLHYNKTIDTHDDNNTFVPALKIKPAASPARRVSSPSLPDQQPYPSTLDPVSGYPEG

SEQ ID NO: 38905 - protein, 168 aa, A.fumigatus
SVVGMLDNNRCRANIFFVIYASTQVAEIVASPLSAWLMSRTPWLPYFLGVLFMLCGLCASITVPETLPKSTKLSEPDTEDDEADDDAPRTVRYRLKAVLHHARHQIMHHSRFIFADRNIGCISIALLAANVAIQSLVITLQYVSKRFSWSMAEVQSYSFTLHYLSFLT

SEQ ID NO: 38906 - protein, 270 aa, A.fumigatus
CSSLTQGRIDTPGVIQRVSTLFNGHPALIQGFNTFLPPGYRIECGTEDNPDAIRVTTPSGTNTLNMPRPRPSMDPAGDMGPAGGMGSHGRTDYYEQARPGWQQQPQGQQQQGNLPASYSPGSRMMGPGMFGQGAQGQPQDHHFDYPTQQEQQAAAGAAAMAHQQDQRGVSQLQGAAAASAAMGRAGMMQVSPASAQASGMNQPMNSLAGIGSGMLQGSQADLNKRGPVEFNHAISYVNKIKVGCSFQVASNGNRNPTKAISLAESLRQCT

SEQ ID NO: 38907 - protein, 336 aa, A.fumigatus
LPLALYFCIVAPSNFLCTLYHPSSRLSLCYIFHAPERDNSRNMQRAKVHHTKPSQADVPAVSPTLIPALPEPIQPTQTMTPSQEEFAFFDRVKKYIGNKSMFNEFLKLCNLYSTDLIDRNVLIKKAAGYIGSNPELMAWFKRFMHIDEPEDKVIETKPKQESGVVNLSHCRSLGPSYRLLPKRERQKPCSGRDQLCYSVLNDEWASHPTWESEDSGFVAHRKNQFEDALHRIEEDRHDYDHHIEACTRTIQLIEPIVQQFLVMSEAERAAFKLPPGLGGQSEAIYQRVIKKVYDRQRGARIIREMFERPCHVLPIVLFRLKQKCEEWKASQVSYVG

SEQ ID NO: 38908 - protein, 148 aa, A.fumigatus
TFTAPGPYHPANQNPGHSLPGLAELSQGHGGPHQPAYGQHPGAPSHATGHSLPGIGQTMQHPSPQSLNRERERDSRERELIERQRQQEEMVHREREQREREREQLERQQLERQREQQHHPVQSHTGSIPLHQPVASKVPNSIHGPNGL

SEQ ID NO: 38909 - protein, 62 aa, A.fumigatus
WALACSDKAHKVNLKIITLTTQPNKSSKLQRVPQQWLTSKTNVVSHNFRAPQPRPLRWAELE

SEQ ID NO: 38910 - protein, 200 aa, A.fumigatus
TRSRLVVPFKWRQMATEIPLKQSLWQNRFASAPEIYKQFLEILQTYQRESKPIQDVYAQVTQLFNTAPDLLEDFKQFLPESAAHAKQQAAARQAEESIPISNVRGEPGYPSAGGLPSQTPNRDMKMPPLGQFNVKDSAKDGKKRRGGPGAPSTMTSSISGPSAGAEAARVADAQAGRPSALQTSNANKVSENLVPRHSHA

SEQ ID NO: 38911 - protein, 113 aa, A.fumigatus
NVRETMPRPSDCALPLEAEMRRVESQSGKLCRITYVEKSPTNILAQREWDKVWREQTQKAYWRSLDHQAIASKATDKKLFVAKHIQNEIQSKFEDATGLRLHHRRRRTRARIH

SEQ ID NO: 38912 - protein, 122 aa, A.fumigatus
VCIDECVFSKMLCRSFNFSQLAIPFVSVLISFLAYTSQLFFYYFEEAPLRSEEFWRLNIFAVCIWVCYYRACTVDPGRIPKDWTPPNLKQLEKDCAGGRQRWCRRCEAFKPPRAHHCKTCQR

SEQ ID NO: 38913 - protein, 101 aa, A.fumigatus
IFSYFVSDTAQNAKEKGYLSIAYAVHHTLFLVSIIAALKVFPTHRRCMPFCIASRIVRLIYTYPNPAASIGNAYAAKSKQACTLSNEDSSIISGRRRIASW

SEQ ID NO: 38914 - protein, 87 aa, A.fumigatus
SNWKRIALGVGSAGVDDARRSSHRERTIARPVRGEILWLESGSRLTICRCIPKMDHHCPWTSNCVSHFTYPHFMRFLFVCCSRHGLS

SEQ ID NO: 38915 - protein, 71 aa, A.fumigatus
SRVLKEELYRICTNCQLVNCTIYCLVAGNDPVPRISPASSFPVCALSILAFVVLHSLGYVLHDGGWKIIRW

SEQ ID NO: 38916 - protein, 166 aa, A.fumigatus
PYSCDQCRRWKEKCEGGIPCRKCSHLGRPCRVRGMPVSQDIGYVVKVTHQYFVQADAASTRDAFLELQERGMYMERILKHAFKGIALDTKSLGQMALSIEETEKGPQTETDEAELAVEEECTIDPVEDTVTRELFLFHSVHGGADCRQTSPGNSPTGTFPCASSAR

SEQ ID NO: 38917 - protein, 221 aa, A.fumigatus
LLQTPPNQISNYPRAKQLRSSSRTLAAAISCIPPRHIAEFLVNIFFKHAVTHYFYVDRSWLRTRLAALYTNPGSLTSKEAPVLGIILTIFAIGTQYAYLEAKPAPASSGQTQDFSEDELGTMFYQEAIRLLPEIIELSSLESVQACLLLAAYALPIDAAGLGYVYINLTIRLAMQNGMHRRCVGKTFSAAMMETRNRVWWTAYAMERYPFSFAFCAVSLTK

SEQ ID NO: 38918 - protein, 310 aa, A.fumigatus
QPRSLLRTTPKQDFPLLLSRLADRKTDLEKWWSSLQLTIPKNDAQTPVDRSTAHIKLEHCLLRMFIGRPFLFSRGSPSNPTSPATPPSGTGQQLTPRQELVTCCITAAADAISICSTLRDSDSGPGLARASYIEYSSCRAALLVLIAYSIQDRSDHFRKALRVGLDMIREMAATGESARSEVELIEVLERALVRLRSFDEVGKVASDYEEFKQWESMWKRQNDGNCNSFETVAGSIHEQGWPTGEMDPSGMAESNENLGSLRLFDGAAEWALFGGGSALPRELQHPETQMLGDFLALHDPRFDADLSQSL

SEQ ID NO: 38919 - protein, 72 aa, A.fumigatus
DGRFHFRSPEPGMSLPELTELTNFSRPLQTKYQTTPEQNSSDPARELSQQPSPASPLATSPSFSSTSSSNTP

SEQ ID NO: 38920 - protein, 170 aa, A.fumigatus
SGPCWLLHQIWAKWGAHQVRYPVGGFRTPYADDWSTQRASHPVGTTVRVTDLFKSIPVRRQTVLKSTAKTVAKIKKIVQSYAIARPTIRLSLKVLKAANEKANWVFAPGKNASLTDAALKVAGTEVASACVTKPWPCANESGEESRVVNGSSFQLMALLADPGSGIYSVH

SEQ ID NO: 38921 - protein, 199 aa, A.fumigatus
KGSIRLEDDPRIPSSPLRMPIKALPQTTVRAIGSTSVISDPCSIVKELLDNSLDAHATAISVEISQNTVDVIQVKDNGHGIPAEDHPFVCRRAFTSKIATVEDLRKLGGKSLGFRGEALASAAEVCGGVTVTTRVEADPVGFCIKYGRNGELIRYVTRWEASELRMLTIGVLNVPRTQSVQRCELRISSRAYQSAGKQY

SEQ ID NO: 38922 - protein, 248 aa, A.fumigatus
WPYSRILDQVFTLSIEPRTWLMSADFSKVNNAGQFFSVDGRPLSASRGIGQEISKLYKTYLRAAASRSGGFPYISDSFLCLQIRCPEASYDVNVEPAKDDVLFENQQDLLSLAEELFKDVYGETLDRHEKHKSSSKGKERMVNSDAFELLLARKDSTECSAETVSEGNKPPSFVTASSLFHMRSSPKHGRHEQRLFSDGSPGASGYTRTRDLEGLNPWSVTRLYAPSGALSHKTPARVVFTAGSGALR

SEQ ID NO: 38923 - protein, 72 aa, A.fumigatus
EATKSSITAEVEGVVDRLRSSFACLSILQTIGELDMAAIDLTTVSLLGRAGTEKKLRHNRTTAGFITRPVLP

SEQ ID NO: 38924 - protein, 123 aa, A.fumigatus
RTYGRGRKDHQPHGHGRGSPRRLRSMVPGLLRTALSSAPEERTSQSGRRPDPQHQSRDPGRLCAAACVGRSRARRGLQGEAQGKRRRPPHPGRVKRGRLSGRMLPRSIVSNPGVQGYHRRPGL

SEQ ID NO: 38925 - protein, 178 aa, A.fumigatus
SRKSTLVVIAAFVSIFTGCGLNFAFGVYQELYESMAQLPRRTPFTGVTPAQIDLIGTLAVSMMSLGAPFASGWCKSYSPRRITLAGTIIFATANVLASFSQHLWQVVLTQGVLLGCGTCLTYITAVTVAPGWFTTHRGLAIGVISSGTGVGGVVWAPALRALNARIGFLHTVRPTGGC

SEQ ID NO: 38926 - protein, 412 aa, A.fumigatus
DLHELELSPLHFESVSQGSTGRVINPAVVLLCRSFFSVPARPSSETVVKSIAAISNSPIVCRMDKQAKEDLSRSTTPSTSAVIEDFVASYEKHRDFYCHTAIAVRRLCEAALEDHHIPCLVSHRAKEAASLRKKLYARQLLRGHAYASREEIKNDISDLAGVRIALYYPRHGEEVKRILDDELTVVEEKTINRMGMDEALHGGYDRWFPGYCAQHYRVHLKSGPVNQEGVPTHNTKVEIQVVSVLRHVWAEVEHDVVYKGKRRASGDDHRILDGLSGAVFLGECFLDQLYQTQVSRATTDDRGFENVYALGSFLWNWTASLGHCQVEYPVEVEFLKDLLGILGLNHPRTLRDILSQIDLSTRDESEWHAFRAAFHPARSSLTMFLMHRILTTPAGANRLATTPADDPGIDRA

SEQ ID NO: 38927 - protein, 118 aa, A.fumigatus
HELGLISSSLIWLDRVYPLSSQLFGALFASDSWDRYLPGIEWLDSQKAQDYWRGKAVLTDEERQKINVVFQCFTRNRAQPIQLAFALARLGVLRRYAADWLALHRVISPLLIVIQARC

SEQ ID NO: 38928 - protein, 176 aa, A.fumigatus
EIHPGGNSRLREHLHRLRPQLRVRRVSRALRIHGPAAPAHPIHRRHARPDRPDRDAGRLHDVPRSALRVGLVQILLPAPDHPRRDDHLRHGQRPRLVQPAPLAGRSHPGRAPRLRHLSHVHHRRHRRPGMVHHAPRPRHRGHLLRHRRRRRRMGPCAARPERPDRVSPHRPTHGRL

SEQ ID NO: 38929 - protein, 248 aa, A.fumigatus
YKMSKTKSVTKKGADKPVDKALSKVKDAGVTKASQSPKAKSKQIAREVAAKENSKRKKKEPTPSSSSESDSDEEMESTTSSSESESEEEKPAKKEVKKESKKAESSSESEPESDSDEEMDDASSSESESESESEDEKPVKKDIKKESKKAESSDSESESDSESESESESEDEKAVKKEVKAKADTSESSESESDSDEEEEAPKKAAKKESSDSEDSESESESESESESESEDEAPSSPGAERPLPCKR

SEQ ID NO: 38930 - protein, 97 aa, A.fumigatus
YCYTMAPTTPSSHRPRKRRKYPTGSNNSLILEAEGGKSSPAFPLVSFLWAARAGVSQWLVLPLILMVVGLFRWAVSLWGYSGLCSAWVLGICVQTCS

SEQ ID NO: 38931 - protein, 67 aa, A.fumigatus
RIDAGFQVPPMHGDFEAQRHWMELTIHLPMSKWYLYDLQYWGLDYPPLTAYHSWLLGKMYVAFWDIL

SEQ ID NO: 38932 - protein, 470 aa, A.fumigatus
GRRSLLTISSGSVLDPSWFALDDSRGFEDPKLKVFMRGTVIASEYLVYIPAVVNFLRRYTRMQGVPAWSASIALVAILLQPATILIDHGHFQYNTVMLGLVVASLDAILAGRMLWACLFFVGALGFKQMALYYAPAMFAFLLGVCIFPRVRILRLLNIAIITILAFALLFTPLLVAATNADARDYLSASAEPPLLQALPIKLSKDSFLYAPVFQLMQIIHRVFPFARGLFEDKVANAWCAIHTFYKLHRFEASLLQRVSLGATLASILIPCGIIFRHPRASLLLPTLASVAWGFFLFSFQVHEKSVLLPLLPMTLLLANDGGLSKDTRAWVGWANVLGSWTMYPLLKRDELRVPYFVMTGLWAYLMGLPPTSLETYRSRTPGGESRPVSEPRILTKLLHFCFYLAMIVWHVLDAFVPPPEGKPDLWVVLNVLIGAGGFGIAYLWCMWRLITQCWQIDRKAAEEESRKKKQ

SEQ ID NO: 38933 - protein, 248 aa, A.fumigatus
RLHGSGLSAPGEDGASSSLSDSDSDSDSDSDSESSLSLDSFLAAFLGASSSSSESDSDSEDSEVSALAFTSFLTAFSSSDSDSDSDSESDSDSESEDSAFLDSFLMSFLTGFSSSLSLSLSLSLLEASSISSSLSDSGSDSEEDSAFLDSFFTSFLAGFSSSLSLSLLEVVDSISSSLSDSELLLGVGSFFLRLEFSLAATSRAICLLLALGDWEALVTPASLTLLKALSTGLSAPFLVTDLVLDILY

SEQ ID NO: 38934 - protein, 68 aa, A.fumigatus
LKKKWVPGRNSVSTRPSLEPQCQLLVLASSSTSTDYYSISLLQAVYLITTGIPHAPTTGFFFFGDALY

SEQ ID NO: 38935 - protein, 185 aa, A.fumigatus
PGYRLEENSHLLQPPVNNYCVYHPSSPATAGYTVMIVGGPNARTDYHINTTPEFFYQYRGSMLLKTVDTSVSPPVFQDIPIHEGSIFLLPANTPHCPVRFKDTVGVVMEQPRPKDAVDTMLWFCKKCGEVVWEKRFVCTDLGTQVKEVVEEFAADQEKRTCKACGTIAETRYQEGEVVQPPRFLE

SEQ ID NO: 38936 - protein, 218 aa, A.fumigatus
GGFSYVYLVQDKATSELFALKKIRCPFGQESVSQALKEVEAYSLFTSQPNIIHSIDHCVSTDSGSKFRSDGGEPGSKTVYILLPYYQRGNLQDAINANLVNHTRFPEKRLMVLMLGVANALKAMHQYRVKSGAGSTRRAKAVRREGEAADAQLSMQMGKPKRRASQRVDEEDSENEPLMDDEVTISQEGVQEGDLRPYAHRDIKPGELVRLQFYALGD

SEQ ID NO: 38937 - protein, 119 aa, A.fumigatus
ENQLLISTTGYRKISNPAIMATTSQPPLRFTGHKNFVNRLVFSTLTGRAVHISQIRPSSPTNPGLAPHEISFLRLLEAVTNGSQIEISYTGTIVVYKPGLVTGGIAGNGLHHGPGRSGS

SEQ ID NO: 38938 - protein, 715 aa, A.fumigatus
LVFLLDFWTPSVFRSGRVRQFEHFEAALSQISNSIAMAPLDDIQVGDVVNVPGGMYGTVRYLGSVAGKQGRFAGIELAPEHAKRGKNNGDVEGRKYFKTTVPGSGIFVPMNNNRYVTKRSSTSAPTVTTAPPTPSRPINFSKSVGPSPAVPRPRVRRPSLPRPESPRGPPPSKLSLAGLRTPSTASRAGPSPNGYPRSPVKAPSRASDRTPSRMSMDDDLSSVRTSDFHRSSMASEVQELKDQIKSLEKQLLDRDKQLEEQANTLAEFQRTIEDLEGSDALSIRAQLREKNERIAQLTAEFDLHRADFRSTLDTLEIAASETERVYEQRLDELMQQNKELQDRGEDVEAVARQLKQLEELVSELEEGLEDARRGEAEARAEVEFLRGEVERTKLELKKEREHSSAMLREAHSGGDGGRQYSKELDQKDDEIRGLKAIIHSLSRGDPNFPGLQNGLASSRQDHDSEHIARLEQRIQEFEHATESKNYRIEELERELQQLRLSNESRTRSSTISAPAPPHKPSNSAGYVGTANTINHAHRLSDRTVVPNDWQEQPHGENQYQPFGSHHRGASNSSRHRLETMHESDGRSDDGNSLWCEICETGGHDILSCTNILGAETKNEHVRPVEQSHHEASVDSKSTPGTSIAGESSPLKDEVSATPQKTGRDAVLEGLKGISGGLTASMAPVAGKASGVIDETKWCALCERDGHESIDCPFDE

SEQ ID NO: 38939 - protein, 68 aa, A.fumigatus
GAEIHEDRSLTVIVDHDITCHKSVSQRIKLQTHQLTRFDVPMRIRAKVSLLNSLLAYSNLVIHQRLVF

SEQ ID NO: 38940 - protein, 77 aa, A.fumigatus
DQFDDYRESTIGAAFLTQTISLDESTTVKFEIWDTAGQERYKSLAPMYYRNANCAVVVYDITQAVRAPITFSNIRLL

SEQ ID NO: 38941 - protein, 559 aa, A.fumigatus
WFQVLISAAAEAPLPPPPPPAPARKTGRFRKFLLYLILTSGFAYGGGIFLALKSDNFHDFFTEYVPYGEDCVLYFEERDFYRRFPNTLRNQNRAPKDEGHTVTIPSKSGLSWKVAEEESGADVSQKGPHMSALDNGDKAQLKPGAAKPEEKVATVEKVKAESAAKEQTAEDKKKVKEEPKKPAAPAVTPIEFATVSEGDEEVVQELVKTFNDIITVIGADENAHKFSGAVNKAKEELRTIGEKIIAIRNEARKAAQEEIKQAHATFDESARELIRRFEEARAHDAAQYREEFEAERERLARAYQEKVNTELQRAQEVAEQRLKNELVEQAIELNRKYLHEVKDLVEREREGRLSKLNELTANVNLLEKLTTDWKEVIDTNLKTQQLQVAVDAVRSVLERSTVPRPFVRELVAVKELAAGDPVVEAAIASINPTAYQRGIPSTSQIIERFRRVADEVRKASLLPEDAGIASHAASLVLSKVMFKKDAVAGSDDVESVLLRTEHLLEEGNLDDAAREMNTLKGWAKILSKDWLSDVRRVLEVKQALEVRLGPFTSLFHLYR

SEQ ID NO: 38942 - protein, 186 aa, A.fumigatus
HRPFRWTKAQRSNSRYGIPLVRNDTSPWLQCTTGMRTVLLLSTISLRLYAPRSPSLISGYFERLTRAIGKQSSLDKAKSWVKELQRQANENIVIALAGNKLDLVTEHPDKRAIPTADAEAYAREAGLLFFETSAKTSTNVKELFAAIAKKLPLDQAGPRNLRTTPRPGVDLRPEAPGTQGAGACNC

SEQ ID NO: 38943 - protein, 153 aa, A.fumigatus
ARASSKRRISSRADSSKVAWACLISSWAAFRASLRMAMIFSPIVRSSSFALLTAPENLCAFSSAPMTVIMSLKVLTSSCTTSSSPSLTVANSMGVTAGAAGFLGSSFTFFLSSAVCSLAADSALTFSTVATFSSGLAAPGLSCALSPLSSALI

SEQ ID NO: 38944 - protein, 152 aa, A.fumigatus
YSQRKNDPRPRQPSRPLLSCPLGNVQSRSAPVRGPRRPRLASRRRSPPDQPAAARQHHPNHQPRRHPPRPKPRRTARRHPPRHRARTLHHPPHVRRHGHAPRGVLRSERRGFPHARDCVPAAHTRGASPTSIPGIHDCAPDGVAEREDEGAG

SEQ ID NO: 38945 - protein, 476 aa, A.fumigatus
TVDTVKGKMTQDQDNLRARFCHALSEMYKAEVPLYGDLVDLVWQADAEALQTSQRQHGNTTPIINPDDILPARNRVERHGAIRLGTARELSTIRRMFAVMGMLPVGYYDLSVAGFPMHATAFRPRTREALARHPFRVFTTVLRMELLSERTRALAERALAQREIFTPRLLELLELAETNGSLSCKECDEFIAEGLETFRWHSRAAVTLEEYRILKAEHPLVADIVSFPSCHINHLTPRTIDIDLVQRMMRERGMPVKERIEGPPCRVNPILLRQTSFKALEETVYFRDAGGEYVRGSHTARFGEVEQRGYALTRKGRRLYDQILARVNREAAGLEPVEYERILRKCFEEFPDDLVQLQTQKLAFFCYRVAPYALQRKYQGVESVSLAQLLKDNVLDYEPITYEDFLPLSAGGIFNSNLANMSQSKQPIMEADADADLDGFQRMLGAPVLDEFYLYEQIQQESLETCCQQLGIGSID

SEQ ID NO: 38946 - protein, 309 aa, A.fumigatus
ICQLPNKDAFRQRLGTAKMRTFYLLSLSLVAAAERPSKPNLLSHGQKDPLLGTFFGTPGADATFDYVVVGGGNAGLTVASRLAQNRSASVAVIEAGSFYEIDNGNKSIVPGYAPYFAGTDPEDYQPLIDWGFVTTPQPGAGNRTAHYARGKTLGGSSARNFMLYHRPTADSMQRWADEASDESYTFDRMLPYFKKSCHYTPPDQSLYVNSTNTQTPDAFEPSGGPLQVSFGNSVDVFGTWAQKAFTAVGLEEIDGLNSGRLLGAAYGTSTINPKNAQRSSSEASFLQEAMAGVRLLRSTSSAMGAENPV

SEQ ID NO: 38947 - protein, 70 aa, A.fumigatus
IQKIPTNTRCWPPPFSLIVPLIINQLEHNGGNLCPTTFPTKVVLFKKSLVSNFSNIYYLISFNTKLFVHH

SEQ ID NO: 38948 - protein, 385 aa, A.fumigatus
ELHTEPPRSTRRTHSVRRPRRVSSRRPWRGFASSDLHQAPWAQKILFDENKAATGVQVSTAGTFGTPPVSYKLNARKEVIISAGAFQSPQLLMVSGVGACDQLSKFGIDCIHDLPGVGQNLQDHVYFGSVRRVNVLTASASANDPSLATREVEQYLANATGPLSIFGAGYYGFEKLPEPYRSQLSETSIQALSSVPRDWPEIEWLPVNSWIGDGSNYMTGDPSDGHNYATIATALVAPFSRGSVTLADASMNTPPVIDPQWLVDPTDVDLAIQSFKRQRQVWEVLVRMGIADAREAYPGEHVQTDSQIREYLAKSVIPVFHVAGSCKMGRKDDPLAVLDNTARVFGVQNLRVVDASSFPFITPGHPQAVVYALAEKIADVILAGR

SEQ ID NO: 38949 - protein, 333 aa, A.fumigatus
  UNSURE (73): Identity of amino acid sequences at the above locations are unknown.
MFEKFETRDFLNKTTLVGNVVGHRFPPLCSSWLIINGTIREKGGGQHRVFVGIFWIYFCEHGRPLTTSPTQIXGSIGFVLRWGGRRDLPRDLSDLIQAEDQTNSPCSPEQRWQERSPYPWEQQHNAILRPSFRACVHQATNTSSSSSTSHLENPLSATPQAQSSTPTAQTPPRPSQDQASPLRLTKSLLEKLPYLTSQKPHYITAHLHARPYLLTAGDHLRLPFFMRGVKPGDILRFNRASVLGSRDFTLKGAPYIDERLFECRVRVMGVDAEPMRVKEKTKRRQRHVRKVKSKHKYTLLRVMDVKVKTAEELLEQGAVVVEEGDVPKLEANT

SEQ ID NO: 38950 - protein, 122 aa, A.fumigatus
WARSRAHYPSTTAPAKQIPRPDISSARHTVPPDNRRKPVSASAAAPDHQETPRNISSRSSHTPPAPSQPPRDSPSQESDRTTGALSASAHTPAARPPQTAPYASPSRTHPPHHESRPSPPAP

SEQ ID NO: 38951 - protein, 212 aa, A.fumigatus
RQEVLVRDGLVVEHIILQQLRQRNRFHALIFPLQGIRCHPITEESQFLRLQLHQIIRKLLETFPQDPLILHRLQASRLAIHPRKNLIVQPAPFPRQRIPPLLDLPKPRRMRAPHVLTPRITKVDRLLQRLEARLTQENGVHTARWTLDAFFNWHPPLTHHPLHEINVDRPRGQMVDVAAGEGDDISHQGMLCLENAVLLQRDRRPRMPPEGL

SEQ ID NO: 38952 - protein, 370 aa, A.fumigatus
AEGLQEQFDQGEHTGKWYIAENSSDANFACSQMGNEDLGLHYHQIGNLVAASKAYSRMRDYCTTPSHIASMLFKIINVAIERGDWLSVQSNVHRLRNLQSKPEEQAKNQPKISAALGLSQLHSGSYLDAANSFLTTDPSLGDSYNEVVTSNDVAVYGGLCALASMDCNELQRRVLDNNSFRNFLELEPHIRRAISFFCNSKFRPCLEILESYKADYLLDIHLQRHVSTLFTRIRTKAIQQYLVPFSRVTLDSMLKIFAPGVAAGQAHPTDFNSPFVQELITLIQDGTLDARIDLEKGVLVSKQTDLRTDVQRAALESLVNFRKEAHLRLLRTNILRAGLEVRAPGDDRKLRPADRGVGKGLAGLGGKYSR

SEQ ID NO: 38953 - protein, 125 aa, A.fumigatus
PNSLVIHPAESHPLVILHAIASRNLSTSQKHQRNYRFTKAYGSYQDLLDDPDVDIVYISTPNSLHYEWAAKALQAGKHVLCEKPFTANADEAKKLVELAREKGLIVEEAVSLFSFSVCAAGAAGW

SEQ ID NO: 38954 - protein, 217 aa, A.fumigatus
VLVFLCANASAVVDKGIGGSAMDMTYALSFTRYALHAQLPQEIISVSVRPSKDDPRVDEAMYAHIDFQGPDGNPVHSRVYTDMAREKVAGVIPRVWELPSIEVETEKAIIYYYNAMMPHLYHYISIQDKTTGKVSYKKQYSGGPLWGNVVTSTGEKGGNPHWSTYRWQLEAFVDAVKGKTPAYWVSGEESIWQMESIDSLYKAANLPMRPSQGTKLG

SEQ ID NO: 38955 - protein, 85 aa, A.fumigatus
MGSILPTVTRGFGQFSTSNNRHCICCVIVFVVIMALVDQAATFLHQYVYSWLHSIPSKTPDALKLGVISTAQINPAASKAYFVSF

SEQ ID NO: 38956 - protein, 252 aa, A.fumigatus
LPDPRDHARDFLARHVRIHAAVHGVAVRALEVDMRVHGFVNARVILGRPHADGDDLLRELRMQCIASKRQSIGHVHCRAAYPLVNHCTCISTQKYQNSLTCQVKLPPDITPGDTRTSRHSGLRTDYLPVFSRIQDLAPCMRGRMELPMELHLSPPRCTCRANRKRKETYSLLNNQPLLPRQLHQLLRLVRIRRERFLAEHMLPGLERLRRPLVVQAVRRGNVHDIDVRIVQEILIRAVGFGKTVVPLVLLGC

SEQ ID NO: 38957 - protein, 79 aa, A.fumigatus
APRHRRRGLTAEFTASFLLHNKTVIWWFLYGIQTISSASMRKQVISSSDTVKDPVTMVPDYISYGSCHHGINLCCRIPV

SEQ ID NO: 38958 - protein, 692 aa, A.fumigatus
TKLHSHSPSNHPGISRPCFLSLQFLLLSLLKRITIVHSYTLQSFWCISIVNNFNMVQQDPQEVAHLVGALEASSKKNRSEGKRTFTCKKSTFAVAGSDNISVDSWRFMDWDYKRSNLPTYARGLFTSKRKDGTPEIVVRGYDKFFNVDEVPTTKWQNIETNTRGPYELSVKENGCIIFISGLEDGSLLVCSKHSTGVRQDTNLSHAQAGEKWVERHVASTGKSVKDLARELRRLNLTAVGELCDDSFEEHVLAYDPAAAGIYLHGLNFNVPQFATLPSSEVHNFADTWGFKKAKYLVYDDIHSVKKFLDHCAETGTWDGRETEGFVIRCQLGEGGGPYRDWFFKYKFEEPYLMYRQWRECTKAIIAGKFPNIRKHQKITEEYLHYARRQLSQNPKLGDLYKQNHGIISMREGFLKERGLKGSDIIAMEAGKPDEVTRDVILAPIASLGCGKTTLALALTKLFGWGHVQNDNIPKQKNKPKRFAFEIANLLADKPVVIADRNNHQRREREQLMEDILPGIPGARFVALHYVHEPKDVLLPSIREVTRKRVLERGDNHQTIRAGTKNSDEIVGIMEGFLKRFEGINREREPDSGFDHVIDLDVAASSRENLETVVNALHSFYPDLLRRVPTSQELDDAVTWAMTEYHVQLDLSYSYGSSKPRQNLNKNKGQNDGASTAAHAQPQESSPRGWKAP

SEQ ID NO: 38959 - protein, 229 aa, A.fumigatus
AQICCFCTATMTQPNPYILAAENPSALLTLLRSNPAIASCQDEHGYSLLHAAASYGHADLLRALVGEFNVDVNLLDEDGETCLFVTENADIAKCLVEELGVDYNKRNDEGLTAQETIESDGAFPDVAAYLAKVMGISPSAPAGSSLDALNAPPPLPPNIRVNLGTVSEEEASAGTDQVDPEFKRRIDELAAREDFHSEATQNQLRQLVMDALSGSNIETQDRDVRRRTE

SEQ ID NO: 38960 - protein, 723 aa, A.fumigatus
LPPSCSRSKSRPNCTALSIPPLQSRNRTSPLRYGYTPTRSSAIGRRVSGACSLTLDQSLDGLFGLRNRLILRHESGGDRVVLIPEGRVTWLKDHGHIAVEIGWQARSTFHLYTVDDQFGRLTDNGSLHSRSLLCYLHALTSYCLPDPLTGRTGTEQALTILRSASMRSFDRLHPKASIILAKIAELTPERHYYPSNERVMQTVRWDKHLGFLAQHDSFYREVTAIFDHDNRMKMFHPNEQVNQPPLPHIVPDLLRRNEIRSSSFRVAGFGAEAHTVEYDRPYKGLDQNRHSAGFYRAYRLCKILYEGIPSALETSHVDLLSELWQFLSQTHVVHAASSPVDSSRIQYDAGWILEPMTFVASHWCSLHQLLCSRDTGMSKFQVMVWLATLAFSESSNMVVLEVLASLYVIPEMANPTPASRGQFQLWHGYEVNEAMLGSRIHQSAALSHTPESNLHPRHNENMRVFRSRKKRIAKMNRTLALQTFIRGLKARWPIRSPATPPEEAGPRFGDYYATPEAMTQAGQLFQIWFDNLEFREYLSDLSSLFVSQTVHHVQMPPVCLPGEVKQTTTRRGYICIDDLLGFEPMLDMERPRLSSLLSSHPECEDPAPRLMALVDSLERQSKSQYERRYVEHLRGSIGSLQQKKRRDYITINSSQLEAALLDYLHHCETYCERLYDAMRMRLTHFDGTLDSTQNSLPLETLAGIGNWPRISPYLLVEQLTHQR

SEQ ID NO: 38961 - protein, 1168 aa, A.fumigatus
  UNSURE (8): Identity of amino acid sequences at the above locations are unknown.
YLLPERWXANIVEYGCAITALQRARRLTTLVHSPDDLIRELQNPGHTNWDPYQYPESLLLEIENSMLIREVQEQIARRMRDISPGTNAVMQLNMGEGKSSVIVPMVVAHLADGSRLVRVVVAKPQSRQMLQMLVSKLGGLLGRPVYLLPVSRSLRLTVADADAIFHLCQKCMKEGGVLLVQPEHLLSLKLMCLESFVTGRGAVGGSLLQTLEFFTQYAQDVVDESDENFSARFELIYTMGTQRQLELTPQRWMIVQELLNIMRMIAPSVKKDYPRSLEVEECSVGGFPRIRLLQKDAELELLQRVATHICEHGIDSLPISRQSKTARQAVRAYILKQELSSEEISSVEDTGPAGFWTETTKNPLLLLRGLFAGGILSFCFGQKRWRVNYGPDHSRNPPTRLSVPYRAKDCPAPRSEFSHPDVVILLTCLNYYYAGLSDEELFLALDHLVKSDQAEIEYQAWVVDCPSLPDTYRQLGGVNLEDRQHCVKQIFPWFRSAKGAIDYFLAHVVFPRELREFPDKLSASGWDIGELRTQPTVGFSGTNDSRQTLPLSVEQLDLPEQNHTNALVLDYLLRPENSVALSPARPQASTLDAKGLLDMVMGLEPPVQVILDVGAQILELSSLEVAEYWLNLIPDNTQTQAVIFVNENDEICVLDRNRRVELLQVSPFAKQLGACLVFLDEAHTRGIDLKLPATYRAAVTLGAGITKDKLVQGKTAGNRGMNRNAKLTAHSACMRMRKLGKGQSVVFCIPDEIRFKILALPHKCSRSDIDVADVLCWAVSETWVDIRRSMPLWAAQGKRYIQQCRLWEAASQGGKAQLSLSRASDFLEPEAQSLDDRYRPRRGDAPFLHHQPDESTPMCLISERCREFDELKFASAQLQEEQERELAPEIEQERQIERPPPAKPNQHCLHADLLTFVSTGILKEHSSAFRPAFEALKNTSAARYLGVSQFPSGLRVTTDFATTIQLREGSSCLSDTYQRPVQWVLTHSIYDSTSGKRNASQVIIISPYEAMHLLPEVRRSTGATIHLYAPRQNLSFVSLDRLDLYNIPSRPDSIDIPDDLKIQLNLFAGQLYIASYPEYLRLCDTLGVASAATPDNFTVAADGFILQGNVTSKSTFSQSPLKFLQVLLSQIRKDGQDISKTHIGRLLDGRLLELRDFDPAIEEFTPTS

SEQ ID NO: 38962 - protein, 701 aa, A.fumigatus
  UNSURE (650): Identity of amino acid sequences at the above locations are unknown.
RMERTFHPRAEDMDCTYEEVIVDRRFNFRETRHSGSCQRCAYQRQADSMKVSVHEWPLPSNRLQAKSTVFELNVPRPFGCWRDITMFFLVDVLHIQYISRDEPRAEHTLQNYGGLSPFYTAVQGVGRVGLLSQNKPHERTHRLKKKIINVTEDDVCVNNGLLLRYFDFSMRTFVGGFKMSDEIANLCMYKLPKRSTDLQQFLFRPLGNPDGPSPNTVIASQDCCPVGMSLEEYRSLCTMPLGVEIQWQNILRQLAMPSIDLKKAETCIFILQIINQAGPSTASRVTRTAHDILNDTAFTTALLGRVYDIAARLEENWEMAQGLSALSALVLRILALSPSADVREICLTTLQHLRKVAFAWVKIVTEKASSTTDDRRRSDLLMRSGQLALICATTFDAEDIVLVRMLENPSDTAVLLQCCMLINDTRRFLCEGSGSSPLIPILFRRWQVLCYRCLPVLRQNILQRADSSLDIAIGQIWVTYRAGSSWKASPEAPICWLVTSLPSQSEHGVDLPVHYNLLTGDLLVNGLPLARLPSEYERHDTYRTLFGQSSLEVMPSVIPGMDFTCRKKYMGHTVSFSRRKVTGCEDFDLCIQATEAGCTWEFIPPRLLMGSFPDAFLTGCVHWYNVHNDYVEFRPIDKPWISSTFNWRLXKTSAHDLWRLAQDTLFLVSVKSRTAEVIAAILQPIEKPSQLHCTFDSTTSV

SEQ ID NO: 38963 - protein, 70 aa, A.fumigatus
SNSCSIRRGQLQVNPSRVRLIKEDQTCTKLLCKGRDLQQLYPSVPVKNTYLIILIDENHRLSLSVVWYQI

SEQ ID NO: 38964 - protein, 65 aa, A.fumigatus
LVMVRMVVVGYSYTSTPLLVITLYSKQSNEPFLEDQPSYTSVSEVFPATCLYRAYKLESYNILSY

SEQ ID NO: 38965 - protein, 373 aa, A.fumigatus
  UNSURE (264),(274),(339): Identity of amino acid sequences at the above locations are unknown.
APRIRAMSTAASTMNGTVEKVLYLSSLAVGSWVAKRLLDEYADLPLHLLCSSIEVHSYDEAYNYLLYWLMKQTFDANKNRLLALTSLTSGQGGFFGEDTNKDNDAAEEDELEVHADAEYKASLANTRPLLWTPSAGTHWFRYRGRFLALTREVEENRQTVYTRTEKLRVSCLGWDPAILKELMQDARVAFSQKEKGRTVIYRAMKSIYDGELAWKRLTSRPARPLSTVILDEAVKHAFLEDIQHYLHPSTMRWYSDRGIPYRRXYLFYGPTGTXKSSLAFAPTRVSRLECVHGQPELATTYGGCLDAVVSDASGDGVWCCWEDIDAKEVTGRSQPNCTXPKGEERDLALGLVEYHRRRRGSGGPGADYDDESP

SEQ ID NO: 38966 - protein, 198 aa, A.fumigatus
  UNSURE (9): Identity of amino acid sequences at the above locations are unknown.
LVVRNPTAXRRKGKNGISLSALLNIIDGVAAQEARVLIMTTNHHEHLDPALIRPGRVDYKLEFQLASRDLCATMFRNIFQVYTPSEVGSAQVAASSTQGGLSEKDGSTAIDLQDVAKVFAGKIPPGTFSPAEVQGYLLRYRDSPEDAVAGVESWVEASQAEKAANDQVLEDKAAQSSESESEDDSEDDNEEQPDEDAS

SEQ ID NO: 38967 - protein, 262 aa, A.fumigatus
LQSTPRALHLRKPAFSHTFNLSRLRLLPTMPTLRCGYAFNHERVQSCIHIYSAMGQYLQAVELALQHEDIELAAIVADRPEGNDKLRKKLWLLVAEKKIRQPGTGIKDAIEFLRRCELLRIEDLIPFFPDFVVIDDFKDEICSALEDYSRHIDALRQEMDNSAQTARQIRSEIAALDMRYAIVEPGEKCWTCSLPLLSRQFFVFPCQHAFHSDCLGKEVLEGAGGKKKYIRDLQAQLNKADVSASRREEIVKELDGLVAEAW

SEQ ID NO: 38968 - protein, 670 aa, A.fumigatus
AHALRPAILVAMLRCFELDIDLPKKSSEVGVIRRMFLDPTASHLIITTTLGENYYLHTQSRHPKSLSRLKGVSIESVAWSPSLPTASTREILLGATDGQIWETYIEPSTEFFRREEKYAHSVYKALEGSPVTGIWTELVPTTPEQRRVLIATHDKLICFQGRAGRQGSQGIYAELFQREAPVLYEIQKPSGAAPSTLVISATAVDGHNVDSYAEKEFAWLSSQGIYHGQLPFASGKEKGPFEGARMLPRSMFPPTESARGGKKLIQDPITAMTLSQWHILALVEGKIVAVNRMSDEIIYEQAVLEPGQSTLGLLTDSMQHTYWLFTSQEIFEIVAEDEDRDVWKVFLQKQMFDQALEYARGSAQKDAVATASGDFLASKGRYLEAAKVWGKSSKGFEEVCLTLINRNEHDALRKYLLTQLSTYKKSSTMQRILVASWLVEVFMSKLNALDDNIATKAELAEGASTEDIKDELSNVRAEFQEFVNKYKTDLDKKTAYDIISSHGREEELLFFATATNDYNYVLSYWIQREKWSEALNVLQKQTDPDVFYKYSSVLMTHAATGLVDILMRQTNLEPERLIPALLNYNKTVNIPLSQNQAVRYLNFIVVNHPKPSAAVHNTLIAIHASSPSPSEAGLLTYLQSQPSSPPPYDADFALRLCIQPRTCSIMHPYI

SEQ ID NO: 38969 - protein, 64 aa, A.fumigatus
YTVNRFFGQVLLFYCISHHPDPRLRKTLPVGWERWTDEILRFLEDCAPFSPAVSKDLELLQLLR

SEQ ID NO: 38970 - protein, 277 aa, A.fumigatus
VFDLPSGHAILSATNNRSHDVNFDEWEGDMKSRVYWNTLMNETILVQELHLPPSGLSRLEELVPIPKFIGFESVDFVPARFSSSSDEIDESFFQYHFLAQVAHRIILTRIRRSLYFYCESSPLAPFLLRCLRPLTLASADSGTFPLPAVNAELRHQLEQWRINLPPALQFSDSQPSTPMDPNPSPAPVSPLPIDPNRPLSPAIAVTEAMLRGRYMIANFHIGRPYLYKALRIPQRVTDHDLEQMRNGLRHAMDWPPVGGIFRKMKSCIPIKFAFCSQ

SEQ ID NO: 38971 - protein, 89 aa, A.fumigatus
PLSLLLKACPLVDELALYDVVNTPGVAADLSHISSVAVCDIILDPSTQVINPRSDSHFQKVSGYLPKDDGLKNALTGTDIVVIPAGIPR

SEQ ID NO: 38972 - protein, 96 aa, A.fumigatus
GTILKTNYDFNGTRNADLILCIVCWLCQHQGTSYIINLQTFDNKEELYLSYCEQAVGVQATENGGVVVITKKPGNPQQPAKNLVSVSWGPNAATRK

SEQ ID NO: 38973 - protein, 79 aa, A.fumigatus
FAGWHCLRLVLLISGIVLWHRIYKAVASKTAKNGYRADLREDAVARVSAIRRSQKPKKDAAPKKLRGAQARKAAEQKSE

SEQ ID NO: 38974 - protein, 187 aa, A.fumigatus
LKIFPTGKPGMTRDDLFKVNAGIVRDLVTGIAQYCPKAFVLIISNPVNSTVPIAAEVLKKQGVFDPKRFFGVTTLDIVCAETFTQEYSGQKDPSKVQIPVVGGHYGETIVPLFSKDSPALDIPADKYDALVNRECLLYIYSYLQLATNSSVGVQFGGDEVVKAKDGAGSATLSMAYAGFRSATFSGA

SEQ ID NO: 38975 - protein, 107 aa, A.fumigatus
VSSLVEMRSSRLKMAPAPPLCPWLMLASGLPPFPELKSAYLLIQGRFAEKVIRASQGQSGIVEPTYIYLRGVTGGEEIANETGVEFFSTLVELGVSVSTSSAQTILI

SEQ ID NO: 38976 - protein, 148 aa, A.fumigatus
LQITVDIEQTLTVHKSVILVCRNIQGRGILAEEGNDGLAIVPANNRNLDLGWILLSGIFLSEGLCTDNIQGGDTKEALGVEDTLFLKHLSGDWDCGVYRIRDDEYKSLGAVLRDSRHQVTDDTSIHLEQIVTSHTRLACWEDFESEEE

SEQ ID NO: 38977 - protein, 110 aa, A.fumigatus
CPLAALYLTRSRWLPLIPVPDHLYARLPSSFAGDLEAGLSSSQFDISSNIADGDTRAGLDNKAKREVQKIMKTQNVNFDEARRIYTERRFATHNIGPDGRPRDPKFVSFS

SEQ ID NO: 38978 - protein, 381 aa, A.fumigatus
  UNSURE (126): Identity of amino acid sequences at the above locations are unknown.
DRILPVSVVRHAISEMDRLPPRWVDVQDEVTELLADIAQKSAQLDKLHQKHLLPGFGDEEVRKQDERMIERLTQDITRGFHECQTAVQRIEAMVREAKQQGGVSAGDETMAKNIQISLASRVQEAXARFRKKQSTYLKSMHCYHGHWENIVTCDLTELRGLEGAAAPFDRAPTPQNPYMDPSLMESDADKSFSQSTLMQTSQRLTGQHDEAIEQREREINDIAKSIIELSDIFRELQAMVIDQGTMLDRIDYNIERMGTEVKAAEKELKVVCASLIRDRGCQRTDKFCLKATNYQRRTTKRKILLLLIILVAGMIILLIVKPKRHSSPAPTPSPPRPVEQPPSEQPPSLFPRSSTFVYRRKRRPFPIQSSDDKLFEPGING

SEQ ID NO: 38979 - protein, 96 aa, A.fumigatus
YLIMMLIWIHPGQTEVVETNGASDENDFLARERAILGDDADQFATAQDHVATDIGDDLLGGAEGAVVGETAPEEISGFESSFPAIETQNEVSFRSP

SEQ ID NO: 38980 - protein, 117 aa, A.fumigatus
REWRERRDAEIARRAELSNEKKEATIKKAREDIDDFYVSYNNKTDKLRAQTRADAEQFLANREDTSAGGTSWERIAKLVDISGKGAKGGASGSGKERFRELLLDLKKDQNAPGASGI

SEQ ID NO: 38981 - protein, 288 aa, A.fumigatus
AIEIDKSRSTGKKPLLGGSLFSSPSGSVPSELQPLVPLQAALSKATMASGASATAANGEYDKMNDPAVPLPTPPVHAARLSQLLKALANAESSVSEVIKSRLALIDGLEKLLETNRAALSKEQSVLSQLTERKAETEAKKRDVEDSIMRGLSIDNPSLPQPSDAGAEAPAVARPEVEALTPPPVEAITPVGSPTQAPQEKIQESVEEGQVDGFSLPGIGQPTNNVPSDTGLPGLSSLSGMLQQGSPNGVNSKKRKVTHGEEDYAQYASGDLDADVAELLNQEGYPQER

SEQ ID NO: 38982 - protein, 65 aa, A.fumigatus
VHSILPHPYQTGLANFDDLYTSATPKTFDSYHLFLTPNHLLHTYGAPLPPDRRGRRLLSLTPFST

SEQ ID NO: 38983 - protein, 90 aa, A.fumigatus
SSQGALMYLVAITNILTDMAVLTLPFFMMHKVQMSHGKRVKILCAFCTRALLVTRHCTSYSTLMETQHRLTHNWATSDTTTILNIIRYYM

SEQ ID NO: 38984 - protein, 115 aa, A.fumigatus
PSQSVINASRKRIPGLEDVEPIQGTTATTTYVYITNQSAGPRPDESSPSARVNTFPSMEPEKTCQLLEAHLQLYHNQIKNISSRDIDIQMASLPPSLCQFSSHRPLQIGERTLSG

SEQ ID NO: 38985 - protein, 63 aa, A.fumigatus
ISITIDGLSTVKFQVYKDVEDWLNIFPSFYRGMCNWIYDIATTISCLSYADLQEHLQTPLRKL

SEQ ID NO: 38986 - protein, 65 aa, A.fumigatus
ASSFKLQQKEAPDEQLSNDGRLNPLFMNQVADDQVYSSYGAQNKAPLQQIAQAYDPARFMKRHGR

SEQ ID NO: 38987 - protein, 123 aa, A.fumigatus
SSSCLRKITNQSEVGEVERLLESALVERFPRHYNSPIMLSETAKRRTNRKGTESKSIEHSYYFLRNIRSIVDQYARRTTITSTYPCNDPGKRHAGYINDALQYVPRWPVLFTKLHPAEVGLVV

SEQ ID NO: 38988 - protein, 76 aa, A.fumigatus
IYINAPVCLSSRGAVCVKLPPMSSILFKNSPLLAKRRNKSNINNINNVSVVDWRSVQLSYDALIPLISFKFIRRQP

SEQ ID NO: 38989 - protein, 86 aa, A.fumigatus
GSRNINIAVFLPCPSVPRLCIPPLHLSLIFLVKSLTAMPCWSSLALEVHMTFYHGELNLTYQHPGIPETVIVCYIQYAFFTQAVYL

SEQ ID NO: 38990 - protein, 473 aa, A.fumigatus
CSELDNSTVSTYRNFAASEYGQLSMLATLNTVTSVVAAVSKPPISKLSDVLGRAETYIITITCYVLSYVLCASARSLDTYAGGCVLYALGQSGTSILNAIVISDISSMRWRGFVYNIIYLPFLVTPWVSAFIVENVVNGIGWRWGIGMFAILMPSCASIIIISLLVFQHRAKKTSSVVYHRPSVHGFCSGIDLGGIAILTCGFSSLLIPTTLAATTTSRWKTPWIDALIVLGAVLLACLYPYEKYIAGNPVFPVRYFHTLSVLVPVALACIDNIGFGTTHTYLYAWSMVSHNFSPRNAQFLSWTSGVIQALAGMCIGLLMYRLRRYKWIAVAGAIVRLIGYGLMIRLRTNTSSLAELFITQLIQGLGSGVIETVAIVAAQVSVPHSELAQVTSLVMLGAFVGNAVGSAIAGGIYTGKLRERLQVRLGSAIGEARLDQLYNSITGTLPMWGTWQRVAVNQAVSITRLLLLYITC

SEQ ID NO: 38991 - protein, 165 aa, A.fumigatus
  UNSURE (162): Identity of amino acid sequences at the above locations are unknown.
RGEDTSQNLKKRDRHQLSDFIKQLQYTLYDAISHLGNADVSIVTATTIRTIHTLLHEAISGPSHVYERTTNTIRYVIKSLQKQNIRLLSDKSRQDSTLRVVSILVAQQDAASNILLATSMKQDSTRMNAIAALTMVSPQDIYSSEYQTIRFLPSLRNCHDLXSLC

SEQ ID NO: 38992 - protein, 263 aa, A.fumigatus
GAHGLSSGERPGPPDGYCHCALTSKDPGDGLPVWWCSFNQSRYSQPSLSLSYQALMNAGGPGGSGVEQALLFGRDMQTIIDGETDPALPTGPANLSARYFDIIGFDPRGVNNTTPGFSCFPDSFSQRNWELQVEADGMLGSSDDSLMRNWQRAVALGGACSKALQYAPEGTDEALGDHLNTPPVARDMLEIIERHGEWRERQGQTEQRMYDRMYGYDQQQSIVARTKWKRGHEKLLYWGRSYGTVLGSTFATMFPDRVERLLL

SEQ ID NO: 38993 - protein, 66 aa, A.fumigatus
FLTGQAGQIENLPKNDTEINSMRVITNKQPVSEEESRMLIRSWKRNFNLNGYYIWFQWDRVISSPA

SEQ ID NO: 38994 - protein, 106 aa, A.fumigatus
SSLIRYIMEDRQRHCWECLRRSLVCDFIRPQCKRCSTSGIVCPGYEDKAPFRLKWLPPGRVKFRNRKQVKHQKMNRARVAAEHSVVPRFDTIYDAPVLAQAAEYCK

SEQ ID NO: 38995 - protein, 248 aa, A.fumigatus
LKAWPYSPLLELANYHVLGRLFYYVPNLAPLPPGKVLAIFGALMALVEALNALGVALNANPTGSQQGLGKALILVSLALQLCVVLAFVLTAASFQWRCAKSQYSFAGSLATLLFTVDISMGLILVRCIYRLIEHVDNTSVDLVIPEGLRSLSPLLRYEWFFYVWEASLMLLNSFLWNVFNPGRYLPRYPTVYLAADGTTEIEEEEVRNDQHFLVKSAYAAVNALTFGLFRLFVRQKDEENHPLTERTK

SEQ ID NO: 38996 - protein, 157 aa, A.fumigatus
RPPCSSSRLRSWSCCNKTSSPTPPPTASLHPSATSCKPSSGAPPSRHDTASPRRSASRSSARTPSPSSSSPPTPGRIFCPASHQPTWAACSSSTAPACPSRPFAPPRPASPKSRCSSANPPRASPRRSCTTPSHSCSPSPATAGSPPPTWASSTCTP

SEQ ID NO: 38997 - protein, 924 aa, A.fumigatus
GAGIIMNILMPALFNLHCVFGPAGVLPNINLVDALAVSTRIDIWSMVPSLVDELGETPAVLSKLKSSKFICASGGPVSPVSAGKVNEVIRVLNLTGTTEGLFMGNLIPPREDWFWFCFHPYSGFEFKQVEPDTYEHWVHRNEHWPLFQGIFHTFPEKQSINFKDLYVRHPTKPNLWAFKGRSDDLVVLSNGYKISPLQTEAFITTHPAIKGCLVFGTGKPQAGLLIELKDPLQKTDELLDSIWETVQQANSMSRHKNQLLRDFVAFATPDKPFCRTDKGTVKRSATLKLYADYIERFYRSRNDDLGGTFDFDMSSAHSIEDNVRKILAASLPDVQEASADTDLFALGLDSLGVFAAIKTIRAATGLGDQIGPRHIYANPTIARLSAIIALLASASDTTLCERPVDDVGAQIARMIAQHKARQSFSLNAFDYVNPNHGMGLVLYFPIRDGVSYEQVFANLQAGLNRTFDLIPALSGKMTDCSEQGIGYTKGDLCVTIPPLAKADSARNRLVYKDLSAVLPSFDDLRKGGFAPSAFSDTLVLRDDPFPQMPADIFVGQANFVSGGCILAVDLNHCCLDGLGAMVALKAWAENCRYLQGDQSATCGWYDPESFNHSLPEILHRQEGWARPLHEIDPGTWGFLPFFPPEDEETNPRCEKATEGSLPARPIFPLHPVWPLPRAERCLKTTMFLVTPEKLELLQQDVIADPATNGITPSISDIVQAFFWRAAIKARYRVATEIRKQKFSPDAVSILELPTDTRPHFLSRFPPTYMGSMLIFNRTSMPIETFCSAETSIAKVALLLRQSAARITPSLVHDAFSLLQSLPGHRRFSTANMGLEHMHAMISNMLLFPTSEIGFGDAFFANGGVPETMRPQLERGNGRFRFLAVFPLRKDGGVELVLGTHREELEMLVTDEEFTRYARMVDTCC

SEQ ID NO: 38998 - protein, 134 aa, A.fumigatus
GRRPFLHLFVRIDPKDTVAADLLDPATVTGLGIAGTMGYVPDGRVLGLSKLARIAEVYSRRLQVQERLTQEIADAINRVLAPTGVVVLIESTHLCMSMRGVQKSGATTITSCMTGVLEHDPKLRNHAEFLLRIR

SEQ ID NO: 38999 - protein, 437 aa, A.fumigatus
ISFTFILPLFPSLLTFYRSQDPSPTSLLNQVFHYLNAYKNSFAKPIDSRYDIVLLGGALGSLFSLLQAIAAPFIGRLSDRYGRRTALLCSMVGNTLSVALWVAATDFRTFLASRIVGGLSEGNVQLAHAIATDISDESKRGSTMALVGACFSIAFTCGPALGAALSNITTVAANPFATAAGVSLVLIVTETLYLYRCLPETHPRLTKLSLGPHRAEDTASPTQKNGKQADASNPDSTMPRKRTNNPALLNLLHFLFLLPFSGLEFSLPFLTATFYAGSTASPSALNGRLLSLMGLIASLLQGTVVRRLPPLMTLRAGVVACTISFFLLARVSSLVGLYSAGALLAVTSATVVTGLNSLGSLEAREGERGLVLGRLRSWGQVGRAAGPLLFCSLFWWVGREIAYTTGGFAMLAVCVGVFTMLRSPPIESVAMAGKVKA

SEQ ID NO: 39000 - protein, 218 aa, A.fumigatus
YFQDPCIYDSEGVLLILQHWRTHGQARWVPLLDTKQLDRLAGGRKEETYWPVPVAQEKFHCIILKGGDRYPYFPRPLLSEFDFRIPISDRPQKASDDEGDESRNDASARFEESFVRGNVLLSLFQDLLSSTNATPSQRVELARKEIELDKILLQMLAVECREGEERGMKALELVRMMKDRNGKMIEAAAKIAERYGRGVLEDKIRDLAERAIHGDRRR

SEQ ID NO: 39001 - protein, 250 aa, A.fumigatus
RCPFAALRTLSPLLPTLLINPLPPSILSPNITLHLFPSTHPHLPTVKGRTLYRAALWTVPVAWSSLPLVGNVKLLILSERIVRAGTVLDPDGCSESESGDERLVVRWRTEPRREGHKGGSAGAASKSNKALSSSSSSEKLSHTSAKNGVNKGLSVLLGGDAPIFKLSNEEQFTGLFIFSFDEEGRISSHTIEHADDAGGWDRTAKFVTLTDWLIGKARGSLDPPPGLAIQGCQTCSFPSPRTHRGSDRST

SEQ ID NO: 39002 - protein, 73 aa, A.fumigatus
CLEATIKSRNDCCWRDECHSFHLLYKPIYAKIDPFSHRPAMSLRRRHSNLPITITISPHSMAQIRHAGPRGEL

SEQ ID NO: 39003 - protein, 64 aa, A.fumigatus
GVKHQRENLTKEMYISYSFPVFVTVIVLSCRRWALLLGAARRTTGVATDKIIARFTVWLRLLVV

SEQ ID NO: 39004 - protein, 138 aa, A.fumigatus
YKIDASDDKLVSDCKSPGSSSKPGCDIGGGRSSESLRGDLSPSSSSRSSNSITFGSSFGPDTIGSSSLKSVSASVSYTTVLSVLGGGLSGCGFLSNSGAESDGPFAGSDCVSSTGKFVSLSTPSSDGDSKSGIMICGN

SEQ ID NO: 39005 - protein, 80 aa, A.fumigatus
DEGISDFNGFRGVLGLSFKTFFSRVEVLGKISFASSSASSFLFLLELKDSWAVATTVGADLSARGSFPSYPWLSLFFGVI

SEQ ID NO: 39006 - protein, 81 aa, A.fumigatus
LLLGLSLPSFVFKIIQDLFNRLLALAGNNNPLKNSSSMSPFEVKACNCVCIINTKDPGCMGGLRMLYVNTSRRNHTRHIDI

SEQ ID NO: 39007 - protein, 660 aa, A.fumigatus
ILRFAMRQGDRPSTNAKSAQEQFRTPNKPPISSASTTSRARKGTATSKKQSGTPTSSATAAKPWKGSLLSGDQPTLTQIDFVTPRTQNAESDDDDDLDYIDKAAQDNEPDSREVIEIDDSSDDDASYQQTSYIRARRTGDAERKPNAARNASRRMRSTGQAGSAEKPPGRKSIEGVKGSKKKTKKQQKDKTLTQMDYVRRYLKIEPDEAKLEYTYITPKKSDSQGYEGKLPRALKSAPTVVATAQESLSSSKKRKLEAEEDAKEILPRTSTLEKKVLKESPRTPRKPLKSEIPSSQSPESPGVAIISSSQFRNATRSPPNLDFSTKPTSTIKEESPDLNQTNAIAAQVSISEDQLPQIMMPDFESPSELGVDKETNFPVEETQSDPAKGPSDSAPELDKKPHPDKPPPSTERTVVYETDAETDFSDDEPIVSGPNEEPNVMLFEDRDDEDGDRSPLSDSEDLPPPISHPGLEDEPGLLQSETNLSSEASILYQRRQPATQFPLEPIPTLSTQKLAELFPRESSTQQTTTEPSCTKSSAHKVQALSDPSFQTQTQSQTQDQDKYSTEMIPESSPITWHAGYASTGNATLPQNRAQSVVQVESSQRVDRLKGRVDPDEDSCPRGILSRSQLLTSSVMESVPLPGFWIGSQDSVGEPYSLTDP

SEQ ID NO: 39008 - protein, 104 aa, A.fumigatus
QDIMAGANVDEEEEVAWDDDSDDDTDSPSTPQVKTNNTTQIPTVDKNKLLKPDEPRRSNDQQSQPDSESSYDLVSGNTSRAPGSPKEKSPTTAAKDDDSDEDWE

SEQ ID NO: 39009 - protein, 341 aa, A.fumigatus
LRYQLAKKTMDIAYDHIPEEIFSSNESSKKKASQDDSKTIRSIVDLNTELQETFRAFSASPWGIKIGGLWDNVRKQGESYYEGARQEYAAASEESAKGLSDLKETIVGRTRGLSLSTAFTSAPSARSKDETPTPTASRAGESQEEGTSDAGASEGFLTRIKAEAARRLKEIEKAEEAADEAILRFGMTIGQKLREAVSIVPPDAESSNMILFESKDAEGKRVIHATRFEAQLHVIHSNLESFTKDPVSDKWAAFKEEFNVDNKTDAIAVDLEKYPELRSAMEKLVPEQVGYATFWSRYYFLRLVIETEEQKRKELLKGLLLVSPPCLFTGKSDKISWQAPT

SEQ ID NO: 39010 - protein, 487 aa, A.fumigatus
FLEDRDEIEISELTARTADEHMPRNVQDFKDHPIYAIERQLRRNEVVFPKRVIGQVSLGKSGSKDQVLVPVYRRSDVHVVRSADKWYRLGRDIKIGEQPLKRIRVNRNKDAGFSEDEHDNESGMEIPLYAYFQTEVYTPPPVVQGKVPKNSYGNLDVYVPSMVPPGGVHIKHPQAAHAARVLGIDYADAVTGFDFKGRHGTAVFQGIVVASECQEAVEEVLDYLEDERRQTESQEKSRETLRLWKHFLLKLRIAERVKSYTIEGEESADEILEKYEDPGEAGGGFIPKPEQEMADGGQFATCQRSMQLEGRGHTYHIVSTNNGGPGIGAHGDGLQSDESASHIEAISVNPSETHIPKASRRPRYSLIVVPNKKANNNEDGTSQRQPQPQSEPTPEIVELEPAAEAQSVQRSGETGHLGSSEIPIMVDSSTTGGSRSASVEVLSRTASQTQPQTPTPEEMDESSGVDDNGSLLSHDPEDEDAIPEWLV

SEQ ID NO: 39011 - protein, 151 aa, A.fumigatus
PVGFSCWYVSHRPGYRDQPIARDEQESNADRNRVQVPQLIENYCNGNAEAISLLFLFVWFIGDITNLIGGAWAGLVPVIVAIAVYFCIADGVLIAQCLYYKSRHARRESLRRRRRSSTVTPDPTTPLLGPSIQRYPGTGSGFATPIYNVAA

SEQ ID NO: 39012 - protein, 377 aa, A.fumigatus
HRVSSSSATRSWMSSRAIRKLQKLREQELQQAHLQAEQDNDESDEYEPVIRPSRPKLNAFDLLNTGDDGDEEHESDHDIEETVTHLAEDVPARVKSADSSKKKKKKNKKKKAAVAKVTATGGAPCAQSDDELDEIDRALKELAVESKGTDSQKAAAVPPENVRGASFPRTPEELLSIEPKFLNAMNEMRRLFGNVVLESFDEETGTGRRRDRNREMVDMGRALTGRYSPASKGLSLAGTTQRRNVLMQGKDEWPRAPSGGLGMELVEKLPSGATKYQIVHNSAYTDVQRQFDMCVESMDPQRMIHLLQYNPYHISTLLQVSEIAKHQGDHAVSADLLERALFNIGRSAHSSFGNRLKESQAKLDFVHMANRELWLVG

SEQ ID NO: 39013 - protein, 375 aa, A.fumigatus
  UNSURE (12),(14),(32): Identity of amino acid sequences at the above locations are unknown.
RYIAIWEMKGTXRXAYEWAKLLLSLNDDDPYXIRLLIDHLALRGREYAHFVDLCAQTRLSEDWAPLPNIQCSLALAYLRLNKPKECRQQLRRAMSRYPWVFCKLAQELDIQPMPKRIWGKMPPTDAHELLTELYIARAKDLWNTPEVVSLIVEIADTLPEEEEPIEPPEITLDIARHVVLSDIPRVTTHLPGRFVSGRISASDPLPPYDSEAHRQQSDPTPSYLAQMPEVGRPQWLRDLLDQLNNGALHFPRFRGGDNEEIRDDDLSDYDQGEAGGERRRPVADQGASLEQWLLGDGMQSLQAFLNQYGVDRGNWGDVVDYSPLTEYLDGLDAVQPDEARQELLHGRIREVMGDMVVDMLENELELQQYDDEDEV

SEQ ID NO: 39014 - protein, 167 aa, A.fumigatus
CADPSSPAVKTEQRHLPLSAGVVVRRLSRRSERIGFCRLETNSDVSSMTKPGSSASSFSASIGVCDSSLSCRAISSGRTFCRFLKAALLWRVREACRSSSSTKDTFSLLSHFRGADAGTPLLASTSIAPFCADSVVENISSSSTGLCLVALTFFFFGFLILISLTSM

SEQ ID NO: 39015 - protein, 291 aa, A.fumigatus
VAYPYRSDKFPMISEAHEHTQATVTLLNEAPSQELRNNTDISSFSGDFPICTDLNGPIAPFCLPKDGADVTADATYYVTWNADFYPLNATITIELRYANSSQGDSAFTSEKTDNSYGYISLPMQKEWLQGKPYNALTLYIIELDPTSGSRASARQGPTVILHPKPVEHYKPSPRTPFNRTALLIGLPVSLGVVIAAVAGLAFGMRKSRKTGLRDVVSARGRSYGIGKSKNKRLGTKREINGPDSFAALNKYREDSGEGFSEFEGSEKSHGLERSGSFACRQEVSRLKTWSG

SEQ ID NO: 39016 - protein, 149 aa, A.fumigatus
KMRVHRDLIANYLTSKESLLLFSTDPNSPNLGYLNCESDQLLCSTWSAGAPSVWYFEVPQAQLGESQAATPLHVVYLNSTTVTSQDIYKIHSEKTYKKEPAYEGALHPTDGWLAQNNLLVPLGYIIHGFSVIPSWLFMIFISFASRSLM

SEQ ID NO: 39017 - protein, 107 aa, A.fumigatus
HDTLNIGKIAAQCSHATLACYKYLIAHNPQSPILRRWEQQGQAKIALQTKSEEELQLLHAQAMSLGLCARVIQDAGRTQIASGSRTVLGVLGPKSVVDQVTGHLKLL

SEQ ID NO: 39018 - protein, 456 aa, A.fumigatus
YRLICNSPNMADALSIEQNNKIRVALGLKPLPVPGADATSGRVFKETREGSASEEDAGSTLESRQALASENWKKLQEEAEAKRRREAKNAAIKKARDAAQRARILEGPTLGESGDADMDTKTWLLQAKKRQKKIEKERALKLAQELEERERAAEYSTADLAGLKVGHEIGEFEAGEEHVLTLKDTTIDENEEEGDELEDVNLREKEKVAERLELKKRKPVYDPTEENTGILAQYDEEIEGKKRKRFTLDAQGSTVEEREAKRQEVSDRLKQNLVSLDLGAIETTPVSDYMDVSEIKIKKPKKKKVKATRQRPVDEDDIFSTTESAQNGAMEVDASNGVPASAPRKWESSENVSFVDDDDLQASLTRQRRAAFKKRQKVRPEDIARQLREESQTPMDAENEEAEEPGLVIDETSEFVSNLQKPILSERRERRRTTTPAESGRCRCSVFTAGLEGSAH

SEQ ID NO: 39019 - protein, 157 aa, A.fumigatus
LTRVMTASSIMRFIQALVILPALAAAQNQVPLADRVQGWFNKAKSYLPTATPVVPTVEKVVEQKVQQKAVTVTPFNMSNWQSLLEPSSEPQDWLLYITGGNKTCFGRCGNADKAFNVRTQMGSRRCEYTETLLLIISLRRNLFSCSPQTLTPLILVI

SEQ ID NO: 39020 - protein, 158 aa, A.fumigatus
LIDKQLWRLPELRSDLSLPLGQARTLMENTQTASPTLALPKITKMAELDRVPPSTTAYVIATAILAGITGYFIGQGASLGLFSWAKEKEGWPNSYNVKIPQHSSDEEGENYEGDSEEEGDGGELANFDASNEEVKLVLVVRTDLGMTKGKMIPLCFPA

SEQ ID NO: 39021 - protein, 65 aa, A.fumigatus
HLSNQSAQKLPMVYSPEHGTCIHYHMQPSYWNGLKLISDQAVAGKIITVTSRFIPRQDHSIGGLG

SEQ ID NO: 39022 - protein, 98 aa, A.fumigatus
IVICWLRIHQCPYSEAMTRTTSVEDVKFEIPTWDNSNVDVADGSGRPESSTSGDTIRPKGRIRRSMTACNTCRKLKTRCDLDPRGHACRRCLSLRFVP

SEQ ID NO: 39023 - protein, 146 aa, A.fumigatus
TCFPRRIECKLPETAERFQDNASMWSDATAAIPSIEERLISLERSMTEMTSMMRRMMDRSPSISGSSVSMLTRSGITDETASIEGSQSSSFAPRPIRLLQDLQSDFTGEANVLPADSRSLGELFTKGIIDPKLSQKLIQLYATFLV

SEQ ID NO: 39024 - protein, 478 aa, A.fumigatus
TYTETFSLITHFLFFSSRAPDNTKPCSLTGESESRPRAIELEDTEDMRSQGNMSDRLGVEVDCHSLGSNECPSMGSSFSPLESPTPTPTSIYSQGSLASPSWPENGSYPGHAYDRGTGSTPIRGHFRLASMPSHENMGLPPYSSLDGQDRMAVTDFLPSYDENADQFWLPSDVPKTYDHHVHGLPCPPSMHQYPPMLRSNYRHHPAPYFPESATNPCLSRPIFHHQPERLPPSLSMSHMMPWMGHTESIAPETIAPSQVAPVTPPPSYTDFSNSINTFKTHSPDTPIRSCSLGTVSGADTPLSRLSGGAGEYIDECHQSPIYRDASGVRLQRQPSRKMARKQPSKQSLSLENLPSIIKQVQFKCKEPGCKGRFKRQEHLKRHMKSHSKEKPHVCWVPGCHRAFSRSDNLNAHYTKTHSKRGGRNRYVATLDETSPDYNPDYRGPLTADGRPMPGGTLDESMPSREIFHHGVRSIRACV

SEQ ID NO: 39025 - protein, 62 aa, A.fumigatus
RRRPLSSFFIKSTSAATRLDNSLIHPFLSILLRYLHRASSSSCNIVNKGLYSNNFPLSSYIL

SEQ ID NO: 39026 - protein, 66 aa, A.fumigatus
PTYRLIIPPFYIKVSSSLIGMASSGFYYPLASFIKYLTSYYLSRSYYYSSFTSSIALLDLVIKYLR

SEQ ID NO: 39027 - protein, 227 aa, A.fumigatus
HGLLQVLIQHRASDESLRFVEEVFSSFGSKYVYLTGEMHDRITADTQAVTHAAFLSMGTAWQANNQFPWEMSRWVGGIENVKINITLRIYSNKWHVYAGLAILNPAAKEQIRTYAQSVTELYKLMIGGQREELKRRVKAAGAAVFKDGTEGQELLLKDEVLDRFSLSNRPREYHPPNNHLSLLAIVDCWSKLGIVPYDHMICSTPVSDANTAAALLTSLHVELLIAL

SEQ ID NO: 39028 - protein, 397 aa, A.fumigatus
VIRTLPLATRWRPMASGYNSGFSGTSIQHRDLGDGRSYASQEDGSANGSWAETASRPGRNGRSQSGNSANIRPRGGSGGSLAPSIGGPGSFSSELKSMTTSRSVTPRPDGAYRRRGSSNVELDELSSTEERQAAIRDKIAKEMKIKTGTENMLEALLAKDPKHTKDQRLRVESELSSSNRKLAELHHELEEELLRAQAPSTPPRNRFSMSFFRGSPRRSPSRNNDLTLDDDRLEEAEAEMESPTYVLGETLQALEIEGMAPDYYVERANSLVELFRRHPTLKYDLAWSVFGLRVQVMLLSDSKEVVAAGYRLTRYAIADRKSLQIIRSLHTDELVILSLVKESKASIEREQALKFVRAFLDVKDGVHEISRAVVRTIVSIPGTPEDRLRNLSTMTLR

SEQ ID NO: 39029 - protein, 152 aa, A.fumigatus
YPARVPPNLSFEVDDFESDWEYSKPFDFIHARDLQGSVSDYNRLVAQAFANLAPGGWFEFADADLLVCCDDETIKEAKNMLEVNRLVCDASARFGKLMGTAKQHKQRLEDAGLVNVREEIYKVGSSDYSCSFKVVTNRRHRSHSHPGQRTPS

SEQ ID NO: 39030 - protein, 134 aa, A.fumigatus
RSAVIFKGSESALTRDRPLKAKTGESVRIFFGNAGPNLTSSFHVIGSHFQHVFRDGGVVDPPARVLSTVGVPPGGAAIVDLKMIVPGTYTLVDHAIFRMDKGAVGYLNVAGAPRPDILYSQMPPEPCVGCKLHP

SEQ ID NO: 39031 - protein, 166 aa, A.fumigatus
PLRGSLAPPWMKTRLGPNHHKIPVNQCPMTFNPTLRDGTGTFDANYGSLPGYVSESQGVNFARPQEHDPQFNAWVSQLSSRPWMQTNENDYKFPRDFYNALPEFRSQEFQDKMVENIIASVAQTRKEIREKVYHTFHLVDPELSARVKRGVEKMDASFKQVSLSRL

SEQ ID NO: 39032 - protein, 146 aa, A.fumigatus
LRSLVLMRRYAMDDLTLADGNKIPKGTVLGIPIFGMRDPKIYVDPDMYDGYRFQKMRDKPGFENKCQLVSTSPWHLGFGHGIHACPGRFLAAVQVKIILCYIVAKYDFKLAGGAPPKVQSVGIELISDTEARLAVRRRQEMVIGLE

SEQ ID NO: 39033 - protein, 75 aa, A.fumigatus
LSQYNSVPLVNYASFVNIILSTEFFAQLLPNEAIGSTGKVSQAYCPLHSDVSSAVGEKCVKVLQIWQNPYNATHV

SEQ ID NO: 39034 - protein, 232 aa, A.fumigatus
LMRSEWHEVTAKSSVHDIIAHLSALLFYGPELCSHKEWLEVTDEYASVGFLAARQLRLWPPILRPIAQWFLPACRRLRYLASRTRGLIEPVIAARQKEKAICYSHGRQPPVYDDAIEWTERAAKGRPYDAAMSPLLFSINALHTTTDLLTQVILDLSTQPDLIVALRQEILSVKPQQNGWKNASLNQLLLMDSAIKESQRLKPTESSMHVVIYNFSFSLPNTVLRYHTNCGH

SEQ ID NO: 39035 - protein, 307 aa, A.fumigatus
VISEPHMARQLVLQRDGGIRPYSISHIVHSLISFRRSKPRPVLRFQANFLADGLMLCMGYNHSVFDGTGAGNILEMLADCCRANPNSILALPTNGDIESELRGLLSSPGVAVANASQEAYAINCAHTEVEPEPSSAMLYCWPFLLSSEKIECLQEACNSLLPHIVRLYSGTQSSLINQDTNWPHILSSNDVLTALLAVSIEKAREATGALGHMSRSLAMAVNLRERLKPMPRHYLGNLVTTVWVSHHRPAVKDLETMVLPVPACNRHEIDRDDLLWITHVAFRIRLGLNAINEEHIRGAHSLSAQSG

SEQ ID NO: 39036 - protein, 124 aa, A.fumigatus
TQIGKTSSLVMTLCGVLKDILLVAASMMIWQTPVTPLQFFGYSIALIGLVYYKLGGDKIREYAGQANRSWAEYGANHPAQRKSIIIGAVVLIFFLLIGSMAPSYAPESVDKVKGMLGGATAGNA

SEQ ID NO: 39037 - protein, 94 aa, A.fumigatus
SHSLDLCFYFSSSFTASPLASARFGQSSLLRPRPFDFKQFLSDQSQLFTMSNEGEKARVSGEVSRPEPTLPTVNPAVEKSEPSKPTFHPAVYVR

SEQ ID NO: 39038 - protein, 96 aa, A.fumigatus
HFPAIILTTWHLAFATFMTQVLARTTTLLDGRKTVKMTGRVYLRAIVPIGLFFSLSLICGNVTYLYLSVAFIQMLKVCFCSDQLAILLAIIADDGT

SEQ ID NO: 39039 - protein, 138 aa, A.fumigatus
ATTPVAVLLATWAMGMAPVNLKVLFNVAVIVIGVVIASFGEIKFVFIGFLFQIGGIVFEATRLVMVQRLLSSAEFKMDPLVSLYYFAPVCAVMNGVTALFVEVPNLTMGHIYNVGVWTLLANAVVAFLLNVSVVFLVR

SEQ ID NO: 39040 - protein, 415 aa, A.fumigatus
LEFYSSLNRTERNSFGFRIHPLNHLRKSLAMCPMLLSGLADGPAMVLSPRQEHAFVQFPRQSQLDSASAASHNSFFRNGVHSQASNNVFSAPKLANTAASSSRISRKRSRDEAESEEALSASSAPAVAAPAPKEEPIYGEGMTLINPRTGMSLSAESQTGTWYEEQLENAAATAAPVSSRSLASSSELHSRKSQRLDPSASRVDDITLAHIQRRLHKTTAEDNHRLLNAGARTNPLTPNEPQVDDATHLLGISWQRISTDDVDMAAAVRGWKKYIDKQFAAYLLDSQILMKNRALNAYLVTARPITPAGPAIAPAFYLFSEDLSQAQLVASSWEQCVHNLRSVPVIFEQNQVLSAADRQCNNNSSGPGVLGLDTTTEPGLPLLQMMCAQPVGSDMRAAGLHNSDGMSSHECQIRI

SEQ ID NO: 39041 - protein, 90 aa, A.fumigatus
PTTKRLSMRSKPPKNPSWPHSPSPMTPPSEAPSTQPSLSPPPQQKTHPPYLLVWPCSSTTTRHGDRLRESTLRTFTCSPAPEARDMGSSF

SEQ ID NO: 39042 - protein, 159 aa, A.fumigatus
QGLQVGFYFAFLQSYFRFLMFPAAFGFSCWLLLGSFSIIYTVVNCLWCIVFIEYWKRQEEDLSCRWQTKGVSAVHEKRAEFKPEKEIRDESTGEVRGVFPATKRMHRQLLQVPFALLAAVALGAIIATCFAIEIFISEVYNGPLKGYLVSVAPSILQNS

SEQ ID NO: 39043 - protein, 167 aa, A.fumigatus
LMIQVFIPTILVSALIPTMSAVLLTVATKLNDYENYETQDAYKVALTQKIFVVNFITSYLPIILTAFVYVPFASRIVPYLDVFHLTVRPFVSKEHATKARTEFSINPDRLRKQVIYFTVTAQIVGFALETIVPFVKQRVFREYKEYTKKQHAKAEPGFLHRGRTSAY

SEQ ID NO: 39044 - protein, 575 aa, A.fumigatus
TKKVGKKRGHHFDRLSSKLKGEEGLKGEIESLRDDLLHLGQDHVEAKDKIKELNVEKKALEETVSKLEKELADIRTSHASKSADSEKMHSDLKEDYENLKVKLTNLETELSAAQQLAATRFKDLTELRETLQKLQPELKSLRVESSELKSTKEALASKESELRTLEGKHEELRAEVKTLKSTISERDAEVKTLNQKIRQETDSRLKAEENLTVAQSDLRYSESKKQEAVETKEKIAADLSRAQDELKTARSQLREVENKVTQLNKELDGLREEIQLKTAQHASAQSLMNSMRDQSAELAMQMKEARERCESLEEELADAHRLLSERTREGETMRRLLSDIEGRAEAKVRDFKERMEAAIEERDRAEDEASAQGRRRARELEELKTKVREAEKALRTAEEDKEELERSQKDWKRRRDQLEEQSERSAQELNDIRQAMARLRDALDESEKQVRDLEKEKAELRRSVEETNSRLEKLRRSYRILSDETRAVQNPQSSRSSIDSGARKAVASPVSKDRSPSTRRSETPTGAPIDYIYLKNVLLQFLEQKDKNYQKQLIPVLGMLLHFDRSVTYFLNYPN

SEQ ID NO: 39045 - protein, 213 aa, A.fumigatus
RTLDLTMSGEATIRLATPEGKFTPHSLQCFSARVGHRCEKVSRPLLTPCEIADVPYILQFIRELADYEKALHEVEATEESLLATLSFPNDTPKRGSVYTALVIPPATAENPSPVPVGMALFFYNYSTWRSAPGIYLEDLYVQPSARGKGYGFKLLKYLAAKVLEVKGRRLEWSVLKWNEPSIKFYKQVGAQAMEEWMKMMVEGPALNKLAEGL

SEQ ID NO: 39046 - protein, 73 aa, A.fumigatus
WRWPISITSPSSNLEIPYNRVKRYAKNKHSLIPLYAYIIATTLSSKIFELSHRSCNIRPLDRTAVVKCTFVLE

SEQ ID NO: 39047 - protein, 433 aa, A.fumigatus
  UNSURE (279),(421): Identity of amino acid sequences at the above locations are unknown.
RFELDEPLIEQELVDPPQIVSGPIHTDPSTTSASDSIAPTYDVPRRTTQLVKIKTCSGKTHTVTQRTYKPRVSYERLVASRSTTGLGRAQKSYYGINIHQILDEVARETEQAKASTKALDRTIQHSVEAPLEGQRNKKMAAAMWTEKYRARKFTELIGDERIHRSVLRWLKGWEPIVFPNLAKSRIKKPGNNNDDGERLHRKVLLLCGPPGLGKTTLAHVCAKQAGYEVLEINASDDRSKDVVKGRIRDALGTENVKGVNVEVGDRKVRKAGRPVCVVXDEVDGVVSGSGSGGKGSFMKALIDLVLLDQKNMARSADQNAKNGKKRKGDTFRFLRPLILVCNDVYHPSLRPLKTSSEVEIIHVRQAPFENVVSRLKSILALEGIPSDTNGVRRLCEASWGLARKKSGWLKSSGNGRKVISXVCWSLRSGWRIS

SEQ ID NO: 39048 - protein, 60 aa, A.fumigatus
FRGHVHDTLNHLVYGSTQRILVRKSVCICSYSEDSRALFFDATIRLLNHLIASNLIGLPR

SEQ ID NO: 39049 - protein, 236 aa, A.fumigatus
YSPELSFCSSCANYKMSLKPIVLWSHVMGPNPLKVVFILEQLGIPYEQKYLATDQVKKEPFVNINPNGRVPAIEDPNTGITLWESGAILEYLVETYDKQNTISFPTGSPEYFQAKQWLHFQMSGQGPYFGQAVWFTIYHPEKVDSAKERYYNEIRRVCGVLNKYLQNREYLVGDKFSYVDAAFVPWFRIIPAITGDAIELGKDFPNLDAWLKRLHALPAISKAFKIQEAAKAAQEK

SEQ ID NO: 39050 - protein, 112 aa, A.fumigatus
RPPQTEQNILRTPVFKILSEHQVKITSKTSLSHQSSLKVNMPFRTTMSSNTSSSDAASTRSVSSKASTLEGIQNMHKKFLVTKQKAYINANSSPCFAAAEHNAAVASYLALR

SEQ ID NO: 39051 - protein, 89 aa, A.fumigatus
IQWPMRNLFSLAAQQKHIANKKCLRFHTISPAPMPATFTLNSNFFKYHPQACHDSNCGLNKCPFTVFANTGHTLLLPTPTHHNWSHIRR

SEQ ID NO: 39052 - protein, 75 aa, A.fumigatus
  UNSURE (27): Identity of amino acid sequences at the above locations are unknown.
NEVNQGLHEASFSTAPRPANDSIDFVXYDAHWSPSLSHFAISHLHIHSFHIFSAKGISNPPLDNVFAAVITGVDL

SEQ ID NO: 39053 - protein, 229 aa, A.fumigatus
  UNSURE (221),(222),(223),(224): Identity of amino acid sequences at the above locations are unknown.
ASSTALTLPLLASTAARPRYYPRPRSKMNSFNSWIKALSHTSRSCQGRVISQHVMHPFSTTMSPSSSAKEKTREIERQILNPNSEQTTDDNSPLSAITRMMQGEKARASQAVSRDYSRMAESLEAEMIKYPYADRSPPHHLHVYAHKHNTLLTLTQPNGNPMLSMSCGHLGFRKGGRSGYDPAYQLTSHVFGQIQERGFLMDIKRLEIVSSPGVQGRSVVXXXXSKGLQ

SEQ ID NO: 39054 - protein, 333 aa, A.fumigatus
APTESQKRLALAIIDFLNSSLKDGTLTADDAESIEIAQSCIADTFKVDPSDEAAVKDALGGQSLASIFSVYEKLRQKPSKEPASAGAQAQSTEAQQPKAGAPTPESDKLKSEGNAAMARKEYSKAIDLYTQALSIAPANPIYLSNRAAAYSASGQHEKAAEDAELATVVDPKYSKAWSRLGLARFDMADYKGAKEAYEKGIEAEGNGGSDAMKRGLETTKRKIEEANRGAEPPADDVDDAAGASRGAGGMPDLSSLASMLGGRGGGGGGMPDLSSIMSNPMFASMAQNLMSNPDMLNNLMNNPQLRQMAENFGRGGGMPDMSSLMSDPSLAEM

SEQ ID NO: 39055 - protein, 292 aa, A.fumigatus
SMISASKMSAVARAATLRSHVPGLRTTYSNAIASSRTLIHKSAYSTSIPTSPTVLQRQQTSFPTGVQLISPYTALPLTRSFHIATARWQQQQKEKHSEEPKSEKSEEAKSEGGKEEGQKEAPPPPPPHGDKTPWQVFRETLQAEFKASKEWNESTKALASSAQEFAENENIKRARAAYEAASGAATSKTSAALKKTGQAIGKGAAWTWETPVVKGIRKGVSATGAGLEKATRPVRETEAYKNVKEAIDDGSSSRYGGWIEKEERRRQRQLREQKEMMKSGRRSTEPLVEDPK

SEQ ID NO: 39056 - protein, 173 aa, A.fumigatus
IETRRNRRSCFSCDSSFGLLIHFFNIFSIPFFYYYYLSTFVLSTDFMDLVYQSFLAFMVFAEAIAVSKGSADGLLLIARTPLILACLHNGQYPFFFPITMGVYGVELYDLRQTTPLRTFSCIGIWNHTQPSSRFCCFLVRATWTYILNIDTTMHWWLLGMLCQGKPLSNQGQI

SEQ ID NO: 39057 - protein, 259 aa, A.fumigatus
RAGAVRPSRWLKIQSKCCFHMELFLFRTLTIAWRSAGTNLTIHKDSAWKESWREFKESNPMMQKLFALKETYNESENPLISTARSISDRVASFFAENETAQVIKKFREMDPNFQMESFLREMREYILPEVLDAYVKGDIETLKLWLSDAQFHVYAALSKQYTTAGLKSDGRILDIRGVDVSHARMLEPGEIPVFVVTCRTQEVHVYRNVKTGELAAGMEDKVQLVTYAIGLTRIPEDVNNPETRGWRLIELQKAARDYI

SEQ ID NO: 39058 - protein, 108 aa, A.fumigatus
  UNSURE (5): Identity of amino acid sequences at the above locations are unknown.
IGQEXYRAPEILFEPELIGLEYPGVHQIVQDAITRTDLDLRKSLYLNIVLSGGSTLCKNFPDRLMREIKRLAVEDMKIRISAPAERKYTTWIGGGILAGLSTFRKVRL

SEQ ID NO: 39059 - protein, 84 aa, A.fumigatus
VKEESGGLVISQRKVWNIFIWPLNSTGFFLISDIECLLGSGIFSSVTDGIPFIVVPNPSLQDNHQEELARQLQKQGYVVASHYQ

SEQ ID NO: 39060 - protein, 310 aa, A.fumigatus
  UNSURE (289),(303): Identity of amino acid sequences at the above locations are unknown.
NLSQPPVLRVTTSKNRPEGHCHHNSCRVSPTDFLPKHNPSPHRMAEATLHNAPIVIDNGSGTIRAGFAGEEIPSCFFPSFVGRPKHPRVMAGGLQGDVFIGQRAQELRGLLKIRYPLEHGIVTDWDDMEKIWHYVYENELKTLPEEHPVLLTEPPLNPRKNRDIAAQIMFETFNVPALYTSIQAVLSLYASGRTTGVVLDSGDGVSHAVPVFEGFAIPNSIRRIDVAGRDVTEQLQLLLRKNGHVLHTSAEKEVVRMIKEKVCYVSLDPKREEKDWMNSYHKSETKAVXYVLRDGHKIKVSLXTFMGRPS

SEQ ID NO: 39061 - protein, 91 aa, A.fumigatus
GGAEARYLPAAGREDGLASSGSLIAGINYANQVRENLHKSGNGTDTSSQDTSIASLGFGMIQVAIGITVGLFIAALVVYPFGKRRSGLFSF

SEQ ID NO: 39062 - protein, 376 aa, A.fumigatus
PFTVRPSSPVSHLCIHVSFPPFLIDFLGVSPNANQDELNKAYRKKSRLLHPDKVKRSFIANRSKDKGKAKTTKQGVHVSKGPSQREIAAAVKEAHERAARLNTVANILRGPSRERYDHFLKNGFPKWKGTGYYYSRYRPGLGSVLAGLFLVFGGGAHYAALVLSWKRQREFVDRYIRQARRAAWGDELGIRGIPGVDSTSTAVPPPPPEQGEATAIPMNRRQKRMMERENRKESKKGSKASPRGSGTATPTTESVQPTGERKRVIAENGKVLIVDSVGNVFLEEETEDGDRQEYLLDVDEIQRPTIRDTMMFRVPIWLYQQTVGKLTGASTTGEHEVDAEEESAEATEQEVQDSSSSALRTNGGASRRRGKRSQRS

SEQ ID NO: 39063 - protein, 80 aa, A.fumigatus
GESSLDFYLILCSGHCGIDRFPSVPIMKPLTLRLFVFAVLVVLAAAWTKEGLSSYSSPLYRHGFPWEQKNCRINANLLRL

SEQ ID NO: 39064 - protein, 94 aa, A.fumigatus
PELRPRESTKWTLKKNLQRPRSRRSRIAAVLLSGPMAARLDGEGNGHKGPKSVCPQDGRAIVKVKPWLILLFLKHYRREIIVYMYINFRRKKKK

SEQ ID NO: 39065 - protein, 412 aa, A.fumigatus
ANRECFFRGGGLGGRPRAPYGMPRWGRPPGARVGRSSGRQAAQWMDINNVRIQEIDCGAEEEYLLRPGRALYAAEQRRNGWPRRNEDYDASAGDVHSVDGIDLDLDDDSDSTVAYAVQLAMKDDEEWLVDKALERIRRAQLLGQKNVRLSQRELDALERKRMQTSGMEDVGQRNKVPKAASVASRPLRPVESSTNGGLGNLWTMRHGSSAPNGSIPRTFVADKKEMYESRARASGASARDDSPVLPRTSTVPNLQPRMSGPPTYSSVPRDSRSEVPLTYPSPRPPATFQNPPYARILPHGPQWVPSYQASYALATVPAGSQSHPGHMAYPATPASVLGDRHPLSRQHVSLNSTRGDLSSAADEEEDSESDNDGDRIHIVDVVRRKVPIGLQRRPSAAGGAGARAVHPRSRRS

SEQ ID NO: 39066 - protein, 307 aa, A.fumigatus
GKPRVLDPLSILNLQGFSLVHSKSWTAVTKSAKVVKAKSPLCLLQRRNQNYDPNGARLKVPMIFLSPGFLISSGQIDLSTLPSLTTPFYEVLLCSLTRFTATSCLLILFNFSWPSVTTSEFISIHKSSYNQFTMSPIQFPIDAIASRFGDRFNSVRAQSLTSRFSNLRPISEFLDVKRLSKPANFGEVQSRVNYNLAYFSSNYAAVFVMLSIYSLLTNLSLLLVILLVAGGLYGIGKLQGRDLDLGFARFTTSQLYTGLLIVAVPLGLYASPIATALWLIGATGVTVFGHAAFMDKPIENAFSEEAV

SEQ ID NO: 39067 - protein, 75 aa, A.fumigatus
GTDYFSVGYLISAVLICIEYLWLGIFYRSQHRILFASFVIKLAFVIIEVALAIAFGICTRRSSGKKNVGAIFGMG

SEQ ID NO: 39068 - protein, 147 aa, A.fumigatus
KSVRWGQTYILDALMSYVPQDTAEALLLAERVAPRLSHSNSSVVLTSIRVILYLMNYIADERHITSLSKKLSPPLVTLLSKPPEVQYLALRNAILILQKRPEVLRNDIRVFFCNYNDPIYVKVTKLELIFMLTTKENIGIVLAELRE

SEQ ID NO: 39069 - protein, 81 aa, A.fumigatus
SSPRGVVISVITVLVSAGMSVFVAPIRSAVSLTPTIIPPIMASVLISAIIPSISLVSVIAIIPPFPVGPVWRQGRPRPVPM

SEQ ID NO: 39070 - protein, 346 aa, A.fumigatus
RYATEIDVHFVRKAVRAIGKLAIKIESAARQCIDTLLELVNAKIPYIVQEATVVIRNIFRKYPNQYESIISNVIQNIDELDEPEAKAAIIWIIGQYADRIENSDGLLQDYLATFHDETVEVQLALLTATVKLFIQRPTKGQQLVPQVLKWCTEETDDPDLRDRGYMYWRLLSTDPAAAKQVVMGQKPPISAESEKLDSRTLEELCLNVGTLATVYLKPVQQVFRSARTRRLQYSPALQKPQDENGSGAWQFLTGTGPDSGVAANASPTNGSGTGASSMNAAVSAADMYFNNVGSQQMAALDLGGREDGGSGGGGASQTQYVVNQNQQQVYQPQLAGGAATGELLLL

SEQ ID NO: 39071 - protein, 62 aa, A.fumigatus
SNYGILISAPLWLLQPDWIFSLHFGVEEESMPNNQCQKKITVSLIFSQPLRNESKAQGITAA

SEQ ID NO: 39072 - protein, 107 aa, A.fumigatus
FEITFPSMFIAVLPYATSYGSPFSQSSQGKVAELRQELNSGGKKDKNFSAKKIALKKIVANMTMSNNDMVALFPDVIGCMNLPSLEIKKMYVPSEDNGYNAQARTDD

SEQ ID NO: 39073 - protein, 128 aa, A.fumigatus
ANIASQDMDDSNPLVRALALRTISYVHVREFVEATVQPLKRLMGDIDPYVRKTAAFCVSKLYEHDKKMVEGSDLIDRLNRMLKDENPTVVSSVLASLTDIWGRSESISLTIDYASASKLVSILPDCSE

SEQ ID NO: 39074 - protein, 462 aa, A.fumigatus
RSKYLHFHSLNHPFCITLTHQHIRSWHPSLLRNQERVWAEEKRALEERKRIEQLRREREEERQIQELQRLQEASGKGRQLNRVDWMYQAPSSATGHYAEEMEGYLLGKRRIDGILLKNDESKKLEKGTDVVGANAAPPPVNNPRDTMAKVMADPLLEIKKREQAAYENMVKESVRRSQHIRDKDRDRDRERRRDRGDRDRSRDRDRSHRRSRHEDEDAHRSHRHRSHRHRSRSPLSPDRSDRKRGDDRDYRDERDRRDDRRDEHRGHDRRDDRRSERDRRADRGDEDRHSSRYKDRDDRYDHSTRRRSYADRSPSPRRGNHYYDRRRTEDRSDGYHRDSRNHDRPEFYRGNDRKVNKEPRDSNLRERSSNTRDEVAGNKEKVLEEERKKKLAEMMSNADELEQKRLQRIAEVTAMEEKEREADEKQRSERGRFVGQLHRQLQEDSLDDRIRRSRGGLERMED

SEQ ID NO: 39075 - protein, 186 aa, A.fumigatus
YDARNPSDVSLEQRHEPPPLQPRQDQLEKAHAQFGTRISDAVNTIQNTTVSDGTPFGLVQHLLSPLKDALLPVGTRAYGALVYANLANASVQQNDEIRAGDIVTFRNARFQGHRGTMHQKYNAEVGKPDHVGIVVDWDGTKKKIRAWEQGRESKKVKVESFKLNDLRSGECKVWRVMPRSWVGWES

SEQ ID NO: 39076 - protein, 551 aa, A.fumigatus
  UNSURE (521),(542): Identity of amino acid sequences at the above locations are unknown.
WLESSISHIKCSCYSNLVSICHRCCQLSPDLDSNKPQRLYVRNASPNVGIRQNFPSNAAMGTFRFGRLRSLLLATGAIFLISTFYLYWTPAPASVVPSSAFEVPLTERQIALWKALKSILEKNAPNCPSPVARADAHAVHFNATSTDARPDLTLLKDDDRKAMEEAHANYIRDIRVSEKLRSPHTAGTRGLVSTAGGSYLPVFLSSLRMLRRTGSALPVELFMKDATEYEKKICDGVLPDLGAKCVVLSEIVGKTPIAHYQLKAFAILFSSFEEIIWMDADCFPLHKPEELFDSEPFKTNGLVTWPDFWASTASPAYFELSRQPIPPVSARQSSETGVFMVSKEAHLTTLLLAAYYNYYGPSHYFRLLSQGAPGEGDKETFLQAATALGEPFYAVSERVQALGHWKPDGEGLSGSAMAQADPVEDYALTSQDKRRVIDPSVAKAPRVFFIHAHYPKFNPAENVFGTKWDTTPTLKADGSEGRAWTAPEDVVSRFGYDVERNYWEEIKWVSCDPKTQFQTWXNKNEVCQKSQKLLAKKCSPEXHEGRSKVYR

SEQ ID NO: 39077 - protein, 242 aa, A.fumigatus
PTVIAMTSVDPRYEQLFLEIESRFRSTALPADKWYILAIATIVASSDPERADQLYLHLINQPGHESPSARQALVKRLREALFKSVIIVGVCKPIEAILAISKVERDEDKEYTCTRENWQCDAANHERGMNWFGKLYARNASNTLDLFNGHKDFAWLSMEITYGLFLSDRQVLDDVDTQMVVLPAIMSQNLRTETHWHIRGTRRLGLSREEVQVVWDCVQLVAGFFGVTLDKVPTVEEVEADV

SEQ ID NO: 39078 - protein, 61 aa, A.fumigatus
NPPAKTEWENPQTQYRALREPSHSHRALTFRKLPMQGIAVSTHNNGSTWAFGPNYLLPTIR

SEQ ID NO: 39079 - protein, 67 aa, A.fumigatus
SQRLDHMTSHRPASGIKPYQSLTMTTHSYFNELKYNPLIDLTQPLTLSSILNLKRYYQNAHRNPKIW

SEQ ID NO: 39080 - protein, 62 aa, A.fumigatus
GLSGIAIIWSTIPRGCPFFRFSAGLEKSSQDFSQPKIASIILFPFNNKYTVMAVARMKDLHF

SEQ ID NO: 39081 - protein, 84 aa, A.fumigatus
EQLFVARVDRCHCDYCGSINGLNIDVSIEKDDSISEWAVVIMQVCIADAHLKPHTPNSVLQMMHPMHSYYDNALTQLKSEILTV

SEQ ID NO: 39082 - protein, 94 aa, A.fumigatus
LTSRNLLPSLQSSISKDITKMPTGTQKSGSSYAGGGQSSVGQPSVYEAGDQRNEPQSVINERERYHEGQKGSHKNLDSSTSLPSDNQLGLVPGS

SEQ ID NO: 39083 - protein, 85 aa, A.fumigatus
PRNGTTKELCTYAINVHIVYLKYGSPPYMGDAPLMDKSRVCAFNYGRIPHLLIATPKPRKTLSPFHKTRGRLLSACPARLRSCIP

SEQ ID NO: 39084 - protein, 114 aa, A.fumigatus
SFLKSQHRANPLQGVSNDGQKASIAGSIAAAHYIRSIAPSYGIPVVLHTDHCAKKLLPWLDGMLDEDERYFKQHGEPLFSSHMIDLSEEPVDYNIETTAKYLHHETPDPRIPRK

SEQ ID NO: 39085 - protein, 233 aa, A.fumigatus
  UNSURE (80),(84): Identity of amino acid sequences at the above locations are unknown.
ASFPSPRDRRVLDQKIQLTRHAMVTDLENLPEGVSFLPSDFAPKRKIARHMRITIFPKIIAIHFSRSIFDRSSSTKNAAXVSFXERLPLGGILSQKWFKLLAIVCHKGSHNSGHYESFRRNNLYPPFSTPDTFSSYAQSRATQRQSLYCTESSSRGSRGRRARTLPNQPLFLDIITIPVGQFASLPSSFSDCVGEGLLTTCISAECASLAVCSAHHIQLPCILSEYPHQIVRF

SEQ ID NO: 39086 - protein, 95 aa, A.fumigatus
KVLLFRDLSTYLSLLPSRSLSSSSISSNSIPSRHSSRIQTIVTMGILDKLSRKSGVIVGDDVLRLFEYAQEKNFAIPAVVSLLILLIACAIRRGA

SEQ ID NO: 39087 - protein, 238 aa, A.fumigatus
ARSGSSCWPLSATKAVITAATTNLSDVTTSIHLSLLRIPLVPTRKVGQPSVNPSTAPSPRLAARGVAEPEPSPISLSSSTSLPSLSGSSLPSPARSQTVSVRDSSQPASQLNAPPSPSARPTTSSSRVSFQSIRTKSSGSKQNLSPPGSETPSPASDSGAWSKSGSRPSFMSERTTSKTPPEAPALSSSRLRRRKKTNDRWWRISDEKIKECKTSDVLGMQKEVYLLFYEMEKGSFGA

SEQ ID NO: 39088 - protein, 82 aa, A.fumigatus
IRLHSAYHYFRDVSICSYRSPRCAHWGPFKMSDASNNVRFRLLDKSPESGRFIGKKSHDHASYVTYLATVSHRIMSKRKDYR

SEQ ID NO: 39089 - protein, 336 aa, A.fumigatus
CTRPFTIFRWKADRTARTKRTTICLTCARLKNCCQCCMLDLSFGLPIVVRDAALKMVAPGPESSINREYYAQEHEKEIQEGRGAVEAYEKTDEKARELLRRLANSEPYYRKPRQQLEGPSDDSTEAQPTDAPVVQSRYGNGPGPIRTSESRRGTPLPGRGRGNMRGGRAGRPFPGTAQIPPSPEDYLPPADPNIMSLFVTGVEDDLPEHTLRTFFTQFGQLRSLICSHRAHCAFINFATREGAEAAAQHCKGKAVIQGCPLRVRWGKPKPLDNMDREERMKNAREGRLTVQAQKDGESGQRAITAAGEPATEKPQSFVVAPPPGSGDVQYSSLSGD

SEQ ID NO: 39090 - protein, 309 aa, A.fumigatus
PLQAQDHYAVLGLSKYRWRATPEQIKRAHRKKVLRHHPDKKAALGDRDENDNFFKCIQKAHELLTDPVKRRQFDSVDEAADVDPPSKKEVAKRGFYKAWGPVFEAEARFSKVQPVPQLGDENSTQEEVETFYNFWYNFDSWRSFEYLDEDVPDDNENRDQKRHIEKKNANARRKRKTEDIARLRHLVDDCLAQDERIKKFRQQARAGKDKKRLEKEAEAKRLAEEKEKARLEEEQRKKEAEEAAKAEREKNKKAKEAAKNAAKKNKRILKGSVKDVNYFAESGEPSPAQVDSVVFTTGLEGSAVALGIN

SEQ ID NO: 39091 - protein, 62 aa, A.fumigatus
SNMPPPQIKQDLNRSGWESTDFPSVCENCLPDNPYVQMLKEDYGAECKIVGCTSCSVYVNIY

SEQ ID NO: 39092 - protein, 133 aa, A.fumigatus
SCKLTGVQKRHHRTFSEDERIQAQQNVKKTEDDDDDEISEPEDPVMLSRDAKDWKVCSLIVHLTVKIDIDLYRPKITTPFLVCPSTAGVLPPSRSSAPTARRSSAITPTRRPPWETAMRTTTFSSVSRKRTSC

SEQ ID NO: 39093 - protein, 187 aa, A.fumigatus
VTRTAPRRRSRPSTTSGTTLTAGVHSSTWMRMFPMTTRTVTKSVILRRRTPTPAASARPRILPVYATWLTTALLRTRESRSSASRLVPARTRSVSRRRPRQSVWPRRRRRLVSRRSSARRRPKRPLRPSVRRTRRPRKPPRMLLRRTSVFSRALSRMSTTLPSLASLLPLRSTLSSSPRGWKDPRWR

SEQ ID NO: 39094 - protein, 101 aa, A.fumigatus
SVIHPFSTLTTSKSPIAIAMAPVALEQENHLRDAEFNRAMHGKSAQFRGGFAALRGKDSASQKAAVDEYFKHWDNKPAEDETEETRAVSNLSLLPSGILEL

SEQ ID NO: 39095 - protein, 67 aa, A.fumigatus
LQSKKSSIYPSPSTYAKQSVLCRPTYPHTHRYLSQQSSTDAAHATESTLSMCRFPDFPEIEVIATMQ

SEQ ID NO: 39096 - protein, 77 aa, A.fumigatus
LMFNRSLDCFNWGIRRHQQLSVAAHLQTWKAQTLPSTLTRKYSVKKYVWPDTTVYISPERLVQTPYWPSRTRPQAVA

SEQ ID NO: 39097 - protein, 106 aa, A.fumigatus
VSGQVRARLTVQVGSIDALTERGGISKTFVGLILLPIVGNAAEHATAVTVACKDKMDLSIGVAVGSSMQIALLVLPLIIVIGWIMGMCYSSNTLLTVTDWQKDSRI

SEQ ID NO: 39098 - protein, 116 aa, A.fumigatus
  UNSURE (97): Identity of amino acid sequences at the above locations are unknown.
MHHSGRCSIVWKPDTTPTDNNSNAVELIVAIIALVDKEVLIVQTSLIGSMLSNLLLVMGMCFFFGGVNRLEQHFNPVVAQTAASLLALAVASLIIPXAFHAWSGGASIRPQIRKFD

SEQ ID NO: 39099 - protein, 148 aa, A.fumigatus
LVQPEPWESLPCREVRLLAMRRGLSLTNAGTSIILLFVYGCYLFFQLKSHTEIYNRPSPKVEKRRQKVSEGDASRGLAQIGKMTATMGGQNAQQMKIHEEDDEEEQPQLSIWVAVLTLAISTAFVALCAEFMVSLMHHFECPVRSGLD

SEQ ID NO: 39100 - protein, 279 aa, A.fumigatus
GVIPRAFRISSGRRGGRPGLRLIGEGDAPLVWSLISSANGSLLELISIPFNCRISAMGVDGAGRSTSSALKTAILASISKSGWNSSQPRSSRGLYPSPCCRAKAAAVDEPYRPRLCDFSLLRRADGEVVGAGGGGGGGGRRTCCDSSSGLAMGSGSGSGSGSGSGSGSGSGSDSGSGSGSGAGSGAGRLREDEVRLMGVRLILGGSSTSISTYLPPPPGLPGMYLRFFRGGPSLASEFGPLRATFGPFREALPADKRYFDEEYGAILKEVREIAETNRK

SEQ ID NO: 39101 - protein, 97 aa, A.fumigatus
YQPVQPEPTFPPQAEEPLTTLHQSLSLSSTDQMEKMQTATVPVDPGAQSVRHITTNTSEFSAANAYAANTMANGKDFFLELRKQVTALRQGATVPGG

SEQ ID NO: 39102 - protein, 609 aa, A.fumigatus
FGFSAKHRTAWKLYAWYLRLSGEPNGTPFRDALLSYFRLVSAISRTSFRMAPYSSSKYRLSAGRASRKGPKVALKGPNSEASEGPPLKKRRYIPGRPGGGGRYVEIDVDEPPKIKRTPIRRTSSSRSRPAPEPAPEPEPEPESEPEPEPEPEPEPEPEPEPEPIAKPELESQQVLLPPPPPPPPAPTTSPSARLRREKSQSRGRYGSSTAAALALQQGDGYKPREERGWEEFHPDLDIDAKIAVFSAEEVDRPAPSTPIAEILQLNGIDINSSKDPLAELIKLHTSGASPSPIKRKPGRPPRRPEDILNALGITPQPKAIPPPGPNPRERLTLPKPSFRLRDPFVFYDQPGVGQRNYVDRTMASVGYQESDLFVRHERQMIRMTEGAQEDDLDIINPPTSEGEVNASVGRVEYDMDEQDEKWLEDYNAKRREEQLEPIKPAVFEITMTKIEKEWHTLEKRIPKPNPKPPQTQRPRSSSAAAVNGETTAPGEEQDSKCAICDDGDCENSNAIVFCDGCDLAVHQECYGVPFIPEGQWLCRKCQLIGRGSVNCIFCPNTEGAFKQTTSSKWSHLLCAIWIPEVSLGNPSLMEPVTDVGLHHGAGRIRGGAM

SEQ ID NO: 39103 - protein, 447 aa, A.fumigatus
  UNSURE (4): Identity of amino acid sequences at the above locations are unknown.
GWFXTPWSRSPYSDDTSVAIVEKNDRCRDISTRIHFLENVTADTREYRGIHPILALESHQENLAKLVDKALKHLPPVSEDGEDTSKLLKLSDGSQRRKPDFVSVTRGPGMRANLFTGLDTAKGLSVAWQIPFVGVHHMQAHLLTPRLVSAMDRAQQGPDVTSANPPLTPEFPFLSILVSGGHSMLVESTSITDHTIMASTADIAIGEALDKAAREIIAPSVLNEAKTTMYGKLLEQFAFPNGSADWSNYCAPKTRGEELIKQPSPWGWTLTSPFANTRQLQYSFSFLPSMINKLMGAKKTAGKEVSDEERVALAREAMRVCFEHLGSRTIIALEELQQKARNKGVPDVNTLVISGGVAANRFLMAVLRSFLDVRGFGHVEIVAPPPYLCTDNAAMIGWAGIEMFEAGFSTDLGGRALRKWALDPRAEDGGLLGADGWMIKKGKDTVY

SEQ ID NO: 39104 - protein, 497 aa, A.fumigatus
IMAREQDLLQWSSQFFVAAPQRTPKLPGDKITLPQSALEQLLAAAPLSDVSPQGSLRQYTSTFDPFNPHTFAAESRARAQQLDRQKQLPHPLTFRLVNPNNERAIYAGIREFSAAEGEVGLSGFLRQALDIEDEPFQLQTGEHGTETAHSPDLNNREGSGSVRSTRHSTPTITVHAKQLPKGTYVRLRPLEAGYDPEDWKALLERYLRDNFTTLTIGELLSVSGNRNERFRFLVDKVEPEGDGICVVDTDLEVDIVALTEDQARETLQRRLEKASRAPGTKGGSSIGGVLALGETVTGQVIPGEYVDYELSRWDGEETIEVEVEGIDDAVVYLFASPFSSHQRNRPRLDEHVFADFSSQPSKKLRIRPTNIELDGAEALYLSVHAYSQTEAGAGMASSQTLPLRYSMRVVQSSSAIQREQTAAQLDTHEPGDVQCKNCHQWVPQRTLVLHENFCLRNNVLCPQCGNVFQKRSPEWDNHWHCPHDSSHGNDIPNQRWA

SEQ ID NO: 39105 - protein, 409 aa, A.fumigatus
RHVLSNSLILDHMAPYLSISGLLSLASTCRALRSVVMETPYVFRHLDLSRCRGAQLQRSSADNGRAQALGNEPMDESLTEDEFYSAPLKKIFAKLEHKSLLQDVRTLILDGLPVPADLIADILLNDRFNVNILSIRGCQHLNERKLMQVLQYAVRPTRPAGTPRVKGIYFFTPLNLAQAAARSRYRKWWSSRCAGQTPVEARPSSRQHDQGRETDRQTVWYSPSGKLLTASIEEGWAQTIQKCHGIIAFDAVLCRGPRHDPNAMLVGQDGSQREGRLLGPAIATIALGSRGCDGCHSSPEGPAIWGQSPEETFPLLTPPPFHSSSVVAAKRPSLFPGADHPALIARCADCLTDRWCHRCNKWFCADCLPNPQRVSSNLSPHQTALRASLGTNDSSQVCKLECSYSEPRR

SEQ ID NO: 39106 - protein, 61 aa, A.fumigatus
NKASGYATKPLIPRIRATAQNIPEELYVHQPTAAVVNKYPNRVSIGIRIPTRLVKTKGRKQ

SEQ ID NO: 39107 - protein, 98 aa, A.fumigatus
  UNSURE (38),(72),(82),(98): Identity of amino acid sequences at the above locations are unknown.
GSRISAFELGWYCEVQRKSPWANHEEVLKVGWSKLRWXSQSGHRHEIGYNGFWRQVTGLAENASPTFRADAXDSVKSSIFHXWFADRRDNLLLPSRGX

SEQ ID NO: 39108 - protein, 215 aa, A.fumigatus
YAKAFNELAGWGPLKGDVSFWKSEVEAQGAIPIPIPGIEGDSGISFTIGFRAGLLYPLGLDSDSRPQLSRINDRFVLGGPTDVRGFRLCGLGPHDGADAVGGDVYAAGSANLFLPLPRVGADKPLRLQAFVNGGRLLPLRTLQKEAPTNSTEVKDAMTATISELGNGLPSVAAGIGLVYAHPVARFELNFSLPLVLRKGEEGRKGLQLGIGINFL

SEQ ID NO: 39109 - protein, 145 aa, A.fumigatus
SSSLLYILAAMAQYYPQQQPYGSQASPQNLQFYPSSYTSVSGHTTPSQATYGGFGGPSGSTAQAYPVGGVGSGYGGFGSPAAGVSGRMGEQGGLRTGWLAAFGTEGYEGEPPLLEELGVNFEHIRTKVGNGLSSGLITGKRCVCV

SEQ ID NO: 39110 - protein, 221 aa, A.fumigatus
PENVVFVFKRKKADHFLHSLQTLTVLNPFARIDQHLMDDSDLYGALLYIVLYGTFLLLSGKVFYGYIYGVAFFGTVVLHLILSLMSPALDTASAPNAADPSNYDPHHKPTMSDASSVGHFSATLTFPRSASVLGYCFLPLVLTSLVGILIPMDTLFGYLLTTAAVGWCTYSSSGMFCAVARMRGMRGLVAYPLALFYVVFGIMGIFSSRGSGTLAAKTGAA

SEQ ID NO: 39111 - protein, 85 aa, A.fumigatus
EVGENMLVQPGSIALMRGEWTREQIDNCVIYSFNLNFDRLLAIPSAEFVVYVFAWNHLSSDCFSQGENSANGAAPFGAGSTRSFL

SEQ ID NO: 39112 - protein, 93 aa, A.fumigatus
SEERKRPSNALPNAGHIQGLFTPDGCLGVSECHLPQTGDVAYFSTTRFTVSGFGNFSCRMEVYLSLAILGMAAEAHCAFEARFASAKYPASNW

SEQ ID NO: 39113 - protein, 116 aa, A.fumigatus
TAEGAVTLSKASTTHFFWDVTAVIMLKLMGSLVLLASAAEVIASPAAEPVAPSTTLEKRASCTFSGSNGAAAAMASQKACSTIVLSNVAVPAGTTLDLSDLADGTTVRTPSPTPTP

SEQ ID NO: 39114 - protein, 227 aa, A.fumigatus
VTFEGETTWGYQEWSGPLLKISGKNIKVKGASGATLNPDGARWWDGQGGNGGKTKPKFFAAHDLTSSSSITDLHILNTPVQAVSINGCDGLTITDMTIDNSAGDTQGGHNTDAFDIGSSSNIIISGAKVYNQDDCVAVNSGTDITFTGGLCSGGHGLSIGSVGGRSDNTVENVSFTNSQVTNSDNGTITSPRCLVEGKLLTMKQVSASRPPKGRLAQSRESPTQASP

SEQ ID NO: 39115 - protein, 236 aa, A.fumigatus
ASTMRFAIPLGAACAWAGVALAALQIAEDFSSITLNNDRFKAVWSKSKGSVVDMFLDGQDLLGPQSGSTGIGPYLDCYCVPSGFYTAGATNPRMQYVEGTDSTGTKYAGVILNDTYTPTGQQFQQYWFLRDGETGLHMFSRLAYYNETTPFLRNLQEFRTLFRPNTQLWTHLTSSELQTAPLPSKNAVSKQVVVQDATWRFNNTPDDAYYTQFSEYFTKYTFSNRKSHSLMWCDLA

SEQ ID NO: 39116 - protein, 65 aa, A.fumigatus
  UNSURE (13): Identity of amino acid sequences at the above locations are unknown.
QPLGLVFAPSGQXSLGQVSELAYWMQESYLKESSPGLFLQQWTPEYDFLTRGLTGATFDNPFGTA

SEQ ID NO: 39117 - protein, 406 aa, A.fumigatus
GPLHSDLTVDGIVYNYIVSNHHGECTPNITNGFDRTFGPQFYLFNGGKGSTSSLHDLRSEAAKLADPSWNAEFYDSIAKHVVGYVPSSKRGSVDGRIKLPKGASNPIAILTVDGQYFQDNSVVPSSYQYWTDIDTSGRFRIDRVVEGKYRLTVYADGIFGDFVRDGVTVRAGKTTTVKEKWDAESAGKEIWRLGTPDKSSGEFRHGVARDPTHPLHPPEYLIYWGAYDWQSDFPKGIDYTIGSSDPATDFNTVHWSVFGPTPDNPNVEYNTTHDWKINFSLTKKQLRNSKKATLTIQLAGAKTASGNTDEYKASEPYINLIHESYINDQKEPLSFVIGFNQSSSCIVRSAVSCYQVRSRMEFPADWLKVGENTLTLHLPYNATDTETAILPATVYVQYDALRLELD

SEQ ID NO: 39118 - protein, 93 aa, A.fumigatus
KMTVIKLTLPRYGILIEQNYDGGDLKGDPTSGIPITDLTMQNISGKGAVASSGYNIAIVCGSGACSNWTWKSVEVTGGKTYGSCKNVPSVAQC

SEQ ID NO: 39119 - protein, 257 aa, A.fumigatus
NVCQGHRGHGLDPVLCCNIGKRFTHSDLSLGLVLRSISTEHAAEAFTFLLSLLHLLPGLEFSTAEDIPWRQSHAEMASHGQNLSLKVTQHDIPAALIDAKGCLANSGRVCIGCGNNPRRRVRDSQVQDFPLLDEDMQAVHNLLNGCGVIPPVQIEDINPVCLQLFERIANTHMQAPPVISTVVRRKTLFLEGMCLVIRSVLGCKDNLVTVFPSRHPFSNPCFRLLVLVCVCGVDKVASGCNVGVKECEYLLLVHASP

SEQ ID NO: 39120 - protein, 418 aa, A.fumigatus
SNLTVHESLIMTPPSSHGYGRFRLDSARGKPRKTVQTGRRSHQKSRTGCRTCKKDRLKCDETHPTCPRCSQRKRMCEYDGIHRYYSESSTACSPVVASQGGLSLEHSLMDGLINQSFTHSLSITNTTHLMHNLVGSVHTSLATPIGKFLFDHYILPHCAATPRLLHSLLALSARHLQHLQPRCLSHTTAHYFHASHAAELLNDELGRVASSPQNLGMIYATCIVLNMGCFASDDYHPSSSWVFQDTAEIDQSFTWFTLQSGLGYVSSMLKNQVHQTFWRLKAGSRGSSIGNLLTWATKDPSHTGSLEKIPDFLLDLCEITPDSSPENNPYYIPICLLSHTLPLKKPVAQEFDHLLIFGPLIPHSFRILLRDRDERALVLFLIWLRLLGRGDFWWVNTRVEAESRALSWHFFVTAKMER

SEQ ID NO: 39121 - protein, 97 aa, A.fumigatus
IRFSYCPASHKYNHRFRSCPPFRHTVQLPKALNQSLYFLCNMDFQTPEPPTELGRYRILSSNCGLRVSPLQLGAMSIGEAWSSFMGTHEQGAGIRTP

SEQ ID NO: 39122 - protein, 81 aa, A.fumigatus
VNDIRLYSCALYQTTVELDMIPYKTHSPSLWDIVKVHIAYALHFTSCTINQATERRESGHVIRTSQIQSQNIVAGLALIPG

SEQ ID NO: 39123 - protein, 114 aa, A.fumigatus
  UNSURE (39),(63),(91): Identity of amino acid sequences at the above locations are unknown.
RGGASPRGTGFGCSKPAWPKKVHRKTVPRPGCEAGRMCXGQFSSPISHIRVDRLTSRSTLGDXARGSISNSEDYLCSSETTEVSCGFEPEXDIGSRHNHSAAGELLGWVLRGDE

SEQ ID NO: 39124 - protein, 151 aa, A.fumigatus
YSITQVFVSCSSVTPFKSGSHTVLPPISTIIDSALVHRFATQFNFQRLSINLYTFFAIWTFRLLNLPPNWAGTASSPQTAVSVSHRSSWAPCRLERPGPPSWGRMNKEQVFALLDAYVAAGGNFIDTANAYQNEQSEAWIGEWMSARKNCD

SEQ ID NO: 39125 - protein, 298 aa, A.fumigatus
IVLATKYTSDYKAHSFEKKGLSPNHCGNHRRSLHMSVRDSLKKLQTDWIDILYLHWWDHTTSIEEIMNSLHILVEQGKVLYLGISDTPAWIVAAANAYAAAVGKTPFCIYQGRWNVMLRDFEREILPMARHFGMALAPWNILGSGKFQTREQVEERKKKGESLRSVFSGDTTENQTEAEIRMSEALANVAAEHGIKSVTAVALAYILCKAPNVFPIVGGRKVEHLHDNIQALKIKLTEEQIKYLESVNHFDPGFPSNFLGEDPRVSGKAGRLLATSAPLACVRAPTAIGYEVLAEIPS

SEQ ID NO: 39126 - protein, 89 aa, A.fumigatus
CLGSPTPVIYKVKSEIQLREALSGSPSRFRSGYFTSIILAWSYIVFCRWVEILQRAGEEVRSYTKRMEVFENSFWDIVTHGGWEALGKG

SEQ ID NO: 39127 - protein, 369 aa, A.fumigatus
NRLRELGYSIPLGTTPIHLRRGGRFAYMQMGFSICFTWGMSTILFFFILFFFSQITAIFYSHGLDAHCWWFFGRHMRQLEQAKKAFPDVYLIVGVTGDEETHKRKGLTVLSGRERAESVRHCKWVDEVIPDCPWIVTPEFIEKHQIDYVAHDDLPYGAAEGDDIYAPIKAQGKFLVTQRTEGVSTTGIITRFGFPPRLADVVADRLISSRIIRDYDQYIARQFKRGASRQELNVSWIKKNELEIKRHVMELRDSIRNNWTATGQELGRELRQLWQNSRPGSPAPSARNSMDLGSVRGGNGGLTSPTGGQKSHVSRLEALGRPDSPVGTNGRNEDFATGYSLGLIGGVRAWVCITFPATMIESSVDHICR

SEQ ID NO: 39128 - protein, 217 aa, A.fumigatus
SSAPQSANMSSPSTAAKRKRSASQHLTADIAKSSTVDLLQPSSRDASGEEGDDSTDPITPTASKNRKHTSIEVTSTGAPNPPSKRARKSSSGEAPAAAPNGTTEHSSAIHQEDPGEPSETTVASSDIEHGATGRPGLHIKTAGADAETKERLMKPPERAGLQHPVGYHTNPPPTGRPVRVYADGVFDLFHVGYVYNTFFFYSFFFLSDYSYFLQSWT

SEQ ID NO: 39129 - protein, 402 aa, A.fumigatus
KDRPFFFFLDIYTIDHRYRKDMRHFDAWLLRDPYSIWHYYSTGRRWQEIVRDLIQERKICAPPVNLPSSTSFRPVDPYDRPINPQSASPLFGKLPAEIRLIIYHYVFGDEAVHLVQLKGKIRHVRCKHTSSSLDSHRLCCPITPARWRAGARTHDGHSDSRLYPHTHPALPDMLSNGSLALLRTCRAVYAEAADLPYATLVFDVDDLHTFVAFSQTIDPHRLCAIRRLTVQWTPVWQPMAGQEHKASIYAHTHNDHLWALFWSRVAACRGLEELHLSIDLGRFTRATNATAGLLGGQRLRLDVREPWVAPLLSVRGLRVFELGITARSDAEPVARRLLEENLTRDAVTLRDSLRAVMCSAPGKAVLVSGVELWKPCPVEDRDEQTQPARWRRTRPRLAITAK

SEQ ID NO: 39130 - protein, 357 aa, A.fumigatus
LMQTLLLEPGDLVQVKSTDLPPGQFIKLQAQSTSFLDISDPKAVLENAFRNFSCLTKGDVFTFAYNDQVYEMAVLETKPSNNTNAVSVLETDLEVDFAPPVGYEEIQRPSGTSTPLSGVSGKLPSGGLLHPHGTMAQAINYAAIAPESTDAATGAKAVSSNFLLGGQRLNAKKGSKAPTPKPSTPVPGATNPQHPPPARRTNGPQPLRLPPNQLFFGYAIKPVKKRGEDGQAIEKPRFQGTGQTLRGKKREPGNSATPTSGSDAENHKGKERNQKSHGSGANPWRYQALIFRLITLTNQCFNDFRIHFFLQGGKKFKSRRLHIKHTKGGRRLIGIVFFLQLCSIVDYGQPSLLDFPS

SEQ ID NO: 39131 - protein, 109 aa, A.fumigatus
LWQDLRPCDSNKAQSPLRYPTTVRDSQDYRASAVSLKSPSSNLAQSALVLMYNNYTTSLRGDSPFPVQKADRTMASSKNHGSKVDINLRVSASLTFLHILVKLPIGHPL

SEQ ID NO: 39132 - protein, 177 aa, A.fumigatus
QPQFRPGYWDDDPMDGVLGSSMLRHGATIRRFDEYYRCYPVAMLPGPERENVNHGGKVIMPPSALDKLTRLHITYPMLFELHNGAKERMTHAGVLEFIAEEGKIYLPFWVRQSMSSFDYIGTAITDIVWSLHSSCKLSSSSLVTSFRSNQPISLPANSLNFKPSQPLSLTSAIQKQC

SEQ ID NO: 39133 - protein, 296 aa, A.fumigatus
FCSSSSFPSRMISSQPRPKRAGEDFTRTHHHDEDDPNGPSEHKKPRFDLRNPSNLAPDALDEDPVLDADEIGRRGQQVRRKAVNLDGYDSDSENEGFSARIEAKAKRTRAKHDAEDDDMFAELQEDFGAEEIDADEALRKNKKTVRFLRDDEIEGQVASSKGGVTLRADLNATGDTVEEDEVESESDVADEDRARLDEGMDEELGAGAKKKHAPLLDAFNMRAEQEEGKFDDQGNYIRKAADPDEIYDSWLEGVSKKDIRRAKEAAEKREAERKERDRLNDIILRPFFNSGHGKYK

SEQ ID NO: 39134 - protein, 244 aa, A.fumigatus
YSGESSNSQESSSNDPQSSVTPKEEEMEQDEPPSSPSSIGSLDAIDRVEEDLNRSESSRATGYFGKNSELTWMQRVRREAEQRVRNQSGASDTKPEGDFALHAVNYHLDDMDITVPGPVQVYWMPPRHVADKLFEDYLTTVHPFFPIISRTLFSAQYRTFFESAGRPGDKWLAILNMIFAIASKHAHLTQAPWRGDERDHLVYLTRARILSMNGDTIFNHPDLQQVQVEGLIAFYLLASDQINR

SEQ ID NO: 39135 - protein, 478 aa, A.fumigatus
LTLSRAWRIASLAVRSGISLGINMKNTSETTPSISKEARYRVWWCLYTFEHMLGVMTGRSTCILDGVCTTPMPLPFDEEQLREPFAAKLLADQDMRQAYIESAMASSYVRQMPLNPPGGRDAQLADKPRDAQWLKSQPASRALCYLFYTDLAVIGQEIVNRVYSPDCVNTPWPHIENRIGELRARIDRWYHNLPEVFDFAHKMTEEDQELLRLKLFLAFHFYSARITLGRPCLCRRDALPRDPSKKPTFSHGMAVVSLESALRMLELLPDEPNAIQLYQICPWWCNLHYLMQAATVLLLELSFGNIHMPEEEPNFFAAAKKAVRWLYAMSECSAASRRAWQLCDSNLRRIAYGMNYDVSDMPESAYETRPAHPLSMQPQRYNPQNTNLTSTTMCYDATDDLSLLNPTAAGGSQETYQYFQNSHPSTVSHSEKIPSLDLLSSASSNPPRGDAFFPYDPISREFIQSFFPVAADEEPWTH

SEQ ID NO: 39136 - protein, 235 aa, A.fumigatus
TNLPGYTPPDLHHPPSAHEFNRRLRRGESSMENAPSSIPESGSAAMRGQMPSHPPPQQVDRNEKAAINSMPAVELKDSSYMQQISKPSPLGPNRSGANESANAKVAIPRQRSTVAPRYSRRVPRACESCRARKTKCSGDTPICRQCKELRVTCRYPVSWREKTKGYVVGLSCCVGLQLIRMVFFFCHGHRQLDILSVKTQDYENLLREIGSMVDSRTSERIKSMLDKVRASGDIP

SEQ ID NO: 39137 - protein, 599 aa, A.fumigatus
LLRDTRRCTGPVAYGHYNVVFLLMKVGADITPGQNTGFSPLDYAIITGHDRVVEVLLKHGATITDVTIGPSQRTTLHAAAIKGYSKIAKMLLSHGAPTDVKDAHGHTPLHLAVSKGHLEIVQALLCAGATVDIQDKVGDSPLHLAAGNGYFAIVQELLNKGADPSLQGRKTATPLHQASLMGFVDVVQLLLESGANVSAQRSDGQTPLLQASGAGQVATVRLLLGAGSSPSIPDEDGNTPLHFAVLSEKATIAEMLIEAGAHVDSANDKNQTPLHWAAKGHEEMVPTLLKHKADTHARSHTGWTPLHWAANEGHVGITTALLDAGARDQIQNEHGESALHLAVQKGHQAVVQLLIQRGSKPHLTDNKLRTVLHCAADVGHEDVVRILLSVQARSDVKDINGRTPLYYAALQGHVVIAKLLLEFGTALDESVKEAFLEAAEAGHELMVQLLITHGIDLSFKDTSGSTALHRAVLGGQIEVVELLLDTEADTSARDNSGKTALHLAAQEGEDEIAKVLLRNSEIRDLQDCDGWTALHWAVNNEHENTVQSLLDAGVDPGIASFDACTPLDLAEVGALETIEQMLREALAATDRPTIGDAPP

SEQ ID NO: 39138 - protein, 104 aa, A.fumigatus
AVINPLARTRCIPQKRFVTMETLDAVQLPYLGVVGASLIVILGIILLFPLGSDPFITINQHPWDLFQTKAKQQFEYNAAALLNEGLQTVSAEIRCSFRIFANRG

SEQ ID NO: 39139 - protein, 218 aa, A.fumigatus
SQTEWHGVSIPETVLALIAQMTTRALLGPELCRNPEWLDIAKSFTTNRAIAVAAVQSWPSFLQPVIHWFLPPCRALRRQIQCARNIILPALERERRAYCSDQPTKREFSNLVFIDQYAKGARYDATMAQLRIIAVAFQTTSDLVEKVIARLCKHPELIEPLREEVVSVVGNHGLHRHSLRKLTLMESVMKETQRLEPAVISTLPPNIVIFLRMGLVLT

SEQ ID NO: 39140 - protein, 147 aa, A.fumigatus
RPISVGMFRLAKEKVTLKDGTVVPKGTNIAFANDLRFDPEMYLEPETFDGYRFQRMREDPAKIDLAPFTKTRMSHLAFGHGKHACPGRFLACDEAKLILCHILLNYDIRAVEGSPPELRARGMFVQLDPGAMMSVRRRRGTETAPHG

SEQ ID NO: 39141 - protein, 77 aa, A.fumigatus
GHSAFRLVTNMVTYLILKDQYAEEIKNDSRFGAHEAVDPVCRPLHCADFSQNDLVLIRLGITCGPAWLREHVPRFAA

SEQ ID NO: 39142 - protein, 178 aa, A.fumigatus
NIERPPRPAASSESCDSLDCPGFLQFRFSISLEHHPHPRPTMTIPTEISCPEEDAFQLLDKFSWFPSDDQRRWWEYTGPYLLKLLRDAKYPQKDQVPCLYLLQQLLVPYLGTFPVVGQAPLPWWSNVTTYGVPFELSWNLLHNIVRNGFEPLSHLAESGVHAFNQTPPEECVSRLSVS

SEQ ID NO: 39143 - protein, 256 aa, A.fumigatus
  UNSURE (246): Identity of amino acid sequences at the above locations are unknown.
KHHRLTRFRHFQHHLLVTPEEETWLLKEKAPLAKSGRGQQTLAVEFQNGGISAKAYFFPGMKSLATGLSPGKLILDSIERLALPGLKEPVHHLRSTLGLQDDGHPTDTAIAPFLLGVDLCTPERSRLKFYVTDQVVSWDRVADMWTLRGKRLEDPQCADGLALLRKLWDLLAIPEGYRSNIRPDFAFGTPPPEDYRPVMMANWTLSPKKKFPDPQIYLLTVGMNDAVVMDALVAFYEVLGWTDLAXTYKDKVASYL

SEQ ID NO: 39144 - protein, 91 aa, A.fumigatus
RLDGVFMFVINRPMQSRPAITILEISDFTVSQENFGNLILALLGSKMQSCFPAVIPGRGISLCIEKKFDHFNLAPENGPVQRCRSACIFER

SEQ ID NO: 39145 - protein, 98 aa, A.fumigatus
KGLLDRLVKGGTKFKKQFCDHHMALECCIVQRSPTIDIFDVRSGLDTQQYSYHILMSYVSCTMQDCAKFVVGEMWLAAPLDKQLDDGLMSFLNGQVQR

SEQ ID NO: 39146 - protein, 86 aa, A.fumigatus
  UNSURE (21): Identity of amino acid sequences at the above locations are unknown.
RRRHGRTRGVLRGSGLDGSGXHVQGQSGLILVSDPVWWVHATTGWNGINLVDSPGPDFTKTNYIHSGVSFSYRHSKPYLSVYYSPF

SEQ ID NO: 39147 - protein, 129 aa, A.fumigatus
LCLGLGSTADLPQFYGRKWIYIVSFTFFLIWLIPCAVAQNIQTMIVSRFFNGLAGSAFLSVAGGTVGDLFDRHELSALMRGYTVLISSVQKWARCMFSSNFLGSDVDRIEARSCAAGTDRKFTQGWRVH

SEQ ID NO: 39148 - protein, 160 aa, A.fumigatus
LDLSRLLRRKAQKLRKETGDDRWKAPIERMHRSVARTVLRSTYRPWLLLALEPMCLNLCIFSAILLGILYLFFGAFQLVFGNVYGFELWQRGLSFLGLFVGMVFAILSDPFWRRVYVRLEKKHEKAVGKPDDFQPEWRLPPGVYSPGVLVIGISNQNRPC

SEQ ID NO: 39149 - protein, 95 aa, A.fumigatus
AEYRRSANSICCTNRTILVYSGVFTFLVDAYPTYAASALAANSFARSTFGGVFPLFGNQSKHSLPVYASAVVREVELEQQVRSMVYVNGGSLILS

SEQ ID NO: 39150 - protein, 72 aa, A.fumigatus
SRNYLLGDERPCQRCIKRGLQDACHDGVRKKAKYLHDAPDGALMPGVGGNFYNNAMRNNMPLSHHGAGRCRA

SEQ ID NO: 39151 - protein, 144 aa, A.fumigatus
IRMSTTQQTDSVTTTEKPESPVDEDSSSEKSTEDARGKETQQGEESDRTFAPINASVATNNERSQKLQRTTSSTIERSWSLNDGYSCHTVDEEAEDRSNQPGEAADGDEFVVGWDDNDPKNPRNMNKLRRWLIVIICSSGSLCV

SEQ ID NO: 39152 - protein, 62 aa, A.fumigatus
YENRVSPHKGTEFVAVKQIAHCTSRNAEKSTASKAVEETAYDHSLDVLRHGTRDQPYQKEGK

SEQ ID NO: 39153 - protein, 78 aa, A.fumigatus
ISRPEAAGQKAAESTPPSVLVTCSDFIRNNMIIRQKSSFLFDCLVALPPRKTFRLSSVRNNCAMRYSSEKAGPLVRAN

SEQ ID NO: 39154 - protein, 121 aa, A.fumigatus
AIGHLMTNIDRGLLHRAFSVFLFDSNNRLLLQQRASEKITFPDMWTNTCCSHPLGIPGETGAELDAAVLGVKRAAQRKLDQELGIKAEQVPLEKFEFFTRIHYKAPSDGKWGEHESTYWIS

SEQ ID NO: 39155 - protein, 172 aa, A.fumigatus
ILHWIRLTALELWAGFPFTNTNNQGGYKTVQSSGSLSHFLRPVAFQANYQVVFFVFLNIDRHCPTRTKMTSTATVTVPPRITAENVATLFPEVDTSLAREVFPSTVEGSAKDSEELAGYDEEQVRLMDEVCIVLDDDDKPIGSASKKACEYLNLLFLSLGPSQKQYTDQCER

SEQ ID NO: 39156 - protein, 279 aa, A.fumigatus
IVTMVRSQGSRSLNADEQTYHGRRMSSSPLAETAIARDLENYADNEDSINNTEDEEHSEASTVRAINSQPGTTPHSLVGSYQRPSFFTTVSHSTVVPHRGEPECLSWRERDQAIEEERRLLADNHVIPDKIRAGDQNGRRRRFSGLLSRSLRSGDSLESSSGVERRERTEAVAVPTETTSLLEAGNGGSGYSLRDAEAIDRKWEEAVIAGLIHTTWKREALVISRYAAPLTVTFLLQYSLTVASIFSVGHLGKKELGAVSLASMTANITGYAGSFSSPF

SEQ ID NO: 39157 - protein, 101 aa, A.fumigatus
EYVLDILMAFGFAFAAVTDTQILVDYILFIQADVDLNVNPNEVRDTKYVSAQELKQMFTQPGLKFTPWFKLICNSMLFEWWSYLGTADLDKYKGEKEIRRM

SEQ ID NO: 39158 - protein, 65 aa, A.fumigatus
FLDKEAIDIFGSTELDNVITLKFHGKPLIVLAGHKSYEKTGIESFPPPHFFPQKPTAATVEFPLQ

SEQ ID NO: 39159 - protein, 63 aa, A.fumigatus
LCHIVYQGLATSLDTLCSQAYGSGKKKLVGLQMQKMVFFLWTITIPLASIVFTLATRRTTHNS

SEQ ID NO: 39160 - protein, 335 aa, A.fumigatus
IPKSDDPKSVSVYSAAESLLCTVQYHQEYRQAIAHPTEYTMHIFITGATGFIGRVVSELAIQQGHTVHGLSRSPQGDEILTSIGAIPIRGDLATHNILREQSAKADVVFHLAFDHDFGKSYDQIIKLDTEAVDALAAPLVGTSKPLIAASGILTVRPDQGDCVVNESAPYTKNTRVRRHVCEENALSWAERGVRVNVVRLPPYVYGRANETGFAARMVRMAVDNGVSGYIASVKDRCVTSVYVDDAAALFLLLASDKTVKAGEIFHGTADWDTTYGMLAKAIGRASWGPGQTIRAEEAEEKLGGFPVKLLWADNSGFEWKACRETGVETRQAQAW

SEQ ID NO: 39161 - protein, 72 aa, A.fumigatus
VANLEEAVIMFLYGTFPEWRWKKKASDKISSMGHRVYYLNVTGQNIMVDLFYLMRDIEIAESSERKKNLTVS

SEQ ID NO: 39162 - protein, 120 aa, A.fumigatus
PGPQLARPIALASIPYVVSQSAVPWNISPALTVLSDASSKNNAAASSTYTLVTHLSLTDAIYPLTPLSTAMRTILAANPVSFARPYTYGGKRTTLTRTPRSAHDSAFSSHTCRLTLVFLV

SEQ ID NO: 39163 - protein, 143 aa, A.fumigatus
VERIRCVFRTSEQVPTGQGQELPAGHHGVGFYYDIQPLLAIPDVKAFINVRKHAKSDLAAAETVISFLERHGQGHHNPRAYLNVLRDIVPAEELETRVGAQAFYSVAVKKEELDITAYFIPQVYRRFASVQVELNGQRRSRFE

SEQ ID NO: 39164 - protein, 73 aa, A.fumigatus
KMLDLSRTTNQGIRNFSATPTVSVLKCEADEDWLIEGTQTPAVGKGTSIVVGALTDIGLSFACAFQETLDTKF

SEQ ID NO: 39165 - protein, 60 aa, A.fumigatus
SVFVSFSPLIKMRDQAKPAHQDLAGKKIDVSARGLLAWITFYAIITVLQMLLTHYKAERV

SEQ ID NO: 39166 - protein, 155 aa, A.fumigatus
PGSLSSGKAFPSFLSATTLIYSFYFRDSEEDAPAEYPPDQPEADLEDDGAAYGAEEAELEAALIRELEEAEREAAKGGDHEMEGAEETAGKDDEEEDLSDAESEDIEDESDDEEDDLDEDEGGDRDEDVEMGDDTESKDTNAASGHHQQQDIMVH

SEQ ID NO: 39167 - protein, 91 aa, A.fumigatus
RYHISITMSVVSLLGVKIVNNPAPFLAPYQFEITFECLEQLQKGNILKMFFTAEVRFTNNRVARLGMETHLRRLCYIVSQSCQHTNAGLLC

SEQ ID NO: 39168 - protein, 120 aa, A.fumigatus
VKAASIQMQVCCADLSSSEYDQELDSLLVGPIPVGVNKFLFEADAPDLKRIPTSEILGVTVILLTCSYDGREFVRVGYYVNNEYDSEELTQDPPAKPIIERIRRNILAEKPRVTRFAIKW

SEQ ID NO: 39169 - protein, 141 aa, A.fumigatus
TARCLVHHDVLLLMMPAGGVGIFRFGVIAHLYIFITISTLILVKVILFIVTFILYIFTLRVGEVFFLVVLASSFLSPFHLVVTALGGLSFSLFELSDQRSLEFGFFSAVSSAVVFQIRFRLVRWVFGWSILLRIPEIERVN

SEQ ID NO: 39170 - protein, 317 aa, A.fumigatus
PVMAEEDAEKAFFQAQTMNAESVDYKAVEEHGADSSDSDDYDPSKTLQDQYSSSMTDLKQSENVSSSASPEPNPTEQNSVQPDHDPSQPDGASYPSQTPPRDESRTSTMVPTSGTSVQPKTRTIGGFVVEDEDEDDAGDADYEPPAVLGVEDMNTVATNVPQQSVSGNENEASSTPDVSLDDAAQQSASLNNVSHNSYSPAPAVAPKSDVAVAAGQSLYNSHALQSGNVQDSATATPTPDSPSTSKGRLPHDRVGILEDRIQEDPRGDIPAWLELINEHRSRNRFDSARDVFERFLKVFPFAVSTLKSPQHRWEKAD

SEQ ID NO: 39171 - protein, 177 aa, A.fumigatus
SHLSTDGRKLTDPQAEQWVAYAKMESELNDLYRLEQIFNRTLLTIPDVQLWSVYLDYVRRRNPLTTDTTGQARRIISSAYELAFQHIGVDKDSGSIWSDYVQFIKSGPGNVGGSGWQDQQKMDLLRKAYQKAICVPTQAVNTLWKEYDQFEMGLNKLTVSSSHTVKVLHFLISSPPL

SEQ ID NO: 39172 - protein, 245 aa, A.fumigatus
PEMWFDAAEFCILKNLESEGNEFLKQGMEANPESCLLAFKRADRLEITSESEQDPIKRGAKVREPYDKLLDALYDLIAKARTREAQDVARLEETFAKMNADNPPAKTDDDDDDQSESKARESVKNAQIDAVRKAHAIQIGILSKTISFAWIALMRAMRRIQGKGKPGETPGSRQVFADARKRGRITSDVYIASALIEYHCYKDPAATKIFERGAKLFPDDENFALEYLKHLIDINDIISKLLQCP

SEQ ID NO: 39173 - protein, 260 aa, A.fumigatus
WNPILNRLPDARAVFEMTVRKLASNPDNVHKTKPIFAFLHEYESRYGDLVQVINLENRMRELFPEDPTLEQFAHRYSAPTFDPTAVRPIISPSQMRPKAVFPTSEQPMSRHGTPTPRYPGSVTDSPKRPLEDFDDDYNRPRKFVRAESPLKTSQRRQLDQQKRSQLSNVQTGSQFRSQGSPAPLPRDIVHLLSIIPPASAYTAGRFSPEKLVDLIRRIEMPSSISQIPLPQSARGLGTTQTPMQPFSGKASPSLSVRAVY

SEQ ID NO: 39174 - protein, 203 aa, A.fumigatus
CCHCWPFRPLPPSVPRRPTPAATLPTVSPLVGVNLTGLTRVATCDPDTGLKTWSLSTDFTQGSSDGWTAISGNVTYGSNGAEFTINKRYDAPTLETNFYIFFGEVEVVMRAANGTGIVSSIVMESDDLDEIDWVSPVLDDTTERILMKIGMHWNRHYPDPNQLLWQGQHDHLRPRNLGDRQQPSGRIPHVQSRLDRCGHHLVH

SEQ ID NO: 39175 - protein, 402 aa, A.fumigatus
NLSMTGLSSYDEILNSLEEDSYYAVSSNDLSPSLQAWSNNTDLEELDLSSLNLSSSSDSSSWIDPLESAITDTRNGSSPVLSTLSQFTALLAQTGIHGPRILKAFNLSRRGTKIGAGAQFTVFTDPIYEGQVIKRVNVPLSSKAEQRFAASTDYRLQLRTLGLEVLSLCNPMLRAHPNITSLLAWGFDFPFADMAVPVLFMEAAMMPLSDFLGAETRAVEVRYQLSLDVANGLEALQNLNIVHGDVKPENVLVFAGPSDRVPFRAKLSDFGVCLDLEAPDAKFMLSDYRGTQAWLAPEVVSEDLDRFGGFSSELMFRFDAYSFGLVLLSVFTGNGAAPVLDEHPENVPDQVFELLYGQEDIPSNIRIELRKAIAKLLSEDPRKRPLPSPGLIKTDSPTYAAW

SEQ ID NO: 39176 - protein, 245 aa, A.fumigatus
ECTGTDTTQIQTNYFGKGNTTTYDRAIWETVSSPQDEFHTYKVVWTAAAITWYIDGTAVRTLEYADAVDGKNYPQTPMVVKLGIWAGGDPSNSEGTIEWAGGETDYDEVPFTMYVKSVNIINYNPAASYNYTDKTGSYTSIVASNSTTGSGIHSSNSVSVFAPSSSTSTFTSSRALIATASTYPASVQTSSSGVVSLSSSSASSSSAAASSTSGSASAVFTGAAVANLPSFFFTVFFALAIALAF

SEQ ID NO: 39177 - protein, 104 aa, A.fumigatus
LYAVSVVYMLIPPARTSTTFSWKSTANAGPSLPLNSPFRHANTAFVYPTPISFGNPCCASAIRSSSTFFDLGRRPLVSASRILASISRDIVTHSPISSRTTPSA

SEQ ID NO: 39178 - protein, 134 aa, A.fumigatus
QTPATAPRPSSAPFRSSQPSSPKPESTAPASSKPSISPDEVRKLAQAPSSPFSPTPSTKARLSSASMSHSPVRPSSASPRARTTACSCARWGWRFYRCVIRCCARIPTSPVCWRGDSISPLRIWRCRCCSWRLR

SEQ ID NO: 39179 - protein, 255 aa, A.fumigatus
EDSDPSLVCSPSPLENDLTAAVPLSFPTGTPLHWACFFRNLTAVEALISLGANINASYHASDASTTPLFLTAYFGEPSLAKYLISHGADVHLVDSMGRNALHGITKYFPERHGYLPHHWHYWIRHGSWEHHLTQMTELVKILVDAGADLNANDKGYPPLTPVAAAADLGVWDGGVICALLDAGADLGESVLSAGNTVLHSWASIVGPRLAYPDSYLSTMKKIVSATPDIDIPNKFEKDTPLVFTRGWKDPRWCIK

SEQ ID NO: 39180 - protein, 62 aa, A.fumigatus
THTLVYVHICCQQPYSNMMLPLLAVSAFASLGAAQTYTSCNPTNSKSARGSKPHWTNKSSNV

SEQ ID NO: 39181 - protein, 327 aa, A.fumigatus
PYVRSLVGDVFTGLSGKLTIRLSSIQLTPTNTHAGIMDPIYNKGPLFWYRLDESIRTELEGQYALMQEGNAPPFPGDVLFGLAQTITGAKPSYLDRLLTYLTEAARAGYSPARGVYAQIMEAHGQKPEFAEDVLGEWMLQAVSEGYFFASPSYSKGRIEEARERFRANGGFCSDPFLAKKDVVEAAGDRTKALRRTMENGSVVDRKGNTILHAAAALGAIDAVRGLLDDGQLPVNVENEKGETPLYKACQAGHAKIVELLLDRGADASTMTRQDKLSPMHWLFMIPDASIPEIARLMVEGGADINATIEPVVKENSAGFPEKIQILH

SEQ ID NO: 39182 - protein, 76 aa, A.fumigatus
ARRGPTIDAHECRTVFPADRTDSPKSAPASNSAQITPPSQTPRSAAAATGVSGGYPLSLALRSAPASTSILTNSVI

SEQ ID NO: 39183 - protein, 616 aa, A.fumigatus
SKLTTMPVCGKSCINTGASVGVIPRGAVSADGQPHASPTNPSRPRLTFSSCSGVVDEQAKMDIYGTAVTAITQVYQVTIFIKGVVSDIKAFDDDRAEIQLKLNLQLTTLLFFKRICFHPEHGLLLPGKLDPFIADTVEGLLVQMRKTLAEYELVAAKYGLIDDELAIEPDKPATTQESLLERAKSKARSLKLKGYDWSLFDKKRLNRILDAYTKWSEDLRNIMLHMSQDTLAKMAESDHQGLRSSGLEPVMKRRTLAAAKAPADYQSLTGTLAEEGKTMGGFRLGKWTASESEAMPVIVEYHEYESRLKRDDLEPDEIEELKEPIRNLAWLLQNTTFSGTSANSLDQPKIYALECLGFLDQPTDERTVFLYKLPPSEPTTPDTTLTTLHAFINAVDSQTKRPLKKPSLNDRFSMAHSLALTVANLHASAWLHKNIWSRGILLFLETPGGTSAAGLYAHRLAPSPKDNTRIVSYLSDWGYARSVQQGTEMRSDFEVEPNLYRHPDRQGRPSHQFSREHDIYALGVVLLEIGLWVTMSRLMEARIREAETSGRLPRSKKVLEDLIALAQQGLPKEMGVGYTKAVLACLKGEFRGREGPALAVDFQEKVVDVLAGGINM

SEQ ID NO: 39184 - protein, 112 aa, A.fumigatus
PSPTSTPPPGCTKTSGAEASSSSSRHPGGPAQPASTRIALPRPQRTTPESSPTSATGATRAPCSKAPRCAPTSRSSQTSTGIRTGRGGRRTSLAASMTSMRLGWSCWRSGCG

SEQ ID NO: 39185 - protein, 236 aa, A.fumigatus
SSSRGRRRRRRGQANDSTARGLHRGRVSTRRSNQRSRRGEGGSRGGRSEHTNRVRAMDATAGRRIRGHNTGIRAGLVRVVIRRRRVVVDDVDRFHIHRERDLVVIRLSPGPLDRSLAVGRVTSGPDAQLHDHWRLRVVLPIDRIGILECAHGGPVNVPGDGRSGPDDFVRVEFVLRAADGLPDCAVVGGRVALAKVVGLDLGSVGSSAFLSSSVFFLWYHREPDSPSRFRPDHPIP

SEQ ID NO: 39186 - protein, 82 aa, A.fumigatus
RSCESRSGVFGTASVACHSFMSFYVIAAVDWHLSHWENIIAYCGGFVYIGHITYTGQVTGLAYHLQSFHYSIYDFHTLQTCY

SEQ ID NO: 39187 - protein, 461 aa, A.fumigatus
  UNSURE (57),(70): Identity of amino acid sequences at the above locations are unknown.
NSWNGKKFFGATNLFKPYRQGTFTQDQCQGCSGRKPVPFAAAWGSPEGTNPHRGPQXWMTCAIQLEEEPXNRIFSRPLSFRWPFKERQLDDESVYDDASTTSPDYASTHESVYSKQSVKSVSKPRMGVMKTVGTEPKKDLVIGDARYTLDEPSQIDPDIPTVDFGPTLTYLPTTGRPSTSDTLKKFTHHKTGSDATEKQRYAVPTHPINHTHARSPSQDEHRRSILWQPGMARPTTPGGGLSPEQFVQQRAAPSPPIHLHHHRAPSATPPPRRPLSGDWMAHARSKSQMTISRDPQPRPHSRGASSMMNFNDISSHLSAREQEHVARMTGSSFFDISSDKSKQAPPVDPMGLVGAIDAREREKQSIKEGMSNQLVQHAIAQRQQHWQHHQQRQLATTPPPQNYGLQSGVHGNVYNLPAASHTWDALNQTYRADEPRRQSWYGPFAAQGTGKHRQCIPKASL

SEQ ID NO: 39188 - protein, 103 aa, A.fumigatus
  UNSURE (3): Identity of amino acid sequences at the above locations are unknown.
AGXFFYGAAPSSPVVKTTRLDAFAKTVEDARIRTTSGGIITLASLVVILYLVWGEWLDYRRVVVLPELVVDKSRGMDLRRTENMGIRADANDGIEQASEWKFT

SEQ ID NO: 39189 - protein, 320 aa, A.fumigatus
QLCASASHSKEEIAKHLDPNYCGDCGGADPLPGSIKEGCCNTCDEVREAYAAKNWAFGKGTNIEQCEREGYAARIDAQRREGCRLEGILRVNKVVGNFHIAPGRSFTSGQVHAHDLQNYLDSELPDNEKHTMTHHIHQLRFGPQLPDEVSDRWQWTDHHHTNPLDSTSQETNDPAYNFVYFVKVVSTSYLPLGWDPLFSSAAHNAHDQTPLGSHGIAYGSGGSIETHQYSVTSHKRSLRGGDASDEGHKERLHAANGIPGVFFNYDISPMKVINREARPKSFSGFLTGVCAIIGGTLTVAAAIDRGLYEGALRVKKLHSS

SEQ ID NO: 39190 - protein, 166 aa, A.fumigatus
QGAPEFSCRGRPCAGCSSFGPVSSQFLLPLASTANNCVRPLATLKRKSPNTSTQTTAATAAAQTLSPALSKKAAATLATKCAKPTQLRTGPLARAPTSSSANGRATRRASTPNAAKAAALRASCASTRSSATSTSPPAAASPAVRSTRTTCKTISTPSSRTTKNTL

SEQ ID NO: 39191 - protein, 62 aa, A.fumigatus
TGERMEIHMNITFPRLPCELLTLDVMDVSGEQQVGVAHGVNKVRLSSPAEGGRVLDVQALDL

SEQ ID NO: 39192 - protein, 247 aa, A.fumigatus
GTSPPLGLSPLHFHPELLGRWPRGGLSHSAAIITTFIGVSIILDEFLVGSRLKGRKASLGCKKKLESQQDGPLGPPGEIHHVTLSCPSSRLAMAAAFDDEDLSVSLPSYNSDRHRECPIGAGPPPNASNYPARPMPPPTRPTGMAADPSKQSPATMRDMQRLDQYQTVKILGEGSFGKVKLAIHQPSGRQVALKIISRRKLLSRDMVGRVEREIQYLQLLRHPHIIKLYVQVRVLSVFTDRNRLMLS

SEQ ID NO: 39193 - protein, 283 aa, A.fumigatus
LRRYTVIATKTDIIMVLEYAERELFDYLVKRGRCNDAEARKFFQQIICAVEYCHRHKIVHRDLKPENLLIDKDKNVKIADFGLSNIMTDGNFLKTSCGSPNYAAPEVISGKLYAGPEVDVWSCGVILYVLLVGRLPFDDDYIPALFKKIAAGNFHMPPYISSGAARLIRSMLQVHPVHRITIPEIRQDPWFLQDLPKYLQPPPEEFIATGVDPNKAIDLKKIAPGKPLSVQHKIHQIAISKLERSMGYAREDIEDALKSPEPSAIKDAFFIIVENEMMQTNCE

SEQ ID NO: 39194 - protein, 215 aa, A.fumigatus
QRAAPTEDNLMGGPVAPSPPPNRTPLTTPAVGRPAAPRPQGFPHYDSHRAPSQAPQQADSDDFESSRISHVRILPTSLPYVHDQLMEQREREREQRARDAGRLREERAQASLDDDLSGARSPEEQEASARALKPHSRSIIDLNKLRLEPPEGRSAPQQPKRTRKWQFGIRSRNQPYEAMLYLYKAIAAQGGVWEIQPSEAGSFSSTLLTHVRVVN

SEQ ID NO: 39195 - protein, 362 aa, A.fumigatus
PVSPCTRYPSGHVGISPRTYQGSLPEDHVDHPRRARKMAPNLAPSTLEFIRDMILSNELTHSQIANAAGCHPSTITRHVTNMKLFGNVKAPPNKGGRPRKLTPVMIKALCDHLLEKPHLYLDEMAIFLWDEFQVHVTTCSIGRALRREGWSKKAAKYKARERNADLRDTYFHFISDFCSYHLVYVDESGCDKRIGFRRTGWSPLGIALTQVAKFHRDQRYQILPAYAQDGIVLSDVFQGSTDASVFEDFIEELLHHCGRWPEPKSVLVMDNASFHHSERLEQMCAGAGVQLVYLPPYSPDLNLIEELFSELKAFVRRHWQVYEDNPDQGFDSFLEWCIETVGARKQSAKGHFQNAGLTIEEI

SEQ ID NO: 39196 - protein, 67 aa, A.fumigatus
SLTRTFLPLLEPEFSVADESPCNTNFYTLLNEELRVFRADLSKVKTVLQRYITRFFNIFLIAVTVHP

SEQ ID NO: 39197 - protein, 369 aa, A.fumigatus
LLVLIYLFVVVGLVTPAQAYISYTMAGKTCLSHDDYTVGWICALPLEMAAATVMLDEKHEKLRRQPNDHNEYVLGHIGEHNIVVACLPSGEYGITSATTVAMQLLSSFHSIHFGLMVGIGGGVPKEDKDIRLGDIVVSEPTYTHGGVVQYNYGKALSGGEFRRTGMLNRPPQSLLTALSKLQATHYTKPSQVINFLAEIEQKLPTEQAANFARPTQTDQLFLDNYEHTNTHTQTCNGCDTTQTIRRQCRSHNNPFIHYGLIASANQVVKDSQLRDKLGRDLGVLCVEMEAAGLMNNYPCLVIRGICDYADSHKNKEWQGYAAAVAAAYAKELLLTVSADQTRNTRAITNVPPPPTVSGHSLIIIYVDLI

SEQ ID NO: 39198 - protein, 114 aa, A.fumigatus
DVMFPGGQQIYVDPSGAVKFTTAHSASMPPGSTVEGFSYTSGDPLGHWNFSGQGATGFMACPTQGDAPAPYQVFAAISSATVPTGNVADCLGFDAAAIAWTPSQGQTAAAWQYT

SEQ ID NO: 39199 - protein, 103 aa, A.fumigatus
LIKSGLYKPPYSTNILSNLPLGAAASGNCLPGCGNAGPHRLISRRYIGLPSRPRNRHVLLSPSILRPSPPTLAATSLVDSHGVQPTIVSSASPVYRLYRLNEG

SEQ ID NO: 39200 - protein, 424 aa, A.fumigatus
TDTRRRKYYQRTNELVSQYLYIDQLLDSSLPHQLIDEYSHDHDIVAHLWTRGREQNGEGPPADTSSRKIKRTPRNLYRIPNERSPLLQPTIEEDTPFPEIPSPHAAEHVHSGDRIVTVAIYINLLANVFLLGAKIAVMSLTSSMSVLASLVDGALDFLSTVIVWTTTKLAQRQDRYRYPISRRRLEPLSILVFAVVMATSFVQVAITSLGRLLGPDHKLVQLSLPAIFMMASTVVVKLLCWFWCRLIKNTGVQALAQDAMTDVIFNFFSILFPLGESYISRCGRRELTDKSVGFFANWWFLDPLGGLLLSVYIIWNWSGTAATHIRHLTGAAASPTDHSVLLYMTMRFSKIITKIQDLKAYYAGDHLNVEVDIVVDERTSLRDAHDVGESLQYMLESVPTVDRAFVHLDYDPWNIPSHMNQLEA

SEQ ID NO: 39201 - protein, 61 aa, A.fumigatus
GCQGGCVSSPLFPLAPALIGNPLSLTFSNSNDYAKLLATRVHEEKAKRDELRKRRASSMRK

SEQ ID NO: 39202 - protein, 113 aa, A.fumigatus
LTLVITAITNFDLAVLALSIVKQGESELPGLTDTVVPKRLGPKRATKIRRFFGLDKKDDVRKFVIRRTVTREGKPDYTKAPKIQRLVTPQRLQRKRHRIALKRRRAEAAKEAA

SEQ ID NO: 39203 - protein, 78 aa, A.fumigatus
PRTPVKMKLNISYPANGSQKVIEVDDERKLRPFMEKRMGTEVSTPPDIFCFTYPAPRKHTRELFSAERKLNIEWRTED

SEQ ID NO: 39204 - protein, 246 aa, A.fumigatus
YSCHHENMAQTAKSLRGNYIGSVVDNEKLSNTMLNMYKTPLADFKAQVKQWTTAERAALESLSDEKIASRQNNTIVVVSFGIWDLWNMIGKSYEDSINVVDHSIQVIMDQLNVLSQLWVINNLKVILTLTPDVTFLPAFKPTAAEQRVSHYKDTVKLTEYWNHKLRDAAEQWVQGAIYLFDTNAFVADLIKDWQLFAAGVEESNGLGKNQDPGWVNVEDACVQSGQQWVMATKEKQCENPDKYLFW

SEQ ID NO: 39205 - protein, 65 aa, A.fumigatus
LLCPPETSFEALIYFLTVSQQFLVLRKVYEEPLLIFDPMSRIVISKRIGADNTRVHGGILITILR

SEQ ID NO: 39206 - protein, 575 aa, A.fumigatus
WAQVRVLKFPRFNIMILGAPISSILNKNRAKILTSKFERILKERARLKKLDLTHDLRKADELIAELESTRDLSQYVVHVDCDAFFAAVEELDRPELKTVPMAVGKGVLTTCNYEARKYGCRSGMASFVAKKLCPQLICLPQNYEKYTAKAQEIRVIFAQYDPLFESASIDEAYLNITSYCTENNLDPEEAVSRMRAEILETTKISVSAGIAANAKVAKICSNRNKPNGQFRVPNEREAIMEFMRTLPVRKVNGVGRVFERELDAIGIKTCGDIYPQRALLTRLFGEKAFHFLMQCFLGLGRTQIQPVENYERKSVGTERTFSEIGDKQLLREKLWDTAQELEKDLARAECKGRTLVLKVKLATFEVLSRQCQPPRAVSLAKDLYAFSLPMLAKLEKEIPNMKLRLLGLRCTNLVSTKKVDINFFGAASQSRSVAGRKPDAMTEQQIGAEEAFEEAARQERQDDINELEQLSQEISDTEQPNKGGDTTMLPESESQPQFWDCPICSRPQVAEDKAFNDHVDYCLSRETIKEAVQCTADVSPIAIESTPKIIGRKRKATKEPSHESHDPRQRRLFFT

SEQ ID NO: 39207 - protein, 538 aa, A.fumigatus
TPDAETASFLSVNVTPRSGSRNSRRDGFLSPGNAPSSGQSSPQVQYSHAGVGHVASSGGCRTERSPARSNGKLEPSRGNRAKTLTTERPNTPRPNSYSDSSTSRMFFHAYDARSPNSSDGDIRSKQLSKPSSPATFVYANGEQEEQTQGEEANITAPTVKRRSIGSSRLALAPKALPVTSPRLRPAKLADSAARLSDATSQVSSPRDGISEVSSQAHSSFSGAFPARTPIPAVRHIKSSSLDSASSGVHPKEGLKPSPIIVSTVGSPVETESAASESMPGLRPRILSNGSMTSVDTHLSSAAQSPVKSDTGQANNDVVLNARIERKILDLEISNSSLLAINRTLEREMRKQNAELRRYRRLSRSGRLSMAPSTRSFSGTSLGITNELDEEASELSSIRSPEELSEYSDEDSTMDSGVVSPDSLADHDARHRVKDEKRFFVDLAKHQELLADSQKINQSLKRCLGWTEELIKEGKKALEYSVHVNDVQLGGRVLSPEELHEEAERARALLSPVAEPPPDPPLASQELESLMEMLDNGGY

SEQ ID NO: 39208 - protein, 156 aa, A.fumigatus
PASAQLHNANSSNHLRQIVIIWDYTFCRLSIQASGSSQAGSGSSSSLSDLKFGPGDLCSSSLSRSAGGSGLSTPRGSVNESLLPSGGRAFVVSLPGAGDLSSVDALNASSSISRASRRASSSAPMQHMSSFQSFFSARFRCCSTRLVVCSRSSTTD

SEQ ID NO: 39209 - protein, 81 aa, A.fumigatus
RNSCQKFVANRLLTFREALYEDESFPERELAALVAAKVYYHLQEYNESMVFALGAGKLFKLENGGEFEETIIGKFWQYSSD

SEQ ID NO: 39210 - protein, 193 aa, A.fumigatus
VFSQAKCVDTFISLSAAQRPAAGDPSANLNNSFPTSGEGATSTSASLTSPITPFSQSTLPSKSLLSRQEVPGLDAAHPGGEDVSVKHDETTLVLKRGVQGQLQSVIERLFEQCFVQKRYRQVIGIAIEAKNLDVLRRAIIRASEDGKKHGGSRRSEELMEYVLDICMGIVQERAFRNEVCLFSCFICRCQAFR

SEQ ID NO: 39211 - protein, 742 aa, A.fumigatus
  UNSURE (727),(735),(739): Identity of amino acid sequences at the above locations are unknown.
ILKLILELLNEIPAPDYFSIAKCVVFLNEHSMASVILRQLVEKGDARSLAVAYQISFDLYDNSTQEFLKKVREEIAELVPEEQQPDSSKTESQEEPKESDPLLQDQSSSEQSRSLGLNNTQAKLSDEARTAFKNILEILDGIKSIQLNLEFLYRNNKADIAILNKVRDSLEARNSIFHTAVTLSNAFMHAGTTHDKFFRDNLEWLGKAVNWSKFTATAALGVIHRGNLSQGQKLLQPYLPREHIAGVGGSGSVYSQGGSLYAFGLIYANHGGMAVDMIRDHFKKATEEVVQHGGALGLGVAGMATGDEGIYEDLRNVLYTDSALNGEAVGLAMGLVMLGTGNMRALEDMIQYAHDTQHEKIVRGLAMGMALIMYGRQEAADELINGLLGDPDPTLRYGGIMTIALAYCGTGSNKAVRKLLHVAVSDVNDDVRRVAVLSLGFILFRKYQSVPRMVELLSESYNPHVRYGAAMALGISCAGTGLDEAIDLLEPMLKDSTDFVRQGALIALAMVLVQQNEAMNPRVSSLRKAMMKMIGDRHEDAMAKFGCAVALGIIDAGGRNCTISVQTQTGNLNMPGIVGTAVFIQYWYWFPLTHFLSLSFTPTAVIGVDQKLEVPFFKFHSNTRPSLFDYPPEQQVKAEEAPEKVKTAVLSTTAQAKRRAQRREKQQRRESMDVDQTPTTPKVSDQLPEKMETDEGAEKPEEEAKEGEKGAGDGPKKKAEREKAGYXFLSRSCKXNMNXGRR

SEQ ID NO: 39212 - protein, 64 aa, A.fumigatus
TVALLIIMDGRYGILQASSFGPKPGNLFQSIRPFVKSEAEYFSFLLFQFQQIIDRLEYPFPCFT

SEQ ID NO: 39213 - protein, 89 aa, A.fumigatus
QSRPLSHQPRKPGLGSKTYLSKMVGLASAAGLVGFLSEPDPELRVFALKTLDSQIDLLWTEVVDAVPQMLVIHPISTSLLKKFLPKVCR

SEQ ID NO: 39214 - protein, 212 aa, A.fumigatus
AEDMAKAYPKAFAGAPRRPRIVPESAVPISLDPPTQARLYSEVEVMICVTANTFLVRQYEAGRISEESIKRVTNFWGSKNRPQVVEFQFDQATQRRLILSNIRTLSFDGESSTNPILLHSNLHNWKAVVKEMSVRTFCAPDSAIRKHMHDIHKLLEMLGAHDATLLAFEELQMSTLALMRQRRQMNYDLERSNSNFSAPATDPQKVVGSCTN

SEQ ID NO: 39215 - protein, 371 aa, A.fumigatus
MLRSFRLASTFSSPKFLSKTSHMMAGPLHTYGPTCLLADDDPDHSTWYSLSEPPKVRAQFFYTSSLPIDDPLSALPPPSSGQNAKNERAPPQPFSVKDNIALEEAWRHLRQTMKEKAAGSKKSSSILRNAGIAVPGKGSTSDTEQSKHTGSRRDGSLTGIDKSPPNGHSSSTNDQRIHSSRGESNDGVGGAGDRVSWGRSQFGSAQDDGSDNHNLRKRELSLSGQPHAAKRAAGTSSESENPSMRGFASGILPGTSSHDASISGSPFARAPIAQSQSPLGRSVESVSSKGGSSNIQAEPYHVGSNHTATKPSDLRNSFDQDNSSEGPIMEAGAVDQDDTSQLKVPVGVSRLHLVELPNLKVVFPSIAEFKI

SEQ ID NO: 39216 - protein, 73 aa, A.fumigatus
NNDHINRQYDADYHEAISVPYTFFSAMHLLLKFYQVFASVFSCDPSARSSSCLCCRVLLRRQFDPIVHTASSP

SEQ ID NO: 39217 - protein, 231 aa, A.fumigatus
SPCPLENAYVLIVRSIHLSYEDIAKLNPFYEKYREFWNTTPDTTVTTLSSLDPSSRSPSFQSVHASTVAPPSPLDISSSPSLHCAEPSAGLHFSAMLDVPLHKGTQRKPSVRVYDEDIPTSQQATFVIEGYSNHSLSPVNEALEMCDFHPIDRHHFSDTTQQVRSSHKKLFGTNGWLGQADDSNTVPLKRQKSKIFRDLGKKIKHHVGEIVSAHSNFLILSFTVSLIQSIG

SEQ ID NO: 39218 - protein, 362 aa, A.fumigatus
MKPIYWSPLHDESNVLRATWFYKNTMLPVETELANKLEDGYIYLKPWTDTWQDELNSCVENGADAEMKIVHKLWPKPETKSNSTPTSRPGSSAQLRSAGSDSDSPTFEENRAAGGTTAHTEAAKPFLNSSVIYVDGRNAQILRPSLLPSVSRGRRPLSSIRKGRHIGIPVVRGFSRRSWEQLHPSKPSPVDVRNYLRIQSRAMSRTDGRQVCYACAMEGSRPTPTDLVLVIHGIGQKLSERMESFHFTHAINAFRRNINMELNNEPVWHHVRRDHGGIMALPVNWRSTLSLADGSLESEISDDPSANHYSLNDITPETIPAVRSLISDVMLDIPYYLSHHKPKMIQAVVSSPRGWKDPRGRY

SEQ ID NO: 39219 - protein, 71 aa, A.fumigatus
DTVTRTTDSVIGFSSATVYSLVIGRRRMAIRRTLINSSEASISTAACMFALLRVTSRSLPRYSYTCISQNT

SEQ ID NO: 39220 - protein, 83 aa, A.fumigatus
FGNCLKYLVPYSSQVIVTKAPIGSLLSVFFQTFADGLGDFVFGNYWRLLETLNSCLNSGQNLIISHGLFTLRLVCLEPFAQAL

SEQ ID NO: 39221 - protein, 234 aa, A.fumigatus
DSPTFSKKVFVSKLMRSHVSLTLSPMAPMTSFMSSARALVVVIASRCALSRSSASVNFEPIELWTSSYLAMTSPSFSSNFAPSSTMMAARTSSCLTRAAASRSSISSLPASCSPRTRSNSRLMSSVSSWMLSTVVKLSAEAAKPSKSCLSSESPSELPSSLLFSSSPSPSTTALASSIFSASPACSTFLASNPCAVNSFSASTFSLKSVTSIDKSLMSVFVGSVSTSGSFNSST

SEQ ID NO: 39222 - protein, 208 aa, A.fumigatus
VFTSNIMASTVCKSDLTSFSVSGSPSESLLLSSSKAIHISFRRVSRVPISDLVGPSASRRAESPVIASFASWTMTSRLSSCSAFAISSRAGNFSSSSWDFVFRSSVSMASVSSFFAVKSSTGFSRATIPATELWSSCRPATTSSRCSFFRTSSDGSGARGADSMASTLICSSVMRVLRASMSLLIFGSFASINSPPRVGSGSLDSSCD

SEQ ID NO: 39223 - protein, 1313 aa, A.fumigatus
PMKLKRWSENCEDIVLGMGRDLARRLEEIEHIRFAGDDEPKAPSKDEIAAIVEQSLQELKNQLSHIMNEHRQHASALSEFRSAMDGAEIYFIVKRVIEEHSMSQPQEPGFQRDEILETVREAWETYKPEIELQNFGLERDEILECLSEGLKAYQPQREQAVTYDQVLAAVQAGVQSFEQPPIVTKDEIAQTIRECLKEHTQQTADRRLRHDDLAAVRDEILQAVTESFASQSALIRESLELGLGRDEILTALSEGLETYFNAAKETEPVHITKDDVINAINDAFAAQNSAISTIVELDISREEILAAIAEGLESQNSMIREIELNKEDLMEAISAGLQEALSSVNLNAGEQALERFQELVQEIKDNVQQQALAGEKSSEQVLEAIKDGLAAVKQAVEGYAATAVEASGKHEIMDTVKEGFRLLHADMEKTIADAALSNSRGVNPDTPELLDAMEKEFEHLRQTLSSLLIRTNVSSDKDEILDAIRDASESQKVPSVDDIAKVIKEEFDSIRETMTTSLVPIQPKSGNDEIVAALRESFEAFRESNNQTKDSGDSVSFSTGEVIEVLNDGVATIRGDLSKLLDRPEQIDYSELLDTLKEGLSSLKADVESLRQSQDESREPEPTRGGELMLANEPNISSDIEALKTLITELQIKVDAIESAPRAPEPSEDVLKKEHLDEVVAGLHELQSSVAGIVARENPVDDLTAKKEDTDAIETLLRNTKSQLDELKFPALDEIAKAEQLDSLEVIVHEAKEAITGLSARLEAEGPTKSEIGTLETLLKDMWIAFDELKSKDSEGEPDTEKLVKSDLQTVEAMIFEVKTQVEELKLPDVETLPTKTDIKDLSMLVTDFREKVEAENELTAQGFEARKVEHAGLAEKIDEARAVVEGLGDELKSKLDGSSEGLSELKQLLEGLAASAESFTTVESIHELTELINREFERVRGEQDAGKLEMEERDAAALVKHDEVRAAIIVELGAKFDEKLGEVMAKYDEVHNSIGSKFTEAEERDNAHLEAITTTKALAEDIKLVIGAMGDSVNETCERISLDTKTFFEKVGESYTKIEEMHNEVKTHHEQARSDFERAVAATDRVESRLHEFHPQVLESIQEILSIVGKHYDHSQKATEDIKMDLSILPSTIPSMLPALPPPEPEKYDDTRVREKLDSLLEHAKNNKVQEALDILVERVTNNQVHEKLDQLLSQTTSTNAQVYDKLNELLDHATNTNGPIHEKLDTLLDHAKNTDQSVTHMMKLDEMHKDIMETSRKMNEMFAAQSALVAENTERRRREAEEAAIALERRNAQKEQVEAEIVTLNEEKTLF

SEQ ID NO: 39224 - protein, 399 aa, A.fumigatus
VVSLLNWLNFLKGHAWSAEQCVIGLLEQTLVVRFDFQLPTRAQSALSRLMDWSRDGGSWHTLTHWILSASWPKMPRRLAMYSVRFSAPPCLKICALVLESNCSDSGIVNRHDPRDPTNLSPRSRSRIASHLQQPALLSRMTSSLRIGVPIEYNISELSPSVRRAWALSIAFLREQGHTIHPVSLPTTKLALSAYYVLAPAEASSNLAKYDGIRYGSRCNSPDSGGQPESYLYAKTRGDGFGLEVKRRILLGAFSLSADAINNYFIQAQRVRRLVQHDFNAVFRAEQPISPSRQKGDTELKSKQAEVDVLICPTAPSCPPQLADLVETDSIFSSLNAYTNDVFTVPASLAGLPAASVPVRVNCRDEGSSDADLAGIQIIGQYGDDELVLKVSESLEGKIF

SEQ ID NO: 39225 - protein, 81 aa, A.fumigatus
TVRYRALGTDTGGSVRLPAAYTGTVGFKPSYGLVSRWGVVAYANSLDTVGILAKNASTARDVFRTLLCASMSQDLCSCIGI

SEQ ID NO: 39226 - protein, 624 aa, A.fumigatus
TVIDVHMSSIQPVGSSGPSSNINSPTLPPGTAPFFSGTVTGQNARSSPAPPSNASVQTDGTRSKRNKRDSRKKREAKGLDQESIAPKKKAAVAPNSALPSSDISILRPLLLAEPRASDLLPPQPRQLSFVSRKTSDVLGQSWDFYEVVDKLTNKNGFRYSYAIADPGFPHIKYRQTDVPPYHARFSFEDSPAAIFFSEDARAVTASSAWHTARANVCAREGAYYYEARVINGIPNNSQSISANESSHRTPKGHVRLGFARREADLDANVGVDCYGYGIRDVNGEVVNRMRCEYFFPKGESIREGDVIGMLITLPPLSLHKKVVEGTYDPAVDGDGTSPTSEAHTSTNLIRDRIPFHYKSDFCWQQSNVFSTKHLRDYAFNLKETPTFGPPSPFNSEDPSLRTLPGSSITIFKNGEKMGTPFKELYAFLPPASRLANGTNNLGIGERENADDGMIGYYPAVSCYGGGAVECRFEGPWWVGPPSHADNGEPVRGIGERFNEQIVEDVVADIVDEVEAMLIWGGVDGDVVGNAEVDSAGAGAVGGSEVLKGGVGAAFDPRLDSVPGAAEFADTENISNGLEAGVTDADAGHLTTEDTLSVGHEGSPNPATPSAPLENTVPTEDVEMS

SEQ ID NO: 39227 - protein, 130 aa, A.fumigatus
DSYLPRRREDLLHTRAESKRVAALFLRPPLCRYPCQLRCRVLVTPNSHLDPLIGLRAVTDLKRVHFCTAIQMASVYGDLRHLLPNNYKRLITAWLEEDCPSFDYGGFVVGESEGEARLLGKSKVCRWDAS

SEQ ID NO: 39228 - protein, 248 aa, A.fumigatus
WLSARRVEWHVKEGESIDPIKHCATVRGPIRQILLGERVALNILARCSGIATKSTTLVAALRAHGWQGTLAGTRKTTPGFRVVEKYGLLVGGADPHRHDLSSMTMLKDNHVWACANNRSAADGGSGSADTQSIAAAIPRAVQAAKAAGGFSTKVEVECRSLEEANAAIDAGADVIMLDNFTPEGVRDAARQLKQDWAGKQKSFLVEVSGGLTEANAAAYACPDVDILSTSSIHQGTPIVDFSLKVSLR

SEQ ID NO: 39229 - protein, 844 aa, A.fumigatus
LLRRGNAELRREVSAQTSMLTFRNKEKERLYQEIEELKLGQRRDGVRSVAGDSIFDRSASRAQGRSSSRASDGTGPSRSDDAEREDLEQRIDQLRDQVSALKLENQTIRAELEERIAEYDALDKQYQADVDGADEMFNALHQERDEAERKMNDCLVNMQIMDAQYTEDIENLEEEVRRKTEECGRLEEELRNQDENLRALQAEMRSASEGIIRLEEDAQTNLQRYEKVQRELQDCNREMEALEKSLYEANTKVQRLTVQIESSQNEIAFLREEQDGDKIRIGDLESELKTCQMSLQSERDKVKDLESRLAEERHQREVVGTKEKQEVQRIINELNREASSAREEARRLKKSLSAQEIETATWRERLMDLENNLRETLGDLTGSRSSLISNIMKLQKELESTALELESVRSKLDEKETLLRNRDALLESHGLESRKLSELLERERQARRADKQSFEQALKSHHQASRTITQNNSRITELENARSQDRKRFTALEQQFKEQLNERNSMLLTMWKRLSAMCGPDWAHSNSLINGNLPSQEVIGNILFWPGFSRNLLLAVKTLENVIGGFKNRIKGVERDLTKQYQNLEHALGQRIKKLDRLEESVMNLRAQQHSRGQSGMSPEIAKLRGENRLLKAELNLLQSHSSRGPTSAAAVAAGMGQGIPRSPSRTLSTESGTDAESALTRHRSVIEKSATPHLSRNAHRSSTTGIPQPSSNAPADDGGAIVPSSHSRHASGDPVSNERWIHRLRELEKRLKAEREARLLDRSGARKRLEERDAENQRLRAQLERQRMRRGLSAETSTDGDYDHGRVRKSEHSDPSNDGDYGRLRNEELSSSEGEGICVDIEV

SEQ ID NO: 39230 - protein, 67 aa, A.fumigatus
NIYSQTPMTSSLISSDPWNVASYIMISTWELLHVTVEIEFLFYTFEQIMRPFRFVMYVLRSLSRYKF

SEQ ID NO: 39231 - protein, 63 aa, A.fumigatus
YSRSLSDTPGCRDCPTRSSLLPIFFLFEALPKDLHGDTYGADIDSSGQSVSAGVMNHSETCMI

SEQ ID NO: 39232 - protein, 71 aa, A.fumigatus
GILHVVKSGSERGPLSLLIIKLPANLVELNTVSIGPMLTVWSDYGASLNTELLAPQPHYLPINDNISGNSV

SEQ ID NO: 39233 - protein, 88 aa, A.fumigatus
LLLSDTAFRLHLGSLLLWGINSLETQMLNLPLKHPLLNHRLPVIHLLDCSLSLSGSPDYLPRLSKPRGIILAIGLSQPSHKSQKRGNF

SEQ ID NO: 39234 - protein, 526 aa, A.fumigatus
  UNSURE (217): Identity of amino acid sequences at the above locations are unknown.
LHGPFQPRGEDMERLGSLQEKFYANGKSVDGWKPQDIEIYKTLVCGLLIKCADISNVARPWDIAEKWTRILQEEFANQGEMEREVGMETALFGGPPELGNVYKLATGQIGFMSIFALPLFEGVSDLLPELRFTVEHIRTNQTRWHFLADMEKRKQSLLDPRFEGGLSPRSQSPAASFKGLRAPLNESSARSALDPDDPATQRREATGDYFGTAESSXNDYNENTISPVVSPDTPGPSMDITGSPIPVRAFSEILQCLSPTSLRHRYPARFLTPMDPKHAGDFERQTGRNSRRSSEDAVLSAVILANTSDDPNRANSRHRSGESTEREAERPSSSRQGPQGHRRHHANTNSTGRGSGAPNSQRNSCTRTHSLSTYSNTMTPISPATNATSFVTVDDRDEKGHSREHIRDEHDESDGARPGSSKQYSVGEGRSEGDTHFSDTNTSHSHLDDGRKSPITTFVVGNGSNSPAHSTTTTPSVKNEAHPTWDDPTAGEQPPRRLPKRRSRLRLAFWKRKPHHSHQHELSGET

SEQ ID NO: 39235 - protein, 232 aa, A.fumigatus
EYNPSSIISVAVASLSLTILTLFRFLFLTLLLTIPMLLPQGPICMAQIPLWINHIPHPTLEHLDLYPASASQFPYQTQPAHLSSSPRKEKRVHTRKPTINPPIPEHTLPHLRLRQTSNTHDKRAPRARHKSNLAKTGRKRREKFLGELFSIHVSIALAISMVLALGPVCLVSGIVCILNPGETRRKGGGGTYISGSEHPFTLRAVFDCDSGQGCGCRCCCCGRGGRGICGCA

SEQ ID NO: 39236 - protein, 61 aa, A.fumigatus
INNAIPASENLVQRNDRTNAPHRTTPTILKHNHKSPAHHDHNNSNDNHNPAPNHNQILHAM

SEQ ID NO: 39237 - protein, 925 aa, A.fumigatus
  UNSURE (24),(37): Identity of amino acid sequences at the above locations are unknown.
ARNQPTRQPQRNSQAAEQAQPTTXPGFGQLAFGQSPXGSLSAMGSSPFGKPSAVPAFGSPSALGSRQPAFGTPSAPSGPSFGSPSQIKPSFGTPSALGRATPQFGQSGFGASAAPSFGQPSTPGKPLPFGTPSASAGGGFGSFANAGGFSSFAASKPATESPFAKAAGESPFGNPATESPFGKVSTESPFAKPSGPSIFGTQAQSGSAFTPQKADESKGVFGASGSFVLGSTFKGDGTAVNDGPKPDKASGLFSFGTSLDDMISTPDKTSPPTESMDDAEDQPAVTQSAKAAAKEAPTSVFGAPSKLDTSKTTSIFGSQTQPQPATQANKSPFSLFGNVAAEKQVTSPLSPQSGKTTIASLTPKAENISIAEPPLPPEPTSRAAYGPGDTSASSNVSKSSVEDVKLEAPLPPDFTSGITGKAGKPAAEGAPLPPEPAPPESPAASDEEAGPLPEESDVDESEKEPSEGADESDFADSGEEITHEIEEEEEEPEITGQTPKISPESSFGTGISEQSPAGGLFSRISRPGQQQRPRQLLGEVAKPMFQPTTHVDREPPRSPSPVRGSIPKTLVKPQIHKSTSAPQIPGSTLAARKAALTEAALGNQRLRRESDRTAREQQARLKIQAQKEEEEALSLSDDDEDERLRADLAQPLEPVPTLDPFLPHQDYMGQTTKPGIPGQIERLYRDINSMIDTLGINSRALSSFLLYQQSPRDSERWIQTLKTDHSADVLDEEVLLGEIEKLDDAVLMLANSLQEQRVQRVEEKLETCRELLSKDILTLRGQCASIRKTLDAHTDTAAILSAPLSAEQANLQQDLRSAFTNLQASLADLESAVSILRAKIAEAPRPDSSRQSTKRPTVEAVTSTIATMMNMAESKSSDIDVLEIQLKKLGIDTTGPPTSREGSPFATPKKGVGKISYDAWLSGVY

SEQ ID NO: 39238 - protein, 211 aa, A.fumigatus
RGRCCCPGLEMRENNPPAGLCSEMPVPNELSGEIFGVWPVISGSSSSSSISWVISSPLSAKSDSSAPSLGSFSDSSTSDSSGSGPASSSDAAGDSGGAGSGGNGAPSAAGFPALPVIPLVKSGGSGASSLTSSTELLETLEDAEVSPGPYAALLVGSGGRGGSAIEMFSALGVKLAIVVFPDCGDRGLVTCFSAATFPNKEKGDLLACVAG

SEQ ID NO: 39239 - protein, 385 aa, A.fumigatus
IIAQLCGEKEVLAQVKLSFKSTSGAKMVATRSLQLTVKKTTRQQKTLEGQLLMVKDGERTAISSRVAELDQIMPQYLGVSRAVLDSVIFCHQDESLWPMSEPSVLKKKFDEIFEAMKYTKAIDNIKAFRKKQNEELAKYKIMEQHAKEDKEKADRAEKRSIKLQDEIESLRAETHQLSQEMRRVAELADKAWKESESYAQILGTLEGKRIEAKSLQSTIDNLKRHLVELDDPDEWLQSNLEQFESKQLQYQQQEEAQKENYMEIKDRIEQARQKLGVKQAEYGKYENDKANFERQVERRQRMTREIARSHNIRGFDNIQDQSDIDDFMRKIRKLLKEQNQALERVKREAQTELREVQSTLNEIGQRKSALQESKNAAKRQIGADD

SEQ ID NO: 39240 - protein, 347 aa, A.fumigatus
IEATKRAGDFARLDHLKKELKERERSLETMKAAHGERLAKYIGANWNPATLEQEFQRVLEEETRNVSNAESQRDGVNRELEQVEFNLKTSKKTLAQRQKELNSCATEIREAINEEPEEYPDALKQRQAQLDVARRDAEQSAGLGDYFMRCLETAKQVKACRLCQRAFRADAEFTVFQKRLEGLVKKAQIGVEEEDVERFEAELDAARAVSTAYDTWTRLSKTEIPDLEKEEDQYALQRDELLNQLENHDKIVSEKIEKKRDVEALSKTVNTIVRYESEIKTIRSQIQDLSSNQQDNTATRTLEDIQEEIAGIGDKTRALKKTLSKLINDREQARTEMNNLELQLPRC

SEQ ID NO: 39241 - protein, 453 aa, A.fumigatus
NCSSRDARSKLDNVKFQLERKSDLLARIEEYKNFNNQQREAITKADRDIEELTPELLKYQAQYDDISQRVEAREREMQQGISQLSERIRQLDLATEEIDSYNERGGPSQLERSRRELQTIEAEISQLEAEQANITKEINKISAQLKDSENTKRQYSDNLTYRQATRALAEVSAEIENLAAQNAEVDRSRFKEESERRTREHNALAAKQASKMGEMKSKDDQLMQLLADWNTDYKDAASKYKEAHIKVETTKAAVDDLARYGGALDKAIMKYHSLKMEEINAIIGELWQKTYRGTDVDTILIRSDNENAQGNRSYNYRVCMVKSGAEMDMRGRCSAGQKVLASIIIRLAPAEGFGVDCGLMALDGPTTNLDRDNIRSLAESVHDIIRAREQQANFQLIVITHDEEFLRHMQCGDFSDYYYRVSRNEKQNPIIERQSIAEVSYDDLRCFQIALTY

SEQ ID NO: 39242 - protein, 292 aa, A.fumigatus
DFDRMCEEVREPAIQVPKAMVGTIVLNFVAGLGFLLPLTFVLPDITMLVNLASGQPTPVILKDALGSSTGAFLLLLPLLILGVICGVGCVTAASRCTWAFARDGGIPGSKWWKTVNATLDIPLNAMMLGMTVEIALGAIYFGSTAAFNAFSGVGVIFLTLSYACPIAVSFFFRRRSEIANARFNLGIIGSICNVVALGKSPPRSPTPQLTPPGQPTDGSTAWSLLAIPLFCMPTYKVVTLETMNYACVVFVGFTTIAGLWYLVWGYRNYDGPPKEGIDGVEADFPDLPAKSG

SEQ ID NO: 39243 - protein, 290 aa, A.fumigatus
HPLLPLHRARMKIAITGARGTVGRTTVKVCADAGHATVQVNRTEQPPGAIPNTEMRTADVAMNYQQTVEAFRGCDAVIHLAAIPNPVGKDEYAVHNNNVDSAFNGFRAAAEVGIKRFCYASSVNAIGLAFSNRPLHFDYFPIDEEAPQHPTDAYALAKREAEIQAQAFAEWFPGMKIACLRIHEVSSLERVQKVHANDWENAGVKQLWGWVNPVATARACLLAVEKCDNWEGCEVFNIVAPTTTQDLPSEKLARKHYPDAEIRADMSGNQGFWTTDKAKQLMGWEHYETE

SEQ ID NO: 39244 - protein, 68 aa, A.fumigatus
LATLSPFTRISCISLDRINYEVFHVKLNTFSPPRDKATSTLPSSLFTLSGITSPFRSSTILSVASGNL

SEQ ID NO: 39245 - protein, 111 aa, A.fumigatus
RVPGVTTNSAAGVRDYDEFFPVFAEMEKHDMVLNLHGEVPGSPGSGITDMNAEEKFLPTLTMLNEKFPKLRIILEHCSTEAALEAVRSCSSTVAGTLACPCLCYMRCGLTN

SEQ ID NO: 39246 - protein, 136 aa, A.fumigatus
AHAHSIPSSNALLIPSSGSDSAPHPRLAKQGGAEGTAKPPAGVFTQPCVVQYVLLALEEGVERGVIANEDITPEKLANFLSGYGRRFYKLPEATERIVLERKGEVIPESVKSEDGSVEVALSRGGEKVFSLTWKTS

SEQ ID NO: 39247 - protein, 94 aa, A.fumigatus
KPHTPPSYHISPRPASTPARSPRDSPTPRAASPRHSPSHSRGPFVPVPARTPRGSAGTRSSFRGTTPRRLEPGSPPRVSPGRTRPSDAGGLLRR

SEQ ID NO: 39248 - protein, 101 aa, A.fumigatus
GIQLEDRLLTSSAEMILKETTRLELPAAADMHVHLRQGKMMESVVPQIRNGGVDTVFVMVSAAGQLLTLTLTPTLTRPAQPGPPRHECCPGAGVQGPVAGH

SEQ ID NO: 39249 - protein, 63 aa, A.fumigatus
AVCLIAYACAYARLLCISLNVFRISFHASCAPFHTYTSLSAKRTAAAYRRTELRQILCSARWW

SEQ ID NO: 39250 - protein, 553 aa, A.fumigatus
SSECIQELTDMWNHRHDAAKPHLADFDTTLAEIGSLSVEFTRLAQLTKQDKYYDAIARITNELEKLQDHTMVPGLWPLKIDASGCRTAASQLNNEVPRNGVVDTEPSALSPTPVHTPAFSASPSMSSASPSTPPVPRSTLTPLLAQNERPLPTDAQSYAKFFARRDGGSLHIDAEPANYDAPNEGENSAVTSSSGDKACTGGLTASLYPKQKFGLGARGDSTYEYLPKEYMLLGGLNEQYPAMYKKALNAAREHLLFRPMVKDERDIRFLSTMTLTRPIAEQAPESVSATYEGTHLGCFAGGMFALGAKLFGIEGDLDLAAKLTNACVWAYGVTKTGIMPEHFLLVPCKKGEPCVWNETDYWNALDPNEEQRIAEAEKAIEQKSKASDSTKRSTTNGIRRRDSSGKWHVIADSAKTDDLINHDEDEVKKQDAKDKAVPHEIFVTQRIMNERLPPGVTRILNRAYLLRPEAIESVFYMFRITGDNYWREKGWEMFQAVSKYTRTEIAHSAINDVTLEKSKMQDTMESFWLAETLKYFYLLFADPSVVSLDDYVL

SEQ ID NO: 39251 - protein, 66 aa, A.fumigatus
LVFNEQFMISAHDPVVDKSSTPLTNKVIKVLAMHGNLYKTFGENIILLINREGTNLRDSCLAKQIP

SEQ ID NO: 39252 - protein, 413 aa, A.fumigatus
  UNSURE (407): Identity of amino acid sequences at the above locations are unknown.
RLLAETSLQLLTLKLLYLIFTTPSTYEYFYTNDLHVLVDILIRNLLDLPEEASALRHTYLRVLYPLLAHTQLKYPPHYKREELKKVLNILGRGQLSSGEGDLERILHFEEVDETTRRLVLRCATVEWLRNEESESHRESVASFDSTTDAVQTDAESGTPTSMEGSSPGALSPTRLCGSGSPKPDAHRKPSAVQRLGMHVEPASCSAISVQEVANQHEKPGVITPSRNDAHPTVNSSTTDTSATIKPKIKPEPPKSRRRRGRRIAEEEDNADKTPEGTASAASSPATASTSVTPLVDCGNSTSMSGLAPPVPAHLRRSASNPPPALPPPRRSSHPAVQAHPLSGNCSPLNSSPLNVPSVGKHGQKPEPPKARRWARGRHAHGDSADRSGKDMPMNGAILRVLAETGRXRTKQCV

SEQ ID NO: 39253 - protein, 387 aa, A.fumigatus
SHPYSRHSFIPLVEVLIFLIFFFFNFFFLLIFVASPHRRYRLPAMFRARRYRVSLVFAVIFVLIFIHFSRSRDTSASTVSIPAPVDQPKTYPQRPPPAAPDNKKPIAPESPSSHEPTSELVSTPAQQVEKPAAPDSNPPQDLASGAHGQASSKDVSVAGQTATSSSDNASAKGDGSEVPPYHLDYHGHARLEADLPETNRPTVHWKQVQEHYPLAPENLIKLPTGKSKALPKVQAAFRDETTSDKIQRVQRLSTIKAAFEHAWNGYKTSAMGHDEIKPLRGGFRDPFMGWAATLVDSLDTLWIMDLKDEFAIAVDQVKKIDFTTSKRDEIPVFETVIRYLGGLLGAYDISGHKYDVLLEKAVELADIVMGAFDTPNRMPTMFYKWTP

SEQ ID NO: 39254 - protein, 122 aa, A.fumigatus
SLSEKIQDYDCFYASVFEAEQPVLKSLPLAVQQKQIVVTCNYEARRRGLRKLQLIKEAKQICPDVVIVLGEDLTRFRNASKELYLFLQDFVWGKRVEKLGFDEVGVYPACAFRIWPHANDQS

SEQ ID NO: 39255 - protein, 485 aa, A.fumigatus
VFLDVSDMVTYNVEMLNRNDLKNSFFHLDRRDPTVGFTYDATDFHGHAYQAVPDVATDAASEWLRTRLLVASHLAAYLRNQLEYQKGYTATVGISTSKLLAKLVGNTHKPNSQTTLLPPYTVAEHGAKSNVLHFLDAHEIRKIPGIGSKIAHRIKSFLTTAVNGPGTEVGRTRDTRPHSDDHIVTIGDVRCFPGMGPFLLEKILGGPGSPRGIGARIWGLIHGVDNTEVLQARDLPTQISIEDSYGRLDTVNEVRKELVALTVSLIRRMRVDLTEMDPDVHSPAGEPAAADALNTKRQLRWVAHPRTLRLSTCPRPAPGSDQSQRHGLNRISRSAPLPSYVFNLDENADALAERLVQDLAMSMFRKLHPENTGWNLRVLNIAVTNMIESAGDQKNSSGRDIGKMFRKQEATQHDDPTPELAKITFSGIAQGDVDSKTVDSAEANSTWEESDEDGDTPCVACTICGMLIPHFAILAHKTYHTTLDD

SEQ ID NO: 39256 - protein, 630 aa, A.fumigatus
GFRPLVDGDEVSQKCSAICCQCTFTSICSGCRLVRITASTNLRQGWLIIIQFRTARSQEPSAIQHVSILEHAVINTPSHEVDHLTDFDVTFELPDKHQTIKLELEPNHDILADDAYVQYLDAEGNVHREEPIQRHEHKVFKGRSLLRRDNGLWRPVGWARVYVQRDGSKPLFEGVFSIDNDNHHVELKSTYLQKKRVEDASIPDRKDEYMVVYRDSDMIRQVRSELKRSLISSSSCQAEKLGFNSDPQHPIFRSEFQDMDLGMSSYGSMSLNSLFGLSKRQSDIGGVSGNAGGVNLAQTIGSTSGCPKTKQVALVGIAADCSFRASFDNDDAAKQWIINVVNSASDVYEKSFNISIGLRNLTMTDKTCPETAPASTQWNMPCDQSNITQRLNLFSQWRGQQSDDNAYWTLMSNCPTGSEVGLAWLGQLCNTEVTGDGSNSVSGTNVVVRVSGGGWQVFAHESGHTFGAVHDCDSMTCAQNLEASSQCCPYNRGTCDANGKYIMNPSTGADITAFSPCTIGNICSALGRNSVKSSCLSDNRNVVTYTGSQCGNGIVEAGEDCDCGGESSCGDNPCCDAKTCKFKSGAVCDDANDSCCSQCQFSPAGTVCRASLGECDLQETCTGNSSTCPA

SEQ ID NO: 39257 - protein, 153 aa, A.fumigatus
SYGVFLSYYLSHDVFPNTSALSYAFTGGLSISCALLVAPLATHLIHLFGTRFVLNLGVFFETLSLIGSSFATQKWHIFLSQGVCFGWGMGFLFVGSVGITPQWFQRRISLAMGINAAGSGLGGLIWSLAVGAMIPRDWSKVGHSRVLGILRLR

SEQ ID NO: 39258 - protein, 468 aa, A.fumigatus
HLWNWHRDYRELIGDLSPANYLKDLRTNRPVRPSGSRPIPSRATGSVATPREALPPRASSSMSMYGQPGPQPTSPERERPRASSSLSTHRPFEPHVSLGSSAGRPLVQEPRMVPIRKNVSPSHVFSRPSPPSPNAVYRESGQRRVEKEEARSLRDALQELDLHDEIRLHQAAQDEATELVWMHQNPGVPYKNPYAPYHNPDLDRSSQTPKSAGRSQNQSDKIGGPMDNHRSTSESSSDSHFADSGGIGLGVKHDRQPQHGLEDSGSSPTKSPSPRKNVRVDFALPAEESPSKSRGGGNSCLSRFGNESSRGIFRNPRDSIYEEPKDTRGPEEDERPAFSRSDSSALRAKPRNALPRGSRPLPGRLSSLPFVDKLARFELHKQHPTQSRNPDYRTNDPHPQAAPDGNADKEQADQGVRTKNGLEIRSEEIRAATSKKLKDRSTRLPMPTAVSNRVGPANREFRPVLEAH

SEQ ID NO: 39259 - protein, 225 aa, A.fumigatus
LRQGVVARSLHSIHTRAVTRFQLHSFFTSYRRNQKSSLAYQNRYTSAQHRPAYSQSYFPSQYRVSIAACTSQTSVLSINSAINMHFTKALLFTAAAVAPFASAAAQAEPTTTITVKMMSVGASSTPTPSPSSSSSSAVGATPSGSSSPSIRPTGGIYLPSSGRWNSTSSSIVKVTVPATVSGPSQTNAAASAASSAPSQGGAATSINFSGPLTAVAMALVGFALF

SEQ ID NO: 39260 - protein, 71 aa, A.fumigatus
FMSVYTLNLSFKKLWPLASCLVSSRFRYSLHPIPLDFFVMIDGTDGSTMSPVPIILEVLKYPYGAYRGIAG

SEQ ID NO: 39261 - protein, 201 aa, A.fumigatus
AVVKLPVIFIDIETNSRSVRSSGGRTGGSSRPGSTSSSNRIGGAYYAGGATSTYKAGTRSPLGVTPFLLPVAALAIFPGIWLYGAYAYPYSHRYNYTNETSRQNESLPVVCLCQEYSDCGCDDNNNSTYYQSLFNGTQPVNSSIAKVVNANGTETIYINGTVPNATDSTSSSTSSAPATALLEASGYWVMVALVASMVWAL

SEQ ID NO: 39262 - protein, 120 aa, A.fumigatus
  UNSURE (10): Identity of amino acid sequences at the above locations are unknown.
LIPMWDWFGXFHPGLGHHVSSHEWEETLPQLLETKVPIITTGYTQWDMERDINWVREKCAGEFDILLEPGENIFRSLRWDLNDLDPHDVSCGNWGLWAFRGKRYVMTVPISETLANFSPA

SEQ ID NO: 39263 - protein, 662 aa, A.fumigatus
SSLAAPSSLQETFIKIHFGNVSKNPKKVPRISLRSKALLFELEDDAFEWKLGCIYRTGLLEQRQRLAREEAFELKVQKIRESGQRRAPSRLRTRSSHRTLRSERTSHDTKRSKSADPKPRGHATETKGGRGRRFRYDTEGSACLSTDSKISEEKAWLRLQEHNARSWKQKIDAAFRFQGSSIKEIRNLFSGADEPPDDATVTEKILAIPNRPGIMSALITDLSLVIDKPSFPIEEFPSFLHRLGKGIPLSTQYALLIPMSFHLNMGESRVNLRDYPLDLLHIPALRPGQSPRLSSWSLRTDFVIAEEYRDYRSSRKVQLELVPSTELSDGTTSPPFLIDVWRSVSPVKTYSDPTIEINTSLPTSISWGMSYQPVIQDMMKIIEGFTKTEIDPSERVGFWDKIRLSFHSRIRVLWKEDGDVHLRLKGSRDPYVVTGFGGGFVMCWKKDVKWEIHTSDDPKEFMSVTSGEYVLAIPDYSNEARYAQEATAHDLESTSSSSDFKNATLFKKVVMKLSGDVRLVAGLVFERNIDGDKRSFEFKPHYDVVLRNPEFIDPEERKVHTINISVIFLSNLSSQDYDAYRGFRSNHIHLSISVVAPVSRNWDVDHVQPLSSYNAVQLSPRVFTHFLTWWALILGGMSFPSRQGPLWAWFHQNQQEVHSAPW

SEQ ID NO: 39264 - protein, 982 aa, A.fumigatus
  UNSURE (923),(926),(963): Identity of amino acid sequences at the above locations are unknown.
SRDAMTLFNPTTVLVGFLLLYLSSFLIFAIVRIATGVSIQRIGYFSLRRIAYVPREGIQVELRGLGLSLHPPSFAQPTWLSLRLTELKVTVNPSALGKGRNSDTAKADVPEPQSSSDVADTSQDGGESSPARARRSKTWKTLTRMKEQVKRLHRKIHWLKLVDVVAVNTTINFLEAGQFQIGSLSLAVDTRRKMVDRAKVFRRKKDESGELCPAEWIMNVQNVLLAVDGNEPAEVLDHVQVNIHGLLHSDRDGLRDTSIALKIGRLHIPYDELATVSQRIKQFRRSRKDLVVNDTDDEISFADFVEELDRPGSRDDVIVQRVADSKEFASSLLRGIREIQLALSFFRLSRIVQPSSAGQKSVYLNVISHEIGVDLHRMDQRSPAHRMYFQRDDVAHQALLAAISLSVSLDDSSGETDNIVYIPMATTTIKTTLPSKTVGSFDNHNAEERNTNILFANFVVTSPSLDLEPHHLDRLLGLVQTRASSSRGKKRDNHRLISRLLPKANIKLSVHEPVVRLVLPINKESAGSDDDYNLLISSISAIALDIDSSHSSEGGVHYLLSSVYRVADHKLYYQTPTGVKHILLTTETLELKVLLNESPEVCVIATGTLNTCSVHMVNGEVNRGIRQVVEQLRAQMQNRRRASMGHQERKPSILRRIPPWLLNFQFEATGLSLEIAGVDSTVSKLSRGVSLQLQSWTAEYRAQKAEPTHISLVRRRTPSHSTIGDESPFRFPPTSPPRQIQHGAADGRRLAFHARGFEGFVIESEDYLEPEPFFSLPRFEVALSTQSDRLGPIFHINSVLKGVYLQYSLYRYYCLGVAVSVIQDAFIQHPTEAPTQPPFEWHPKDSASSPSVPRPPLQRSELITVDIRATVVQIKTFLPADPPMLLQIYGLAAGSHRLSSPYVKAQLIRLHAEAPKLKGVWAXIIXMNNVKADLRKFKLKQGSNLFEEKSINVWADFIRIGVXHHMIMHRVFDNWVNTAKAL

SEQ ID NO: 39265 - protein, 80 aa, A.fumigatus
KMVPRKRSYARFTTMKTATSANEGPHFAVPSADVVEATGAKNTSLCTLQATINRQQATVRFVIKSSPHPYELLSSVDDAD

SEQ ID NO: 39266 - protein, 136 aa, A.fumigatus
LNRDNDFRSKIISPSSIFANANLYRTTMSCHQHIPRDQDGIPGSPLSTKSRVLEGGASMVQDFTPVKQICAHLNAFHVYASDQTRAVEANHYCTHVTEGLDSSLPSARERQLISKRRSQAVYDIRIHQAECPVDRR

SEQ ID NO: 39267 - protein, 182 aa, A.fumigatus
PGKVQQAQSGETTFMAAVKSSTRKRAPVGRVLATKSLQFDGGGGVAFGPHPRDFATSLPRKIYDQAWRIALSYRYKRGQLIIIDNEISIPEGATPHLIKEIFKVNCWGREFGRSTLITDQLNEGLFETVREVGEHAKILNRKDVDVKDLLETGRLVIEKQALDRILSQHSRDLVNKPATAVY

SEQ ID NO: 39268 - protein, 182 aa, A.fumigatus
SQNADLRQCMIYESTKPNARLIGVEYMISPRLFETLPSEERKLWHTHEFEVKSGMLIMPAPAGVPKPAWEAAETSEMREVILLYGKTYHFWQADRGDPLPLGAPQLMASFTSEDKVKLVHPKGLDGLLAGRDEAFGVDYKVKAEKRKDIEPPNLSPGKHFGACLRSSIIADNCHRCRHHGVE

SEQ ID NO: 39269 - protein, 131 aa, A.fumigatus
SRYALTIPMERLFRSALRNATPGAVFRLTLDGLGLFCACTLVWEHLLTVQLSEGTSMYPTFNPRGDYLMISRVHKYGRGIEVGDVVRFYHPTFLGVNGAKRVLGMPGDFVCRDLPFSTEVGTSREMIQVGV

SEQ ID NO: 39270 - protein, 73 aa, A.fumigatus
MSTAPELPKELPGDEPDDVLFSSLYGVRLIELNRPKKLNSLNGSMARKILPRLKVSDSDPAVCDNVLVAKPVE

SEQ ID NO: 39271 - protein, 310 aa, A.fumigatus
EWEKSQLANIVMLSGAGTKALCAGGDVASLALQNEQGPEGQQKSTDFFGLEYRLDHIIATYTKPFISVMDGITMGGGVGLSVHAPFRIATERTVFAMPETTIGFFPDVGGSFFLPRLDGEIGTYLALTSERLNGVQALYAGIATHYFHSSVLSNLTARLAELVFRDHASLAERLDLVNKTMAEFSVGLPPVEQEPIQLAGSLRSAIDRCFKHNTVEEIFRALEQETVHKEWAQKTLETLSSRSPTSLKVTLRQMRVGKKWSISETFQREYQIAAQFMKHPDFVEGVKARLMSKPPRQATWQPATLEGSHQ

SEQ ID NO: 39272 - protein, 84 aa, A.fumigatus
ISCLPLVVKNGPPKAQLCQIYYHEDCYQRQRRPTFRCPQRRCSRSYRRKEHLTLHSASHNQSPAGDCPFCDKVFSTSLRAALVC

SEQ ID NO: 39273 - protein, 203 aa, A.fumigatus
KRCLATPLSRSMTTEAQHTTDFLTRESVTGPRPVWDTPAKATTYSFPSMEPLRVVEYPRNHLLMPLRKDILHRAVVYEGDMTRQGTASTKWRDDVHGSGKKLYAQKGTGRARVGDKKSPIRRRRRCRFWSSPSRLCYKSSQEDLRPGLADSPELPVQARPADYHRQRNFDSRGCHTAPYQGDLQGQLLGPRIWTLNINHRPAE

SEQ ID NO: 39274 - protein, 137 aa, A.fumigatus
  UNSURE (88),(89),(90),(93),(94),(95),(100),(104): Identity of amino acid sequences at the above locations are unknown.
CRSPLAKLHGSPLPWKEVTNDAVDAFFKLPADKSRLTLFNKTDYKQYPHAYGLPSEAEIEKFVRDSSESASKTVADFVEKWGHKEGVXXXGCXXXGSTNXANSXRSAMGVNSEVQKSQWINSMLSLLHMGCFFHSPC

SEQ ID NO: 39275 - protein, 244 aa, A.fumigatus
TASLGDMTKPIYRFLADRKWREYRRKILVQRITQMKVIPDVLPHCDPVVDTKLYFGRHTIQPGEFVNSRVSSTPPKLNIQLFEAGEKLVTIAVVDPDVPNVEKDGFDYKMHYLAVNVPISATSTKVDLANLSADSQVVLPWLPPVAQKGSPYHRLSIFIMEQKDSAPLNFSLVKGMETSRDVLLRTLQARYHLKAIGAHLFRTQWDENMLEVMREIGFPDADVELRRKRVEPLPYKRRNPSTFR

SEQ ID NO: 39276 - protein, 461 aa, A.fumigatus
NDLRDLRYGPSCGVAFVHRCCPLLHSSSEVSEEKAYASLRRSGCTMLTENASVARDLIFRTLVKPFEHDYAQILKRYQIHRNELQIVALAAMERNARKERELAEIARDAAEKERVAAENERKEAAAERQRAEQAREDLREEIKRQEAHRKEASRARKEVREETKNQEVHRMVVQGQLKGKIRTLVRGNPTADTSHLVGLESDSMMRWLDPPDYESMLSQMVRQRHEDTVLWIEKHPKYLSWRQYANWARDILWIYGGPGMGKTILSATIVEDLRRLHITQSPRQTTKRYAVCFFFFDSSNFFEQPEVVMLRALVAQLLHQVDKPDPLNQIYLARRSAHASLTELREAFSTLVSDCSGVYVVIDGLDDAANASDALQLLLMLLVQVSPVMKLLVTSRPEPDIRRFFHSHPQFELTEDITQPDVRRVVTTRVQSACEDKKIRVSDPNLRQEIVDALVSSSSGV

SEQ ID NO: 39277 - protein, 189 aa, A.fumigatus
LIIPDLKYDDFKFVPTPSGNQIYGQPSQAGHPGFWDRLDTNTHIPQPTNLLEPGQIQLTGLAQRTRHITGIIAAPASTSTSDGPTSTFTFTKKTILQLPPSTHLHQNAVRVLQRTNDYLVILLFQDGPVHLKNTKTRGSASTNDTETENLVKPILIPVDAKELASRPVSPLKAGDVDDIHPLLTISQES

SEQ ID NO: 39278 - protein, 836 aa, A.fumigatus
LRSVSGFQHNVHSVNGADEQLSARFLWATMQVKHLQTLRVQTDRTLRAAVRNLPSGVADIYGRILAKINSYAEEDRLLAEELLRWVVCARRPLNVSELCCALAIDIGDEELNLDNVPTNTSEIVDACSPLLSIGDKGTVSLVHSTVAQFLLDPSNKASVPMGTDRYFIEQTDAHTMLAEKCISYLSLLSFRNRISGTQTLAKITHEEIHAFPLLEYAALTWWKHVAHSAVSKASAKRLVDLMFNFAKSSQGLTWLEVSITLSRSLEHLHTISMQLRAWFRRLEFKHAHIDELKLWLDGLVDLTRVWDSILRDSPFELRSTVKKFSTEGQFFQKHFGSDFIGEIGPPPASLPRINTNPTVAEGNAFDILVDDEEGYVLHPSGKLRFQFTWDIMQSNGTNSLRYTIYAESPITRRHFKTVEFAHEIPWKLPQGFHLGLHSVAFSPDWVYLAIATVESVRGLPTGRRYQGKTTIRVFLWRMRDLDEAGEELLFDLPWIIPTRSSDGNVYSGYVGQAQYDAFRGSRCAVAFHRIKSTLYLQTPFGAVDVETGTSLEHSRYLQSVVTQPTVTQCTFSPDGRRIAMVRNHTDFEIANIDGSNVCATKLVGEICEILSISRTGRYVAICLNQPATSSQLTQSRLVVLDTVTSTIQVLLTGTQERRFDEVSFKLRGWLSWSQWAAQGRYMKFMPKGLAPVRPDRHCIQVYSVFNWLVGGASSELYIEPDIDHLLDPQEQRWDLVQPAAVRRELPLSSSATYLFSDRTIRLSDSSFVLSVGFSPEDEHCCILTSKQTVLLPSSLQSSPLTSVPPTADKQQKTTYQTYTRLFDHNRKLGCFQLAYQ

SEQ ID NO: 39279 - protein, 247 aa, A.fumigatus
VGPPCSFGNPLTCRSGTQGRWMDYLDYKTHNIAQSITARVYIWDLCGTPRLVRDQLLQLDEVEINLLRYEQYRRLDVAFHPASDRMAIFNVVYNLDLITSSSMEYQIYHETNKFHPDIAAGRTNNTWQVSFSPDGRYIAFAVTASTRTPGLFGKRGEITNAVVLFETDKPSTPLCSQISSHKGDTLAMGSCSVTFHPTDRKLLWTSSFVFTDATTKTTTKLLDFSLKPYETTFITGKFSALHQSGPN

SEQ ID NO: 39280 - protein, 86 aa, A.fumigatus
TTATLSISMLPLVQDGLQIGIERIEPTAFIPQYLIVLDQPLLDILPKVLLSFQVCVLTLKAFDETLGLNQIFSSLLGPQVLSVGVL

SEQ ID NO: 39281 - protein, 243 aa, A.fumigatus
TMDPRTSQARPDTHLKPPNPHQRASPSSSTSPSPTPRAPVAAHNTATVAESVTFQGTHPISVGAGTVIHPRARIYSYDGPVIIGEGCIISEKSTIGIPPSTPTSLPPTPKEVVPIRISNGVTIGPLVTVFPGAHIHSFVTVESLAIINRRVSLGAHSKVCSGCEVAANTVIKDWTVVWGSGAGSCQRRKRATGKMSSSVVAGQDLSAPDAKVVEDARLIVLQKEREVVARLIGSSASAGGRRK

SEQ ID NO: 39282 - protein, 1376 aa, A.fumigatus
  UNSURE (854),(878): Identity of amino acid sequences at the above locations are unknown.
KERDTFRSMLTRRRQTVGDGSAFSQSLLLGAVPPNVDDQGRDVPDYAELLRKVQAHFDSFREESATDHAALKQQVNELTRKNSELLSEISRSSSQLGAATQRAELLQSNFNMLKNENAELQKRYAALLENANRQDLRTQQAAEDLVETKGLVESLQRENANLKAEKDLWKNIEKRLIEDNEVLRNERSRLDSLNANLQTILNEREHTDAESRRRLQLSVESLESELQSTKRKLNSEVEESKKAALRREYEHEQSQKRIDDLVASLSSVREELVATKTTRDHLQTRVDELTVELRSAEERLQVVQSRPSIAAAPAEAAAAAEEGVPDTGLTREQELGIQVSELKRDLELAKGELEHAKEQVEVYKTISQETEERLQSVTETQEQYREETERLVEEKEKKIQDLEARIEEISSELSTTNNELSKLRDEQGEAGRRLEEQKAALEAEITRLKEENERQIAAAQFHQDDLKAQAEIAQRAQQNYESELLKHAEAAKNLQAVRAEVNQLKLELVESRTQADTYKKDLAQKEESWSELKERYESELTELQKRREEVLHQNNLLHTQLEGISSQIAALQKDRANIPESEQDEGTTAPNLEGLQEVIKFLRREKEIVDVQYHLSTQEAKRLRQQLDYTQSQLDEARLKLEQQRRAAADSEHTALSHNKLMETLNELNLFRESSVTLRNQVKQAETALAEKSTRVDELLRQIEPLETRIRELENVVETKDGEMKLLQADRDRWQQRTQNILQKYDRVDPAEMEGLKEKLASLEKERDEAISARDTLQAQAATFPEQLKHAEDRTQELRTKLTEQFKARSKELTGRINAKQLELNAVIQEKEVIQEELNTTKNELSELKTKMAXSPSPSSAPAPAPTAPTVEQTPGVXSTPASQFPTPTSMPSDDERVKTLEEKVRRLEAALAEKDAALAAKDAEYETKANERVEKLKETYNKKMAEVRAAHRQEVERLSANQQVAPQEPGTPVSKPEQTPATPSQQDGDLPELTDVQARALVAKNETIQTIVRNNIRAKVAKETEKLKQECAELEKKFNEEKEALKKAYEESTDEKVKSAVELSDKKTLVRISMLDTRLRTAQAKLDVIAKAAAETPQRPVVEVWEVAKTTKAPPVQAQGAKPTATAPSAPTAPTAAPAPAQVATVPPPSSVAAPTAKAESQDQQAAAPAPAQQTTAAPPTSSVPDEAQPQADAQAQQPQQEAGPAQKPASNQPANAVAQSQNKQQPSSLPSKPPAGGVLRALQSGLPVARGGRGGARGGSHQQNPFGPQPTDQQQPQQQQQAQTQQSQRGTGLQRGRGGRGGAGRGGHQNVQASNAPQGQNPSSPGGRGGLNVQARQFVPQGSKRAREDGGEAGNEAGASGGKRMRGGGHARGS

SEQ ID NO: 39283 - protein, 85 aa, A.fumigatus
TRRHVHVNRTKEALINGGAYHFSHQEDHFLLPPADADDPMSLATTSLSFCNTIKRASSTTLASGADKSCPATTDELIFPVARFLL

SEQ ID NO: 39284 - protein, 278 aa, A.fumigatus
SLARLKSIAYVPLPTCRPKMFLLTIVAVSSFLVLLLYKILISPYFLSPLSKIPNAHFTAPISDYWIERKRRSGEEVLTIYNLHREHGPVVRLGPNELSVNSLGGLHVIYTGAFEKHSFYRDTFVNFLTDNLVGMLPNDSHARQKRMLSKIYSKSYLHESVDLRNASSIILSQRLLPMLKNAAEKGEAINVLPLFQAVGMDFTSAFLFGTANSTTFLFDLPGWKRWLVEYERFKTLSGKERYLGFIERWCLSLCSRVQSNEHPNDVPVATNPVVYSSLR

SEQ ID NO: 39285 - protein, 209 aa, A.fumigatus
TLEKHPDQRPLDLALASELLDHLVAGHETSGITFVYMMWELSKRPRLQAELRQELLTLSPSLRYPLVELGDGSLPLLPSPAAIDSLPLLDAVVRETLRVHSPAPAPLPRITPSSSEGIAIEGYDRIPGGVKVSSSSYTLHRISEVYPQPFEWLPERWLDPGPGKIHDMRRLFWPFGSGGRMCLGSNFALQGTAPFRSLPFLAAYSESAS

SEQ ID NO: 39286 - protein, 64 aa, A.fumigatus
KVAPVRLRQILHQALFKRVNEIIDRATCDCKEQTIFGCLKELRRINVSPLDLSSSKASVAQMLD

SEQ ID NO: 39287 - protein, 124 aa, A.fumigatus
RHGTIFMQDSGHILFDNLGCGTKRRQMLDEQIKTGERSFRDVSEEMWGSLRVPFEDGFEVMEKELEIDPGFQEFHEFCIANGIDFNVISAGLKPILRRVLETFLGEQTVSHSPLSAAWMMSLID

SEQ ID NO: 39288 - protein, 103 aa, A.fumigatus
  UNSURE (103): Identity of amino acid sequences at the above locations are unknown.
PSIRCLDDVVDRLVKSSIQIVANDADIKSDGSEWKPIWRHDTELGHDKALSVQEGRAEAAKYCIDGQIPLIVFIGDGVSDLPAAREADVLFARKGLPLEEYWX

SEQ ID NO: 39289 - protein, 473 aa, A.fumigatus
FPNYSPICGPLVKTLSRPELDAYFPPPLTRFCSPMVTDQSIKLSYNDTTADMYSYANHNCGPLNWPSTTKLHEITWYENTFLPKIREYFKGDLVWTRGTVAKQADDSQRYWVIVNKNIYDLTDYFYTLDRMNNQDTYNFLPKSVTDLFKNYPGTDVTDKWGDSEDFKKSQICLDYVFYKGKVDFRDTPRCTVNNWILLAFTILICSVVLVKFLAALQLGSKRRPAPQDKFVICLVPAYTEGEDALRKGLDSLTALQYDNKRKLIFVICDGMIVGGGNDRPTPKIVLDILGVDPKIDPPALPFKSLGQGSDQLNYGKVYSGLYEYEGNVVPYIVVVKVGKESEQNRPKPGNRGKRDSQILLLNFLNRVHHRSPMSPLELEMFHQINNIIGVDPELYEYCLMVDADTSVREDSLNRLVAACANDARIAGICGETSLQNEERSWWTMIQVYEYYISHHLAKAFESLFGSVTCLPGW

SEQ ID NO: 39290 - protein, 466 aa, A.fumigatus
HVFRGGKCDRSMTLVSSQFTDALVSFCMYRLRTADKGRPLIISDKVIEEYADNDVDTLHKKNLLSLGEDRFLTTLMTKHFPTMSYKFIPDAYASTAAPETWSVLLSQRRRWINSTIHNLVELAALKDLCGFCCFSMRFVVLVDLIGTLILPATCVYIGYLIYRVASHTGPFPYISLAILAGVYGLQAIIFIVKRQWQHIGWMIIYILAFPIYNFILPLYAFWKQDDFSWGSTRIVLGEKGTKRVVAVEDEAFDPRSIPLQRWDDYALANNLPGRRGDYGVSQEKMYSRYGDEAVMEMDDLHSTYSSVKPASTILTGFPQGRHSSPYMPPQSPAPFGGNIPGNRNSHLSSFTRYTDNPHQRNMSMGNLSHYQDSPMGMSRHSVGLMQSTDNLLGVARQNSRSPLGGGLNSRPVSAFDFRTGGTGPDEGAITEAIRSCLAEVDLDTVTKKQGQFFSPYIKWYSSLIAS

SEQ ID NO: 39291 - protein, 168 aa, A.fumigatus
PTMSTQPPPPQQQQQSPTSSPTLSQRTLEAKAAFTASLRSVGANYDAELRDRARTLHGNAAALDKQEAELRRTTAELRRQNEQWERVADTAREGLKEIGDVQNWAELIERDLLIVEEMLREVEAREEGVGEEAEEEGEEGRMMIDGKGKGKGNGKGEEEGKGGWLRWW

SEQ ID NO: 39292 - protein, 141 aa, A.fumigatus
NTSSRTWYLTQEAKLKNHHHLSHPPFPSSSPLPFPFPFPFPSIIIRPSSPSSSASSPTPSSLASTSLNISSTINKSLSINSAQFCTSPISLRPSRAVSATLSHCSFCRRSSAVVRRSSASCLSSAAAFPCSVRARSRSSAS

SEQ ID NO: 39293 - protein, 285 aa, A.fumigatus
PHSRSFGALCEDERLSLTVTKDDFARMRIIGQFNLGFILATRPSEDGSADSKDELFIIDQHASDEKFNFERLQAETVVQNQRLVQPKRLDLTAVEEEIVIENRAALEKNGFVVEVDDSGNEPIGQRCKLISLPLSKEVVFGVRDLEELIVLLSEMPATDSRGSAMQTHIPRPSKVRKMFAMRACRSSIMIGKSLTQTQMVRVVRNMGTIDKPWNCPHGRPTMRHLMTLGQWDEWDEYGYDNEEEDEESGRIEVDRLDVWRNYYQEMGEMSAEEEDAAEADEEAEI

SEQ ID NO: 39294 - protein, 355 aa, A.fumigatus
ILARDPQQVVRTLHKSHAVPTHAHRAILVVAEVAHGHIPLVWVVGISGKARKVRVAVARNVSAKWSWRLRWHVRTRVPALGKSGKDGRCRLHRGIGGMKIIHLHDCLVSVPAVHLLLADAIIAATAWKVVRQGVIIPALERNAPRIECFILHCYNSLRALLPKDNTGTAPAEVVLFPECIQGQDKVVDWEGQDVDNHPPNMLPLPFDDENDGLETVHTCQDSEGDIWKWASVTGDTVDQVPYVDAGRRKDEGSNQVDQYHKSHAETAEATQVLQSRKLNQIVNRRVDPPTSLREKDRPSLRGGGTGIGIRNELVGHSWEVLRHESGEETIFTQRQQVLLVQGVYIVVRIFFNDFV

SEQ ID NO: 39295 - protein, 1367 aa, A.fumigatus
LGGLQYRWLLTSNFLLCSNAPGAFFHSGHSSIDSTNESTRSTNSRVSLRSTSMGNLAKSDYNHTPPDQTDFLAPVSFDDFHNSIMAEPSLNHFPMPGTAVSNHTGSPLSGPFTRNPWADNDEPSFASRSRSNSVRRKSEVSHLSSQNSSAESVASRLPASNTAARSRRQSLVQNSAAKAPAPRAPRKSIGPGSIAAATSARRQSVSARKASVDTSPADHASLRPHAQNPDSSGLDKTRLPSNVRNMKAKSLQPPSREPGDHLLTASGLTDHSRSCSTNAVRTPIKNPAGSATTPASSAKRVSVMAPHATGLGARTISPTDARRMKRISTAPQAPPLPYTPPTKQDTLPVRPRSCAQSPSSLPRKSVTPSSTRTTPDPSRRSYSSGLSLSSNTSYSFTRNSGSSLQTRFAQNQSSSRLPTPKPRAEHMGGNNEEVPPVPAIPKAYESPKGDGDFHTYFASRKSSLPLDIGLPKPKADHDAEPKQAIRGNDKKTTDHPAERAMKTPDAKTPASNFGKKNLQPLKLPPLNLLPLSTPVASKIEALKDREDDGQSYTPSGQAVSKTPSTPMTASKANFSFRDEDDTMGFTHARSSTSHFVLSTSTVAPLRTASSSSALASFDNNTTGGARTISPYVSYTLPKSSSDFSNLQQKANTSGDYSPRISQAYKLTGPRPQTQSSAFSSNAETISQLSTPSDPDNNSVPGSSIFNKVTLTGKRSDSKSQRSTGADLDPAKQMPPPRLPASATWNNLSTVKGSSPTLKPAYVQARRQSSISGTSVSTMRNQSVSSEQSLALEPSVSNESGESNTASLRPGSSVFSPMHKMINSAKSSTAATPRQQHESNPDSDILAADEEMRRLASKRKDFETAARNLDELRRKAGPKERVSPAQALKMANLNIFERGEIIDFKDIYFCGTQNAKKHVGDLNAQAANFGYDDDRGDYNIVIGDHLAYRYEVLDVLGKGSFGQVVRCIDHKTGALVAVKIIRNKKRFHQQALIEVNLLQKLKEWDPHRRHSVVNFTQSFYFRGHLCISTELLGMNLYEFIKAHDFKGFSLKLIRRFTKQILGTLTLLHTKKVIHCDLKPENILLVHPMSSEIRVIDFGSSCFENEKVYTYIQSRFYRSPEVILGMSYGMPIDMWSLGCILAELYSGYPIFPGENEQEQLACIMEVFGPPEKHLIEKSTRKKLFFDSLGKPRLTVSSKGRRRRPSSKDLKQVLKCDDDAFLDFISRCLRWDPARRLTPHDALRHEFITGIKPASRSRSYGMASLSNKRATTLSNPTARPLPEPPGTSLKNGTFIRSRDISGSSPVKATAVGKRHSTVSGLQPSTPAKRGTTVPSMPGSALPRVAARSISGKPDLATAAAATSLVSNLAE

SEQ ID NO: 39296 - protein, 153 aa, A.fumigatus
YRFFRSGSRNNQSPRTESFPAQHVPCKCLAGHLQYHRSTPAHINPAHLLANPTALTEPYSVDTLFTRNTPQCFTISPSFTGTLPFAGDLPLSWVYSRPAASTATSLAATTIVAALFTSLSLSASAATTTTAASAFSAQRAQARRRSSRARPIQ

SEQ ID NO: 39297 - protein, 708 aa, A.fumigatus
FLGSSFLFSFCLLSIMSADPPENGWPSKEDESLSSIDSNARPRRASATTRRSRRKKDDDADVTQKNLARSKPQKDNNNNNNSKDGAKDAKEKSKPRGSRRQREKSTSTNPNNSTATPASSSNSINDNPSTTAPLDQNSSNNSRKKPKLEPTPPDEIPKSISVSSITTPSAPAPALASTTPTTSTGRSPHLTASSALHLHQPPQHEHPHQQQHQHQLNPSSSLPPYSNSIPTHAPSPAYAMNHQSLPPPRPQSQPPPPAPPQRRSGQNYDPIRSAFDTASSAPAPATTSPPAQNPSPRSTFRASASPAISSIIDPPQPTSTQHIYSPIPRPSPSHIPSTLSSPGIHPNASQSAHPSLAPSPLPATSPSHGSILAPQHPLPLASQPQQSSPPYSHRSPYPPQQQLPQPQPPRSPRNEHKPVAAAPEPVPSSEAPPKSPPKQEAEPPVPPTKQALTKLASPPEEPAAMDVDTDEPAQPNAEAKAPKKEKGSTATTATAPSSNAASPKPARPVKEAAPPLPQGSGLISNALFGTDDTRSSGSSRTSPNIILHIPLQRDGNQIINFARMAEEQYGFAALHPRLAAHKERLARVAAAGAALERNEKGGKGLSAGESADEDLSLDVDRDSDLDGDVAMGGVGVNAAAATNGATGTDASDGKKKRRKKKMEEYDRDDPFVDDSELAWQEHAAASKDGFFVYSGPLVPEGEKVQVER

SEQ ID NO: 39298 - protein, 77 aa, A.fumigatus
APSRPHLLLLLRSRQRRRRRQLAALRTSQPHPHYTSTNLLSMSTRTSNSTSTSSIPHPLSLPTRIRSRLMRRPPLMR

SEQ ID NO: 39299 - protein, 141 aa, A.fumigatus
PRSHNNRRRPIHIALPIRLSSNYHNRSLRVLRATSTSPSPQLQSPSHPVRHPRNRLRSRRQSHPFRLRNRPSPNSPLPQRSQPRWMWIRMNLLSPMQKPRLPRKKKDQLPPLPPPLPPTRHRRSPRVLSRKRPPPYPRAPG

SEQ ID NO: 39300 - protein, 139 aa, A.fumigatus
QLLTMIDRADGTIKRGRGRGRGGRSRGGSSTHQVPIAAAVPISQETGLPLRGPGSRGGSTTRRLRPSKPRQQAEQDKQGASSATSQGRGGGQAGRGGGAAGTRGGKTPSMLELAPAPRPSLAPAPPGPSPLAGPELVSK

SEQ ID NO: 39301 - protein, 195 aa, A.fumigatus
LQRIYRSLDRISKDFGPVRVDVLGKITESVLAGLVYLYEAHRIMHRDIKPSNILVNSRGNIKLCDFGVATETVNSIADTFVGTSTYMAPERIQGGAYTVRSDVWSVGLTVMELAVGRFPFDTSDSSAGDRASAGPMGILDLLQQIVHEPAPKLPKSDAFPPILHEFVAKCLLKKPEERPTPRELYVSPCLLACRF

SEQ ID NO: 39302 - protein, 79 aa, A.fumigatus
LQIIRVDAKENVRKQILRELQVGHDCNSPHIVTFYGAFQNEARDIVLCMEYMDCGYVSHKESSKPGNAIFSRTLTPADI

SEQ ID NO: 39303 - protein, 168 aa, A.fumigatus
TDNSAFIIPIGLHNPQTPSHTIINYIMPPYTRTMMGTSLYIIEKQSLDFASAEKPVMRQEGHFDTSSGPASGLGPGGAGAKLGRGAGASSSIDGVFPPRVPAAPPPRPACPPPRPCDVAEEAPCLSCSACCRGLLGRRRRVVLPPRDPGPRSGRPVSWEMGTAAAIGT

SEQ ID NO: 39304 - protein, 80 aa, A.fumigatus
PYDLTDMSCAYFSALMYYYSSYSLYSRTFPRWLLSALFMSKEFRCSLYSYGVRWAFGFLLSYRGSVPKCHRFMMELIIYE

SEQ ID NO: 39305 - protein, 96 aa, A.fumigatus
FLCCGYKFPKAQWDDSLRAVHDGNLWCSGGITNGHDLIAMYLRTIVAEPLVKTILGMSDVPQRSLKYDSAPTTDNLFFLWQVLRALPSMLFRSIKA

SEQ ID NO: 39306 - protein, 61 aa, A.fumigatus
IPTFCQFHLNLARVWTLDAIHSRVSEELGAIIAPRSITPPKAIYPSHKLLLTPFRPKSLTD

SEQ ID NO: 39307 - protein, 169 aa, A.fumigatus
GSSLCFRFQGADILDPSGHYDILYRLEPTVNMEPVVNYQFGMTTNYSPWDQGALSFDVNSSLMSIPGLMMDPSFGLAPPAPAAISPAMSPAPPSPYRVSPPHEVYQPSMPSPPAAIPATSPPPPRMSGPPPPMSSLPSRSSDGPQIRLNPLVMKQNLSHSLPVTTPFKK

SEQ ID NO: 39308 - protein, 767 aa, A.fumigatus
PPWTSFVLPRVQVTQAQTRINTSLLDLTLDNLAVYSVAAMAYATTSSPAALNGDAESSLNINNSLPNPPKLHHVIKSFSPATQTSSTTSYISSLTTTPSSLFPASNHSNASSPSGTPLQIATDALQGRLSTFPPVSLSSFELGESMMAVPGNPATSNVDSVSPNPNKGAGLMRRISRGAASKLTRRRQSATHSDKRDRSSGPVIMRRRSDSKTAAQTGRECALDSSNEEDGNDAVDSLGVWCGSEAPSLSTDASMMASRNVGAVAPKVDSAIQRGTVLTKVTKKRKKQVRFFLDLDAGKVYWDLSNPAKRFYIDDIKEVRVGVDARNYREEHQVPQDVEGRWFTIVIADPEKSKGRSVKTLHLIAPNDHILELWTTTLENISQYRINLMAGLAGSGQSETVLKVHWQREMSRLFPQGLAPGEEESLDFGAVETVCRSLHINCSKNMLRAQFSKADLGNKGRLNFSEFQNFVARLKERKDINDLYKTWATNAQEGLTVDEFLAFLRDAQQEDVDTDRAYWVSVFEKYVRKCKPRAPSLTDGVERQAFRMSLEAFSAFLSSNWNGIYASRPPQSRFDRPLNEYFISSSHNTYLLGRQVAGASSTEAYISALSQGCRCVEIDCWDGADGRPIVSHGRTMTTSVLFADCITVINRYAFITCDFPLILSLEVHCNPEQQLAMVRIMKDTFKERLVLEPLLTNSFVLPSPEELKGRILVKVKTCDETLDGVRQDTSTSFASAGRKRSSSSPWMRPSVPENPFVHEPFPFSPVL

SEQ ID NO: 39309 - protein, 474 aa, A.fumigatus
RAGFSSKSKHVTRPSMECDKIPRPLSRALVGSAAQAPHGCVLASLRILLCTNLSPSLQSYDPWAQESVGPFVSQDRRSFTTTSMSSATEDSDGALVSVKRERRRRQKSKITKPLSDLGVYTRGYKWHSFSSPESQRFNHVYSFAERAFESICRDAENKALLERHNQKYLTRVYPSGFRLRSSNFDPLKFWRRGVQMAALNWQTYDIGMQLNQAMFAAGTDRTGYVLKPESLRLPPYEQASKTSTERKLVRFSVEVISAQQLPRPRTMGPDDNINPYVEIEMFSADDRGQSFVVGEGGMNASARNGVSGIGYPHRRRTKIEQSNGYSPTFNDRFKLSLETKYPDLVFVRWTVWSSLDGRSAGNNNSVQLATFTAKLSSLSQGYRYLPLYDLGGDQYLFSTLFCRITKEEPVPVQRLGAEELRAERLGILRQIGQTVFKRGSSTERSDKGSETPASQDDKDTSPVLTPTVSTTSTS

SEQ ID NO: 39310 - protein, 263 aa, A.fumigatus
YPHWTGRRDKQGSPIVMLETVHLDQKAITHWHQTRQLSGQSSSPDMEQRALAYFDYLTRFVFPLCSALQDRPLPSEPVTKAIYLIDGSSICLRQAWNLRDFSQDVSWILATCYPETIDRIFVSERVIGPCAFGLTCVQLCNPPSYFPKMWSMLKKFIDPVTAEKIVMLDPADVYGTLNKYIHHDNIPVQFGGAFEFTHGMLPDLCPVTRQTLRWSPPFNGTFPPGPIKWTEHARGQIKAVAIGTVDGVERGFDVATLDIEEEK

SEQ ID NO: 39311 - protein, 66 aa, A.fumigatus
HIRRHGPYMTLDTARSSSLAAIHQAVQALWAGTSRMAVAAGTYMWTHGAAMVRRYCTCLPERLSIS

SEQ ID NO: 39312 - protein, 128 aa, A.fumigatus
RGNTGVMRLPSSALSFLASQGPGSGMVIHRGEGKFFLIGWGFQVRATSLSLTAAYTGIFRFEEKVVVNKGTGELRTRRVLNGDETRSGQFAIMPNEDPDYGGFPIAITIPAKTMIAELEVYALDESDV

SEQ ID NO: 39313 - protein, 319 aa, A.fumigatus
PSTTIQYPFLMPCRSMNRLIIASGMSTYAPAWVKMNPKRFPRMKLRKAGGVLQTTEILSIFHEEAQKCDARAFKQLMRHLKDFDQNHSTVIMVQVENETGLLGDSRDGSAAAEERFSKPVPYDLLDFLANDWDSLHRDLKRNLVRFKAQTNRQGSWAEVFGKGPHTDELFMAYHYALYVNQVAAAGREEYPLPLYTNAWQNYAGEDIDNNLLGIVGGGGMPGDYPSGGCTTNVLDIWQRFAPSLDFFTPDIYLNDYESCCAKYCHRGQPLFIPEQRRDEYGARRSWAAIGSYRGPWCLSDCPRYPGTPNKIHTSSIMPY

SEQ ID NO: 39314 - protein, 167 aa, A.fumigatus
ASLLSQIFFSDLTSSPADPVSNGIRCSVSDLSSPTARILPTVYMRRVNISVYDAQFDDDSGCQIPIPKHVIKSVVGAIVRFQITCAQIGVPPENIRIIATEATRTALNANEFVDAIRRATNVSVETLPKEVEGIIGAWGIASSFSDIEGLAIDLGGGSMQMTWIVSH

SEQ ID NO: 39315 - protein, 70 aa, A.fumigatus
ARSTISLLDFYRSLKTTTSNTLLISPLLLRPILLLLNLPYIPSYPKALALLLLSLLSNPSALLFKGISIC

SEQ ID NO: 39316 - protein, 679 aa, A.fumigatus
SGRYANCCFLCPHQHFPQVDSHTWRSLLQMRALGTVASSADMEKLSPTMAQSIVELTDKLEHELALRLVNRLVRALTARLAFYEISKARHPCLQDFSKKRQDSALDLLMNNLGDHYSLVRAATDESDGAEPPPSAAVIIAEWLRTLFLKEWDGNPEISRSSSAGGVVEILSRMYKQRNRLGLVPEDFHTPFLCERLEPLDMPVEWIGRLTNNKTLHLLSYSFLFPPSALVIYFRALNYAAMSKYYEAAMTTSRHVNQTAFGPIPIQDDVMLLSQMKTSMSTYLVLMVRRDNVLTDALNQLWRRERRELMRPLKVQMGMDEGEEGLDHGGVQQEFFRVLMAEALNPSYGMFTMDARTRISWFQPCSLEPLYKFELLGLLMSLAIYNGLTLPVNFPVAFYRKLLGLKVKHLEHIRDGWPELTKGLELLLSWQDGDVGDVFMRTYEFTFEVFGAVETVDMEKVGRDAVWPLRARDRSKSSELATNWSELSQHADPADLSPPCSMSADHVDFLECGSSHRSKSERLDYCVPTPPVEEASLVTNDNRAQFVKDYIFWLTDKSIRPQFEAFARGFYTCLDRAALSIFTPEAFKTVVEGIQEIDLGELERHARYEGGFGPHHRVIQDFWSIVKSFSQEKKAQLLEFVTASDRVPVNGIASIMFVIQRNGVGDAVGVLARFSAALSD

SEQ ID NO: 39317 - protein, 131 aa, A.fumigatus
QHHQGVHNLSTANHVIHDPSLTDLGNEQCRILRDNFPFHDRIELITASPLRRTIYTAYQSFQPVLEKHKDMKIVLLPDVQETSDVPCDTGSDPEVLRKEMEEQGIPVDMSLVQEGWNSKVCFLRFGRERGG

SEQ ID NO: 39318 - protein, 147 aa, A.fumigatus
RTQQRQVSHPIPRQGTRFEIASMIGLDALLQGRFPWIGDILATLEQYPLCAQRQKYKARRVDQNRTTETQQQDSDKDGVKSSTSLCAVVYKSIDCCMSFAISQWPSRIISETDLVSFTLLEQYRTGESALKGKQILMPGSQDPHTYD

SEQ ID NO: 39319 - protein, 89 aa, A.fumigatus
CRKDGTARFVSFVSGGRGEADGIQTGRYAPTNEAIKNRARAARRWLKERPEKEIVVVTHGGFLHYFTEDWEDSSLYQGMSRFVIFLQSM

SEQ ID NO: 39320 - protein, 64 aa, A.fumigatus
ISARVDFFWVYPSFARVKSLIALSLALLFWKVCAPEFIHPVYNKRRCAFSFYILSGCLFQTHTL

SEQ ID NO: 39321 - protein, 857 aa, A.fumigatus
LFVFNPAWSCGVGFSMYALVDPICQVKESRSLITDILKQKQRESWHVPSNASARIAPDQHRQYRIEGTDSEPYHNGQYNSQSSHHHTRGSPDLGDLDIAKACGEVSGDHQLRFSRQKSSTGVEHAVKNAQGLSGRPENAVRSTEKSTSQNETNTFSHKKDKRVTRRLEAERIELEKRLLKLEQTQLAGNHNSPKRESRRLTKKQPLGSSSRGSSVSADESRPSSRRLSGLFSIPRRASTSRSSSVNGRNGEESTDSAPVPAKTLPDDVSTSRVAKPSLSTSLPERFSAVISKELIVRSNALLQDQTSPAQSPSSPATTAAMNQSETLESNEERPLQKPEPTLDYAKQQIDDHGESPKSRSLQTSPDLDPLSFAATLHLAKRARGNNHFKDQSPDKVQHPSFVQRDVTQNGKLYDPQPLGSSKMGAVSQPNPKTIDNSSSLPTKVSVKSVPRRTFKPSPLAGDSTSGGSSRSLAGNASVWRSRNSGGSSGARRTPSSSMVTVATRISSAVESLQVSQPSTNSQSETEREGRAQDSASERTPKSNNLANTRVSKEQEALDYASSQHPRIRHLTRTSAPVSNPPQLSVKSRIQTSENDKNINHLSVKHNRQEAQAIHGAQTARVNQDVPPMTEHKSGRRLDARGFATPGSASSRSSSPEPCSEDYNTADEAGSIGSVPRANNDCLDGKSAAASGPCFVQNTIESNDSTCVGKFTDVAVSKAGDPQGDRPATETGVCQRKQSTTKTFVICCSCKYWHDMPPESYSKVASPDTCSVPTRKGPTLLGRSSSFAQKSSRKLTRSTQIKSALLNERSVSERATIGSATRSRFADAPLRCCWCDHPMNRHCCEGWTTTVYKHERQF

SEQ ID NO: 39322 - protein, 310 aa, A.fumigatus
SYPLLPLSWIAGSLIHHSTVGRVLSSQTIGVEFSSKIIRLGSGPRKTRIKLQLWDTAGTERFRSVSRSYYRGAAGAILIYDISSQASFAALPTFLMDARALASPNLTVFLAGNKADLASDSVTHGDLADDSMRAPPTPSSTSSKQSSFPIDSVPGSVRSTSILGTGTRLTATYAFEGRQVSAEESAHWAAKANIPVAVEVSALTGEGVEELFNRLARIILTKIELGEIDPDDPQSGIQYGDGGLYGQGTSDGSSIRSRMTVDDNSVQLHRRNPKRRGGTRGVNNWRSNMGEWEEVFQLSGSHQKKGTGCC

SEQ ID NO: 39323 - protein, 145 aa, A.fumigatus
QDAENGKGCESPQAPDKAVLVRDSFFCPPANQDPDKSLLGIPAIKYPELLHGRLPSIKQYSPMGPKKKPDARGVPKPGTKQAKAAAERLAENAKKAQAATEEPKKPSVKEVIGGASWTGKLPVNMLAEHCQKQKWEKPEYTMVSE

SEQ ID NO: 39324 - protein, 928 aa, A.fumigatus
MRTSDGYISSVILKRIDPKTRELTVLPPMKPPSSHKHLAAQPTALEARHFAAAYALFRVCNMRNLHMMLPPTYKKLWKEDFTDLKNADTKEGKGWMYEADPFLAKQERETAAAEQEKKRKEREKAQAKEKETAVDLGVGSSGENRGKRIWSQAPKVDLGNRIRRELEELLRQHTIWNPYNIQISEAERKAIVEEFLGLGFRRSHVEEATAACRDREEVLEWLLVYVPEDDLPRWCLPERYTAGVTLASDDLGREAKIKRLASFGYSADLCAQTLDNKRGDELAAAEFLQRTLVHGENHSLDSLSVGDEDSWVEEQDTLEAIFGERYKRLSSKVCEIKSEAPNIPGSLSFRFQKPSAGYPSSVPVIAIQGTGIPAYIRLSAIRQAVQFAEENFLGESMIFNIMDWLETHLPGIIENPGKLRDISTVTGSSSSAVGSFPRLPVRQSRKQSRKIDWNPGSPLGVSIREAWKARQSTTAQQEMTRKRESLPAWKIQDAIIQAVNTHQVTIISGETGSGKSTQSVQFILDDMIKRGLGGVANIICTQPRRISALGLADRVSDERCTSVGKEVGYIIRGDSRMRPGETKITFVTTGVLLRRLQSGSGPDGNVAGSLADVTHVVVDEVHERSLDTDFLLALLRDVLPYRPDIKVILMSATLDAEIFMDYFGGREKVGLVNIPGRTFPVSDYYLDDIVRYTGFAPELAERGLDEDVMSPPQGDESLGKLLRGLGMGINYELIASTVRYIDSQLGDQPGGILIFLPGTMEIERCLNAVRKIPNVHPLPLHASLLPAEQKRVFLSPPKGKRKVIAATNVAETSITIEDVVAVIDTGRVKETSYDPKDNMVRLQEVWASQAACKQRRGRAGRVRAGSCYKLYTRKAESSMPQRPEPEIRRVPLEQLCLSVKAMKRIGRCCYLFWRAPSRRLKASLSRVP

SEQ ID NO: 39325 - protein, 118 aa, A.fumigatus
KAHSYHPATSATKPTPPKRPSPNATGISSPTSPHTSSGLSEPKHRATGRPSPGAPPTSSRTRPSATFRPTEPSSSVLSRTPASSQSTTQTPNPVPPGTATTGTEASSAPSSQVPSSRR

SEQ ID NO: 39326 - protein, 163 aa, A.fumigatus
ANQSTGLLADPVLVLRQLPLAPDPPRHFVQPSPVHQFSQGRRHPPSRLLRLRTQFRLEPQQREQKPPPRHHRRCLPAAGSPDLLPGQEIRQLRDRHRRNRPGRPNNQVLQPGKRPCLHPPKLPPLLRAELLRCRRVPQLLHQDGDKLSLHPGSNPYAFPSPSP

SEQ ID NO: 39327 - protein, 338 aa, A.fumigatus
LRPEGQHGAPPGSLGFPSSMQATTRPCRSCEGWFLLQAVHTQSRIEYAAATRTRNPASPIGAAVPVSQSHEKDRTMLLPFLASTISPPESVAVEGAIDFLHRVGALDQDRLTALGRYLSMIPADLRCAKLMVYGSIFGCIDACVTISAILTVKSPFISPRDKRDEADAAKASFSKCDGDLLTDLAAYQQWSERTKAQGYWQTQSWCSANFLSHQTLRDISSNRAQFISSLKDAGILPVDYSDSEPSSAWNRNNGNRSLLRAIIAGAFQPQVAQISFPDKKFASSVTGTVEIDPDARTIKYFNQENGRVFIHPSSLLFSAQSYSGAAAYLSYFTKMATS

SEQ ID NO: 39328 - protein, 125 aa, A.fumigatus
ISKRGKPFDFGLPSKVIAGESHTGGISLGQTPPREVILRDVDEKPLKNLFPVSTGGGSLFNMTASEAQTEELFNNSFALSLRNLYVVRIPDCMLSQQLLEFTANSISQINLWSLRPDPFSSVLAT

SEQ ID NO: 39329 - protein, 249 aa, A.fumigatus
ISVSELLSPKNKQQKQTSHPPSKTDIKNRFGARDGLGAYIEKPESYPSSVVVHYDDDFVVIHDMFPKSTLHLLLLPRDPTKTRLHPFEAFEDAEFLSKVKAETRKLRTLAAAELRRKYGRYSAQDKERQDALNADPPPDVLPQGRDWEKEVMCGIHAHPSMNHLHIHIISVDRYSDRLKHRKHYNSFSTPFFIDIEDFPLAKDDPRRHPDREGYLRRDFKCWRCGKEFGNRFAELKSHLEAEFNEWRKL

SEQ ID NO: 39330 - protein, 153 aa, A.fumigatus
PFDFGRNAPFILGVRAVALPLAAGNTAILKGSELAPKCFWAIGDIFREAGLPAGCLNVLYHKTADAAEVTTALIAHPAVRKVNFTGSTQVGSIIAATAGKYTKPVLLELGGKASAIVLDDANLEKAAFCCALGSFMHVSIGSLTPWDAFRRLT

SEQ ID NO: 39331 - protein, 150 aa, A.fumigatus
NQSGQICMSTERIVVQRAIADKFRQLLAENAEKLFGKAAPAPVLVTSAAVKKNKTLVADALSKGASVLFGDANATESSDHSLRPVIVDNVTKDMDLYSTESFGPTVSLIVVDTEEDAIALANDTEYGLTSAVFTDNLFRGLRVAKQIEAG

SEQ ID NO: 39332 - protein, 219 aa, A.fumigatus
SSRKTKMRFVTVAISALVAMASAYTQPDYSKPPQGNAILKPGLNEQVPVGKPYTITWDPTTEGPVSLVLLRGPSTNVVPLSTIVESIPNTGSYSWTPSTDLENDVTHYGLLLVVEGTGQYQWSTQFGISNPGKAADTPAASVTATTSATSEVETPAASSPADSNVTLVTTETTTWCPESTAKPTSIPVIVPTGAPSIPSGSPTPSAYPSSTLDQGPKKR

SEQ ID NO: 39333 - protein, 174 aa, A.fumigatus
FSLVIISALDTPAEEIVNMAANGAKADSGVIPLIINNESIVTENVFDIHAPATGQVLHQCAAASVDHANRAVAAAKAAFPAWSRMKPYDRRDVLMKAADIMFARSEELIKYQMEETGAGRMFAEKTCLLGAGFLKDFAARIPSIEGSVPSVTQDGECAMVFKEPYGVVLGIAPW

SEQ ID NO: 39334 - protein, 102 aa, A.fumigatus
VLPVKFTLRTAGWAIRAVVTSAASAVLWYRTFKHPAGRPASRKMSPIAQKHLGASSEPLRMAVLPAASGSATARTPRMNGAFLPKSNGQFLCEDDVAKADSK

SEQ ID NO: 39335 - protein, 67 aa, A.fumigatus
VITSPSHINSARRGAKIRISANKQLTYYQVRSFKSINGVQPLSFIISVEPQFVSQKYYEHSSLQSPG

SEQ ID NO: 39336 - protein, 67 aa, A.fumigatus
RRVAGIEICWWPGGIIYNEGWEALYTAVVMRSGNIFIDLVLYWDSCRVSLHCSTQPNNCNRKIVLLW

SEQ ID NO: 39337 - protein, 169 aa, A.fumigatus
GWMPKTIELTNIDVQMVEQKPLRVLVIISDTNAYWEKSWSASEDLLPVAFEILQENCLVENTYKHWPKMRLLAKEKWATRVFLIFDISNTSYDPEVGHLPQQNNLPVAIVRLGATVQAYTAAIPVQNKINKDVARAHNNSGIKSLPPFVVDYTSGPPTYLNPRDPSLLR

SEQ ID NO: 39338 - protein, 67 aa, A.fumigatus
SLTRTVLPLLKPEFSMADESVCNTNFYTLLDEEVWVFRMDLSKVKAVLQCYITRSRNIFLIAVTVYL

SEQ ID NO: 39339 - protein, 102 aa, A.fumigatus
RFTKAPVTNFCIKWYWSFHDAKYFILPVSPSTRYPSGHVDISPRMYQGFLLEDHINHPHMARKMAPNLALSTLEFIHDMILSNKLTYSQIANAAGCYLSTIT

SEQ ID NO: 39340 - protein, 75 aa, A.fumigatus
PELKSILVIGDASFHHSKRLEQMCAEAGVKLVYLPPYSPDLNLIKELFSKLKAFIRRHWQVYEDNPDQGFDSFLK

SEQ ID NO: 39341 - protein, 125 aa, A.fumigatus
LFIRGSPAPVEKTAGDVSGAPKVRAMQLIAELEGEKRGVYAGAVGYFGFDSSSADGANLVPGAMDTCIALRTMLLKDGVAYLQAGGGIVFDSDPYDEYVETLNKLGANIQCIKGAEDKYLSMEQL

SEQ ID NO: 39342 - protein, 459 aa, A.fumigatus
VFERPGRPLANERYLLCRTVRVAAEELTTLILVEDRCRIERSDRKLWKSRVNGLDEYQSHGPEPSRRSDRRERRRPADDEDIEYRLAIEASKAEAEEERKRREKQSMMGEEDEDLAKAIKLSKEEEELRKRELEESNAQSLFDDTPVAQSQPTGYNQGYQQQGAVDWFGNPINAQQPLSTGYLNNQYAQPTGFQNQVTGIPNGYANGFQNQPTAFDQNPYGQLQNNFLQPQAPLQPQQTAFTTNNPYGTDIFSQQQQQQQYQQYQQQQQAQENVSPAGSNNPWAQSGNQTANALQPMPTGSNNPFAARTQFQTRPHTSTGPPSLNTLAEERATNQFTSSPNPIANFQAPAPPKSTPPQTSNPHHARLNALLATGEGQDTFGNVGDLRIPAQHTAPGTFVNSAGQGLDRLRATHTGNNPFYNQQQFVPQSTGFAQSSNNPWATQRPYQQQPQAGGSLIDL

SEQ ID NO: 39343 - protein, 78 aa, A.fumigatus
ISIVEYKKLQSPMERRELKHRSYLIHASSIEITKLNHVRQGYLKIISGKHRSSGTTNTMYVPIHQEAFQIEPAEQPTI

SEQ ID NO: 39344 - protein, 104 aa, A.fumigatus
INQPPRSPNFLAHSSYSRSPSRLTLGLMDLRLASKSWKRMGRIWSMGVWRRASPRLRRGPIAASLARAVMSEPEKPVIVDDHVSIVDKEIEWGIMMMIELPSVT

SEQ ID NO: 39345 - protein, 182 aa, A.fumigatus
FYHHHYSPLYFLIYNTHVIINNHRLLRLRHHRPRQRRRNGSSPQPRRSPPPHPHGPNPSHPLPRLRSQSQIHQAQRQSRRTTRIRGVGQKIRRTGRLIYLLCASFSVHLPFGGLRRHIRCLDSIVHGPRSLVFFAQLVSARSYSGGLHVMLYGWLFGWFDLKGFLVNRYIHGIGGTGGAVLS

SEQ ID NO: 39346 - protein, 279 aa, A.fumigatus
  UNSURE (1): Identity of amino acid sequences at the above locations are unknown.
XGAHFQPLVKTSITSIMNKLPKGIDPNAARQILNDIVVRGDEVHWDDIAGLDAAKKALKEAVVYPFLRPDLFSGLREPARGMLLFGPPGTGKTMLARAVATESKSTFFSVSASTLTSKWHGESEKLVRALFGLAKALAPSIIFVDEIDSLLSSRSSGTENEASRRSKTEFLIQWSDLQRAAAGREPSTKRGRGDPSQVLVLAATNMPWDIDEAARRRFVRRQYIPLPEHHVRDQQLRKLLSHQVHELDDEDIEVLVHVTEGNSIIIIIPHSISLSTILT

SEQ ID NO: 39347 - protein, 78 aa, A.fumigatus
SSTITGFSGSDITALAKDAAMGPLRNLGEALLHTPMDQIRPIRFHDFEASLKSIRPSVSRDGLREYEEWARKFGERGG

SEQ ID NO: 39348 - protein, 206 aa, A.fumigatus
PVDRGCWALMGLPNQSTAPCCWYPWLYPVGWDWATGVSSKSDWALLSSSSRFRSSSSSLLNLIALARSSSSSPIMDCFSRRFRSSSASALLASIARRYSMSSSSAGRRRSRRSDRREGSGPWLWYSSSPFTRDFQSLRSDRSMRQRSSTRMRVVSSSAATRTVRHKRYRSLAKGLPGRSNTHRETTYRSGQGLSRPHPRIGTRAVS

SEQ ID NO: 39349 - protein, 93 aa, A.fumigatus
HCRRSPPVTAARDPATNSVDICIDHVNAQYIRTLPVSAHRRPVLVGCRLYRIEQPDGMSYSPVAQKYRGIIRHISAFSSGALDGGSRCGRNER

SEQ ID NO: 39350 - protein, 1400 aa, A.fumigatus
LQTMWMLRPFNQPREVTIDLPPLLVESLGVGAEVLANYLTTLAEAAANEPDPSKYPAPNPVLCRICERQITPWWFEKHSDLCLQEHRAEMDVQIAQENLNEHRHAIVKVLDALEARQSRPLAGETPSPMPQPEYKGLAIGPSPAVSAPSSGNVSSSSSAPCTPPRSREHSASDGGHARGRSFAVRRPLTRIVELILDLCDTALEINMPVIKEPRGDSLDDFRTLSPQSESRISQVMQWQSPSSNTLEQEQGLAALSADTEQVCKAKVDAVIRHRKIVEYAERIRIEYTVMVEDCIAAALSKAERIAAGQLSDSTCSSEDELPPESVTASSATANGSSTAVVPPLSPQPVTRQPTPSTSALTMSMRNTSERFQFPHTEGRSSSVAVSTGSNSPMECPTPRSHRSTAGLLGTSQPSRRGLSMVDLDAGEMSDSSVLSSAFTGAVRTESPASDRSLERKRRSLVLPGLSSSPRRQPSPARMSTPHSPLRMPKPRLSSGAESLPSPIVSPSTHASELAHYHYRHHRRQSSATSSDATKPPVSPHLTSASQPQPRPAPSSIKDFEIIKPISKGAFGSVYLSKKKSTGEYFAIKVLKKADLVAINQVTNVKAERAIMMWQGESDFVAKLYWTFSSKDYLYLVMEYLNGGDCASLVKVLGGLPEDWAKKYIAEVVLGVEHLHSRGIVHRDLKPDNLLIDQRGHLKLTDFGLSRMGLVGRQKRVLKSLNEPAPDLLKQGPFPRATSIASSRSASFDFQAPGSPGSTPLMTPDLSGSLNQPSYFSLNQSGLSRQPSRRASGYRSDSGGSENLSAMFRNFSLTEGNETASSLPPSSLPVPVPSSSNVAEEESQSEAGESPRLYPLLPTLSNSVPLSTPPQQSMMPPLMALFDPEDHNRRFVGTPDYLAPETINGLGQDEMSDWWSLGCIMFEFLFGYPPFNAPTPDEVFENILHQRINWPHEAEELASQEAIDLMKRLMTLDPRERIGANVGDKFPNGGAEIRSHPWFSDINWETLLEDKAQFVPNLENPEDTEYFDARGATLQPFAEELEEGISSQHVTAADRPHDALFKVRSQVNSMKRPLMPLHIPPHVRDSRSRRLSEPALADDFGSFSFKNLPMLEKANKDVIQKLRQEALQAQQRQYSSSIPQAIPPTQGSAATSGPLLEGSPLPMPLQRTLSHNKGNNRPSSPSSLSQANSSPSRPSQPSSPLLVQFSTGNNHERRKTSGSSSTNSHQSSGSFATGSTDQGRMANIKLGSSASSPIKIGRGGTHSPDKTPSGHRQGSIPTTRARSQTIGSQDGEFSSSLAKESYVAGHYKRRSQLFDISPSSSDNEDPRTKALLKVQRRRQSSRRLSQINILDGPFFRPLDVLICEDHPVSRMVMERLFEKLRCRTITAVVFTTGLAGSALTY

SEQ ID NO: 39351 - protein, 64 aa, A.fumigatus
RVMSEWVETYMARPIWRPLKYHNALPFHAQDIMAVVYFLRRLRALTAFFCHRVDWSGFRRVLQY

SEQ ID NO: 39352 - protein, 136 aa, A.fumigatus
HQVFPRSFPFLGFLPGHTVKYRSLEAPLVDRIQISSTLFSRLLFSLFLFSPSHHLICTLLSQTFAYINTSLSVSLIPLTKPLSTSRDKASISLFSSSFPLFSVYSAYNTFYLHLLLVIALLSQRSLAYQSKFTLFP

SEQ ID NO: 39353 - protein, 225 aa, A.fumigatus
LNYTLSMDAARGVLQRRVRACISRPGVLSGRVIYPSLWLSSSLSSLSSSVRARSSPRTTVSPLRGGALREGRGLLTPVMAGAGVGYSTTTGASGEQEQEQEKAQEQEQEQEPEKAQEQELEQGQEPEKPQVQISQGEDAEQVQGGLERLLENGWVLDGERMGIKKTFYFRSYFKAVVGFVLTVVLRERSREADWLVQSFLNVVASQSATKKHHPTMTVVSFLLTC

SEQ ID NO: 39354 - protein, 531 aa, A.fumigatus
YARYRAGYLKMAVPPSEGVIEIGDSHHHESEASSSTHADHGIDPFEKTEPTTDVENVETVEAAEDKPLPSRADKVIKEADCYDELGYSWPAWKKWTIISVIFLVQTSMNFNTSLYSNALTGISEEYGVSMQAARCGAMIFLVTYAFGCELWAPWSEELGRKPILQASLFLVNAFQLPVALAPNFASIMVGRALGGLSSAGGSVTLGMIADLWEADDQQYAVACVVFSSVAGSVIGPVVGGFVEEYLPWRWNIWIQLIFGGAVQLAHLVCVPETRTTILMDRIAKRRRKNGEDIWGPNEVLEFRERFAMREILSTWIRPFKMFLTEPIVLSLSLLSGFSDALIFMFIQSFGLVYKQWGFGTIELGLSFLPILVGYFIAWISFIPAIKRNIIERRAKPQDERAQYESRLWWLLYTAPCLPIGLIGFAWTSQGPPVHWIGTMIFSAIVGIANYSIYMATIDYMVCAYGPYSASATGGNGWSRDFLAGVLTIPATPFFESELSSSLIRLIVTAADTGLHRHWRQASSRVRIYDFV

SEQ ID NO: 39355 - protein, 173 aa, A.fumigatus
KTYNSHGRMMLLCRALRRNHIQKALHQPISLPRSLAKNNSQDKTHHSLKIRPKIKRLFDSHSLPVQHPPVLKQAFQSPLNLFCILTLRDLHLRLLRLLPLLQLLFLRLLWLLFLLLFLRLLLLLLLLPRSTSSSRVTHTRTRHHRCKQPPPLTERTAAERRDRRAGRTPRPNG

SEQ ID NO: 39356 - protein, 65 aa, A.fumigatus
YPPLITECLLTICMSPSALNLYPNTLISTHSSIPPFNHGQVPPVDYVDIRLTAYRSLESFDRKKT

SEQ ID NO: 39357 - protein, 233 aa, A.fumigatus
PYSGTLVNSAKCLLHSDDPRPHGGSLGGCATLVYITFGTQNSKEFCTDDKQGLLARTPDPRPRPLRLHKAQQSTPPGIPPSYPFLRLRHSQLLPDHPPQLDRHRAAAQPRTHRAARPASRHRPPLQDRRLHVPGGHASHLLQPRAQHLPVPRSAHQPHRPSNLLPQRQPAGISPRPHPPRSQNRLRHRRRLRLVRFPAARGSQPGLALRPRRRSRPAYHRALQRSRLLRAQRG

SEQ ID NO: 39358 - protein, 511 aa, A.fumigatus
ERKEAHPSIMTILHIRAATPYEPGDNATDVIVNEVHLNRTTLDLYNYTLYSNGTLSNGTDCYLAFQEFQPRMDENGTFVNGISCYAPIHGIGRHASIGMAFTAFFAVSMFLTMFNLQKHGRKYLPGRTMGRRLKWLWLLFVAACGLVSCIMTVDVDRSHIQGPSLILQSVFYTLMTPGLMAAVWEAVRHWYTSLSAHKILKNSVLTINRASWQERQILDRDPYAFTKRSSRRRQESLLPILFYVFAIASFFLTIRRSWTGIELQRSPELTALRAQPLATDLRFKIAGFMSLAGMLVICYSLEHSIYRYRAAPTSPIAQATFYLSASPPEFLLALILLGLKTGYAIAAAFDWSVSPLRVAVSQGLLYGLGVAPALLIIVLFNAVGFCELNEDKALIVQRGELDSALATDADLLGRKRWWESRWLHGGDRNRNRDRDRDRSSSREQLDRYVEMGILAPHGKGDGEDKDGSAGAAGAEAAPRVTTRTASDASSSSESGFVTVTVASPGQQRADR

SEQ ID NO: 39359 - protein, 70 aa, A.fumigatus
RGKSLPITYSNGPYEVLLGYDNPIANLCYKVHFARSKMARKFTIKIAQLIYKCRGGVDLAQSHRHCHRPC

SEQ ID NO: 39360 - protein, 78 aa, A.fumigatus
  UNSURE (19),(26),(51): Identity of amino acid sequences at the above locations are unknown.
SHAPHHLFAGLASPRSSGXAFGQFVXLMGFKLKIASQKPLGSDKRTALFCXKSQKASRIAQCRRAGASSFHSGACVPW

SEQ ID NO: 39361 - protein, 201 aa, A.fumigatus
SSATASSTASTGTAQRPPAPSPKQPSTSAPARRNFSSPSSSSVSKPATPSPPPSTGPFPRCAWQSARACSTASASLPPCLSSCSSTQSASASSTRIRPSSSSAGSSTPRSPPMPISSVASAGGNRAGCMAAIATATATVTAIAPRLVSSWIATSRWGFSLRMGRATARTKMALRGRQEPKQRRESRRGRRVTPLARRKVVS

SEQ ID NO: 39362 - protein, 75 aa, A.fumigatus
IWLRSTSTVMMQLTSPQAATNNSHSHLSRRPIVRPGRYLRPCFCRLNMVRNMETAKNAVKAIPIEACRPMPWMGA

SEQ ID NO: 39363 - protein, 73 aa, A.fumigatus
  UNSURE (28): Identity of amino acid sequences at the above locations are unknown.
GPLLYVIGRDFPRYGKSRACLNGVFRSXDTTISSSYKLGTHWESVTLCTSREGNMEHFIRYRFFVSGTLGTDI

SEQ ID NO: 39364 - protein, 186 aa, A.fumigatus
IIGAPAFFPTVWGWIKRWFDPVTTSKIFILSAAEVKPTLTSFMDPSSIPKQYGGELDWQWGDMPNLDEPARELVGALEIPPAEGETKPSFTKGPVLFKGDHVEILGKVNGKSRQRTVPVPMPAKQEENTNTPDVELEAKMAATSLAPAASSTEQSEVQSENENEKVALDNVAAEKVANPTAQTVSA

SEQ ID NO: 39365 - protein, 421 aa, A.fumigatus
RKEVHEIKVKGSDVRHPAMHCDLFSMDADGQQVIPSVQYADIVSGRVSDRATGEILHRGSVVIRNVIPRKEARGWKNRVEEYVAANKERVKAFPPDSPAVFELYWTPSQAEARAHPNMLETQRFLQRLWHSSDPATRISTRYPLTYADRLRIRQPGDGKFSLGPHVDGGSLERWEDPEYSRVYTKILEGKWEEYDPWDAKHRVSAKMDLYNGAGACSMLRFFQGWLSMSNTGPGEGSLHVCPMLIQSTAYTILRPFFDAKTLQPNLDATFPGSVPGACQEYNPVTHPHLELDTTMVSVPEVEPGDYVAWHCDSLHSVDKEHKGNGDSSVLYIPATPMCEMNVDYLLKQRNAALAYSPPWDFPGAGGPGEAGFKGALDWSSVNSDGLRAMGMGAKPWEVTGDMTEGEKEVVEAANKACFGQA

SEQ ID NO: 39366 - protein, 193 aa, A.fumigatus
PFGAEVMKMWLRVALLLLTSCVPSTVAIYPDEVNHIDFHHALLGTPSSHSTFFLKPSSSSNASLLYTLSQKLLLGAVNPRDGSLVWRQNVSRSLLSKDDGQVQSFLRASDGSNAMVSAVGDYISSWSALDGKLIWENWFAGEPVIDLELLELEDAGATSSARDAIALYGHKAGVLRRLDSESGDVKWEFKDDR

SEQ ID NO: 39367 - protein, 819 aa, A.fumigatus
  UNSURE (27): Identity of amino acid sequences at the above locations are unknown.
CLSLAQFSGDIPFHISSRATEVLYISXQSGLLRGYRIKSISVDPLTGRQTRQHILNTESDVFGPESILFVGANTASPVIIWTDKAQKALKINQIGLKQVNTLHIDNTSGEEIRSIEVHTPKKLNSLPHFLVHYETDSSSWAEVYHIDLTSATVSKAYSLPRVQERSAFATSNIDANVYFTRITQSEAVIVSSASHGVLGRWPLQAPTTEHAQHAVSEVVAKGDAVAVRSATVLSSGDWQLIRNGQTEWTRYEALNGAVAASWAEEEYQEDLAHELEVEGHESLYKAYIHRVKRHARDLQHLPEWLKELPKRILTSILSDEISSLDGFGLSKTVVVATENGRVYGIDTGNHGVVSWSVKAAESDSWNVKAILTQPGYATVYVDDGSSVSLNTTSGAVIKRTPASGKIASIAVINGPSNPITIGVKEDGVPVEPLEKPGFFVTLSADGRVLGWSAADNKTPVWEFLPAQGQKIIRAIARPAHDPVASIGKVLGDRSVLYKYLNPNLALITAAGEDNTATFYLLDAISGRILHSSTQKGVDTSQPIASTISEKWFVYSFYGDPLTPSDAKGYQLVVSELYESPLPNDRGPLGSASNYSSIHGSNILPLPHVISQAFIIPEPISHMAVTQTRQGITTRQLLCTLPASNSIVGIPRPVLDPRRPVERDPTSTEAEEGLFKYNPVLEFDGKWYLSHNRDVAGIKAVLSSPTLLESTSLIFAFGGDVFGTRATPSQAFDVLGKGFSKLQLIMTVLALSVGVIILAPMVRFPDLPPTLTPACTPHDLQNTDQSTGAEEADQSAVEGSLEKDRETGSIYTTSLHDCVY

SEQ ID NO: 39368 - protein, 159 aa, A.fumigatus
VRSLIRTSLTYTMFRSTIFRQAAKAFSQRSHPAPFAAPLRCSASNTFFRPLSYTIPRSTGGKKDPEESEVEGRFARTDESVVIEYPNDADMPRTPIVQGRGGMHFKRTLAQFSLKNKVSLVTGGARGLGLVMSQALVASGSDLAIVDLNRMFQAINCNS

SEQ ID NO: 39369 - protein, 201 aa, A.fumigatus
IPEMTANASQERKLKTRLRSSSNSLRRKIRAWNSKSIGGFQAFLSVADANVLFTFLFSRMPNVTAHYADVANPDSVNTAIAEVISKHGRIDHLVTSAGFTENFDAISYPYDRMQKLWGVNVDGTYLFAVGVAKHLMERKAPGSMVLIGSMSGAIVNVPQPQAPYNAAKAAVRHLAASLAVEWAPHGIRVNCISPGYMLTAL

SEQ ID NO: 39370 - protein, 78 aa, A.fumigatus
TALFHLVVFLSDRLTSISRTRKILDERPDLRDKWTSLIPVGKMGTPEDLMGAVTFLLSDASKYITGADLRVDGGYTLT

SEQ ID NO: 39371 - protein, 89 aa, A.fumigatus
  UNSURE (73): Identity of amino acid sequences at the above locations are unknown.
ALASGEPMRPLKFRLLAEIPTSPSLRRPAPRPIQTAHPAGRGIAPASIRACQSPAFSAIFCSAFGSRRNVELXAVRDPHRPTPSGQRRP

SEQ ID NO: 39372 - protein, 95 aa, A.fumigatus
SSTLRRLPKAEQKIAEKAGDWQALMDAGAIPLPAGCAVCIGLGAGLLKEGEVGISASNRNFKGRMGSPDAKAYLASPEVVAASARMPLSIGVPYL

SEQ ID NO: 39373 - protein, 203 aa, A.fumigatus
ESANSWLVNGVISGPGIYKRPEDWTGVSIGEGEVVESGSRIDTTLEAMEKFIGQLDSMIDSSSKAVMPEESTGSGATEVDIVPGFPEKIEGEILFLDADNISTDGIYPGKPSQTGNTLLALTNVTGKYTYQDDVTKDKMAQVCMENYDPAFSGIARAGGLSPSLFSSFLSIRKSLTHINRHLRLRLQLRLWLVPRASRHLHPR

SEQ ID NO: 39374 - protein, 455 aa, A.fumigatus
  UNSURE (432): Identity of amino acid sequences at the above locations are unknown.
LLKKRTGSLLLRCRASRVPVIGRPLISLSTSSTSLSLSRPRSFATTSLRRYAEASSSTTQTSPSSSSWPAPDAAPRVPQTLTEKIVQAYSLGLAEGQYVKAGDYVMLSPHRCMTHDNSWPTALKFMAIGASKVHNPDQIVMTLDHDVQNKSEKNLKKYESIEKFANQHGIDFYPAGHGVGHQIMIEEGYAFPGTVTVASDSHSNMYGGVGCLGTPMVRTDAATIWATGRTWWKVPPIAKVQFTGTLPEGVTGKDVIVALSGLFNKDEVLNYAIEFTGSEETMKSLSVDTRLTIANMTTEWGALTGLFPIDSTLEQWLRHKAATASRTETARRFAEERINELFANPTVADRGARYAKYLYLDLSTLSPYVSGPNSVKVATPLDELEKHKLKIDKAYLVSCTNSRASDIAAAAKVFKDAVARRGWACEGRGRRXVLRCGGFQRPNRRLQRRRVTGKP

SEQ ID NO: 39375 - protein, 130 aa, A.fumigatus
TDIFVSGFNFGCGSSREQAATSILAKQLPLVVAGSIGNTFSRNAVNNALPLLEMPRLIERLREAFGSEKQPTRRTGWTFTWNVRTSQVTVQEGPGGETWSQSVPAFPPNLQDIIAQGGLEKWVKKEISKA

SEQ ID NO: 39376 - protein, 191 aa, A.fumigatus
TFSDRQYTACANERHRQIHIPGRRHQGQDGTGLHGELRPCLQRHCPRRRFVTFPFLVISFDPQESNTHKQTSSSPASTSAVARPASKPPPPSSLSSSLSSSPAASATPSAAMPSTTPSLSSRCLASSSACAKPLAAKSNQLVARAGPSPGTCALPRSLSRKARAVKPGARAYLLSLPTCKTLLPRVDWRSG

SEQ ID NO: 39377 - protein, 367 aa, A.fumigatus
YLFYQSAFHPQLDQVLTDVQIASYWLTTTVIMDLVGTPSDNNGNKAFPFGKTATPIINTIVKYVYLGFLLLQFILALGNRPKGSKFSYLASFVVFGIIQVYVVIDALYLVVRAFSGSAPMDFTTDQGVGEFLKSFFSSSGAGIIIIALAATFGLYFVASFMYLDPWHMFTSFPAYMCVQSSYINILNVYAFSNWHDVSWGTKGSDKADALPSAKTTKDEGKEVVIEEIDKPQADIDSQFEATVKRALTPYVPPVEKEEKTLEDSYKSFRTRLVTFWIFSNAFLAVCITSDGVDKFGFTVCRRRQSLLVDCETNILQNSATDRTQRFLQALLWSNAVVALFRFIGACWFLGKTGLMCCYARPLEGRSS

SEQ ID NO: 39378 - protein, 76 aa, A.fumigatus
  UNSURE (9),(19): Identity of amino acid sequences at the above locations are unknown.
GFRGVNDLXDARLHPAGVXRPPGGLRRYATRKVKLVQGSVLSVDYPVPSAIQNAIQAKYRNDLEGGSEEFTHMRCE

SEQ ID NO: 39379 - protein, 114 aa, A.fumigatus
QIAWELDLQELTLGSTMKMNFPNPDDILNFTLTIEPDEGMYKGGAFHFNFSVNQNFPHDPPKVKCTQKIYHPNIDLEGNVCLNILREDWKPVLNLNAVIVGMQVGLRDGRCRCV

SEQ ID NO: 39380 - protein, 195 aa, A.fumigatus
VSIILFRARSRMLFRPSTEMISRVEVRNLRTCDVSDLRRCTWPFYFVHIADNPSYKSQDTAATCDPNEFTLHNGYNLRPAMYNRHTELLIAITYYNEDKTLTSRTLHGVMQNIRDIVNLKKSEFWNKGGPAWQKIVVCLVFDGIDPCDKDTLDVLATIGVYQDGVMKRDVDGKETVAHIVCALRPVGITGRTNWS

SEQ ID NO: 39381 - protein, 302 aa, A.fumigatus
FEYTTQLSVTPNQQLIRPTDDGPSTLPPVQMMFCLKQKNSKKINSHRWLFNAFGRILNPEVCILLDAGTKPGPKSLLSLWEAFYNDKDLGGACGEIHAMLGKGWKNLINPLVAAQNFEYKISNILDKPLESSFGYVSVLPGAFSAYRFRAIMGRPLEQYFHGDHTLSKQLGKKGIEGMNIFKKNMFLAEDRILCFELVAKAGSKWHLTYVKASKAETDVPEGAPEFISQRRRWLNGSFAAGIYSLMHFGRMYKSGHNIVRMFFLHIQMLYNIFSTVLTWFSLGKLIFILSKRVPPPTGPSSD

SEQ ID NO: 39382 - protein, 71 aa, A.fumigatus
RPAIMVDQESNPAMDELEQGSPMSGVENGKREQVEDVEEMDVKSKALMHLLNTSEVCFPLSYVILYFIMKH

SEQ ID NO: 39383 - protein, 289 aa, A.fumigatus
VFVAIMADKMKKQQEEARLEAAKQQQQRQQKLTEDQKKPTATRSVARRETRARAKQPSADETTPAVSEQADEKTATSSRRGRGKKGASAMNGNSIASYFKKVDMEDPEDKPTVQEALEHAADEYEANPSALGGQDLVATQQPELVTGGRMRKYQLEGLEWLKSLWMNGLCGILADEMGLGKTVQAISLIAFFKEKNVSGPFLIAAPLSTVSNWVDEFAKWTPSIKTVLYHGSKDERATIRRNLMKLKDQRSADFPVVCTSYEICMNDRKFLAQYQWRYIIVVSSALPST

SEQ ID NO: 39384 - protein, 272 aa, A.fumigatus
KGCASLTRGQDEGHRLKNMNCKLIKELLSYNSANRLLITGTPLQNNITELWSLLHFLLPEIFNDLNSFQSWFDFSSMLDSSGQTDVIERRKRTLVSTMHSILKPFLLRRVKSDVETALPKKREYILYAPLTAEQKDLYREILNGTGRQYLEDKAAERLLAKNERLSRSASLKRSAESSNASTPNKSLKSSRDSTPASVASSTRRRRAPQNYKELSDREFNAQLRRLEQGLEDDLDIQQSPTDTEQEEIERANTIKLASTYMAGSNLEATDSC

SEQ ID NO: 39385 - protein, 292 aa, A.fumigatus
RTYTEKEIAQKKLQNPVMQARLACNSPHNFYWPWSDDPAAIDETLVTASGKMLLLDRLVPCLLKKGHKILIFSQFKTQLDILQDWATQLRGWNCCRIDGAISQTDRQAQIKAFNSDPGYKIFLLSTRAGGQGINLVAADTVILYDSDWNPQQDLQAQDRAHRIGQTKPVIVYRLATKGTVEQTLLEKADSKRRLERLVIQKGKFRSLLDSSSVNHSDVEELKKALGEDEFERFETGADPTALLSQKDLEILTDRSEEAYARAEKGLEHTGRAFKAVETKKEGNSLMAQITGK

SEQ ID NO: 39386 - protein, 222 aa, A.fumigatus
STLLPSPAINKDATLPSLHIVNYRQKGFRIPRTIPASLRASFENNKIDYQIDNARPAQRWGADGDTETPTGRKAKFGDTYLSRLGVGGKGSYTPKGTDFSDTIQDEEWEKVRLRRELSELQAKLEAANKASESRRDRPRNDGRPNWTLIKKEALQLLEYKERELRELREGTGRAKAGQDLERLREDIRTVGEQVEGLKSHLAQRKEVLADLRSQIEEERARR

SEQ ID NO: 39387 - protein, 256 aa, A.fumigatus
RSTTPPSMASASSPTTSPSRTSSSTTPPVPSSATIPMPLTSVPAPTSLLTAPPSTTRTTAWPSTPVSTSPSPTATATVVTVSPSAPSAAAVTMSSTTSPSPTPRSSTPRTVLGSRPSTARLALSPASSSRISPSKVSPSTVLLSSRTTRTASPLASPPTASRSPISPSRRSPVPSPAPPLIFTFSADLAAAPTGPGLAIASPVARRAPVARTFLLAPHARLASRNWPAGAVESVLFVSPLLDSCLVFDHEGWKYRV

SEQ ID NO: 39388 - protein, 65 aa, A.fumigatus
TNEPGHAAHLPRERNQVHSLCGDKSTPISLTHGNDKVGVLNPQWVEHGSVTQYEQSSQCPGATSH

SEQ ID NO: 39389 - protein, 68 aa, A.fumigatus
GEYEYLTALVSFLIAFKRRTRTIRSACSWDKKETRKLVTANEHMLNMDSLFLVFIYFLGLFTPISNCI

SEQ ID NO: 39390 - protein, 402 aa, A.fumigatus
PEPCPIFLNRVPTIDFRSSTMHFFQSSLVAATMGAALVAAAPAADLETRGSCTFTSTSALKSGKASCSTITLQNIAVPAGETLDLTGLKTGTTVSLTLELSECHRLMCCQKVVFDGTTTFGYKEWEGPLISASGTSITIKQNPGAKIDCDGARWWDGKGGNGGKKKPKFFSAHKLNKSNITGLKVYNTPVHGFSIQSDHLTIKDVLLDNSAGTKLGHNTDAFDVGSSTYITIDGATVYNQDDCLAVNSGEHITFTNGYCNGGHGLSIGSVGGRSNNVVNDVTISNSQVINSQNGARIKTVYGATGSVTGVKFQDISLKGITKYGIVVQQDYENGKPTGKPTNGVKVSDITFEKVTGTVTSSATDIYILCGSGSCTNWTWSGNSVTGGKKSSSCKNVPAGASC

SEQ ID NO: 39391 - protein, 88 aa, A.fumigatus
TSSVCHFSRSVLNNIIGGPDEVYMAGLVSVCPCSTVWPLMTSQTNYITSTGAYALIDPRTLADSKSSLQPRMKTLIEPAMASLPMSII

SEQ ID NO: 39392 - protein, 89 aa, A.fumigatus
TAHSLPSTGVGSNESGAEFGSGTIPGVPGKDCIWLNTTAIGIMKEAGTRVEHLPCAISHGASSTTSLEALMRCTWLVWSLYVHAQLYGP

SEQ ID NO: 39393 - protein, 108 aa, A.fumigatus
  UNSURE (78): Identity of amino acid sequences at the above locations are unknown.
PPAENENTNRTSYGEFAYEYYLKVFGAIFSKVELYGNVDGEGDCYGDCFEYELDNRGNRDVYCSCTVLGSMGSLGLNXADDLCIPYICQVQNAYVRSVCMCCWNGSQG

SEQ ID NO: 39394 - protein, 105 aa, A.fumigatus
RLRSCYNAFSHLDMRVEVKIPGSLESYCIDERGDKRVATEALWLETFLCGVLRAYSYADDGSGDAIRKIVGVRRFNPVTNTEMEHKFLDAAERLFFLGALHCKFC

SEQ ID NO: 39395 - protein, 74 aa, A.fumigatus
TGVYHHVTGVDASSSASLAAYVNTLTFSPLDKTHKVVSGIYWSETQMNERNDSVMVNVCAAVTMPSRISICVSK

SEQ ID NO: 39396 - protein, 340 aa, A.fumigatus
QELIGRQLSSDPETQVPSTVSNHLTAGLLKYIQTTGRYTSGVNLFEKLRTRDVEVSSLLARVLLMADEEVQAVRLMYDALQDVPMDYALLDCQAAFCMSKGEGELALECAKRAVTAAPSEFSTWARLAEVYVSLEQWDLALLTLNSCPMFTYQDKDTPRMPQPSRIMLPILAESILDEIDEGQPKQGDPHDYIHPSLRKLHAASYQGTFLKAYNLLTKIAASIGWDQLLKIRSEVFVMEEEYRVERQHSTSKPGKSDSVAEIQGVETNGNGENGDGSGAEDADQSAETAASNNGVNETQVESSIEKPEQSMASEVVKSSNDDVSLSTSPLLLPRMLMMNF

SEQ ID NO: 39397 - protein, 112 aa, A.fumigatus
ADPSHSSYTQFKNKRLCERWLDNLFMVLYEDLRIYTIWRTEMAQFRQQAIEYKKSATEWEILGELAERLHHFDEAIEAYQHCLSIRFSPKAMRGILKMYDNRNDTRGIPRLA

SEQ ID NO: 39398 - protein, 104 aa, A.fumigatus
PLRSIQKLVLHLRVGYRVESSNTDDFSDGITTTVVRVRICSQYTTEEGFKPQRLRSNTLIASLIDAIALQTPWYLHFDTHIEMREGIVTAAQTLTITESLRSFI

SEQ ID NO: 39399 - protein, 143 aa, A.fumigatus
DGVHHSQFIAGVRDLFAGRVDAVMSSWVALNIEPDEAIEEEVDDTKEIQIEEALKLYQNALKLHSQGPQFYAQAAEAYEALLSSDIFKYPESISDFKRSALQDSEAHLDDDVAVIDAVETFPEFSVNDSTSSTLLQTSSLSYK

SEQ ID NO: 39400 - protein, 264 aa, A.fumigatus
TVSLSVTDREPFLTDIAIGVFQDYYQHNQLREYSASSISWILSLEPFVLFAAGIVLGRVFDNYGPKWMLLIGTFLHVFGLMMISVSSEYYQFLLAQGICSPLGASFVFYPASACTATWFDKRRALAFGIMSSGSSIGGVVFPAMLSRLLPRVGFGWSLRISAFVVLALLAVANMTVRSRIAPVPRRVQFSDYIGPFSEVPFVLLMLASCCGFWAMFVPINYVILEAQEDGVRRSLAEYLLTILNAARLVCPSLQLRGLTCMLMS

SEQ ID NO: 39401 - protein, 150 aa, A.fumigatus
ASLPGRILPGYLGDKLGRFNVMIAMCTLSALTILVLWIPGTLLAPGSAAVYVIFSLLYGFASGAFVGMVPALLSQITADMSKTGVRQGVLYTCMSIATLTGSPIAGAILNRQQETYWGLQVFAGAMMVGSVVFFVAARVVLQGTSLRKKV

SEQ ID NO: 39402 - protein, 93 aa, A.fumigatus
SKQGFSVWLITAKDKDTLDAWFRAMETSQFGNIARINAEWYRYQNFRIEHSTTDYCLTQRFDGLILFKPLYGYNDSWHTINNGPFVDCFQYNW

SEQ ID NO: 39403 - protein, 129 aa, A.fumigatus
LTCDSCRYYIRSKKSKSLYWDVKRKSEAESLQVYVSTKSRARFQAIKILCPNYAPSPVDHRILGDDRMSLHHAAGPVSFIRNDMGFLILTISCLNPHFRISELTTSFAPQPDNRIAYIPGFGAEWELVY

SEQ ID NO: 39404 - protein, 226 aa, A.fumigatus
DECRTCSALRTDYIVIDDRDAEKRSQKDSGSSEWASVEEESPDDLGALSSSEVARLGLNTVSYVMDSEEPLDTLVRISQDFPKHSAKIAAYNASDALLKDIRTSRLGMLPSGVNVMWINGVQIDPRQIDAFSLLDHLRRERKLIDKFRSIGLSAQEAVDLLCHQTLGETLAKDSPPRYNYRDQIEGGGVIIWMNDLEKDTKYQSWPDDLSAVSFHLQFCVCVAYLP

SEQ ID NO: 39405 - protein, 277 aa, A.fumigatus
CETPSIPSNSGLLNNSSRLHSNPSFLIWQENMAFRTKWSPNNGPHWLRAQREKQRRSGEYKILFLDVLFPLSLDKFIFLDADQIVRTDMYDIVSLDLEGAPYGSTPMCDSREEMEGFRFWKQGYWKNFLRGLPYHISALYVVDLNRFRALAAGDRLRGQYQMLSADPNSLSNLDQDLPNHMQHHIPIKSLPQEWLWCETWCSDDSLSTARTIDLCNNPQTKEPKLDRARRQVPEWTKYDDEIAALAERVALEQQRQQLEEMESADEDEESGWEKDEL

SEQ ID NO: 39406 - protein, 719 aa, A.fumigatus
  UNSURE (643): Identity of amino acid sequences at the above locations are unknown.
SAAKKKIGSPDKAIFQHAIKDRTSRPNKQILSFDEILKSDELEILVSRTKQYQDRLGIKGNASYILVNGVFVPRDDNWPQEMSMRVGRDLQTIQQGVVDGSIEEDTWLPELFLSEAFDRRNPLIIPEDSKDIRIVDISKLAKSRGDSADTLRIASEMDTLDSKHLIVVGDFDSENGLKLLVEALELRATHGEVEMVLIHNPAPDVETESGSALIYNALKGTDKVDASRVLRHLKTAENTNFPEAEAKKMSQFWEAQQALARDLGFLPGTNGVIVNGRAIGPLPDGSTLSKEDLDGLLTYEEARRIGPVAKAAKDLGLESKLSGPLALAELSSLAALSTVSDVPEGIFEQMSSIRMDLFKKWNDLLSVITVSTSEDPAIIIAASIDPTSETAQRWLPILKVLSRLAGVRVTLALNPRDQIQELPTKRFYRYVLDSEPSFNDDGTLARPTATFSGVPVEALLTLGMDVPSPWLVAPKESIYDLDNIKLSSLKPDANVDAIYALEHILIEGHSRDVTVKTAPRGVQLILGTEDNPHFADTIIMANLGYFQFKAQPGLWKINLKPGRSQRIFNLDSVGGQGYSPQPGDENNEVALLSFQGKTLFPRLSRKKGQEMEDVLDTDVKSGSAMDYVSKGFNFAQGVLSSVXVGSKDGLAEKQADINIFSVASGHLYERMLNIMMVSVMRNTKHTVKFWFIEQFLSPSFKSFLPHLAREYGFSYEMVT

SEQ ID NO: 39407 - protein, 91 aa, A.fumigatus
PFTLAFCIDVGAFGVTFAGFLSEGSSGPDTDSSSESEVSDADSESDSDSDNVSCGGSSSLIVGFDGFEALGRGVVFVSALTTESEADFFVA

SEQ ID NO: 39408 - protein, 654 aa, A.fumigatus
TSSQKPHHWTHEQDDELIDLVGQYGPRFAHIAKILGRVEDDVVQRWKNRLEHRSTMRRGAWSEEEVRGLLDALQESWNNLKKDGQDVGRDIYEMDEGLVSWGTVSNKLQNCRSRQQCADKWRKIRRKIMGQRRTGNQDAIYDPATEAKPQGRAKSITLAEQMEMERMLKSSEYVDSEDGDEEDVEQSLGTESQSPNIKDEGESAEKESIIIPAPEKPPAPSVKALNETSQFKESQTENDVDSESDASSDSADSASDDASEAEIKLGSESGSDADSSVESDAKVDARMRAQSSKRQEKDVRNNKASSVKSSLEPTKPMPKQKLVERSKPKTSDGKQSGSQATKKSASDSVVNAETNTTPRPKASKPSKPTIKEEEPPQETLSESESDSESASDTSDSEDESVSGPEEPSDRKPAKVTPKAPTSMQKASVKGQVSQKTQKKDEPEESSSTSDETSSGDDNTDDSEADDDSDSDSDNSSSASADKPVESPKAAALKGTKRKAQQPADKAGTSESKRPKTGQKPSKKLSTSSASATSSSEDSESEDDADSDSEADTDESSSASDSSDSTSEPQPKSKSDPKQPSAQPKVDKAVNGQKPELSKPRTPVSKEGGNVKNGQSGAKQKSKQVKPSLPQVGKDGKKEKSKLGSAPVSKGKNSK

SEQ ID NO: 39409 - protein, 67 aa, A.fumigatus
NHNIPNSLITTVEAHMPLSAFSPPSLEHRKADGSNEKVADTDIVRTDFGTGTSKLPSNKRYDSCNSS

SEQ ID NO: 39410 - protein, 1088 aa, A.fumigatus
YRIQLAALHTTVTSASFFAAATFHFSSTTLSSAAHVSQALLSTLDAILGSTESSRAIAAIITLIRREFRSPSAEIGTDNIGVGDLLVGTVGFAMLQRWGRKSTERHMRLNGGYETVWDVVILDNGARADVIGTHPIEPAEYSRSALGSATRRSSFISPGNEEERFDAVQRPSSVVEHAEVPEMVLPASDQQVSDEDVRLHIMKQLPHGCRASIRSDVVTTRTITVDIYDDDNAELAAPPGMMMIEERFHNDRPDENSGLLSTMNQLPKHTVVFRTAFNKTQNADVRPSLRPEAFDSRELENPIATKSLPALPSTLLDTTTPTDNKNEADSQARISDSRGLSGEQPSTTEHMESLEYDKPRSRAAPESSSEGFSSAGAARDTRSGGGAKKSREVSSSGPVNELSTGSKGTFGKASLTRLAQKVKPANVERDETGQRIAQRSTLDKAQKFSKNGTQRNKMQKGPLVDKKSAHHDMSTTPTAAESATKMTGSHTNRTLLPVANRGVPRSALHDPRLRISPSQTRQVQTPSRSQRDAQPDYFTVHEVNQETFITKSDSFSLRSAGTRANSPAATRTHVRSSSSLSLTRSETDMALSLSADGRPTSSGWQQRTTSFAPSIYSLATAGSETSLILAHRARKSAYDDIDTIRSLTRDGRIPGIFPEQHFVQNIRRFCRFSSASYGSNALKVMGVTRQTQAIPHLESDNQEHSDFSVHTGLPASTILLSSFVDPAGGTNAAGETDSGFPLVHYVCLDHASKAVVLTLRGTWGFEDVLTDMTCDYDDLVWQGRSWKVHKGMHASAKRLLMGGGGRVMITIRTALEEFPDYGVVLCGHSLGGGVAALLATMISIPNSEQFGTSFVTATPQSAARRMLLGNNDDEDEESRLPFYLPTGRPIHVYAYGPPSAMSPFLRRATRGLITTIVNGQDVVPSLSLGILHDMHAVSVAFKSDTSGTKSHVRYRVWEGLRQSIVNKFYVNETPMLLHAGDGLGEDAWAWKTLKALREEMCAPKLLPPGEVFVVKTMRVLQRNAFTSDFGGDGYPMLGRPATRVQLKFIRDVESLFGELRFGSGMFSDHNPARYEASLAALAQGILDD

SEQ ID NO: 39411 - protein, 86 aa, A.fumigatus
LLCTALSASADLNFASSFLYQSLKVSTFCFLHPSRTFTLRKNWIPAILTMGKDNFIRQVENSAEFKLLDKVVKDQVTVQDAVQESH

SEQ ID NO: 39412 - protein, 128 aa, A.fumigatus
LRTKSQCKMRSKKVIDMTMTALSVHGPSKQGGIGVPDYNISLAVMELAQRREPAEHTKLAKFVSHLQKQIAIDPSTNEPLTVQRDILWTDMPSFGYTELETWSEFGGDYKGNTSCHSSSQNANVCRSL

SEQ ID NO: 39413 - protein, 152 aa, A.fumigatus
LVNVDLSVANVAQRLADRHARYSKRMHCMDDRTDCSSDVLLLLPLSSTFGTLFSQINSTQDVHLTEPACTVTNSLPAATCAIYTVLAIPILYLLVRHGRDGLLGWLFLFFFCTLRIIGGALAVNSPSTAATVISSVGLSPVLLATAGTLQEA

SEQ ID NO: 39414 - protein, 82 aa, A.fumigatus
VPTHKYSINANMISRHYRIQPLHKKMEWVSVLAYHMLVVAGVALTAAGPVKLQEHKQPLDKAAKIAKEGIAILAVAWGVLVV

SEQ ID NO: 39415 - protein, 159 aa, A.fumigatus
DELDDSGDIKIYGSCETFHHRQQHHSNPFPLGSVSPPYYRPKHQPLEMLFDMKSVVLYGLMALVHASPLSDLSKRAKLGDFQCPDDTLSEHDIREALHECRRLDDGSIGKYPAFFGNKSNNQKVFGNIPDGTDLREFPIIVGGVYSGGKLRERKDTEPS

SEQ ID NO: 39416 - protein, 157 aa, A.fumigatus
CSILVLLLGAPIRPAHASQIQSVEPGRDKDDKNKHDKDEGDMKSNNEERSVQETETEVEEPTGHIVSDLTTRSKKRRLGSATCTDGVTLSHDDVVNAFRECKKWDDHGRGGYPHKFGNKSGNSQVFEGITKDLREYPIIQSGTWTGKSSTLSLWDAD

SEQ ID NO: 39417 - protein, 107 aa, A.fumigatus
VVYLLVMAAKFIPRQAFPSYASIPRSYYLGHHKAGLKKMQNMLSSIDYVIECRDYRVPITSINPMFEEALGKTRRLVVYTKRDLGAEPRSSAQRTVSPRSKFGPYLS

SEQ ID NO: 39418 - protein, 269 aa, A.fumigatus
VQDRSLAHTCHNADGWFCMQAEKIIKKFDSSSAVFFVSSSSRADVSSILAHLRNDAEGPDKLVGCRVMVVGMPNVGKSTLINNLRNQGVKRAKAVQTGGQPGITRKIGTPVKIIERDNGAHVYVLDTPGVFMPYVPDAEKMLKLALCGCVKDSVISPVTLADYLLYHINLHNPGQYERWSQPTNEISPLLDSFARQTGLLAKGGIPNIDLAALHLIQKWRSGELGRFMLDDLQAEQRRIDEGIENDVGISISQALKAERMSRKQPASNS

SEQ ID NO: 39419 - protein, 465 aa, A.fumigatus
SSARFPSSPVVKTVNWRDAGEAQQAVEILPKWTEIDVDDALELLGPTFDNTTVRSYAVDRLRKADDEELLLYLLQLVQALKYEENSRGAAHDSSLANFLITRAANNFKLGSYLHWYLMVECDDTSPGTLSTQRRLFARVEYYFMAELEQVSPEHRKTLLRQGELVAVLTKIAKDIRFARETRPLKIEKLKKYLKDPKNELVHIDPPLPLPLDPEVSVTGCFPEESNVFKSSLSPLHITFKTSEGRKYPILFKVGDDLRQDQLVIQIIILMDRLLQKENLDLKLTPYRILATNATAGAVQFIPSTSLSAVSAKYKSVLAYLQANNPDENEPLGVRKETMDTYVKSCAGYCVITYLLGVGDRHLENLLLAPDGHFFHADFGFILGRDPKPFAPMMKLCKEMVEGMGGTTSPQYLQFKQYCFTAYTTLRKSANLILNLFSLMVDANIPDIRVEPDKAVFKVKERFTSR

SEQ ID NO: 39420 - protein, 252 aa, A.fumigatus
ARNSEKAQSMLFRFRAQQAADLGIIDIGRTRRPKAITSVDSIPSCEKWRGQVLKEISRKVSRIQEPSLSDYQIRDLNDEINKLMREKWAWEMQIRNLGGPNYMRGSGRVYDDEGREIPGGGKGYRYFGRARELPGVKEMFEAAARRGRRPPEEEEEEEGKGRGGDIATKKVDANYFGYGLDEEDGSLLAYERQKEKEAVEYLRGQKDSDAEDGWEPLPGDAGDGVEWRLPTLEEVQEELVDRRRRRLLDKIS

SEQ ID NO: 39421 - protein, 103 aa, A.fumigatus
TGGENISSVALESMLVTHPDILEAGVVAVPDAHWGERPKAFVTVKQGKQIDGQEVIAWAKNNSAISKFMVPREVEVVAELPKTSTGKVRKNVLREWAKRGSRT

SEQ ID NO: 39422 - protein, 252 aa, A.fumigatus
NASDRFPLPLLTSISQLKLNGVVQVTDRSILSFAENCPAILEIDLHDCKLVTNPSVTSLMTTLRSLRELRLAHCVEISDAAFLNLPESLSFDSLRILDLTACENVKDDAVERIVSAAPRLRNLVLAKCRFITDRAVQAICKLGKNLHYVHLGHCSNITDPAVIQLVKSCNRIRYIDLACCNRLTDNSVQQLATLPKLRRIGLVKCQLITDQSILALARPKVSPDPLGTSSLERVHLSYCVNLTVPVSFRTSV

SEQ ID NO: 39423 - protein, 153 aa, A.fumigatus
HQLAVNYRLKEDDIAYIFTHSDADVIIVDKEYLPLLQAYRAAKPEIPVIVDTDTDSTEGQLSGPFDEAVLLGLKYDADTGAKGWDGLESQAASEDDVIALAYTSGTTARPKGVEFTHRGCYLAALANVIESGLNSQQGRCRYLWTLPMFHAMG

SEQ ID NO: 39424 - protein, 238 aa, A.fumigatus
SAVIRLTLPGWTFPWAVTAVRGTHYCLRKIDYPEIWRLLKQEHITHFNAAPTVNTLLCAANEAERLPRPVQVTVAASPPTPHLFEQMTNLNLHPVHVYGMTETYGPITKGYYMPQWDQLPAEEKYKKMARQGHGFVTSLPVRVIKTDVPEGTIIDVQRDGKEIGEIAFVGNICSRGYYKDPEATRKLFAGGVLHSGDLAVWHPDGAVQILDRAKDIIISGRQYLSSVLFFFPVHSSQC

SEQ ID NO: 39425 - protein, 108 aa, A.fumigatus
EVQRRDWNHQFLFASHRPSTNHPSLWQPPPTLYCADSLFSSRPIKQLALWVPSRDPTHPPYLKFSFSHITTQRIDRLDNATYSEHKISITPPRTSFPPRSSVCRFPGQ

SEQ ID NO: 39426 - protein, 286 aa, A.fumigatus
IAYLMLLENLDQTTLITRPPQASHPLSRMPRSRQPLRFSSEVPSESSSSTSPDRTVDDDTDFFMAQANDSQSSVGVGNFREPRDQGPRNTVIPPIGRLPPELLISIFAKLSSTADLLSCMLVCRGWAANCVAILWHRPSCNNWDNLKSVTASVGKPDGLFAYSELIKRLNLSALTEDVSDGTVVPFAQCKRIERLTLTNCSKLTDKGVSDLVEGNRHLQALDVSDLRYLTDHTLYTVARNCPRLQGLNITGCIRVTDDSLIVISQNCRQIKRVSFKMLLIDSRCLC

SEQ ID NO: 39427 - protein, 113 aa, A.fumigatus
GIHALLNNCPRLTHLSLTGVQAFLDPAVTQFCREAPPEFTQQQREVFCVFSGEGVNRLRDYLNRSPDPPREMTEATMYDDDEELDEDEGQVTGLMHATVINDEDYIDIGHAHG

SEQ ID NO: 39428 - protein, 192 aa, A.fumigatus
YPSSLLPLTIEMIQYLGCLLQVRIIACHHRLGSSGSHRGLVSIVGKMSRFSACHQKGAGPWIPSTALAISYSQWDSTSADTGHVRLPLFAHSRRTFFLTFPVLVLGSSATTSTSRGTMNLLIALLFLAHAITSCPSICFPCFTVTNALGRSPQCASGTATTPASRMSGWVTSIDSRATDEMFSPPVQLWSAL

SEQ ID NO: 39429 - protein, 135 aa, A.fumigatus
ASAQYTDSTVSKYWCEPGRNSRKMAESTGRFPPTPMDHSALKTHTAAKVGEPAATSPNTAVRPMVRLKAQRRPKISQPKPQNRAPMSRPIFWARVKNGGLEMWNSDVTGPRMSEVTIGQRLSLAQPKPMTIKSCH

SEQ ID NO: 39430 - protein, 75 aa, A.fumigatus
TKLTMQALILGSRGTCLVIIWLIKVTFYDYDHDTHDQMRLKSGIETSCGPKSKRMESIQLENVVGMYGTLIIDRD

SEQ ID NO: 39431 - protein, 297 aa, A.fumigatus
DPHLYNVNQANGAKNENGTLPRIKIAKFDGFSQTPRLLQEILTWFTGLEHFAFTYIYNRSYAWYYRWNYSNIGAALDRHKETLKSILIQLFGYSRIGSFDLRSYKSLRVLELSLQNIVVESPEAAATKLLAPNLELLVLNFGTVDRKKAKYNCIEKRDEEWLVQFGEHASKIRKSLPRVHAKIPAYAFRGTETELWDARCTFEDLDNIQDELQGYGIDFTYNDPPVSEEEFREWIRDKDEMDLLGGLWRYMNRYAAYHSDESDSGFESNALDTKDHDEMAQQSTDKLDTEVEEEAQI

SEQ ID NO: 39432 - protein, 278 aa, A.fumigatus
SIIRQNSKVIRSSSSMDPNDINILADFLAFNQIPSTFPPSDAADVLVLCVSAILPVAEKVFAHLEKNPTAIKTLVLCGGIGHSTPHLYEAIANDPRYAHLLPEIDGLPEAQVLHHIFRQCFDAPRILSSCRVLIEDRSTNCGANAIETKRLLEVNGICPESMLIVQDPTMSRRTVASFEKAFSGQRTLRFTSWPTFVPKVRLEGGRLVYDESAGIEASRLWRLPRFLGLVMGEIPRLRDDEEGYGPKGKGFIVHVDVPDEVEEAWKRIKDAEMEWERR

SEQ ID NO: 39433 - protein, 174 aa, A.fumigatus
TANRWFSVTMGTGIVSILLNTLPYNAQWLYWISVVIFAINVLLFITGCIISFLRYTLYPEIFGAMIVHSVQSMFIGTFPMGLNTIINMCCFVCVPAWGEWTRNFAWGLWIFDAILSVVTALSLPFLLYVFPLFQTYPTVTLKSYSMAHGNETQLSSMTAIWLLPIVSCIVAASS

SEQ ID NO: 39434 - protein, 84 aa, A.fumigatus
QASQRIFQSHVDKDLDIVTFHIHISVACKYSSFFYPAVIWSGVRSTGDVVNLPDYESDTFGLYLQWCHANIHPVSEESEEKPEY

SEQ ID NO: 39435 - protein, 355 aa, A.fumigatus
  UNSURE (353): Identity of amino acid sequences at the above locations are unknown.
IKMADDHDKLNDYRLNAATLNTAIQSIGMGAYQWQLFIVIGFGWASDNLWPIVTSLILGPVTSEFHISSPPFLTLAQNIGLLIGALFWGFGCDIFGRRWAFNLTIGLTAVFGLVAAGSPTFAAVCVFNALWSIGVGGNLPVDSAIFLEFLPGSHQYLLTVLSVYWALAQLLANLIAWPILGNLTCPDEETCTRANNMGWRYFLIAMGGIAAVMCLLRWTCFTLYESPKFLMGKGRYEDAVAVVHEVARRNGSSASLSVDDLITPETSAEQPPTVGTNVLIRHRLDHLTLSHIRALFDTPGRACSTSLLIVVWGLIGLGFPLYNAFLPHIQQTKAAEFGDGSTGSELTGLPDHXRR

SEQ ID NO: 39436 - protein, 168 aa, A.fumigatus
LLISTSLVNISSTLISRLSFDSSICMVFIKVYDFRRGCEWVRTFADPLHHIVSDVFHTGSPDSALWEFKHGNGNFKRGDLVGLREIKRRASRHALIHRDSFPGHKTAVSQPGTPAEPVPDATEARLLNLEHSLYDMHTRLSRAEEAHTALNLRCQAMAESLARCHHVR

SEQ ID NO: 39437 - protein, 75 aa, A.fumigatus
QLLVICRSDLLTRLVRDTFLSFHGSPSRPSSISCYTFFRDYGVDWNEWRTKGQRGTLDWSKTLHPPLSLVGDKNS

SEQ ID NO: 39438 - protein, 865 aa, A.fumigatus
QNESRAAAEEATRLVLELQTIARDAGHPVPLLIALDQENGGVNSLYDEIYIRQFPSAMGIAATGSKSLAHDVAYATAQELKAVGVNWILGPVLHVLTNVRTQPLGVRTTGDDPQEVSQYGVEFMKGYKKAGLVTCGKHFPSYGNLEFLGSQTDVPIITESLEQLSLTALVPFRNAIVHGLDSMMVGGVSMSSAGVNVMHACLSEQVVDDLLRKDLKFNGVVVSECLEMEALTHNIGVGGGTVMAKNAGCDIILLCRSFPVQQEAINGLKLGVENGIIGRARIEQSLRRVLKMKAKCTSWDQALNPPGLPSLMQMQPSHTSLSKRAYNNSISVVRDKQNLLPLSNIIEPNEELLLLTPLVKPLPASAVSRSVTEHMNLSIDPIASDRTASVLSGESVFKELGRSLSRQRSGRVLHTSYTANGVRPIHENLIDRASAVIVVTADANRNLYQHGFTKHVSLICRSQFSPSGEPREKPMIVIAASSPYDFAMDTSIGTYVCTYDFTETALEALVKVLYGELTPKGSLPGSISRSQKLHQARQHWLVENWNEERDAQSLDTLLDAVRADCAQGQRSELLGVTSSSFLLRSEEIDEAHFVVRNSSTQALYVFCSTYFFRSTGTGVIGSLIVDPARRKLSIGNSLHNRAIRTLLQRKGMRRFQLGSRLPGIYLGIPSSNPVERKRLRQWFANLGWNTALSRPVCSVVLRNLPTWTPPDGLIQGLKNADVSYDLVHGWDYAEPILDHIKTNSRQGLIDIYKIALGGAPNCGIIRAMRPSDGAILGTVVIYNGRSSLAEHVPVLKATQPSSGGISSPVISPSVGEYATVMQGLVLLGIKQIRRQGAEAVVIDCVSSNPLYPAFQSFRSLPRLTG

SEQ ID NO: 39439 - protein, 94 aa, A.fumigatus
LRCIPNHTLYVVGNNDGGLLNEHYLPSSTCGPFNLISEFDSVLVHGYVRKETKDEIEAEPLLWNDKPLGGEGLNSVSKSDHAEEQGHPANDHFC

SEQ ID NO: 39440 - protein, 191 aa, A.fumigatus
  UNSURE (186): Identity of amino acid sequences at the above locations are unknown.
LVSLPSIMASVDPSLHDPLLALRRAIAAGSLPTPTTTSDLSDDNATEDLAKATHLYFRQPIPQTIPLTASTRFVSASSDSAVDLRSIFFAWQKKDVAIPEYIASAQELNESLKQKERKEGEPEEKVQNLVFVERLDLITWLEGASDESEYIKPLEGAAAAAPSAAPADASAAIAPGAAGSSPRGCXWTSID

SEQ ID NO: 39441 - protein, 976 aa, A.fumigatus
  UNSURE (292): Identity of amino acid sequences at the above locations are unknown.
SPQPPNNTPQRVFHLFVEGVLCQIMTDTSPVAITHSTTEPYPVTVPLNSPALNGAVSDSAAPDEEEPYTIKCICAFEDDDGNTVFCEGCETWQHIECYYHGRHVPEVHNCVDCEPRYLDAKRATERQRRLREIGDSGDRKAKRAGAKGQRKRVKDHGDKVNGFHQRADSIARDQPPAKKAKATHRASGSISSLPGAAPFPLDARRRVATSMSPTKSLGPSIPLYSNEFLHLYDHDQDYAPMNSNLFVNLPLAADLASWVTEPTALARVSNGRSSRDIFTWSDTALDRSLWPXLSTETITDPSINIEGRHPTWKVLRTRESVSKDHIVGEITGKIGLLRDYCLDPSNRWQELRHPEPFVFFHPQLPIYIDSRHEGSILRYVRRSCRPNVTIKTYITNEVEYHFCFVAKEDISANSEITAMWYLDPQLFESTHGLVKQEPNDSAQEVAAICISNVLANFGGCACEPPANCLLASVDRRRHPKALESKQVNGKRKKAKAKSAASPPATNSRASSETTKNMEDDDQPDSRSTSGSSRGQPRSRDLTPTLQHDGESELSAREKRKIAAAEKKFQQLEHDQQAHKKKKRNSGQATLVPQAQVSQSAHQAVSAQGHSRSSSSAQPSGSMSRKPSSIEASHGRSPLRRSHYVDSAIQTEPEADTSMLSVAPPLRRPSYVPLTQRLLRRCHADRVRLEEDSRRLPSSSPAALSPLSSSSHGALGPNVTPLKTPLIEKEDVEMKDSDSPTTVVSAGQSPTQETEQKASTPPSAPWMLTKPPFPPPWPSTAAHNARLPGSRVNNHRTNLWVPLPPATHPAGPTAISPGSATGSTVSSPSTLDAPAQPAAATPGSGVTAPSPVKKKLSLGDYLSRRGALTTPTSEKSQAQATAMLPPQKPVSDQSTATRDVSAPVDTLHPEIKVTGEAEATKRESPTSPDVTVKGASSSGPTSHVPSSFSKHNCLLVTLAALLWQFAGSFFLFFHVVS

SEQ ID NO: 39442 - protein, 71 aa, A.fumigatus
MRDGDWGGICHNLTEYPLHEQMKNALWCIVGRLRASNNPFRPNRHATYHQIDGYTSLLSSCPIIYNTCGIE

SEQ ID NO: 39443 - protein, 79 aa, A.fumigatus
KMAFPYKNVFIIGATSGIGKALANKLVQNGIPTIIAGRRQGNLVDFVQQHGTDKVKSKVIDVLQLDKVCLSTRFHNACS

SEQ ID NO: 39444 - protein, 201 aa, A.fumigatus
IPQFVADVIDENPDLDCVFVNSGIQRPFDFSKPESVDMDVFDQELITNYSSAVRLAKAFIPHLQRQSTAAIAFTTSQMALVPMKRCPNYGASKAALHHFILALRTQLQDGPGNVKVIEIYPPAVQTELHDAKHQPDLKDGHLIGMPLCEFIEDVWCQLCHGKEQVAVGSAREIFEAFEIKRQEVYYQMTEMLSKLLRQFLR

SEQ ID NO: 39445 - protein, 225 aa, A.fumigatus
QDIFVCPKSISMLMKWPYRPRGHRAAAKANTHGNRYDTRDSSSSFVGHRPSSSANSVYSAVRASESSASLPGTNSQSPMSDASMLTPPAINSAHEPSLDSDSHYRSRRQSLGRPSSGAEDPNRRSVEGISARATPDYTEILMEMRDLDPHDPLAHEWNTDPFEHDAELTTHYVENYFTYVNDSLYYIFPRRRFLLWLRSCHAKSLEDKMLLYSMMTLGSHFLRSA

SEQ ID NO: 39446 - protein, 334 aa, A.fumigatus
IALRSAVPFMNVMSAYYVGPFGRMLPVTDRNSPEREPERSANEPVSGNHPYQLPPPRTMESLQFGTDPFLSRRNLEGNGDSRLGSSAHGHQPVINEQLPSVSELLTPSSRSSQSVSPNRSRLFGFYHPTGESPKPSQPSQRPHTTSRHDDTGVPRTPQGRPEARAERFSRPTAGNLPSLSQMSVYTAGNEASIHGGIRTDVPQQQAHLSPFTPQGRVSHDKEIREENSLPGTHEIGSAAADQSKMAQVRPHVVDERYIEGEGWCYIYADGSHCPKTIDGVPVNANWGVTKAGKPRKRLAQACLTCREKKIKCQPNLPKCDQCQKSGRECRFESA

SEQ ID NO: 39447 - protein, 66 aa, A.fumigatus
RKEKNKKRKEEHSGESNGKWNRERKRIIKKKHKKNSDTLVIPAAISSSLTVLLGHGVYQQTTFSFL

SEQ ID NO: 39448 - protein, 83 aa, A.fumigatus
TSCRPIMWDLSGVCYLLPTEILRRGNQSVQLTSQYLETIPTNFPHRAQWSLCSLEQTPFSPGEIWKEMETPDSAQVLMDISQS

SEQ ID NO: 39449 - protein, 139 aa, A.fumigatus
REDTQGPDGFYLFLSPSPLSSIESSDYRVGLRPSEVRYWDVRPRKPVINCSAGRDSDSRLTLVNMGGQVSKMLGKIFGTKEMRILMLGLDAAGKTSEFQLRGRLNGIAWKLTSVTRSYPLQTKAHESGCHHYSYCRFQR

SEQ ID NO: 39450 - protein, 85 aa, A.fumigatus
MELPGSSPASPAAILYKLKLTNQDVTTIPTVGFNVESVTYKNVKFNVWDVGGQDKIRPLWRHYYSGMNRHVWCNISSIRVLTSIR

SEQ ID NO: 39451 - protein, 96 aa, A.fumigatus
QTTQHSDFRSYVPHGFIFFPVFHFRSSISFFSMISPSVSVRVIHTYPFTNNPPVVLCTSDCSSAILVEYICFRDFPCRKNPNRWQIWTSTYNGSLQ

SEQ ID NO: 39452 - protein, 137 aa, A.fumigatus
KLPLVLEIWITSLTQLIYRYKSSQAKPSTTSAPATSYSTGHNARLQKRRKSPLQACRRYVLPQSIKTNGKRWLDAKLIRLGPESKTSEAVGIIREVATESTQMTGRNVAASDEEPRYTVSYYFIQCVAGGANWGGKD

SEQ ID NO: 39453 - protein, 203 aa, A.fumigatus
TTLTPMSIPAASPELEQSVRQLSLRDDAPIKDIPRPTVKTPTRKKKAPVVADSWEDEADSDPSLSEVEQSRSSSAATPDLSTLSPSVSTSTEGPLDPPPTPISPQTSQLWGSSAPLPGRGLSSSPPRGSGSRSPARRPEKQTAVAGRLIAGALGIRAPKRTEEQRAYDRAIKEQELRRRNREREEEAKRKEEEERAKAAVWDE

SEQ ID NO: 39454 - protein, 76 aa, A.fumigatus
SPMDSIMAPNGKHSRLTRVACLTKNSYKEERCQAQINALYECCNAFYQEKGEDAKTPSCPKPSLLKLRIKQQSQGN

SEQ ID NO: 39455 - protein, 63 aa, A.fumigatus
AKPFVVRSYARSLNTLALRQHQHRRAARSSPDTYLTTDISALGVERALTGSWVELVPTARVRV

SEQ ID NO: 39456 - protein, 67 aa, A.fumigatus
TSGFECFSMDTCSRIQAQERAKPDASAIYVPGNQTAKAIEEAIEAEIPLVVAVAEHVPIHDMLRVSR

SEQ ID NO: 39457 - protein, 156 aa, A.fumigatus
GMLKPRMADLLQVHSMLQTQSKTRLVGANCPRLISAIGKCRIGFQPLPCFSPGKVGIVAKSGTISYETVASTTRAGLGQSLCISMGGDVLAGTNFVDALKVFEEDPDTEGIILVGEIGGIAEIDAADWIRDYNKRTANPKYARFEHVLAYVRTDTA

SEQ ID NO: 39458 - protein, 87 aa, A.fumigatus
ELTLPRPIMALVGGREALPGRVMGHAGAWITPGEPDAEAKHRALESAGVTMVDHPEKFGQGMKALLARRTLTSATVSIVRWPCASRD

SEQ ID NO: 39459 - protein, 117 aa, A.fumigatus
CTVRADQIVNGAGLAMNTVDALSIHGGHCANFLDTGGKATSETVKSSFRIIRSDPRVKAIFVNIFGGLTRCDMIAEGIIMAFRDLEMNVPVVVRLRGTNEEIGQKMVSLVPDYGILD

SEQ ID NO: 39460 - protein, 94 aa, A.fumigatus
LPVSMADNGTPSEAPAPPPVEHLNIKVTDNNNEVFFKIKRTTQLKKLMDAFCERQGKQLSTVRFLFDGTRVRPEDTPDSVRAAFPLSDVYANID

SEQ ID NO: 39461 - protein, 84 aa, A.fumigatus
DTASKHMKPNILIHPKQQPSPSPPPLFSSPPPPFPDSAGEAPAPLSPDHTRAAPPSSLEPGSPTRPQSAFPQQLSASPAFSPAT

SEQ ID NO: 39462 - protein, 197 aa, A.fumigatus
NRFLRSDFILKIQQTRACFAALALLLLLLPPGNPFLRGGGGLRLVGAGRSGGGGSLCAGGGLGGAGFAHVTGNVFLGGRTIRGRSSGRGVGSRAEVRGDVSAGSARKLDLFLRCLRGGRGRGSAGSLLGSLALSPARATASTRNEVKARSCPLNGPLELSSTGGRFCEARLSSRTASLGFLLTLLLPLSNLVESPVL

SEQ ID NO: 39463 - protein, 734 aa, A.fumigatus
SIRLAAGADALVELVLLLLELGKLDGAQPVGIQVLQVNLADVDALDTTLKLLKLLLELLLADALLFIPQTLLFAFPLLVKQSLLLSLLQLLITNTLAGLLLSLLALQSIGGSFLLLLDEDTAGKGLLVLLGSTSLGAGLGSLLGLDTGLVIRRIDVHACDVQGLGETGELQAGDFSRGVLKTLHRADLALSRTGGAAGMQSLGGREDIGVEGQNTCSMVDADSEVALLASVHDELLDHGRGDLEGIGELCKLVDKLELDGFVNLGQLLEETGEDDLLQGQDVLLHLGIGTDLLEDGGDLLADGKRVEVNLEDVVEIPNFRTSTLEQALIKSIPEKHRTAGWLSHTEQVGQTGILVLAGLIDIDQGASRAGGADDGDRQSRQKDKGSGLGHVSLGHRGVLLLGALACGERSGGLAEKVVVAVPSGGMEKIVLADEEDPCKLFVVISHHDVLGGALAKAEKSVNVFNAAESLLPQLQLHGNIQLLEAGVKMALQGVGIAEVDSVHLSGVLGGVLDVVTEQLAKTAELGLAGVLEAKLEGLQGGGLVHDLKASIVLQDLQDGTVGLPEKLEPRSDNSAVGSVARLFARNSSKQDGLGGLDRFQILDVGRWGSGLQRGLDLVGLGLGLGHLLLGEFDELLEDDLFSSTNISRCKSHHKSEKVLSLPRWFPRWCSGRCSCTGRDHPWQPFLCQRSTHNSTKRSMTGSREAIGLLRVLLEVTCSWRTLRAAGAWPTAISS

SEQ ID NO: 39464 - protein, 68 aa, A.fumigatus
YRRFQQKNYGFHTVQILKLDHCRGTPPLLSAGSTIYFWSQYGSTQKFIPHKSENGLVLAKVGPWLNHS

SEQ ID NO: 39465 - protein, 91 aa, A.fumigatus
PCVLSLQRAQELIAVGQAPAALNVLHEHVTSKRTRSSPIASLEPVMLLFVELCVDLWQRKGCQGWSLPVQEHRPEHQRGNHRGRLRTFSDL

SEQ ID NO: 39466 - protein, 410 aa, A.fumigatus
GMNRSASASRSSRSSLRSLRVVSRASTSARLTWRTWMPTGCAPSSLPSSRRRRTSSTSASAPAAKRIDHLERAFRREELKHIPEDYEAQKKRDMELYEAIKAETLKEAEEKHKEAVALKHRLSRLVPVFSSFRKEVSEKRHEEFEKRRKAAEREFEAKKKQRIKEVQERRRRERAEREAEERRRKEEEERAKREEEERIAKEEERRRILAEEKAKREEERKSVSPPVLSICPNGTNLQYRRLDEIAQRQKQREEEAEARRAARKSGLAEPPTRAAELERPVERTAPRLNLVSRTGSGPSWRERQAAKEAAGAAPAPAAAEAPKEEVQLPRRTGGYVPPHLRSGANASPATPPSNGPAPEKYVPRHMRESSSSQPPSRTQTPPAAAPASSDKPEASPAPQKWVPRWKQQQQ

SEQ ID NO: 39467 - protein, 84 aa, A.fumigatus
NLNSVEAIVLLLKATVSERLDIWGSLKQIENVYHLESTYIHLRFDAFLMYGLSMLKYLTWTPHQRLECKNVSELSLMYLTIRST

SEQ ID NO: 39468 - protein, 316 aa, A.fumigatus
RKPRRSTRRRLPLSTVSAALFPSSPASARRCRRSATKSLRSAARPPSGSLRPRRSSVSRKFRSAAVARGPSVRQKSAAERRKKSGPNAKRKNVSPRKRSADASWLKRKPNVRKRESLCLPQFYQFVLMVLTYNTGDSTRLLSGRSSVRRKPRLAVRLESLASQNLPPVLLSSSGPLSGQLLALTSFLVLAVALAGESARLPRRLPALPLPLPPRRHLRKRSSFLAEPADTSPLTSALEPTPRPLLLPRMVLPPRNTFPVTCANPAPPNPPPAHRLPPPPLLPAPTSLRPPPPLRNGFPGGSNNSSRASAAKQALVC

SEQ ID NO: 39469 - protein, 663 aa, A.fumigatus
VVLKKFIELAEKKVTEAQAKADEIQSSLESAAPSSNVEDLEAIETPETILLATVSGEQSRDRTDRAVVTPWLKFLWETYRTVLEILKNNARLEVMYQTTALQAFQFCLKYTRKTEFRRLCELLRNHVQNAAKYSAQMHAINLSDPDTLQRHLDTRFQQLNVAVELELWQEAFRSIEDIHTLLSLSKRPAKNVMMANYYEKLARIFLVSENYLFHAAAWNRYYNLLRQSAAALAAGQGTKKENPSVTEADMTKAASFVLLSALSIPVISTSRSRGALVDVDEARKNKNARLTNLLGMAQPPSRAVLFRDALNKGLLKRARPEIRDLYNILEVDFHPLSICKKITPILKQIGADPEMEKYVLPLQQVILTRLFQQLSQVYESVELKFVYELAQFPDPFQITPAMIEKFIMNGCKKGDLAIRVDHTAGVLTFDTDIFSSAKALHSGSAAGSAESEVGSVQRLQNTPAEIARLQLTRLAKTLHVTCMYVDPSYNEARIQAKKAAQARAEAGAAKEHEETLARRVLIEKKKEAATDALQRKQREEETRKRIRNQQLQEAEKQRLLDEQREREKKRLRDEQERIRQQELKKQLEELKSGVKGIDISEIDLEDLDANRLRAIKLAQLEKEKNELNERIRTSCQAYRSPGACFPSRGVEAHSRGLRSPEEA

SEQ ID NO: 39470 - protein, 159 aa, A.fumigatus
LVATATTCERSRDPSLQNSPAAFQFASSDDLNWFSTHNCTTIDDDITLLESFNGSFSLPDVTSIRGIITYTGPTETFKLTSISLPDVLYLGGMNVDLPGSQKIINVSAPKVTAIDSINLAVPSTAAIDFRSLKQATSISLTGNYSRYSVCSCNVQQTPD

SEQ ID NO: 39471 - protein, 71 aa, A.fumigatus
AGSYSTHQTYYHSNEYAPQANPTTYIYNQGKGDGRAVSPSPDISFVLALCQRFTTWDLYRITIYSGASCGL

SEQ ID NO: 39472 - protein, 65 aa, A.fumigatus
RSGGPSEENMTMDGQDKTEQADDYRSVSELGYVVVYHYCVWSKYPHSRLPRLFALLARVEFLSWN

SEQ ID NO: 39473 - protein, 737 aa, A.fumigatus
GRVSFQSRSVKNTALENNGLEDIRRGLDNLGSTGWTINREVLNVMLEAWNSGEAVANLAPLEPDLPLPPKPAPEAGYHAEKEWDTLVREIENRRSGLHSMRCFQNFQMELARAYRNVTFYLPHNMDFRGRAYPLPPYLNQMGADNSRGLLLFSEAKPLGASGLRWLKIQIANLSGFDKASMSEREQFTMDHLDDVLDSADKGLHGRRWWLKAEDPWQCLAACCELRNALRHPDPTQYPSRLPIHQDGSCNGLQHYAALGGDSVGAQQVNLEPSDRPSDVYTGVAEFVKKEVAREAAQGHPIAKILDGRITRKIVKQTVMTNVYGVTFMGAMRQVRKQLIDHYPDLSYEDKKNGSLYIARKIFEALGTMFNGAHEIQHWLGDCASRITTSLSPEQIEQIAKEALTPSSSGRSAAKLKDPSEKFRSTVIWTTPLGLPVVQPYRVRKARRITTTLQDLSIVDTNSEDVVSKRKQLQAFPPNFIHSLDATHMIMSANACNQAGLTFSAVHDSFWTHACDVDTMNQILREAFVRMHSDDIIRRLASEFQVRYGQNLFLAKVDAGTKIGRAIRDFRKGGKKKSGKVQELLDEYKRQQLLRSDDPELQAQGRAMVTAGSVFEQLGGTDKDLAIASSLGESAVGHIPEDLAAAERKTPGLGIDTSDPAIESLFSDFQDLEPRGGEADKATGAELEDEMVAEDGAGKKKKKVRQHVWLWLPLRFRDVPAKGAWDLTRIRDSQYFFS

SEQ ID NO: 39474 - protein, 64 aa, A.fumigatus
SLSSPPPPFIHSFFFFFFIYFYYYYLISAFYPFPSLFLFLLGLLHLCFLSSWFLVPLFFLQEAL

SEQ ID NO: 39475 - protein, 98 aa, A.fumigatus
VWRKRREYDKTERDDRLDDIEDSSPLRCGRSATHTVFGVGHRINSASFLLIQAAGQVRRLDDSQCMNIFMDECGVLSVVRALICIGRDRGSVPRRTIW

SEQ ID NO: 39476 - protein, 86 aa, A.fumigatus
WLPRRRVSIDSNSMITLARIRLVPRVERTVWHSVSSRTMSFALMFNYAIANLPNQSTKKGIHTNDLVADSTTYYMNASAAHQSRQC

SEQ ID NO: 39477 - protein, 156 aa, A.fumigatus
WISVPGALMAQVYFIHSTINSSDATSETWPVTVASQLVQCLSIVTASAPQFIPFLKQLQSTGMRLDGMTRYTLSSHHKSSRGRYYLSTDRRRTGNESTHELDNIPLATTKTVVTSNANGLEEDHDNESQSSQTGIIRETRTWTVTEEHTCLPGHNG

SEQ ID NO: 39478 - protein, 176 aa, A.fumigatus
YRAPRTSFFLRIRSSSPISVSDRRGTPCKFCVTLSLVVPPGIGMMVGIPGLPLRVSIQAKAIWAGATPLREARSLTSLTSLMLCFIASSWYLGSDFRKSPSGISDTLVKAPASTPRPRGEYATRGIPSSAQVSATPSFRVWVSQRESSISTAAIGWTLCLFPVVSNSVDQALATRK

SEQ ID NO: 39479 - protein, 70 aa, A.fumigatus
RFVASFMVHPTSDADPDGLSCLITGVTARPNGAHTVPLCPSSTYFYELAGRRGGYREGEICDYPGFSLSD

SEQ ID NO: 39480 - protein, 244 aa, A.fumigatus
RPPWNGVPDPVPNWPRIWTLVISSSLEEHRVEKKNERANPDDKTTKTPGAVHLVRRVEYLLSVLRDKLTNGTNASARRAVENHHRNHRSTARTNVSASVSASPAPSIPRKGHREADRSRHRSQTHGARDSVERNHTPGRDSRPKSVQENDRRRKLSDASSEDIRRRKSSERKSSDNGNSDEMLRLLFKPILSSLERVSGLTRDSMTSKARRASELRNLLGYIGGFIRKTLKGENYMPSLEIRLW

SEQ ID NO: 39481 - protein, 242 aa, A.fumigatus
CNKSLLMFFKLTEGRRSINTSPFLIFCVSQIAELHLGAHTPVKRKRKGKEKGKKDAVSRWKRSRPYGVRHDEYVINSRLYTQLNPLLTRTGMTWAPQLPSEEKCFETLNTALALGANFWNGGELYGTPEYNSLHLLNKYFTKYPENADKVVLSIKGGLKPGELVPDGSEENIRRSVDECLRVLDGKKTIDIFECARQDPNTTVEQTVTILAQLVKEGKIKGIGLSEVNAETIRRAYVLLSSC

SEQ ID NO: 39482 - protein, 211 aa, A.fumigatus
HFPPECDRSFTRSDALAKHMRTVHETEALRPSDPVPKGHNVPASAVGTPTGTPVSKLQRIRLKLSQPKDETDRLSEIANDDAVVAEDLDELELPEFGPEIGFDEHELQLRPYDLYRLLRRQIHWAEKEGQELKEEWEKIRPKRKQAWLEKESIFDDVIDAELRLFSAIVATEGLPTESGNAPNGVQKVQQGHLAVAEAEASLSRDSMSIPP

SEQ ID NO: 39483 - protein, 178 aa, A.fumigatus
LHMSQSTRSSMLLSFFLVTILALSSLGSARPISKSGNGLSRSGIYSRSASPSPVRPFQPPILATGRLTDLQRVIPSSGEYREKLMKNIFDSLGLSALNKLDDWKKKLEDSDIIDDSNSPSSTVTEQNNASIVDESTNDSNDEETENTPATVDIVDDILSTMIDKFHEAFLTQDEVTLI

SEQ ID NO: 39484 - protein, 187 aa, A.fumigatus
MRRQSGERTFYFRVASAWSTLLLTTGNRHKVHPIAAVEIELSLWDTHTLNDGVAETCAELGIPLVAYSPLGRGVLAGAFTSVSEIPEGDFRKSLPKYQEDAMKHNIKLVNEVKDLASRKGVAPAQIALAWILTLSGKPGMPTIIPIPGGTTSDKVTQNLHGVPRLSDTEMGELDRILKKNEVRGARY

SEQ ID NO: 39485 - protein, 329 aa, A.fumigatus
EGRGEICYCAGFSLVGIASSRVARCKYTRIKHQQPSANVAIEALSAAAFYPLRHLSSASTSLALASTPIPMTESPGSPLSSIASDEMSDREDLKHPFSPSASTLPPSKRRRTGVASWDRNTPLSTTFQEDLPPTSPSTSISSDTSGDIPNSPTLLALIGGSQDDDYSGQGNDQVTVCRWEGCNVGDLGNMDDLVQHIHNDHVGNRQKRYSCEWSDCPRKGQTHASGYALRAHMRSHTREKPFYCALPGEHLSSSLVPACQNLHLCDANTSLQNATAVSPVQTPSPNTCEPSTRQKPSDPLTPYRKATMSQPLQWEPLPEPPSVNSSASD

SEQ ID NO: 39486 - protein, 67 aa, A.fumigatus
  UNSURE (55): Identity of amino acid sequences at the above locations are unknown.
AIGSQILLHSASSFIFIIPFSYSPLGEINWIVKTSVFYITGTPPKNLENLHLLSXSTCRSRRGHRCS

SEQ ID NO: 39487 - protein, 169 aa, A.fumigatus
FTKYIHSDHVYLICEPPGEPYYLARIMEFLPSKDKPNGPIEALRVNWYYRPRDIHRIVADTRLVFASMHSDTCPLTSLRGKCQIKHLSEIDDFNAYRKTRDSFWYDKMFDRYIHRYYEVVPTKKVINVPANVKKVLDERWKFILVEIGKRKELFSAVKTCKRCGLYAAR

SEQ ID NO: 39488 - protein, 276 aa, A.fumigatus
GLVMASDRSPPQKQSQQQLHVKSTSPSHRMPTSGQTSRRGSADSSTAQGNATANESLSQPMTASATPSEAAGTEPPSTSATPAPYGTRSRGRNAPRPNYAEDRDIDMDLELLPPSAPKSSKKSSGTAATSTTNGVKPDGEKASSSSNSRKSLTAASGPNAATAKDAIPGTSSFSAKPDDSGGSSSSSRKRKQPASSTNSNSTNGNAAKKIFTAAPSADPNLPESNMVSFENTGAYLKDGKLIADDGTTFAVNGKYLHHSQCLLCDLLNIYIQIMFT

SEQ ID NO: 39489 - protein, 1015 aa, A.fumigatus
ENEKNCLVRLKPASDAVCTLLGRCFIDKVIRSFELTTDSSYSNDSVDCAVCHNTYHMYCVRPVLTKKPARGFAWACATCSRAQEKKLEARNTPIIGESPAEAEEEVAEEEEEEPNGLPSDTNVSTPAPAEEHPRPATKEQIAQARMWPYRYLGIHCRVEDALDYDDRIYPRASSRLGPRHQAIVNPWPGRPVEYAKPIDIKKKYLSRSGRKDSKLSKEAQAAIEAAKREIASRPKWVMDEPVGYVRRGEDEPVLINGKPTRTAEVLFKMPTATQIPNRGEDDAPGAELSPADREKFIDDYMERAKEIAPQLGEEKYATNFLDKALELLYSNSFDAEAALAKLKQQNKYKDLKEPHLRPEEVKLFEQGVAKYGSELRNVTKHVGTVPHYQIVRFYYMWKKTPRGRQIWGGYEGRKGKKEAKRHNANSKLVDDVADDHEDLGFDNEKAGEKKRGFQCKFCSTRSSRQWRRAPGVPQGITTPSEPSKKDKGPPLTVALCLRCALLWRKYGIQWESVDEVAKKIAQSGNKSWRRRVDEELLTQLLLSTETPISINSATAATAASIGVPVNANPQVQQQDSNKKKAKPNEKESTATPVASSVEPAPKKKPPPEKAPEPQPIVPDPPKAKTLPCAVCSRLEPLGDQHLSCRDCRLTVHRNCYGVSPSRNCAKWLCDMCSNDRSPMISTCYECVLCPVTWTEHELMEAPKVSHKKKTDRDREKERLEKEMVQEAIKLYRQRQEAVGKPIGPREPLKRTAGNNWVHVMCAVWTPEIKFGNAKELEPAEGFGLIAAERYRDVCKLCKTTKGACVTCSHSGCNARFHVGCAFQAQYTFGFNITPVKSSRRDTVSSIRLGEEVGAATAGIWCPHHAPSSGLHQIGEVTGEDGLNALQQYVQSYKQADLTLPGTLRRAAYIQQTGNASSQHASTAGSRRSSAINGVVTAAPQSAPTTKDNQKLAATAPEQHTDEMEIDSGSRAPRQVSSSEVERKCCRCFTSFSPRWWPIDVSRRLYSTRRLDNKRS

SEQ ID NO: 39490 - protein, 263 aa, A.fumigatus
VRYHLILVVESSGFVAGCQLRLLLQIRNKRLAKLGNPSSSSQNASGPETASTQPSTPSLPSPSPQQTFDAPQPQISISSAPRSQTSSPRLELQESEGKRIKITPSAPASPAPESVADTPVSNTPPPPKAEESIESFEDRTLSAVFKLSLREDRQRDIHGHKLIYLPGLRSELEDQGREPRIDTTVLDQALLEAASNTQQKPLDYLLPCWGRISRLHKGFRRAREDDPKFAVISEARRLCMSYCIFAITMPEMFGWVLTSPLFS

SEQ ID NO: 39491 - protein, 85 aa, A.fumigatus
ELPAVRFSEGEILASLRYALFHLTRDFGSLQFLFGRSSFCLLFYFALDANDWRRFSMASHGLMSTDVYDYSYCANTFLSTAVRRD

SEQ ID NO: 39492 - protein, 112 aa, A.fumigatus
THQIISSTMPSASASGADTGGSARSREHNQGNQDRKYTAEQKAAVIRIRKCSSTAYYEILALDKSASDGEIKKAYRKLSLLTHPDKNGYEGADEAFKSEFFSSDARMMALRM

SEQ ID NO: 39493 - protein, 293 aa, A.fumigatus
LMHVAAVVSRAFQVLSDPDKKSKYDKFGGDPDSRFTPSAGPSGASPFGGFGGGGGGFPRSAGAGGPMFEEEISPEELFNRFFNGGFGGGGFGPFGTLGSHSSLVSLRAHTYGCYLGGPQFVFNMGGGPGFRVHQFGGPRPRRRPREASAQAEAAPSGWATFQSLLPLILLFVLPLLSSLFSGSSSPSGPSYRFDAAVPPHTMQRTTPKYNINYFVNPRDVEDYSAKKLRQLDTKVEVDYITKLRYECESEVHARDRMMQEAQGWFFPDVEKMKEARSMELKSCRQLDSLKGRY

SEQ ID NO: 39494 - protein, 63 aa, A.fumigatus
IVQRLLLGIRGGFKEGLVQYSRVDARFATLVLKFTPQPRQVDQLVPMDIPLSVLPQAKLEDGA

SEQ ID NO: 39495 - protein, 164 aa, A.fumigatus
ALKETREECEPSVPKGPNPPPPNPPLKKRLNSSSGDISSSNIGPPAPAERGNPPPPPPKPPKGDAPDGPALGVNLLSGSPPNLSYFDFLSGSDSTWKARETTAATCISYIRNAIILASEEKNSLLNASSAPSYPFLSGCVNKLSLRYAFLISPSDADLSKARIS

SEQ ID NO: 39496 - protein, 328 aa, A.fumigatus
ISKRGSCQPRGEDGNICYGAGSGLGGVFGGWINDTLGWRWAFLIQVPFVVVSCILVAVTVKIPAKETDTAKLKRVDFLGAITLVITLVLLLLGLNTGGNQVPWTHPIILTTLPLSAVFLFIFIHIEANIASEPVIPVRLLLDRTVSSACLTNWFSTMAIFGLLFYLPLYFQVEGLSATAAGVRLVPQALGTSLGSLASGFLMRATGRYKIFSNLSMILLVAAGALICTLNLATPAWIPFVYFFCLGTAYGGMLTITLVALMSAVDHEHHAVITSASYAFRSTGSTIGITIASAVFQNILKSGLWSRFGDREHARKDHLTHQGQFGRDQ

SEQ ID NO: 39497 - protein, 141 aa, A.fumigatus
TNDATEIFHIHSTFQRTICLTSEESVYSLIFEYSWNPSDWAKSRCCCISIHPLNSTNSSFPSSFSTRQPLKIGNGIVAFSRRCCIPSNTRSNPSLFSALTTYRPTATTGASASNSRCRTASPSTCNNPITSISPESRSMIP

SEQ ID NO: 39498 - protein, 672 aa, A.fumigatus
SLLCRPGSHLDFSICSPDHKLCSVDLSSPQPFSSRFQRVLAIFLAWQWGYGRIVLQNWVFPLVLPRKALCRLKWRLMGRLRGDQLSILHLPTPVRTKSWKMSRFRRNAAEGRILLSTESVFVDNILPSLLQNPDVELRLITDEPSALLAGANKIPHYMDTVDSQTFEKKTGARRWLKAKAAELSEWADMLLVAPIDAGTLGSMLFGLTNTLTLALLRGWISTKPVILVPGMTVSEWEHPLSRRQLAEVDRYWPWINIVKPALWRSNGPEELVQLPWDGLGELHNTMERTLGLSFSESSTISGQALDSTQQVVPAVTKQSASAMSAAQHLRKGARSLRLELWLNIFEEQLQDWEIAKAVGIPTNLPVPKEWQSHLLKMSTPASLEYTILRGSFAAIKKRIDSLPRWKPLSDLACHLIFKFSRTDILSYLTENHLDMLWTTSRLTKLPYRASAIYGNPKVLTWWQETLALPNKDYSADAMDGASRAGFVEVLEWWRTSGLELRYTERALESASAEGRVAVLEWWKNASANAPPSNPIPLKVGKSVLLAAQSGRVESLAWWDASGIPYSHAESVARIASTHGHVHVLDFWYRLKGPKMIFDSQLLVGPTKNGHDNVLEWWRRSGLRVEFKTCDIEEALEDADPVSGAEGRVRRWWARNGLNLGVGTSEWMKTKVL

SEQ ID NO: 39499 - protein, 264 aa, A.fumigatus
AKGEVFRDNGDLNNEPQLGHTVSISVGNGPTTVLSRSQHQNKLSKFFFQRDQEGKEEEIHNRSFSLEREKPEMLQTLASSSVASTNLLNALKRVNRETHRVSEDAECLNRFETCKLLRRQILRYIQHVESEEYLGSLIHANEELVTALMAFEVLDKSIDYDSDSDQDVLESGWTPDRDDINESFAGLVINPPKPPRPPRPLSISVPSSSQQKYVSASESETDEDDDDENNPFGDRNAIRTPGLEKAEPTWYVLFADLPGAHSSG

SEQ ID NO: 39500 - protein, 206 aa, A.fumigatus
MTPPVTEIALLRLKSNPASASFKALLLDGIKAQAEFSSYPVYLFSQVEDPSVIYLVGGWDSAQQHYEDWIPSATNQGIMERLSGEMEVMGLLHVDGDAVRQRELLAEAPVVAVGRYVVSAEKREGFDRVFEGMQHRLENATMPLPIFKGWRVEKEEGKEEFVLFSGWMEMQQHLDFAQSEGFQEYSKIKEYTDSSEVKHIVRWKVE

SEQ ID NO: 39501 - protein, 341 aa, A.fumigatus
RVLLQPAHAIEAVRSGRNQAIEIIEQRDDRLLVVVGPCSIHDPATALEYATRLKELSQKLSSELCVIMRAYLEKPRTTVGWKGLINDPDIDETYNINKGLRVSRKLYADLTGMGMPIASEMLDTISPQYLADLISLGAIGARTTESQLHRELASGLSFPIGYKNGTDGNLTVAIDAIGAASHPHRFLGVTKQGLAAITKTSGNEHGFVILRGGNKGTNYDRESIKSAREALRAKKQREVVMVDCSHGNSKKDHRNQPLVAKEVADQLREGEDSIIGVMIESNINEGNQKVPPEGPSGLLKGVSITDACISWETTVTVLEDLADAVRTRRAVKASKSNGVSQ

SEQ ID NO: 39502 - protein, 84 aa, A.fumigatus
YEPPVPIPCPDPQPTRRDSQPQGPMPAPSPAGHHTSSPALWQNPRKTQHGDPAKDQRLRRKKSSDCEPRHGRLGWPSQPRASIR

SEQ ID NO: 39503 - protein, 213 aa, A.fumigatus
GHGLQFDHRVRYVFRKHAKRQLSISKLVDCSEGYGIVGMECANMFCLWLGICGVLTVYSMVSLTLYNRRQRALWVERELQKLQDAKAAYASGSATPEQLELIKNEEIGEIMKRKKEEAKAQRPWNRAKEYLFGGLKQDETTSDLSSKVDGAADHKVGVLEALNAKAAEDSKSRTPSETATMPAQPGQLDVLAENVETAAKQSTRSWKSWLTGR

SEQ ID NO: 39504 - protein, 138 aa, A.fumigatus
RLGDGSKALLGHTKETVGVGGGSNGVDSNSEVAIRTVLVANRKTQTRGQLTVQLRFGRTGTNSSKRDEIGKILRGNGIEHLASNRHPHTSKISIELTRDTQALVDVVGFVNIRVVDQTLPTNCCAGLLQVGTHNHAEL

SEQ ID NO: 39505 - protein, 77 aa, A.fumigatus
ESSFSRVAYSSAVAGSWIEHGPTTTKRRSSRCSMISMAWLRPDRTASIAWAGCNRTRQPQCYTFHGMVYLAFPKRIL

SEQ ID NO: 39506 - protein, 122 aa, A.fumigatus
VRPNPDRRELASTPFSSTRRTTGVKPARNAMKPNKPQPRTRMPKRRVTKSARRWVSCGGKPAKRKNDRISNRRRSTGRPTRRSGIDGSRIRRSGKGSRSRSRSGGARPIRSRRGSRRRRGNA

SEQ ID NO: 39507 - protein, 1107 aa, A.fumigatus
  UNSURE (987): Identity of amino acid sequences at the above locations are unknown.
ISGSLSGYYQVSSGPVQCPSNPLLAKMEATASMGLQGLNGVSYDLSQLDNYLSHATTYVNGNQHLQHPSLPNERISGTVDLSEPPAKRLRRSPSCNESNESNGETSSPAAIIDPSTRLQDVNGGLDRVAGGSESADSMTHDSNEDTSNILSGSATSVSLMYEPSQKNSTPPSTVNNVPSSSSITSDSKGLSGNTDYARYRPRSSIPSKLTAAVYAQQCVTAAYACRLNPYSLHKKEQEPLQDHLCHLHVTAYLNIRNGILRLWTRNPMVSVTKDEALGCAKDYRWMGLASFAYEWLVRNGYINFGCVEIPPALVAPKKGRRKDGPVIVVIGAGMAGLGCARQLEGLFKQYHDPLTSPRVVVLEGRRRIGGRIYSHPLRSLQSSKLAPGVVPKAEMGAQIIVGFEHGNPLDQIIRGQLALPYHLLRDISTIYDIDGSAVDEVQDAMDERLYIDVLDRSGLYRHNAVIVPTAEGDRRLIDSGRDLTMSDGLTVRQYEEARAAGTVELLFPNKKVRRGVGHKTADIKATIPPVPTDLGPAEEQPAALACQAMGWKLKDGVPPTASLNLDPVAKASMWPTLGAVMDEGVKQYQRMLPLTPKDMRLINWHFANLEYANATNIGKLSLSGWDQDLGNEFEGEHSQVIGGYQQVPYGLWSLPTKLDVRTNKIVSKIAYDSTGSGKRKTVVHCEDGESFVADKVVFTASLGVLKHHSIEFSPPLPDWKRGAIERLGFGVMNKVILVFEEPFWDTERDMFGLLREPKNRDSMVQEDYAANRGRFYLFWNCMKTTGLPVLIALMAGDAAHQAEYTPDGEIIAEVTSQLRNIFKHVAVPDPLETIITRWASDRFTRGSYSYVAAQALPGDYDLMAKPVGNLHFAGEATCGTHPATVHGAYLSGLRAASEIIESVLGPIEIPNPLVPEKGKAVELGTSVATAQKKKEPPCSNGFSAPVSTSAHPTDASAPARSNNSFSGDTALRQAYEQAMWAAIHAEXGPPEPRPARTGLNPFLLYQKDYWGKARAQCDETKQATTKDPNAKAARDEIRQALGLMWRQASEEEKRPYIEQTEVNRQTNTEIWDRWKQNTKEWERKSLEIKKRWCAANPFETWQPPAKR

SEQ ID NO: 39508 - protein, 222 aa, A.fumigatus
SRVDLSSKPFKLWTEWNDGPDKEPACTADAVIIATGANARRLNLPGEETYWQNGISACAVCDGAVPIFRNKPLYVIGGGDSAAEEAMFLAKYGSSVTVLVRRDKLRASKAMAKRLLAHPKVTVRFNTVATEVLGEKKPNGLMTHLRIKNTVTGEEEIVDANGLFYAVGHDPATALVKGQIDLDEDGYIITKPGTSYTSREGVFACGDVQDKRYRQAITSAGL

SEQ ID NO: 39509 - protein, 67 aa, A.fumigatus
LGSGCIAALEAEKFIAEAESPEEEPVAVSAQKSADNSTIQPAAQEVNGDVKKDPKGAVPEYKSNPLL

SEQ ID NO: 39510 - protein, 218 aa, A.fumigatus
NDLYDCSFQPVRTASSFAATMQWLSCWLPLLVAASIPRTLAAQDTDTSATSTTTATNALFTITGTITDHVSDATLPTGTYLSYTSTRTLSTDSDGKVLSSIAVTNATAVGNSTIHTTSTDTMTRLVGNATANATMNGFGFGFDISRCQHSALQWPSPNPVLASTQTSPRVGGSIHPLCQTRQCCCEPRIGGGQSVERRYPNAYVLLKNISFARDQLLT

SEQ ID NO: 39511 - protein, 132 aa, A.fumigatus
LNKKKERAMAESHRASYVSLHVRVSNTAALRLYRDTLGFKVESVESKYYADGEDAYAMRLDLTDQWLDWKEIERKDRERAKSDEKDADEGDEVGSLGKKEEKTVRVKVGRSLGVGDLVERNEANPSQQSVSS

SEQ ID NO: 39512 - protein, 145 aa, A.fumigatus
TKPKSKMVDIVPLSSYPSYIDLLPSIQTCNITNLPENYFLKYYLYHVLTWPQLSFVAVVRPRNGYAKHKGGAAGTSSTGTADLSGQYPKVVGYVLAKMEEEPTDGVQHGHITSLSVMRTHRRLGIAERLMRMSRMFPPFFTFPYS

SEQ ID NO: 39513 - protein, 161 aa, A.fumigatus
IKKKNALWLSPIAPVTFRCMCVSPTLPPCVCTGIPLASRSSPSRASTMRMERMRTPCAWTLPINGWTGRKLNARTESALRVTKRTLMRATRLEVWARRKKRPFASRSDGVWVSAIWWRGMRPTLRNKASARRKESSYIPLRASPLDSFESWANVLDLQNMQ

SEQ ID NO: 39514 - protein, 324 aa, A.fumigatus
TTVSECVRTLEEHLLCERPTANLIHGTRVVQFQTHYENGTMYLCHTSCDLLNVGTLTEYLTTVTRWIRQHPYDVVTILIGNYDYAAPGNFSKPIEDSGLLDLVYMPPKIPMALDDWPTLSNMILSGKRAVVFMDYQANQTALPWLMDEFSQMWETPFSPTDPTFPCTVQRPPGLSNEDAYNRLYMANHNLNVEVNVANINLLIPNTAELNQTNAVSGPGSLGWMAENCTSKLISCPASRYKERMSASNLSIAMWNRPPNFLLVDYYNYGNFNGSVFEVAAQMNNVTYNGECCGSTSAAFSLMPAGALWNALLVVASVHLFASIF

SEQ ID NO: 39515 - protein, 257 aa, A.fumigatus
IALVRWIYHCIFCRSSTFAQDSKLSRGLALRGIYDDSFLRADALLRRVGLIPLHQIADTQTPSDLDANGLFFLLAQTSNLVALISVLFVTLSALSVLAFNFLPVQPLIGKVQAHGVRILSIRIVLALDGLDLEAKGIPVQTQGGSVGDTHMQRNVTGAMGLSHSAFFFFIQSNAVSQEYGNVKKGGNIRLILINLSAIPNRRCVRITLKLVICPCCTPSVGSSSIFASTYPTTLGYCPERSAVPVLDVPAAPPLCFA

SEQ ID NO: 39516 - protein, 124 aa, A.fumigatus
RVMSTPSPRTAMRKPAANVAYILGSEVGTQSTTRFIAFKALPPIQLRRKRQYRSSGTVSETDWVRSICEEIERAMMAGEGPRPGEGGKPPSVVENSEIISLEDAKKRTGILEHLVYDIKKLVWA

SEQ ID NO: 39517 - protein, 533 aa, A.fumigatus
RGRLADPGYPQFFWNKNLMNPFIKADAHSFILPLVQGFVGQREFTVSAKSEQPDSNVAEEHTEGRMLGEKDESQSIKVDAAKRNFLLTLISRRSVKRPGLRYLRRGVDDEGNTANTVETEQILSVPSWDPGHNVYSYLQVRGSIPLYFSQSPYAFRPVPVLYHSTETNQFAFDRHFRNLARRYGKLQAVSLIDKQAGELKLGNEYEKYARVLNDSGGIDGVPLRMEWFDFHNECRGMKFENVSRLVKRLESVLNEYSDTIVRNGTVTRSQTGIIRTNCMDCLDRTGVAQCAFGQWALERELKLEGIDIDLSRDSSTQWFNTLWADNGDAISKQYSSTAALKGDYTRTRKRDYRGALNDLGLTLSRYYNNIVNDYFSQACIDYLLGNVSTRIFAEFAMEMRTADPGISVQKLRRSAIDTSCKIVISDQSEEFLGGWTMLTPRQPNTLRTLPFEEAVLLLTDAAVYSCRFDWNTDKVTSFERIDLRSISRLNYGTYITSILTESQANEQGNVGLVIEYRDGGRERLARQHPVSEE

SEQ ID NO: 39518 - protein, 135 aa, A.fumigatus
RSTPPCPSDLPLSTVTISPLFSRALYLHTLALLAGVLLVTVAPPLRLTSPTFRLSSVLRQLRGSRLPTTTAVYNSALTDLRKSLTTASMGSRTSTSAAAGPAPLYRDCSVHRRRCQAPHRDIPQSAGQHRCECQA

SEQ ID NO: 39519 - protein, 428 aa, A.fumigatus
EYHGARIHILSFYQAVSTDQELRDASSKAEELMDEFFIETVMREDVFKLVDAVLKKNESLDPESRRLLEKEHKDYIRNGLGLPAGPKRDRFKEIKKRLSQISIEFQKNLNEENGGIWFTREELDGVPEDVLSGLKKGEGEHEGKLWLTFKYPDLFPTMKYAKNAETRKRLMIENENKCNQNVPLFREAIILRDEAARLLGYPNHAAFRIEDKMAKTPKTVDDFLGDLRSRLTAGGHKEIKALLELKKADLESRGEPFDGRYYLWDHRFYDRLMLEKDYSLDQQLIAEYFPLQTTIEGMLKIFEELFGLVFVEITGEDREKVAPTGKGSDIVWHEDVQVFSVWNDEGEGSGFVGYLYLDLFPRPGKYGHAANFNLQPVCETHKSHITRLTIVRASSTLTASGATRPLHWCAISPSPRPRNLVSSSTTRW

SEQ ID NO: 39520 - protein, 291 aa, A.fumigatus
DTTHSNPTLNLRQLQLTTSHKIRSSVGVNLTNPRQPPARVTLTPPKENTMSTTNPSASPSRSPAPRQQDDQPQQQEQEQQQQQQQQRLKVHTHHCRFCNHLLLATTRTIATLPRRKAPAQDNALILPLPHADEDEDEDDDDDNDDEKKEEEKPDATTSPEPGSETNQTIRTEGEAESEGQAGRKRRKQKHYTILLSTTLPDRKATLIRREDGFEKRRFLRCGRCRVVVGYFLDAVHFPVVRRAEDVVEGEGASQEPRVVYLLPGALMETEIMGDEEKMEALDREWSGWIAQ

SEQ ID NO: 39521 - protein, 83 aa, A.fumigatus
LIFASPSPPLAWAPEHLRRPPQAPPLFTATAQSIVDDAKRLIETSRKVQDNIVANVKPDSATFDSVLKPLAHDENTMALESTF

SEQ ID NO: 39522 - protein, 90 aa, A.fumigatus
CRILRISQVSFFLYFVFCVLAILTDCSSQVYSTDMFYTVFKDDPMNPAAGRRYRYGVLEKGGSQDEMKTLTDFLGREPKTDAFYKELGLA

SEQ ID NO: 39523 - protein, 278 aa, A.fumigatus
YCLARILPPPVVEDVAGLGWGDWFGGFIYAGILRIFFVQQATFCVNSLAHWLGDQPFDDRNSPRDHVITALVTLGEGYHNFHHEFPSDYRNAIEWHQYDPTKWTIWIWKQLGLAYDLKQFRANEIEKGRIQQLQKKIDQKRAKLDWGIPLDQLPVMEWDDYVEQAKNGRGLIAIAGVVHDVTDFIKDHPGGKAMINSGIGKDATAMFNGGVYNHSNAAHNLLSTMRVGVIRGGCEVEIWKRAQKESGEYVRDESGQRIIRAGQQVTKIPDPIPTADAA

SEQ ID NO: 39524 - protein, 224 aa, A.fumigatus
ESYHSTNNCKGFIDADGKRRYPATALVCNFTKPTAKKPSLLKHDEVVTLFHELGHGIHDLVSRTIYSRFHGTSTVRDFVEAPSQMLENWCWTPSQLKSLSKHYSTLSPEYLAAWQEQANGKPQPPERIPDEIIENLIRTKHVNDALFNLRQLHFGIFDMTVHEAESHEQIQKLPISTTYNQLRKQIALQDGPEVLGMGDEWGHGEATFGHLIGGYDAGYYGYLR

SEQ ID NO: 39525 - protein, 72 aa, A.fumigatus
QADSALVDFESFLKVLNRPGGFREPGEPEEYCRGFQVFDKDMTGFIGVGQLRYSMLFCVALCVQLAGGLGAD

SEQ ID NO: 39526 - protein, 77 aa, A.fumigatus
CRNKLCHLIWIVGVSHPSLVVTTTTTRLNTAKPTPGQLLIFAPPRMIISQSSIYAVIFVFVRIYHCLPSEQYSCRRH

SEQ ID NO: 39527 - protein, 110 aa, A.fumigatus
TSLPHCIFHPQLLPFIIHPTFFLLENSPFLKMPRSPDSHNDQASTNYKEAFSLFDKRGTGKVSLESLGDLLRACGQNPTLAEIADLEKSIGGDCKLLLVSGARCSKLTVR

SEQ ID NO: 39528 - protein, 90 aa, A.fumigatus
LGLLGWGSCAIVCCSALRCAFSWLGDWVLTDVVLTNLGEKMSDEEVDELLKAVDTSSGEINYTGMFSCLIYSEWLTLTSIAELVRTILAN

SEQ ID NO: 39529 - protein, 171 aa, A.fumigatus
RARNLSSPGHDLAQRQPLGPGLPRSAGGLPVRARGHGEPAVPQVRVADDAGGGQAAPAGDPGRRHRRVLQHPHRALYQPHHYGPAAPYLSQRVRQDSSVHHALDCRGDLGDGSVPPPVLRRRRLVPLHQGGRRPWQAVRGGRPHARGAPGQGSRRRQRPVRAAQHQEPVRG

SEQ ID NO: 39530 - protein, 89 aa, A.fumigatus
DSTGQFPGPTIEADWGDTIRTTLLAYTCKLLTGTGISVYNNFTDNNNGSAIHWHGLRQFENNVQDGVPGVTQCPSKVTISPAEYRRRSD

SEQ ID NO: 39531 - protein, 204 aa, A.fumigatus
ERGTYPARGTILLNGSHSALGYPGQLAGFQYVHEVMANPLFRKFVWQMMQEEVKPLLPEIPGVDIDEYCNTLIERFTNPTIMDQLPRICLNASGKIPQFIMPSIAEAIWETGPFRRLCFVAAAWFHYIKGVDDRGKPFEVVDPMREELQAKARAGGNDPSELLSIKSLFGDDLRNDERFLREITTAMNDIARDGIMKTLPKYIN

SEQ ID NO: 39532 - protein, 76 aa, A.fumigatus
RIETNANSCSETIAVIEEPRCKDENCPDSQFGYIKELGLVDLVRTNHPAGRFKDLCVVETASMQITIQTPFISRLL

SEQ ID NO: 39533 - protein, 111 aa, A.fumigatus
RRLPPLYDRGFRPDDQGPDGKIWRQAMDDGGFALLPLYTRLLTEQVHNTTATRALMAELCDSQMTNVVDFDCFSQVVFESLEDYKRMKQDPWYKEHLFHDHENFADTKKSM

SEQ ID NO: 39534 - protein, 275 aa, A.fumigatus
SSYANVAILKTSPGPIVIHGPSSMDWDEDLGPWLLHDWYHDDVFSLLWVGETKNRGAIPESTILNGKGKFDCNHHNDTRCTGTGGEYFEVNFRKGVRYKLTIANTGTLLEYMFWIDGHNLTVIAADFVPIEPYVTDVVNVAMGQRYEIIVEANADFTHGSNFWIYAQYCDEVDLLPHKAVGIVRYDEQDRQDPRTPPLGDQHRDFGCEDPDLDNLVPVVQQSVGRRVNRMEMKDYLRMGQEGYPDPMNFDGDLHKWVLGDVPSSPRGWKDPRWRM

SEQ ID NO: 39535 - protein, 138 aa, A.fumigatus
CRRRSSRSCRRSRASTSTSIATPSSSALPTPPLWTSCPVSVSTRPARFLSSSCPRLPRRSGRRVRSAACASSPPPGSTTSRGSTTVASRSRWSTPCARSSRPRLAPEATTRPSCSASRACSGMTCATTSGSSGRSPPL

SEQ ID NO: 39536 - protein, 338 aa, A.fumigatus
  UNSURE (89): Identity of amino acid sequences at the above locations are unknown.
QSRYNTIDSSQQHSRSNVSMAVPQSIPPPTAAPIESKDQVFARSKAFWDNYLRGRPQVPPSFFQRIYRYHREHGGRFGTVHDVGAGIGXYAGEIRSQFPHVIVSDIVPKNVQLAEAHLGRDGFRYRAAPVEVADDLPPGSVDLAFATNVMHFADQHAAMQAIATQLRPGGTFACAGFGPARFDDPDIQDVWERISQQGGRILLGMAEHPPDTINVMSRSSKEYNVAPLEPQWFRPGALRIRLNMAQGGITGLLPPERQQEVTDPDFAGPRDVVVYETNEEWRFETDWEGFLQHFRSFPHAGADPAAFTGLLQELKDLLDEGRCLRGCWPATLILATRR

SEQ ID NO: 39537 - protein, 202 aa, A.fumigatus
LRSFRYSYWHLSLFSSTFELHFYQYAAECFRDYYAGDCSHYRLLSLGYVILCRIHVERLNADAGLMMGLSVVDIPVVLDTATQASQLLQHFTRLYDIGHKMMPSLAVTTCLLYGYTASSTRTTGGSGLPHIIAAVTTISMVPFTWLVMAPTNNALFRMHANPAAANLGEVRRLLVRWAQLHAVRSLFPLMGSVLGLRQILRE

SEQ ID NO: 39538 - protein, 228 aa, A.fumigatus
NMQNLKISLANAGVYHPTSLAGRLVNVLGERLHDAVPGNVIHSGGDLPEEPLVVAQVIPEQALDAEQLGRVVASGASLGLELLAHGVDHLERLATVVDPLDVVEPGGGDEAQAAERTRLPDRLGNRGHDELRNLAGRVETDTGQLVHNGGVGKALDEGVAILVDVDARDLRQERLDLLLHHLPHELAEQRVRHDLVHVLEARQLTGVAQGRVAAVEQDRAPGWIGSAL

SEQ ID NO: 39539 - protein, 263 aa, A.fumigatus
LPLICACYLLQCRVAELETKQSIFCRYSFLKLCKVKYYNFSPVHSVQKNFTFQTGDPLGPDSPESDGGSSIWGLLEGPVKRTFSLKLSPKLKHTERGTVSMATVPSSHDPDERLAASQFIVTLEDNLDYLDGKAAIFGKVVEGFDVLEKINGAFIDDQGRPLKDIRIRHTVILDDPYDDPPGLVVPAESPLPSKAQLATVRIADDEELDDNMDEEAMEKLRREREARAQALTLEMVGDLPFAEVKPPENVLFVCKLNPVTQGI

SEQ ID NO: 39540 - protein, 187 aa, A.fumigatus
RVREVEACTHRFAWRSRTVQSSEEARLQTCGLERRIPASGGMARWPTRHRLCICQSCGFSRPSCQLSLSQRLTYFFFSFQLEIDEASQTLTGKLVPTHPIIDASKKRELLKSLAADNGIPISQVVSVGDGANDLLMLHAAGLGVAWRAKSKVQLEAPTRLNGESMLDILYLFGMTKEDIKELVSDDA

SEQ ID NO: 39541 - protein, 218 aa, A.fumigatus
YDDFCHIIGPRDGYCMIIPEAKPTKNQQAPINYPKDVKDRNRESPKDNSPRHLVDGNWPNADCFRASRSSSSLLQNILNERLAGLVTAPNERARRAVEEAHVKRPLAPQLESIRSDVLVHSHMALRRPHILSECDNVHVSRAQLAQRIPQLVIRLPEAKHQRGLGDKRGLGVLRCLEHPDRLLKVGTAITDLRRQGFHCLNVVCVDIQAGASDQLHHL

SEQ ID NO: 39542 - protein, 102 aa, A.fumigatus
LLGGQEITERAMNGELDFSASLKERVGLLKGVPADVFEKLKPVLTVSPGARELCKALKKLGCKLAVLSGGFQPLAEWLAGQLGIDYAFANHVGSPVPHANFP

SEQ ID NO: 39543 - protein, 77 aa, A.fumigatus
LSLCDSNSAKLCGLVGIYPPRPQQLILSFDIVPLGSSPREAKLNASNAIHSNIAVPYQRPRAGTKKHRASHRLGSSR

SEQ ID NO: 39544 - protein, 435 aa, A.fumigatus
YHRWSLCQSSYRPHNHSRTSIMAVSTSHFRSLCASRPLSRTAIVGHISCRSYATTEPSPSATSTSTTTTARRRTTFKDKLNAGPSFADFVGNGNTPLDPSEAYALKTALVGPAGRKKEMTRLPSWLKTPIPDSKNYQRLKKDLRGLNLHTVCEEARCPNISDCWGGSDKSAATATIMLMGDTCTRGCRFCSVKTSRTPAPLDPHEPENTAEAISRWGLGYVVLTSVDRDDLADGGARHFAETVMKIKQKAPSILVECLTGDYAGDLEMVKLVARSGLDVYAHNVETVEALTPQVRDRRANFQQSIRVLEAAKNAQPSLITKTSLMLGLGETDDQLWDALRQLRAANVDVVTFGQYMRPTKRHMAVHEYVTPDRFELWRQRALDMGFLYCASGPLVRSSYKAGEAFIENVLKKRRATSGGTETVGVRPVTVDEVTR

SEQ ID NO: 39545 - protein, 570 aa, A.fumigatus
RSPSLDNITAAARESKAARPMSGNRTLRTWRSDLNLASSLETFGLLPSPPLSDSRDSRPSTSSTYFSPKPDSEMEAGERRMKHCGCIPDFNSCDACDGARGKVTKAEERATQEPTNVHAAYSNLVKRCESDEGRFTPDSTDSERTLSPSQFSDNEPPELGKAFSCVATAQRSRTGTVSSVGSSWMPSNISYFERWLQGVPATLDVKDERSKELNRRKCQIVQNSPPHLERRGELEATDEAVVSLHLRVTRSLTLLIQKQILDLTGCSITKPKLVDISRQSSPAMSHTLPNTTQHPVPSTPDMRQHEISAFSPDTPLEMSDSGYVTHNSCYSPDEFQDDKESHYTDSISTHSETASETIVCEKLVLKEGPSFSPPKPKPETRADSPPKNQTSPARSSSMLEKEERRWWDHEWTIEQLEQSVKDFPQNMLKLTSPVIMFLRQNNEKALIRPFRKIFPDVAENLLDCLCAILIARNYVASLASTPRGPSSLSYHSTLSRLGPVQEKPNSTPATQFTPTSPSRIRDRVLGPRSIELRTDLDRVVDNLLFAVSGRSDETLKSAVLVLAQVLECKA

SEQ ID NO: 39546 - protein, 505 aa, A.fumigatus
TDEGSSMTAELAFWSSFMDEPDANDLSRAVSRVFNEFVRSPEAVLHDLSPIGPLNVEQIVRLMPSAISGEQQCLHWLIEQWVCRTPDAPAVCSTELEWSYAKLHQLTTSLSHHLCQLGVGRNDRAAICMEKSPWVIVAMLAVLQAGAAFVPLDPSHPRTRRESMISSLDAQVLLISLDADEDAHLTMSSCRQVRVGSTRGAGSDTGVSSNLPKNEPDDAAYILFTSGSTGQPKGVVVPHRAVCSSIKAWSDMLNIRSTTRSLQFAAYTFDAAIGEIFAVLANGGCVCVPSESERLNFLHETITQLDVNWSFLTPSVIRQIDPSSVPTLQTLALGGEPLSKEVIETWCDRVHLINVYGPTETCVFSHANPITDSKQEPSLIGPPILGRSWVVSPFNIDILVPRGCIGELVIESPAVAAGYFNNPEQTAKAFIAPPRWWKLAQDALSGSNKLTEDELPRFYLTGDMVRQNVDGSITYLGRRDTQTKINGQRVELGEIEYHILRLPAV

SEQ ID NO: 39547 - protein, 1232 aa, A.fumigatus
DQKTVRARGEAVLPEDFRLEVVEPQIAARYTSDLIVHLERNLPAYMVPAFLVVVRQLPLQPSGKINRRMILSWLSEPTMAGLQKTQHNFTRREEEPTTLGPVEKQMREIWSEVLNLPVTRIRLDQSFFDLGGGSITAMQVVSRCRRSGLQLTVQDLLRWKTITKVTPRTISLSQVTGERVYSLTSAGSVVDMRSIASKLEAIGLPGRAGVKGVYACSPMQEGILLAALKSPGKYEVVLMLEIRATGSQDRVDLELLESAWLQVVDRHDMLRTVFLQEKTATGVFSQVVYKHIDPPIEITTVDDLDTLRSASFSACHFDCIPYRVTLCKLSGSSLAYVRLDISHAVVDGWSLSILSRDLQQAYDGQLPSQPVAQYCELIQYLESQPQETSMEFWRHLLTGMVPCHLPHMISYSGSHSTQEVKLHQTRLEVDRNQELRDFCAAHDITIANVFQLAWAVVLYRYTGMEDVCFGYLISGRDAPIDNLEDAVGPFINILVARATLRQGISVKEFLGEIRDTFLAMSAHQHTSLTQIQHELAVGNLGLFNTALNVQHRALTQQNPHSDIEICELSGRDPSEFGAILNVIDAGNTLEFALSYWSDLLSEETGREICSFLSCILSAVLDNSGCSVKTVSQTAADAARSFIDRKGDDDISSTPRGNPAPECYRPLKEPTNLIALTVQQVCAEVLDLSVSSLSLDETFLSLGGDSLLAMKVVSRCREHGVALTVQHMLQNQTIREVFEHARFSDSFSYRQLRHTPDPTGIPFPLSPIQKLHFHLMPTGQNYYNQSFFLRVTERLEASAIERAVRLLVLRHSVLRARFNQQIDGAWAQVISPDIEGSYHFSATSLISWDGLWPLVEGAQKRLNIRQGPLLSVDVLNLQGGDQHIYLVGHHLVVDLVSWRIILADLEIILRGGELSHDPPLSFQTWIRLATEYAQDNIDPATTLPFQLRPGNFAYWGMAGIPNLAKDVSSLSITLPTDITSSLLGPANASLGTEPTDLMIAALAHTFSLVFHDHSGLTIFQESHGREPWTPEIDLSATCGWFTVLTPLSVETDKVEFRNTLKRVKDLRRRIPGKGWPYFASRFASRRRTGQKLDEKDEIEVLFNFVGLYQQFNRNDSLFVRPVADVSLPPDFSPDSIRLALIEINSLVDGQGRMVMHVTYNSRMKRQEGLTAWLERSQQVLEEEMPKLLTAAPERTPSDFQLLSLSYNELSALESHCHKQFVFTTGLEGTAHWG

SEQ ID NO: 39548 - protein, 376 aa, A.fumigatus
RKSKQRKSHTMLPDADSKDQLVTIIQSVKPPTVPPHRSHDPANNLKRTDPYQFGSRYLEEGDDVFEFNAWDHVEPDDEFKAFAEVQYAKQRESPVSDFDKQRFNKDPAKWWNLFYKNNTSNFFKDRKWLRQEFPVLAEVTQKGAGRKVVLEVGAGAGNTAFPLITHNKNEELMVHACDFSKTAVQVMRESEHYNPKFISADVWDVTAVPDEENNGLPPGLTEGSVDVVILIFIFSALAPSQWDQAIRNVYRVLKPGGLVLFRDYGRGDLAQVRFKKGRYMDENFYVRGDGTRVYFFEKEQLEKMWGTWTPEKGLQMAEDNSIMAESEGAFDVEKIGVDRRLIVNRQRKLKMYRCWIQAHYRKRETPAAVEAEKADS

SEQ ID NO: 39549 - protein, 94 aa, A.fumigatus
RKEPARLCQRGRRRAHLGRLLGDFLPKQLRQHLDGHKGDAPAAVFAAHVSCPVEVHVYFLLESPAAPSAAAYGAYCAASAGVAAGVFAAGSCGP

SEQ ID NO: 39550 - protein, 436 aa, A.fumigatus
RNWERRMHWIEQYRKSHMVHIDSSLRRAYATLEAVRDSCSYASGELMGGGKKRAKILVETLEDRYNDALATKETLEQKAQAGVRLMESFLVELESRAHAVRDRGIYGALDDGWKAVDSKLVHAREVVDEGIEQARRAKDSLRESINRAILLAQEQRLITYADLPHPWRINPHILQGYRFSSSKVECLMSVFSVCNETVNIWSHLIGLFIVLSVAFYFYPLNPNFHLSTKTDVAIAAVFFFAACKCLVCSTLWHTMNSIANQPLMERFACVDYTGISLLVAASIVTTEYTAFYCEPVSRWTYILLTMSLGIGGVILPWHPTFNRNDLAWARVAFYVTLALTGFAPLFQLTYTRGFVWCLYFYAPVVKSILVYFAGACIYASQIPERWRPGLFDYFGGSHNIWHIAVLGGILFHYCAMQDLFANAFVRAKGECPSLTA

SEQ ID NO: 39551 - protein, 235 aa, A.fumigatus
YCSISSGASISPRRTKSSVMSFLSGLCGCFAPKSPPRAPSARALSRAMAETHQHHHYHNDSNFTSHHRPDEGPVYMAFDEDGYTPPVPLPRYTPRPMSSIQEKTLEAHMRDPPVSSSRSIISLHDEKNPRDFASADGDELTSDVSSAISFPSSYGNTSTATRETPPPPYSPRMSPAPSRSMSISSLNPPPLPPPPPMAHIAQPRPVLRRECLPRDLAGHSRVSFESQRRFSWESR

SEQ ID NO: 39552 - protein, 89 aa, A.fumigatus
EFDLLNRYYHHYNLLRLSAWLIAFFLSYIQVPCRFGPFVSIIIITTTTYFLLLYYYYYYYFYLFSRCHLDLNNPSRPACDHHSFFPVRL

SEQ ID NO: 39553 - protein, 136 aa, A.fumigatus
LALKNSAASSSALPPISPIKMIPSVSSSSRKIFRQSMKLVPEKGSPPIPTTRDWPRPAWVVWLTASYVRVPDRDTIPTRPRLWMNPGMIPILHWPYDVERRISTRRTALEKPNSDATELTGAMIPGQLGPTRRVLF

SEQ ID NO: 39554 - protein, 577 aa, A.fumigatus
TFTMATLTMTMPPPSKPKNGNEKLPPENERYMRACSDIANVLIQEYEAQRDSTKPRKDINLNKLRGQIAKKHRLATQPPLTAIIAAVPEQYKKYILPKLIAKPIRTSSGIAVVAVMSKPHRCPHIAYTGNICVYCPGGPDSDFEYSTQSYTGYEPTSMRAIRARYDPFEQARGRVDQIKSLGHSVDKVEYIVMGGTFMSLPPDYRESFIAQLHNALSGYQTDNVDEAVQAGEMSNIKCVGITIETRPDYCLDTHLSDMLRYGCTRLEIGVQSLYEDVARDTNRGHTVAAVAETFKLAKDAGFKVVSHMMPDLPNVGMERDLFQFQEYFENPAFRTDGLKIYPTLVIRGTGLYELWRTGRYKNYTPNALVDLVARILALVPPWTRIYRVQRDIPMPLVTSGVENGNLRELALARMKDFGTTCRDVRTREVGINEVKNKIRPSQVELIRRDYTANGGWETFLAYEDPKQDILIGLLRLRKCSATHTFRPEFTGQQTSIVRELHVYGSAVPLHGRDPRKFQHRGFGTLLMEEAERIAREEHGSRKISVISGVGVRSYYARLGYTLDGPYMSKMLDPIEDE

SEQ ID NO: 39555 - protein, 94 aa, A.fumigatus
ISIADADFPHFAALRRVFLSTVSLFSPRNMASFDAKTDSESTDMVRITDILKTQNKTRLVGPNCPGIIAPVSSVASEFGFSKAVRRVDILLSTS

SEQ ID NO: 39556 - protein, 135 aa, A.fumigatus
GQCKIGIMPGFIHKRGRVGIVSRSGTLTYEAVNQTTQAGLGQSLVVGIGGDPFSGTNFIDCLKIFLEDEETDGIILIGEIGGSAEEDAAEFFKANYKHNKPAVGFHRWALTLLPVVLWVTPVLSSTVGKVGAELQ

SEQ ID NO: 39557 - protein, 76 aa, A.fumigatus
PLDLGCIGVRQEFRSLQFPGTKVVGGTNPKKAGTMHLDRPVFANVSEAVKETGATASAIFVPYGITISRFRRCRTY

SEQ ID NO: 39558 - protein, 108 aa, A.fumigatus
GGCRPDHQNRQHCPWLPTYSHPATNETQPPSRVVYSRPSTMAHEMGKLFLRLFRCSEASTFHLISRYCPATSLSLLASAFRRVLLIRSQNKQGELHLNARVSHRKLHS

SEQ ID NO: 39559 - protein, 114 aa, A.fumigatus
KSCTDTVIAVMALPQTQIAAVVSGPRKSSSARVEITSERPVPSPKQGEVLIKLEYSGVCHSDVHSIRGDTLMLTDVAGHEGVGKVIQGEAHRADLPCLTVLLMYSLSLSWIERG

SEQ ID NO: 39560 - protein, 130 aa, A.fumigatus
DLGGQTSIRPYWRCYYANTAAVIFVIDSTDIERLGTAADELAAMLNEEELRDAALLVFANKQDQPGAKGAGEISEALKLGELRDRNWSIVACSAIDGKGLDEGMDWLVVSCPLWLSARFVPILDLQGTNL

SEQ ID NO: 39561 - protein, 66 aa, A.fumigatus
VSWTIGLTIVGNSAGTAKEMEELLTMAVAGDVKAHIECFDFSCINDVLQRLERAEIDGRAVLKIPE

SEQ ID NO: 39562 - protein, 100 aa, A.fumigatus
  UNSURE (24),(29): Identity of amino acid sequences at the above locations are unknown.
ILIQWGQKEELCLSLGATDYFDYXKDDMXVSVTSVTRGLGAHAVICTANSESAYIHSMQMLRRLGVLVCVGIPNEPFRLPSTPLDMIVKGMGRTRRCQPH

SEQ ID NO: 39563 - protein, 94 aa, A.fumigatus
ALLRFFAMSSFSSTPAGSFLSRMEPVHAYIAGAGFLVCALVGVVLMLASQHKKFDYNSGIFTYLRFIYASFLKPHKKGLNGQQDALESFYKTQV

SEQ ID NO: 39564 - protein, 80 aa, A.fumigatus
DSYNIEAMASFLPVTQFFSHVYLVDLSPSLCEVARQRFERLGWKNVTVVCQDARSFRLPPEKGISQGPEDPAWLMGGRED

SEQ ID NO: 39565 - protein, 88 aa, A.fumigatus
LTLCIGFFSFKWPDFTIKFDYIGESVNVRAHPTWVGSTVNVRKSMDVALSMNAQSEISKCSVCILNYLASSATLHLTLQDFSDQYTTL

SEQ ID NO: 39566 - protein, 174 aa, A.fumigatus
NGTCLFVGRQQSQHAQIIDIIIMLLAYLAMHLTFLSLFMSMRQLGSRFWLAYSVLLSGFFSLFFGLKVTTSSGVSTSMITLSECLPILAIIVGFEKPIRLTRAVLRAATESYLPAKPMARRSTPEAIEVAIMREGWRIVRDYAIEIAILAAGATSRVQGALPSVLLSCGLDPPL

SEQ ID NO: 39567 - protein, 290 aa, A.fumigatus
RADRLAEKRTVDAMLQEGRVSLLEDEEIVNLCLRGKISAHALEKTMERHPTMSRLEAFTRAVKIRRTVVSRTPSTIDVSSSLEYSKAPFENYDYTLVHGACCENIIGYLPLPVGAGGPLEIDGRNYFIPMATTEGVLVASASRGCKAINAGGGAVTVINADGMTRGPCLAFSSVSRAAEAKQWIDSDEGKKILATAFNSTSRFARLQGLKSAQAGTYLYVRFKSTTGDAMGMNMISKGVEKALEVMKGHGFSDMSTISVTGNYCVDKKPAAINWIDGRGKSVVAEAFHPS

SEQ ID NO: 39568 - protein, 320 aa, A.fumigatus
REPSCVLRPNPTFLQNQWPVGPHPKPLRWPSCAKDGVSCVTTLLKLLSWRQAQLQGYKGLSPQFCFLAAWILLFDSFAPILPFYISVLCVKLEITRIRKHVEPRRALEDDDISTGNQDFDSRVFGCKVKAANISRFKFLMVGGFVLFNVLQLSSLTYGNVRVSDWMPYLSNLSNTLMPAPINPYRVVRNGLDDIYVASRANNIETRVTVLPPIKYVLQSQSRHCRDNFAGPLCDTLRGRTLGCVLAWLEDPVISKWVIAALFLSLVLNSYLMKAARWNLRQSEVIPDSSATVSQTKDSSNKYEKTMSGPSELIDSQKSEQ

SEQ ID NO: 39569 - protein, 65 aa, A.fumigatus
LGQLRSTVRSTSLKALSKPPPFFSGAASQLRIELVNYGQLVINYDELSGPLGSRRYASRLFPFLG

SEQ ID NO: 39570 - protein, 562 aa, A.fumigatus
MGFSALSTELIQLIARQLTEKDTAILARTCQLLYRTLNSILYRYNAKYHASSALLWACEKGILDTVLRFLEYNTNDNTRLSSDWKGRDHPLYVAAKNGYDEIVRTLLQEGVKVDATSNRRRTAISIAASNGHQSVVDELLCAGADYDLADDERKTPLSWAAEHGFVAVVEQLVAAGANINHIDIHGQTPLYLAAWRGRDESVRQLLQAKADTSISADITGLTALSIAAFKGNSAIVKQLIKAGADIHHTNATGNTPLMLAVCIRHIATVRELLHAGAKTTGCSTNRENALAWAAEHGDIDMVRILIEAGADVKSTHPDGRNALSFAAERGHIEICKILVQAGSEVDSVDMLGRTALSWAAEHGSIDQFIYLWQLDPQLGQTDRFGRSPLSWAAEKGHNDIISFVVSQRAPLDITHKGNWDVELISDAIRKLHRSTFKLLPPLRFPWQFRREEFRREDAATLQRPACNPLGIAVAQGHTQAVKTLLDAGAATDIKDITGFTPLMLAAKRGDLHVVSLLVSAGASLDRKCQRGWDAAKIASASGHHSLAFYLNRESGRMRYTSP

SEQ ID NO: 39571 - protein, 567 aa, A.fumigatus
  UNSURE (105): Identity of amino acid sequences at the above locations are unknown.
KTLSPCTSDGVVVATALARYIYREGMRSEFWERMEEPSEETCGVAFHVFDRYGTVQTKYKDHPVQRGTGVWGNELDHGPLFLIEKVHVTALELRRKGLGQKLVSXLLNKARQFCLNEKGDGEYADLIYGSDEAFERAWTLHALASPGILTADVESQLVGKSAEERLMIRARIQSGAIDFWRSCGFRRIGASRCFAFSFDLQHQSHALAAASDFDPRRSHAEDLEDEELEVIYETDRFTEVKKLKMGRLRDALPLHHAALTLTDEELNAFFVTHADDEIGWDRVTNSEATLLHLTACELKPLSTRWLLENVRHADSWKTARDIDGYTPLEALQETLETMRTRKEYGLSRVLNLSDHFKGYPDAAVSCLSLLLGQDSLGLSKACLRFGCTCGECVEGLLSARMRSSLIFQVEITYDLMQEEIDDGDFWIKDNHYILVHFDPDVRKNLRTNKSLRKGFVNIFQIAVECIKARKLPTAENLKWCCNNRSEWPPDTKNYLRRAGTQMGFRAVLRRMFDTAKEEDEKAGNGECQLILGEEWSQLPTCRNDHEFEVVARACGYGGDDFISLPCW

SEQ ID NO: 39572 - protein, 84 aa, A.fumigatus
RPGMDFEDDESTDYGSEYNGLSDSKEEGWWREDESEDLDCEEDIEDHEYTTSGDTPRTVKIRLFLTDEAMGEFKWMKNFIAVHL

SEQ ID NO: 39573 - protein, 188 aa, A.fumigatus
SVLLHFVSSSSPCPSPSSTPSSSRCLTVPAPGPSGSDGSSPPPIQLPSSSKYSCIFSAVIHPELPSIGGGRPPSALPIVTKPDCMSESPSPSPSSSSSNGSGWRFEHADTAAYIICTGVSSFSAWSSIASSAGAVVAPPTYSAPVGGTIVSVMLSSSSSSVFVPGAPGVAICMYRPWTSAGFPGRRRR

SEQ ID NO: 39574 - protein, 860 aa, A.fumigatus
RKERTRLTMPALATVIAVAAVCAALFIVSAVVGTLVWIKAWRERRSRKAVNLGQGRYARQSRAFEADTATSLSREEGSALRLYGQLPYGKPTEWGVLASRESLTYSTVDSEASSQLAEKARSLGRSLSRSKSTRQLKGLLRPQPPGPLAPLAEAAAERPCDKGPRYKARDHVSVSAVEGALELPTEMTPRQTPEKEEERSLAGPSIRPLSTVMPSVHRRERSGNLFPVMEDHHEGFELPFTRVRGGSITTQTAGAIPEQPVPPPPSAYPPNRFRLSKNDSMRFSSLSLETADSSILDDSRRTSTAIESDFTSPALPPCPTFTPFSANDVGRLEFERRSFAASNSAYPAPFIFPDTSSTRDSLRLEPNRTSPRRSLTTRSPSQTERVSPPPRRSESLCSNQSRREVTSMPHLDPNMIPHLNATGYNGSLLPYFSQLHRHSMYASRRMDGDPFYRDQASSHISIHPPRAPARRVSSLYVPEIFTQVRPENAPKLPLTSAMKNTQGHRKGHRRQNCVRISIHPPITFGRPAFSPMAEEPEELEDMSAHRPEAQVPRPTSYGIPSMNPSVVTFSANKNDSHGFQRPRPRITDDFSTPDGSPTKKRKHSRADSGDDFLSPAGSDKTLPEIMTSIPSCNDGCLSQTPSPEKNAPLWLLPIHPSSPTSRENASPQTSPRRSAVKGPRTLPNPMAYSNSSRSAVPLEENDTPSVQQASSSNPPHSLMPHGSRKGAGTATDPLPHNERSAVVLHNPLLQQQDQGDLSCDVQKTSSTSNGNIVTIWEDNDTERKAQAIAPTTQSNDSASCLKKFVHKGRQQTTTDDKTPHKSSQKTPRKGITTPTGKKIGLGIGAATPGSLYDGDGFLKE

SEQ ID NO: 39575 - protein, 66 aa, A.fumigatus
GGDVDAVGLFPVLPSPSRSEVGFPDSAQPPNHVIYLRSDTEESQSSNNNNALDGMLGPLHHQFLVN

SEQ ID NO: 39576 - protein, 107 aa, A.fumigatus
SLFHPAPEDSSFVFRAEQPLGQARVISIRAFNSSITPSNKCKLVILERDLLSTPALNAIRGSAPTANGSSDHTTTATASNNVAAADGQEGQENELVVDGVDVWVTSE

SEQ ID NO: 39577 - protein, 236 aa, A.fumigatus
VSHHPPPNTLSLLAFYTDSIGSKFLLYAPTVAAGVSIPYPSISLHAIQRLRLPGNPAEVQGLYMQIATPGAPGTNTEDEEEESITLTIVPPTGAEYVGGATTAPAEDAMDDQAEKEETPVQMMYAAVSACSNLHPDPLEEDEEGDGEGDSLMQSGFVTMGSADGGLPPPMDGSSGWITAENMHEYFDEEGNWIGGGEEPSLPLGPGAGTVRQREDEGVEDGDGHGEDEETKWRRTD

SEQ ID NO: 39578 - protein, 685 aa, A.fumigatus
ITQRTSVYPPHVVASSYHREIQQPHHNFSFSIHYGIVLFEGMAHKERNGLAGLKIETSFQRHQWQRAEGGRGATDDGSGIEGDRTNIFHDSGARGCGTDQDNSILSGLHSATPPISVPRHDDRHTHDVSYPHKPEEVSASPLESYIQKRRPSISFDPNVTLDSGQQQPLEEPLAKGDPRDRGLLKYQSRTSGLRNALSQEDDEEHVAKQIDYNASPRRYRSQRIFPTGYRGSFPTSPEEEMPMSSEIDRPTSLTSVSTVSPINDEVRTPPESSRDLLSPIYMASPVQTFASLDDRSSWSTGVITPFGSKPRGFRGPTRQSSRRSTLSSGKSPASTFLSMWNGREEPTPQPDDEGQMVGTEYVLGKQIGFGGFSTVKEAYKVEESGGTRRLAVKIVRKQVSGKSEKENDMVQAEFDHEVRVWRYLNHPNILTLDAVYETDYATFCFTKLAIGGTLFDLVRQNRQGLDIKLAKKYTYQLACALRYLHEDARVVHRDIKLENCLLDPHKSQDGTQSSTLVLCDFGMSEWLNTDNEGDSPGPYDDAADRPPPRNIGPAGSSTSVAGSLEYASPELLLSDNGVIDPSVDIWAFGVIVYTVIVGSRPFQDSFTPRIQSNILNGTWNRQAVLGDASDPQVVTDREAALELIQGCLDMDVRRRWTIRDVLSSRWLDGFSENTQNGSSDSIWKL

SEQ ID NO: 39579 - protein, 217 aa, A.fumigatus
WRFSNIRQRSFALDLAPANLDRIQEWIDQGRIDPTRPITIRELAKSRCIHQTKDGVKLLGRGVSAEGGNVLKQPIHIVVSRASASAIAAVEAAGGSVTTRFYTRSSIARIMKRETHPFISAAWSRESASDALLKAAGLEAQDLAESNIMREMGYKYRLPDPTKRRDIEYYRDPAHRGYLSHLLKPLEGPSLFFRSPAERKSSAGVKKEKVLPENRLW

SEQ ID NO: 39580 - protein, 89 aa, A.fumigatus
LDSQQQDGKQEHPMAIIIISLRAEGKCYSCYGYGHTLVTTLPAPIVTPFPIVTPGRTITLPANQQSSPIWISFPSSGPSVPLRTAGSSG

SEQ ID NO: 39581 - protein, 309 aa, A.fumigatus
  UNSURE (30): Identity of amino acid sequences at the above locations are unknown.
HHYHFHTLTPTENQNEQQNSSQEQSVSSGXRPEPSNITSSPGWATRATCGGHDPDSPPPLDPSKYPNGEKSLAGISLRAFLLGTTLGISTSITLYLLLISPHPLWRVPFFVSSLALFHFLEYWVTAQYNTRYASISAYLLSSNGWAYNAAHSSAVAECLLSHTFGPRDGYTSLTASVNGIKWQVVLGVALMVCGQTIRTLAMKQAGTNFNHTVQVERQEGHTLVRHGVYAVLRHPSYFGFFGGGMGTQLVLGNVVCFIGYAAVLWNFFYNRIKRECFLPSVADCWRTGLTERRGGKILGMFLWRRIRRV

SEQ ID NO: 39582 - protein, 160 aa, A.fumigatus
PQPSTLRCGSSMSRILTGPQLIVDSIVDDKTPLPPPKKDPAEDDALLSREPWIEAPIRIDYGFNVRLGEGVFINFNCVIIDTCLVTIGARTMLGPNVSLYSGTHPLDPAVRNGTEGPELGKEIHIGEDCWLAGNVIVLPGVTIGKGVTIGAGSVVTKVCP

SEQ ID NO: 39583 - protein, 215 aa, A.fumigatus
FFLGRFPFHSLWYQQPNRSFLLLFPRGSCPFWLRWPWCHWCLPIISWTSLLSMARETRSNEFVRSNTRPAKYNPTKWKNIRDDMTPDMPDFRCNKGAFTFAGQTGTAEVKAGSKLAMKLAVGATMQHPGPALVYMSKAPSSAKTYEGDGDWFKIHEEGVCNKNADFTKDAWCTWDKDRIEFTIPADLPDGEYLIRPEHIGMRFFFPLHLSLSMDT

SEQ ID NO: 39584 - protein, 104 aa, A.fumigatus
VQQIHRVSVSTIRFFYPQCSSFFWAGSHSILSGTNSLTALFFCFFQEEAVPSGFGGPGAIGVCPLFLGRPCYRWQGRPEATSSFAPTPARPSTTRPSGRTFATT

SEQ ID NO: 39585 - protein, 106 aa, A.fumigatus
PYSSCAQVKVVGGGTGTPGPTIKFPGGYKKDDPSFNFSLWNGYKDYPMPGPTVWTGGSGSGSSSYSKVANVTSSDESSQSGASSSQGTVSTCPNKYNRRHARQFKP

SEQ ID NO: 39586 - protein, 301 aa, A.fumigatus
DSQLPCEHHNLPYCHRLSYPPINIPRGLTMVPTIIYSAILALSAFTPSVFAQTRSSGCGKQPSLANGVHNINGREYILKVPDNYDKNKAHHLVFGLHWRGGNMWNIVDGQSIQPWYGLETRAQGSAIFVAPNGKNAGWAKYGGEDIAFIDAIIKQVESDLCVDQSSRFATRFSWAGDMWYSLACWRAKQFKAVSVLSGGVISGCDGGNDPIAYLGIHGINDGVLPFQGGVNVAQKLVRNNGCQQSNVGTPQPGSRGSVRTDFKGCSKPVSFIAYDGGHDAAPLGVGSSLAPDATWRFFMAA

SEQ ID NO: 39587 - protein, 233 aa, A.fumigatus
ANNGLEVSCDSFPADDQTDPDAYKTAIDALEPGSAITIFTPDPTHFPIALYAIQRKIHVMITKPATKLLQDHLTLLEESRKHGVFVYIEHHKRFDPAYSDARAKAKNLGDFNYFYSYMSQPKSQLETFKAWAGKESDISYYLNSHHIDINESMVPDYTPVKVTASAAKGTAVGLGCAPETEDTITLLVNWQNKQDPSKVATGVYTASWTAPQKAGVHSNQYFHCRVISSSFFR

SEQ ID NO: 39588 - protein, 91 aa, A.fumigatus
SPGRFYMRYAPDEEGNFGGQTGYGYVSFEKFIDAVTALNEGRVTLDQLDARPLPTLKNTIATTAILHAGRISLDENRAVEIVHDGDKWELK

SEQ ID NO: 39589 - protein, 680 aa, A.fumigatus
LQAEAMVMADYNDEDGGVILDGPFDPDAQATVTDFIDYTEYLPADLIRSLTLIRGLDERYLEATQNVHELTKTWGQLPDLPSHERPDAQTLRKNISAQLDQAINARECAYAEACRLYDVVDRHFNRLECIKQKLHALPKPESREPTPPETQTTLNKRGRSSKKGEAAAPTTTRIKLRLDGAANAGTRPEQRSRSRRGKLAADHLAGLHPDSPIASTEHSDVEAGTKPTRSAAPEELAVAKGKKEKQTRRSRTSAPLTNGHGHGAAMSTSNALAMLKPPPEDAKPGSEDLPWLRLTEWEMTKLRKKMKKNAVWQPSEVMIHRELALRGRGWDAYRRAKAEAEANGTEFLDCDDIMNNYVPGMLTRLTDANGIEGVVETKLSNRGMKLNEAKKLKRENMAREQAAAAAAAAAEAKRLAESGTTGAAAPDQSQVESSLAARKPSRASKKRKVDESVAAQAAPAPPVDSETRGSLRSSAKRRKMSKTPVEADEAMVDETADQAAKIESSKASPVPSAASTVAAAQTKEIKTSTPPVSRPPSRHLAPGGASAEVAALAPGKDLRRKSTTPARRTPVPEGSQAGGRRRKRPAPGPVSSGQDGGAAVSYGRRKAKPAKKRFGPREQGQKDGTTREDIRIDEDGVLEEIDPNEPRYCLCGDVSFGTMICCENQDVSFCLVSSISSIHY

SEQ ID NO: 39590 - protein, 851 aa, A.fumigatus
  UNSURE (842): Identity of amino acid sequences at the above locations are unknown.
CLGMPKSWADSQIMCHLIVRRELIMSRRQADTPPPSFGQVPVSARHDVQRLVRVRPEFLGPGVDDCFSPGPFFHHMVDFDRHGRPVEDVVVEVGTRHDRVRAQVQVLLRRGQIAPVPAAPVRGQRLVAAQQPLVHPADDDAVKVDAVLPRLPDQRAGPRGRDGKPLGGEAQEAGDGVGAETVAVEERIVMHKAGVLGLGQDAEEVMLDHGRRLDLLPVERGEDGRVELVVVQPASLVDVGALHEGRLGDLGVRDPALDLLGMPHGRRTPGDGAGNVREHKLGAKQFVAEPGVLPVVVLEPDQVAIFHVGTGLDETLAVILDALQMAVAADAPPAQGDAGIGAAGQPEALLVRRAVVIVELVDGLAVFELLPDEQQHVLGVRADVLERLGALGLGLVLAAVVVDLEAAVLVVVLERRKGAVEALQHESALLDADGHALGLVPETLDVVPAMEEEERQDHILHDLRVRPDQVEEEHTRHADDAGALFHHMVEFSLEFRIGNQGDDDELDGGRHRVPEVVQGILDERERRGQLFGHIGNEQRRLGVLAQGLFAGAVVGVIQNADCGGGAQVASGNMDIQITGIKAAEVLLKPLPVALREVRRLADTTVQQRLPDRLGQLLPMRVTFEPQTQLPEELLLGPPHDYRGVGFFAKLPGHGLGHAGRDERFREHGVLVRHPQHGLGHRMKQSLGDDLAVAAHVDALVQSASDRQDQFQLVRGMAAKSADAGTQRAQGNELDRNLPLGPGLQGSVNQLGCLGESLLDSRFFAAREQQRLDFHPRMRTRLQLESRVGRHQRDSLEEGLQLLLGPFGIRPRGRVRVERLAQVDGRVHLLRHSHFRRDQSDIXTPAWKVADC

SEQ ID NO: 39591 - protein, 166 aa, A.fumigatus
LVESILTDSDSIYTERYMHTPQHNPNGYDNSTITDMAALSESVRFLVMHGASDDNVHLQNTLVLIDKLDLSNVENYDVQFYPDSDHSIYFHNAHMMVYHRMSPPSLLLFRNTNQTRSFGLARQCIQRGVASDSEARAGRVNVGAYEAVAAVIVSLASRYSCSILML

SEQ ID NO: 39592 - protein, 139 aa, A.fumigatus
RSQKIPVLFYLYGGPGSQTVDRKFTVDFQSYVASSLGYIVVTVDGRGTGFIGRKARCIVRGNLGFYEAHDQIATAKMWAAKSYVDETRMAIWGWSFGGFMTLKTLEQDAGRTFQYGMAVAPVTDWRFYGMTSPSSPSDS

SEQ ID NO: 39593 - protein, 665 aa, A.fumigatus
EGLPRREDRQGCVARQAHEGVRVGRGGEVTEGGADGRGPGQREHGVPGDGGVDGGHARGGGRAPGVHGGLRDGDDFFLDGVCDLEGVGDVDGVPEGGAGGAGGGADGHGLDGLADPEHLLVFAQVAVAGEGLLDDVAGHHAKFAAVLGLLVHAAGDLGDVVRGGRGGEDGGGLGVVGVLGPFAEEGEHGDLGAGEREGVVGGDDRAEAGEVVRVAEDAQGGTDVGADDGRAGEGGFAEGEREPFGEGGVEEEPGVFEDLHGVGAAAEGDAAAEALGGDDLLALGGVGRGLVDGAVDVEMVVVELPLVDDDVGGQQGGLDVLGVPDVRQHGDGGPLRLDLLDGGELLHVRDAVDDGVDLAAEDVAVLDGALAGADLHLPAGIEEVGTRRDDVGMVEGDDGGDAHQAQEGVADKRRELAQGRGEAEVGFAPADGVVPDLQGAVPLDLADDPVRGADAVMRRLEHAGDLLGDGDREDEQVAVPELQRHVERPQGGELGVEPLRRRDRVGHLLREPEVAPALLDDVAIPDLRPVPRVLEVRVEVDQRPRGLVDIGLGQLDGARAFHQRCQDRDEVHLDVHVVGRRDVLHLRVQLVLEEPMRRRQKVQPPQRDHLQREHVLLRLMLGNAKVVGRLADHVPLDRPQGVDHVASTGRHTSALVRPGARVGPP

SEQ ID NO: 39594 - protein, 937 aa, A.fumigatus
NITLVPAKMGMPKKVDSPVDLGKTFHAYTTPWADPEWSQQELQTFFERISLVPSDTRLKLEPGAHPGMEVKSLLLSRREEPRIEEAFPKASELIHRALQAWAQGEISIELVPLGSLGPGIRALSCHAADQLKLVLAVGRGLDQRIDVSGNCQVIAETLLHAVSESMLRMPHEYAVLAESLVTAGVTETMARQLREEPNTPVVVRWAKKELLRELCLGFECDTHWEKLPKTIRKALLDRCVGKPSHFSERDRQWLQEHLCRFDTSDLDVHVARCNLGAATAVSILDYAHYGTGEEALGKDSETPLFIPYVSKKLPAALAFVKDPLHNFWYSVASAIKFIIIALIADPEFQREFDHVMKQRARIIRVPCVFLLNLIWSYSKIVQDVILSFFLFHGRDNVKRLWDETKGMTISIKKSRFMLQSLDGTFTAFKHDDEDGGFKVYYYSGEHKTEPEGTKSLKYVSTYSKDMLLLIRQEFKDGKAINEFHYDYRAPNKKSLRLTRGSDTRIPLGRRCIRGDSHLQSVQYNRKGLIEAGSYMKDGNLIRFKYHYRKNPRFGDELLRAEFVLSHITCTVSWCAPPVRHPEKVERWIPHSKVTEATFVQGADVYEARWLYDHKFHPTIFTTLNGQKIQTPPMIEHDFLGVLAKPKYTSFVHDNPLFYCDSLSSNAITRFLGLSTKRFPVSTSRARSLVWKAWKDRVDFDGIIVRWMDERLLRRDKTLAPYWRSRDRGDLASAKKYLDLRADTVMASADLDDNIFNWTPMAIKVNHMVKKGPGGEAVVNTRSKEFGSDTDKSLHVMAGRHGHLAERGRRCVGLSTRHDQLPADDQVAHDLRVGPRLWHSQASDGAERALVEDDPAVGAGLFDADAWALQEQAGLGGGERHVGQRHGHQDELHPDPDSAGERRARHRAVQGRYPPGHAGAGQPQHVLPGLAALDAGLE

SEQ ID NO: 39595 - protein, 493 aa, A.fumigatus
RHRQGELARPLAHAGDAQHDPVGAVVPHRAPHPGDARRGAGALVPLPVHLLDPHPRADPQRVPGVASQRQRLVRGRLQDQAELHPADLGPRHQLARNQPLPLLGPVQALAVCPQRPPGPDAHHLRHHPPPCRHHLAVCRLLQSRLGGGDRHLPGHHRAPQHLPPQGRPRRQRHHGHAKVRPRQGDQVAAAHRHHAVARLVRQGHQDRPAGRRHHHQPVEVRRLPSRHLRRHRQGPDLLHRVPGDHRLQGPPRPRHPPRQRRPHEGPRKHLALPQLLPLRRAPARPRRSRPHRRARRLHRRRCLPARPQRPGRLLPLQRGRRPQRRPRARPRPDHHARPPRRMGPVRRRHRARPRPHLLAHPGRRRQDHPPHVREGRAPPQTWHDDPQHRPEVLLRRPLPARTRADALDRQGRQDHGRPRRRRRPRRRPRGPHRHRRRPPGRRPHRGRSHHHPAVRRALLALVRRLGHVHRLLHHLRVPHAPADPARVHPLLLQ

SEQ ID NO: 39596 - protein, 134 aa, A.fumigatus
SSMTSSASWPSPSTPALCMTIRSSTATVSAPTPSPASWASPPSGFPSRPRGPARWSGRRGRTASTLTASSSAGWTSGCCAATRRWPRTGAAGTGAIWPRRRSTWTCARTRSWRVPTSTTTSSTGRPWRSKSTIW

SEQ ID NO: 39597 - protein, 776 aa, A.fumigatus
KKGPGEKQSSTPGPRNSGRTRTSRCTSWRADTGTWPNEGGGVSACRRDMINSLRTIKWHMICESAHDFGIPKHQTEQNVLSLKMIPLWGLDFLTPTHGLFKNKLDSEVENVTSANDMDIKMNFIPILTALVKGARAIELSKADIHQATRALVNLNTYFQDSRHWTQVWNSDIVKESWRDLWLTQEMPNTIPSAQWFHTELPTLGTLDVALELWYRYLFIFSIPIPEQIPSVFQASHHSVSASYGVVCKIKRNCTLQIWDHAISWRETNLCLSSALCKLSPFVRNALLGLMRITSVITLHHADIISPCADFFNPGWEVEIGTCQGTIEHRNIFRRKVDPVVNGITDMQKFAPVKEIKSQRPTVTMLSHVWYAKDIKTALLAADIIINQWKFDDYHLDIYGAIDKAPTYSTECQEIIASKGLRGRVTLRGSADPMKVLENTWLFLNSSLSEGLPLALGEAALTGAPVVCTDVGASLRVLSDPDDFSRFSAVVAPNDALALARAQITMLALLGEWAQYADDTEPAPVLTSSPTPDDVAKITRRMYEKAEHRRKLGMMTRNIVQKSFSGDRYLREHEQMLWIGKAVKTMAVRAAAGAPGAALGDPIDIADALQVADPIEEEVITIPQSAVHSWRSSAASGMSTVYSTISGYPMLPLTRPASIRSSFSNFSTATDSDSFMGLPSNASLPVFAPRQTLSFDAGGAVTPTGRLSPSGRLSPAFGRHRHSHARSISTLGREQLRGLQREEPHPYRNSDVSLHMREEFLQSSIFKSIDGNAGGKS

SEQ ID NO: 39598 - protein, 157 aa, A.fumigatus
KARAPSSCPRPISTRPRGRWSTSTRTSRTRGTGRRSGIATSSRRAGATSGSRRRCPTRSRRRSGSTPSSPPWGRSTWRWSSGTATCSSSRSPSPSRSPACSRRRITASAPRTGSSARSSGTAPCRSGTTPSAGAKPTSASPRPCASSRRLSATPSWA

SEQ ID NO: 39599 - protein, 143 aa, A.fumigatus
CASPPSSPSTMPTSSRRVPTSSIPAGRWRSAPARAPSSTATSSAARSTPSSTASRTCKSSPPSRRSSRSGPPSPCCRTSGTPRTSRPPCWPPTSSSTSGSSTTTISTSTAPSTRPRPTPPSARRSSPPRASAAASPSAAAPTP

SEQ ID NO: 39600 - protein, 102 aa, A.fumigatus
  UNSURE (72),(74),(75),(77),(78): Identity of amino acid sequences at the above locations are unknown.
VNVLDWIGMVMPLQPSLGFCISNVTKGPCLLLHHSIKLDYEQKSTILDWIKIKLSMKKKGLVCHNCQAREGXTXXKXXKGKSEEVISTKTSCLNSLIPSTSF

SEQ ID NO: 39601 - protein, 94 aa, A.fumigatus
NVDSILTQPNMYARGILFGKMKYELGDHSYVRCPENNLVADIEFKTKGYFSGTYNAIGGTIKNEKTGEVYYELSGLWNGEMFIKDVHVWCPSVS

SEQ ID NO: 39602 - protein, 87 aa, A.fumigatus
SSFLESFMAHPETLLPMPTINDPLERFVSVVKFYLSGWHIKPPYVHSTCSHSVFKDETTSLTWILQRREEAAESDSRRDLHLLLGLP

SEQ ID NO: 39603 - protein, 105 aa, A.fumigatus
THKKDILFDATHAKHTPPSTRPIEQQGERESQRLWHSTVKALLARNHEAATDEKSKIEERQREEAAKRADEGVEWRPRLFRPVHGGPGGPDEGEEDLDWIISAHM

SEQ ID NO: 39604 - protein, 70 aa, A.fumigatus
VTARPFRPVVKTYGVEEGIVHLVVWTKFELEDDPATDDLTPQARKEIDDYVTRTFRSRMPAEQVCCSNCP

SEQ ID NO: 39605 - protein, 97 aa, A.fumigatus
RGYCRGVKKPLNPILGETFTCYWDYPDGTRGYYIAEQTSHHPPKSSYFFMAPEHHIRIDGTLKPRSKFLGNSAASMMEGVAILRFLNRGQNPEKGER

SEQ ID NO: 39606 - protein, 182 aa, A.fumigatus
RRSLPATTRQQRTKSQRLKSVNVKRPLSGPMKEWNGVRDSSALFTGAPEAPMRVRRTWTGSSARICKCDGYVRLSYNRKLTRTYSDSQNPELAAKQILAIAPILDGQKDNRQFQIPPHVPKKEKEGKTAPSASDPVDAKNTGSDTGSGASEAPQPSSEGNNSVERKDSRTSEVDEYVDAEEK

SEQ ID NO: 39607 - protein, 137 aa, A.fumigatus
TPTAPAPLSSNAAPTPSAATASAASTSTSAPTAPASPSSRLSACLSSSSAVAAIPRATSPAPGPTKPPSSLMPRTSSIPTSPTPSPSATTSARTTRSSPHCRKCASSRTRTPARTLPVLSSPSVSSSAISRGPLVFR

SEQ ID NO: 39608 - protein, 122 aa, A.fumigatus
VVLSLGQLHIVRKCFLLMFDKLGVAATRSSAIFSPQLSTTSDLSVFFISPHSSDASALRIQPLHLYCVHLESGLSQYVLDAYDFFFPFRTLASSPLFIHPFSSPNPSQPVRPHGALRHCPRI

SEQ ID NO: 39609 - protein, 508 aa, A.fumigatus
PLLLFLSIHFPLLILPNRSDLMARSAIVQEYNPPPPSNPTLSVDRKVSLERQKNGIPRPQGYRVSWHANPAVEPHHFGQSHPMKPWRLTLTKQLVMAYGMHHAMDLYLARAATYEEMAEFHQTDYLDFLRQVMPGDMENPEQSENIARFNFGDDCPIFNGLYNYCSLYAGGSIDAARKLCNNQSEIAVNWSGGLHHAKKAEASGFCYVNDIVLGILQLLRHHPRVMYIDIDVHHGDGVEQAFWSTDRVLTVSFHKYDKDNFFPGTGPLDSTGPTHPLNPGAHHAVNVPLNDGIDDESYIQLFRDIVGACVDTYRPGAIVLQCGADSLGCDRLGCFNLNVGAHGACVAFVKTFGLPLLVVGGGGYTPRNVSRAWAHETSILIDAQDLIDPNIPDTVAFRNHFGPDYSLFPPLSEMRKLENKNSRPYLAGLVQSVREQLRYIQGAPSVQMSFIPPDILGLREDTEKEIEEATARLEEEREEREGPGSAAVKSNRRRELERGAGYRGELYS

SEQ ID NO: 39610 - protein, 61 aa, A.fumigatus
MPREPKRGMTPSQSAQITTPQINTAFIPQVIYFGISIDSKIISSPRPFRIPTGGNPITLWI

SEQ ID NO: 39611 - protein, 84 aa, A.fumigatus
QGQGQRPSVCTDQHSSLVSNAVLAYTLGLRHAFDADHISVRPKQSVARQLSNIIQAIDLMTRRLLATGQQPVTVGTFFSLGHST

SEQ ID NO: 39612 - protein, 148 aa, A.fumigatus
VSSSRSIQGLGLSDGTSIVIITSIVVAATAAAVSSRFDSFSTVGGIIGTSVSAAFLILLGLMNFYILYKLYKQMQKVLSLPEGQEDEAWKIEGGGVLFNVLKRMFKLINRFVVPRSGVQTIQLIRWLGLGRCTPWVFSSVLVSTHHPR

SEQ ID NO: 39613 - protein, 163 aa, A.fumigatus
PGRRLHLPQADSRPVARANRTTAHPARATGPSYTGKRRPSTTKRSPYLPRRTGSRATSCTPACGPHRSTRPTRRSSTSWSKSARPASSRSTRSASAPTAPLSPRWPPTHTRFDGPPRSSPSPAATPRSPPSSPNSKPASTVRSPPPTPSTPTPSSKPSTSSGT

SEQ ID NO: 39614 - protein, 320 aa, A.fumigatus
TAIMGVLRLPRPTGIYVPNSPTRSLTTDMISSPLSPGFNFDCETVTPSIIPALDYISSKLQQKMMHVTLLVGRGKPYPTGQPSDLMVIPIAQLDPQSWRTICRIVAKGAKKFSLGQSWTDALARSQYERQANEYLIQQSILQNEVVFSREGLTLLSVDRIYTFKRRLCILSNRDNGIEEPYISSCVHLLHRTIRDFQGRPFSKAFFHRVYEQLDVRDDLLTRVAHAYKKEYNQEGIVLPPRPRPEYSRKSPIRPVRPRRQPTPPTCRPASAKKGPKTPLSASDVTPITRSEWNMFVGAGIRPINPTVTKWTPSPTVLAAA

SEQ ID NO: 39615 - protein, 198 aa, A.fumigatus
ELSAGMCLLDTTDGALMLSLYIQPAANFLPAKRDSTSSETPLILGEDHEIEPSQNHRDPVAFLYYSIVLTLLTVIVAIIIGIIQLLTLVLNVAEPTGRFWDGVQTAGDYYDVIGGAICGCFLIVGILSVVLYKPWRRWIAKRQGKSTAADEESSRPRDELPPANTGRAVLSEESNASTSVVSYGAVGKGATSQVVAQP

SEQ ID NO: 39616 - protein, 181 aa, A.fumigatus
SKRGPVERNPGAGEARCHDQAGGCTSHKPIRVPSLARTARRPIQPGPPAQAIPANDVRARRSGPLTSPAGLGQEPRHVRLHAVRTAPPAQRGVHQPAGQNPQDPRAHARRDRRPRLQHLYRRAGRLPIPDSTALRDPHPPRLRRQDRRPLRRIPSQRARYARRRRRPRHRPRPQNPPPLLE

SEQ ID NO: 39617 - protein, 67 aa, A.fumigatus
LSSASTASTPSSAASASCQTETTASKSPTSPPACISSTAPSATSRVAPSARRFSTACTNSLMSAMIS

SEQ ID NO: 39618 - protein, 88 aa, A.fumigatus
GRGCAVQCAQAHVQADQSVRGSQIRCTNDPADSVVRPWKMYPLGILFGLGFDTSSEIALLGISSIEAARGTDFWVILIFPILFTGGSA

SEQ ID NO: 39619 - protein, 421 aa, A.fumigatus
SPNCQIQRSNGYTPPAMSDITTYTSLKHDLNESPDGLDFSSLPPIFVLSTHLELDALHQIEDDLVTRGGRLTYDISEARLVLGRISQKKRAALELRSRGVWTEEVSGSGSVSAPLRTSHEPPVKRRRVDVVQQGKPRGAQLEDIDLGTETVDEEDGMRSLHDTRGHLRRPRSVSPDTASVASTPSLTSSVATALEDHEQADVVTVVKLDWLSEVLRTGTLVPLDPFVVYRGRRTAQPASEASADQSKGILERAKQDAMTRPAAAPPTSRFASRRSREPHDGPSSQGHRPKLYRQTTSEHDEAVPLPPPPDWVKSHVMYACMRSAPLHPPNEAFINQLVKIRKTRELTLDEIGVRAYSTSIAALAAYPYQIRRPSEILTLPGCDAKIAALFAEFQASEHGTLAAADALDTDPVLKTLHLFWN

SEQ ID NO: 39620 - protein, 135 aa, A.fumigatus
YRPLLGRSKKLGKVKGIVPRKIPCKSLHNFLIQTLQCINTLQLSFVILIGLYHGLFEILPPGDISRSVVCWEHDCEGRLLPPCPPPALDEGLEVGWFVIAHDDATGTKINTFFEDVCGYDKVLATAAEIVQCIAL

SEQ ID NO: 39621 - protein, 170 aa, A.fumigatus
RAFRQRKEAHIRELEGKVKAYESMGEAIKALQAENYQLREYIINLQSRLLDSQGEVPELPGNIDLSQPRSEIPVPPIPNSGTATTTAPPPTAPQQPQPSHDQAPTSNDDMNSLNRIAVAGLGMRKPPTEEANYLGNNFQAQARRVRPDEGQPEASELPKQEQTHGLPLIS

SEQ ID NO: 39622 - protein, 148 aa, A.fumigatus
VTLHVVPVENTAQRTRSCACCALHPPNTFHNRRLASANIKSLVLHDQLLAAQHQHLTHPQQARPQPPAPQPPHMQPNTPARDQNNIDPAISGATMLTGPPQTPTQPDVTGQETPKTYGKRPLSTSKRAAQNRAAQVRALRKTVYKICD

SEQ ID NO: 39623 - protein, 407 aa, A.fumigatus
QPVPWSDRITQSSCQYSKFFTNSLLELADSPSKMVESKPDAVCRTPRLHRQELLKFTHRPHLQQIWYTPTDPAGFRSASLTLGALYHAWENLDIGDDPYIQRLRKSSLDDRALKKALLTGKTYCREQLRRFVDRSRHIFEELGEWAAEYYIYASIKQLRDRVRDSYMSGDWDEAEKAYLVDFLSKIPTSDIHFALNDPDGFRISPKFESLLNFLDSSDQREFSGLIFVKQRVTVSAMTSLLSVHPYTRERFRCAAYVGWSNSSASKDILGDLLNMQLQRDTLDDFRSGRKNLIIATDVLEEGIDLSACSVVVCYDKPPNLKSFIQRRGRARRKQSTFAIMFPTDDTSADVSRWQDLEQAMIEAYQDDERQLQSVYALESLDEEVMERLTGDFTRYDSFHFPKFLGSP

SEQ ID NO: 39624 - protein, 461 aa, A.fumigatus
RGGWIHTGGSDPAMEVYSRGHNPLLMGVVRDHSRYGETFLFRKWLVSQPEPVMFDLWSWNVLPFPHRRNFVGRQTLVNSQVDVDEAIPDSAAKNPIVAAEACTIDRLPFTMAIFGLFISAIVEQLEIELIATRLRDTILRDVSFKSTDHIITAISTPLAHRLTNYQRYEFLGDSILKFSVSCQLFFQHPNWHEGYLSEGRDMIVQNPRLAKAALDTGLDAYIVTKRLASRKWSAPLISEKLERVPAKRQMSTKVLADVVEALIGAAYVDGGHSTAQACIRRFLPEINLHAVDTRTAARSVAPESARHMMNDRLKDHIGYTFEDESLLVEALTHPSCDYDSTTQSYQRLEYLGDAVLDMVIVSAIFNHRIQRPQGDMTKIKHAVVNANLLAFLCMEFAISEEKLDVAQTSKDSFAVTSSQESVELWRFMRYRGQGLKAARDASLARHRALRDEIASSLRPAR

SEQ ID NO: 39625 - protein, 343 aa, A.fumigatus
VVLLIAMIQAKDRPYLEAHFPLLVPPILALIDDDSVTYKTRGCLFLTQLLTPIRESKSDILQRTNLASVFEDAVRPCLLSLPSITPEDDAIKLLGVAYPALLSLLQTNYHTATSRSAANANRDKYISSVARTLRENLISSFHHISSTNRTSISSFASFPYPRLSTLLVNQMYPLLLELGIHTTKYLQEIVPLLYSTLSNPFGTAYPPLLLSAVAVTRATILNAHPRLWRWRGEILGALCSCWLRVAEEEGEIAERAAKGRSAAEDQETNTTLTKLKRQLRGAVYLLRFALQNPAQADGDAGQLEAKAAIGKELQDLVDADESLADLLLADIDPNDADFFGMDP

SEQ ID NO: 39626 - protein, 97 aa, A.fumigatus
HLILLNEFVALTCARPTVIQEYDRFISYIIQNNLQGVCEMKPIVNGAEIMKALEAKNGPWMSRALDMVFKWQLLHPEITEKETALKYLIDRKDELGL

SEQ ID NO: 39627 - protein, 895 aa, A.fumigatus
  UNSURE (5): Identity of amino acid sequences at the above locations are unknown.
VALKXSAEPRSAFFDLGEESINRMHKISLYETATRFYMVGMDLSDTRFRILKIDRTSDTNDLVIVEDDIVYTKSEMSQLLDAIDDGNKISGGLKLRCSAWALLGFIRFTGAYYMLLVTKRSQVAMVGGHYIYKIDGTELISLTTSSSSKLKPEKNPEEARYITILNNLDLSRSFYFSYSYDITRTLQHNICRERKLHQDGYSKGFHQDYNTMFIWNHHLLSPAIAALKNPYQWCLPIIHGYVDQAKIDVYGRLAYLTIIARRSRFFAGARFLKRGANDLGYVANDVETEQIVSEMSETSFHAPGPALYANPLYTSYVQHRGSIPLYWTQDNSGVSPKPDIELNLVDPFYSAAGLHFDNLFERYGAPIYVLNLIKSRERTPRESKLLKEYTNAINYLNQFLPGDKKIIYKPWDMSRAAKSRDQDVVGTLEEIAGEIIPKTGFFKNGYDADSGLQLQNGIARTNCIDCLDRTNAAQFVIAKRALGYQLHALGFIDGTTLEYDCDAVNLFSAMWHDHGDTIAIQYGGSHLVNTMATYRKINQWTSHSRDMVESFKRYYNNSFLDAQRQEAYNLFLGNYIFTQGQPMLWDLSTDYYLHHASPKSWAEKRRPNYINWYTPENLKKRELPPPPSRPKEPLSRFDDYWLEYYRPLAVSTLPKIFSFKMKSTFHYVPHHFSPFDVRIAHEQANRERHPQRSVRIQEPGSSVIEQSRRSPMHSSPRNPNHTQNGLQQPDLTQPSAKCTKDSIYELSVSSSKIPSMQTSTESATPSKAQIAQWTLGQLVADSLNPSVTAAEAEEYERYINHPLNVPLVVTSEDEITAASAQHESNLDLLEYANKCNIEEAILEANAEENLADYAEFLTVSEEGLTVVAEDYEKKRYKRYRQWLRGKSLFKQRVDI

SEQ ID NO: 39628 - protein, 145 aa, A.fumigatus
SIDKLRNCVRRDDFCKPGFSPTYIDYRVSDPSYSLDPRSAGPSSIWYPDLRTLCVMCQWPYAQRCSRCLSSWYCSKRCQSIDWPFPQAPLLPIPQLPGHPPIRGPQARHLVSQRHNPANAHMGPYLFSRMGLPLSLLGPLPWPKA

SEQ ID NO: 39629 - protein, 96 aa, A.fumigatus
HSTDVDIHGSVLLRRLHGEDLDLAMAKHMCFYCLEVLKPLFEKALSGEISRQDGLDEITLEKATAWKPIDAYTEVTAEQPRPQRGFVRRMGSSGWE

SEQ ID NO: 39630 - protein, 202 aa, A.fumigatus
PMPLQLVLFQEMPKHRLAFPTSSSAPDTAIAWPPADQRTTGSASGFSETQPSQRSYGPLSILQNGASTVPAWTTSLAQSMSSFSPSHSSKTKEEPYSSTTLLQCTCDYNIVINKSVHAAVEDCHGMSTPYNMPGEYVVMSGQQGSYTGTAKHEFKDITLADFRHALGWFSTYFDDTVRETSSGGSSVLAVQASSPFKQNSSG

SEQ ID NO: 39631 - protein, 105 aa, A.fumigatus
STRSCSAQVHSESNPLIFYEIWFHLPTKRAPELPRVGLTDLVSYDIRKTSIRALRRKFHSRKWKDTWDSLCGAIGIQQIMVNLIMTQAKHLASVIAEINSSEWVR

SEQ ID NO: 39632 - protein, 130 aa, A.fumigatus
NDDLGTEACIIIKKIEKELISAHRNLGTFPSQNIVISYISAFFLIVGFLIQSVGLSMMHWPTQSLQLLAISAMFGLRYWLHKQTIPDGIKLQYNQDDGPKKEFNTGKAEKELMALLPPAAPAGDIVRWIS

SEQ ID NO: 39633 - protein, 99 aa, A.fumigatus
FLGKYRNTQQAWDAEALRGLVLLEHALSTKAGLIPFYMCTCNSRYYKAMPYIIRPGKSSCCRLNQSAVALPSHAEGNGLTSPIAFRNSSSRCGELNSTV

SEQ ID NO: 39634 - protein, 352 aa, A.fumigatus
IVCLEFPDPLLCRNAVLRAGLTQRFSTVKPWHVVVAYEIINFFCYLFNCFGKSLPLVAKATLYISLISFLVILVTVPACAKTHPSASYVFGHFVNSTGWKQDGIAFIVGLINPNWIFACLDSATHLAEEVPQPEKNIPIAIMATVVIGFVTSWTYCIAMFFGLNDLNKLLSTATGVPILELYYQALQNKAGAIVLETLLLVTGMGCLIACHTWQSRLAWAFARDRGLPGHKLLAQVNKTLDVPLMAHTVSCFIVAALGLLYLGSSTAFNSMVTACITLLYLSYSCPILCLWYRGRNNIKRGPFWLGKWGLAANIVTIAWTVFCLVMYSFPATMPVTTGSKCFLMLLDRKHLC

SEQ ID NO: 39635 - protein, 133 aa, A.fumigatus
  UNSURE (13),(65): Identity of amino acid sequences at the above locations are unknown.
VLRFVCRIPWFGXSASLVTGINSGGTVLIVYGLLWITFISICVASSLSELASAMPNAGGQYFWAXELAPQKYARFASYVTGWFGYAGAIFACASVALSLGSAGVGMWQLGHPELYAWNSLTLFSAEMLFCAPG

SEQ ID NO: 39636 - protein, 116 aa, A.fumigatus
RESQHLAATSPSVEILRFLLLQGGSVHIRNRNGRTPLFLAANAGLSEHVLLLRKSGAHLHSDERQAAELLARRRPAVWGLAGIGPREVSDREMEEENESLLGRREIPSRMVSGSAP

SEQ ID NO: 39637 - protein, 377 aa, A.fumigatus
REQSTSGYIQTSSEGELACRVLWKLRLFFDASSGLPDNMTAAEATIPELLEEQADSVPESRVLIIMTGGTICMKQSPSGFVPARGFQEQCLARVPTFNDGSSSTMMDVVVNAAREIRPHPSLRTPQTLYGRRVRYTVFEFEELLDSSSIDAKGWTEIARTIERNYTLFDAFVVLHGTDSLAYTCSALSFMLQNLGKTVVLTGAQAPMLELQNDATDNLLGSLVVAGHFVIPEVCLYFNNKLFRGNRSCKVAASDFAAFDSPNFPPLAVTTSMRTNVNWELVNRPKNIEHFSIQTNLDTTHVACLRIFPGIKPEMVDAVLKLEGLRGLVLETFGAGNAPHGQDNAMTNVLADAIKRGIVIVNVTQCKLLCRTICYERC

SEQ ID NO: 39638 - protein, 137 aa, A.fumigatus
PQPGLTGSVSPVYAPGMSLSRAGVVAGLDMTTEAALTKMSYLLALPDSTPESVAKAMSVSLRGELTEVSQPMFRHPDGALPERVQTLTMLGYAIAQGDFERVQEIFKIEHHWILNDADYSGNTPIVRKAFYSWVFRE

SEQ ID NO: 39639 - protein, 65 aa, A.fumigatus
SRLCASSQERSLRLNTKCSQEGLHSMKDNENNEDRLKNMISLINQGHSKHHKVSRQGGRTGRRTI

SEQ ID NO: 39640 - protein, 227 aa, A.fumigatus
  UNSURE (10),(49): Identity of amino acid sequences at the above locations are unknown.
LACRVSQNSXHTSVFEADPDHSQFQSQTPNGRRTAGRARSNTAHSHHEXYEPLHEELTNGVSPRPIIRSDRHASSVPPTLPAREAYPAETPYQRPFLNRTSTFEGPSQLRHLQPSGLSSWQSRAASENLVSRRDSSQPRPVSMMPDNPYTDAYEESTAHVNSHSDVFYQGRSSPPSHGEIISRRASSGTLNGSALNKKGPPPPPPSRAKKPPPPPPMKRPMLSVGDA

SEQ ID NO: 39641 - protein, 191 aa, A.fumigatus
YLFPSSAAHTRLNKAPAQFRTLDYAERHGYVRGVVKEIIHDPGRGAPLAKVQFRHPYKFKMVTETFIANEGMYTGQFIYAGKNAALTVGNILPLASVPEGTVVTNVEEKSGDRGALGRTSGNYVTVIGHNPEEGKTRIKLPSGAKKVVKSTARGMVGIVAGGGRTDKPLLSMLLRLANSLLVWKVYERRRC

SEQ ID NO: 39642 - protein, 61 aa, A.fumigatus
RVSTEASRAKHKFAVKRNSWPKTRGVAMNPVDHVRSPFGLFYIFFLEQHLTRILSAASRWW

SEQ ID NO: 39643 - protein, 231 aa, A.fumigatus
YLKMHVVDDSNDAPKILPLPRAAPSTSAAARWQAVVNRDAAANTFVYAVLTTKIYCRPSCPARLARRANVRFYDTPSQAESAGFRPCKRCKPEMHWAANPQVQLIQKACETINLEVLNGCKPTLQKLASEANLTPSHFHRVFKKVMGVTPGQYSAAAQDCRNRNASVDSGLGEDWSLNRPLCDDGVCYDPDLLGGLDDSHAPTTTDAVVWNDFDAMIAAENEYILWPDEVQ

SEQ ID NO: 39644 - protein, 150 aa, A.fumigatus
NMRVGKICVQCAGFLMLLFAETIHTLGVDRIHKSLAAYLKSISKRSEGDDKEKTLPIAHLGSSMVSHGEDFDANSEYGRCLTSKRPCHSCCFTSDWLSDVVFYQIVFGRAEERIARVQETYISQATATYLESLERSLAQLKEYQVRFPSV

SEQ ID NO: 39645 - protein, 98 aa, A.fumigatus
RHEQAARKKLDSRRLAYDTSLSKMQKAKKEDFRVEEELRTQKVKYEEANEDIYRRMYDIKDAEVENIADLAAFLEAQLNYHERCREVLLQIKNDWPAE

SEQ ID NO: 39646 - protein, 64 aa, A.fumigatus
IVSGHSSIHFEFPKLESTTKGLSSSTPSHKRPTNACTVTLYSVDRYDHGRCLKPNNNCTKSHAN

SEQ ID NO: 39647 - protein, 121 aa, A.fumigatus
LFTSLGAFVFIFGLSTLIYCLTFLCNDVSGCPVPSLLNPSTLSLDKLKEEAGWPQEGLKAFFDVRVTVWVLSYYVLSLVLYVFLPGEVVEGTELACKGRLRYKFNGTKLGAVFYVVSTDGL

SEQ ID NO: 39648 - protein, 274 aa, A.fumigatus
PWLAIAVSVRSLPIAVSGRIFEGLASDNLLHFNLNTIYVSLTLPSSVSGQKASQLMATSLGLYMLGTAVSPVAVSLFQSYTASFAAALAIFGITLAYLVIYIDIPAPQAMPQVETYSSKILSGVGILLSPLRSFLDHPHAIPYGLSLLLYTAVQAHLFPAIMVFASIRLHSSAFQNGLLVSIAAACASVSLFLKVFIMPRVRWLRLNSERPTDSTAILAALVIQMHALIGITQVRNAGQLYLAVSVAAAGLALPAFFKGHFVSLTPDASRAISA

SEQ ID NO: 39649 - protein, 278 aa, A.fumigatus
DVCMVLRPCGEDSICDFDIYRYQAGSNLQIGNIFPREYARAFYEGMEAEGQKNIVNLLRCAWAGSQKYGALVWSGDIASSWGSFRNQLAAGLNMGLAGIPWWTTDIGGFHGGNPADPAFRELFTRWFQWGTFCPVMRLHGDREPKPEGQPTAPGADNEIWSYGEEVYEICKKYIDIREELRDYTRSLMKEAHEKGTPVIRTLFYEFPEDKKSWEVETQYLFGSKYLVAPVLEAGQRKITVYLPEGALWKLWGEETERPGGQDVEVACPIETMPVFVRV

SEQ ID NO: 39650 - protein, 371 aa, A.fumigatus
RIIALPSAILILGGLALGTYMHGADFVVWTFLWDNYVQIITANLIICVVLAIFVYARSFSIPAPGQPNPELRELAPGGHSGNALYDFFIGRELNPRVQLPIPFVDEASRTIDINVWCEMRPGLLGWIILNLSNIARQYRTYGYITNSIVLSTVFQTFYVLDALYMEPAVLTTMDVIMDGFGYMLSFGHLVWVPFIYNIQTRYLAVFPLELRLREILLILAVTGAGYAIFRGANNQKNRFRRDPSDPRMMHIKYIQTSSGSKLMISGWWGLARHINYLGDWLMSWSYSLPTGIAGYTIIESINSSGDMQKQAIQTPEVRGWGMIFTYFFLVYFGALLIHREGRDEEKCKSKYGADWERYTSIVRSRIIPGIY

SEQ ID NO: 39651 - protein, 293 aa, A.fumigatus
DVEAHSGDVITQVHTAATNSLVYKPNVVLINAGTNDCDRNIDPANAGARMRSLIETLIHAPDMARALIVLSTLIPSGSTSVEANRPSVNAQYRALVSDMRAGQNVSIVLADMDPPAPSPGNNWIKYPDSYADNKHPNDYGYSQMADIWYNAIYDAAKAGLIVEPADLSISPPGTCDKEYGSGVYAGGFTQQGSGEDDGIYRHDSEYSGALFSVRAGKGALDPYRDDDELFFFFGRLYTREYDDLIIFQKDTESGAVTFVPYTNHVHTEKKEFTKGVHSRLISLHPGGEATRKA

SEQ ID NO: 39652 - protein, 63 aa, A.fumigatus
VQFKMGNMSSEKTLQNNKHADDLGEGAMQQIQECSAFSSTAEKRLVRKIDIMYVRHAISLPRY

SEQ ID NO: 39653 - protein, 191 aa, A.fumigatus
SRILPIMTFAYMMAFLDKQALSYTAIMGLRTDLNLKGSEYSWSGSIFYFGYLFFSYPASILMVKFPLGKYLACNLFVILPKRLGLILTMNSMLWAIVLACHAATTNFAGLMVARFFLGCTEASVSSGFSLITSLWYRTSEQPLRHGIWFCGNSISMIIGNLVAMGIWQIKTGLQPWKVCSHPLQDSIHSDM

SEQ ID NO: 39654 - protein, 92 aa, A.fumigatus
IIQWLFIIFGIVTFLWGILMFFRLPDTPNTASFLTEAEKLLATERLKANNAGYKRNKIDTSQIIEAFIDPKTWLLAVMILGFNIPNGGFTTA

SEQ ID NO: 39655 - protein, 191 aa, A.fumigatus
RKKRIMDPYRQIRVHTIVVNIISHILDLGIIVPLCRRSGSTVLKSSHCRELRDSGSARVDGLREGVASDNAGGWPGDGDDAGWQSAGRPVGQPSQRRTRGRHDERRRERRKMEYSRDRRRGEEKIGVGIKDGRLAMKEEEKKKKRRKEGEKGPRGIIVERDRPSRWTEAGSVCCPAVTPGYPNAEGRMAQR

SEQ ID NO: 39656 - protein, 125 aa, A.fumigatus
LHHILQNPQLPLHRHRRSRLYQVNPLTGYTATDPDKNDDHSILGSALVYATESIAARYAGLLLMGVYSVSMPLSLAMVASNIGGFSKRATVSAIYFVMYCTGNIVGPQLFYESEAPKYQVCCIQL

SEQ ID NO: 39657 - protein, 213 aa, A.fumigatus
DKVNGPLASITSSPRFSGHGVRGMSVGTETLAVHPSLSDGISGLLLVEAEHLSNHSSGGNLDQHNVVQADSVVRILQGQNTLDFVGLDHSLQHFLDLHDLAISEVTSGTVGAGDPVSDSQNTAQIVGGVTPLGGKPAVIVVKPPDHGTNVEGTIDRVQLIGSTRDTSTVRDNGALNNGPQQLGAFLESQGLQSATQRVEEDQTGSVILNQINA

SEQ ID NO: 39658 - protein, 190 aa, A.fumigatus
IVWTMGCRNHEEGSSLLLLGKDPVSYCSPVGPLLASQLTFLCVGADIFSRPGEVLPPFPKPTHGLPGSGLSDYTTINQMIANIPPNAPDHDIEGARSRGLRNGTRVPFDPNQQAKTVTCSGGENNYHPSGTRGFTNREFACLQTFPLDYRFGAREVRRQIGNAVPPALSKAIYREIIKSLQRTDEQELKG

SEQ ID NO: 39659 - protein, 272 aa, A.fumigatus
YDTARLVFLDTLGCGLEALRFKECAKLLGPVVEGTVVPNGTRVPGTPYQLDPVNGAFNIGAMIRWLDYNDCWLAAEWGHPSDNLGGILAVADWISRTNRAGGNLGNGKIVKVKEVLEAMIKAHEIQGVLALENSYNRVGLDHVVLVKVATTAVVAKMLGLNEKQTADAITQAWVDGQSLRTYRHSPNTMSRKSWAAGDACQRAVNLVLKVQKGEGGVPTVLSAPVWGVYDVLFKGNKFKFQRPYGSYVMENVLFKVSYPGKFVEVRIRRVHY

SEQ ID NO: 39660 - protein, 100 aa, A.fumigatus
PLTAEFHSQTAIECAQIINRKLAAMGKSAKDIKEITNRTHEACIRIIDKQFKAMDNFADRDHCVQVCLQLEFDLGSFADLDQVHGCHHAGLQPPDRRGLR

SEQ ID NO: 39661 - protein, 353 aa, A.fumigatus
PMFGKTNWSNKGGLPLNFPRAFFSRIELVFKKLLKSSLSRPSFDRNVESQGDLYPKWSNRTVWIVNESTEVPLSFVKRFINIRFTNCCHVEQDLQKRNRPNDLFCRLKENLKSSQAAVEYLSFEDSDEGFAIGSMSLRHSWRGETRPFGSADANSQPQSPIIVLDADPVIDLTGIEKEDARVQKKHRKYTFGDGFCGAGGVSCGASKAGLHIKWAFDKSENAITTYRLNFATAVCEACDIFCFLTNKPEELKVDVSHGSPPCQTFSPAHTINSVNDDDNSACIFSCADMIKKSRPRVHTMEETSGLFDRHKETFHRVIQDFIEIGYSVRWRILNCMDYGVPQSRRRLIIIASG

SEQ ID NO: 39662 - protein, 115 aa, A.fumigatus
VFHLPSFPSPFIMSASCSALRRLTHRSPRTLPSRIVSVSRPSSRIVARNSFTKAVNPCAPRVSQFSTMTALQHGAPAAPTERNYDPEIKDMADYVHNYSVNSDLAVWVHYPLFSL

SEQ ID NO: 39663 - protein, 224 aa, A.fumigatus
QPSSTLRPPLSARRLSTGSWQPWARAPRTSRRSPTGPMRLASGLLTSSSRLWTTLRTVTTVFRYVFSLNSTSEALLILIKYMVATMLAFNRLTAEDYADGSEAATSPLVEDLRKRIRCVEDPQFTRDYHDPAKRTIPNVVTVTLNDGTVLEEVVVEAHLGHRFRREEAKPEILSKYKRHLEAHFDQARIDEFFKIGLDRSSLENYDVDKYVDLYVKDKMVVAAQ

SEQ ID NO: 39664 - protein, 148 aa, A.fumigatus
ESDPRDYFLTIFTLLETLMTHELTLDDVQVATAPTLRTFLCLPLFLIASGIQHDCHHYLFSLKKYTLPTHPMFQRIVCPHYTAECVIYLSLALLAAPNGEMVNKTLLSCFAFVTVNLGVTATISKRWYEQKFGPESVKERWNMIPGLF

SEQ ID NO: 39665 - protein, 73 aa, A.fumigatus
GSARCVSVSLFFFFSGSDLMAVGGSLGWKVRGSLNADFEKAAYELEPSTTANPKYVEVKTGFGYHIIMVEGRK

SEQ ID NO: 39666 - protein, 212 aa, A.fumigatus
RWKVTTAPLPRWTQLSRRRLQTWPSALTTSNTLIASPLPSWLVSPIINPRLDSLDIFADAPHGAPNHVLVNEYCPGQGIMPHEDGAAYYPLVATVSLGAPIVLDLYPKPGSSNAGNSSGVGGARQPQYRILQERRSLLVTRRSIYTDFLHGIAETRKDDNLSAESICNWNLLREPDRYECGWYERETRISLTYRDVIKVSKLGNTMKFLGGR

SEQ ID NO: 39667 - protein, 492 aa, A.fumigatus
YFSPLSYQKVRHNSESAVFLLPFSYRVTSGATATLLPRIRTKSSLIRNFESSAVVERPREKLRKTGIFASLGVVEHQLPRATAGGFDYYEYSLSATASENDDRNTQQSITTAMSDVDAVSSLPAALRAGQNATAVTVNPRSASGSLSSKRVSPSPHRRGDNARVKEVDSASGEGDGPPSPKADSEAETIIQSGRESLSPEKRRKYIQHEPRRLDVQVDNSDTVGNSALPDDTHIRKRNRSIDESIAERDRGFSPELHSRTAISPSHVKIEKAEELQPALNDLHSALPSHSTEAVPGGQNVHSSRKRSHSDGVDSERDRTQLSRHTTASRDKERRDINGISLPPPESIDRSVSPIRSAHKRTASGPQLGGSDLQKKRKTTTPLITGFQRQSSEDRLSVSSSTSGSPLPSSQLRKLAGVDGASASPARPTGHKKQRDQNGRTRLARACAAHELEATMAKPAERPEDLNVGDNAGNTPLQIAALRRVCADCEISS

SEQ ID NO: 39668 - protein, 93 aa, A.fumigatus
TIPGSSKSTPQQRSCQKNNSQRIRAPISHHLQLHRAVRTPCPIPCNTRLGSDSAFSPTVYGYTVITMLTPLAATLTNPLTPDRTTFLTNKLYK

SEQ ID NO: 39669 - protein, 337 aa, A.fumigatus
DRSWLPSVCHGVCLAVAGVKMLSSRAHYMDIPDSGPGVEHHWGYYNRQLPCTTDKGKCDYLDTVYHSHDLSILYSAILWGVILGVLVLCALRRLIRVRRTSHPCPQDAETGKNPPQSFIYRCQQSLKSAYHRHLLRGWLPGIFGHTTGFNILVLLILIAYLTIFSFVGIVYKTWYSPVKGYPNLHQTRVGLGPWADRLGLLAYALTPLAVLLSTRESLLSLLTGIPHHHFLFLHRWLGYIIYIQAVLHTIGWTVIEGKLYQPQPSTWNEFIAQEYMIWGVVAMILLSFLVFCSPQWCVRLTGVRIPPPVALCSGHGLCSAPAGGHWGLLFCWYDRLR

SEQ ID NO: 39670 - protein, 162 aa, A.fumigatus
PCVTNSSHSQKRSAQNSRITHRNQRSAISSSRVLMALRCHASMSFLVFKITNASGYASTSSAAKNDAAVSTTASQCPSSASNSARDTRNSPSSFPFHFARASFAHPSMYPAFSSKEMSHPWYGVRPSCRSATARLSVADRGRPTQITCMGLVRVRAGGFGRL

SEQ ID NO: 39671 - protein, 83 aa, A.fumigatus
LSHMQDIQSPVPTPDKRPRRLVCIASPYSTSLIENQYFANSDNEQPVPYTLRRQAGEAIFDMILPKNRYDESDSEGPKAVELI

SEQ ID NO: 39672 - protein, 88 aa, A.fumigatus
LYNLPQLTIIFFNKSNNPLETTSSPMTNRPTLRRPLIVGRHGSQVWFTLEVHHTLFIYFSKTPRSSDRAAVVIHAFRSSDTTGQEIPR

SEQ ID NO: 39673 - protein, 199 aa, A.fumigatus
RPTLPVENGINRVMLRSTTRAGQVTLTATSDGLKPATISLNTKPFASKGGLSTVIPGSDLPFVLSRGPTPSSESYTISRKAVEGLNVTAGCDTENMINSYDDDEETEWSCDGDKSSTWIKYSWDSPVNVSQMVMKLHSFRTTKYPVQISVDDTVVYEGVTPTSLGYVTLDLNATVGQSVTVASEDSDLGIIEAEIYTPA

SEQ ID NO: 39674 - protein, 70 aa, A.fumigatus
GLCSPSKSSLVCVLVSGLLTTERLSRVLDILAALKFNQFTDLAVSLASISLVLGTKHAVLLQLSRLYLTS

SEQ ID NO: 39675 - protein, 69 aa, A.fumigatus
LYSVENVNDTEEINPDSLRAAASGAGSGNRSGKQFGAGQDTKVTASCNCSSPYFINFIDGLESLYSVQY

SEQ ID NO: 39676 - protein, 94 aa, A.fumigatus
GIELLKTQGLTPVTPEQGETVARRMNASYIECSSKEMRGVDEVFALAVDTVVSAEEQDWMGNSQSNGTSSKFGGGGSGLRSGSKKVKKRTCKIL

SEQ ID NO: 39677 - protein, 132 aa, A.fumigatus
FHKMKSLAGSFVGLLFLLSAPVTSVYAASEPTGKKDGLSPCVVRSPATGLYYDLNAISVPRPDPSDGKKSNKNAPRESWHAKGHDYHANFTLNICAPVVEDIKDVVGVERDRWKNVSAYYEKEGKIYSIGYV

SEQ ID NO: 39678 - protein, 136 aa, A.fumigatus
SATDGRMSAPTTRKKGRYTPLGTFDKRTVRYSMCRLIVLYREQAAQPLFRGRKLVLNYTNGSPCPGEQIGHSSRNKSTIMSFLCDRDALSHQAVASFVGTMDQCTYFFEVRSAAACGSIGHAHGDGLGPGGVFGVM

SEQ ID NO: 39679 - protein, 98 aa, A.fumigatus
VHLTFPLSDRILILSILSALIAVAAYLVGGCAYQRTVMHQRGWRQCPNYSLWAGIFDFVKVSALALIPFRSSRIRSGRGSLSPYKEFGSPRLPISRTD

SEQ ID NO: 39680 - protein, 494 aa, A.fumigatus
  UNSURE (14),(15): Identity of amino acid sequences at the above locations are unknown.
GGNTGKWFLPPGGXXLCNLAISRREGEYTLRKRKWDPHPLWSPESGYMKLKRQIEDFSATLPSHLAFTFENLQVHAADKIANQFLYLHIIIHQNMLFLNQFAIPLSPGGRPPKDMPKSFLSNAGRAAVEAAHHISVLIDRASAYPLTVPFAGYSAYSASTVHIWGIFSKNAQLEARSKENLRHTYRYLNKMKKYWGMFHYMVESAKDRYRQFADAAIKGTVVTQNGNHVTPMFQYGDWFDKYPHGVSRLHWEDPDARQKDHADDGVMGQKPELQSVEDFFASLSPSVPQHSTPRRPDPRRDSKSIAPPDQAIPPQSVVDVNMNNAPGMLGTSSTGFPHPTMYDQQGGTTSLGPAGFDFNIPQDQLPLLDRQFVYGSFAGIDPSPAAFAAVDTPGISTPGEAGPHTNQDTSAALFTGHMDPNAPSGTGEYYQPSAWFLPFNLDPVGAGVGLDPNPAASVPSSENATPDLSAFGGTGIPLGGYDLGMTGMNQRSHR

SEQ ID NO: 39681 - protein, 108 aa, A.fumigatus
VYFHSIGAFGIIFGLPCLLYAFTFFCNDISGCPAPSLLHPSTLSIDKLEQEVGWPEDGIKALYDTQVTMWVLSYYLLSLLMQVFLPGTEVEGTELACGGRLKYKFNGK

SEQ ID NO: 39682 - protein, 103 aa, A.fumigatus
QFAAFLSAVLILSGCAVGTYLYGTEFALWTFLWDNYVQVITANLIICTAIAIFVYLRSFSVPAPGQLNPELRQLAPGGHTGNVLYDFFDWLGSLTPGSVSPRG

SEQ ID NO: 39683 - protein, 229 aa, A.fumigatus
DDDIMRFFDGGQPVRNHHGRPALRRLLQRRLHQPLGFCVKSGSRLVQQQDFRVFDDGPGNRDALLLAPGERETPDVGFVAIRQGHDEVVRICHAGCILDPFLYLLRGFVFMLRADESDPDVLRDRGGEEPWFLRNKCHLLAQPAKIQLLDIMSVEQDIPRDRAVEAFEESDDGAFAGSRWSDKGCGFAGWDIDAQVVRDDDLGPRRVDVADILQNDVSTDMVQGDARVE

SEQ ID NO: 39684 - protein, 143 aa, A.fumigatus
RIRQLHAPHTRRDIMVEVMERSGGSELPEDEIAENFSAIMLAGFHTTQNALCAVIYLVLTHPEAHVKLVQELQTAFASADDISGDVAAQLPYLNAVITEALRLYPPVPLGGPRVSPGAYVDGVYIPAGVSTMLQFQTLVPLLT

SEQ ID NO: 39685 - protein, 69 aa, A.fumigatus
QTLVSSGNELRNGACKPITFIFARASTEPGLMVRNSPQALPITTELNVNRGYPPAPQSATASKPPNPAR

SEQ ID NO: 39686 - protein, 111 aa, A.fumigatus
RRVIRECILRLHEVIRDKLETHNTISLNELLYCHSVDTVSEVLLGKPLGCLKRGKPYFWTEQLPRIFYWATIRDQFEGSGIPTAIKWLLRRFLRKGIRLRAEQARMRLINE

SEQ ID NO: 39687 - protein, 546 aa, A.fumigatus
VLFGNLTSTFQDIVSGQIAYAHFHHELTKYVVYFVYLAIGEFATIYLATVGFIYTGDHIVQQIRVEYLRAILRQNIAFFDTLGAGEITTRITADTNLIQDGISEKVGLALTGLSTFVTAFIIAYIKSWKLALICSATLVALLLIMGGCSTAMLGFNKRGLACQGQGASLAEDILDSIRTVVAFDAQETLATKYEKHLKDAERPGMRAQMIFALMVGALLCVMYLNYGLGFWMGSRFLVDDGSHVKAGDVLTILMAIILGSYNLGNIAPNTQALSTAVAAATKLYSTIDRQSPLDASFDTGITLDHVRGNIVLQNIRHVYPSRPEVIVAHDLSVYIPAGKTTAFVGPSGSGKSTIIGLLERFYSPVAGNILLDGHDIQQLNLRWLRQQMALVSQEPRLFAATIAENIRVGLIGSKHEHEPPQQIQKRIEDAARMANAHDFIMALPDGYETNIGGFSLSGGQKQRIAIARAIVKDPKILLLDEATSALDTKSEGLVQSALEKASQGRTTVVIAHRLSTIKEAHDIVVLNNGCIVEQGSHDRLMDRRGV

SEQ ID NO: 39688 - protein, 431 aa, A.fumigatus
  UNSURE (225),(249),(253),(273): Identity of amino acid sequences at the above locations are unknown.
YGMVKAQQIKKRLTRMSQMARSPMRTFFFDLDYPTDDDVSEYDAQDDASDIGLKTGERLKQRMSRLSISALPVHLHKAKEMSHSLCTLFKFLASFNRPEWPLLALGLAASVLAGGIQPSQAVLFAKAVSTLSLPPWEYPKLRHDASFWSLMFLMLGLVTFLLYAFQGSLFAYCAEKMVYRARSQAFRVMLHQDISFFDEPENTTGGLTATLSAETKPTGRIQRRXRSATLLMVSVKPVGLAGYRNRHGXEARXGVHFRRACLPALRLYPRLDXGQVPAARQGSVPAVGQLRLRSGLGDSHGRFVDDGGGGFRVVSNAAAGPAQAGSPPHRQIVAPVCQLAGPAVLVHGSGILVRWDASRAWRVLPLPVLRLLQRGDLRRAGGGNRLLARTRFGKGEARRRGIQAALQRRDHAVEVQGCGTPQIPARDARAD

SEQ ID NO: 39689 - protein, 107 aa, A.fumigatus
TEICTSLFALHHNPEYFSSPYEFLPERWTEPGSTDRKEAVQPFLIGSRACIAKYFAKQMLQLTLAGFFLEFEAEHVGKVRDWQRQSRCYAFWDVPDLQVKLRKRLID

SEQ ID NO: 39690 - protein, 323 aa, A.fumigatus
  UNSURE (13),(18),(38): Identity of amino acid sequences at the above locations are unknown.
NLLASLGIAIVMXWKLAXVCISAVPVFLLCGFIRVWMXDKFQRRAKAAYQQSASSACEAASAIRTVASLTMEGEVLESYQTQLQDQLKRDLLPIVKSSLLYASSQALPFLCMALGFWYGGTLLGHGEYSLFQFYVCFSEVIFGAQAAGTVFSHAPDLGKAKHAAGEFKRLFSGETMQSKCRAAARHKSQPEMRGLIEFRDVSFRYPSRMDQPVLRRLNLTVKPGQFVALVGASGSGKSTIISLLERFYNPLTGGIYVDGSNIAAWDLTSYRSHLALVSQEPALFQGTIRENILLGSTRPYTSEDELIKACKDANIYDFIISLP

SEQ ID NO: 39691 - protein, 135 aa, A.fumigatus
ATLSPHKKSFCSSGSLMRNRQGFETIVGTKGGMLSGGQKQRIAIARALIRDPRILLLDEATSALDSKSEKVVQVALDAAAQGRTTIPVAHRLSPIQRADVIYVLDQGPVVESGTHEALLRKRGRYFELVNLQDLA

SEQ ID NO: 39692 - protein, 200 aa, A.fumigatus
LATLPRQTPQTNAQTKMNLRLLTLALAGLAAASPVAIEERQCTYIRSVSASWSWSWSCLTDFSVLRERTPQWSLQTHHLHLRARIHGARAHGKELPAGSPNNNRTKRQQGISTGPAVCNSLKAAKPGQVACQGVGPAYTADLASNALPENTSQAAINEAMELFKQAASKCPDTQIVAGGYSQGTAVMDGSIKRLPEDVKG

SEQ ID NO: 39693 - protein, 107 aa, A.fumigatus
LSLPMRFLKELALGMLQTFNKAIAAVVSSPFQSLGMLDLCSEHDRQLLQKYTESVSESYEVLLHALALQHAHLTPDAPAIHSWDDNLTYAQRDDATSRLGQSWPGWA

SEQ ID NO: 39694 - protein, 284 aa, A.fumigatus
AWAPLSSAVLRSLHGPLSPRLAIWRAGAAYISVDATDPPMYLENVIRRVNARIILTSEAYRSRYASFVPSVIAVTPDMVRALPVSTGIICPWVKPSDVCLVLFTSGSTGEPKGIIQEHRAYATAVRDYNKLLGLGRHSRVLQFDDYAFDISNNDYLTTVAAGGCCCVHTPTKSVPTLVENINTLQVDTTFLTPTIAAQISPQDVPTLELLCLGGEPVPNELLIRLVAACETGESVWDGGGGHLVRVQRPTPTGPECDRRTGWERSHLDHKSGIPRVPDAGRSCR

SEQ ID NO: 39695 - protein, 68 aa, A.fumigatus
ALADKCRGGGHLQHLWNQPNSVDDMEDARRKYLHNKIFKAIVPHFVDSKYDHGPFKLIATISGLEIYL

SEQ ID NO: 39696 - protein, 135 aa, A.fumigatus
SDWSPHVRLVNQYGMGEAATLCAYNDQLQPGQNAIVGRAGSGAIWITSPESPEFLMPVGAVGEILIEGPHLARGYLDSVCQKPGVGFLPNAPTWLKDLHPSRTGPSRFYQLRRPGEIHTCRDCGTSWAAKTPSSR

SEQ ID NO: 39697 - protein, 213 aa, A.fumigatus
ELIAMIDVCIPCFSPVYSYGLTPDLYVDRRSRQATEGINYRNLRFPFQNAGARAAGITHGAVHFAAAAESSGADQADFFIEHGGNWTADGQTLPGVLEMEGNLAGKLCHGMTPTEITDWMLDFSHRYKFRTGRTPILFLSAGWWAKCAGNNATFGAEHALWLANWAEEMGPLPVGWQAAKFWQYAGWSENGGEANVFLGSSKDLVKLAMGADE

SEQ ID NO: 39698 - protein, 61 aa, A.fumigatus
FPFWDLTAAVICFDSALNKSKMGATDVPQAQAVTVSLQELVNGELINCKNSCRFRAVESWS

SEQ ID NO: 39699 - protein, 311 aa, A.fumigatus
YAIESLTSPAAKYLVGWSCGKETLRSGHFDTLKGSYYVNCAFYQNPDLQGAPADNFHDLSEYTAPNIWPPADRLPTFRRSLEELCTLIIDTAALVARACDRYALANIDGYKEGYLEHVVKTSLTTKARLLHYFPTDPTAAANAEAEDDDDWCATHLDHGCLTGLTSAMFVDEAANPPSLTDASTPLAELPQSPDPKAGLYIQSRTGQVVKVNIPNDCLAFQTGEALQLITRGKFRAVPHFVKGARPSGRARIARNTLAVFTQPNLEEEVELGKTFCGVLPGRWSVGLISVYKFRFCRRLQVLTGGKGYIRE

SEQ ID NO: 39700 - protein, 593 aa, A.fumigatus
QCLLDGLPARGPGRPTGSLSTPGSARPSRPPGRPPGRPSGRPLGRLGRPPGRPPLNPIVDREGTPDVFKMAIVKLKDRGEIDEPISEPLSMDWKSERPGLGEYLQKLRMQPSYVPRAGEIVLWVPNFEGELAWNPEHARVEMYDPTVDRFIGVPEWRAGIVGQVPEEDTVLQDIVETANKEWEVNYSGFRVETFPDPNSADKSYSLQYKYVHLKCIKPFNGYELFLQNMPRDELHPSIEYAMTVMSSFSLLEKFHFRGRWPNASIYCMGIFIGAELLIVGDAVRLKPVGYSLSSGQKAVTDVMVIDEIRLDLIQCVDDIKSDQLAERYQVRLGGKVYTNNRQRAVIDNSMQPPKPLSPEEVLSVFQYIGMSGYGDWYSLNGGKTVDISQGMVIGRCYEPDAMRLLFGSLSLGRDLHGVLSGRQYSRQADERIPEGKDWFWGDFRTQTLAVETLNGEDVGHYSEIRDVKMWRANLKVIEGRATAADLREAKIPGELGRPSHKSRSAFAEVRKTSKLVSTGLGAVITDVSNNSSSADESNAQTRMNTEDEGEEESPEDEEDFTLRLEDLRGGTEETEGGDYVPGNDGHTAKRPKT

SEQ ID NO: 39701 - protein, 85 aa, A.fumigatus
IISLGLSIIPSAVMSVSQHSQTSEEDAETITIPIDRSFSDGDPSTWPTEPRFGMPDDTWYREKLAIMWLKETGAYEEGTLLTSNF

SEQ ID NO: 39702 - protein, 622 aa, A.fumigatus
QYEGKLCSDLLVRHERLVHPAEAAANREHRNHNNHEVSSTPSSMIQTTHHESRMLELADAIPVQPQPIPPPPPEVHVQPAPIIETTHFNPSWGYDLNLLSHAASHVALEGQQEALESMRKPSHTVGPPQPIPHVTDRPITENYGLEPSMLDLTDLGDPVQDFTVFLESVGLSSDWDSGVFSTVEEPMLPTTLSIDSKPPLRETSRLGTEIMNDPRSADDPPSFSNFGSRLPSLQPESHEVDDRLGFGDDGPRPAWDISNADRQVFVSKLEEFAYILPKGFVPPSRHALSRFFAGYINGLNEHLPFIHVPTLSVANAFPELTLALAAAGSHYRFENNRGIDLFHAAKTILLERLRRRDSKQVPCPTWNFYSPSSGFHNSRGSSAMSNHASSPFQQQQQSMPHPVDPSIYVSDDSDAHMEVIRTFLLLTVFASWERHPELLREILSLQSTLARLVREHGLSEPATSPDPNNWEEWIRREGNRRTKLIVYCFFNLHSIMYNIPPLILNAELKLNMPCSHDVWKASNATQWRRLSRTWPGVDVPFQEAFAKLFLKSSISNSSAPISPLGNYILIHAIIQQIFFARQLCLSAPTMQGTSLRPDDLTVLDNSLSAWKALWKRTPGIQH

SEQ ID NO: 39703 - protein, 166 aa, A.fumigatus
LLKTPVQIARALSESPPIARSPRLIMALLHSAHALSIPVRLGIDFVARTHSFFWSIQHSLCSLECAFLLSRWLLSIPATHSEQRLSDHERKLLLWIKSMMDETDMAVDPPGAPDMEFMANPYKAKQLSVAIVRVWARTFKGNTSWAIVDLVGSSLDAYADVLENQL

SEQ ID NO: 39704 - protein, 154 aa, A.fumigatus
PSTSIASSMPRPSLVGLTPGLVADRLGSLKTLIPMGLIAAILAYAWMGIKNIAGTIVFACLYGFASGAIVSLPPTVVARLSPNMSIVGTRMGMCFTFAGLGLLIGNPIAGALLDLERGVFWKAELFSAVMVTAGAVSFIWLRLLKWRDGEKGKY

SEQ ID NO: 39705 - protein, 433 aa, A.fumigatus
  UNSURE (48): Identity of amino acid sequences at the above locations are unknown.
AGYSRLATVDYSKIFYEVLIPYASTMMALGGIVRQTAYKWRPYTTLDXCKHHQRLPFSQPINLSQSSLIYFHYIMAESLIFAYGSTEPVKDIRLHSTPAPADCGPHEVVVDFLAAPINPLDFLVLHGKYPVKPQNHITVADGEHRPIPGSDGAARIVRTGSAVTQFHVGNSVILRTHCRGSWRTHAVLAENDVLRVPSELDPRLACILRMGVAPAYFLLRDYSTLEPGDWIIQNAATGTVSHFVTQLARLQGVNVISVIRDRGTDDELERTKRSLRSHGAAIVLTVDELKTVGAEVLQGKRVNLAIDFVSDDALARLMASFLVPGATLVTAGFLGIAPSSPEANLRQFLWQRNITLKAFRLSDCLGRRSAFHQTALLEWFARLFLEGTLKTPALEYVRWKRGDPGLEGKLQEVLERHERGEVGERKKILVFEH

SEQ ID NO: 39706 - protein, 133 aa, A.fumigatus
PISRGVVNTFGVYQTYYETDLLHGHSPSSISWIGTVQGFLLFLVGVIAGPVFDKGYLKTMIAAGSFLVVFGLMMTSLSDQYYQVFLAHGVVVGIGCAFLFLPSIAIVATYFTTRRAVATGITASGGSIGMSRR

SEQ ID NO: 39707 - protein, 274 aa, A.fumigatus
VTKSTASILTRPGSVIYPIIFRKLIDSVGFGWTTRIIGFIALGGLCVSLAVMRMRLPPPKQARSLLDLSAFKEASFLIFSFGLFCAFVGLYFPFFYLPTYKSNIVHSTDDLAFYINRILNATSVFGRINPRPGGRPAGLPQNPHPHGPDRGDPRVRLDGDQEHCGDDRVCVSVWICLWRNRLVAANGRGPVESEYEYCGHADGYVLYVCRVGAVDWQSDCWGAVGSGEGGVLEGRAVQCGYGYRRSCVVYLVEAVEVEGWREGEVLICSAWSSE

SEQ ID NO: 39708 - protein, 394 aa, A.fumigatus
KTRPRVCTSIGRIYIILISLSVGRVTLRTLLDDGLILERVSCPIGVLLIIFEARPEVIANIAALSIKSGNAAILKGTFCMIDSEIHTTDMSEGGKESTESFIAISKVISEAISGTRVPVASVQLVKTRDVVSSLLAQDSLIDLVIPRGSNDLVRFVKENTKIPVLGHADGLCSAYLHADADPAIAVKVIVDAKTDYPAACNSLESLLVHEDALGTIFPAVAEALLAKGVRLRCDIQSKSALLKNISSPPADLLEDAVDSDFDTEFLDLVLAVKTIPSTSSPISAVEDAISHINSHSSKHTDLIVTESKEIAEYFMRGVDSAGVFWNASTRFADGMRFGFGTEVGISTNKIHTRGPVGLDGLTIYKYLLRGQGHRAGDYFEGEGGKKWKHEHLVI

SEQ ID NO: 39709 - protein, 89 aa, A.fumigatus
SPVLQGLTRSQFDGKEVISFIQETNKYRDNSPKSSKEDLIPCDAVDIMASFIHPRGYTLRQTLGFSGQSWTSFRYSSVPINACSEHYLS

SEQ ID NO: 39710 - protein, 64 aa, A.fumigatus
IHPIACRFMSSCVKNKATCVYINWPNIHHTNQSISGESDPKDATGRWSHPGESELSYWCLADYI

SEQ ID NO: 39711 - protein, 72 aa, A.fumigatus
RRTRLSIQSASFAALGHGGTAKKLPGMFTTMVLIYKNEGGFVALYRGIVPTVAGVAPYVSEIRMMINRCLRV

SEQ ID NO: 39712 - protein, 78 aa, A.fumigatus
YRHSDVLRRRFQINTMSGMGYQYKSIWDAVRVIIAEEGLRGFFRGIVPNLLKVAPSMASSWLSFELTRDFLVGFSDEK

SEQ ID NO: 39713 - protein, 139 aa, A.fumigatus
FEFSVLLGRTESNFNKVVLRRLFMSRINRPPVSLSRLVSNVTDAPKGKTIVVIGTITDDNRLLTVPKLSVAALRFTATARARIEKAGGETLTLDQLALRAPTGANTLLLRGPKNAREAVKHFGFGPHSHKVRQYLTILC

SEQ ID NO: 39714 - protein, 198 aa, A.fumigatus
SVLASTMTLTAIAGSASAWRYAEQRPSAWPRTGILVFSLTNRTRSLEPRGMTRSIKESCARSDETTSRVLTSWTDATGTRVPEIASDITFDMAMKDSVDSFPPSLMSVVWISLSIMQKVPFRMAAFPDFMDSAAILAITSGRASNIISKTPIGQLTLSRMRPSSSSVLRVTLPTDRLISMMYIRPIDVHTRGLVFHTT

SEQ ID NO: 39715 - protein, 226 aa, A.fumigatus
HCTFPKTQPATPLFYSLPLMVQPYTYGYLNDEVILLLHTLGVSAEVFLRKQKEHFQRLQESVTEPTVAFTFLCSLNRFDLAEKLVLHGIERVSGALRSLVADEHKKMLNKREDQKCRILVPESRLVFGVCDPRGVLQEGECFLRVTDDMNGGRPRTIVGCEVVVTRNPCLHPGDLRKLKAVDRPELSHLRDCIVFAVKGERPAADQMSGGDLDGDTCKSPPTPCQR

SEQ ID NO: 39716 - protein, 82 aa, A.fumigatus
NRAAPSSPAVKTVIMSSISRTANLLLRSSKASLLRPRALNPVQHVFGNNKLAARGLATTFERTKPHVNIGKYHFHLQTGLFH

SEQ ID NO: 39717 - protein, 88 aa, A.fumigatus
TTLTAAITKHQSEKGLANFLEYGAIDKAPEERKRGITISTAHIEFSTDSRHYAHVDCPGHADYIKNMITGAANMDGAIVVVAASDGQM

SEQ ID NO: 39718 - protein, 162 aa, A.fumigatus
QSASHSPNISKYLSLENVTHAGFNYHLISVFGSQSTGKSTLLNHLFGTHFSVMSDSERRQTTKGIWMSKNKREGEATVDPTLRMADNILVMDVEGTDGRERGEDQDFERKSALFALATSEVLIVNIWEHQVGLYQGANMGLLKTVFEVNLQLFLKDKKYVFY

SEQ ID NO: 39719 - protein, 104 aa, A.fumigatus
QVDKSLVLRNPAYFFLLFICAVGAYVTYQLNLWGPIIKMTEAASSQALVEGKKRLREFLESSDTGRQAIAMSAGSGRSGEQYELSDLSKKGKARTSADEDMDDL

SEQ ID NO: 39720 - protein, 319 aa, A.fumigatus
KHVAYVFANRPQTREHLLLARQVGVQKIVVFVNKIDAIDDPEMLELVELEMRELLNSYGFEGEETPIIFGSALCALEGRRDDIGKDRIEQLMNAVDTWIPTPQRDLDKPFLMSVEEVFSIAGRGTVASGRVERGILKKDSEVEIVGGSFEPKKTKVTDIETFKKSCDESRAGDNSGLLLRGIRREDVKRGMVIAVPGSTKAHDKFLVSMYVLTEAEGGRRTGFGANYRPQVFIRTAGKFPHTVSRSSERLAIYANDSSDEAADLSFPDGDQSRRVMPGDNVEMILKTHHPVAAEAGQRFNIREGGRTVATGLITRVMTE

SEQ ID NO: 39721 - protein, 605 aa, A.fumigatus
CSTTHRSLLFFVIRDFVGTTPLKNLQKTLMEDMARLWESISKPPGLESSSVHDYFDFQFYGLPHKSYQPEQFVAETKKLSLRFREGQRDPSMDARRGEFSEGGVFLPEYHRRIPADGFSRYAEGIWDQIVNNKDLDLPTQQELLAQFRCDEILREVMIAFDEAIVPFEEKQSQSARLGEPEVLGGLGAAMRSSRAKAVKNFETEASRYHKGVYQRKRAELESKVDTRLKALLQGQLNAAHKSGINEFSEAVSSSVKSGQKQGAGYDFAEIVNEEVKKAIAKFEDVARSTVVEGTTWSDYKQELALYEKELADVSGRLRREEMRRLANRVERWVQSRLGESVGLEFNALGSGRAGGGAPETGEKPLEKAFWDRVWNVFVETVLDAERRFTDRASSFDASLEEVDVGLWRLRRKSWGVLRAKIDEEMTEGNLLLKLRENFEDKFRYDDAGVPRIWRPTDDIEGIYTRARESTLTLIPLLSRFRLAETSAPPPLDRWIGHTPSSATPADEEDLPPIGGVDEEEGKSLDEEMMINHARLSVKKLTVRFKKAADGVYVEAKRSAIGGMTQVPLYFYGLLLALGWNEIIAGKYSMMKFSNEISWADRLTNL

SEQ ID NO: 39722 - protein, 270 aa, A.fumigatus
SLGRSGHGVRELTCSTDEDLGTVVGTEASTTTTLRLGQDVHGDEELVVSLGAAGNSNDHTTLDVFTSDTTQEETRVVTSTRFITALLEGFNVGDFGLLGFEGASNNLNLRVLLQDTTLDTTRSHGTTAGDREHFLDRHQERFVEVTLRSGDPGVDSVHKLLNSVFTDVVTASFESTESGTENDRSLFTLETVAVQQLTHLEFDQFQHLRIINSIDFVDEDNDLLDTNLAGEQQMLTSLGPIRENVSDVFLRRISQDVPPTSDRRRQQQRQ

SEQ ID NO: 39723 - protein, 193 aa, A.fumigatus
PYHRCNASSDQQLERMNVYFNDVGNSKYVPRAVLVDLEPGTMDAIRSGPHGALFRPDNFVFGQSSAGNNWAKGHYTEGAELVDQVIDVVRREAESCDYLQGFQITHSLGGGTGAGMGTLLISKIREEFPDRMMATFSVLPSPKVSDTVVEPYNATLSVHQLVEHADETFCIDNEVSVLILPSRNDKLTSPGAL

SEQ ID NO: 39724 - protein, 115 aa, A.fumigatus
PAQALYDICTRTLKLSSPSYGDLNHLVSTVMFGITASFRFPGQLNSDLRKLAVNMVPFRRLHFFMVGFAPLTSRGAQSFRAMSVPELTQQMFDSRNMMTACNFQNGRFLTCSALL

SEQ ID NO: 39725 - protein, 162 aa, A.fumigatus
PARLFCKFFFFFFFFLVPFLRGVPEKLISFSRGKISMKEVDDQMLSIHTKNSGYFVEWIPNNVQTALCSVPPKGLKMSATFVGNSTSVQELFQRVATQFTAMFRRKAFLHWYTGEGMDEMEFTEAESNMNDLMSEYQQYQEASISDGEEQPYAEEAAYEAEE

SEQ ID NO: 39726 - protein, 637 aa, A.fumigatus
  UNSURE (388): Identity of amino acid sequences at the above locations are unknown.
KPNARPGAEHVFFGRAVGINLDADREAIISCFRCTQGADGGWSTAPDQAGDISVTVEAYLALKILGLSEDDAAMRRARDFAIAAGGVAKVRIFTRIYLALFGLFPWAAVPELPPELILLPSRVPVSIYHWSAWARATVVPLLIISHHRPIYALPGGGKRTSSDYLDELWCDPQNKMIPYNHDEPTAWRSDPFASIFTLADSILHRLDGLRSFNPFRRFALQKCVDWILEHQEDMGDIGDIMPPLHGAMLALRLEGYPLHSGPIHRGLEAIERFAYRDKQGKRIQTTVSAFWDTSLMLIALGDAGMASKPWLTRSLGWLQQHQRLGNYGDWKVNNHGLKAGGFSFGYFNTWYPDVDDTASAVLAMIRQDERLVHSASVLDALNWLLGMXNTDGGWGAFDRDNDKHFLNKIPFSDMDALCDPSTPDVTGHVLEAFGLFLALSKADALADRVVSASRRAIRYLSDTHVLSRGWYWRWGCNYIYGTSAVLCALAYFGSENDALSGVRVMKDAINQAIRWLETVQNPDGGWGETVDSYKDPSRAGSGPSTASQTAWAIMALLPYLPPSTEVIQRGMEYLLRTQTKTASQGATWHEKAYTATGFPKYFYMGYSLYAHYFPMMALGRYAYPCPAWHENWRLKRD

SEQ ID NO: 39727 - protein, 218 aa, A.fumigatus
SSTSFMEILPRLKLISFSGTPRRKGTKKKKKKKKNLQKSRAGQKAAVLKVARRHHIPGIKHLLREFRDTHCAEGLGSSTGQWREAHHEEMQPAKGNHINRQLPQVGIQLSGEPKAGCDAEHDRRNEMVEIAVRRGRQLQRPRTDIIERLGWLACHFDLEGSGRIPRCRCKRSHLRARPTGGPTASHCTAPPRYPRPWGMAGPRMWPSSDRGTPPGSWR

SEQ ID NO: 39728 - protein, 299 aa, A.fumigatus
RPFRTPETKTPTAASLRTVPAVQQTPRPATPVSTAPFRDHPRFKVFQPALSSQSQFTPRPTAGSASQLPTPGPQRQKPVFVLPRSPSPSRMDDESMIPTPFSPSSHALRRRGRPRSSTADYLPGGMASDVRSWILEMGTKSEQMQKSLDAHSSTHHAQGPPDLSQYYLVLRILDVRQSALGSSGPVAYIHGVEVTLPDESESATSQSRRVLLLGPPRPASLQSSRARAQVPELRTGHLVGVFRNLVWEVGLDQTHLDGNVPSEDTQKKEEPASSLGRNTSTEHLEKWLVGVEWELIDQG

SEQ ID NO: 39729 - protein, 137 aa, A.fumigatus
TAADPFQFFSSLSDLLSKTSQKARGSVFLTQKPLLPNNANTSTSENASSSSSIPPILIRATDGNTNAPNPKTAKDQSQKAARTSKVKLSTVVAQEDLETFFARYAEVCKASMTGLKKRDRKKGKAKAKGGASKVTKA

SEQ ID NO: 39730 - protein, 161 aa, A.fumigatus
RLSLVSDSDSDEEVARSDGGIYLPGLFSEDGATGATYGFSLFFGAGFSSSSSSSSSSSISSKPSPSKSPSSSSLARSLSSSSETASGARPCAFLLLFFSHSSASRLRFRISSSDPSPKSPSKSSSPSSSNDFGSFFPFFNPSFFSNAAISAASSSSLSFTG

SEQ ID NO: 39731 - protein, 151 aa, A.fumigatus
VPPPLRNFFFRRHKNYQRTYVLRSLTIIINIFVAEMRRPRPKHNTTSLPRALRAELGIKDHYGEKKHKRNGPGSRKDRRQAERTEKKRGPPPRSKARQYDGEDDDDDDLAEFGNESDFDSDSDEDVPASKSKSAKSEPEAPFDTQEESEGS

SEQ ID NO: 39732 - protein, 465 aa, A.fumigatus
SLYSRNFITFTSSEAPWCSTTSGCSCKRSTRRAQNYCSKSSEVRCQPSFLPKSALLTELDSGPQLRQDDPSSLKDIVLLIQPAVAKVGEESLSVRTKFMIDTITDLKNNRLKAAPGSSVTSEHITKMRKILGSLNNSRVLRASEPISISREDIHNASQKGKWWLVGASWKEDPLVSARQELASLPQDNKAAAQEEDSEVEPDLASIAKAHRMNTDIRRSIFVAIMSATDYQDAHVRLMKLRLKRAQEFEIPRVLTHCAMEEEAYNPYYTLIARRLCGEMGRRMKVSFMYTLWNNFKRMGESDDMDDDEEEDAGFRDDNDERNQLSMKSAVNLAKMYASLIADGALTLSVLKTLNFAYLQPKTKAFLEILIITIIQQSQKSKKGKKNGKKAGQEEEAERNEKPLMEIFLRARDTPQIVKGLIYFIRKVVAKTDIVESEREQKLVRWGCRVAVDALKVVANEDVSLG

SEQ ID NO: 39733 - protein, 62 aa, A.fumigatus
FFLAVSCLFPGDCRTLGWIKSRIGYVLPNEACTFSVYHHLSIYPFQLNCADEALILDKADCV

SEQ ID NO: 39734 - protein, 323 aa, A.fumigatus
SPARILQPVKDKLDEDAAEIAALEKKLGLKKGKKLPKSFEEDGLLDLLGDLGDGSEDEIRKRKREADEWLKNKRRKAQGLAPEAVSEEDDSDLASDEELGDFDGDGFDDMDEDEDEDEEEEKPAPKKRENPYVAPVAPSSENKPGKYIPPSLRATSSSESESLTRLRRQAQGHLNKLSEANLISILGEFEKLYREYPRQNVTSTLLTLLFGLVCEGSALQDTFIILHAGFIAALYKVIGPDFGAELVQKLVETFDAAGDERGKFQGKEMINLISLLSQLYNFHVVGSTLVFDYIRLFLQEINEESTELLLKIIRSTLSTLFFA

SEQ ID NO: 39735 - protein, 127 aa, A.fumigatus
TIQLVSHLRPSAIMASNQPSKRKSAFPGPQPGAAASRKRAKTFDARSLAVQSADAALSASGELNVAAYVEAREFEIRALESGMQRSKSALTSRAFQKVPRALRRRTASHNVKRVPRRLRARAKREVC

SEQ ID NO: 39736 - protein, 768 aa, A.fumigatus
  UNSURE (159): Identity of amino acid sequences at the above locations are unknown.
PLDDDDRQKSCAFALKRLDGFEISIPRQKPSVRQRKQSGTKRPKRLWKRQVATPITSPRECRRSRKTSSHCPRRPNQSTRNGSGARHGFRRICSMRSAPTWPLRRTRCGGSRYPCRRREKSYRPSHRAKGARGAVAWDMSYMSTIQLEGTEEAMEAVLXGIGINGQDAWGPKGRKWRAGTRSLHAWAFERDGTQRPIAPITLIRCADGKAEDVEMVDADGPKKKSQKDRKKLFIRVHPSAFLQLWNELLGISKRQNPPVMVEDLRFEIGSIEITGPGSTEALLSALKPLVPDGAEPPAGSPEATWTSLLGVSNPSSLPQNAFLGFSVSDPRLHFPPRTLKPPASDQEMQNLAILLSTWSPDTTQTSPALFDRRARLTATRQLPRQKAINRRRTLAGPGVYPPAEASDPKIPVMILASRSTSQSKNTNAPGTWTVLLPWKCVLPLWYSLMYYPLSSGGTVRFGGLKEQRQLAFEAGEPWFPGDFPGTRAGWEWNIREREKAKQEWERRPKGRRTEFDSLDLGNGQKGEIGHGWACDWERLVQGPPKISTPEPNEAKEIEQSQDAEQQDTQMSDAEQQAVGGHAPPFDIHHLPIAKAEAAINNRSEPTEQAAIATVKISLLHRGSPNPAARIYRLPTTNPDLRQEWLRLASDERKSKSRKAPHLQGHLQQSAQPSAAQGDARQKLAASLITPAADTESRKEHLPIPTEEDLIGFVTTGNYNLSEGKGTGIGSILVSKVAASGKGQARERRMCIVRNAGERVGRLGFWELI

SEQ ID NO: 39737 - protein, 76 aa, A.fumigatus
NPDRLSHWFIYKAYVPPFRASYFDVIQTCTQDYAAPMSWISVRDMAFNLLFMLSIIGTVTVNYFESHYLLMLPFKS

SEQ ID NO: 39738 - protein, 112 aa, A.fumigatus
PQILALVDLIVPGITTTLSLSQYSKGPLPSGQSPRNKSKLQQKALRPNQPSKYKSNPLTSQSNSNAPIQFSSNLVDALQTNTEVRLRAQLTHPNTLATQTPIALRTRPQLLI

SEQ ID NO: 39739 - protein, 213 aa, A.fumigatus
PRRCPPDEHRGTSPSPANTPQHPCNPDSNCTPNQTTTINLTKNQTDSSRAKSLELQIQARVAQELERLREREQQTLAEIEKRLAEAKDSAPAAPSSTPNITYPAGSLNLDAPRIPFAGREYESTPAPTVAADQPINRDLSRESVNAEIEQLRAKLEGRRKLVEVDENVERARNEVVTCLRLHDRRPLDCWKEVEGFKREVARLEEAFVDRVVG

SEQ ID NO: 39740 - protein, 85 aa, A.fumigatus
SSLRKHSRHTMLIVSLEYFCPIKTDMIHYIDPIYNKDCTTLTNKIQPSNHHHAIITKRPNFYTSSTFLSIPDRKNQVHLALLFSI

SEQ ID NO: 39741 - protein, 128 aa, A.fumigatus
DLSPFPWAETIPHPSTGSPHINPQDFSAPSSKPASTFATDPKADTVKRQRDLQKNRVAATKCRSKKKLYIQQLQSRFEDLSLAKRELQCQVQMLRNGLISLKEELVRHARCGDEPITSYIEKRRARCT

SEQ ID NO: 39742 - protein, 66 aa, A.fumigatus
HIARVTDPILRRMQDLEQRLKEFYRLLRRIEPRADAKDQPLIAKALEKASPVEVLETPYLFGLTIP

SEQ ID NO: 39743 - protein, 226 aa, A.fumigatus
ETPPASLSPSSDLSVDAITRLVTPTTDPIEEDFNKNKISQATGFIGAHSGRSWLHQLKRKGLQLDASWLGPETQDDFFPDSISSVNYFLDGEELSVDPSVQPFTIPPQDVADELLDTYFNMVHPGFPVVGKTVFLHQYRRLYSEPQSKPPKKWLAIFNLILAIAAHQLSLTCSGEADEWHDTLIYFSRGSKLGLAEIPLIPHPDIQQAQIEGLAAFYLLIIGQVNR

SEQ ID NO: 39744 - protein, 68 aa, A.fumigatus
RWKFSRNLLPLLDLHPTPGVSHSSSILHQKITMGVTKELKSPGNGVDFPKKGDFVTIHYTGRLTDGSK

SEQ ID NO: 39745 - protein, 101 aa, A.fumigatus
IALSNNLSYFLSSFFNIPRYEQPVIMSGLMHKVKDAVTGHHHDSTHTSNTTGTHHGTHQTTADTTTTNHGPHHSKLANKLDPRVDSDGGMLYLHLNLFCKC

SEQ ID NO: 39746 - protein, 132 aa, A.fumigatus
SDTVVDRAWRMSGTATRSAIAMGLHLRSVSKEYLDISKETRCRVWWSILVLETTLSVMTGRPYSVANQFCTAPLPLPFDEDQFGDAFVARLLADANARRALFQVPAVVIGSGCRNLSSRRQAVCVALLSVHR

SEQ ID NO: 39747 - protein, 72 aa, A.fumigatus
  UNSURE (45),(47): Identity of amino acid sequences at the above locations are unknown.
IFPNFPPIQHIFPPEVSKNLTGHKHLTAVPTEVYTKREHPLSTLXLXLKPFPLGRDNSAPQHRLSAYKPPRF

SEQ ID NO: 39748 - protein, 106 aa, A.fumigatus
LLFAVYLFPMDPRSQASQIRKRQREGSPGGIQKNNSPLQSSSTQSLPKVSLPRITTAKPRTRRASRACISCREQKAKCTGGSPCERCRELKIECVFVANKNEKIAR

SEQ ID NO: 39749 - protein, 289 aa, A.fumigatus
  UNSURE (256): Identity of amino acid sequences at the above locations are unknown.
EELTGIIPMTLLTLSSDNRAHTGAGATTTGAYASGAHNTYGTTFTNAGPHNSNMLNKVDPRIDSDMDNRARHETMGGAHGPHGSSIANKMDPRVDSDMDNRGAYGTTTTHGTGAGNTFGTHTSSNAGPHNSSMMNKVDPRVDSDMDNRARHQALGGAQGPHSSNLANKIDPRVDSDMDNRGTTHGTTGHAYGSGAGMNTSMGTGMGTHTSTNAGPHNSNLMNKVDPRVDSNRDNRARHETLASNSYNTPGATTHTXGPHNSNLMNKIDPPVDSDLDNRGTHTLGTQRGI

SEQ ID NO: 39750 - protein, 192 aa, A.fumigatus
PESRILAGISSETSALYLASKSNYQHILDGTLLPGVSYPETLAENLSSKRTNHKLAEQGRRNRINNALKEIESLIPSAFIQMKQTKENVASHVKGDKEKEKEKAGAPTISKASTVELAIDYIKALKQELEETKGKLAAAEARIGENGAAKDEDCKAATVSSPGDEKSKSSNGTQDSSTAEGAVSSTEATGSS

SEQ ID NO: 39751 - protein, 321 aa, A.fumigatus
PHRPYSAVSNIEEKEVELLKRLESEGNRIRSRSILLRPPARTKVIMDQDNSMAWPGSLQEQSLMAASGEDEFTNFLEFGMHFPDLEGHGPGERQLQPPRSLPASASMMPTTTAEQEQLIRMDTDSLPNAHSSSSYSNRIMGDFPFDLSNHNQQSQPQGQIPSSYTSAPVTPAFYNQKLAQPQIYHHPQQPPQKQQQQQQSHHGLPTTSQPYIPHGQAIIPPTPNSIELQGNAARYPAQVDENHELYDRYPHMNEEQVRLNPPGASFAHCDGSAQANACARIDTGTLHTSRLSRHDTVRNSISTARVHNSRGVFYPPHISSS

SEQ ID NO: 39752 - protein, 382 aa, A.fumigatus
ILPGRPSLIATEAHRLMHAPALTQALYTPLVSPAMTPLETQFRLPEYTIPGEYFTPLTSPALEAQNSNGNGYPFQSVSEVGFLHSPADAIPASSAPSSPGLMRKHRRRPSATKSFSSRAKKQQSPSVRPQTRKKSMLNLNSDEVLNGLSQDQGVSKILPHGVSGLRQSSNESSDQDSVSPEPLSEPLMPPPALPPARKSPTIVPQANQSQTSTPATPAMLMRLQRPQPAENPTGQFNGQARLVSTESYDDVMEDVMLPEAANPSSELSRPQVGRIDTAMKSGSATPVTSASITPSLEPKSAPVMDRNLTSIAPSPRTMAMPSPSGPIAKKSDTPKLGPMGRKRQSLSSTHASPNLRPKISPSIQPLVRGEGKQCHLSCYCSR

SEQ ID NO: 39753 - protein, 341 aa, A.fumigatus
SCDTQSGLVVRVNYNKLDVALRNRRFVELAEQGVSPATAKVYECLLRRIEYQTHQCRDTAEIPREGEEGEQYSVPIALSALAEDVNPQLDLSSSTGPMDSSQPDGRRGKRPWDGDVEGTNHEEANGLSSGGNRTFEIDQHLSLLAQPPHNLTSKRMVSGLITWTVEFRHLARKLRHLELERMIEARYGDVALRVVRVLHAKGKLDEKRLQEISLLPFKDLRQVLASMQAGGFVDLQEVPRDAQRQPSRTIYLWYYDPDRICNSVLQDTYKAMSRCLQRLRFERSRIKDFLEKTERSDVKGNEQRFLSEPELVLLEQWRAKEALLLGEVARLDEMVAVMRDY

SEQ ID NO: 39754 - protein, 64 aa, A.fumigatus
GRLSASHFTTLEYVPSFAILELKPNNYSQSNMNIADLKKQKWLLPRGQELSGESRIRIRMGYHN

SEQ ID NO: 39755 - protein, 86 aa, A.fumigatus
NGLSKDLYANIALFQHHLDSCDKEFQALGFFQATPIESLPTLHAVFLAVHYTTAKCWMDCGLKVDAVIGHKAEQLTALCISGYLPL

SEQ ID NO: 39756 - protein, 552 aa, A.fumigatus
  UNSURE (50),(59): Identity of amino acid sequences at the above locations are unknown.
AMEDQGHPPSEPRALFDRRDDTDSTNNAFDETDLSRTLFQDTSHTPKAEXWSLMPDFKXQHDRNVASGFRRRELGVTWKNLSVDVVSADAAINENVLSQFNIPQHIRESRNKAPLRTILHESHGCVKPGEMLLVFGRPGSGCTTLLRMLSNHRLGYKAIRGDVRFGSLTPEEASKYRGQIVMNTEEELFFPTLTVAQTLDFATRLKVPFNLPDGVTSPEAFRQETREFLLKSMGISHTSDTKVGNEYVRGVSGGERKRVSIIECLATRGSVFCWDNSTRGLDASTALEWAKAVRAMTDVFGLSSIVTLYQAGNGIYDLFDKVLVLDEGKQIYYGPMSQARPFMEEQGFVCREGSNVADFLTGVTVPTERKIRPGYENRFPRNADELLAAYEKSPIRAQMAIEYDYPDTESTRERTEEFKLGVLDEKAKRLSKNSPFTVDFLQQVKACIIRQYQIIWTDKATFAIKQISTVIQALVAGSLFYNAPDNSGGLFIKSGALFFSLLYNSLLAMSEVTDSFSGRPVLIKHKYFAFFHPAAFCIAQIAADIFTAGLEG

SEQ ID NO: 39757 - protein, 706 aa, A.fumigatus
VPELWNESGDTYVYLFPQNTGRSPSFKVHSTIFAESPSLTFLARGTDPSRVNALEQQARSMSLNSPMTSPASPPLTPQDGYPDNDNDSTNSRRMAFVDDEGLDDFQELHLYLPIPLNSDVSSPDSRISPEDTETLILFRNLFAFLLGQSLIATPRSPTLFSIFMDVASLLSRFEFSNFDGTNFGETATSSFSNYCDELQLDDVRKSREKTIEAIVLGERLRFFPLYLEGFVHGVGKLDELKQLRSPKFSLISPVTQKRMERGFIDLDTRLRVLHSKLNEFDFPSVFSGVANSTTSAESKIVRFKLWKAAFMEFRRFTVHYYRQKYGSWPPKARSKKNQFEESGLNRQVLKDLYDDFANLYDMLVDRTALTTRTVDMAALETVESEDTQEVMIRALRQVLSEYDRATPPVQPPIPFDVPQFPSLDSLQLKAVDPKKEAKRRAKKLKDSDINAVLMGSYTRESMRPTPFIEAFMQFERRCAHGKNVEDLIDLRCGQWIFLYCVIQALPLLVVDVQDVKYTDGVEYLLCIAPRGGAPWIHNDGKTARSWFGVAGGAGVVSLPSDVVINGVEGIYRRSHCWQVAEQWAEKDAILGPPTIDDPYDNESSLSSPYPGQPSSGGSSTEQPQQSAQLLSPNGLTPPPPVIPRTSSPAARARPEHRHSIYPGLEALPLPAGVAPVDPPARPVSRLNPNMSFDDILKQVPNQRAKK

SEQ ID NO: 39758 - protein, 76 aa, A.fumigatus
ICITTCLIPISPCPVRIPPSFTAFVHFWLSLYYGSLIIRGVHTLYKDQKNGSAQYKTGNPTNVEANFAQEEESLIS

SEQ ID NO: 39759 - protein, 164 aa, A.fumigatus
YLRGKECSQDVANESPNAVDGKDIQGVINLEPILEFGGIVASDSADNTEDESGPWGHEARSRSNSDQASDDSRAETHSRPLPLESVIQKTPSDTTNRSGEVSHKCCHNSSHVGGKGRASVESEPSNPEKHSANDNVGDVVRAVVELMGAVTTAFPEHQRVRQCC

SEQ ID NO: 39760 - protein, 78 aa, A.fumigatus
SQGAMQRISPWLISFRFTMNNQYDKDDVQGNRSLPKFVYQGNSNSAYLSGSSSMTLHVLEGWDPAGESRARMMSRGVR

SEQ ID NO: 39761 - protein, 1042 aa, A.fumigatus
LLVASMDPGMHRHTLSSLGLGAPASPHSPSNWTKTPKKPCKMESPQDRKFRVLENPDIPNHDSDSSGSSDELLQQPYAMRANSTFPEIFEQAPPATTIASSPPPSHATGLPAWASTSGLRPRGSSVGAGAALDKVSPVDGLPLTDRDLRPQRPSGPARTPSNTYAPQRRPPQYISLQSDRQRSSSARRSSRRDPNAQYRAQEKAYVQRIRANPQAWYNHFDDAQNMGLTPGDSDLEEPSPSSEAPFEDDAYDPDIQLFLPDDNQPTLEELKNPKNQERLEWHSMLASVLRGDVVKQEKQRLLGSAETKRSAAQNNAIWLGVRAKTCGRSVALQRKLIEEARAGLGPLIEDIINFKIKGETEIGKSPIKQVEDIVQKIEECEMLYSTLKEFEAANPRVASEEYCSSREAVFAWHNTIALINTELAILQKWVGNDELDFSKPKVKSANSDLSDGSSFLDRIMKEDGLKTLQGEHNMLNGIGEVIKKAKTTLIENADSFAQRHLPPYIEELLTLINFPSRLIQEIIRVRLSYAKNMKDPAQQSPILIDQMIPQFQILMKVAVDIKQRYVDISRPEPGWDLPPCIDENFDSVVLDALKYYFRLLNWKLNVNKNTFEEAEILEQDWEFSNDIGRQLEGGDIEVAEQFRYEFSFYPQVYAIANKHSSALTAKSLQRLMIHFERELTARPNEDPIDMDRDSKSVLESTRIRQREAISISPAFLRQLFETLTEYNISADIAYDFFEALLISDHFLVKSNASIGQKGVYLFAHRELWNRPTDIQAILATSFREEDVPKDSAHAPYILVIRPEKPLSWAGKEMQVDFLEQPTDVRLGKCRLVVEGTQQRLANARHELVQLTGMQLDMAIEQRANLGRVNVELNKIKKISFKLSMTIMDSVAIIKDQLKSRGIENTELIQSCYAFATEFGKRSSNYVDPNRRAMNSARLVELSLEWVSFICDDCDAADRKTFKWAVAALESAMAITSSRHLLSMDDSQFSQLRSKVAGCMSLLISHFDIMGARSSLAAQAEKQRVEERAGARKFGAGRILTDA

SEQ ID NO: 39762 - protein, 388 aa, A.fumigatus
ATKLVREQRLARLHDIEDKRVEEDAKRQALGRVLEGSNEADRSLAVLSSSATNVTLRWQQGQYIGGGTFGSVYAAINLDSNYLMAVKEIRLQDPQLIPKIAQQIRDEMGVLEVLDHPNIVSYHGIEVHRDKVYIFMEYCSGGSLASLLEHGRVEDETVIMVYALQLLEGLAYLHQAGIVHRDIKPENILLDHNGIIKYVDFGAAKIIARQGKTVVPMDAFTGPNHKDAALVPKDSQMAHQRGKNQKTMTGTPMYMSPEVIRGDTSRLIHRQGAVDIWSLGCVILEMATGRRPWSTLDNEWAIMYNIAQGNQPQLPSTDQLSELGIDFLRRCFECDPMKRPTAAELLQHEWIVSIRQQVVVEPQTPSSDGGSSSISSSNSCSRHNSTYM

SEQ ID NO: 39763 - protein, 64 aa, A.fumigatus
PQPSNRPYLQICDCAAGGFTMAEYPVAYNGTIATGGDSLTEELNIYYSVSQPHHCNMLFWNERL

SEQ ID NO: 39764 - protein, 63 aa, A.fumigatus
TFPSARQWSIMFDFRNSGRGSIIPGDFDLYQRRIFMGLALSPCHISPFIRHRSLPFPSSRVQL

SEQ ID NO: 39765 - protein, 97 aa, A.fumigatus
DSSSCPSLTNFSFFYSGLARRKSALSLIWLSIMSVGVVSFQWFFWGYSLAFSHTAGKYIGDLSNFGFKGVLAAPSVGSSKVPDLLFAVFQGMFACIT

SEQ ID NO: 39766 - protein, 229 aa, A.fumigatus
QLESVALAVGAVAERGRMLPCMVFSFIWTTIIYDPIACWTWNSSGWVFNLGGLDFAGGTPVHIASGSAALAYSLMLGKRRGHGTHELNYRPHNVTHVVIGTVFLWVGWFGFNAGSALAANMRAVMAAFVTNLAASVGGVTWCLLDYRLERKWSTVGFCSGVIAGLVAITPGSGFVPPWAAFIFGVVGAIACNYATKLKYWLKIDDALDIFAVHGIGGLVGNILTAFFAA

SEQ ID NO: 39767 - protein, 275 aa, A.fumigatus
FPLSAALPAPCVKTDRIIPLQLNVSMDLNETVVGVSGGFSRILSFGNESAFDVSGFAVWVPSRKNWLQNLNISQIAYTGQLASYAKYENTTILAGNLASSGIAAAGAVALLYNDGMSLDPLLTKVGGTDTSAGTFTGTYDTSSGRNLTILGGHFTTIASDGSSVQNLAILNGADNTIRGIASGLDSNSTFLALAVSDDTLFAGGNVTGTVGNSMINGFVAYNLKNESFVENVPPPFTGKDVSVNAIAFRPGTTEIYFGGNFQTAGALPWPRRLFL

SEQ ID NO: 39768 - protein, 86 aa, A.fumigatus
SYILTLATGHHHSNGIVVLVAFCCALGCVFLIVIAGVIFNKIQRRRQGYMRAPQAYGTDRPSTMRRVPPEYLFNTLKHPNPGTPVL

SEQ ID NO: 39769 - protein, 225 aa, A.fumigatus
PSAPEPPKSILGATSKLLEHSLGPAVCFYDTTEAQWTRPGVTLYGNVLALKWISNKQLIAVGNLTVSGNQTVVATYSPKDQSWEPLAGTSTADNLGTVTAFTPANTDVSRFWLAGESKNGSSFLASYDGSSLHFAGSIFGDGTTIRSLEILPLSQKHRDVSVLNNDQILLITGQLVIPDFGNASAALFNGTDLTPFLLSSRWDGQSGSMSQLFYENKNPYTSGGQ

SEQ ID NO: 39770 - protein, 76 aa, A.fumigatus
KSGDEQKPQCSQCRKGSRECRPSEGVIFRHQQNASMNKSLENSSNGRGSLKGFYSYKNTFDDDSVWLDIPKDGTDK

SEQ ID NO: 39771 - protein, 70 aa, A.fumigatus
SVLFFSPRYRQRISFSGTGSQHTFQYTRPYRPFSTVWIFNKCTAYCIAPSAIASNINFFFLQSQQHNTNQ

SEQ ID NO: 39772 - protein, 230 aa, A.fumigatus
  UNSURE (140): Identity of amino acid sequences at the above locations are unknown.
YHFIALVVFVDNSDPCAEELETVLGESEAAVLASKAHQKGLQTPSSADGEIRGLEQSSTWGSTNRYSFSPLATDNGSHSLALDHNTPSNILGLTAPSVPSGSSTNVPHTALPPQPSPPISISSFSNPNSTTRTNDIKFIXNPSQTLSPPIDPSAQHTSEQMISSIPSRSVLPRNTGNTEQESEQPVETEYEVVFLLRHFSEAPGLWYVFLDPRQDSVPSNGKYIGWISSI

SEQ ID NO: 39773 - protein, 81 aa, A.fumigatus
HWCTWVRMLERVKQVFWRNPSHGRRPVSAICLGGAHIALAAPLNLIEDNSGDDNQEDATKSAAESYENHDSVRVVMACSKS

SEQ ID NO: 39774 - protein, 187 aa, A.fumigatus
RCRLIDENGDNISAFDVRGELCVRGPTITPGYFRNDSANAESFDAEGWFKTGDIAYCEGRTRKWYIVDRRKELIKVRGFQVAPAELEAVLLGHPLIVDAAVIGVVFPGTDTEYPRAYVVRQPGREGEILTEEDVRKYLGERLAKYKALVGGVKFVDAIAKSASGKILKRVLRENSKKDIEAGLRPKL

SEQ ID NO: 39775 - protein, 246 aa, A.fumigatus
AGSSLPVKPENCLLHHNPPNMHFAMLLFPGFEALDVFGPLEVLNVLSERKQIYLSLLASSLTPVSTQSPDPAARRAGSICAQEVLPTGTFADYLQDARAPDGVKGNIDVLVVPGGAGTRYPHAIDPVIEFVRGIAPPVKYIMSVCNGAGVLARAGVLDGRRATTNKMLWGQTTALRGEVRWVRDARWVADGNVWTSSGVSAGIDMMLAFVRETYGEDLASGIAQEIEYVWDREEDGTRDPFATAAL

SEQ ID NO: 39776 - protein, 329 aa, A.fumigatus
SLHHSSARRRWTMANRTLESFYKPIRKPGKPRVEDTPPPSYSHHPSYPFPIADLPPSIANTLLDLPATPPRSITNQPHLDLLYYQPFIPSATARELFHFLRRELPFYRVQYTIRRGPTTTQITTPRFTTVFGVDDTSLFTHSPGDSGSTSCLVDSESHRPVPPNKYKSHPRPIPPCLDALRQRIEAATHGAVYNFCLVNYYASGDDSIAYHSDDERFLGPNPCIASLSLGAKRDFLMKHKTAEGVAAAPVKLALADGDMVIMRGETQSNWLHSIPKRRGSRGEARQGRINITFRRAVVPAGTENYYRYNVGEGKAHRWREEEGRMVELF

SEQ ID NO: 39777 - protein, 155 aa, A.fumigatus
SLLDHSITHPPDDDGQWLTGPSNHSTNPSANRASRVWRTLLHRPTPIIPAIPSPSRIFPPPSPTRCWISQPPPLAALPTSRTWISSTTNPLSRQPPPASSSTSSAANSLSTVSSTPSAAARPPPRSPPRASPPSLASTIPPSSPIRPVTLALPLV

SEQ ID NO: 39778 - protein, 171 aa, A.fumigatus
QLLHASQGCVQGPTRWCNCMVSCVWAVPRGKDTRVSMNAPLRLTEDLCRDLPGDDRAVSMASSRPVYSLQEVSRHNIAKDLWIVIEKEVYDVTQFQAEHPGGARSESSTERPRKQSDETVLRKLAGKDATEKFLEYHDTSILTRYRERLQVGVLVEGPEPQKGFLSRFFRS

SEQ ID NO: 39779 - protein, 442 aa, A.fumigatus
NLSAVLSSSWWRSRGRSADSRYGTARWSSKPRSRARLYPPSTMGSSRTSLDDQSSLWSPSASSTWSKYSLGKLTSASVDSFGSDYPRGDYQQSIGFANALSQAIIREDSAHSITSVEEEGTAHLLEDETLQLAGAPWAKEGSLKHKQHLDSVDKRAKDRNWNECFAVIQQGWMRLFSFSNAAKTPRQKPKQRPHGGVVVGGGNWTENAQELWKFLLRHTIASALPPPGYSKSRPHVWALSLPTGAVHLFQAGTPEIVREFVSSANYWSARLSKEPLVGGISNIEYGWSDAVINSALVHADNNRTPPSSGPRASIQSSIRSSIDQQGMRPRLPADRVHISDWAPPQQSMAASTLPEAEQLKALQTYVKNVEDDLSRHNELRPAMILAFSPRHPNAAKAMANWERKSSYLLREIVKFRTYIDSLQAAIDAKNKIYATREEDVPS

SEQ ID NO: 39780 - protein, 786 aa, A.fumigatus
ELSSQIMISIYPIHTDSFLQANVEQGKGLCHCVPRRWIQAANVSPKPTRLIGLNHNKNNNNNNNNNTTVTMSTNSDLSPPSSPSPIFQITHCAQSILLPSCVSIPDAFDTDDEVFASVEEFCNPFDLMVQDTTWADPPLGGSTTMDEAHDTDSEVYHTQDETTLDLGRDDDPTSTIDPSDHDDSNISHLPPLPDHDDSSLFLSSEDGDHERAENQTLLEEKEMRRKLMDMESSFLPEPSTIEVAPSNQAAGIGDTLLQDNCDNAHEPAASETNQSFMTADNTSPDLISTGKEVSVPQTPSLGPHDDSTMGLDATPTTVPQHHGDDTTALEAISSSPAADAAARSSARVQSTFSEGSQSTNRDGQEEADHSTTLDLTRSMQAANLSTQTSFRSSSLERPRLFQNESAQDAEAASRTSSRRSNRPKYLNSRQSSHRLSYSSVASNNTEITNNDATLGADYALQSGGAVPGNSHPAQGDPRNNLTRSVSLGSMASGISSLSEENVMERRNPSAVAEGGLQTLTEEEGISQSRPGSAQQQSQSQPQPHQERQSPTLGDDLGPMTPKAKPRDNIFPTDTAIAERVKDVQVPSAFVRQFREDFAGRPSSPEKRAGLPTPGFARSGRTMTLKEQSSTIDRLSKENFDLKMRIHFLNEALNRRSEEGIKEMISENVELKSDKLKLQKDNQNLKRKIRDLEKQLKDQQSDKESMANHDPEGSDEDSRDAAQDEEILFMRERQEAYELEIERLRSESIVRESEKRRLAEMVKALSDRPIGSEAGAREERVMTTDVL

SEQ ID NO: 39781 - protein, 84 aa, A.fumigatus
SPLHFCSKTCIASTSNIYSYTSILAASVAYTLSFSPSLLIFNPSINDIESDILFVTPIPRSFSCGSLNRCFGGGRCIVSQTKAR

SEQ ID NO: 39782 - protein, 124 aa, A.fumigatus
LRVCFRTLPWKREVCVILLIWIIKRWSSVSGLCRLSLVSVFSSFIHDNRMWYQSSSLLGVAAVAQAATVHYSLDLTWETGSPNGVSREMIFVNGQFPGPTIILNEGDEAIVSIWQHGSIERSGY

SEQ ID NO: 39783 - protein, 162 aa, A.fumigatus
QGVGQSMHIAYCRSNRNANCQRCVPYVPPIQGNWEHHPDKVPPGLNEGCHPSTTQETIFTVDAAHQWASFHFISAASLNVLVVSIDEHPMYVYEVDGRYIEPQLAHSVKLYNGERYSVMVKLEQEPANYKMRAANDGGQQIVSGFATVTYEGGGNQPGPIPA

SEQ ID NO: 39784 - protein, 414 aa, A.fumigatus
VYRRQKQVQTCILTGQVNQTGTYWYHSHEMGQYPDGLRGPFIVRDPSPPFAYDDEFTLTLTDHYHEQMSVLLQQYEADSVGAQAGVNEPLPAAALINEGFDTTTLRVEPNKTYLIHLVCVGNWPGHVIVFDDHEISVVEVDGTWVDAYPARDKKIRLATGQRMSILLKTKDNTDRNYAIWDSMDVNMMFFYQNRAIPEGFNPNTTAWLVYDEAKELPPAPDVHELDPNNDFVDDLVFVPASHEPLLEKVDRQIIFDTGVTQRDGRSVYTINGQTYVDPEEPTLYTALAASPENASNASIYGQVNPFVVQYGEVVEIIINNHHGNLHPWHMHGHQFQVLQRTIPEGGYFDGYFANISSTPVKRDTIMVQNHGHAVLRFRANNPDKLPSALGEMHTDLSYEFGSSTAISNGTSPRG

SEQ ID NO: 39785 - protein, 148 aa, A.fumigatus
TEKYPVGRRSCRSLAMGHSARPILHLPMASRYLWDLLVSWFLKMYLQANVSGTMLMTRLKLWTDFMDRFISGEISTQGKTRLILTTDRPRPNRDSPFSMISDDPADIRAMKQAERNGKLVMLSDWDHLTGQEYMKAMEETGYDILCVK

SEQ ID NO: 39786 - protein, 266 aa, A.fumigatus
  UNSURE (70),(73),(112): Identity of amino acid sequences at the above locations are unknown.
NCTTASGTRSWSSWNKNQPTTRCARPTTGGNRLSPGSRQSLTKAGETSRGPSQRNIDYGSRNTSADVIPXNTXHLPRNRVISLASEPDDFHILMLGRTNSFWEWSLDGAAFXPSNLGALPPAILSPQAPEFADALKITTRNDTWVDIVFQLVVSETTPIQPPHPLHKHSNKGFLLGTGHGKFNWTSIKEAKEASPESFLETPVYRDTFTTSPQGETWTAIRYHVENPGPFLLHCHMTTHLQSGMGLILMDGVDVWPEVYADMITPM

SEQ ID NO: 39787 - protein, 280 aa, A.fumigatus
LVSPSKGCPRLLHWDVLAPCIPRLRALPCIVLVRSQHFQHIAIVYISVFIDVRIPSIASVYLDGLSPVSHTTDQRHRPQHTMFHSRALLLSWLVGFTAAKDIHLDWNITWVWAAPDGFGRPMIGINNEWPCPIVNADLGDRLIVDVHNGLGNQSTGIHWHGFHQYMTGTMDGSNQVTQCALPPGSSMRYEFDVSISSPEASSDVYTHGTGQSNRDLLVSLARNGTVSRRPAGSVHRAGSLAAICLRRRVYADSDRPLPRANVGSSAAVRGRQRRRPGRRQ

SEQ ID NO: 39788 - protein, 182 aa, A.fumigatus
  UNSURE (176): Identity of amino acid sequences at the above locations are unknown.
PVLRVWLIHCHIEWHVTKGLTGTLIEAPAQMHKISVPLDHQRICPSYGTPPGGTPSSPPHDAPRPDGASGSPQYPPKPWGEPDASAPEQDDSQPGGTPDSPEDFPQPWGEPEESPQEPPQPWSPSNNAQPPANTYAPEYPSGYVPVAPGPVIIDSELHSRWQGVSYTDEARQEAAXRCPPKR

SEQ ID NO: 39789 - protein, 408 aa, A.fumigatus
LIWVIGAEAKHRVPMVLHHDGIPFHRGRRDICKVAIEVAALGDRALQNLELMAVHMPGVQVAVVVVDDDLHDLAVLDDEGIYLTVYRRIRSVFWARRQRCVQCWFLRIDVCLPIDGVHAAAVALSHTGVEDDLTVDFLEEGLVARWHEDEIVDKVVIRVEFVDVWCGRKFLCFVIDQPCRRVGVEPLGDRAILIEEHHVDVHRVPDGIVPVGVVLGFEQDAHALAGGQPDLLVSRRVRVHPGAVHLNDTDLVVIEDNNVAWPVAHANQVDEVCLVGLHAESGGVKALVDQSCRWQGFIDACLGADAVGLVLLQKNRHLLVVMVGQSQRKLVVVGKWRRGIPHDERTPQAVGILSHFVRVIPISPGLIDLSREYTRLNLLLATIYLHRIHSACCFPEATHTALPGSSHP

SEQ ID NO: 39790 - protein, 97 aa, A.fumigatus
VSEPNMSEPIDSDSTYGTYDAQASTNYGVRGTRQLNNRNKNTPMRKEYYASGINDIGWWYDYDYKSPGLGLGDYTTSATEAPVERSTAEASGDRSDK

SEQ ID NO: 39791 - protein, 370 aa, A.fumigatus
TDSFSRLVLCGCSCSDQCFPNFTLRWLWMPQADTQAHRGLRLTQSEASAMTLVLNLSTGGFCFDLQSIPSSVLIILYFYRRFRPHIPVKMDGTGPTEQWLSQLTAMREAIAALKLPKDPATEQLSYGSDLDLDLDDEYSSPVTVDDIWDIISSDDETNDDLDDINGVPLPPAPSTSLYDQAWLEQRCQAITLQKPGMSAQELAQQITASLATDSGDDELQMSLAEIVGFDDLDFVIELIGHRAEILASTTSKTEAQTDGLMTGKLQTRAEREQALRQQDFEHKHAPLLPAQARSEPRYPHVFKTHDSRNTLALGGKRYGLPVGSRQIDEQRYTEFEIPASRVGTLASSQKLVEIKSLDALFITPESASTL

SEQ ID NO: 39792 - protein, 129 aa, A.fumigatus
SFSCIIVPERNYDRYYAMRLSYRVGLAALLILAFVLIKRHLDSLQDGSHVPSSWQFSNVVWGGAAEPVATPASKPEKEKPQTPAPAVEQSLPIKQTYEITPIIVPNDRVIVMARLSREDTSWVSTDLNE

SEQ ID NO: 39793 - protein, 228 aa, A.fumigatus
MSELFMGKALRGELRLTQSRWRNFIYTVDDVNAARHTPKNKGRESLAYLQYIVDHYHDLPSTMVFLHSHKDGWEAGWHTDTLDYSNVESVRTLQTEYVQKSGFVNLRCQGNPGCPDEIRPLDDPPRPGKENSRVYARAWEELHNNTNIPEVVGAPCCSQFAVSKAQVLKRPLSDYQRYYNWVLTNNLPDELTAWIMEYSWHIIFGKDPVFCPDIYQCYQNVYGNPYSW

SEQ ID NO: 39794 - protein, 123 aa, A.fumigatus
NLLNPSLWHSKMSLGPHLYYDGEDYKCLLCDRWFETEKALYDHCRYTSRHEWCETCRRVLVSTTAKNQHLFDSPVHSHICTLCSSRPRFDTALELKAHRIDYHNLCGICGKYFDNENNLRMAS

SEQ ID NO: 39795 - protein, 124 aa, A.fumigatus
RYLQMSLTILDLQHQQRHQARNLQCYGCHQSFKTFSGMLIHLESGSCPSGTDIDDINRLARQCYQSRKYIDTAGDYICPACDKFCSKLSALFQHVEDSLGCLYLKEGGQCLAKLEYYISWNVRR

SEQ ID NO: 39796 - protein, 98 aa, A.fumigatus
TNIVAEIRHKRRITVAAASKILANLTYAYKGMGLSMGTMLAGVRFDPLFCRSDECETDNTADDPSRRTGPLLHRLGRHKTLRKPVLRWVRSDLRLRCA

SEQ ID NO: 39797 - protein, 147 aa, A.fumigatus
HTPTREWVSAWVRCWQAYVLIPSFADRMSVKLITPQMTPQEGPALYYIDSDGTRLSGNLFCVGSGQTFAYGVLDAEYRYDLSEEEALELGRRSILAAMHRDAYSGGFINLYHVKEEGWVHHGFDDMNPIFWKTKLEKGEFSNVTSAL

SEQ ID NO: 39798 - protein, 95 aa, A.fumigatus
HCHRPRSDGRLRPPTPRHGSPRRQPRGHSVGSAQCPAHRSAGRRRSWRQPRRKRPGGPYWSRRMRRRPGWRGRSRSRGRSRRAGSRSSSSDGPEG

SEQ ID NO: 39799 - protein, 76 aa, A.fumigatus
IVATDSRATAGNWIASQTVKKVIPVSRLSRGEDKKQDTPVPGLLGTMAGGAAVCILLRTGGMATLTELPSRIANTG

SEQ ID NO: 39800 - protein, 110 aa, A.fumigatus
NLVPSATCSTFVSSSSRTFWASLHKPLSLLLWGIYYLIYFCLNSFDSGLAHLFPAVTGYQIYQTTKRLTFSLPPLPALRSKSPGPWISTYIHVHSSFATNPANTLFSSWY

SEQ ID NO: 39801 - protein, 503 aa, A.fumigatus
TNRCHLEKATPQELVQHKEESEELGGYFIVNGNEKLIRMLVVGKRNFPMAIVRSSFVRRGHTYTKFGIQIRSVRPDQTSQTNVLHYLSDGNVTFRFSWRKNEYLIPVMMIMKALVETNDREIFEGIVGSATSKGVNNTFVTDRVELLLRTYKAYNLHTRSSCRAYLGEKFKPVLGVPADMSNEDAGTEFLRKIVLPHLGNQNVTEIQDYDKFKLIMFMIRKLYALVAGDCAPDNPDAVSNQEILLGGFLYGMILKEQLEEWMRSFGPILRDWSNRNGGAKFTDPAFERDFLSKIVKRTNENIGGKLEYFLSTGNLVSPTGLDLQQVSGYTVMAEKINFYRFISHFRMIHRGSFFAQLKTTTVRKLLPESWGFLCPVHTPDGAPCGLLNHLAHKCLIATSDVNVSHLPKLLVQLGVRSESSVALEDSVTVQLDGRIVRYCSPKQARMIADTVRHWNVSGTHNITRELEIGYVRNSDGWPIPWYLHVLSSRQNVQTCQVPTSRQA

SEQ ID NO: 39802 - protein, 186 aa, A.fumigatus
SRQTEKEARSAQILSKMAPSATDTNWSVDFDTIRRHQLFKNPPKDHTAFPSLAAAIRPHLDSFNALFEGSKVIEAGLKDIGIKTFLDGDAETPEERRARKAEGRRPPKRNRLNVRIREIFLEKPAIPATNKFATRNRNIYPSEARERHATYRGKLRARLEYQVNNGDWMESIRELGQVPIMLRVSG

SEQ ID NO: 39803 - protein, 644 aa, A.fumigatus
LRIPFGTGMSQVHTTSHENWRLGMFATQMGGQYPGIYMFSQAARMYRPVKYLPLDKLDYVGPFEQPFMEIACLPDDLVAGVSTHIEYTPTNILSIVANMTPFSDYNQSPRNMYQCQMSKQTMGTPGTAIEYRTDNKLYRLQTGQTPIVRPPLYNAYGLDNFPNGTNAVVAIISYTGYDMDDAMIINKSSHERGFGYGTIYKTKIHSLDDKDSRRSKSRREITKLFGFAPGGEIRAEWRTTLDEDGLPHVGARVKEGSLIAAWHTVRYDAASDSYVNVDGITHFVKYKDAEEGYIDSIRIMGAETGLEPCQALSVKYRIPRKPVIGDKFSSRHGQKGVCSQLWPAVDMPFSESGIQPDLIINPHAFPSRKFTFAGFSQLHFKRHETNFIAGMTIAQMIESMAGKAGALHGHPQDSTPFQFSEENTAADYFGQQLRKAGYNYYGNEPLYSGITGKEFAADIFIGVVHYQRLRHMVNDKFQVRTTGPVNQLTGQPVKGRAKGGGIRVGEMERDSLIAHGAAFILQDRLMNCSDSQRAWICRDCGSFLSTQVAVSSAGSSKARLAASAAAAAKNAFAQQSGAPGIVRCRRCAREAVFEDSRAVVWEDGDGRRYVGGDNVTIVAVPGVLRYLDVELAAMGIRMKFWVDN

SEQ ID NO: 39804 - protein, 91 aa, A.fumigatus
EIEEKETVWSLESEIKHTASTRNSDDFPAFCSPIIVTSISVALYSQHTFTPLSKPEHSMSLRGAEPGELWPTGRIRLKPRPTYQNILRSQS

SEQ ID NO: 39805 - protein, 111 aa, A.fumigatus
TAPTPSAPGSAATAAPSSPPRSPSHPPAPVRPAWPLPPRLPPRTPSPSRAVRRALCAADAVPARLSSRTPVPWCGRTETAVATWAVTMSPSSLFRVSCATLMSNSPRWVSE

SEQ ID NO: 39806 - protein, 129 aa, A.fumigatus
SSIGMSCSPQCNKALLIWSGMFIMVIPANIGLKYGISSCIGNGIQKAFYDDPNVLYISLHVYQDGKFYPGGDEGDWDHCGADAGIGKYAYPEICRSELCALIPRLGMSTSPGLAKVWAMATTCMLSSRL

SEQ ID NO: 39807 - protein, 78 aa, A.fumigatus
GGYNFRSISKSALAVTKTLMGDPPDRLHSTLPSDLATSTVRRVMMIQSRYWRCMYPKVPQEQGLWTDRLHGKANQYQI

SEQ ID NO: 39808 - protein, 84 aa, A.fumigatus
SAFTLNITDGLLLDILGYTEDDVVSSDLNGDERSSIFDAKAGISLNPNFVKLVAWYDNEWGYSRRVVDLIGKFTFGLVLRSAVY

SEQ ID NO: 39809 - protein, 248 aa, A.fumigatus
KDHNIILLMAMEQDGDTLMGEAGPHLPSGSASHGHPTSNPSMPAIPGNLNGGTEPWLAPPLLGQSMNLPLPALLGDQHAAAPVAQAQPTVPSSAPEQSAGLSAAVTDPAKRADSIVEETSDWSEEDLGARVGLPLASLPSGLCYDVQMRYHCEVRPTADVHPEDPRRIYYIYKELCRAGLVDDPESSRPLVARPLKRIHARNATEAEISLIHTPDHFAFVESTKGKRECNGPRFLPTSSSNHYHRHVR

SEQ ID NO: 39810 - protein, 72 aa, A.fumigatus
AVASGFDAAAGDELGGCFVTPSCYAHMTHMLMTLAHGKVAVCLEVSTTVYLNLINAEQIRVVTILDQFLSLP

SEQ ID NO: 39811 - protein, 231 aa, A.fumigatus
AYMLKYDTTHGQFKGTIETYDQGLIVNGKKIRFYAEKDPSQIPWSETGAAYIVESTGVFTTKEKASAHLKGGAKKVIISAPSADAPMFVMGVNNTTYTSDIQVLSNASCTTNCLAPLAKVINDKFGIVEGLMTTVHSYTATQKVVDAPSNKDWRGGRTAAQNIIPSSTGAAKAVGKVIPSLNGKLTGMAMRVPTSNVSVVDLTCRLEKGASYDEIKQAIKAASEEGELKST

SEQ ID NO: 39812 - protein, 217 aa, A.fumigatus
GFLLRLYRQGSAMMSRCATIVRCDQLQMSILRIHGESITSTRSYAEQGSLMTPNLQDRLSHDLSNVFMLAMPLRLKSLSFTPRIILPLLKVQKVKGNAMGLGFSRHQVLTIITDMSDDELIALEHTRDSIYFNKLTFASSLLSAGGAIETCLAVATRKVKNALAVIRPPGHHAEHDKTMGFCLFNNVSIAARVCQNKLGESCRKILIVDWYVLFPTM

SEQ ID NO: 39813 - protein, 94 aa, A.fumigatus
PQCSLHLPSCLSRRKVLSRRGRGRLGPLRGRRWYWKVCISGDLQKRALCADSPSRNVNIPWPSQGMGDGDYMYAFQQVVMPIAQEFNPDLVIGE

SEQ ID NO: 39814 - protein, 84 aa, A.fumigatus
QRAGLKSWACLIQSPTSSRPITAGWYVRWSLGSTAYANKGKADCMKNYIGWAVGKGYAVIDVNIPKHVTIEPVSIMDFSYDVPR

SEQ ID NO: 39815 - protein, 102 aa, A.fumigatus
PRTDRFAQNSLVFVSHMHGVWTNVETRRKPSKRYGHLIQSPKAGLSEMLMHHKDEVFKWIEERADEAESEEEEEEEETKSKSKSKSRSPTKEKPVDLPPGPG

SEQ ID NO: 39816 - protein, 100 aa, A.fumigatus
TCTSPLPSLGLAALIPLASAVGYAVLTTYCDAPFLPLVLSAAPSGPNHTIPAGASSSSGGPGPLYPRVSGGLCALLLPVSDLRPPSMCSPQASTTAYYPP

SEQ ID NO: 39817 - protein, 246 aa, A.fumigatus
KQISSSRTLELALLGGSLDGLLDLVVGSTLLEAASEVDNGDVGGRNTHGHTGELAVERRNDLADGLSSTSRAGNDVLGSSTTTSPVLVGGSIDDLLGGGVGVDGGHETLNNAELVVDDLGQGCKAVGGARGVGEDLDVGGVGGVVDTHDEHGGISRRSGDDDLLGTTLQVSGGLLLGGENTSRLDDVGSAGLRPGDLRGILLSIEANLLAVDNQTLVVGLNGTLELAVGGVVFEHVGLKYRVLSVS

SEQ ID NO: 39818 - protein, 73 aa, A.fumigatus
EAPFSRRQVRSTTETLEVGTRMAIPVSLPLREGMTLPTALAAPVELGMMFWAAVRPPLQSLLEGASTTFWVAV

SEQ ID NO: 39819 - protein, 112 aa, A.fumigatus
DRRGAGRSHNYQGVFGFPRGSTLFVSMILSVNTISLSDYGAGVLCAIPYGFLADRYGRRQAIRLTIPGFLLNAIITNSVLWFSDIFPPRAIWLAALSWTIGGGPIVAMALLW

SEQ ID NO: 39820 - protein, 397 aa, A.fumigatus
CYLFPTQKSVLVIDTHTMDKNQRVVIIGAGVFGLSTALNLTQDGFTAITVLDRHMPPVPDGSSNDISRVIRFDYGDPVYAQLGKEAYELWNTSPEYADSFHRTPCVWTAQRTGPAGLVQAGGSDFIRKTKEILTRMGAEWHGLADAAELNARFPAVSGTPIGEGFEGFYNNAAGWADAGVAMAGLRDRCIAAGVSFVTGPHGQVTELEKSSDGRITAVKTADGGRITADKFILATGAWTASLIPSWNSMVATAQIVGFVRLTPQEVRALKDLPIIFNLSTGFFSFPPHEKTGYLKVACHSFGYTLSSSQQISSPPSQAISARANFIPEEGRQRLLAGLKEILPQLVERGFEKTCLCWYNETPTGDFIFDYHPDHPNLFIATGGTGQYVPHRILTLRN

SEQ ID NO: 39821 - protein, 150 aa, A.fumigatus
WVYQLLTLYKAQPVVYSSNILHHPVSLLVSLFNFIKTSAPPDLIANMQLSCLLALLGASRIAWAAPVANNNQVESASGDLEERFFYTNYDLEKRDEELDKRFFYTNYDLDKRDEELDKRFFYTNYDLDKRDEELDKRFFYTHYDLEKRDE

SEQ ID NO: 39822 - protein, 181 aa, A.fumigatus
HNSVKKSCNILEHDGLSYKYRAFRERQICIFNPSAPRRTPTPAPTPTYSHAAPHHPAICPPRPPAPRPPPPPPRPPPTPDSPSWPLRTASPPPRPPPRPPPAPLLPPRLPPYSSHLTNALRRDAHAYRPDLPAYDADPASHPTPSLAFSTAQAIQKRLLERAFGQICPDQQHCCVASRAAH

SEQ ID NO: 39823 - protein, 95 aa, A.fumigatus
PSRVLFLFILCFFYFMVGSDVSCQPGLTRGQLILCLAIALSVAQSHGCEFCRRGFLFRHVLRFNQRLSLYQVEFNSVALYFFQRSSIPLVAGDYL

SEQ ID NO: 39824 - protein, 526 aa, A.fumigatus
PSFSIDRWRACRLLMSEQAISATPAPDGRPDSQWDIHDDQLKSIQQQATSSGTVSSVSAHNDPSATHEAPRQGDELGKRKEIPQDEAPTSTFESPNITSEKVAPACSKSTSEPQGTLSARVKGLSVSTKITETGSLEDSDVPPPPPEKDESYLSTKSQLAPPLQKSVNATSELSEKELPDVPSPGQAEDKRDASMDGTREDDSESEIQSIMGQFQDPERRGSQEQLMSPRLELAEQFLGGQGHFPPRHSSLSKSAEGGTQAAQANASAQSSADDKPPVPISKSAQRAYEDYPALTRRSSTSTVPPPPPEPEPDQPFDFHRFLEQLRHRTADPVAKFLRSFLHEFGKRQWMVHEQVKIISDFLTFITHKMAMCEVWRDVSDSEFDNAKEGMEKLVMNRLYSQTFSPAIPAPPSIPRSASRSRRREMERLHGPWRRGQHQEDVERDDVLAQKMRIYGWVKEQHLDIPPVGAHGRRFLNLAQQGRSRCPFMLGLFLTLNEELLKINGYRAPRDKVICILNCCKVIFGEQ

SEQ ID NO: 39825 - protein, 103 aa, A.fumigatus
GAPLTLMSPAGLLKNSKQADTSADSFVPLLIYVVLQARPDHLVSNIQYILRFRNQDKLGGEAGYYLSSLVCQSTLFADNACNVTDSINSPVLSNLSRPWIGPA

SEQ ID NO: 39826 - protein, 67 aa, A.fumigatus
DSSFSGGGGGTSLSSNEPVSVIFVETDNPFTRADNVPWGSDVDFEQAGATFSDVMFGDSNVEVGASS

SEQ ID NO: 39827 - protein, 291 aa, A.fumigatus
RICSHCAAMCGIYFSLSTNGSVLPNEETCSLLRNRGPDSYQVHTRKQELYVSRTDQSGVTATLTFISTVLSLRGDHVHAQPLVDSSTQSVLCWNGEAWKIAGEPIQDNDTESIFQSLLRASHSSLDAVDRGYPLQKVLSVISNISGPFSFVFYDAVNSRLYFSRDCLGRRSLLRGLDDSGNLRICSVCDSSSSSHFEEVDTNGVHCIDFEQVVLQNALASGAVKFNPDAIQTLRWEPKDANACCLVYTLSPPRLTQSLTGRTEKSNTTHEQISPEWNAPVIDSRLLRRPRA

SEQ ID NO: 39828 - protein, 354 aa, A.fumigatus
QDGQKSPIPHMNKSLPNGTPPSLTVDSCAVQELERRLRQSLHLRIQKVPEPPSITTSDVKVAVLFSGGLDCTLLARVSHDILPKNESIDLLNVAFENPRVAAAAAGKEGATLSVYESCPDRITGRAAFAELQRVCPERNWRFVAIDIPYTETVAHRDMVKRLMRPHNTEMDLSIACALYFASRARGMAVNSQDSSSEPTQYTSPARVLLSGLGADELFAGYARHGVAFARDGFRGLIDEIHLDVSRLGKRNLGRDDRILSNWGREARCPFLDEDFVSYVLEAPVWEKCGFGVPDPPETTGVDYTGIDPEKRALRLLAIKLGMTTVAREKKRAIQFGSRTAKMEKGRTKGTDALS

SEQ ID NO: 39829 - protein, 64 aa, A.fumigatus
KHHKARRPLLHTLLKSFIGHMSSGEISHETACADCVQRQTVLTNYYTQLAFATATQNQHMQNSQ

SEQ ID NO: 39830 - protein, 247 aa, A.fumigatus
STKAGMIPCRIINLESALSCTQHCPFARLLCSSKTSTMAPAAIDPRIVDVAEPRKETLPLPPNARERLEKAGIDLSAGYPYRPARPLYVDDVYNIRNYDRPHIDPGTRADPEKKALLSAAKEVIHLTKHIGTEIVGLQLKDLNDKQKDELGLLIAERSVVFFRDQDISPQQQKELGEWFGEVEVHVRRCIISAKLLGHWTNSCSAASTTGAWSPRCNCIVAGTAGSRNPGCVPPAGRRFPLAYRSCT

SEQ ID NO: 39831 - protein, 189 aa, A.fumigatus
DTGLILVQPQVPQVPGVPGVTVLWPALQAAETPAAFRRPGGASRWHTDLVHERQPAGVTHLHNDTVPSIGGDTLWASGYAAYEKLSPSFRQFIDGKTAIYRSAHPYLDRKHPEKGPVYVEREHPLVRVHPATGWKTLWVNRAMTVRIVGLDKAQNDVILGYLCDVYEKNIDIQVRFKWTPKTSALWDNR

SEQ ID NO: 39832 - protein, 66 aa, A.fumigatus
RCTLCLCGYLDRCVSKFSDFATLHSMGLARLSRTIFSETGDATVPVAPHGTRVIYEFSIDYQSAGN

SEQ ID NO: 39833 - protein, 293 aa, A.fumigatus
NMRDIGANADSADSPSTPLKSPRPLSNPLQDQALPSVECTSSCSPSSAGRLTPVSSVDDSLDHQVERSSLTPNTQSLFQNLRLSEAMRHPNHSSQTDPSSGPRESGLTPHSHHTTYRDLYNATPSPGGASFTEPSQQRQPPTPSSPLAAVGSSRSQNLHPADSGDTAATDADRDNEPEPHEDSLQNNNRESNNNNEDFLYNIRQEELPPVPIYDIRLQIALRRVRGKLVDLAQVMNRRELAQDPTTTFHKLYNETLEASRFAYPATRTVGFIGDSGMGKLCLASRGREGDERG

SEQ ID NO: 39834 - protein, 99 aa, A.fumigatus
QLVVVGDQSTGKSSVLQAITEVSFPVKDTMCTRFPIQISFRQTSVSNQYPVKATIVPGRLSENDEALVLRAQDFIIEREELTSEVMEEIIEQVCEIEEI

SEQ ID NO: 39835 - protein, 73 aa, A.fumigatus
KIRGFSADWFSSFLDFVALSDNGIFTNGVDSLFKHNLQPCKRHQSRYHQPLRRYPSPFYVSMLTETDSVQWIS

SEQ ID NO: 39836 - protein, 450 aa, A.fumigatus
MVKLLQNDLPTVPHLDHGWFGLRNRIPAEAHITDAERDEREIKEFAQPAWEGVGKDRTGIHSLIKYVDKERRAQIQSGLPQIIAEIRRKLHDCESDLGRMGEARDSPKAQRYFIFQFCNEMQKMANASLIGQYHDIPSEDPRIMLRYRVQRRLDRFYEEMVDLDNMPILFSSYQHDLEILSSMNPEEWEDKVMNAPGIYSEIYKEAKISEGRSLPGSIHPDVEERMFRKLTTHWERIARSFVEDVKDLVKDCHDVLARIAIPNSKVRLEVSRVVAKTLEEWNRDADAALLELIKDNQARPLVTRHPLLISETIAADKQRGEILLGKKSTMAPNGESEGTPNTIRGGHQQRFISTLLSQVLFVRARLESYYKIALYRFIDNVAMQVVERHVLGPKCPMLTVSVKTFANLNDEELNSVAGEDETDIRIRARLERQRSRYVQALEKWERLRAL

SEQ ID NO: 39837 - protein, 62 aa, A.fumigatus
YLKYMLCTYQGYLYKKDFYTKKEWDLLKRAEKKIASKLSITNNKLELLYPELRQLQEYLEKI

SEQ ID NO: 39838 - protein, 307 aa, A.fumigatus
  UNSURE (4),(18): Identity of amino acid sequences at the above locations are unknown.
EIVXAQGSYPSEGLPVHXRSPRLKAGEQLLYAMLRNIRICETEGLSSELHLNQDGKDIMVEISQSELHFHECESGLTIYVPRDEQAQYLCFLDRIPQALMEWIMTEPSTGICEPSTDKALDVLSKVLQAEPKYTSMTLDRAGIMSVETPEEMAAGQVAENTEDELTERHTEGHDSIDDAPSTGAFIRSARSESSVTLTDEFASGPYARPSSPSRGLSWTPLTPRGVPSDASYLSRGSAQPIDVAYAAILRRVVTAARTTTFPSKGAFNMTALSDSLGPGNEPFQLRAIDKLSRDKLIGAAGELFVSS

SEQ ID NO: 39839 - protein, 104 aa, A.fumigatus
VFETLCCLTPSLPHFGRDNWQSTIRNHVKLHDDYTDLEPWNGRETADITYSDRQGILTALLINKGYLDATWAGARPDYFLEVKTTTSSWETPFYMSKYQYERVC

SEQ ID NO: 39840 - protein, 91 aa, A.fumigatus
  UNSURE (80),(84): Identity of amino acid sequences at the above locations are unknown.
MRINDTAEEEEDKGKVLTPLMKMVAYSWGGDEGLPWLRKYGEVQRSSVDNSVYLNNPCEEDPIFLGTGHLTIIDRSNNLXQGAXCKLLAPQ

SEQ ID NO: 39841 - protein, 162 aa, A.fumigatus
VLQVYVHPTPSSKDNIPGFIALLQQKPAPTPSSDIASTNSAKTTADLSSYLLAWVPESSLGDAYSTYVKVDLSGDSSPPKQRYLVPPLPTTTTYKDPIGLYAFAVPLSEIYSLLVRPPSLGWWFGSLVINTRAGDSFPALFFHDSECESTILQKKKRTRGKF

SEQ ID NO: 39842 - protein, 238 aa, A.fumigatus
LTVLQRVQSLHAAHQVTNGVDLPWGHQSCCPLNASTAPPRCGVDHRRNSWRITMEALTPPTLTLVTLLTAFFFLYRAWLRAVYPKTPLIGRSELFLHVPEADNTQAVSKESDFPENWLNSNDIFELERRAVFSKVSPNRHAQGSKFTPPNPCGSQSWLYLSHRSQFTKPGDYQSFEVAGFPIFLILGKDGEIRTFHNVCRHRAYTVAELRARKFYRSRMSLPWLELQHERRAYQSPSF

SEQ ID NO: 39843 - protein, 151 aa, A.fumigatus
RGPNRVDGYQECLHCQYTHPSFSVYYPPTFYTVNNHQNFSQHIADPKKPDDGLFLYFFPICTLNVYGGGMSSFRVCPAEDPSQTRMEFDYYHSESGNKFEEYYQFVRQVAMEDYELCEKTQGNLEKGVYTEGILNPQKENGVSCEYNIDAR

SEQ ID NO: 39844 - protein, 106 aa, A.fumigatus
ERGSSTGLGCRYHGWSYNTKGELIKAPHFEQILGFDKSQNGLFAIHVQQSTDGFIFVNLEADAPGELLETDRLVDFVKCNGPIPQSRWIGGRAIEGVFNWKMASKF

SEQ ID NO: 39845 - protein, 93 aa, A.fumigatus
TQGANFNRKFEHSSTFGLVASGSSNAIWTRDDDLTGTVRRTGAGRAIVGAGEEVLCWDVKKGDLLGRWRDTSCKAQVTVITQSKADEDVFAVG

SEQ ID NO: 39846 - protein, 914 aa, A.fumigatus
GRFRCRVGLPPLSEMGQLPSWCLHPELVLFRYDDGSIRIWDSRTETVIISFNGHKSAVTQLAFDAAGVRVASGSKDTDIIVWDLLAEVGLFKLRGHTDQVTSLHFLNLSSELLHAAGLSEHAGFLLTTGKDSLIKIWDLSTQHCIETHVAQSNGECWSLGLSPDQSGCITAGNDGELKVWSIDESAMLEISREKVGSEGRKILTDRGTFYRNGKDRTIGISFHPRADYIGFHGSEKAIEIWRIRSATEVQKSLARKRKRRKEKEAQREGAVAEVDNEKVDDVSSAPVTEVFVPHVIVRTGGKVRSFDWIRTKTTGNLQLLASTTNNQLESYSVTTANKKKDDDGSDYNRNLAVDIPGHRTDIRSIALSSDDRMLASASNGSLKIWNVRTQSCLRTLECGYSLCSAFLPGDKIVVVGNKNGELEVFDIASSTLLDTIKAHDGPVWSLHVHPDGKSMVSGSADKSAKFWNFQVVQEEIPGTKRTTPRLKLVHTRTLKVADDILSLRFSPDARLLAVALLDNTVKVFFTDSLKLFLNLYGHKLPVLNMDISYDSKLIVTCSADKTVRLWGLDFGDCHKAFLAHEDSIMAVAFVPTNKEGNGHNFFSASKDRVIKYWDGDKFEHIQKLQGHHGEIWALTVSHSGEFIVSASHDKSIRIWQQTDEQLFLEEEREKELEEMYDNTLTASLEQDEDADGEKAEAVDAGKQTTETLMAGEKIMEALDLGMADLEVMRQWRAVKASQPNAAPPARNPLYMALGNISAEQHVLSVVQKVPAAALQDALLVLPFSKVPALFTFLNIWANRGWNIPLTCRVLFFMLKTHHRQIIASKMMRPMLDSIRSTLRRVLTRQKDEMGVNLFCLAELRPTRGGKAAPRTTSMRKRGNQEPPQVAGTGQKPGIWPKWLLRAWSYQHDFFFSGA

SEQ ID NO: 39847 - protein, 256 aa, A.fumigatus
LIGFSAGCNRGAPVSIDQVVSDFDGVTFHLSTPESKTKILISIHVKCFKELVQYGAQEVLEREYGPYIVTPEPGYDFSVQIDLENLPAEQEARDELIMRLALLKRNAMAAPFERAFDEFAKLSEEASRYTSESAPQGVKEGGELMAIHYREEEAIYIKASHDRVTVIFSTVFREETDRIFGKVFLQEFVDARRRVVTLQNAPQVLFRSDPPLELQGVPGLQTAGDGKMSYVTFGKQTSLHMLRALIDSSQSFSLDT

SEQ ID NO: 39848 - protein, 65 aa, A.fumigatus
GTKTSVTGADETSSTFSLSTSATAPSRWASFSFLLLRFLAKLFCTSVAERMRQISIAFSEPWNPI

SEQ ID NO: 39849 - protein, 217 aa, A.fumigatus
QLSFTLRRITVSVIRPDQADSDIISLEVGGDMTVELLKAIVESETSIPTNNQRLVYNNQLLGNDAQTLEQIGIGEGDMLGVHVTMRSPQAPARSIGGGPSAAAQQNLQRRQPMTPDPETIRLHILGDPRVREAVRRQNPELADAATDAQRFRDVLMAQQRREAQMEAEKEARIAMLNADPFNPENQREIEEIIRQNAVTENLHTAMEHHPECKWQRI

SEQ ID NO: 39850 - protein, 235 aa, A.fumigatus
  UNSURE (175),(181): Identity of amino acid sequences at the above locations are unknown.
GLPPKTNKRAAFGRVTMLYIPVEVNGHKVNAFVDSGAQVTIMSPECATACNIMRLVDRRYGGIAKGVGTATILGRVHSAQIKIGSMFLPCSFTVMEGKHIDLLLGLDMLKRHQACIDLKKGALVIQDEAVPFLGEADIPKELQEGFEDEPLFKVPMGAEVGARTGAVTHQASGSXTSAAAXSSSTPRTNIRPAPSSRWPQDSIAKITELGFTREEAVRALDAANGDLDGAIGFLI

SEQ ID NO: 39851 - protein, 204 aa, A.fumigatus
NRITNITMPSPTPSPSIWSRKRDLVYLIFFVIHIPTIFSKCSHSRIQYRNIANCKAVVDAVPLLPTALQTDLAHQIRAFYVSSYNDKFFAEPPPPWFTAFIAMELFYHAPLSLWAIPALIRDNAMVPVHLLAFGVQAFVTSLACLVQVWSWEDRTVAQKRSITMLYGPYVALGWYPILLCLCFWDFGWALTGVSRGVYGAGYGL

SEQ ID NO: 39852 - protein, 121 aa, A.fumigatus
QAALCLAPGFLKAGLDPPDQFFFDFSCPYTSDDLRMNMAMHDPHEKNGPDAVESRVQTDFPVERFGGNGSPGVRRIEVISSQFNLVHRIIFFFGVFLIAYVYGLDGTIRYTYQVFCLTHAS

SEQ ID NO: 39853 - protein, 85 aa, A.fumigatus
GGHLTACDFVSVLPLGLSGGANLSWSSNDQTVAQLLHHILTPSEAIESDHQYHNAVTNTLPLNLEPEARPGLPHLLRHPHPNHLQ

SEQ ID NO: 39854 - protein, 98 aa, A.fumigatus
LDVYMPSIRVAWQKQVNSLDELEASLVLRTYQFSIFNLKNYIFYLLSHSFMLSLRFLLPSFLNRSTSAIVQDKSPGWGLSRSLIIPCLCEISRFRIQR

SEQ ID NO: 39855 - protein, 83 aa, A.fumigatus
KTPEEANIGTTAEDLKMAAELPPLLKASLEQTKVSYRQLGKSGLRVSVPILGGMSIGSPEWGSWILDEEKVSPCTVKFDHEID

SEQ ID NO: 39856 - protein, 123 aa, A.fumigatus
LNSDESSTHETSQQWGPLDGGKLARPLSQVRGTTRSENTDPNAVTKADEMTISRVEELAKNKGWTMGQVALAWVKKRVASPIVGFSSVERMDEMIQVADRILTTDEERFLEEPYVPKPIGGHD

SEQ ID NO: 39857 - protein, 174 aa, A.fumigatus
MTRFRWVACHTDPAGLSRQAIFNAVNASLKRLGTDYIDLLQIHRFDPLTPIEETMEVLNDLVRSGKVRYIGASSMRTYQFIMMQHCAEKHGWTKFVSMQNQYSLLYREEEREMNRFCNETGVGLIPVSTDDLTLMNHRLMRHPNSGVLSTVVSLHVRSHKSEGPPARRTPTRTQ

SEQ ID NO: 39858 - protein, 70 aa, A.fumigatus
VEQWDTANNYSNGKSEEIIGKAIKHYNLPRHKILILTKCWSPVSEHDNHYVVPFADNMRQDKEYVNQFGK

SEQ ID NO: 39859 - protein, 164 aa, A.fumigatus
TFDKKFQEAESTPFTVSTPPTDITMGKAARGKRNAPSSSPYQKPGAPLSKAASAIFKFNTDIGQHILKNPTIADAIVDKANVQPSQTVLEVGPGTGILTTRILEKAKKVIAVELDPRMAAEVTKTVQGTPAEKKLQVILGDFVKTDLSKLPPFQICISNTPYQV

SEQ ID NO: 39860 - protein, 260 aa, A.fumigatus
TLTSPPQISSPLIFKLLSMPNPPKTCILMVQREFALRLIARPGDSLYSRLSVNAQFFSRISHIMKVGKNNFRPPPQVESSVVRIEPKADRPNISWDEWDGMLRICFVRKNKTLRAGFMATKVRALIERNWITWVSMHPEKVTQADIDFLQGKDVSALQSVDEDMDMDQDGDEAVQGGDDEDDIFMDLGGETEAPVTTSKGSLVAIGDQQVPRAMVTKLVQAKIQRVLEQTNLANARAQKCDENNFLRLLHGFNTEGIHFS

SEQ ID NO: 39861 - protein, 133 aa, A.fumigatus
TRRPWEKAPAPAITHNRTSPLSYPGRTVTLSWDAPGPRVWVRTTATSRTQLRDPPSYVLWASQLNVTYSTLTTSGNSSYGTTTQPDLSTYAGDPALNGTIFIAITDTDLFVTPFNISSINPHIVAGPALYQAG

SEQ ID NO: 39862 - protein, 379 aa, A.fumigatus
HLNYLLDVRRISPFLTITMNWRHFLLINVLGGLPYTFAGPNVRRADGPSSEPPILSHTTSLPHSSYTATPTTSGAERASSVGSGISTLGPAPGATSYPSDGKLHDLQPAPFTPAGGVGTNGTTPISNAKSDFDYESLVGFYRLAGRTVADRCQALVLYQEYIELDLFHDGLARFSVAEFTAAGLTAEDRFLIEFMADQEAGHATMLTNILGDQAPRQCVYNYPYATVHEFIDLCQKLTRFGEAGVYGFLPHLDSREAAGLLTQTVTTEARQQMIFRQFEGLFPMPVWFEVGVPQSWAWTLLAPYISYCPANQTRLAWQNFPSLYIENQPHPYRVNGSSSVNETLAHGGMNTLASRNVTGPESCLNKTAVGESSSPGNYP

SEQ ID NO: 39863 - protein, 978 aa, A.fumigatus
SSIGEWNWLNRKSDRTNKSHWVQRVVCSISRAHTVHVTMEDVRPTAKWANRILRPLTSIYHRLEKHHEIVSSIAQSKWKERPENADTEQAKPRTVPSTEASCQFSDEEPDDPAWVPGKREKRRIRHNYSSRGQRNGGRRRSRLLIRSPELQRTLPGAIEIATPLITGKARQVCEGLSIRKRLFSVDAPAAASESHEGGTGRRKTTRTKNSSFPAYQGSWKEVLDLSGDAGFADIAHLLDRIFLKFLYTTRTNAPGSQQQGQGARSLVSMIARRLPEFIAYEQRFQDETDEDCEVDMCDAYFTELEAYYAPNGNGWEPLREAVRAQGVHLVVRMIENGWLTKLVACRLMDECMRHGEADAFEMIISSTLSTINSYHYPATFDPQRPSTHCDDPVYMLRTYYSRCGGRAFVYNELSKLLLRRVVPPEWMVTTWWKKCVDEAIRSVSTEDTDSATATHLIEAILLSAGGIDQSTERTALLEKDLNQRKILRLKDSRASAVTSPLPNDLTPCPIPVQDALSNLVSSLVTALCGMHIARSNASDAPERRVGLKARHTINCLALTVETDIGLRHRQAIDDAPSYQTLRRGYLLLGNYMLQIGEETPVTMRPRCDPVSKQRIDSFFESLALQQDMLKEFSDLVQRVSRYCGQGDLREQRRTSVAVRTKISQLARQAGVRGLSYFLGKVAAETAMALAHKTLDPDDHVWAVQIQESVVSAQQGQRVNADFSDEPEERDDRTGLYRWEESIGEWIASTPKPKAGQTNWNQSPVISDAGRASVISCSDSSESVASAASERSASSVTSSAPSLPAKRTYSGDELVSRPIKKLRSRTVEIYADEAQDQTGGAESQPACFTSLYYSSPEARCVPGAAHTRSARGALGELVQAKNVPNRALVGKLKSANPSPKLEVVIINRKNSSSLDEPIDQTTDHALKTCSLPPRPPRLPIISKPANPKWRPSSRINAVSRLNVIPCSQDDDSEDELSFL

SEQ ID NO: 39864 - protein, 250 aa, A.fumigatus
LSRGALWGVDSADTILAYVYVSLLEHASGNTKNAVVYIKHAMDLWKIIYGSNHPDSITTMNNAAVMLQHLKQYSDSRKWFEASLAVCESLFGKQSINTATILFQLAQALALDQDSKGAVGKMRDAYNIFLNQLGPNDRNTKEAETWLEQLTQNAVSIAKHAKDIQARRLRRINMNPRVTTLGTKVQPQVGQTAPEASGAKGAANASMDSRSIDELLKFIEGGDATSSRSKQKKRAAASNPKLRGSKKSSA

SEQ ID NO: 39865 - protein, 248 aa, A.fumigatus
VRIESLSKSQQETFSTSVELALTTPSRVQQGIDSLGEMALWRSLATSTSRLFRPSLRSNSCFRRPLATPPSAGPNDYRSRLRRLNDRLPPFLRSYTTPLLGAPGTHITSFLILHEITAIVPLLGLVASFHYGDWLPDFTSKSGFDEGVQRFGRWLRKKGWVEDADVDIVNSDGSASGNDSTTGSPGQSQLRPEDRKGVRLVLEFATAYAITKALLPVRIVVSAWATPWFARSVLAPVGRGVGALLGKK

SEQ ID NO: 39866 - protein, 165 aa, A.fumigatus
FLQKDLATGQSFFSYSGHPHAFCGRYLWARISSPFILGEASDAGLAWILTFQAQSTVKTIVCVPRPLALDLWSTSLKVDTAPLNTSCECYTCNSHHRAYILHLLSAKKMLAWTLLQIHNHHIMDKFFSAIRTSIERGTFLTDADMFHRFYAPELPEKTGEGPRCV

SEQ ID NO: 39867 - protein, 75 aa, A.fumigatus
RGINGHIISRFENRGYVISGTQWLLLALIVHSFKLVAMKLVSPPQSQLEQHYADLSDKPFFKGLVSCELPFHMRN

SEQ ID NO: 39868 - protein, 74 aa, A.fumigatus
RAYANGTIIAILGATNPLASAPGTIRGDFAIVSSIETSLSWFVADIALGRRPQRLPRFRQRRERQEGDCPLVQA

SEQ ID NO: 39869 - protein, 99 aa, A.fumigatus
AVNGRHQPLVGLTIYGRHSGVFPSPLIGGGQVLHSRMRWLKFSSINFKDPRYFSHHRGEVRVKMEKITDKIAALPPNENYFSLEFFPPKTQMVGYPRTF

SEQ ID NO: 39870 - protein, 508 aa, A.fumigatus
GFSNLQARLERMSQALRPLFVTVTWGAGGSTAARSLELAEICQRQLQLTTCLHLTCTNMSRALIDEALEEAKVLGIRNILALRGDPPRSEEYNTHGEDDSNKDFTFAVDLVRYIRKMYGDYFCLGVAAYPEGHPVDSYQDVQDPVRDLPYLVEKTLAGADFIMTQLTYDIDAYTKFEQMLRNHESGAFKTIPIIPGLMPIHSYKILTRTTKLSHVKIPPQIMSKLEAVKHDDDAVKRIGVDVLSDLVEAIKKIPCPGFRGFHFYTLNLEKTVSFIIERCGLIPDYPEDSGAVVDDDYTTAPTGAQHRSLSRRRASSVNSLPHNRVIVDRLQVPSDGSSRASTHEAPAASAGMPAMPPDRNTTLQISEGQGALGREATWDDFPNGRWGDARSPAFGEIDGYGPSLHVSGAVARRIWGYPVSREDISALFRRHVSGDLYIVPWSEGGAEENSSGLNAETEVIRPELLKLIDGKRWWTPGIPTGCPWRPKRRSNLWMGSARRRIRLPGAIR

SEQ ID NO: 39871 - protein, 195 aa, A.fumigatus
NSLTANAGGLLASQPAVHGVRSDDPTFGWGPPGEGFVFQEPFVEFFCPSKDFRTVLKPLFAKHGHEKLAWFATNVKGEFESSLPADPAHADTIEMNPNNVNAVTWGVFRGKEIVTPTIIEEVSFRAWGEEAFRIWDEWRRVYPRGTPTERLLEEVKNDVWLVCVVGQDFGAGTENGSEEEQQETKWMWNVLINSQ

SEQ ID NO: 39872 - protein, 149 aa, A.fumigatus
NSTKTDETSLASPARCLAWSSSISGLSRSISDLAQFIVSTFFPIRNFRRCVGLSEGLTQRAATEPDSSSGSSDKFSSGTASSSAFPSFFMALARAAFASLISFVSAASNFMAAASRSLTLSSSSLTSVAIQTFFTFSMPNIFRILSRLR

SEQ ID NO: 39873 - protein, 156 aa, A.fumigatus
DEDPQNASNSASSLVSTLVPALVVAGIMVLVFVILRRSERRMYMPRTYLGFLRPEERSPPVGTGLWNWIIDMYKLPDEYVLQHHSMDAYLLLRFLKLISVICFVGCLITWPILFPVNATGGAHKEQLDILTMSNIAQDNNARYYAHAFVAWIFVGQ

SEQ ID NO: 39874 - protein, 215 aa, A.fumigatus
LAGFVFMTVTREGIFYINLRQAYSLSPAYASRLSSRTVLFTAVTDDYLNRDKIRKMFGIEKVKNVWIATDVKELEDKVKERDAAAMKLEAAETKLIKLANAARAKAMKKEGNAEDDAVPLENLSDEPDDESGSVAARWVKPSERPTHRLKFLIGKKVDTINWARSEIERLSPEIEELQAKHRAGDAKLVSSVFVEFYTQADAQLAFQSGMSGVGF

SEQ ID NO: 39875 - protein, 127 aa, A.fumigatus
  UNSURE (79): Identity of amino acid sequences at the above locations are unknown.
QMWSVAHNLPLHMAPRYIGLDPTQVIWSNLRIKWWERIIRYSATIGLVCALIIFWAIPVAVVGSISNIDSLTDKVPFLXFIDHVPSWIKGVITGLLPTVLMSVLMALLPIFLRCKPSLPQANVTELY

SEQ ID NO: 39876 - protein, 152 aa, A.fumigatus
WCVAVMAKLGGAPSAAAVELTTQNFYFAFQVVQVFLVVTLASSAASVVTKIIQDPTSAPQLLATRIPKVSNFYISYIVLQGLSFSSGALLQITGLILGKILGKLLDTTPRKMYNRWSSLAGLGWGTVYPPLTLLAVIGNASYLLVIILVPCS

SEQ ID NO: 39877 - protein, 218 aa, A.fumigatus
RCRPIGNSCHLLVYRSAGAWFRDHWSVLVLFPLTGYNMLYVSNADIDTQGKAYARALQHITVGCYLLVVCLIGLFAIGTAANRMALGPLILMIIFLVLMILYHISLHNALSPLINYLPKNLEAEEQSLLASNPIKHGDTVGEHPDDITATNAGKNGDGGFPDVDAAEKGLTTTPATPEKKPNLIVKWFRPDKYDGYWQLRRLVPEAHETTQYPPEVER

SEQ ID NO: 39878 - protein, 101 aa, A.fumigatus
NYLVLSPQRSFTAFNFGFLLLAILAVHTIETRKIPNFFINWRAWHVQVEYSELLSDPTSFSFSDPIKLRDEGSDVKLLLSPLVPFEIWVPWSFDCCLTFIY

SEQ ID NO: 39879 - protein, 257 aa, A.fumigatus
NCLTKPGIIFLCPNQFQHRYLSAKEAGRSPPRLLSRLYPFDYQNEPLNSTIDCRIRRRYVGPCRLYLKRWMLIAICVQDEISAIVLDPGFSTTRAGFAGEDTPKSVIPTYYGKYTYEAQEKLIFGDDIFVTPRPGLSIHNPMGRDGVVEQWDMAEKVWEYSFTSRLTGPKAGNPFQNGLNDVANGELPSEMEGVETEEKPLADSPLLMTECGWNPTKAREKTVEIAMEKWGTPAFYLARNGVLAAYVFTILCTHSLS

SEQ ID NO: 39880 - protein, 80 aa, A.fumigatus
FDILYPPPSLSLGLPVYLCGLDFILDRGKSPFGFFGSSGVLCAIKLLLKGSFSPPSSFFFLPHYRLVDSDWVSEILSYAT

SEQ ID NO: 39881 - protein, 320 aa, A.fumigatus
PEMVCLRRMFSPFYALIPLADRCAYVALSFAAGKASALVVDVGASNISVTPVHDGMILKRGVQHSPLGGDYISSQLRALFKTNSPQPITITPHYLVASKTAVDAGQPAQAKYKTFPPDKAPDASYRTLMEERTLSEFKECVVQVWPGPNKLSATGPNGVSNEEVAKSSPGRPFEFPDGYNQVFGIDRYRVVESLFDAKAAIPDPESVFPAPTQAQTVPELIKAALNGVDVDVRPHLLANVVVTGASSLLYGFTDRLNQELMQSYPGPRVRISASGNTAERKFGSWVGGSILASLGTFHQMWISKKEYDEHGPNIVEKRCK

SEQ ID NO: 39882 - protein, 82 aa, A.fumigatus
KAWKIPQVSNLIKSSGTPFLCRNLNCINVSHYRAATTNKRPPHAFFAAFKNLTYFNHQPCLQKHIKIQELQLSKRAESYLLS

SEQ ID NO: 39883 - protein, 289 aa, A.fumigatus
HRLTCRRQVLYIIPVPLDAATIGDATICCPLVIKRDGDSIICSILPSATTDRGIMCNSNKLVSPAFPEAIKCADFTMRTPDLTARSKYRHPQTNEAMSKANMYTETAPVNDSVVEDTASNSDNLRKVITKENAIFTTGSSALPPFIDLEKTQIIRFGTGLEFQLPDEESHMREEPSAIVLPCIFGTELQGPILLATGTVPSNVPFPNADALRDYYKQLKNAVVIVDERMTDNARNLASAYRINALFIVRLTPETELKDTNNVISLMNSANIKCSAGTRRTPVLDSGSDL

SEQ ID NO: 39884 - protein, 105 aa, A.fumigatus
VLMSWFSSPTCAVERMEKGDFSSFCQTILWNMSGYLDPANLAITVTTSDTAAPAGKTKEGLTHLIHVHLTFPQSITVSSSQATIVKTGKTRIISYNYIQHKWIID

SEQ ID NO: 39885 - protein, 134 aa, A.fumigatus
QRTEVFDDFQIMQAPSSTFKVPIVSDQITILAVSERTPTYYDFCFADESCNTCCWLARNTFPGITHSGDILNGQDLLDYVTINKDTLTEKEICVFISGYRSTLITRFLGTYPALLVADHVDKVCSESGHVPSID

SEQ ID NO: 39886 - protein, 275 aa, A.fumigatus
NAVPALAGPQSLILVQISEKYYFYRGIANRAHLNTSGLAFGSDVTSVLESVGTGSILDPRIERVINLGGVNSIVLPSTGQLVQPQDLQKLLEDISIDQIQNLEEDISAVVPQLQVLLNQKDLQELSRSLVTALSAKISNAATPLRDSYTRFLTQEYRMEDPKSVQKKNQMFGELRKVTKDMQKALEPVISCLANMMSSQTTSKRTHDLKRLIRQTTIQKNVEAVKSMTFETLMGYLEEYAGEMGVMLLNIETTHYHQLLGNLKNSAIDARYVQPA

SEQ ID NO: 39887 - protein, 515 aa, A.fumigatus
KTAPLMPGMYNQLEANPFVGNTPLSSLQKCTSTDTDFFSQCCALDSRILHLEGFDAGIIMEQSQAKHNGPLKSTLGPCQPILALPCLSQLSETGSMLAWVCWDEFVNLKSPYTVRWIEKCNEPHIAALRIIMRSTLSQAVASREHDIQPSSPETGHLMSALLMAAMSKLAAMRISKPVELDKAEDTVTKLMRGLFGNLLTIAGSGVRPLSMVWQLFGTNPLYDLPTSSAEWIWYENVVALYPYTGWPPRQFHENLEKFLDKAVIRVVTKNENVASIKASRMAELVKFCKLRNIQLAHSRTIITVFMRMLTAEDIDIQPVAAQLLTQLPHKLERQSQSYTRMIRYLNHLAGGGERCVHDDLTAANVYTSRSAAFAELKKQVCEACKRSDWPRMKEACQEIMTKHIEIATLWRVKPESLKIQNMKLYKALLAADFDSLDQNTQAKNLQLTRYVFSDAETKRVPWQVGKKGQFGDSIEPLDEVFLHEIMTGEKSEPAPPATVNEFSGEEKKAMIETED

SEQ ID NO: 39888 - protein, 267 aa, A.fumigatus
PPKPLAPTNKAGEYDTKMDSHVYLGAAAETSSVFRLTSHLTHGLTVLPTTVETDDAVQRLQESLAAAARGSKKTADGSAPVIEVKEDPELAKRQAEMAEREKLKAARRRQQLAERELDRGRRVGFSNRSGGAGLTVGGLEDDDGLLATRPRARKPRKPNRRGEIYTDDEEDYDRRGRTREDEYDEDDGFLVGSDEEPEVIEDDEDEEILEDDEMDAEGEEEETVPAQKPAKEKRPSPERPVSEAGASGTPPVRKKNRYIVDDDDEDE

SEQ ID NO: 39889 - protein, 327 aa, A.fumigatus
KTQLVVQSFLVARTQPLFANMNTSKASKKRKAVTRDVEEEAGVFSGDELNTGNLDGALSDNAHDLSSDEDESDSEVELIDDFSDEEDEEEEDVLDSDEIPSDGEDSAKKKSNAAPGELGAVIDDDDDDDDDDDESPSEEEQLNYRIEKDANGNDRFVYDEINPDDNSDYSDVDENANTIGNIPLSFYDQYPHIGYDINGKKIMRPAKGEALDALLDSIEIPKGWTGLTDPSTGKPLELSQEELELLRKVQMNEIPEDGYNPYEPIVEWFTSQQEIMPLSAAPEPKRRFVPSKHEAKRVMKIVKAIREGRILPFKPPTEEDEEDDTIV

SEQ ID NO: 39890 - protein, 491 aa, A.fumigatus
YDLWADEAERKDRPMHIPAPKLPPPGYEESYHPPPEYLPNRKERKTWEEADPEDRDREFLPNDFGSLRRVPGYENFVKEKFERCLDLYLAPRVRRSKLNIDPESLLPKLPSPEELKPFPTACATVFRGHKGRVRTLAVDPSGLWLASGGDDGTVRVWELLTGRQLWSVKLSEEDPVNVVRWRPGKDALILAAAAGDDIFLAVPPIVDPAMEKASLDILDAGWGYAASVPPPTPAEANKKNNPPKWMRPSSSLADSGVCAVIPLRYVAKSLSWHRRGDYFVTVCPGSSTPASVAIAIHTLSKHLTQYPFRRRIKGGGPPQAAHFHPSKPILFVANQRSIRAYDLSRQLLVKILQPGARWISSFDIHPTSSTASGGDNLIVGSYDRRLLWHDLELSQRPYKTLRYHRKAIRAVKFHPGGRYPLYADAIDDRSLQIFLRQCYRRHAQQCHHCFGSRFSRDTKSLGKLGVLDVDWHPRDPWWVSAGADGTCRLWM

SEQ ID NO: 39891 - protein, 303 aa, A.fumigatus
SAYPSSPVVKIFVSNADFFTALPKIQPSSKREGFATIPDTTWADIGALGQIREELNTAIVDAIKSPELYANVGITAPTGVLLWGPPGCGKTLLAKAVANESRANFISVKGPELLNKFVGESERAVRQVFVRARSSVPCIIFFDELDALVPRRDDALSEASARVVNTLLTELDGLGSSRQGIYVIAATNRPDIIDPAMLRPGRLETLLYVSLPNPLERVEILKTLVRKLPIEFNEDMRRLAEECEGFSGADLGSLLRRAGYSAIKRRDQISFEDFVAAKAFIRPSVTDLKKYEKLRREWSGGVL

SEQ ID NO: 39892 - protein, 136 aa, A.fumigatus
FNCSSSLGLSSSSSSSSSSSSITAPSSPGAAFDFFLAESSPSDGISSLSSTSSSSSSSSSLKSSISSTSESLSSSSLDRSWALSESAPSRLPVFNSSPENTPASSSTSRVTALRFFEAFEVFIFAKSGCVRATRKL

SEQ ID NO: 39893 - protein, 201 aa, A.fumigatus
QASNIGKRKLKCSGEATGCSRCLKQSLPCHYSLQKPMGRPPKKRPREDNDASVYEITDNGMWADIDDGGILTEEAGAEATAASDALRLCPPVYTAPMRMPQAFPNLLSTDDSHSHLWQLESGRSLDPIPATTGPWPDFSSVTAATSSPFTLPSSLTLIDSPSVSSPSSDGGNSSQCTCLSYLCLCLSHLSSLAPFPISQHT

SEQ ID NO: 39894 - protein, 182 aa, A.fumigatus
CSLFIAAKTARAVIRCEVCPTSFALGMQNVMSTGTLLNVIADAWLRVSQADAEELGKLAAPPAYVASVTQNSPNPAEAWKDWLRQTVRSAITGGPADPAGQVKCSDSPTLLSLIEEMEARQHRWHRTRTVESPNEPGSCSPVSHEDHREEDMLCFRVIRSARDVIAKFEFAPHEYPEGVVPV

SEQ ID NO: 39895 - protein, 124 aa, A.fumigatus
THAMEPFQVRLNCVDHYQATPSEFDPPLPYRDGAARKYDGWKVPVIRIFGATETGQKVCVHVHGAFPYLYIEYDGPLDPEQGKFRTRCTPSIFFSSGGSSLRNQEAPSLHRPCTGIELSSQCVR

SEQ ID NO: 39896 - protein, 393 aa, A.fumigatus
YDIAELSDHIPVQTDEIMPAESSDRSLHNGKLQENVQKHIPSGKAFHDDTANARRNPKRSHQGVLDSGVPQKKPRFFNDGASHSPDNNPLQKAADIHTVREGPKATYIARTSTSFTASKRVSSQGTPPASQDTHLKNNGQGGRLNFPVVKDPNDPMTIMRLSQDCSPKAIMEFDNQTVSQSLGSAQKSTSGSGTASQSQPLSSGLEPNITNTHVSDLAPKIYDAFNISEGVRICYWRYACPDASEVSATLADHGYLSVIYQKAFYSNNQDVPDRPRDYAGRVSRLEGSSIHYLPDFDPSGRSPAMLGEYASMPRDRYQQEQIDQRLREASTSRVWEFAPVPPSRAEVLEWFDEEQSRCQARPKADKEPESEPQLHPKIHSQIEGLNSKERLRV

SEQ ID NO: 39897 - protein, 518 aa, A.fumigatus
SEFSEPQKLAKRFASTYMAHFLIYTLSTMGLLTLNKVSSERVALQVFFSHQAAVRSAIRRLHLSIDHALALNYRRNAYDKKTAFVAHITLVKGVPFYGYHVGYRFFFKIYLLDPVYTTRLADLLLQGAVLKRPMQPYESHLQYVPQWMCDYNLYGCAYMKCSKVKFRSPIPEYYELSNLSHRWHDRSIQPDCVSDATVLPKQSHCPLEADVCVHDILNRVDIKERPLHQDFTEMLKPIAQKERLVPSMAGLWQDETRRRKQRMGLVDPGSSPFGPEELMSFSADPRNNSEGGWIHEDEFRQLMSQIVEEERKQNNENVTLDNFLQEDPLEKRIKTALQSVEDFFPDKIELTQMEMRQSLIAVDGDGEAQVNENAALSADADIDFYSSVDYYISNPLSDDHGAIEEVVDGIDESTGDDIFDMTLQSFRTIFRCKRMRLCRLNHRIVHCTMENYRKMFRSTFPVARLFMMTLRMQEGILRDHTRAYLTLVFPRRNRGSSMTVHLTRRITTPFRKLLTFTL

SEQ ID NO: 39898 - protein, 928 aa, A.fumigatus
  UNSURE (905): Identity of amino acid sequences at the above locations are unknown.
GKPPPLEYGSLLPYPQAVQKSWNGSTKNNPGAKRGRKQIKSQNPSHNCTPKFIRKSKDLTQKNDYGFKYSQKGKSTSVEHQTQYMSSMSLEVHVNTRGVLLPNPEEDEISCIFWCIQSDDQDVDVNGNLPGVHVGMIAQGSGDGPTSKLSKALRIELEHEPTELDLINRLVDIVRYHDPDIITGYEVHNGSWGYLIERARKKYDFDICDELSRVRSQAHGRFDKDADRWGFNHTSSIRVTGRHMINIWRAMRSELNLLQYTMENVVFHLLHRRIPHYSYRDLTAWYQSGKPRDVLKVVQYYVSRIQMNLEILESNELIPRTSEQARLLGIDFFSVFSRGSQFKVESLMFRIAKPENYLLVSPSRKQVGQQNALECLPLVMEPQSDFYTSPLLVLDFQSLYPSIMIAYNYCYSTFLGRVRLWRGRNKMGFMDYKRQPRVLELLKDKVNIAPNGMMYVKPEVRQSLLARMLAEILETRVMVKAGMKMDKDDKALQRLLNNRQLALKLIANVTYGYTSASFSGRMPCSEIADSIVQSGRETLEKAIALIHSVERWGAEVVYGDTDSLFVYLKGRTRDEAFGIGEEIAKAVTDINPHPIKLKFEKVYHPCVLLAKKRYVGFKYEHRNQKEPEFDAKGIETVRRDGTPAEQKIEEKALKLLFRTADLTQVKRYFQKQCAKIMQGRVSIQDFCFAKEVRLGTYSERGLLPPGAMISTSKMVEDPRSEPQYGERVPYVVVTGAPGSRLVDRCVAPETLLHNAELELDAEYYINKNIIPPLERIFNLVGANVRQWYEEMPKIQRIRRIEGAASAAGKDAKGKTLESYMKSSSCIVCKSKLDHIGIPVCSDCLQQPHISLLSLVSRQQQAEKRVSDLHRICQSCMGVPSGDDVICDSKDCPVFYSRTRHLASWXHTKATLAPIIKLLENQRESALEW

SEQ ID NO: 39899 - protein, 466 aa, A.fumigatus
LIPLLSPIMKERQINPRYSRDRVKFNCLARKWRPQLSISTSFKLNVTIRLISSAPSLLFLTSFANIHTMSRKPADVASKERNEYIPSFIAKKPFYIDDESTANDYLEHQRLQKQATDQSKWYDRGKRAGPAATKYRKGACENCGAMTHKSKECLSRPRKLGAKWTGKDIQADEVVQNVELGWDAKRDRWNGYDPSEYRQVIEEYEELEKLKRNTKPGAQDGKKIMDGELDDEEAAIEEARYAEESDMGRQQSTATRNLRIREDTAKYLLNLDLDSAKYDPKTRRMVDMGAQDDQAAALVAEENFVRASGDAAEFERAQRYAWESQERGDKKIHLQANPTSGEILRKKEQAETEAKRQAQRKALLEKYGGEEYLKPTPLRETMVIENERFVEYDESGAIKGAPKNAVKSKYPEDVLVNNHTTVFGSWWHNFQWGYACCFSTVKNSYCTGADGKAIFTHRPGRTAKCA

SEQ ID NO: 39900 - protein, 127 aa, A.fumigatus
NTFNPMDSATTGRSPQAVVLPVLSSIAVVVSIPPIILHWKNRNFPATALIGWFLLINTFNIINALIWPTDDVDSWWDGHGLCDVETKVMIASYVGIPGTLVCIFRSLGLCARHQKRYARPQHRPTLA

SEQ ID NO: 39901 - protein, 115 aa, A.fumigatus
RAMLAYRGLWSVSSEAWASVLDTRSAMLVPSIGQRWRDRLMDFSFCVIIPVIAMGTHILYQRSRYLILTISGCVNNFDQSWMSLMLAFIWPPIICLLAAFYCGMNMAPSSFSAHD

SEQ ID NO: 39902 - protein, 1886 aa, A.fumigatus
EAQKAAMPPEHLRKIVKDIAAVSQKKFTTEKRSYPGALKFMPHAVLKLLENMPMPWESAREVKVLYHVNGCLTLVNETPRVIEPVFHAQWATMWVCMRREKCDRRHFKRMRFPPFDDEEPPLSWSENIEDVEPLEPVQMELDESEDAPVYEWFYDHRPLLDTPHVNGPSYKSWNLTLPQMATLYRLSHQLLSDVVDQNYFHMFDLNSFLTAKALNVAIPGGPRFEPLYKDIDPNDEDFSEFNAIDRIIFRAPIRTEYRVAFPFLYNTLPRSVKVSWYSHPQVVYVRADPNLPAFYFDPVINPISSRSVAPKNITVSHEDEIFGPGNNEDDFELPPEVKPFFADEELYTPDTASAIALWWAPHPFNKRSGKMVRAQDVPLVKQWYLEHCPQGQPVKVRVSYQKLLKTYVLNELHKKKPKAQNKQNLLRTLKSTKFFQQTTIDWVEAGLQVCRQGFNMLNLLIHRKNLTYLHLDYNFNLKPVKTLTTKERKKSRFGNAFHLMREILRLTKLIVDAQVQYRLGNIDAFQLADGILYAFNHVGQLTGMYRYKYKLMHQIRSCKDLKHLIYYRFNSGPVGKGPGCGFWAPAWRVWLFFMRGIIPLLERWLGNLLSRQFEGRHSKGVAKTVTKQRVESHFDLELRASVMADLMDMMPEGIKQNKVNTVLQHLSEAWRCWKSNIPWKVPGLPAPIENIILRYVKSKADWWISVAHYNRERIRRGATVDKTVAKKNLGRLTRLWLKAEQERQHNYLKDGPYVSSEEAVAIYTTMVHWLESRKFSPIPFPSVSYKHDTKILILALERLREAYSVKGRLNQSQREELALIEQAYDSPGTTIARIKRFLLTQRAFKEVGIDMNDNYSHINPVYDVEPIEKITDAYLDQYLWYQAEQRHLFPAWIKPSDSEVPPLLTYKWAQGINNLSNVWETADGETNVMIETELSKVYEKIDLTLLNRLLRLIMDHNLADYITSKNNVQLSYKDMNHTNSYGLIRGLQFSGFVFQYYGLMIDLLLLGLQRASEMAGPPQSPNDFLQFRDRATETRHPIRLYTRYVDKIWVFFRFTADESRDLIQRFLTENPDPNFENVIGYKNKKCWPRDCRMRLMRHDVNLGRAAFWDLKNRLPRSITTIEWDDTFASVYSKDNPNLLFSMCGFEVRILPKIRNQNEEFSVKDSVWSLVDNTTKERTAHAFLQVTEEDIQKFNNRIRQILMSSGSTTFTKIANKWNTALIALFTYYREAAVSTVNLLDTIVKCETKIQTRVKIGLNSKMPSRFPPAVFYTPKELGGLGMISGSHILIPASDKRWSKQTDTGITHFRAGMSHDEETLIPNIFRYIIPWEAEFIDSQRVWMEYSQKRMEAQQQNRRLTLEDLEDSWDRGLPRINTLFQKDRSTLSFDKGFRLRAEFKQYQLMKSNPFWWTSQRHDGKLWNLNAYRTDVIQALGGVETILEHTLFKATAFPSWEGLFWERACLAKGTRLLRYDGSEIEVQDVKEGDLLLGPDGGPRRAFNIVNGKDRLYRIKIGGSKEDLVVTPNHILVLHREKRARNVYTGPSVQGHIQRSENGHGNLPMLSSSPAAAHHPNNLVKNRGDFWSALKSAIAWVLHAERSSTGANMVRNVLNGTVGLTAHKESYTVTNPQQKGVYYTYVWGNPQRTSIKGHRDHPPVFLPTKEDAFSAAIAKSRELYSQSEVTLATLRQRFLAKSADGKGGEILVDANLPNIFLLWDKNRSNLKFRVLCSRNFKTYGRVYTFESMPSTNAEEPGYGDDDELPQVSAEERYDTVEMTAAEFASLSTEERSRYRVFRCPGFELPEQPVPVNPYFLGLWLGDDNHEKTTNHNIHEENVREFLVNHAAELDMYLAWQGLIDYATVANPAPMMVRLPPTNPDTIEHRPVVCQAR

SEQ ID NO: 39903 - protein, 187 aa, A.fumigatus
RELPSNTETALRSEAEASSISAILDSKAGHSSLDTGDPNSDVVPESIPNDVADFGLDGVPELTSSGFSELTSDSELMRLIEQVERSSQGSTEEPSQASVVEQEADLNLLETDSEDEEADSADDDEFGDPEASEFRPEPESQLSQSHFSNRRRNHRLRTGRRVYGDLNGEEEGILLDQIVEQSEGQSC

SEQ ID NO: 39904 - protein, 115 aa, A.fumigatus
AIIPKASSARRSELTRLPFRLLHDLVKKYTFLLAIQISVYSTTCSQAVVPPTIGEVRLGKLAFWLRPKFGSLWVSKLIIVSAVGFLVLAIGFKQIEISFLFYHRSLAWFFRRTLA

SEQ ID NO: 39905 - protein, 118 aa, A.fumigatus
ESEANSVCRSVSQQIILQELEPLFRMKLSLSVALSLAAATAQAATQFCDQWGSVTEGNYILYNNLWGQAQATSGSQCTTFESLSGNTIVWNTKWSWSGGQGQVKSFANAASCSSPPRN

SEQ ID NO: 39906 - protein, 155 aa, A.fumigatus
  UNSURE (135): Identity of amino acid sequences at the above locations are unknown.
LDLEVEVRQSLQILRGCEADDNSYSGSNIVADVAYDMFLSTSPGGDHKYEIMVWLGALGGAGPISSTGSPIATPTVAGIKFNLYLGPNGSMQVYSFVAQSTTNSFSGDMRDFFTYLESNQGLSSDLYLVDVQAVXEPFSGSNAVFTVSDYSVSVA

SEQ ID NO: 39907 - protein, 335 aa, A.fumigatus
RDTSPPNKDHCQHLLSALLAPFTIGKSTSKTKTNTRYYFCLFNFGLLTFFNNKHQFRSLRSRYYFLYFRCSHHHKHQQLQRHHNSITMDVPVALNRAALNDFVTRPVSREMVAYLAQQASLVIRCESHVTSAVSRHGHPTPPSTPPLDGLPPLPSLETFIISLVTRSQVQVPTLMTSLVYLARLRARLPPVAKGMRCTVHRIFLASLILAAKNLNDSSPKNKHWARYTAVKGYDGFSFSLPEVNLMERQLLFLLDWDTRVTEDDLFLHLEPFLAPIPPRFDAQEREAELRRPQQPPQQHYREWRRPPCIGRTPWYPVCFAEKVEGAWRRSPHAWV

SEQ ID NO: 39908 - protein, 130 aa, A.fumigatus
  UNSURE (1): Identity of amino acid sequences at the above locations are unknown.
XYTTTSTMPSKSSSPQSNSTRKNSCGCCCFSVRKFGFLAVFVAIFAALYSYLDARLEQFYIFNPEHLHDLSQRAIQAHGNDTRAMVDFIVAELDQKIPGNHLNKNEEWIFNNAGGAMGAMYIIHASKFVQ

SEQ ID NO: 39909 - protein, 85 aa, A.fumigatus
DAPASKPIREENKQNPMPGELIQLTKDLLTVYGVDSKYTRAPRTPAFLFFLPSLIIPIITPLVKPLFVPGFCQLFQLSILVSRLA

SEQ ID NO: 39910 - protein, 79 aa, A.fumigatus
YKLGTAIGTEGHTGRHTADDYFNILQGTQVAFVPGTFEPEVYPPGTVHHLRRGEVKQYKMEQSCFALVFTTGVDGSALA

SEQ ID NO: 39911 - protein, 80 aa, A.fumigatus
LIMLNCIINTINVHQPLSTSLDLMARRVFPGQNVAFGLSLFLFTFMFLPTLVMLLAVIVFFAFYYPQLGKSTAAQNDDYE

SEQ ID NO: 39912 - protein, 106 aa, A.fumigatus
TAFHASWSNSASADRNTLKVSRGTSVVSIVLISIYVYDSHIVQVLLLVYILYIIFQLKSHSYLYASIPQRIIDEESHPGVLAEFMNSSSDSSKHSSDDSDEPSTSW

SEQ ID NO: 39913 - protein, 178 aa, A.fumigatus
PADTYQAVEVFQNLIHNLKAAQLQIQVRHGYGSSLLVCVRVPRDHLGRMIYESRYPPPVYTQLASPTNFIRVKDWLYGIVHELPVASDHAVAETPAEELRSVYHAVTWQRHLGGAGITPGIGQWKNIASAFPLHDQAANAELLRNMSRSLTLTDKDLDAIRALFGEKVCDHKNGDNQS

SEQ ID NO: 39914 - protein, 65 aa, A.fumigatus
PITAPHLVINHASLFYLSTAGMVAVIECHPGVTLSCCPTQENCLCNPLSYNNTCDWSRLSFRVTI

SEQ ID NO: 39915 - protein, 252 aa, A.fumigatus
SPTHCQLARMVIFFGTVQAGIRAFIVDNAPAHQQESANAWASRLTGVGNILGYIFGYLDLPKIFPFLGNTQFKVLCALSSLVLAITLSISCSYIHERDPRLEGPPSKDSQGLVGFFRQVFKSIKFLPPQIAKVCQVQLAAWVGWFPFLFYATTYIGQLYVNPIFDQHPNLSEDDINKAWEEATRIGTFALLIYAIISFIANMILPLFVVPTYRPITWAGAGLPGYSRRRTNPVYPEGCQSQVCPLVSPQNPP

SEQ ID NO: 39916 - protein, 409 aa, A.fumigatus
LTGLGIVSLLFCGITMKHYAYYNMSRRTQLTTKYLFQVMAQLSENFIFIYLGLDLFVETNLQFKPLFILVAVFGICLARYLAVFPLSKAINWFIRYRARRHGLEVADELPFAHQAMLFWAGLRGAVGVALAAGLTGVNAPALRATVLVVVVLTVIIFGGTTARMLEILGIRTGVVEEIESDDEFDIEVTHGGTYYKRSDTGLGYTPRRTDSTIPLDGIQRASLGDRVGSYSSGNNRRPSPPPSTRGHGRMYSKAYRSKDGRDKSSMATLLGNGAGMHSDSSAASEDEFGLRADGRGRGASEPDQVDAFDLDIDDGASDDDLPPSAPTAASRMRRSPSQAQNLTPSQAAPSNGASPARRETGLSAREALRDLFSGGPSGDHAAWFRQLDEDFIKPRLLLDQSNHKGPGAV

SEQ ID NO: 39917 - protein, 162 aa, A.fumigatus
LCVQRSPGLVVTEAYADAHDVDGFATMLLSLVSIARDGEWTASRPVVYATYVACVVVHGLITTFFARIMPKIQTLCIVSNIGLVVATVIALPIGKAINGGPVNPGSYVFRHTDNLTTWPSGLGVYACVGSSLSGQLAPLDSGFIITRRLLMATLAGPVGFLW

SEQ ID NO: 39918 - protein, 347 aa, A.fumigatus
PGVFVLQGEQPTRMSPMTVRAWISYIQKPLGSVADELFQMPPDAGKKRVLQLLGSFSSWIMPVDVWPCLRVISCNKRRSSGFMKQFCRSLLVCLTLFLLFVSSEGRRSLMRINAGMFVGLIIRLSPESPIQDSVTFDYQFFFNLLLPPIILASGYELHQANFFRNIGTILTFAFAGTFISAIVLGLVLFIWTRIPLDGLNISFVEAISVGATLSATDPVTILAIFNIYKVEPKLYTVIFGESILNDAIAIVLFETAQKYAESDAGSLTILNLFEAIGLFLLVFFGSMLVGMIVGIMTALGLKYTHVRRMPKIESCLIVLIAYASYFFSNGVHLSGECLCDFLHRPGN

SEQ ID NO: 39919 - protein, 68 aa, A.fumigatus
PFLLISASRLSCIVDSSLNHQTMAEKSRAMDAKSKVAQTVDPDIAVETGDMELLGVWHGVPSTMRICC

SEQ ID NO: 39920 - protein, 115 aa, A.fumigatus
WIWILPATLGYKQELRRHYSTTQIFAVAFSIMGLLPSIASTLSFSLPAGPVGMVWVNYLHELQCGFLKCPLTSDRVRALGHCLWVHSFSGIDSLSIGWLVASVFIFIVGLAMVRV

SEQ ID NO: 39921 - protein, 138 aa, A.fumigatus
PYLLSLGMSKALLAFVWIAGPLTGTLVQPYIGIRSDNCRIPWGKRKPFMIAGAAATIVALLALAWVQEIVGGALGIFGVDPASDGTRATIIFLATVLMYCLDFAINTGKHMISNPLSVGADGNIFRYSSGRYSSIHRR

SEQ ID NO: 39922 - protein, 250 aa, A.fumigatus
ADHVGRSRLTRILQKKNEPCLSRRMSISSLPVGVASEPSLEPTSGKQTESRDESTWLSKLQIPGLTLRRAWLISHVLFAVCMFSTFLISSYQVGSAVIGLVGISWALTLWAPFALISAEVSRIDAERRTRRHQAEMDASPEQYTAANVAGDRGDGADYDEDVENGARPRRTKVEDEEENLAQAGIILGLHNVAVSAPQIFSSLISSAIFKAFQKPRGEPWDDSVGWVLRFGGCAALVAAWLASRVGDRTA

SEQ ID NO: 39923 - protein, 177 aa, A.fumigatus
SNEVARKTKIHRLHTLQVLDLLRGQFDAQRLNVVVQVLDLASSDDREHIRRLGPHISQSNGRHRLDTVLCGHLRESLTHLHLILRLLPWPEHAAQALALLLALLERLFGLKLAAAQYVPRRQGHTKMPRHGDDLALKVPQHHVPPPLVDAEGRLTVCTRTSVRRAHNPRWCVRNPQI

SEQ ID NO: 39924 - protein, 60 aa, A.fumigatus
WRQMAPNGEEVDLIYNSSITTYKIDQTIRRIEMLYYLAETPTTPDDVVRTSPGPHRRSEP

SEQ ID NO: 39925 - protein, 208 aa, A.fumigatus
LEVMAVGPTLGTGLFIGGGQALAAGGPASLLFSYLFLSVLVYCLATALSEIAAHMPAQDGTMVSHAYRYASKPLAFSMGYLRWYSLSMLIPFEITNAIVSLGMVNPSRAVALRVSIPTLIIFGFNMLPERSFKRSEAVFTYLKLITTTGLVFLTIVFAIPGVSHSPVQGFQYWNNPGPMNEFIYDGHLGRFLGLLSSTTGPEGYAQCV

SEQ ID NO: 39926 - protein, 81 aa, A.fumigatus
QGTPDRPDMSSGFTDFDAGHRDLVTVTKFNFYGNRIVTASSDHRMKVWDQKDGEWHLIDTWRAHDAEIRDVSIRFMGPLRR

SEQ ID NO: 39927 - protein, 297 aa, A.fumigatus
QATWNGPFTGQHIGSVGEDMKCKIWQEDVTQPPNSGRRFRSIFRMTAPQRHPFVSMDFRNIDLETWLAVITRDGYLMVMEPVSPDSLADWQPLDQFRVCTAPQRGEETSFKVQFHHDPTDITHLVNPSWDRKSLSLVVAAMDSVKVYRTDANRRFYHAIELTGHGGLVRDISWANGSVRGYDLIASGCKDGFVRVFEVYTSMSNSGSQTTNGSHVESQSQSPSLRATAQSGIGSALANRTPESVTNRPATGDSQFKHSYKEVACIDSKHLDVWQVEFSYAGEFSGHSWKPIPGMPLN

SEQ ID NO: 39928 - protein, 86 aa, A.fumigatus
PEASPRIGRLGNVFLPDFALHVFPYTAYVLASKWAIPRSLLQMSILSTQWAHEADAYITDFSVMSAPGIDQVPFTIFLIPHFHAVV

SEQ ID NO: 39929 - protein, 361 aa, A.fumigatus
DCSCREWSLSPSLSTLQGPSCEFSYHAWLTDMLKLASYLSGLLSLQCIVILGIGDDLLDIRWRHKVLIPAFGAIPMLIVYFVDFGVTHVVVPVPLQPYLGTFVDLGRAVLCEQGRLMPIFCPNAINMRAGITGVKVAQSLVIAVLLVANDLLYIAPTTPFPHPATDSHLFSLYFLLPFIGVSVALLCHNWYPSKVFVGDTYCYFAGMVFAVVGILGHFSKTLLLLFIPQIFNFLYSTPQLFHIIPCPRHRLPKFNAMSGLLDASVTEWTVPPGPLVATGLEILHRMRLIRITKNEEGEIVESTNLTILNLWLIWMGPMREDRLAWHMVMVQTACGALGLFVRHRLALLVFQQDNRAFRYGV

SEQ ID NO: 39930 - protein, 74 aa, A.fumigatus
FARPETMGAVCAVVYLLALIFFIPFAFYKDIVAATSGGGNRDVVLEIAHVENGRFLHRFPHSKVRPASSPITLG

SEQ ID NO: 39931 - protein, 395 aa, A.fumigatus
LYCYQHNNNLNMSEFFRPAPEPRTELGRYRILSSTAGIRVSPLQLGAMSIGDAWSDFMGSMDKESSFKLLDAFVEAGGNFIDTANNYQDEQSETWIGEWMAARQNRDQLVLATKFTIDYKAHALGKGNAVNHSGNHRRSLHMSVRDSLKKLQTDWIDILYLHWWDHTTSIEEIMDSLHILVEQGKVLYLGISDTPAWVVSAANTCARAHGKTPFSVYQGRWNVMLRDFEREIIPMTRHFGMALAPWDVLGSGKFQTKKALEERKKKGEGLRSMFGPGEQTEDEVKMSEALAKVAAEHGIESVTAIALAYVRAKAPNVFPIVGGRKVEHLHDNIQALSIKLTPEQIEYLESVKPMDLGFPSNLIGSDPKVTGKPTLLLAATAPFVFETGSKPIGQA

SEQ ID NO: 39932 - protein, 168 aa, A.fumigatus
LGQSITIDASADSIGSGKTTFAKSICSAYPSFTRLSIDAYVYSHHGLWNVDYPKEHYEKYQEEAEAALRQQLVHILQHDDANVVLDFSFAFREDREAWKALISEFGGRWVLVYLNVDPTEIRRRVAARNALIDKDGDSAFYLTEDLLERYINGFERPVGEGEIVINLD

SEQ ID NO: 39933 - protein, 72 aa, A.fumigatus
MKTSGTYKFLENYVQNSVSDPLRPGALGLGQSKASLLVNIFLIISYMTPMAAGILADGYLGRYRTVLLSMTY

SEQ ID NO: 39934 - protein, 63 aa, A.fumigatus
VLTCFSLYVLGVAVLFATSIPSMLHRGAGLPGLIVAMILVSLSLGGIKASLPPHAWYAGPPTC

SEQ ID NO: 39935 - protein, 246 aa, A.fumigatus
AEERLVCLPCIVGTRVCISKDHVLTDRSTPFVIFWLCQAQMTTNTVSQAAEMETHRVPNDMLPNLNSITVIIALPLVTKFAYPFLHRRGIPTPPLRRVALGFFLEALAMGYAAGIQGWIYSSGPCYEHPRACAASMNGSLPNHVNIGYQSPVYVLEGLSEIFASPAGYEYTFTKAPKSMKSIIQALYGLTAAGGSIIALALTPTNKDPDLLGMYAGVSGAMFVAAVIVMVVSYKHEGRTARDDDSS

SEQ ID NO: 39936 - protein, 72 aa, A.fumigatus
SSSACPLVELKLRFPPMLGTRVPRHAKNPRLTSTIAEQCSKIKQRIRITKKGERVIVDPDVTLEYAFDVYYC

SEQ ID NO: 39937 - protein, 62 aa, A.fumigatus
ALVNRVEKAAMGHLTRIFIETYEICEKYDNPFKDFKLPSSSSMNDDSLPNVGLPDAQTGLPW

SEQ ID NO: 39938 - protein, 358 aa, A.fumigatus
QLSAFQSLKTQAPPAVNNNHHQYIEAFRSDKMTDIENIANLIKSGQVHKIVVLVGAGISTAAGIPDFRSPETGIYDRLKPLHLPYPEAIFHINYFRHTPEPFYAIARARHPRSLKPTITHAFLALLEKKGLLHFVFTQNIDGLERDVGIPEDKILNAHGSWRTQRCWKCKTPYPDDLMKQAISTGTVPYCQVPDCGGAVKPDIVFFGQPLPAEFDEKEKEVSEADMMLVMGTSLKVAPCSRLPRLAREGIPRVLVNREKVGDFGKRAEDVSILGDCDDGVRKLADALGWTAEMESLWKKAIAAKEAAQEDWGEEESLDELIDRYAKTLTDARKISAGHKRMLEEHLENKFAEVLKKST

SEQ ID NO: 39939 - protein, 68 aa, A.fumigatus
WIDLVTCHGAGHQDNRARIRGSALNGRTKASYSIQQTAHDANVYLAENAIENARPIVGDQYMFKKFNV

SEQ ID NO: 39940 - protein, 180 aa, A.fumigatus
PVRVNKKSQILNYVLFFRTSANLFSRCSSNIRLCPAEIFLASVSVFAYLSISSSRLSSSPQSSCAASLAAMAFFHSDSISAVQPRASASLRTPSSQSPKMDTSSARFPKSPTFSRLTSTRGMPSRAKRGSLEHGATFRLVPITSIISASDTSFSFSSNSAGRGCPKNTMSGFTAPPQSGT

SEQ ID NO: 39941 - protein, 87 aa, A.fumigatus
NADNCQPSMIINHHGNPVWASGNPTLGNESSFIELDEGSLKSLKGLSYFSQISYVSMKIRVKWPMAAFSTLFTSAYSNPSDTSWMVG

SEQ ID NO: 39942 - protein, 81 aa, A.fumigatus
NTYTLCVDIHFIPFSETQAIATFLLFSLTDPYPLKPQPPQHWETLTMAPSVLPFRDINLHASPSHYAFTSPSSPNAQTLVV

SEQ ID NO: 39943 - protein, 93 aa, A.fumigatus
TRDARNDKEDLTRGWPATRLSYNIIYGRESRECMRSSTMFTLDYTQAAQSSICSVLYCQCIGPRPGPLNNVTGLQLRLRKLSKSRSTQKNQRK

SEQ ID NO: 39944 - protein, 225 aa, A.fumigatus
  UNSURE (129): Identity of amino acid sequences at the above locations are unknown.
YTSQSSNLSSFYDVSQSRRDVLIFLKILHRDVLLLYINAVRSLLKSCHPNHPLTSASPVNSQERYASSVIMSPRYTAQPTEQTTQCTDSAMQTREDGKTEPTDTYEFAHVLFEIKTSPKKLAPILLESXHHRLHHSDVKVYPSFDVLRADSAIKRGNVVFALPAAGQTVDQIILAVRRQVQHLIMDWDTEELSGEGLYLVTGDKTCPWGWSFLDYQAWREQRKRR

SEQ ID NO: 39945 - protein, 316 aa, A.fumigatus
QSTSWWSCNRSSEIYLDYSIVLYKLRKPRLSWLVFLLPEIRVWGLMTFAGDHQNDIKVLAPAVSYTSAHDASSMPQSLYLSSSSIPENHIARLSTETAAHDIPSNPSYGIDSPLGLIASNVLSPFYLYATLKGKFQVWDDLLAHTPQETFRAPTLDLGCGRGLVLLKIAQIKKRLASSESPVPPAYGIDLFVKGDQSGNAPLATYKNAAALGVCEQTVLHTGSVADLPFCDGVFSLVTASLSIHNADKATRKKAIGEAARVLVSGGYLVVVDMAGYVEEYADLVKQMGWTDVSTEFGGVRIMYGAWPCRILRARKP

SEQ ID NO: 39946 - protein, 341 aa, A.fumigatus
RNAHSPLNTMKLFLLLLISALAAAAALPSSFKWSSSGPLVEPKKDGRNIAAIKDPSIVKVDGTYHVFASTATKSGYNLVYFNFKDFSQANQATFHYLDQTPIGSGYRAAPQVFFFKPHNLWYLVFQNGNAAYSTNPNIANPAGWSKPKNFFSSMPSIIAQNKGNGNWVDMWTICDSSNCYLFSSDDNGHLYRSQTSLANFPNGMGNTVIALSDSNKNALFEASNVYHTGNGEYLLLVEAIGSDGQRYFRSWTSNSLTGSWKGLANTEANPFARSNNVAFSGTPWTKSISHGELIRTQTDQTMTISPCKLQYLYQGLSPSAGGDYDLLPWKLGLITQTNSNC

SEQ ID NO: 39947 - protein, 197 aa, A.fumigatus
SSSSFFSSPPLRRRRPCPAASNGAPAGLWSSPRRMAATSQLSRIPPLSKWTGRTTSSPARPPNPATTSSTSTSRTSARPTRPRSTTLTRPRSARAIVPRRRSSSSSHITCGTWSSRMATQRIRPIRTLPTRPGGANRRISSVACPASSPRIRAMATGSTCGRSAIQATATCSPRTTTAICTARRPRWPTSPTAWAIQ

SEQ ID NO: 39948 - protein, 422 aa, A.fumigatus
PRRISGTRLAQVFAAVLVLFLIFLLGAYKASSGFRASHSSQHLLSNGSALFGPTTILISLDGFRADFLDRGLTPTLNALIAEGVSPPYMLPSFPSVTFPNHFTLVTGLYPESHGIVSNTFWDPALKENFHYTNQSISMQPKWWNAEPLWMTAEKHGLKTGIHMWPGSEAHIGGVDPTFLDKYNGSEKLSRKVDRILELLDLTGAEEESLMVPERPQFIAAYVPDVDADGHKFGPNSTEIRHTISQVDSMLAELMSGLRSRNLTDIVNLIIVSDHGMATTATERLIQLDDFIELGLVDRIDGWPLRGIRPRKPEDLEVLQKQLENLTLQYPQAVEVYTRETMPERYHFSRNDRIAPLWVIPKTGWAIVERPDFDAQEAIRTGRVYHPKGVHGYDHEHPLMRAIFIARGPAFPHPPNSPAGSFP

SEQ ID NO: 39949 - protein, 139 aa, A.fumigatus
ANMRAENINVYNLVCDSLGIDPLPNNGTMRLPLQPVGFHSDEDAPIVDKPADPPISSASMSVIPSQTTTPASTSSEVPATALLAQPTSPSENEPSSEPQNEPESDDEQGPTWWGTLWSKVEEIKEWATDMIETVKDNIA

SEQ ID NO: 39950 - protein, 258 aa, A.fumigatus
SSFLFFDFSSFFSRWMAVPNMASYLDSNISNNSRNATTTTFDTAVLDAFIPGYSILSRFLVSYLQIDLSYYLPFLVMAAAVTASLRYTIKRIIHLLGEHFTSTAEIRLDDEIYNYLMFWMAQQPFTKRTTHFVAGTKISSGMRYWDSDNGEGSDDEDICDDDDDDNGSAGDNSDTLANFDRYWQKVISKDKYRTLRFTPAEGTHYFWYKGRPLAFIREREENNSGMSLRWVPERLYLSCLGRDRYSVFTHRGRKVPRS

SEQ ID NO: 39951 - protein, 200 aa, A.fumigatus
GDDYHLWSTEYAGCHQHLNPHFCNLYTVYVVTKDLSCTAMPPRPDLLSPSLLSPGDYDDDASSLRSLSEQDSDSDDDEFLRKARTTLELAEHDRAVLEEEEEMEKLLVRSGPAHGLRRIFSPNGSSVKIGKYERNRDRRRKRHDERKRRRRSAVGENGELTYEMEEGYRESESSLLSGSSSELDQRLEKQYASIRVRADF

SEQ ID NO: 39952 - protein, 132 aa, A.fumigatus
WVVSSLSIVMVSSSGMLNSLRPSGWAFFVGLLQAAYTLTGYGMVAAMCEEVQNPHREGPQGNCPFGRRRRYHRSHLPDPHSLRSADREGLPSVWPVPNPSASSSRQRLARPVVGSACCSSSSVLPCSPALAP

SEQ ID NO: 39953 - protein, 91 aa, A.fumigatus
AFAAHCLHCATDLPTWVLPLLLCDCFCDDAFPYLLLLALTVFSLTPVVLIHRAGSLKHDSTHWTYSSLAIMRTSHSTRPEANLKKSSKEIK

SEQ ID NO: 39954 - protein, 194 aa, A.fumigatus
SVACPNSSFAIMAAPFGLSTTMYITLTDGQSVTIIWGWVLVTLISIAIAASLAEICAVYPTAGGVYYWSAMLSTKEWAPMMSFIDGWLTLVGNWTVTLSITFSTGQLILSAISLWNEDFVANAWQTILMFWAVVLVCAMVNIFFSKYLDLINKVCIFWTAASVIIILIVLLSMADNRRDAAFVFGHYDASDSGW

SEQ ID NO: 39955 - protein, 195 aa, A.fumigatus
  UNSURE (183),(188): Identity of amino acid sequences at the above locations are unknown.
LNPTEGDVEGVMDRPVGNTADVYAECEKWYAGPFAFLFAGLIGPMLIRRRDAWYAQRGLSRTEAKRRYISTLIDTMHRYASQTPEARELVAELEFVWDQIKSNTSSSSSSSPMQNVGVPPLPQPNYASIGGRLARPIYEDIIATARDNHSRERNHGDSRLRVLSPVSQPDGLYERRGHKDLGXSRRGXPDPKIVK

SEQ ID NO: 39956 - protein, 98 aa, A.fumigatus
YNSGTDLKTLLHHLLDIAEAMHAATVDASADAALARMGYKSELPRNLSMLSILGLCVILQDVFSLRGTGAATDRSHVQTVPLPSWPRPSVSAPPCTSP

SEQ ID NO: 39957 - protein, 240 aa, A.fumigatus
RTSFSVASAQPIGLIFKTATGSAGGGFGLLFLILGIAMFAGIGSLTAASRCTYAFARDGAIPGFRIWRKVNKRLDVPVYAVLLSAAVDCLLGLIYFGSTAAFNSFTGVATICLSTSYGLPILISMVRGRRDLKESTFSLGAFGYAINAVTVCWIVLAVVLFCMPVSLPVTASSMNYASVVFAGFATISIIWYIVYARKHFTGPPASAEEVRARPVMTGKAVVDAENAYSDGSMSSKKVEQ

SEQ ID NO: 39958 - protein, 294 aa, A.fumigatus
RSYCGDTYRNRWVLDGYLHLHQAQKELSTQKKETSTTAGRSLLHLLGGHRSIRICILGIYNRFSCHHRPRPYFFGRRRWSSEMLAGIDNVPNDADCREPREHDAGVVHRAGSYRQGDRHAEEDYRQDDPAHCNSVDRIPECSEREGRFLEVPAPTDHGNEDWKTVRSRQADRGDTGERVEGRGRAEVDQAQEAVDRGGEQDGIDGHIEALVDFAPDAESGDGPVTGKCVGAPAGRRQGANAGEHGNTEDEEQQAEPTTGRASRCLEDEADGLGTGHTEGSPSRSAERREWGSGR

SEQ ID NO: 39959 - protein, 61 aa, A.fumigatus
AACSKPTKKAHPEGLREFSIPDDDTMTIERLLTTHYPTHRNAQKQTPHPADYPPSIKERSR

SEQ ID NO: 39960 - protein, 66 aa, A.fumigatus
IFLSSLSLMSMEFPYLHSTDNMLDSVQMSISSYIMIMLVQYFQLLNHDYVKKMSSAGQRRSSAICK

SEQ ID NO: 39961 - protein, 357 aa, A.fumigatus
  UNSURE (33),(34),(51): Identity of amino acid sequences at the above locations are unknown.
NGKRTTPLGHFFNRRFDLNFVPMASPLPKHQCXXCPSAAGSEHDLRLPPDXYPTSHNPQVDAIIRTKRKAREPKACYPCHARKVKCDRNLPCDGCVKRDHPDICSYERPSKKRIIASSVPPSYNDSPAGASQPDVAEHTVSAAQEEPHLRIKQEAGASRINSLGFRHRISIAREEWDNVRNRLKEMEKTISNLRAGLERAEEGPGGILETASAHSADEGNRSKAGSPEREGIHAANTLGEGTVHLGSRSVLAYILNNKSGSDQLQALLEGGILPKLGLDNESATYPFVDLWSSDMSTFDISAVCSALPNDQQCKESVLYLWLGCYAPRWMLTGWQIFLLLSRRRRRHLPCHRRYPAV

SEQ ID NO: 39962 - protein, 61 aa, A.fumigatus
  UNSURE (22),(34): Identity of amino acid sequences at the above locations are unknown.
LKSTMSWRCLGSETREFRTGGXGMTLVRLGLRSXGDGGFDGYVLVFLQTLDVTGFSIRGGL

SEQ ID NO: 39963 - protein, 159 aa, A.fumigatus
  UNSURE (4): Identity of amino acid sequences at the above locations are unknown.
SHSXTTGPELPRLAAETSPGHCRFQLHRQRTSWSMTHFTTLLSEPRAKGLFRGVVGRCVMSARLASTICDLRIRDILGTGTVNESMEGSYGNLLDIMQVGKVPLALLDASPRRFVQNGDLPNEASKSGSVDRCISVMKETFQVPVLQYHEAGVDYRFIY

SEQ ID NO: 39964 - protein, 327 aa, A.fumigatus
KNIELFFCLYARHWNNAPQCNSSHSRLLGFFQCLPSIWRALQCLRRYGDTKNVFPHVVNFGKYMFGVIYYATLSMYRIEKMTRFQAPFVTFALLNAVYTSVWDLIMDWSLGNPYAKHPLLREVLAFRKVWVYYAAMVADVIIRFNWIYYAIFARDMQHSALLSFMVALSEIFRRGVWTIFRVENEHCTNVLLFRASRDVPLPYEVASPEVEADHPGEDVQLQDQHATTPLSAPADIEQGTPIPPGLTTHPRGLSRVGSLMATAHAQDFERRKRPDQLTGASATHGPTTTDDTSDEEEDDPVDSRQDTDTDEAMSERLSDANAQISPK

SEQ ID NO: 39965 - protein, 522 aa, A.fumigatus
FFSEQTGKKKVKAIARAIQKTNRSPRHPSLRRTAIGPGDPTITPSGTLRSSPGQTSDNKRLEASNSFRSPSIPIRADAHATTSRSTPGQRDERQPLRVPGSRFSAVLGSYGSIIASPPQHGAASDLVSLELPDPALDPKDDMSYSPSADTIRRGVPKTPSPVMSRCDTNRSLSRDAASKSPAAKFAGSKGSLRNNLAGPSTTRASQILKRVFSHPDWGPPEKRAEADTPVSEVERREDEFFAFLDGELAKIESFYQMKEDEATQRLQVLRQQLHIMRDRRIQEILGTKSKSKKDEAHQSNGFSTLNALSAFHLKETLLGRGRIGKNSEALAQMNSPAALQAQNPEAVSGRRDFMRRPEDSQNDEVTYRFAKRKLKYALQEFYRGLELLKAYAYLNRTAFRKINKKYDKLVNARPTMRYMSERVNKAWFVQSEVVENLMAATEDLYARYLEHGNRKITISKLRHTTNKSGDYSPNTFRAGLLSMAGVLFGVQSLIYATRHLEHSDPSVQVQTSYLLQVSVASQ

SEQ ID NO: 39966 - protein, 103 aa, A.fumigatus
WRLLLAGLYPVEFRDFFLGDMYCSQTYAMGVSSIQCISKDSLLMFERTSSYSSAFMHVTGTMRHNAIHPTPGSWDSSSAYHRFGERCNASDVMEIRKTYFHMS

SEQ ID NO: 39967 - protein, 89 aa, A.fumigatus
QFHLPLCITMNSLTVSPNALSAEIELYRLEQRYARRKHRSTFSGVQYVDGEYVYSNGSNSPTGTVSKHSTGSYWKTPTWGGSGSESRWR

SEQ ID NO: 39968 - protein, 113 aa, A.fumigatus
AIAPWRLNIQETLTNMLLDGVTRIGATLFQELRNAVFASVAQKAIRRVARNVFEHLLRLDLNFHLSRQTGGLTRAIDRGTKGISFLLTSMVFHVVPTALEISLVCGILVSRSN

SEQ ID NO: 39969 - protein, 350 aa, A.fumigatus
TYQYGFQFAAITAATMVAYTAFTITTTAWRTKFRKQANAADNRGATVAVDSLINYEAVKYFNNEQYQVARYDKALKAYEDASIKVTTSLAFLNSGQNMIFSSALAAMMYLAANGVANGNLTVGDLVMVNQLVFQLSVPLNFLGSVYRELRQSLLDMETLFNLQKVNVNIKEKPDAKPLQLHKGGEIRFENVTFGYHPDRPILKNASFTIPAGQKFAIVGPSGCGKSTILRLLFRFYDVQEGRILIDDQDVRDVSLESLRKAIGVVPQDTPLFNDTIAHNIRYGRIDATDEEVHKAAQRARIDALIQKLPEGYQTAVGERGMMISGGEKQRLAISRLILKDPELLFFDEAV

SEQ ID NO: 39970 - protein, 105 aa, A.fumigatus
TSALDTYTEQALLQNINSILKEKKRTSVFVAHRLRTIYDSDQILVLKDGRVAEMGSHRELLDLNGIYAELWNGECTPQEYEGTDWTGANDRLCSARNVSSTRSRV

SEQ ID NO: 39971 - protein, 156 aa, A.fumigatus
TPLHFVTSSLQTIQYDTSGKLAGSTPEERATVNKWLAWQVSGLGPYQGQLVWFLAFHEGAHGEKPNGSVIARYQAEVERLRSVLEKHLASAENGFVALGRLTIADFAILPWLKISVLAGSALKSFEEYPAINAYIKKLDALPEVQAAYKKAVPPMQ

SEQ ID NO: 39972 - protein, 570 aa, A.fumigatus
AFTNCYCACTGSPDHSLPPSSIAKMLSNTITIVPSIETRVVEPLPQFDTSRRLSFPVSLPLDSLAGARKKAANEALVERIAEIIASYRISGPDDRYEVVYKPKLLDTLRYFVSKQEPVNMVVPAYPFKSPNRDEKVLGPDPDVGERMSLEHFNSMGARIQQIYPPGGYVTIVSDGCCYNDLLGVSDEEVFRYAEGLHRIVDRLGLKHIKFSDPFDLIEGRHNVPVTEEEYASRIGELKDYLFRSYHPDGYDFDEELSKDPNAALTYRGYIRFLMSDLALFFKERQMSKNAIKKHCSTVARSMIKRGKAFSALVARASPLHVRLSIHASDNTGKLSVALLPHKRYSTFPVTPWHNTPYLDTTSVSLSLSRKPTDGATPYRLCQDELGLHFLCADVPMYRVIETPDLPALAQQVQFQPLYPFGLRIKVPRGTPIGQFRLERVAELAKVHSPIIFEGLDPMEYTAAIADDFQRVAGGTMSLSILHEGVATTANTARHLGGSAAASYFLQISAATGDDAQPALLPFLAAAAALDDVRYRVLHHWQAGHAVVSDHRVALPVHLSPSSLRVLHGGV

SEQ ID NO: 39973 - protein, 70 aa, A.fumigatus
YSCAGDGLAPGSEVSALSLINAAAAAPMYVQHTGLRPSSTNHWRYSTHGIRPPRKGLAPKHRRTSLRPSR

SEQ ID NO: 39974 - protein, 116 aa, A.fumigatus
EPMTRYEYPRLALISTISGICISSAKSSMQGSIRLPPERTGSSCRDVGMLGVLLHVIGDAVNNLGVMIAALVIWFTEYEGRYYADPGASLWIGVIIILSSLPLRMLSSIRGVVRWC

SEQ ID NO: 39975 - protein, 102 aa, A.fumigatus
  UNSURE (80): Identity of amino acid sequences at the above locations are unknown.
TSITILLLDNNTNRMHRCVRPHPPVTRALRHAKEKLLAAGLKVVDWEPYRHDHGWEVIVRPSSFSPHPLHLLTNKSSHPXTSPTPPTANAPSSPKAASPSSP

SEQ ID NO: 39976 - protein, 202 aa, A.fumigatus
EEEATATIDRDWGGVRRPYSRKFQWLPCDVHFTDNGECRIASYINNLHPNKHRQLYQVIEKILEHTIPLWNTTLTLVRDKYKRIPYNEVQYDEHPEPEPQPENEEDEHSDEYYQRYDEWQKREPIRRPEPGEFAPHVTEAKKQVNLHKDFAERGLQVIIKLANIELTPEKPEYEGGSWHVEGQLVCCFAGAHKHTHTHTHTH

SEQ ID NO: 39977 - protein, 202 aa, A.fumigatus
LSQNEHICASAIYYYDSQNITDSRLAFRQRADTEEVSHISYDQSRHEFLHEIFGLDNEAGWNEGNVTQFLGGVDTRQGRLLTFPNSLQHQVSPFALADRSKPGHRKILAFFLVDPHLSIISSANVPPQQEDWWKERQEVVGKLLSERLPAELQNMVNEGLDATPITLEEAKQYRKELMEERSNKAQEQNRDFERGEFNLCEH

SEQ ID NO: 39978 - protein, 104 aa, A.fumigatus
YIMSVQNWEIRARRAKDVLLNSVPKQWILPAHKLPPAHQKNVEDFPRKSGILSDREVSITEMSATALVAGMGAGLLSAEEVVVAFLKRAVLGHQLVCCATRSDV

SEQ ID NO: 39979 - protein, 80 aa, A.fumigatus
LNFATEFMAERAISRAKKLDEYFKRTGKLVGPLVGWPIMSKRANAPNGESTVAWRPHQRERAYRDQRSNLQCRLCGMVRF

SEQ ID NO: 39980 - protein, 166 aa, A.fumigatus
GTQSIEALTQQTKLSEIDDPPKILAFGWQRAPVLGAFFNGALLFALGISILLQAVERFISLHSSCLPSTCRRLTDILQRSRIPDSCSLLDALAWVLISSALLFFMAGLSFWMCSPVANVKALEKSSHTHRHALDTSTDSSIGAHDEVRIPETCPHFHNFWDLHKLS

SEQ ID NO: 39981 - protein, 74 aa, A.fumigatus
IQGVLSIHEINVWHISQHKSLAVIGVLLTDQQVPGSTKVISMVNECCQKYGIQSVALRQKLHSQELSLAALDRI

SEQ ID NO: 39982 - protein, 153 aa, A.fumigatus
  UNSURE (144): Identity of amino acid sequences at the above locations are unknown.
HLCCDNNLTGPTRNPYNRTLTPGGSSGGEGASMGFKCAALGVGTDIGGSIRAPAGFCGAYGFRPTALRMPATGIKVPGPGQESIHGTAGPLASQSVEDLNLFQRAVIDQEPWETETSLVPLPWRQVKATKNMTVGIMWDDGYSXNLNHYSPLR

SEQ ID NO: 39983 - protein, 97 aa, A.fumigatus
  UNSURE (6),(96): Identity of amino acid sequences at the above locations are unknown.
QVKSSXYFPDAANSQRTVLSQSGEPLLPLTEWAFAYSRASPLSIPENWALNCKRDAYRDTYHALMKSRDVDFILCPVYVGAAGLNQRAGTKCVQIXA

SEQ ID NO: 39984 - protein, 451 aa, A.fumigatus
  UNSURE (390): Identity of amino acid sequences at the above locations are unknown.
DHPNNILLTDSSFIGLLVFWHSYRLLFLVALSTVFVGLRFYRKLQSRTKTTASSSVPPSPRSQSPEKTEKGVSRESSNKATAQKAEQQPALANGSAKPTSGPKRVTGKKPSKVAGRRGQTEDAEPLAFIQPIIFYASLTGNTERYAKVLLDELRVAAQKRADLRDRERGLLPPQIYDLSYVDLDDYFTSAPKPPPTSPGTRYVYCLLIPTYNIDSILNTFLDHLNETHNDFRIDTGPLSSLAGYSVFGFGDKEGWPTEEEGFCSQAKELDKWMAKLTGRKRAYPLGLGDVKSDAETSLKEWSLGLQDILFDILENGGLGEGVPGSGDPVESDEELNDEDTDKDNTQNVMDLEDIKFGGDQNAAGSPIPVDFTTTGKSSSVQSTEKEMVPXTSTTYAALTKQGYTIGGSHSGVKICRWTKSALRAPRFMLQILLVRYPITSLHGGYTVAVLQ

SEQ ID NO: 39985 - protein, 376 aa, A.fumigatus
QNKATRSVGLILESKSAAGLNLRCVPRGSCYKFSLYGIRSHLCMEATPSLSCSNKCVFCWRHGTNPVGTTWRWKVDSPELIFQGVKEGHYKKIKMMRGVPGVRAERFAEAMRIRHCALSLVGEPIFYPHINEFLDLLHGEHISSFLVCNAQHPDQLHALRRVTQLYVSIDASNRESLRKIDRPLHRDFWERFQRCLDILREKRHVQRTVFRLTLVKGFNIDDEVIGYADLVEKALPCFVEIKGVTFCGTSTTAGVGLTMQNVPFYEEVAQFVTALNAELQRRGLKYGIAAEHAHSCCVLIASERFYVNGKWHTRIDYDRFFELLEREKADGTSFTPEDYMRETEDWALWGNGGFDPNDQRVYTKGKKKHMQITAEP

SEQ ID NO: 39986 - protein, 703 aa, A.fumigatus
LLLDRMSSSLSSCTTAESPAKYIAYHVPRIANPSQTTPHPPFGCCHGSGCVVVFSSKMSSSRPSKRQRICRACDQCRRRKSKCDGAQPVCGICRSAGRTCTYEAGGGRRGLPSGYVRKLETALGLVFINIPNSEGILRGLLAECGDAKATDRAVAAWRNSQVNRGISQMLVPGCKETSMEDSVEDEAEWEDLENRDIIPTIESSEPFIPTEEIPLQAQPIIAAEPKDVLDVPIPNNTSDLLELYFTYTHCWFPILERRDLLRAMYTYPLRSTPRDETCHLVLWAVIAYSSVIHPDHNHGRPNSMQIVHSIQRRIPSQLDKLELGHIQALLILVLLHLQVGDVKLAWVLVGQATRFVTMLPTSSKSRFLHTVHACILLDNLASALLDRSPCLSLEEQLVYGPVEEDDVEEWDHWTARNGFTSNGPLRALSMFNAVRQLMQLLTRVLYSPVDLAQLHSLLLQIQEQQAILLAQYSNPRSDSTTPPLLTLHLTAVFVILALVRHCRSPSADMIDLAVETSQRMFDLFDRYVKLAGHQQSPLLRCCFLQCRHCFESYLSAADGPEIGVLKSRLSTYSQEFQMDGIFRHENCPAVIQPADEWRSALTTDPRAGQSLQDGISNSLQRTYATPVSATATASPALAGEADSFDALFEEMANLIPSTRYKSCRLLLFFVLIPRRLEPEFAHNLGFCAGDLDTDFLIQLQQPP

SEQ ID NO: 39987 - protein, 169 aa, A.fumigatus
SGLNGSTLQPEPSSLRTAAMPSILLINGPNLNLLGTREPHLYGRTTLPQLEDNAKALAAAKGVKLESFQSNHEGRIIDRIHEARGHTDAIIINPGAFTHTSVAIRDALIGVSVPFIEVHITNVHAREEFRHHSYLSDKAAACIIGLGTYGYEAAIEYAAREIISAKEVY

SEQ ID NO: 39988 - protein, 60 aa, A.fumigatus
YALQVAYNTRGINKYGGYPWNHGPYSSLSIFIPIHHPLHPTSGLYRSKLTDLGYCSLLLL

SEQ ID NO: 39989 - protein, 480 aa, A.fumigatus
IMSISAAPYREFLRQKEAEFFSLIDQGVISPWLFPHDFLVLIIPLLVLMIPNKGRAWVVVVRRTAFGLVCCLTIRNLLYTRCLTGGGTVIGFYYAFAVPWNSLFLLFKDVQNECSRLERRSNGILYWQGYPDSICHRLSWLLDMFGSLRGAGWNWRIPGLPPLPKIRSKDEQTSTDGKELAQEAPSSTLLRSSIVRTARYYLVMDILKVLTMVDPYFWGLIDAAPLYPLDKIYQFSPALLRLFRAVVTVVWIRTSMAFIASTVPLIISLAVTVCPGFVKWSRIPLNAPWLYPPLFDSFWNFKPVFDYGLDGWWGRRWHQAYRYAFSETARHVVPHLEKTDMARFLRHSVAFLLSGLVHFCAVHSHFVAPDSVHFGAIVFFMLQPLGMLVQRKLRGILFSEGSTLWRAFNIISTYAWLYLVIGPFCDELAAAGTWLYDEACPISIIRGLGLIEGEGWFVGTRRYVRLRTGEKWWQAAIQIL

SEQ ID NO: 39990 - protein, 183 aa, A.fumigatus
STSHMLPQKGTRLVAKVYDPLYFNDDEGYLNPFLCMDKYYTHEANAYMVLRDFQGQWIPNYYGSYSLVLSVDSVRTRTVRMILVEYIPGITMADCEPGNFCQSARLLIRKSIVDLESRIYKKDILLTDLEPRNHYHTFARQGTGLALCLSISAHALFNRQARRILFRSELNAFLEEYISPLLR

SEQ ID NO: 39991 - protein, 184 aa, A.fumigatus
PAILRLCTTTTTTTCDQAKVKSIQKNANSDMQTPESTRTAESSMIHSRKYLPDATLLLIGFFGAGKKTLGIIASVALHRRFIDFEAFFREKTGLSPQAYIAAHGLAQYRTVEEDLTRELLTKCRNGCVIVGLGALASNQQQILLKDFAQDHPVVYVRRAESELRRYMGTSQDKFERFWQFSTRR

SEQ ID NO: 39992 - protein, 210 aa, A.fumigatus
PSSDCHHLPVTSVRLGTFAKEIRLLLPTSIRLNRGNLVLPDLVASANAAALTDMVLLHEHRGTPTAMTISHLPHGPTASFSLHNVVLRADIPNAARGTVSESYPHLIFEGFKTKLGLRVVQILKHLFPPREAGKVGNRVVTFVNKEDNIEVRHHVFVKTGYRDVELAEVGPRMTMRLFEIRGGSLEKGSSGDVEWALTQYTRTSKKKDYL

SEQ ID NO: 39993 - protein, 101 aa, A.fumigatus
RRQARERRDYLYRRALLLRDASIAEKRAQLKASLATGKTLDPSIANDKKLREDFKYDESLETPNKESKDTDYADLDDEYALTSGIIDPRPIVTTSRSPPFA

SEQ ID NO: 39994 - protein, 195 aa, A.fumigatus
LYLPFYSYCGIHNPSSVVKCLACSKWFCSARGNTSSSHIVNHLVRARHKEVQLHPASSLGDTILECYNCGTKNVFLLGFIPAKSDTVVVLLCRQPCAAMPSSKDMNWDTSRWQPLIEDRSFLPWLVAAPSDQEQLRARHLSPQLIAKLEEMWKENSQATFADLEKATAVDDEPAPVLLRYDDAFQLPKTSYGAPR

SEQ ID NO: 39995 - protein, 144 aa, A.fumigatus
VHESNDVPHTYATQAKYSRTGKSTDEILAPPGSDQDAAMAAFTDFFAAKTGKKWENRLDGIPMAPKQDVDGKELPAHAGWFYYETGRSLLSDFLRQGESQSSAMGQGAMQIAVSSNSDDHGPLMPPDSKDGSVDDQAESPPRVF

SEQ ID NO: 39996 - protein, 82 aa, A.fumigatus
QYGFKAGNMYLTGLTLYFIGYVAFEVPSNIVLKRTTPRIWLPTLTLLWGIVATLLGVVQNYAGYLTSRTGKVINIAYAQKKC

SEQ ID NO: 39997 - protein, 84 aa, A.fumigatus
LERGPCLKGPCSPLRRGASTSVALGIAESGLFPGVVFYLSMWYKRNEQHYRVALFFSAASLAGAFGGILAWVRTSQTRGKVTSR

SEQ ID NO: 39998 - protein, 621 aa, A.fumigatus
ISPAIGTFILPGLNQQNPLIPWIVNPVSHDFEMFTRVLIAAGFSRIRVMPVGVDASVTDARAIRVAPAECPEGILTVTSIFPVVATSTNSEQFGQVTGEWGSLFIPFNHLSGHISKVTAVTNHFSVWPSSKPMITDAKSTDLASILLLASLHSRNIHVMSVTSKEDINLIALSKEKGLKVTCDVSIFCLFLSREDFPDCNFLPSAEDQNALWEHMSTIDVFSIGSIPFQLAGKQASPVSGIAESLPLLFTAVSEGRLTVEDIVSRLYENPKKIFELHDQADTSVEIEVDRPYLFQSPYWSPFNGKSLRGAVQRVTFQGKTSCLDGEVTRDAPKGTDMSGHRIVPASPSVKAMSPMVQARPESSLDRRLSISGTPGRSFKQRPADSAANELGPPLYAPVQTSSSLHDLLSRSTFRQKHVISVNQFNRADLHLLFTVAQEMRLGVQRQGVLDILKGRVLTTLFYEPSTRTSASFDAAMQRLGGRTIAISTEHSSTKKGETLQDTVRTLGCYGDAVVLRHPDPSSAETAAKFSPVPVINGGNGSVEHPTQAFLDLFTIREELGTVTGLTITFTGDLRYGRTIHSLIKVLQFYHVRIQLVAPKDLSLPRGSPTDSRRVRTAGARV

SEQ ID NO: 39999 - protein, 132 aa, A.fumigatus
TLLIFDRLFARGYLGSNSTYGDIYVVNPDVAAATGNSLATSDMCPNFKDTSGGTYASTWDKIYLPPITKRLNKKISGNLTLTDDQVSIFPYLCGFETQITGSRSPWCDVFTPNEILQYEYRQDLRYYYGTGE

SEQ ID NO: 40000 - protein, 149 aa, A.fumigatus
RSPLLVTSDMDAPSTLSSKCSSSITCASSWLRPRIFLFPEEVRQTVVASGQLVLESEELTPEIVARSDVLYCTRVQKERFADLEQYERLKNSFIIDNALMKHAKSHMVVMHPLPRNAEIAEEVDFDQRAAYFRQVSCLSFSSLVCVELC

SEQ ID NO: 40001 - protein, 104 aa, A.fumigatus
FKLTSSKEGLVTVVMSIVAYFWVYNYPATAEFLTDKERAFIQFRLKNDSDATRDEKFSWTAVFEAFKDVKVWLYGLCFHTMSLPLYTLSLFMVRCVDTIDYIAV

SEQ ID NO: 40002 - protein, 198 aa, A.fumigatus
PTIIKELGYSAAKAQLLTVPPYALGFILTIIVAILSERNRRRAPFIIGSTTFACIGYILFLTSKRASVCYAGVFFAAGGIYPSVAIVLSWPANNVSGQTKRAIANAMQISIGNLGAVMGTQLYRTESSPRYYVGHGFALGYLLANIAVVSVLWAVLNRENIDKAKQREAKGITAIIGDIGDAGGDFQGDRDSRWIFQT

SEQ ID NO: 40003 - protein, 95 aa, A.fumigatus
MTLSIVSLSRCIHLSAYTIPAVRLTSIAVPSCRSGPGHSCPLDQYTALVAKKREQYGSFASVCGLPEGNVTTATLDGAVTFFNDLTLPFLSVVKP

SEQ ID NO: 40004 - protein, 510 aa, A.fumigatus
AARWSKSTSSAISAFLGSGCITTMWLLACFMRALSMMKLFLRRSYCSRSANRSFCTRVQYRTSERATISGVNSSDSSTSCPDATTVCRTSSGKRKILGRNQLDAHVIELEHFDERVDGASISEVTSKGDRQASDSSKLFPNREEIEECLSGVLDAAISAVDDRHWREFGSRLSAAGIGVTQNNCISVATQGADSVLQGLTLLGRRMLGGDGNSPSAETLHGSIKGCRSAGRRFIEESGKDTTLQNVKNTLALNAETHLLSHREEQVQVSTVELVDGDNMLLSEGRPRQQIVQGGGSLYRSIQRRTELIGGRISGPLLERATWSSRNRQSSVKRTLRASLDHGRHGLDRRRCRHNTMARHIGSLGSIASHFTIEARGLALEGNPLNSTPQALAIEGRPVRALEEVWAVNFNLNRSVGLVMELEDLLGVLVKARNNVLHGKATLRHGGEEQWQRLGNTRNRRGLFASKLEGDTADGENINGAHVLPQGVLVLSRRQEVAVGEIFSREEETED

SEQ ID NO: 40005 - protein, 100 aa, A.fumigatus
AKMRQLTEQELQTLLAKLAGYTGRSLNNLIVPQSDSEDDRHVFRLQGNRVYYVKKSLADLSTSFPRDTLLSLGTCIGKFTKTGKFRIHITGPCFFRHAES

SEQ ID NO: 40006 - protein, 730 aa, A.fumigatus
RPQTSVESCAVASSMANDWQPNNEKLSLGPFGGRNAMQSPVERECERKVQLDTLLLTGSSPAARAGELENSGQAQVIREQPSIRSLRAENDSGSPTSTNISFYAVEDEFAEPISPSIYDNAGAKITPGLPDTAHRRGRVRTNEQRFPEMLATDQPSFPASFNHGHEGVQPTVMTAYQPALEETHDQHFNAQSHAAVAQHPFDGVTSHGGYAPPPPDPDYRNTADLEQQLTSHIEAVHAHMNNVVHRLCRVLENSNNWSKDQILRQTDAMFDILRLINARTAGHNEAVSDLHRGMTNLQCQVGAIEFQMRRMEERLLIGVSSQINKLRGEINASRTSPQKARASCNSAPDPKIAGTEFQAPEITPVVTKDSEKQPDTNEQRCVKKGKMEVSRNQDRKKGKEKEESENVSGGEGSLTQHNNQGPAQNIPSTTVSFRNTPSGEKRREITYSQVKRGVRRNPAQESSGSPEPKAPKLSRQPAANFAPENGQSSVIQDSHLDNNEGVKTPHKKGMFGFRRRDDGESRAGGKFLHTPRRNKKTRDSHGQNGHSSMPSAPAGAVGVSQPSTLAEESPSSIHPALRNDKQKQIMRDRERLEPQPHTQTGQMTCTTERPTPQRRGLKNPHPHQNIGTRAPTSNRLPTNAFVVTPSSSSSLNEDIQLCPPAAAAPPRAPLIRPSYAGQNPPNISSSPQVSDTVSVSASAQTGTQGWQAATWYPAAQSGASHESNQSNHHA

SEQ ID NO: 40007 - protein, 108 aa, A.fumigatus
SYLGSYMNANLCVGRYPVYDVIEVFFTGRIIYGVRILDIKGLSQEFGVSHLFGYKSLFVSMSNINYHLPFYILHSALRLAGNMQYFVGQKVRQHRTIALKILCQYFPY

SEQ ID NO: 40008 - protein, 84 aa, A.fumigatus
VVMAWLANAVASLALDVIAPHARYKVWIKDNGIMPYLYGSNVVKAHVGRWSEDIPEHTGVLVYDSNDTPLVWMVCSATVLWISN

SEQ ID NO: 40009 - protein, 735 aa, A.fumigatus
TRWSGSSSARFLAFGENSKEEKSFDSQLRRLPSLISNDPRTEIMAPGRTIKRRRLSPPGDEEDTSSRPSRDSFNDFYNNAAKWDLEQDYERRPRKLGKKDKENTRLPIKTAEGLQMVESEPEAEESDSFLGTDDDEDGDENEADFDDEDMEDADEAAEETPKVPLKLQIIQAKEELARLATIINEDPEEHISSFKSMADMVENGQHVTIQKLALAAQAAVYKDVIPGYRIRPLSEEDMSAKVSKEVRKLRSFEQSLLSGYKHYVQKLLDLTKSSKRDTAAVDPGLKSIAINCACNLLLSVPHFNFRTELLKILVNRLAKRQIDADFVKCRETVEEVFRKDNDGIVSLEAVRLLSKMMKAKDFRVHESVLDTFLHLRLLSEFSAKGSRDRVDRRPAEEETTFHGKKPKQKREFRTKRERKLQKERKAVEKDMKEADAIVSHEERDKNQAETLKLVFGTYFRILKLRIPNLMGPVLEGLAKYAHLINQDFFGDLLEALKDLIGHAVKSEVEDGDEEEAQEESESTSRDAQREALLCTITAFALLEGQDISKAASSLHLDLSFFVKHLYRSLYSLSVNPDVEYNPTKALRLPDPNSNEANGSTHRSKSKVNFQTPTVLLLRCLQSTLLSRAHGTPPTIRLGSFTKRLMTTSLQVPEKSALATLSLLNQVAKHHARRIAPLWNSEERKGDGVFNPFAADVETTNVFAGTVWEGELLRLHYCPQVRDAAADIEKLIVGRN

SEQ ID NO: 40010 - protein, 150 aa, A.fumigatus
YILYDIQVLTSPRYALDGIPYTIVFYLHLKDGSYKCLGGVYTFSTKLSDAQDTERGGCDNCREQKKAGVLASAQIPLTYTLYERQEWHNLGKLLPVKETADIIRQHLCWKVVGVNNSILFDVSRDYAALPSVLLHHALTKDVIYSSLSNP

SEQ ID NO: 40011 - protein, 218 aa, A.fumigatus
HARAQRPSWTTIRSSPRWAQPRSSILGHVLGAVVGVGVTKLFKLRSDFEDLRWVAGAVCTAVASLVMGLTNTVHPPGGATALLAAVDSTVDAMGWFFVPLVLIGSLLMLGCALVVNNIQRQFPMFWWTPRDVVRKTGPPDIEKASEVPQESRERRISWAVGVLRANSIVISPDRVVIPDGFTLGLEEKGILEVLRDRLRDPDQYDSSVGDQSTDSTES

SEQ ID NO: 40012 - protein, 78 aa, A.fumigatus
GGTITFSTRPTPREDLNYAQISIPYNLISLYEHGSCLTMSAQHSRSVVRLLHYGHMADNYCTVTTHKTTTASSSFVWH

SEQ ID NO: 40013 - protein, 130 aa, A.fumigatus
RTTCWCQVWLILSRPDNADFCSWNKALARQRAVQMATEFRKKGVNVLLGPVVGPLGRVAEAGRNWEGFSNDPYLSGALVYETVDGAQSVGVATCTKVSHLDQFLVQPKDFFLFIQHFHLGMNQKTNPKPP

SEQ ID NO: 40014 - protein, 140 aa, A.fumigatus
VNIALVVSGDYWLTRASNVDRLTAIWQVLNQDHWFDEPHPSDAKPDDPLKPFHVSKDKYFTSDDARFWRKYGYDYDIVKKPGTNEDRAPEEVKMKINQLYGEPISRLHEGQPVEYDYVINVIYDRWVVNQFNTYSTTYRC

SEQ ID NO: 40015 - protein, 89 aa, A.fumigatus
CEVAEGTGTGSWAAAYAKAKKFVAQLTPEEKVNLTAGTDANNGCSGNIAAIPRLNFPGLCVSDAGNGLVRAHMQQLLEITNSCRGEPTT

SEQ ID NO: 40016 - protein, 174 aa, A.fumigatus
ALVAVSVTRRKKFHQCGHTSCGFFLFLFLVLFTRSRDCFFLYLLFLFWPVLLFMLLLLLLLLFYLMIWLAINFLFPLWFRSLFGGLLALCTRGFLWLDISGASEGLLRLLSGLSRRCSNGHCERIVFAREGELGQLRGSEISRSMRQICERLKRTTSRAKVRCEYDISRPSRSD

SEQ ID NO: 40017 - protein, 98 aa, A.fumigatus
VEWSFAPQFMLATELLSTTGRNRQLSQGLNYVTIILLRVLINPYTLISAWTSMDCDLRINVDVYMLEHEKDTLYPRPRHPRVGLIQNARQRTKKSRES

SEQ ID NO: 40018 - protein, 161 aa, A.fumigatus
QAAQKAKEAFTSTRDIKPKKTAGAKRKETTEKGPEPKREKKVDREPDHEIEEKEQEQQKHEEKDRPEEKEQVKEEAVPGPGEKDEKEEQEKAARRMTTLMEFLTSCYANSDQGSVNSPKSEQRSQNKNPKKVKTKRLPQDLVMKRKPPTVTINSAEILNHR

SEQ ID NO: 40019 - protein, 191 aa, A.fumigatus
IQIQKETPIRVRLSPATAVSSVSVNDHCGLHIMLPASGSTAAVPASITSLNHCVVDMSIPTANGKPYASLTVKDVNESLLICGQIDGPAHITGVENSVIVVSCRQFRMHNCSGVDVYLSSSSNPIIEDCTNVRFGRIPRAYVSDLSVRDHSNTYTHVHRLWTTIVRIMKTAGAKLRTSNGSSLNRARTGAC

SEQ ID NO: 40020 - protein, 109 aa, A.fumigatus
LVLINDWCVKFSTCFAMETRRYLFNSICHSQLTSSQFDESFYTTLVKSACFSKVTTSSGHGLQHADYASSIAGIEFILQFSLTGYKRMIQLRVNKWLFLHSYYSLLIDD

SEQ ID NO: 40021 - protein, 76 aa, A.fumigatus
TTLWEKMAPTSWRKASEVLYNPIKSTVLNDDQQANWSQVSSSVEIDLSDFIWSTFAGQRIGEIQTRSFEDPPASCG

SEQ ID NO: 40022 - protein, 226 aa, A.fumigatus
KHGSASVFLKRAICLVAAKDQAASSFLRTSINGPLSTPRQFGSEIYTGLVVAMDAGLESDRITRIRTLALMSLHCEGHEGAEAASMHLCRAIHEAQTAGLHLNRPDRVQGDSLSRLFWCLWTLDKMHASIGGRPVLLADRDIGLRKPIVNTSHPKTTFDVWFAISDLLSSVISFYRPSADPTVGWETSFPSFEELMGDNFGEELDFTMLSMLHDLSRRVPLPTVYY

SEQ ID NO: 40023 - protein, 87 aa, A.fumigatus
ALLCVKSTSHQENSASRWTKNGEPNLQSTKAVDFSSSLFMSSLARGAPPFALPLYGQGDTKRSSLVLQRKREIDCPAEFNPNTKFTT

SEQ ID NO: 40024 - protein, 351 aa, A.fumigatus
FKMARAAIIPKSSPKRATRGRPPANTVKAASLTTASKPVVRTARTKSGTSATETRKKTTRTATATSARTRQADSDTDEATDDELGLIDTKEKAKPGRPKGKSSTSSTSATGRGRRPATPAAAECESDNDEDELAQTDAPKKRPGRPRTKPLPKEDEVKPEAAPRPRGRPRATAATKPTVTTGADKDSTKKKTRAQTGAVEASSSGPKHILIATNSTTMRSNLLRGPAKKKTVTFKDVSDSEEEDANEPAPTTTGRRRAATTAAGKVGLGAKPVRKPATTTGRGRKPAGSKIEAGKPLSPKKATQVAKSISSYISSDGEDDELSSVQDQMKLIINSPLKKGSGSYWVELSCA

SEQ ID NO: 40025 - protein, 968 aa, A.fumigatus
NRLHTKKTQPVGGRKMVSPTFNPRRQWTSVARCLCPVLPGGPPPSPFHYTVKETPRGARLSFKGSAKSIAQPSLTPTQNSPLKAAPKKANLETPRHGGLGLCDEIMPLSQPNFTPGHNSPLKSSPKKGIFGVSFAQAPLQESSSTPFKSRSLLLQSPAKRIASPFKNSLFSSVRSMPELRRNESGMGLVSGADQANDAEHVESSFRTPEPQGPMDVDYDNEGLEQDEVPQQESSDEHPVVDSRAQFADSHDVNDEQQTPSMTAEDVEEAPEQLSDHDDVADNVEDLQACELTNEGPEVEFEESGDQTLAGKEPRALDDNDSEEGSKIDESDIHLADESIVGHTAYVSNMGTHTEQNDHTPDYDDAEDPDATESEPEEEHMMQDVYGSEFQAVTEESSLPFQRHSIEGLEDVFTDAPVAYEDVDGESDTDSVPEATGSAAVQVDFQPGELNNEYVDFHDSEYFDDDEATLVASDTTDHYIYEVQPDEEPNAQLNTQLGPQQELERMNSHLHDQDGSLAPQASTTQDGIFYHGDLKYREEVDMSESELTTDNQSHSIEHNDLPDSPTSAAVCNDEPESGFLMQRNRGPRFTLLAEQLSQWKASSPEKSEPRRTRRGVFSIGGLRRSSRRGTRLPQEVAYPDIEDCLGSPQEKASDRPRDSEIYAGVPEIYEDQDDQNLEESRSSAVATSSPQREPMTELFSEPQPEFSEPTAYKKVLNRQPAHASDTTKSPIASPSSPKEGDSDENKENERVEPPAPATPVKQKSIPLETFHTVSKVPLKPEGQVSPLKLSRKRGRSLSISSPIRSSPRLRKRVLASPQQSTAQASPRKMPKLQHNETPRSQKCESRRTSVASQSSRRSMAPSASPGPSKTPACENILGGAVVYVDVHTTEGEDASGIFIELLQQMGARCVKSWGWNPRASMSSGDMTNRRDSKVGITHVVFKDGGVRTLEKVRQAAGLVKCVGVGWVLE

SEQ ID NO: 40026 - protein, 260 aa, A.fumigatus
  UNSURE (254): Identity of amino acid sequences at the above locations are unknown.
SCSLLHRKPSVPLSRFTTLWLAFSLMHAAPTSHPRHHDDDHLHLNHVDASPHGLTCLDKDRDGDIPNSTNNDGSHPPTSPDAHVFDITSHGRTSSDTSFNDSDGDDDAEDADLVIDTPSEKPVTWASLPKKGQLAILTFARLSEPLTQTSLQAYLFYQLKSFDPSLPDSTISTQAGIMQGSFTAAQFLTAVWWGRLADAEWMGRKRVLLIGLLGTCISCLGFGFSSSFAAAVVFRVLGGILNSNVGVMRTMISXIIERRK

SEQ ID NO: 40027 - protein, 113 aa, A.fumigatus
  UNSURE (108): Identity of amino acid sequences at the above locations are unknown.
VLTQYPWNSQWLTTLKHRDLHLGNVCIKTTRSDGSMTPPSDIEIMRQTWTSGFGLSSLETTIIDYSLSRAELRASEDSHQIVDIASSDLDKKQIFDAIGRDEDEILLXDTDRQ

SEQ ID NO: 40028 - protein, 158 aa, A.fumigatus
YGNHDINLISSMRAEVYTGNPVDTKRTPDIPGIWEEYAPRTNLIWLLFILKNLLKNRKSEPSTSAATRPPLAPCSPNKNIESKQAKNLGEKAKPPLLGQTQVTEADKRVADLKQSLEDRLKSVLDLLDLEHGHKDMCCAADLVAYAIDSQWLSEEDFF

SEQ ID NO: 40029 - protein, 148 aa, A.fumigatus
GVATEKYRTKEMSRDAHACPCAQGRMASDLLGQCDKPSIKWSRSVTIIGQAYTVYMLLPRRGHSYVGDKEAHETSYSQATHKDHAHEPTSSLSFIHRNPVTSSHHTAAAKISVGNPEQKLHNEEIKEITLYNGPSPSNVTKQVKWDEP

SEQ ID NO: 40030 - protein, 65 aa, A.fumigatus
HYSLSKKKSIDTNKGDILTDQDAKPARRGVNVSKQKRNKRTCKGVYVSASGPDNPPKALINFSRL

SEQ ID NO: 40031 - protein, 192 aa, A.fumigatus
GDVGILGYLCPVITLQVPRSFLRHRVGRSVGELVHHLTAAHLPLHQFGEGAIRASTELLITALFGYSSVGTKDNNRIGSLNSRESMSDANGSIVTTKERGKSTVHKSFGLRIESRSCFIEYENIRILDQSPGNRNALLLATRKLSAPGSDLGVKTIRLDNTISSYLNQNGRRPTYKVTYELAVRLARSCNDL

SEQ ID NO: 40032 - protein, 196 aa, A.fumigatus
QLGELTSFLMYTAYAGSSMFGLSSFYSELMKGVGAASRLFELQDRQPTISPTKGEKVASARGPIRFENVTFSYPTRPAVPIFRDLNFEIPQGTNVAIVGPSGGGKSTIASILLRFYSPTEGRVLIGGKDITHMNAKSLRRKIGIVSQEPVLFSGTIAENIAYGKPQAKRSEIVAAARKANCQFISDFVSWSTSILV

SEQ ID NO: 40033 - protein, 170 aa, A.fumigatus
ADCVVQPDGLDTQVGPRGAQLSGGQKQRIAIARALIKDPDILILDEATSALDAESETLVNSALTALLRGNNTTISIAHRLSTIKRSDTIIVLGPDGRVAEQGSYEELSARPDGAFTKLMEWQMSGGEVMDQLANTPANPVAQETSWDLQSDDGTEISEDTNIPSEPRKID

SEQ ID NO: 40034 - protein, 393 aa, A.fumigatus
LCRTWVRNMFLAAAPYFYLRFRSDKWTATHFQPSILTVSTITNLGSAFILAKLQKGPSYSRRVTLSLLINIVIFSLLALSTVFVKDVDVKTYFSFLMFMVFGASLATGINQNGVFAYVSGFGREEYTQAIMAGQGVAGVLPCVVQIISALAVPKREGQNMPQASSKSAFMYFTTATAIAAISLVAFLSLVRRRSVLSLQLPEEQLDSISSGYAHKTVSLWVLFKKLRYLASALFLCFAITMVYAVFTAEIESVHQDPNHSRLFSREVFIPVAFLFWNAGDLIGRMSVIIPRLSLAHRPWVLFVISVTRLGFIPLYLLCNIGGRGAIVQSDFFYLFVVQLLFGVSNGYLGSSCMMGASHWVSVDEREAAGGFMSMVLVGGLAVGSLMSFLVANI

SEQ ID NO: 40035 - protein, 242 aa, A.fumigatus
AGAFFWFVEKQSQIANYRRRTLTRRQGCVYLIGHSIYAIYFHPLSRYPGPKIAAISPIALLVWEIRGKVHSKVKHLHDRYGDVVRIGPNALVYRVPRAWKEIYGYRTKKGQRTFQKDPSLYVPTPNGVHAIITAAESDHIRMRRLIAHAFSDRALREQESLLHLYADLLVQKLHENLNHSHSEVVDIARWYNFTTFDLIGDLAFGEPFQCLKDSKYHWWVSIMLDAVKLSVYLKVLWFFPIP

SEQ ID NO: 40036 - protein, 163 aa, A.fumigatus
  UNSURE (83): Identity of amino acid sequences at the above locations are unknown.
APLTKLLVPRYLHQRREASFQLTVEKVIRRLHRQTNRPDYLSYIIRHKDDENRMSRQEIDGNAATFVLAGSETTAALLSGCTXYLLKNPHIYRRLVTEIRSRFQHPSEIRLSSIATLSYLNAVLEESLRIYPPIPAMLPRLVPEEGAMINGEYVPAGVSPGLC

SEQ ID NO: 40037 - protein, 68 aa, A.fumigatus
TIHEQSMDNSGRFRVSLHKVISGTVWRQWLQKAYNSIPKAILLLVYSTDELLTTCVTSPLTFSLFVRE

SEQ ID NO: 40038 - protein, 63 aa, A.fumigatus
LEEQRASLNPVKPAISLMGIHAVITESRPQGMHPLGAPIVANHKNTSLASDTYNRPGGCWAHR

SEQ ID NO: 40039 - protein, 74 aa, A.fumigatus
CQIPAPFITRFASGEETDLANPLKDTVIRPSIEAPTEVKSVVSTLITPLSREQVRHSGKRLLQYIRFPVVVRLS

SEQ ID NO: 40040 - protein, 175 aa, A.fumigatus
PACAARCSGVTPFNNCALILAPACSSNRTISTAPLSQALCSGVQPPSLRASMSAPCLSSSCTISSLPCAAAICSDVLFLSSTAFTSAIGPRRRVSSSSATRSFPVAHAQCSGVRPNSSRPSAPSSAHPVPSRSSITSSPQSHCLSAARLCKTFLFRRSFALTSAPRDINTCKTCQ

SEQ ID NO: 40041 - protein, 374 aa, A.fumigatus
PAVDEQGAVGALFDLPGGILVLDLVALGGRRSRGKDIHLLQRVSHKFVHLIPRHPHAHAHADLPFLLGRQRQTPLRIHLIRRTCTWLPPPQPGHMMRRLDRDALLLHRLHRIRRQPLIKHRQHRRRNIVQRDPWDPRQAGIQLHEIAGDEIAQRRRQLRPRRPGPHNRKVQQPLPHLRRRRRQHRQLEALAHPPPDPPRVPNVLEEERVLAHPGGIERLGDGPHRDDELVVGNRKRFAGFPPSFGHRAGDTPRLVRPRRLRHPALDDRRLAEDGLPVEVHRSRRRLDEVHPRPAIPDRLDDIREIKRAPGCIRKQRREDKVRPRGDDQRRELAGGEPPRETVASPPGAQDDDPLFALVSLLVVREGRRVFDLCC

SEQ ID NO: 40042 - protein, 460 aa, A.fumigatus
LLTTLRVALVGRRPRLGPFRCPFALFALRAAEPIVKRAGIRPFKLHALDLGLFGLGRVVVPVDNDCGQFRLSTLLDPLILAERACSRGALTQRPHEVGVRPLSAVLVIERPFQSLEALHVVGAFFDKRLGEQRFHPGHVVRGQMDPAKIRRLAVGWDGAERLLAWIFRVAPIQQVKHGRLLDPILVVKVAKVNHRCVKGLACAPRIRRERIDVVERRQEQHDVLPLKLCRPEERGAPKVVPNTAFQVRSFEQALDDLAVTGLRGQMQRRDPVQQLRVDLGPSLQQQPHDLHCALVTGIVQRRPAPIAPRFDVRPVLEQQLHDILPAMRRRDMQRRLVPQLDGIHIRNRAPPSCQQQLRDSQFPRRTRPVQRRAAQLIPPVRAVKRTPRPQQKLDHILAPIALLIRRQVMQDIPLPQIFRIDVRPARYQHLQDVPVIPPRSRHQRGPPFLIRRLRRGPVIQ

SEQ ID NO: 40043 - protein, 186 aa, A.fumigatus
FLEYRRAGPGSQGAGGLHPGGGASGGLPPEDHPLRGDGRQERGDGVAADGRGGGCHQHDGQTTVGSRRNVYGSLRQARRRGGDRHQDVQYPRGARERALLQGHWGRAAGQAAGARVLRAGGAADDGAGDEAVAAALCDCGGRADGDGAGGVAARFHLPRSHAAVSQPGGDPTDHAVRCCADGAVDV

SEQ ID NO: 40044 - protein, 1059 aa, A.fumigatus
  UNSURE (37): Identity of amino acid sequences at the above locations are unknown.
KGCSKIVDLAPGKMASSNENLLRVVLMRSCERGSFAXTQYLFSLGAKTEVPSNRVAPLLRAVEHNHVRIVQLLLDYGASTETADKKGRTSLMTAAWRNHWHVLQVLISRGADVNAKDLRKRNVLHNLAADKQCDWGEDVIELLLGTGCALDGADGRDELGRTPLHWACATGKLRVAELLLTRRRGPIADVNAVELRNKTSLHIAAAHGREDIVQLLLKHGADIEARSDGGWTPLHNACDKGAVEIVRLLLQAGAKINAQLLNGVTPLHLAAQAGHREVVECLLERPDLKRRVRDNFGSTPFLRAAQFKRKDIVLLLAPFNNIDALSADARGACEAFDATVVDFGNFHNENRVQKTSVFNLLYGRDPENPRKQAFRTIPADSKATDFRWIHLPANNMAWVEALLTKSFIEEGAHDVESFKGLERSFNYQHRGQRTHSHFMRPLCQSTPRARPFREDERIKESGETELPTIVVNGNDDPSKAKKSKVQGMKLERADTCSLDDGFSSSQGKKGKGTPKRAKSGPSPNKSDTKGSKQSSAQDDKRRAPLSLCKDHSLTPACNVCVFMPYLHFETAERRQKMQEAIQRAETLRFQHPGISRSSTRDEMLISAHLASSTTSLHVRRTLDQFFYPNIDTQSRDQDQVIYRYQTKGQGRDRFRSDPKIFMVDQLWMWILGTNLIVTSFAQRWDQPKNDPLNVLDGIIEDINSKTREPVRSVYDLAIIITNRCSGVFDRHRMGDEEYQFLDMFEASIGVATDRETLLFNMFNSASAQASDWLKNHRKLSRFARDADNAKGKAFAEEDEQPLFVDNLLDIGQETDLLAEAKDIRDELNMIRTVLQHQQHILDDFQEVICEIYHGQHRSQYEVKKRFKEQQRTIDMHLKDIERMDKQAERIYSSITDLLDLKQKHANAFEARFARDQAADTTRQGKTIMVFTIVTIIFLPLSFITSIFTINLTEFPKGPDGVGELHLSYVAKYTFGIGFAISIPLILLALSVDDIGDVCQEAMRHMRRWLSRRRKSTDDQLDEATLEMEKIISTSKSRRSMDTRYAGSLLPVSTRGSRPA

SEQ ID NO: 40045 - protein, 442 aa, A.fumigatus
RIANCLSSSMKPAPSPVVHGSRRHHPWTLVRQWKSIGTRRLATQVEHSTAFPDDKQRHQGKERVVILGSGWGGYSLSRRLSPSKFAPLIVSPRSYFVFTPLLTDAAGGSLDFSNIVEPVRDRRARVDFIQAAARAVDFHRKTILCEATVVKSGVTESPRTDEAGGVTSTMAKRRWEAGETFTVPYDKLVVAVGTVTKTFNTPGVRENALFFKDIGDARRVRRRVRECFELAVLPTTAPEMRQWLLHFAIVGAGPTGTELAASLRDFISRDLMQLYPSLAGIPRITLYDVAPTVLSMFDERLAAYAMETMKKEGITIKTSHHVAGLRWGEPGASPPYEMDPKRCLTLTTKEEGEVGVGMCVWVTGNQMNEFVRNSLEEVDVFPSASATAKGDKIKDENTSWKVKKGPNGALLVDGRLRVQLANDHGETGLHHGAGRIRGGVTI

SEQ ID NO: 40046 - protein, 83 aa, A.fumigatus
RLLYRAWQVCQTPNEVLVEKLGLDIPPPPEVTLEEITAREVRIAWKLPDFHNSIHKHIIQVNGSKGSLFCVLLSRVTSTLNMQ

SEQ ID NO: 40047 - protein, 116 aa, A.fumigatus
IDMIRHSDNAQLRFSPQLSVVRATQRVSHPQPERASLPRLDLLTLQTLTLGVSKLVTTIVSTFTAHYIYHWGTYFPSTPLQPPYLPSFDGRAVLYPTTRILRDYMSWRQVDCAFDL

SEQ ID NO: 40048 - protein, 651 aa, A.fumigatus
  UNSURE (542): Identity of amino acid sequences at the above locations are unknown.
KKAQQQYQEAQERLKWLTTQRSGSSGPFTLPALDLDMSNTATIRPRRHRSSLNSNVSSPMNFPGLEPSFPGGVNFNPPSTNSPTFAPAPAFFNINNGMTLPGLSDLQDPMRGDLDVSFGNPQMSPRADALLPSDLLGDEESPEPPRPIVRPRFSNLELSESQRESYSRGPSSPESAVGSKPASIFASPHEDRKGTEPQSTHVDESSDAPKSATRRLSGLFGFHRPRGKTLADEPPLLGTLKPGQSQSFPRNLDEMDPIGSRRRRLSHTGNWTNPISLLPRSNTAAVTADSSSDHLPSRRAGFTSIFSPSRFGFGGGSSSLLKSSEPSDVSTGYNQFSPRHDPIDPASILGTVRRGSLSPRPSSTFSFDNQLPHPSTDNRPFGWPSAEKPNHRSLLGFDWASPSSWSRAQSRRPSITYGSSGHLPLGLTGEPDFPQETFERQGRPLQAPIGTRPSSSHRPVTPKLNPAAPTFKTIFSRKSDKDKDKEKGKEKESDMPFDFHMEEGSPSEPRISRDSRSRSLSIFNEDSYVSLERTPSATFADXSNSKESFIRKITRKGSSSKFGSWKERSGLFSKKGDSSQGDIDEDASSEAQLAKSIDSTVSSADRSTRSSLGFFSRKSKKSDKAASETSERPSELASETGDDEIAEEEEP

SEQ ID NO: 40049 - protein, 137 aa, A.fumigatus
FTPHELTRSCQGTVSSDKNEILFKRFGINYNNEDEMFKKGSVVYRQVGQQGCLYDRRLTWILQYQLEDPKPESKSRHGDDDEAPMDESKISRAQQDKLRKLRRKAQVVVDHVDIIKDEFWERRPWILSGKPGKLPEA

SEQ ID NO: 40050 - protein, 372 aa, A.fumigatus
LILRITVASYINTKHAIVGESKRVETAVEISNLVPGSIYHICVFSVSAANFQTPSAVIHVRTKPLPLSQSQQNAPVGSPTIRASIPRPTAGLVAPSAPPMARELSGGQLQGKRTSAGRKQSPAASGVDLPHGHPEETQKHATHSDSSETLERLADRLKTLQHENENVEKQAAEEEEEHIALLKELERQRDQLRKRVKEKDEASGDLKKHVNKLESVNRTVQNEKAKRERLLQQKETERKKRKEDIIRWREEMERMTTEVAQINEEKARMEEEGKRSADGVREKIAKEQAEMKVLDDEIQDKGGRVKKLEEERKRQQGGDSEDGKELDRIDNERARQWEVKLSNLNARYAALVNLHAQVGARTTYWRFQIEGY

SEQ ID NO: 40051 - protein, 62 aa, A.fumigatus
ITNDRLSDRYGFIKPNDRRALDLMNAAAVEVMKELPDLCIAYGVSDEYRSVPRQLDRHDSSL

SEQ ID NO: 40052 - protein, 113 aa, A.fumigatus
SPCCVLYVKVLTKSRSDALGHVLNMIGRDWTHAGVAKLYTDIVNNGYNIMYLTSRSVGQADTTRTYLYGVCQDGYRLPKGPVIMSPDRTIAALRREIYLRKPEVFKMASSPRG

SEQ ID NO: 40053 - protein, 133 aa, A.fumigatus
EEGTDLLFRRISSDLTELDFFSFQVEFQVNGVKQDYAMKLGEGGEAFFVFETSDEIPVSLQTSPLVSPAASPRTRSEVDLPSSLQEPEFLDLEKSSATTQSQDVKAGSDIPLLSRGVRASSDLGTVALSLVRI

SEQ ID NO: 40054 - protein, 67 aa, A.fumigatus
AGPLMSSSSSRKMVAPHISGLSNILLLMLAIGTLACSPFHVRFGKFSLLRPYEKKVPICCSVEFLRI

SEQ ID NO: 40055 - protein, 368 aa, A.fumigatus
  UNSURE (218): Identity of amino acid sequences at the above locations are unknown.
GHLVIWVRWRFPWSGSEAHAHMDIGAMTPLSQSPEEETNVGRLRRGSLGDAPGFDRASSEPVLTAKRNTGTSNEGGLAVGTQPPSPTTSDGDNHTDRPRSPPLLTPQEAVSRALSLSKKLSSSNIPTRVNETGDLMLDMTGHKSNEEDALRAELIARKILAEELEGSYDIGSLIGADEHGNLWIYSSEEAKEAANRRATFNSMRPHSAMSENAVSDPXYHSDTDHPMSESSYPTRHHRAKSDVQPGPPTPPQSPTQDSTPGEQTRNYAKTLRLTSDQLKALNLKPGANPMSFSVNRATCTATMYLWNSTTPIVISDIDGTITKLVSMLCIICQGTDEKQVRRFGSCVEYDRSGLDTCWCGEALHRYCQ

SEQ ID NO: 40056 - protein, 68 aa, A.fumigatus
LNYSAMLTLWFPRLINNSNSMNIFTKITIYYYLVNDLKPNLLIRTNVICSKGFILNFKYSIIIISSYS

SEQ ID NO: 40057 - protein, 80 aa, A.fumigatus
KIHPVLSVTHLKPAPATPNLFYHELPKPPTVINAKVYPSEDDIYKVKCLLDKHTIQHRRKHTPYIEYLMQWKGYRLEDDQ

SEQ ID NO: 40058 - protein, 70 aa, A.fumigatus
ITVWFSKGTNCATGRINHRPLDTWISNTWISVRYATLIPPKQYIKLINLIIIFLIYPPLKKIYFILLFLS

SEQ ID NO: 40059 - protein, 64 aa, A.fumigatus
NGPWVCLEPRLNWAEASLNVAKCNVEDWINIKDYYIALLECFIDIIQTFSLWTLLAEVFSVILF

SEQ ID NO: 40060 - protein, 68 aa, A.fumigatus
WWQRRQYAEVGIITHVFVTLTYRTPADELQHDHEFERSLYYATFGTRDMAEGVTAFLEKRAPVWRTPS

SEQ ID NO: 40061 - protein, 63 aa, A.fumigatus
LYQPPLLKANGPSFYPDPMASRTSGASSFMSQPILGRRGPTDLVRGRLINHFQQILLSRNPQR

SEQ ID NO: 40062 - protein, 72 aa, A.fumigatus
ADCAAFQADFIVATPEVEFRLPEISIGLIPGAGGTQRVTAAVGKYRVAALYARCTKGSTDKVREGNESDSTK

SEQ ID NO: 40063 - protein, 123 aa, A.fumigatus
MRIVMDYSTQTERFILARTCQSSTRILTLDRPNKRNALCQTLIDELLQQLKIASADPHIRAIVIAGSGAIFSGRCLHIECRQHVAELPPLAISIQLVPTSKRSLSWMASLLGRSGTLKTSVMG

SEQ ID NO: 40064 - protein, 98 aa, A.fumigatus
LLFMLGAQRVRLTRSVKAMNLILLNEPLSGSEAYQVGLVSKLVEPGMALSGALEIAEKLASWSAPTLMVAKEAICRGGNHYSCVCDSYLQNTSGRIAA

SEQ ID NO: 40065 - protein, 270 aa, A.fumigatus
VIWHTFGALSTNLKLIRSTGAYSLSIWTRNFRHIVHQPSWPVPASNHTEDVIIIGSGNNWGSIYTAVHAINRTVVGGQDATVGPGGLIQNGGHGLLSSHHGLASDQVYQVTVITTDGRRLVANHAENEDLFWAVRGGGGGQFGVVTEFVLKTYPVPANVVSGGLSFYPSRSTKACELASWDALAETTRLIPDLMDSGMTGTVTAMTKEAAIRLTGVKESIPGVTVSINMIGYHMTMTKMNTSIHHLAARIRKYSISSSLTVTLSAPSAQS

SEQ ID NO: 40066 - protein, 429 aa, A.fumigatus
RAMSLNIYLEDPRQYYAENDMIKGRIVFNCPRDFQQLKNVTLTFSGCSKAKIRKVKGPAGPTGSYQSKCILFKRERILVPAEECKIPPTTYEWPFEFRFHPHVASPNAWPEAESFRVDENQPLPPSFNTECHNSLRRVSASIEYRLKVQIFKPTKGLFERKSPVFEKVLHLPLIPMAARAHTHVIELEKKQKINRTFTVRSLSLLPGNTDRSLSVQERFKAWLSPGQLPYFSFGVEFRYPLYLVAGTPIPLLLEVKPLIDNSNAPHVPEIVLQTASITLIGRTAARASPLLMGSMSGQMDEETMLLSKTSLRMVISGQMGLSERFGQISFPTTDVTFSTFNLSRSYRLRISLVFECAGKLFKFDATDLEVGVLSNAGMTVEKDGLHRVSANEGSSHSRGNVVHGSDEQPPPYLLSSGVSEWSSEGKSSV

SEQ ID NO: 40067 - protein, 212 aa, A.fumigatus
SCKVPPEMMSPLVSPRDGNLFRSFGFGPQRPVSYPTVHHAFIDCAKQYPDTVAVCDLSRNKSVEVTYGKLLQYAQFVALRLQSHGVVPGSRIVLATKRSVEMVAGILGILMCGAQYIPLDGAVVPDETLAHAVIQSQSSVALCTGTFRSRLHSLPQVSSVLVLEDLLAEAEHTGIRASTTPLICEGDENSGCYVIYTSGQFVSLCVPNRTLS

SEQ ID NO: 40068 - protein, 132 aa, A.fumigatus
VSPGFLWNSCLNTSLLNFATLARTDEIAFAATGEPEGHLWRADDNDYAPNSAHSARTNAALISLVRNEELEDLISTMKDLERTWNSKFNYPWIFFNDKPFTEEFKKRTQAETKAKCYYGICAQFYFYSMKET

SEQ ID NO: 40069 - protein, 219 aa, A.fumigatus
KKPDKKCPEQVPKEHWDPPEWINMELFRESAAILTEQKIQYSDKLSYHQMCRWNSGMFYKHPALKNYKYYWRVEPKVQFFCNVDYDVFRFMEDRNLTYGFTINLFDDPKTVPTLWPETKKFLAANPSYLSSNNMMGWLTDDSLRPDHTEAANGYSTCHFWSNFEIGDLDFFRGEQYDAYFNHLDRAGGFFYERWGDAPVHSIGLGLFADAAKVHWYVTS

SEQ ID NO: 40070 - protein, 165 aa, A.fumigatus
RLRLRELIPGASFWPSFERNASEQYEGRVCMVRISDPDPANPSVFLHGMNGSSLPIAVAHGEGRASFAAAPGTSAQDFVRQGLAPVQYVDNATLKPTMKYPFNPNGSPEGIAGIRSADGRVLAIMPHPERTVMGGIASWLPPNAEEWGDIGPWGRVFFSARRWVG

SEQ ID NO: 40071 - protein, 74 aa, A.fumigatus
TLSSSPREDAVRPSGFIRAPQFPRSRVQVPAALALNRPSFSTTTKRLSGAHEDETYEEFSARYAITISKPLDAI

SEQ ID NO: 40072 - protein, 81 aa, A.fumigatus
RVANCIGFLFCPRYMTLIISPLQRNLNNCFAYDLVPSVEVLSAALRAARRVNDFPTAVRIFEGAPLAFLLLYTHRHSCICT

SEQ ID NO: 40073 - protein, 873 aa, A.fumigatus
NTSRLKHLKHHVEDTFKSASHVRTDQFAVSKQLEGLQEKFQVLNRDDLADALRNRLTELDEHHKSWFPEILSFLLQLSSHPAVFSRVDRLPKPKVDEGAKQLSWTEMDASGSAYCDEDIWECVDFGADSSSEEDDDLASSGRSDAPIPQTLPSSPIASEEDYEIPDEVFPPGTDMALVDSVREAQFWKPRKHAESNQVGKLSCRVITELQIVRETLFMLQGLPTSLFWRLDDSIEVDRRYTLAHTSSEALSSLLRSFSMIGARLDVVRRFVKITQVVPYMQTFHRCVEDCLSQFDAFLSEVQTQCISQGAPFSVSLLQLAEDVRTASAMLVLLADLISNLEYDSPDDGVRCLDLLYDVVCMKQATGDDVEFTFLAKLFFSCLETYIRPIRRWMEEGRLDPREGVSFIIDQRDDKDLRSLWRDWYAVDDSCGLPQFMRPVAQKIFTTGKSMVFLQHLNALETLGDSKAITLTLEHTYGDESSSLLCLPFAAICESAIGKLVEANHSFASDLLRKELDQQCGLWRSLQALEHIYLCKDLSVSAIIDNKVFDLMDRGRGTWSDRYLLTELAQSAFSSMPFIDHSRIIVRSHQDSQGRSRSVKGLKTISFDYILPWPIANIIPKDAIHRYRRISTFLMQIRRAKHLIVKQRLKYADETDEFSRDRSSNALSYSLRHHMLWFLNTLYSHITDFVISTATESLRKFLSATKDVDAMIAAHCAYMSSLEDQCLLSSNLSPLYQTTISLLDLCVYFADIQATRYGDKLSDQSTPTRHAKFPQGRKSLSTTHQIPYTDDTIPSDDDDDDDTQDESDEDVGNTTGISFYETPYAHRLRDIKGRFDQLLAFLTSGLKGVGRVDGQISWEILAEKLEWRKKRLAV

SEQ ID NO: 40074 - protein, 189 aa, A.fumigatus
ATYSGRARRPPCVTNCEPKPPAPGLGVAPTMLRRAAIPVAPPASPAVVPGAPSAGGDSISRASVKGRLSSSSSAIPSPFGNASPSSSAKKSASYAPGAASSSAAASSSCLRLAQNASSISPLTAVRSCRRLLNCRRPTSFFEPMRALGLRKRRSSCLELKCLSSGSRFRPLVFHCVLGREMVELELAGV

SEQ ID NO: 40075 - protein, 171 aa, A.fumigatus
TFSIGSRAASPAHASPPLPKPASSLRSNPARVPSSSSKPTTLSSSSMIPEASFPPRPSSLPFSLRHSSGALRKGISSDPEGSPRSKFLRDGQISCSSRRVKSGKNWFASGVMSISTSSKASSEDRFGAGEEDFGCSGSSEPSRLLSTSLGLSSTASSLLSKTIRPCPSIDR

SEQ ID NO: 40076 - protein, 918 aa, A.fumigatus
QCRLVRQAKDQCSFVRVNCSDLEDGLLSYVQLYYCTFANAKPIAFIVLILWLSLLFSTIGIAASDFLCIDLSTLASILGMSESLTGVTFLAFGNGSPDVFSTFAAMRSNSGSLAIGELIGAASFITSVVAGSMALVRPFRVARRSFVRDVGYFVIAVSFSMVLLADGRLHAWESATMVGLYCFYVVLVVTWHWYLVRRRRAYERNLAARAHFHIPENQELEIEEEVEEDPGVASESRSLLRGPSTEDFDALQGSDLPAWKDGDEDDDTRNRYLAEISENMHVFRPSTRRRNTFNPIRPSLVGALEFQTVLSSLQKSRSINRGTPIGHDLHFDNPELARAPSALQDNLSVASHPRTSRPSGNNSLLSPNSAAGSSRVRAVSANDAAGLKLDTSIFNSGMPQPRVTVSRPSGTEETFQPQISQIDQTSATPSLSSSGRPSRDSSAARSASPNLLAPPGTFHSPNYQADSPLTRSPLDVSPLGTSYATRGAEIAPESPSSPFPPFPDAIDFMQSRAPSIRLPAPTSPTETLQVHDNDFEDEGHRSSSPAKWSLLSPCCIARSVMPVLFPTLVDWGTKSFLERLLGVVAAPSVLLLTITLPVVEPAQREGDPAPNILPSADGGESAAPRVRLPEDSPLIRTLDRDLGDQDMASLAGKAQSLQERRRWDSELPALEPPTSSASQPKDWCQWLLYIQLFIGPFFVALITWTTMDPEMKVRNLFLPSLCSLLFSFLCLVCLVVSTRNCRSSRPSSFWRPFLAMLGFVVAIFWIATIATEVVSLLKTFGVILNISDSLLGLTVFAVGNSLGDLVADITVARLGYPVMALSACFGGPMLNILLGIGLGGLYMTVKAKPETEAARQGSYDIAISKVLVISGATLLTTLLLLLIVVPLNNWRMDRKIGWGLIILWACSTLGNVIAEVLN

SEQ ID NO: 40077 - protein, 61 aa, A.fumigatus
RGLRMFGVLRAFATIVHVIRAFLNSVVAAVKDDTSLPIYRQVIQEQAFGPSLVKIRGGFLE

SEQ ID NO: 40078 - protein, 218 aa, A.fumigatus
ELKRLNGALGCKGEDDINELRIPLNDDTGEKAARLEARQARHDRQMDQIKAAVKTPMPPRRYTYDRASSMSPGTPRGSGHRRRESDADGRRAVTPMKRVPILANFEEWMKMATDNKINANNSWNFALIDYFHDMSLLKEGDGVNFQKASCTLDGCVKIYTSRVDSVATETGKLLSGLADSREKRGRDTGAEGEGDDEDDEEGEDGTARKSRRKVRRTV

SEQ ID NO: 40079 - protein, 666 aa, A.fumigatus
LHQAQRTHEATLAPSFAALQLKKFELEFSVDPLFKKASADFDEGGAKGLLLNHLSIDGQGRIVFDSSDDAVEESPNDVDNSREGSEDPEHPKSSSPAPKRSSDDAFEDVEIDITPLANQFFPDLTRLDEQDICPSLKNFDLGDPSGSLDIPFLKAPEEWRNEKGNEDGRGGNDASGIMLDDDNVVGFDDDDGTLAGFDLSEDAGFGNGGEAWAGEAALEPMLKVHRIDRDGDQNQDGGEAMDDEDGYAISLTHQPDKRDHENILSYFDNALQKNWAGPEHWKIRRIKENAAAISATAAPKQRKEKEPFEIDFAAPLDPTVAELIYTPASSNSTISLPKTQWKTKGRNLLPDDKHFNSRQLLRLFLKPKARMGSKKLVGLRQFNSRRQDRTAVNGEMDEAFWASRKQEEEAAADEDAAPGAYDADFFADDDGLAFPNGLGMADDDDDNLPFTDAREMLSPPADGAPGTTAGDAGGATGIAALLNMVGATPKPGAGGFGSQLVTQGGRRARPEYVAYARVAKKIDVRRLKQEMWKGMGERLIASTQFDSMTQASAGNGVNQVLNTETEPDAPPTPTPQRPQPVDSSEEPKEDRRLRFTQVMNSLKTVYPPEKLRDISTSFGFICLLHLANEQGLILQNDGLSEGAGAGSLEEIYIAKDVNAVIDEASA

SEQ ID NO: 40080 - protein, 116 aa, A.fumigatus
FYFQPALTMEKEPLKSTFPSVSYRGMLKLEEQFRNASSSTRTDMQFDSLVSPTNSKVAIPRIARSQSRNAVRRAKRACLGCRQKKAKCDGHQPCHQCVLFEAACEYAEGKEDRIKR

SEQ ID NO: 40081 - protein, 239 aa, A.fumigatus
SRISMEIQSMSCCCNDRDIQHQEVRTHQGVQTHQEVRPHQEVWTNQEVRPHQEVRPHQDPGALTLSSALTLPSAFTHPGALTLPSALRLSSALALPNAFTLPSAFTLSSAFTLPSALTLPSAFTLPSAFTLPGALALPSALALPGALTLPSALTLPSAFTLPGALTLSSALALPSALALSSAFTLPGALALPGALTLPSAFTLPSALALKIVSFLISGVRIILLYPTGEKVVPGPGPAF

SEQ ID NO: 40082 - protein, 224 aa, A.fumigatus
RLVINIFWHRQVGSLVYLWKSNPCHAVVTTGIFNTRKCEHTRECKHTKKCDHTKKCGQTKKCDHTKKCDHTRTLVHLHSLVHLHSLVHLHTLVHLHSLVHLDSLVHLHSLMHLHSLVHLHSLVHLHSLVHLHSLVHLHSLVHLHSLVHLHSLVHLHFLVHLHSLVHLHSLVHLHSLVHLHSLVHLHSLVHLHSLVHLHSLVHLHFLVHLHSLVHLHSLVHLHSK

SEQ ID NO: 40083 - protein, 201 aa, A.fumigatus
YYFECKCTRECKCTRECKCTRKCKCTRECKCTRECKCTRECKCTRECKCTRECKCTRECKCTRECKCTRKCKCTRECKCTRECKCTRECKCTRECKCTRECKCTRECKCTRECKCIRECKCTRESKCTRECKCTRVCKCTRECKCTRECKCTRVLVWSHFLVWSHFLVCPHFLVWSHFLVCLHSLVCSHFLVLNIPVVTTA

SEQ ID NO: 40084 - protein, 258 aa, A.fumigatus
EIPVLADKGIMVLIEVIKGLTTGLCIISHILSRISWTNQKAGPGPGTTFSPVGYSKIMRTPDIRNDTILSASALGSVNALGSVSAPGSASAPGSVNALESASALGSASALESVSAPGSVNALGSVSALGSVSAPGSASALGSASAPGSVNALGSVNALGSVSALGSVNALESVNALGSVNALGSASALESLSALGSVSAPGCVNALGSVSALESVSAPGSWCGRTSWCGRTSWFVHTSWCGRTSWCVCTPWCVRTSWC

SEQ ID NO: 40085 - protein, 180 aa, A.fumigatus
PRMLDNEYHDMDQTLVLNLNQAAINGIRAAGATSQYIFVEGNSWTGAWTWADVNDNLKALTDPQDKIVYEMHQYLDSDGSGTAESCVSTTIGKERVSAATKWLKDNGKVGIIGEFAGGVHDQCRTAISGMLEYLAHNTDVWKGALWWAAGPWWGNYMFNMEPPTGAAYVGMLDILEPYLG

SEQ ID NO: 40086 - protein, 110 aa, A.fumigatus
EKYTAADNIKGKEFIFPDPSTISTLIGKGMNIFRIQFLMERLVPSSMTGSYNEEYLANLTSVGLSSSMLDCMRLTRPGCGRCHQGRILCYFGPTQLWQIVSNARHTVDLF

SEQ ID NO: 40087 - protein, 504 aa, A.fumigatus
TDGDYVFTAHDAKLSLHVVENSHSVNTIYLQQLVTGVKSILFSADTIALSSSHILIAAGTVFGEIIVWSCFVDDDESQPLTLNAVGSIHHFFTGHEGSIFGVRMSPPISSLPGGQPGRLLASCSDDRTVRVWDITDCEHASRQDPSAYSTDGFELRTTGFGAVATTDDKSGSESCVAKAFGHSARIWGVHFVPTAVENQSQLTIVSRGEDAKCILWDLSWNLSPTHKTEFKLTQSSSPHLHNGKHIWSLDLCSSGTQTTIYTGGADSSVRSFKIDVDDTASISLPNRDNRIIFSSDPQNTVLARERSFKAFAFISPELFVATTFQGEIQLCSIRTDSGKGQFIFKETLHVEDDLRSFSVVSSLPQKGVALLGNARGLIRLYTHGTGLLNQIVQADGRPLQLYFLGYDTNTSEALATLTFAISYATLRKADLFQVTMQANTEPKVVKTELSLPHGMEVSCASYISSQYLALGIKSGALIVSRTARNWCVSPADHLRSESPWSRGR

SEQ ID NO: 40088 - protein, 329 aa, A.fumigatus
IWHPDNLHKLRLLNVEEKPFKRISKRLLNPSSLVISNATILPTPPPDETEENATAAAEAEKQKRLDEWRNFREDVTLDFASFEGSIARIQFLLTSNERERERYAAEKLRILSTMQAVRENTAELRVQLEEAQRLLALRKSYDELAEKITSNRLLKPREDQQANLQKLQAEIADLENESKEYAKTWAERREQFGRIVEEGMQLRRLIRDEKEEVERREGMQEGEDGDEGDVPSKGKSSGANTPRPESNTITPSQHSQDEAGRPSAGLHAERISATTGAASPLRNVSTADQEDTNMDEGEVTGEDGSEHPDELEEGEAEPDDKTADRMDTT

SEQ ID NO: 40089 - protein, 78 aa, A.fumigatus
RLIHWIQIFDMQLYLFIMGPYIFPRLWLCSRTVIVLPIYNDLVVDEQRIGQRLGQMQKAMVSERLHVGTKVGASKRAY

SEQ ID NO: 40090 - protein, 79 aa, A.fumigatus
ITDKLCSQIVNMAPRSQLEIATSSVERLVKEEASYHRELQQQTERIQKLESQEPGEDENREYMLKQEVGLMRIKASPQF

SEQ ID NO: 40091 - protein, 205 aa, A.fumigatus
RNVLLTPQARPQRRPNMSRQQAAEKALHDQMNILPIVQLLVVFAGLAVSLLITFVDQNGISVTLPTIAKDLNAENTISWAGTSSLIANTMFSVLYGRLSDIFGRKIVYLSALALLCIADLLCGLSQNAAMFYVFRGLAGIAGGGVGSLTMIIVSDIVTLENRGKYQGILGASMGLGNVIGPFIAGAFIMHSTWRGLLWLISPLAA

SEQ ID NO: 40092 - protein, 408 aa, A.fumigatus
VTAVMTEMYSGLHVGQRFASLEEFKSVVRSISVRQHWELRVTRSNKKSVVIGCRSSANCYFRVVCRANKNETYITSLQDSHSCRRHAASPGTTPARSEASHVRFLLNEIPKLFDLSHKIKGQDVVDAVKRYHGYDISIRQAHRALTKLQPRLPHHQIEEPRDRGLNGDDQPGPQVPATPSVNGSVYSAISEQRWISDNVHQSGFLVKRPVELTAGPSHESPQPAELARDAVQPQIPSQRPQPVHGSSQVQLPSGAQPQEQIALNDGLRTSDEQQSDYILSAPTVLSAPQQGPSQSPQQPRGSGHPSAPQMILTSFKIEFTCTACGALNQSFIPYQGNITGGAYLPSNNVINHGPVGRPTSSSMHSGASGVERVAQNNEYVEAPSVNARGIQPLWQPGSVPVSIPPTHT

SEQ ID NO: 40093 - protein, 330 aa, A.fumigatus
LLGIVRLIFPDNEYHDMDQTLVLNLNQAAINGIRAAGATTQYIFVEGNHYSGAWTWADNNDNLKGLKDPEDKIVFEMHQYLDSDGSGTSESCVSSTIGQERVESATQWLKDNSLKGFLGEFAGGVNSQCETAVEGLLSYMSENSDVWLGAEWWSAGPMWGNYMYSLEPSTGPAYSSYLPILKNYFVSGTSSSSSSSSSITSSTTSVNNPTTSATTQAQVVNTSSSSPTPSPTSVPAAEAPAPTPTEAAKTSSAASTTPTTAAASTTAFACRAPEPADETTLPSATPTTSASASGIAKHWYQCGGINWTGPTTCESGYTCVEQNPYYHQCV

SEQ ID NO: 40094 - protein, 67 aa, A.fumigatus
AHQHPESGIMVVNSSTTGSPSSSSSPSLSTTFSSTYFKTITQRRQQKKMSITQTYYLAHTARKNLIL

SEQ ID NO: 40095 - protein, 218 aa, A.fumigatus
SSRADHDLRLLVGHANLLDSLMLDLADAEQEQERWFNQTVNGASKSSQSSQPRHIQWADTVIEEPEEDWDPEDASDLDSDSDDSDFDGEEDYEEEQTFATIQLPARQRAPSPVAVITEKEVDEDYDSDSDSDFEYDDIEDLDELTLTRSPSRQTPPELSSDSDEDSEDDATPPSPPQPTLAGFPEKQPQSAELPLSDPEYGTGYYVTGQEQSTFIEAY

SEQ ID NO: 40096 - protein, 69 aa, A.fumigatus
LRLVSIDCFSTSVYFCDTLLSDNLGIHFQRFAYAKQERHGVFLGLISAIDLMHLWASRFLLVCPLFGHY

SEQ ID NO: 40097 - protein, 65 aa, A.fumigatus
NFFSYYSSLHYSYILFISLSDVFLPLVAVIPSKSERRSDAGEKASLTSMARAQRDNWVHLRKPEK

SEQ ID NO: 40098 - protein, 193 aa, A.fumigatus
ITCTTEAKCDRATLSVLDVPPHAQLPVSLRVQRPTANLNTLVVVRVLLNTGVAALAGCGAGPVDSTTLVPVLGDARGRRRSSWSSTGQSGFVCRLGGTASKSCSRSSGGRRGGRSSTGSLSSLSRRGSGSLGCRHRGWRRSRGRGRSVDNLSLSSGRSGGVVHRSSRAGDGGRRRGRRGGAADKVILQNGKVA

SEQ ID NO: 40099 - protein, 98 aa, A.fumigatus
PSLEGDLLWNAGRTSATYIEEKASSLVEGKDVLEVGAAAGVPSIVSAVKGARTVVMTDYPDPDLVEDMRYNASLSAVIIPRCHPFMLLDTNGVIRLNR

SEQ ID NO: 40100 - protein, 119 aa, A.fumigatus
QLIVLSGYPCSGLSYRAQQLASLLEVTQDELFKSGAIPASRPRYKIHIVPTHDPSHPRTVYDNARTEKEARGVAYTRAKRALGRDSFVILDGMNYIKGYRYQLWCEAKALGTTSCVVSL

SEQ ID NO: 40101 - protein, 314 aa, A.fumigatus
CEMLKVHVGTPVDQCVANNEARIRRRNTQQEKSESHDNEPKEASTINADPEVEAQNTTQTDAPSPATDDTEEPYPPDLLKNLIFRYEEPSTYSRWDKPLFTVLWSDPEPPIAEIWTALTGIPHPSTSTEPETPVTSLTSVLASSALLSDTASINTSATARTPRTAALHRPKIKPHQATVQPTATDSSALYAMEKCTSAIVSAIRSYALTNPSAEAALAQNPDARGIAIPVPEASSPIFIPAHVATSGTTDELAGAGGILALPRLQRLRRQWIGLNRAYVGVNHASAVKGGLAPDQVGDAFVRFLNAEFAGESGV

SEQ ID NO: 40102 - protein, 225 aa, A.fumigatus
RAIYENVQIADKPTSKYLDSHLKPYRCKVPACMEAQLQFSSNACLFRHEREAHGFHGHGDNPHLCLFEGCDRSVPGYGFPRRWNLFDHMRRVHDYASSERPSSPEHSPSGVSAPKKKEASGRKRRVTGASGAQTMKRTRSTHSQTSTSKALQQTASHNSQRLQNAERNYYNCRARLLEELSNITPQDSSMHDKVNASLQELITLGLNYRHIEASQTSSLPNGLPA

SEQ ID NO: 40103 - protein, 68 aa, A.fumigatus
KITDTPRKAFHSGHWICFCVPMISSMLKSSRSARHTFSGIGTSCFESSFFKQTTGPISGQYHCSVKLA

SEQ ID NO: 40104 - protein, 170 aa, A.fumigatus
GWNQARSKSSAQALINTTITNCKFSSKVTGLPEFVVPRLRDLLRDYLTNSGDSDINPSEPGSRSLKVKLKIAGNRSQNTIRVIEKEKKLIRSHRVTDYINSVCERFQELLALYFPYDEDDFDYERRVTLTLKVIMKPLHGNTNGLAKSYVVSFPAVLEECTSKQVSGTGN

SEQ ID NO: 40105 - protein, 72 aa, A.fumigatus
PNTSESSSNCSSTMVLLDFVLNIIWLPIGAHDTWGFRSAHEAFMSTYNGTGGPASLELVSLLPGHCRYSDWV

SEQ ID NO: 40106 - protein, 214 aa, A.fumigatus
YALLIRLSPAICVPIRRCPRQRRPRLHEHHLHCSSVACKPSFAHYTPPKHILTPPQNTAIAIVAASRLVFAVARDGVLPFSGWVSRVHNGQPRNAVVVVWTVAALVTCTLLPSSVAFTSLVSAAGVPSAAAYGLICLGRLLCTPKRFPKPKWSLGRLSKPFQFIGVFWNAWVVAILFSPYAFPVTGENLNCKIPQFFILLSVSVCGRILMCLSE

SEQ ID NO: 40107 - protein, 108 aa, A.fumigatus
LIGKTRLPFRGMWKLTMSRTSYLVTMVFTFITAAVIAEVCSASPSAGSIYLWAAEAGGPRFGRLLGFTVAWWSTTAWTTFCASNTQAAVNYMLSVSLQVYSSANQGPS

SEQ ID NO: 40108 - protein, 61 aa, A.fumigatus
DTDVLQPDADTLFSFGSPQPFVSLYAVVLGKGGHVFMNIICIVALWLVSRLSLTIPPQSTF

SEQ ID NO: 40109 - protein, 136 aa, A.fumigatus
PLRRTRPSPSSPPRVSSSPSPVTESSPSPAGSPASTTASPATPSSSSGPSPPSSPAPSSHQVWRSHPSSPQPVSPAPPHTASSASAASSARLSASPSQSGAWAASASHSSSSAYSGTPGSLQSCSLHTHFPSRGKI

SEQ ID NO: 40110 - protein, 80 aa, A.fumigatus
LDKVVLEMDEINDDFPDTDVTLVIGANDTVNPIALEPDSPISGMPVLHAWKSKEVIVMKRGMSSGYGKCFLSFILSRTYH

SEQ ID NO: 40111 - protein, 63 aa, A.fumigatus
IDAPIIMAGVTILALISYFVMPEDAWLPRNRISHFIDSKGAVSETVEEVGSSRMAQHEGTASQ

SEQ ID NO: 40112 - protein, 68 aa, A.fumigatus
GGAFDCRKGEELRQIKCQFRLTSAEASVKEPTTHSYSILDESTSKYARFVQRHNALTQHLGLQGATQT

SEQ ID NO: 40113 - protein, 244 aa, A.fumigatus
DDTFGEGRNDYDTPATSIVMTPAESDVNKPRRRVNASTRARELRSRTTPLSSMQRGLKRNAAALSPDDSTLGASDEAFAEALQMQEYQESFSKRRKIAVSASRDTPEIEKSTEDDDILEHIDSDGFEDAEDEEDLEPWQPKRSIRTSRRSTTQQTVPDSEASDLSDDEAGDGNYQTESEAEGPPSSSSEEEPLIAERARNSGRSNASSGSRARRQALRNQRHTLIPSWMSQRVSMLASSNVIML

SEQ ID NO: 40114 - protein, 114 aa, A.fumigatus
AYRERRKLEKQHPLITKMWDDLKNTPPITPVLAEQPPGISRTLKSYQLEGLNWMLQQEKSQYKGGLLGDEMGMGKTIQAVSLLMSDYPVGKPSLVVVPPVALMQWQSEIKVRLF

SEQ ID NO: 40115 - protein, 404 aa, A.fumigatus
HQGISKGPLAFTYLMVTNASQQRTTSVARACFALKASYKWCLSGTPVQNRIGEFFSLLRFLEVRPFACYFCKQCKCQQLHWSQDADKRCGNCKHSGFSHVSVFNQEILNPITERDNPEARKEALAKLRLITDRIMLRRVKRDHTASMELPPKRVVLHNEFFGEIERDFSRSIMTNSTRQFDTYVSRGVMLNNYANIFGLIMQMRQVANHPDLILKKHAAGGQNVLVCSICDEPAEEAIRSRCHHEFCRRCAKDYIQSFEADSVVDCPRCHIPLSIDFEQPDIEQDADHIKKNSIINRIRMEDWTSSTKIEMLVYELYKLRSQKQTHKSIVFSQFTSMLQLVEWRLRRAGFNTVMLDGTMTPAQRQRSIDYFMNNVDVEVFLVSLKAGGVALNLTEASRVFIVDP

SEQ ID NO: 40116 - protein, 81 aa, A.fumigatus
WESTRWWNPAAEWQSADRCHRIGQRRPCVITRLCIEDSVESRIVLLQEKKANLINGTLNKDQGEALEKLTPEDMQFLFRGS

SEQ ID NO: 40117 - protein, 129 aa, A.fumigatus
VISYSCPVTGGAGMLAIASARALLEHGLSGLALLDLPSALQKGDAEIDALRRDFPSARIITHQCDVTDAAGMQEVAEKIKIELGELNILCCFAGIVNCVAAEDIAVEQWRRVIDVNTTGSWIAAQAVGK

SEQ ID NO: 40118 - protein, 145 aa, A.fumigatus
DPDAESRYMIASGRGGKIVLVASISGHRVNYPQPQIAYNVSKAAVLHMKNSLAAEWTQYGIRVNSISPGYMDTVLNEGEDLAPWRQIWADRNPMRRMGSPQELTGPVVFLCSDIGGSYINGADIVVDGIPLPSGCPGYMKELTGV

SEQ ID NO: 40119 - protein, 80 aa, A.fumigatus
WALLAPANRCAKIPPGHAMCISKQMTTPTSLAVTDKVSSVPFVMKSIGHRVLRFCLTTFLLCLSVPMANWNIDNTDHHFD

SEQ ID NO: 40120 - protein, 127 aa, A.fumigatus
IDALAKNLKLAEGIIASCPACKANFFNIFCTFTCSPDQSLFINVTQTEMASSGKLLVTELDNIWSEEYQSGFYDSCKNVKNGASGGKAVDFIGGGAKNYTQFLKFLGDKKLLGSPFQIQLPNRALIT

SEQ ID NO: 40121 - protein, 288 aa, A.fumigatus
GRSQGIQVTGMSCCRLPCDGSVTDFFSPFQLETVQSSLQVDPDNTELQSLKTELEELINLTETSIAELKPLAPPPSAAKPSPPPAKDKWSKENHPAYQAGYRRPAAEIPEEAPTPVTYSVNDHVLARWVSGDNSFYPARITSITGSSANPVYLVSFKSYGTVESLTAKDIKPISNADSRKRKADGSSGYSSSQTPTPQPLHSSVISAAADINPALANQARKEPSKVGDASARPSKVARKVKATRELEAGKMKWKDFASKSKLGRKESMFRTGEGINSRGKAPLSKVPE

SEQ ID NO: 40122 - protein, 116 aa, A.fumigatus
SSKIFLSMSLVVPVNALLQLGLTCHRYEAKKVLKSQTDTDDSEIQFILEYYSLVREGKTNYVATTAFRDVTSDEPQQPVDFFRSYFEEFAPKKGAKKKEGKMESEFEEGRWCTLFW

SEQ ID NO: 40123 - protein, 61 aa, A.fumigatus
LFPTMSSDRTAALFMYLSFSFSNYKCAWKKRQQAETREDWGQAKSPHRRDKGWMTTPVSNT

SEQ ID NO: 40124 - protein, 62 aa, A.fumigatus
EHMRKMRDASDSLIKKCFPSKWAMHLHDQHLAKVAHNTYVPLLQKTRRPYDEKIAIRIEHNT

SEQ ID NO: 40125 - protein, 100 aa, A.fumigatus
VAFPRNLRRRIHRLQIKVKSDSRLVSYAEDGLLFEDGTHLPADVVIYATGYTGNLRDSVREYFGEGIYAQVEDYWGINQEGELKGAYVPTGRMFPERCVH

SEQ ID NO: 40126 - protein, 103 aa, A.fumigatus
SIKRIWTRSELQSGTWDDSHAQWTLKVRQTTAGSELIKILTCRHVVLATGGPCNKPHKPFYPGEERFKGVVRHSARYHNARNWKGQRGVVVGTANTGEQRTKS

SEQ ID NO: 40127 - protein, 98 aa, A.fumigatus
GLSRARGCQRRTKLFNQRHPTPICWQIFTSSISHTNGTMPSIDLGQEDKEWKILLQKHTPDYSDAREFWLDFYSLSKYPNLDERGMDLLKDQDSKNFA

SEQ ID NO: 40128 - protein, 236 aa, A.fumigatus
PRTMTQKRSKDILPSLLDALPSAIIPDDVDVASIASSFANSLARLSASDFAEVAIWRDCFALTGTLRTFYTPRTVSEVYRNRCLARRAQLFIVQADEAHVVRISPSCSWIDVPFRFEANASPAACCSGVLSLIPSGENGDYRIWMLQTLLDRFREYPSVDTLDTTTQRPSVGDSMTDFDCLIVGAGHSGLNVAGRLKALGVSYLVIDKNPRVGDNWRLRYDSAKCVFFRLFHGNVA

SEQ ID NO: 40129 - protein, 502 aa, A.fumigatus
SMPTHQWESSRPRDFRDCLASPSLNCDEYPPVVDLEKSIYSLATTGKETKKMKTIQLGQLSDFKQSRYVIHLSDGKRLVLFRLPTIESSKGSSPAANETEDGWCYYAMEAECPHAGGPMEDSHVDIEDSAYIASCPWHAYDFNVETGESSVGIKACTFPVKIGDEQVTLQYPGDASLVRLDPVSEKIKLKKGSVSERPTVQPVSQQTTPAKYLDEDATLCDWAAHILNTSNHEHKIELTAHLYATFTERERTPSPMPIGSGSVTPPDQPPRDGLVTVEPRSMPRAGKGGTLKSRIAMLHALANIELWAIDLAIDICIRFASFQTQPQVGDTPRELPRTYFHDWLKVANDEAKHFSFLRTRIEEMGSYFGALPVHHGLWDSAMATAHDLRARISIIALVHEARGLDVNPMTIDKFRRAGDRESVDALEIIHNDEITHVTTGHRWLTWICQQEGTDPVQVFRTNARKHFRGALKEPFNHEARMQAGLNRQYYENLMGQRDIAVS

SEQ ID NO: 40130 - protein, 183 aa, A.fumigatus
GTESETIPIGLGGNDLQPLTCPDGETYYKWQGKTTSAQYYVNPKGVTPEKGCQWGDGTQAIGNWAPVNLGVGLNKGKWLSIFQNSPTTSEKLDFNIKIKGDNLSGSCKYENGVFYSETGSSSSGCTVSLGHPTTLRIVDLQTVSNRSKSCLAMPPLSSTRVRSCPAPMVVRAAVARKCNGHLR

SEQ ID NO: 40131 - protein, 290 aa, A.fumigatus
  UNSURE (105): Identity of amino acid sequences at the above locations are unknown.
DYRHCERSIRDVNTMKFNTVALTLATAGSLVTAQHHHQHRHHQHKREDVVESSATVVQYELDGKPISLKQVCAGLADNTLKFANNDHPTGICDNLSSAAALASTXEVTSAFAPAQFIELSSVVTSATPTSASSSETVQTPAASSSSASSSSTATGLDADFPDGELDCSTFPSEYGAIPLDYLKLGGWSGIQYVSYAGNFINDIVTAVAGDTCKDGAMCSYACPPGYQKSQWPSTQGATGQSVGGIECRNGKLHLTNPSLSKKLCIPGVGGVHVQNTLGETVAVCRTDYPG

SEQ ID NO: 40132 - protein, 381 aa, A.fumigatus
VARASSALLKHIKSKQEEQEKRATKKTLIGDDEDSEEDTPLKNEAIWLVLTTKKHVVDKNRLKPGKISIPHSLNASPSLSICLITADPQRSVKNIVADPSFPQHLSSRIDRIIGYSKLKARYQSFESRRQLLSEHDVFLADDRIIMRLVNTLGKVFYKSSKRPIPIRIAEIEKVDGKKVKKDPKKKSKDDDSSFASPAIVAKEIEKTFNCAAVQLAPDTTAAIRVGSSKFTPEQLAENVEAVVKGLTDKFITKGWRNVKALHIKGANTMAMPIWLASELWVDEGDVVEDVEEDLKAIEGTKNGKKRKQIEDDKKLLEDNKKAKKPKADEDDDALSMAARKEKLQRQKAKALEDGNESGNKKVSNAEKVASGLSKKKRKSIS

SEQ ID NO: 40133 - protein, 75 aa, A.fumigatus
HRAASLKGHSKLCVTQHNFRLDSQAKQKIEMVKHELIETMPQWLMPAYVICVVYAKGASAASSLMCSRVLWFESP

SEQ ID NO: 40134 - protein, 64 aa, A.fumigatus
HRARNSVYEAYYKNTLLRNESNSNIAWIGSLQAFFMYASGLVSGPLMDRYGPRVRVITLRTDNY

SEQ ID NO: 40135 - protein, 320 aa, A.fumigatus
VILVPCSIVFVLSVMLTSLCKEYYQFILAQGVLGGVFNGLTYTPTVTAVNQHFFRRRPLALGIASSGSSLAGIIIPIALNRMFNQSSLGFGWSVRILGFIMLALSVVACLAISSNAPKRRTGAPFFLEAWKQPEYTVQIIGVFLVTWALFVPMFYIPSYAQSIGIGVSLSNYLIAILNAGSLVGRILGGALANRLGRFNTLAAASAACGILILCWLRIKSRGGMVVLSVLFGFCSGIVIGLFAATIAVTAPKPNVIGSYLGMAMGVLSLASLTGTPITGAMISTYGTYDAAIIFAGVSAVLGAVIIFVARVVYAGWRLVA

SEQ ID NO: 40136 - protein, 149 aa, A.fumigatus
TTTIPQIITMPRWLIQHSPNTLTPEEKSHLAQQITQAYVGFGLPAFYVQVHFIEQPAGTSFIGGEQHPNFVALTIYHLARTMTSDEQRQGFLKRIDAFLTPMFEPKGIDWEYFVTEAPRDLWKINGLAPPAAGSEEEKVWVRENRPVRF

SEQ ID NO: 40137 - protein, 108 aa, A.fumigatus
YYASIQYTLVKKYPFPIITMHLDHKLPWNTVSAHFAFTKDNQDIRRNDFLVHDRLVDRQSADFKHFTQTLISTIEEFSATERAKYPPPAALPKSGPLYDAAILSLHLK

SEQ ID NO: 40138 - protein, 227 aa, A.fumigatus
KYHLGPHATNSAVSNPLSEEFQDVYYWISQAPYSTATAHLADAVKMLIISNEMLALLRLANHEKIPLMDLNHLSWGHSFGVTHVADVALEIYMLLNIAASVKANAKPGSANETGCLTETRRFRSFASWGLGDFDFPAQNIPHRLFWNTKCITDGLEFSTWDPLRLESDDERKEMNEYLKMCFELLYRYDLLLNDNGGDPDWNDNILCILHTWGCKCIALSQSGFCFI

SEQ ID NO: 40139 - protein, 79 aa, A.fumigatus
NDFSQAHRVAAKIEAGIVWVNGHHLNDPSSSWGGFKESGMGKENGIEAYESYTKVKSTVINYGVQPVWFDDEPANARYG

SEQ ID NO: 40140 - protein, 170 aa, A.fumigatus
IFCVLSFTFVLPISVTSLITMGSATNNPVDFGGNYAILNLDWMSLLIKAVENTPEGQAMIASCSRWNVAVHQKSPRPLTVFSTLSFSPGQPEVQPNSPFADLLRPYGEFAQGTPPVEIDERFHLDEKDLVLHKTRWSATSGNALEQILKAQGIKTVVIVWNTLFLNMTVC

SEQ ID NO: 40141 - protein, 86 aa, A.fumigatus
QYANYGNSLGLSLSGVVMSTMYRLFDLDYDMYVIRDNVVELPPAQNTAFSNVLLDMLLPKMGLKVISLEDALEALSRSEKSAERTV

SEQ ID NO: 40142 - protein, 114 aa, A.fumigatus
LREDYKLSTTVVSLIFVTPFAGYAIATLVVNKIHMTLGQRGIAIIGPLCHIAPFVIMAIHPPWPVMLAVYVIVGLGNGLIDAAWNSWVADMANANTMTGLLGAFYGVGYVKHVR

SEQ ID NO: 40143 - protein, 65 aa, A.fumigatus
LLSLTVSVGGWVVDFMIQERNGKPFESGLVPTGFWAGVTVGRLVLGFVNDWLGMYPLYAALAIEC

SEQ ID NO: 40144 - protein, 125 aa, A.fumigatus
RGSSGRFMVWGTSNMCDDRYSNTDGRPRATLSPTIATQMIKSGLHWNYFYYTLLGGSVLELLTSVATFWQENAVSYRAKNRRSPDSSGGSRTTEAMKSPITWLIASWLFVYMGVEGALSDLLWSK

SEQ ID NO: 40145 - protein, 60 aa, A.fumigatus
LHLQTYVAIPQWALYHREQYFAEPNDFHPERFLGDPKFANDRRDALQPFSVGPRNCLGRK

SEQ ID NO: 40146 - protein, 85 aa, A.fumigatus
VVCYVITQAVYNVFFHPLSRFPGPLLHRASRLAYVYRLIGGTLTLDALEMHQRYGDIVRVAPDELFFAHPDALVRHPQEDWEGDG

SEQ ID NO: 40147 - protein, 63 aa, A.fumigatus
LTIFSLAYAEMRLILALVIFHFDMKIDPDCRDWIQQRNFTLWQKPPLKVYLKPVARKSEPNQV

SEQ ID NO: 40148 - protein, 92 aa, A.fumigatus
STQDFNYPNRCISSLKKPAVTDPPDTTVAKMGLIEGLQAALDYLENPTALTATSVSMCLCWLATYAGMVRKSFQDRSYSMPLMPLCCHIAFE

SEQ ID NO: 40149 - protein, 229 aa, A.fumigatus
SEGRLPWTHSKCINATEILYESPLMSSFSPTQMPWSDIHKKTGREMDKAAWFYRPLEQSPRCIVDESHEQHSRLRRQMAPGFSEKSMRDQEPIIRGYVDLLLQRLLEKSNDGQPVVISDWFNYTTFDIIGDLVFGEPFECLGSSKYDGWIKSIFESLRPLTIVQALSFFPWLKRIALDTVPKNLQGDIKQQQQQTEAKMRRRMAVTASRGDLMEGLLKKKDELVSNLAL

SEQ ID NO: 40150 - protein, 125 aa, A.fumigatus
YRNRIGTNGRPLTNLQHLSTEELIGNAQVLILAGSETTASLLSGVIYLLLQNAVAYRQLVDEVRSTFNSEKDINFVSVSQLSYMLACLNEALRIYPPVANGLPRVVPKGGAQILGQYIPEQVRRH

SEQ ID NO: 40151 - protein, 529 aa, A.fumigatus
VANAIEIASNPSADPALKTQAFDFVNQLRSDPSGWQVCLSLFTQTPQRSGIVRHVALEVVNSAAQGGLIDLQALAYVKDGLLAYLRQVYGQDAGASDPPNIQNKIAQTITFLFSALYASGWESFFDDLLGLTQKSPSSTTRDNASGIIFYLRVINSIHDEIGDVLVSRSRNEQDKANALKDLIRQRDMQKITSSWQQILSEWRDGNDVIVEMCLKAVGSWVSWIDIGLVVNQTMLDLLFQQLGRAQKEDLRQGEEKVRDAAVDVFTEIIGKKMKPEDKIDMIIFLNLDTIVSQLSNSPPLHGNRFTFKYDTDLAETVAKLVNITVIDIVRALEQEGVSTECKEKANGLLQAFLPHILRYFSDEYDEVCSTVIPCVSDLLTYLRRIAKVNPALASQHSSILLPILKAIIAKMRYDETSSWGEEDEQTDEAEFQELRKRLGILQQMIASINEQLYMEVVSEMVATTFENLRQSGSQMDWRDLDLALHEMFLFGDLAVKAGSLYTKGNPNNQAAERLIEMMLRMVESGRYIK

SEQ ID NO: 40152 - protein, 356 aa, A.fumigatus
RLDIRSFTHPATQLQYTEICVRYSSFFHHHTHLIPGVLENFLQLVHHPIKKVKTRSWYLFQRLVKQLRQYVGNVAQTVVEALGDLLVIRAELPSEVSEGDEMSSEDHELADAIFNSQLYLFEAVGIICSTPTISPDKQVLYLQAVLNPIFLDMEKNLEAAKSQDERAILQIHHDIMALGTLARGFSDWMPGTNTPATLPAPEVSAAFNQVAEATLVALESLKSSFNVRTAARFAFSRLIGVLGSRILPQLPRWIDGLLTQTSSRDEMALFLRLLDQVIFGFKGEIFSILDTLLTPFLQRVFSGIADPTTGTDDEIQLAELKREYLNFLLAVLNNDLGAVIISERESQNQQSILVSV

SEQ ID NO: 40153 - protein, 168 aa, A.fumigatus
ANPVPGNQPIFETVISTIEHFSKDIDDFTTAKMAFSVLSKMSSSWGGPDVIAEASNGTPPSQAPLPGFGQFMITRFSPLCWALPSTPFFNSKDAQAKQVLAEAGGLQRTIYAKTGMEYLTYLRDRELPGMGMGGELIEEFVGALSRLDLKGFRQFFPVCLSNFHILSI

SEQ ID NO: 40154 - protein, 119 aa, A.fumigatus
LDNSVREQGHTIMSVTTKATIASFGGKLLKLSHAAASTKCEMNFNLYLPPQAFQDPSQKIPVLIYLSGLTCTADNCSEKGFFQHGASKKGIAVLYPDTSPRTLQPQPLAPPPPPGTGQE

SEQ ID NO: 40155 - protein, 99 aa, A.fumigatus
RSGRGGWMSSLTWLVFLLSLFDFGGGLGGEKKTDRLPQGTGDNFYKQGQLLPENFEKAAKEAGVEGVNIRYQPDYDHSYYTMATFADDHVEHAAKYLFA

SEQ ID NO: 40156 - protein, 215 aa, A.fumigatus
QLRPRTRSHNHVRHHKSHNCLVWRQAAQAEPCRRLHKMRDELQPLPAPPGLPGPLPEDPRPHLPVRPHLHSRQLLREGLLPARRQQERHCGTLPRHQSPYVTAPTPSPPPPPGHWPRITLILNKMIETGGLDIEGENDSWDFGTGAGFYVDATKAPYNKGYNMYTYVTEELPKTVFAAFPQLDSSRVSITGHSMGGHGALTLVSSVQSDVREWLD

SEQ ID NO: 40157 - protein, 80 aa, A.fumigatus
QKVPALKQYLRNPGKYKSVSAFAPIANPINCPWGQKAFAGYFGEDQKAKWAEHDATELVKKWKGRLDVLIDVVSLLAFAV

SEQ ID NO: 40158 - protein, 112 aa, A.fumigatus
VIITSFLFPEGKFSLERLQSVLTALGGDKSKLVLDLSCRRKDNTWFVAMNRWQTITEMEINQGILQFNFVLLTAPKLTLAQNQSQCLSRIAPSSSFMLQMWKGYSKVLTKSL

SEQ ID NO: 40159 - protein, 153 aa, A.fumigatus
DKHSPSSYQRRLWGVTIIARNLLWEQIEVDKMTKFRPCIDLHSGQVKQIVGGTLSDRDSDLKTNYVSKLPASHYAELYRKHELRGGHVVMLGPGNDEAAKEALRTWPGGLQVAGGINDKNARYWIDQGADKVGFLLTPAGCIWSSHLCSRLVQ

SEQ ID NO: 40160 - protein, 114 aa, A.fumigatus
PGYTSVQFCASHCTEANPSPESISMLEPYCSEFLIHAADVEGLQQGIDEELVAKLAEWCSIPVTYAGGARSLQDLERVHVSSNGKVDLTIGSALDIFGGLGVTFNECVRWNEQH

SEQ ID NO: 40161 - protein, 69 aa, A.fumigatus
NLTSIFSYRPIADRCEDKSISQLNRSALTSINHLSHLWSRQRQNEARCIGAKCLFLGKVIVHSQNRITY

SEQ ID NO: 40162 - protein, 186 aa, A.fumigatus
ALRTYQTAKPPTLSTESTTTKPASKKAKNKKEEDDDDDMDAEHLKNDLALQRLLKESHLLDSASELAPTGKNRLKALDLRMQSLGAKTSLYQQNMPSSLRRGIKAKALMKEEKRRREAKENGIILERPTPKSKVTKGRRERGIAGPGIGKLSGGTLNLSKRDIAVVQSARRSRRGGRGKSKTRGRH

SEQ ID NO: 40163 - protein, 156 aa, A.fumigatus
LVGPSYLACWLLQSANFYAAEVLHKTLARQSGDPSTQTRFQIGRGNSSPAAETSFLVLTYCIMMTNMTLVLRIFAPSSTATKYLDSRFESKDDLDSVRSKVTWSLATLRATRTGMTGIATAMLQNREKTGSSPVLAMSVPSFANRQQVLNLDHLIE

SEQ ID NO: 40164 - protein, 294 aa, A.fumigatus
SAYFLGKICKQVLVMSSSICVASSRLSLPTLLRNVCRSEFTADLGPRSEYKSFFAMQRAALAYRRIRGPRQFSSLTLADDIPTTSKQPPSRAANVSSVSQPGEPTKTGAGEIRASSHPSEVVSSSPRADSAKRKKASAPEATAGAKPAANESSDKKRSEAPRKSSLSILSKSKKKKEPWQIQKEALKKKFKEGWNPPKKLSPDALEGIRHLHAVAPDRFTTPVLAEQFQVSPEAIRRILKSKWRPSPEEMEKRRERWERRHDRIWSQMTELGLRRPKRSAEKFSDVKVLYDKPV

SEQ ID NO: 40165 - protein, 466 aa, A.fumigatus
SARTAFLLPLREITKTPGTSTSAPCLYCQLKVKELGIKPRGRRSSSIVPGRGRVMVVLPACKSYPEGMRGMKIASQKVRLKLPYLMIDDTHIFRFLAGRNTVRGISEAGTNQFPGNLRPDLEGPRVSRSGSNGQRPIQHSGSPRTPGRRPQLPPMDFKFPPAPTSDPSNRPALSPAATSIDENPGSVSTGLSSGKESPAIPPLGHLPQLTRIISTSSPSGSHRSSGEFYSASDNSSETLQSEYTNYSANTRRPSGPRHARHFSSVDTGPKRPNGQTLLMGYAQVSASFTVDGSLINQAAFEEVKRKGVVGSQGNAAGTLGGGSASISDKSRKSGGFWGAFKWNAIEESISGLLSNNELDGLRDMRGVTSSRSIPLLSTPQSLLFVDLRLAPGEEQSYSFSFTLPKGLPASHKGKAIKISYNLVIGTQRPSGSNEPQRVNRITIPFRVFSGVNSKFSRSSSLLDTCD

SEQ ID NO: 40166 - protein, 299 aa, A.fumigatus
FLLGQGEILGHNLMSPYVILRDEARVQKVGSTSPPPVSKNKSISGHVWTSAPEFLSYVDELLEQQSRKNLLQPPDLVSARRSSSYEALAGPLSCKDAIDLAILRSNQAISKARSPNRFEIARNGRRIAVVVLNRPAHRLGETITATVNFTDVALPCYALRATLESFEKVASSLAVRSNASIHRATRRVHASFFENTLYSTRVVFSPAVPVSATPTIITTGVNHEWELRFEFVTTSLHHELGTGLSGARLLEVVSEDDRGQVMSGLENLGCESFEIAIPVTVYGETVRERLPEENEGYSI

SEQ ID NO: 40167 - protein, 71 aa, A.fumigatus
NCDVRLGYQICAVYQILISTYLSVNGILRVYHVGDRYQYEYHKKTLMERIPFISSAMGMINAHESRTYASR

SEQ ID NO: 40168 - protein, 110 aa, A.fumigatus
GVSWSFYSEANQQMGLISNSGLHLGLRSMWTACNWAVGVFAITSLAAHEFCQRRRVQELDGMKQAVELMKELKLKKQREKEKQMAEEAARLAEEEKKRKSWTNLSNYKFW

SEQ ID NO: 40169 - protein, 62 aa, A.fumigatus
ANKVGLVAWMSNAVITCKGLQETCHACKIEAIMPKMYSNKFNNYHLKRLTSYYSNFICLKGP

SEQ ID NO: 40170 - protein, 67 aa, A.fumigatus
  UNSURE (15): Identity of amino acid sequences at the above locations are unknown.
CLVNPCYLAQQIPNXTSCKLPAIRARIPFITYTTKVMIARAATAQDDILGDGTTSVVLDGRRALEAG

SEQ ID NO: 40171 - protein, 408 aa, A.fumigatus
FLDQFKIERNIDRELLLSVARTSLATKLNSALAEKLTPDVVDAVLAIHRAPEKPDLHMVEIMTMQHRTASDTQLIRGLALDHGARHPDMPKRVENAFILTLNVSLEYEKSEINSGFYYSSAEQRDKLVESERKFVDAKLQKIVELKKQVCGTDPKKGFVVINQKGIDPLSLDVLVKNGILALRRAKRRNMERLQLVCGGVAQNSVDDLTPDVLGWAGLVYEHQLGEEKYTFVEEVKDPKSVTILIKGPNQHTIAQVKDAVRDGLRSVYNTIVDGCVVPGAGAYQVACAHHLSSEGVRRSVKGKAKWGVAAFADALLVIPKTLAANSGHDIQDSLAALQDERAEGNVVGLDLTTGEPMDPVQEGVFDSYRVLRNCIASSTGIASNLLLCDELLKARQMSKQGGPGGMDE

SEQ ID NO: 40172 - protein, 108 aa, A.fumigatus
ISSNYEVTATGACYRTEIAACLKYMTRRDWRNYALGYSTKSFDAQKSNAIIQEWIRAYAKEADTTIAALEALSPRKTDQEYTGKLSTLLRRWKQIRCLCDKALEAVSC

SEQ ID NO: 40173 - protein, 98 aa, A.fumigatus
IDSPAERRSAILNQILEPEAADRLGRIRLVKESRAIDVENRLIMLAQTGQIRQKVTEEQLKELLNAIAENQRKDEEEQKIVISRRKGGWDDDDDLLDL

SEQ ID NO: 40174 - protein, 226 aa, A.fumigatus
CWERLTQPPRSDLIAALGEATATPYFIYRLRDAMLSDPTGRRILRDRPRITSETLKLPYLRTLPENSVGRTYATWLDREGVSPDTRNSVKYIDDEECAYVMQRYRECHDFYHAVTGLPTFVEGELALKAFEFLNTLIPMTGLSIFAFVRLKPAERERFFSLHLPWAVRSGLASKELINVYWEEILEKDVDELRKELGIERPPDLREIRKLMRQQQKREKERLQGKS

SEQ ID NO: 40175 - protein, 105 aa, A.fumigatus
RCALPELQGIPGIENRFAPERLRSMVTKLANQTAKNTSSMLADVRSGKTTEIEYINGYIVRRGEELGIKCAVNYMIKHLVLAKQQMVKQRVSGAIPIDILEGSKL

SEQ ID NO: 40176 - protein, 138 aa, A.fumigatus
LSNLDVFVGEAGSIWRANKHMELSKCMCTEETGCDENCQNRYMFYECDDGNCGLGPGCGNRSFEELKQRTKAGGKYNIGVEVIKTADRGYGVRSNRTFEPNQIIVEYTGEIITQAECEKRMRTIYKNNEVRHLIYAVT

SEQ ID NO: 40177 - protein, 464 aa, A.fumigatus
IISNSTFPQSSAPQEEAPPSRGTEFTDPIIPDRNTSNASPFGNTTSRSVGESAKLLHDRDRVYKITPQHLDLGANHNIEKSDPSQRSPLSFLSLQNGNTAPEPRDNRAHERLSSADSSPGSIQKQHHAPTSANLGKNYEYFTGNTLFFGGGRFQNSRDKPINIATGIFVVLPSALFFAYSAPWLWHHISPAVPILFAYLFYICFSSFIHASVVDPGIIPRNLHPMPPPEPSGDPLLIGPPTNDWVMVKLATSDVAAMDVPVKYCKTCNIWRPPRCYHCRVCDNCVETLDHHCVWLNNCVGRRNYRYFFAFVSSATLLALFLLGASLAHVLVYRAREGVSFGSAIDKWRVPWAMVIYGALAAPYPASLWAYHLFLIGRGETTREYLNSHKFAKADRHRPFTQGNIFRNWISVLARPRPPTYLQFKRPDQEGDQRLSAMKRKDRPRDVEAQADIEMQHVPPTPRQG

SEQ ID NO: 40178 - protein, 442 aa, A.fumigatus
FYSSLYLRSRLFQQRNHVHIVLKAIEMGKRTRSSVASPATPATLSDLQKHAHEHVDETIGLEVPEQLLTPENSRSETSSNSENACPEEKPTLRRTSTRVTRSSLRASGTFESKPEEEDAILPSLSGEMDPTNSSGNLANDVTKLKRSQSSHLRHSIAVMETAVWSESTLTRHIMEAEDHLLTPDTPVSNSSQEPQLDDLNSSLPQRSLRKRVERALTKEDSYNRKKDESAARVDGPLPRRSTRLSLLEKASDCVEKAGSVLGKRSKDMMEKGQILDRRASLRPRSVVAPKEEPASLTSSEPSAVKKRRVSESDLPSKTKAIDESTAQSDTAAKEPRFKRKRWLSHGLYTGQEYTTARPSQNRNKNAKRRSQGVPSQRRLLPMPMFAGDRLLQLGRDFQLPFDIYSPLPPGQPKPDEWRKTNKSSLTTECALVERKSRTNYPI

SEQ ID NO: 40179 - protein, 67 aa, A.fumigatus
CYYLMYFDQNMIIDATRGSIARFVNHSCEPNCRMEKWTVAGKPRMALFAGDHGIMTGEELTYDYNFE

SEQ ID NO: 40180 - protein, 78 aa, A.fumigatus
DRQHELTSPAIATSTFGVSFPLLSGDRIPNEAAMRPQRSLQTCKLPDDKYMKFFRLTDYAIRQEVVRAPTTQYGGMCG

SEQ ID NO: 40181 - protein, 591 aa, A.fumigatus
SVQVNTDTPVETNKFYCGLFLGTQTNNTFTHPYSVAWVKGGGTSQSYGMAISHVESNIVAHGPVNTAIPGSPISYYVNPIGIHSVILSASELGPSTVLTTENPLPFSANAVLRPSASSSQSITIPVVQGMGFVTGIYSNLQPKIQSGVFFTKMVTAGSPRTGIFKYSLFLEDGTSWLLYATPDDGSDPQLQLASNSEIIGPAGWSGTIQVAKNPAGASGEKFYDNSSGVYAVEGAVMGSVSESTGTYSLMWAKAGKDAQNTPLLMFALPHHMESFDASTQSRATNITLRTTTKGQATAVIGEYWTMVEPELPISMGFAPWSVSGGSIDKISPAAQQVILAAAPTELQQDMDAQTNLNSMYFSGKALSKFATLLYTVDKLGGNSTLAAEGLARLKQSFARFIDNRQQFPLVYDNVWKGVVSSASYATGDVGADFGNTLYNDHHFHYGYFIHAAAIIGSMDPQWLETSKDWVNMLVRDAGNSAGNDPLFPFSRGFDWFHGHSWAKGLFESFDGKDEESTSEDAMFAYALKMWGKTIGDVSMEARGNLMLGILRRSMRNYFLMESNNKNHPANFIANKVTGIVRQALSPYVLWG

SEQ ID NO: 40182 - protein, 60 aa, A.fumigatus
NTKYMATQLPHPFETKAQYERSLRLPIGPEWSTKETLQNATKPRVMIKQGIIKPMEKPMI

SEQ ID NO: 40183 - protein, 108 aa, A.fumigatus
SGPVLLKNHDLVKRAFDGDEVVQEFEQDKLETIEEEGDKVIDETLRGWGSWTGQGVSKREQRRQKKVLTKVEGVKHENRKDAKLSRVIINEKRIRKVSNSYFHRFKSD

SEQ ID NO: 40184 - protein, 94 aa, A.fumigatus
RRIHMLPILPCSAFTRSKQFVKEEWDAMFASNGPDPAENVVGGWKGVLYANLALVDPAASWNFFTQPNFDYSWIDGGASRTWYLAYAAGEFIID

SEQ ID NO: 40185 - protein, 66 aa, A.fumigatus
MLGVKRLLLCDGYGSYMTYEFIDFCEKNNILLYFLPPHISHILQPLDVGVFHAYKHWHSEAIEDAT

SEQ ID NO: 40186 - protein, 123 aa, A.fumigatus
LNEVVHIKHAQLPIDASLGREPEILAEDSDFLHAHITEQCHSIVFNLYHHTQLILVSTAANDFDMVTFPKALAKRFDWSFNHLTGQFTFSYLQGNNVSTGRRGATDQALLLASEHLDWVTWKI

SEQ ID NO: 40187 - protein, 94 aa, A.fumigatus
DILLIFVFIFIFVVLILLLPLLLVILVILVIFTFFLVFPLVSLAASVSLIGINVFLYVIFAPLSVGSLRLNIGMVVVFLFLVDTAATRRLLQSV

SEQ ID NO: 40188 - protein, 69 aa, A.fumigatus
  UNSURE (52): Identity of amino acid sequences at the above locations are unknown.
SRLGNQREVSSHQTTVTCNKTAQEHLPCESALKFYSAHFDDQLVRRHGSWIXMALFSQVYVTRISRCAR

SEQ ID NO: 40189 - protein, 157 aa, A.fumigatus
NCHQLGKEATSLTDETSCSSSSSSSSSSSSSSSSPSSSSSSSSSSFSPSSSSSPSSLSPPASASSASMSSFTSSSLPSRSALSGLTSAWSSSSSSSLIRPRLVDYCKVCKHLYQSQPVDLLDTHLWLDILFVRVFRRRGIEVIVFFFGPKVLVQKIP

SEQ ID NO: 40190 - protein, 494 aa, A.fumigatus
GRPRKRRKRLGGVHNFIDTEAGVDEEEDEAEDEEDEMEFGAEMHPDDLDALPAGADTDDRRHRQLDRQRELEASMDAEKQAQLLKERYGRNRAAATDAVVVPKRLLLPSVDDPSIWGVRCKAGKEREVVFAIQKRIEERPPGSRKPIRIISAFERGGAMSGYIYVEARRQADVMEALEDMSNVYPRTKMILVPVREMPDLLRVQKSEELNPGGWVRIKRGKYQGDLAQIEEVDTNGLDVTVRLVPRLDYGLNEDSGAPVVDIKRKRPGMASGGPRPPQRLFSEAEAKKRHGKYLSATSGLGGKSWSYLGETYIDGFLIKDMKVQHLITKNVNPRLEEVTMFARGSDDGTSNLDLASLAETLKNSTAEESYLPGDPVEVFRGEQQGLVGRTTSTRGDIVTLQVTEGELAGQMIEAPVKSLRKRFREGDHVKVIGGSRYQDELGMVVQVKDDTVTLLSDMSMQEITVFSKDLRLSAETGVDGKLGMFDVHDLVQLE

SEQ ID NO: 40191 - protein, 140 aa, A.fumigatus
PSSRTIILVERRVRRCHMLLDSDISGIGADSAHLVLSRVAGKDASKQFWKYHNEGILKKYKAQLQIGSLDSKKAVAAPTPAKKEAPRPQAAAPVDVAAAKSDEPLEPYGELVPFADPSWYQGVCSLGKNPSYCPLLKRPR

SEQ ID NO: 40192 - protein, 260 aa, A.fumigatus
YHSPYFNQTHAALRAEVRQWVETEIEPYVTEWDEAKKVPDSVYKQMGERGYLAGLLGTKYPIQHTRNRVQSVAPENWDLFHEMLLTDELSRAGSGGLVWNLIGGFGIGCPPLVKFGKKPLVDRILPGILAGDKRICLAITEPDAGSDVANLTCEAKLSPDGKHYIVNGEKKWITNGVWSDYFTTAVRTGGPGMNGISVLLIEREAGGVSTRRMDCQGVWSSGTTYVTFEDVKVPVENLIGKENQGFKGALLHLKCPQHRY

SEQ ID NO: 40193 - protein, 190 aa, A.fumigatus
SARRTRASRVRCYILSAPNTDTDYVLVIMTNFNHERIGIVIQCVRFARVCYEEAMKYAHKRRTFGKKLIDHPVIRMKLAHMARQIEATYNWLENIIYQCQSMEETEAMLKLGGAIAGLKAQATTTFEFCAREASQIFGGLSYSRGGQGGKVERLYRDVRAYAIPGGSEEIMLDLSVRQSLRVHQLFGMKL

SEQ ID NO: 40194 - protein, 252 aa, A.fumigatus
SSASTVACVVKVDRESLRVIDQNGSIRTVLPSQIANKITPRRDAVATDRNGAEIRIGDTVRELYGDQRSGVILHIYRSFLFLHNKAQAENSGIVVVRTTNVVTVSAKGGRSTGPDLTKMNPALMRSGIPGASMGPPKSFGHDRLIGKTVQVRKGPYKGLVGIVKDSTDVQARVELHSRNKLVTIPKDVLIVKDPVTGQTLDMSRKGGQRVPYGASAAPPSGWSGGRTPMAAADSSRTPAWGGASSARSKYLF

SEQ ID NO: 40195 - protein, 201 aa, A.fumigatus
MDRTVTNWYLAPAWAGISGSRTPAWKMDGSRTSNPYDGSRTAYGGAGSRTPAWNAGARTPYDSGSGSSGFDAFAAGSRTPAWGGANAGGRTPAWSASSSAGSGNRDSRGYDAPTPGGAYSAPTPGAYTAPTPGASAPTPGAWADSAPTPGVFNAPTPGGLSGRPYDAPTPAMGGAAATPGAGAYGDGEDGGPRYDEGTPSP

SEQ ID NO: 40196 - protein, 643 aa, A.fumigatus
RAAIAHQVTRCLTEPLFPSAIQRAQQLDSILQRTGKPVGPLHGLPVSVKDCFRIKGVDSCIGLTALALKPSTSHARLVTMLLSLGAVIIAKTNVSQGMAAPDSYNHVFGRTLNPLNHQLTVGGSSGGEAALVAMRGSMVGFGTDIGGSIRVPAMCTGLYGFKPSVGRIPFGGVVTGQPPGLGRVSLQGVAGPLARSVADLGTVLGAIVPIAERFGEDCIPAQWESESPVSERQTREFTVGVLRTDGLVTPLPPVARVLDEVAESLRRTPGVRVVDVPVPPGLSKCQGIAGRLMSADGGGSLLDLLQSTSEPLIPWLQKRIKRREALTLEQLVHLQEQRSDVEKELLGMWTVDGDCTRRIDAIITPVAPHPVPEIDRFNAIGYTASFVLLDYPAGTIPVRNLTESDLDSDQGMNSPELGSWDRVNRDLCMRTDCFLRCKCSWLTGCYRAGAICRPPRISGLAFEHPGGHAETTRLRTVPSHGNHRSSHSIAERSEVIKIQTTARPVMRRYPPLLTGCSIVSMNSIDTKVLSVDGRSMVQHTSTFLLHSSFSPFLPSDLTKSKQSRCRHSNTGAVFPPCGRSEHSDMQAANRLHPIYGPLAHTIHASSGNGHICLASSGDHSPAVRSRNVDSNARFCLRFSVMSS

SEQ ID NO: 40197 - protein, 454 aa, A.fumigatus
STVCFLSHTSCLVRKHTGIPVPRVLAWSSDSSSPVGAEYIVMEKAAGVPLFQRWADMAEIDRLQLITNLTKLEAQLSSIGFPAYGGLYLRADTGAQQSNYQMLNESIDPSHTFCIGPSCDRSFDIDPDTALGQSKGHLNQGPCEYRGSWQCHKLTHCTGNTISDVGICIAKRELSPLSRKRLDRPPTFYQGSVEEQAKLLQSTMSLMPLLDSHPALDKSGRPILRHTDLHMGNIYVAPDESSQIVSLIDFQSLSVLLAFLQAQWPIFLKPPPNYPKGFVQPRLPDDFDELDEESKSLAQQEWSQAKWAKAYEVSTYLEDRFAYDAMNVPRVFRELFIRCAEVSEVGVVPLRACLIEMFQNWSGLGFTGQCPLSFTEEEIKTHERQFTEYEAWHEVQRLAWECLDTDAEGWIAPQLDITEKRRQNRALLSTFLERTAGEWSPEEARQMWPFPEEA

SEQ ID NO: 40198 - protein, 69 aa, A.fumigatus
IFNGQPGSQCFLSSETVGKCTITHQKPSCPYSVKVTEKQTNKGKASNYQARQTNRSRRTLCIYKWPFPY

SEQ ID NO: 40199 - protein, 183 aa, A.fumigatus
YLRLCEFTIQCLHTSVYHLNERDQRLPADRPYTNGYFLDLVAQIRRYAAMINESRSSMPSNREPAQNGAKASAPKYVVSPPSRWFARFNIVRSEHITLEGGLSKNGRPAELVVHKDGEMISLRTGKPYEENAVPAMKRSLSLGSVDEGVERSMARRKKNAPPMDINQKCKDCDKVFKRPCDLT

SEQ ID NO: 40200 - protein, 385 aa, A.fumigatus
VQFLGCTLLTGSRKHEKTHSRPWKCTEPSCKYHEIGWPTEKERDRHINDKHSKAPALYKCKFAPCTYSSKRESNCKQHMEKAHGWDYVRSKHNGRNSKKASNGATPQTPSIATPSSKAQGITTPLTGSEPSPFEPVTAYPPNPPFSFADPPTQTGSGDFPLFTTNSPFEDLAAGVNDFSPLPTTSLDFQAFQSQLEGADPNGLIPLTFDRQSFDSGSPVPDLINETMGFDTSPVASTDSSSLNFDLAWSQLDAQNVEEEFTTLTMQMLTPEHSVSMSALNSFSRDPSISNPSPLPVQKVENSLYTPDSCHVDEGVSDLFDSGYQHKADFMLFDQHTNFGASSVNMSSTCQLSALHNSNQMFPSLNTPDLNYMTQGWPQDMEMEHF

SEQ ID NO: 40201 - protein, 239 aa, A.fumigatus
ELSPFGYVMAEEDLSLTGTDLKRELIGRQVRNEITELNSPTALHRFGAPFKSEFGEVAPVDSELPILRYIFVHHVRKFPFLDQAREKEFWQDKLQVVSNLHQFELSAVAGDSLRLTYFFMQFLESFANKHVSSSEDRLEETKRRKLARKAEKLVELMMVSGIPTASGYEERISFSEMEVVDRGANEKGLLVNMPEGHAIHGWDVNVAAVRVTFVKLTVRYHKHAVSDRDNYTLTTITLA

SEQ ID NO: 40202 - protein, 75 aa, A.fumigatus
ESLQKANIEDRREGQVEHTGKGNENVMIGIMIVMTDLREDDSLCLGRQADIDDYGGCSSGPDLLGPQAEVVSMSA

SEQ ID NO: 40203 - protein, 81 aa, A.fumigatus
LRLGVLDSIFTAFNVHSHCVISGSADIVTRGRLFVVTPVLFTTLFYAFLEACNPFDFGQKPVEKSLSGDIDVSVWVAEELD

SEQ ID NO: 40204 - protein, 139 aa, A.fumigatus
ARVWRDGQKKDCFVYRFIATGSIEEKIFQRQSHKQSLSSCVVDSAEDVERHFSLESLRELFQFKPETRSDTHDTFKCKRCRPDGTQYIKAPAMLYGDTSSWNHFVNDGENGQLSKIQDLLIRQETSEKDVSAVFQYISH

SEQ ID NO: 40205 - protein, 61 aa, A.fumigatus
EGVAPYLKEIVPPVLACFSDQDARVRYYACESMYNIAKVAKGEVLLFFNEIFDALSKVSRS

SEQ ID NO: 40206 - protein, 243 aa, A.fumigatus
TKIRLQLASDSELSVKNGAELLDRLVKDIVSESAASYISVLQLSEKHTVDPDAQEEVELPTAFSLAKFIPLLKERIHVISPSTRTFLVSWLTLLDTIPDLELVSYLPDFLGGLIEFLGDPNRDVNVTTQALLDRFLSEIKRIARLKKGIEESRKEHGSDNKQSAASDNVSTTTDHTVAVDIERSENAIEDSESESDLEENDLQADGDWIPGQDVHIDYPKILDILVGFVDTSFGEQTGWCIMP

SEQ ID NO: 40207 - protein, 383 aa, A.fumigatus
KRVVKSTGVTTNSRPRVTMSALPLITQWLWTLNAVKMLSRTPSLSQTSRKMTYKLTETGSRGKMFTLTIPRFWTSLWDSSIPHSVSKLDGALCRSRILNTELDEEMQLTALRWIDSFFEISPEDILPFVPRLLTQVLPAMSSGSDQVRQAANRVNTSLLEYIVSLSDDSTEETRQSPPSRPISTASKELVERRASTPSGRQSFETSTSESKKQASQQELSNEQASRSSVIPTPVPPADLDYAAAVNSLTLQFLNENEATRVAALSWLIMLHRKAPKKVVAFNDGTFPALLKTLSDPAEAVVTKDLQLLSQISRNSDDSYFTSFMVNLLQLFSTDRHLLEVRGNLIIRQLCMNLSPERIYRTLADCLEKEEVSIIHYAMFPGAD

SEQ ID NO: 40208 - protein, 147 aa, A.fumigatus
QRISTSMVSSSSSGYERATGSRLKTREENTIRWVELLDKFKSVQEKARRTHRASQRQFDQDGSTTGLRNPSLTAALSAAATADRGKERGLPDSPRGGRPDIGGSGGRNSPGDSGTPNRGSLLSGTQRNKSGLPNLGRLGIGSRRSKR

SEQ ID NO: 40209 - protein, 188 aa, A.fumigatus
SQHEPAIHIGKMDAFEYNANPGRVIFGSGTIQKLPDEIARLNLKGPLVLSTPQQVKQAETVKSVLKGQVAGIFSEATMHTPTHITDKAVDYARAHGADLVVSIGGGSTIGLGKAISIRTGLPHICIPTTYAGSEMTPILGETADGLKKTRSDPKILPGTVIYDVDLTMTLPAAMSATSGVNAIAHAGQ

SEQ ID NO: 40210 - protein, 198 aa, A.fumigatus
NRTSVSMTFERLMVMIVEALYARNTNPVINLMAVEGTRALASALPEIIENPSSKTARSLALYGAWLCGTCLGSVGMSIHHKLCHTLGGSFNLPHAETHTAVLPHAISYNAPNIPEAMKKLAEALPDSNGDAIQGLNVLLDKLKVKRGLKEFGMKEEDIDKAADIAVSNPYWNPRGIERIPIRELIRRVWAGEPARADL

SEQ ID NO: 40211 - protein, 567 aa, A.fumigatus
SKMATEMQAAPVLSTPDSLILEATEPVARQNATRTLSDEELSITYDIERTLQEIRQARYKRIALQFPDDMLPDAPRVFQLLSRGLACRDVDKITVEKNGNGTGGVESEKLAQDVSQLSVDDKPEPEPKLYILADTSYGTCCVDEVAAEHVNADVVVHYGRSCLSPTARLPVIYVFTHKELPIEPVIQAFKATYPYQATKIILAADVTYCDHIPAVYARLMEEGYTNLYATELIHCPSSAIPNRTVPDSVRENPDTLSEWQLFHISDPPTALLLTLASRVAAIHIYPTTDAPSDNVKPLPVSTSAALGRRYAILTRLSTVPIFGILINTLSVKNYLHIVEHVKQKIADAGKKSYMFVVGKLNAAKVANFSEIGGWVVIGCWESSLVDSKDFWKPVITPFELELALKGDHERVWTGAWQSDFQSILDQPAEEAQTADHEESPNDDDDMSEPESAPPEFDLRTGRYVSHTRPMRNPAPRVSAQSDDAVSAASGPAAARALARRAKGELAMIGGTVSPGAEYLRSQRTWKGLGSDFDIQYDDEDPSDSTLVVEGRKGIARGYTVGDSIEKH

SEQ ID NO: 40212 - protein, 87 aa, A.fumigatus
THKTITMSSTDLEQDPTPKDIAQRELEEKERKAKEDAEQAQLPYKWTQTIRDVDVTIPVPCDHQGSGSGLCVGQRPRSRSHSRGQEA

SEQ ID NO: 40213 - protein, 615 aa, A.fumigatus
SSAAACQRGVKRQRKDSAAMSLLCESPGCGPEVKSRDLDEMEEDTGSVFSESASEQSIPPTQRSLSTFERVITTHAPILESLLLQTPTDAILKLFHTSRYLRSFLQNYPTAWKYLSFRLFYPSGSQFPLRIVFPGGTESAMPRQSRSYSLDQLLMNVVVPFSPCLKSLELDNTAVSGQILISTVLHSRRETLEHLSVRGCKNVSLKYHIFPYLTMFGLQYDVDMERNIGSSSSTKRLALKSLYTYRCRHHRRRPYLSSSLSRKDSDSEPTHELVSLCHKLGIWTDTAWCSTPAGRCFRRRSYVSMRVPQGSAEVWVVFDRLWRSKNWIGPVEQGGRPSQRDGKLWEHDETGCNGEPLGTGEGQGLGEGKMMPAHLRSSHTRFVDNIRCDNCFEEISERCEQCSILMHCVGCRKTLCASCAFDRPYLHNRRSASTPEDAAKSFWWAPGAVVSPCLMQDPLRNSTDNVSVNPNDPVPYPNLKFHWCCTEPIFSGGGGISIGTPNRDVDQVRAAPLPRGQGWEDLEYSANEWSKTFPKYAYGDPRKPDYSLETGHIAMMKWLLGPPDRQPTACPRNLCQECYDAPQWKVHCKSCSKPLCIEHDLRGLRLRICGYRDLA

SEQ ID NO: 40214 - protein, 519 aa, A.fumigatus
AYVGIFLLTTAALMNFSYTDGAMLQEAATTASHFLEKSRAPAQVCDRCHDLIHHNKAVSVPTPTIYSIQEYLKESPHRDNRIYHVIDAADFPMSLVDNIYDALSIQEPRSKNRRASTEKYRWGRKLPTISFVITRSDLLAATKEQVDSKMEYVRSVLRDALKLSSEHFRLGNVHMISAHRGWWTKQVKEDIREHGGGIWVVGKANVGKSSFIEACFPKDSRNLEKIAELVERRAVESDINQLNDVSLGSDSILPPAPREDLYPVLPVVSSVPGTTVSPIRIPFGHGKGEMIDLPGLDRGQLLNHVLDEHKRDLTMTKRKKPERLTVKPGQSLLLGGGLVRITAENPDHVLMAACFVPIETHVTKTEKAVEMQAGQRPYPGEQIMREEATASISSAGIFELKWDVTRSHLPTSIAKAVEDHGIPIPRLPYKVMSTDILIEGCGWVELTVQIRAGSKSEELESSRSVPRVEVFSPNGQHIGSRPPIECWNFIAAKRAADKRKRPSRGRQNVGLKRRAQQSR

SEQ ID NO: 40215 - protein, 328 aa, A.fumigatus
PHNHSSTLISVAVGYPTTSMAAQTVNVLLSSFPGLSLPSTVSFSLPSTSTISDLTDRVSAYLPSSIPLQSLVLTTTSNKQLVPSCERLFSLFGASKGEVATTSNLLPLRLTVPLRGGKGGFGSQLRAAGGRMSSKRKRNQGDDNGSSRNLDGRRIRTVNEAKALAEYLAVKPEMDRKEKEERRRRWQAVVEAAEKRQEELKNGGGKHKIDGQWMEDKEEMNEKAREAVLAAMRDGVWTDNLRDTILGGSSTSASASEGSGQETQNSSEEESDEEQDPADVPTPSEPAVKSAPTRKFIGFDDDDEFMSDSEDEEVEQIDNPKGKGKAKA

SEQ ID NO: 40216 - protein, 106 aa, A.fumigatus
DIVELVDVRLYSPAFNQFCNLLQVPRILGKTGFDEAALSDIGLANYPNTSSMLSDILLHLFSPPTSMSTNHMYIAQPKMFRGQFQSVSENRSHILHLRVNLFLGRG

SEQ ID NO: 40217 - protein, 201 aa, A.fumigatus
PETIHYARFPEVPEPSVELSAALTYVRSTSSSITSAEAGFVKKLSKGKTMFFDPRKPKKLTIYAAKKYPAWQEKYIDLVREAFDAVSLSINDKELNAKVGKLGEMKKAMPFVQTLKTRLIKSKEAPENVFSRKLPFDELAVLKEMLGILKRTTGCKEIEVIAVDEGGKTGEVLGTGEKREGLSAENAVPGQPTFGFTNIAE

SEQ ID NO: 40218 - protein, 94 aa, A.fumigatus
IDPHLISSIQGLDYLREWLHLPAEVVPATHIKQQRSHAPPRGMMGGEERERRPRAPREGGYRRREQEPKEGGAPGEFAPSFRGGFGRGRGAPAS

SEQ ID NO: 40219 - protein, 82 aa, A.fumigatus
LKPDHRFDFPSEVTTGDGIEDANFDENVSNSSILILFTLNEWIEETVKDSSLRTDSEYSFWDKLFDNEMNSLVREAIKHYKK

SEQ ID NO: 40220 - protein, 71 aa, A.fumigatus
PHLSTDFKLALKSALFDLTNARDVYREAAVSAGVGMHRDVVLRYVELQALMISPIAPHWAEYIWLEVLNKV

SEQ ID NO: 40221 - protein, 251 aa, A.fumigatus
LRCIRGKIEEVTLPVSHVDIIVSEWMGYCLLFEAMFDSVIYARDRYLAPGGLMVPSDATLRIAPFADSEFISSHISFWDDVYGFKMGSMRKNIYDDALVRSVQPAAIPGDSDVFLELPLHTITVEELSFLKGFQVTLKEDIDALDGFVIWFDIFFMPSRDSTVPKNAVPSEMKKKGFVAFTTGPHGPETHWQQGVLLIDRERKKGVAVKKGQAIAGKVGYQKREEGSRSLDITVEWDTQAGEQGAQKWVLQ

SEQ ID NO: 40222 - protein, 91 aa, A.fumigatus
IALVQTRLESMSATISSDRRVRDQDALSTTSSDDSDISNEEGWEDVEPDDETQPVIGLFSDKVYPDVQSMLQESKDKHGFDLRKIRKDLGV

SEQ ID NO: 40223 - protein, 329 aa, A.fumigatus
NSQYGYDHDYLREIPANLFRFTSDLDFLGTIRLVNYVRSQVKAGNTTPDVSSKDRFEDDAYLKPVLEDDALLYSLDDIEDEHSATAGTTEAERRVIELQEDLERLQSQFTEYRMAVQKSMEEQLSMDDEKLRSSPSGPSGKKMSKVEEADADYFVSYSYNGQFSTGSRAGYAFCANCHMLEAIHESMLKDTVRTDSYRDFIYDNKHLFKDKVVLDVGCGTGILSMFCAKAGAKKVISVDNSNIIDRAKEIIYENGFGDVITYVFRSAYDNNLPESNISSDASVARLKKSLCLFPMSTLSSPNGWAIAFYSRPCLTRSFTPETGISLQED

SEQ ID NO: 40224 - protein, 200 aa, A.fumigatus
KKEKNGLSQQNPLVAPPDAGWVLCLSALRLTTADRADNKWELRRTSLSSPSSSSPAPSPSPCLFLFSLYRLSASFSRDREVFNPHSARDQLLVLHHLHVLNSSLPLILSCFFCIKLSCPIHIKPLISTEMAFLWRNRQRPPSDVVRTIKELLLRLGEAPAAAKVSLTGSLYLFMPQIVRICSLLTASNRSKMTWRSNLRR

SEQ ID NO: 40225 - protein, 171 aa, A.fumigatus
LQSALETETTPEQVHALVQATVHEDLLYELARNLRHLPFQARKDAQTIFSQILRFRPAQTNSGDPPVISYIVHNRPEIIVELCRGYESPESTMPCGAILREALKFDVCAAIILYDQSIEGQPAIRLTQVNPDIPQKGNGIFWRFFHWIDKSSFEVSADSFTTFRVSHDWYG

SEQ ID NO: 40226 - protein, 79 aa, A.fumigatus
VFVANPNKSVAVQRILINNRDRLLKFLPRFLMDRTDDDQFTDEKSFLVRQIELLPQEPIEPTRSAQESSRSRVNTAAAA

SEQ ID NO: 40227 - protein, 212 aa, A.fumigatus
  UNSURE (6): Identity of amino acid sequences at the above locations are unknown.
ASRWSXARLVENEDQYRMRFSNAAGYRQSAGQMPWYSSSSRDALAPDAMPEKDVWGNEDPMRQEREKARLDANDPLMAIKRGVRQLKSVELERKKWNQERKRELDSLKEAERHRSRHRRRRSRSRSKASDSGDSLENFSLDAPDKHQDRKHRSSHRHRSHRRERSRSRSRDHFCEQSRKRHRHSHSHSHSHRHRDHHDRGGVCEVQSPRRHV

SEQ ID NO: 40228 - protein, 98 aa, A.fumigatus
DILTRHKSLVTSYLTTNFDLFFSRFNTLIQSSSYVTKRQSIKLLGEILLDRANYNVMMAYVESGENLKLCMQLLKDDRKMIQYEGFHVFKVLFSISSA

SEQ ID NO: 40229 - protein, 70 aa, A.fumigatus
VPYAPPNVRANVWFSAFSRVNFNTSPPYNVPAGSSVDLSAVVAHYEQQNKQMEEARVARMKDGKVVSLYD

SEQ ID NO: 40230 - protein, 166 aa, A.fumigatus
IGIANCISAKHVFRQTVSRFGAAAAAQSAASSLCVSCRSCRACERELRRMFDLPRQNSSSSLTTTLSSLQRSFYVTIGAFASAYVLYRLSKSAEESGSQSWISNLIQKWTPSEKLFEERNAIHTALMEKAAQDRHLLQSQGPRATFELKQPEYVHMSSLCPAQCTS

SEQ ID NO: 40231 - protein, 175 aa, A.fumigatus
GDRTNEKMLMFRSDNFEQAVAALEHAKYALAFSSGSATTATILQSLAAGSHVVSVSDVYGGTHRYFTKVASAHGVHVTFSPCIEVDVEALIRPGETKLVWIETPSNPTLGLVDIRNVAAVAHRHGIIVVVDNTFMSPYVQNPLDHGADIVVHSVTKYINGHSVSCDASFTGKTVY

SEQ ID NO: 40232 - protein, 96 aa, A.fumigatus
IYKRAMTSAFSFGFSGDDIDIDIDEDDLSGIDERDMNAVEDASKQLTGRLMEPQRHDMGEWVSYKSLLGSWVATDGSRSKTTDEMNRERGIADDEG

SEQ ID NO: 40233 - protein, 193 aa, A.fumigatus
DVLMGVAAFNSDALKDRLTFLQNAIGAVPSPFDCWLAHRGLKTLHLRAREATANATVVAKALEASPHVISVNYPGLDSHPHRAIAIKQHRQGMGGGMLSFRIKGGQKAAHLFCQYTKVFTLAESLGGVESLCEVPSSMTHAGIPKDQREAAGVFDDFVRMSCGVEDAEDLKADTLQALEKAVLASQQLENGSS

SEQ ID NO: 40234 - protein, 216 aa, A.fumigatus
LGAGTSVPSLTLFAQALRRPDSATNKIHFTFADYNSAVLRLVTLPNLLLTWNYIVMHRDPPSAEDTSPRDQPDEEELDITPELLESFQKDLANKKITFEFISGAWSSAFVDLVFSSYGLGKGKTLILASETIYSPASLEPFSETLIALLRRSETEQERSKALIAAKKVYFGVGGGVDEFLMVLKNVNGYDLDVQEQVNINSEGVGRVILKITLRST

SEQ ID NO: 40235 - protein, 166 aa, A.fumigatus
SGPVPSSYSYFPLSLLTSPALFPTHPGVYFWSYGLLDPLHYSFFHHLRPLHVRFALGLSYVLRAGHDRLSSLFFYPLSFLLLSSSRNCLDLSAFALRPRIRCLFRRRCSIHSYISITMEGFDTMAMPYLASPLSLGNMQGADYLNAMPGIDLPDQRSNFDSDTFVR

SEQ ID NO: 40236 - protein, 60 aa, A.fumigatus
GLFRPTLYCSLALPDRSSRCLLWTFRFKSSIASTTQGTNYTTTTITTDCIYLLHIYNYLQ

SEQ ID NO: 40237 - protein, 307 aa, A.fumigatus
VFLTSSGLVTIAFPPSSSILFRFYFFPLHATALTFLPLPCVLEFVVSFVGAVLSTHTSPSPWRVSILWPCRIWPVRCHWAICRAPTTLMPCLVLIYPTNARISTPTRSLGKSILALRSQMIILTKAHWNSGEDIPPFTQHSLPNTLKRFSSGYDDPFTEMVTPFDPAPSEQPPDSSIDHNNKLLSFSMPAYNFTLLDYSLRRTSLSLSAQLHGMFSLAESPWTTSPTENAPPQQGAELTCYRRNLFQITGSVTLPRSLRYIMNEQGDRLPILAQELCVSATESVEGHSVKIISVAWKKPAAKGDSTD

SEQ ID NO: 40238 - protein, 353 aa, A.fumigatus
PRYRSIKRIIFETLVKRVPGGLVRLSVPEIKQIGGRAGRYRPAAQQDKKNNNDSDSNIGLVTCLEEVDLPYIREAMETEPPPLTAAGIFPPDPVFQKFSAYFPRDVPFEYLIKRLLEVCEVNPLFFLCDPRGQLENAEIIDSVVGLPIEDQVTFMAAPMYTRDRKSRSVACAFAECVAEHSGGRLLDIPDLNLEILEEPVSGNKDYLHELEGLHRSVILYSWLSYRFGGIFTDRTLAAHVKEMVEERMVRALTEFSANKKLRKDASLRRQIALQKQIAEQKRVLAEANIEGFEYGVDGERVPVDVSAEDGSLEQEGQESYDPFGDGQEGDTIPVDVSAEDSPLERAAPAARGV

SEQ ID NO: 40239 - protein, 395 aa, A.fumigatus
QILTYTFTRTLSLLTRLLIRLFAIQSWKKKALARRPLSQPFIIRDFASIVESELADFKQSLKESSDPVLAGWERFERYVLNACKLEDRSSQKVFGPLRHVKTTLQKAYLSSGISGLRSELRYLMHAEEITEKYSAPLLEQQKKVADLRYPAEWYPQARALQRTIHLHVGPTNSGKTYHALQRLQASKNGFYAGPLRLLAQEVYHRFQASGIPCSLVTGDDVKIPEGQTPSIVSNTVEMVNLGQPYDVGVIDEIQMLADPKRGWAWTRAVLGARAKELHLCGETRAVPLVRELAALTGDRLEIHRYKRLNPLKVMDQSIRGDLKNLQKGDCLVAFSRVGIHALKADIEKVTGRRAAIVYGSLPAEIRTQQAKLFNDPDNDYDFLVASDAIGMGLNL

SEQ ID NO: 40240 - protein, 188 aa, A.fumigatus
IVAEDIKKAALLPEGVWRSLARETLSILYLVYSILLFTSSGFRFWWFRSPLQVMDDLESLELFSLVSRITGELQNHLGVSDKTLAEFVIDQHLSCGSFDEFKGKLEAMGAEFPQSLMESIDRLVLTMHPKYKSKKANVTQEKTEAEGDMDVLDALEKKARVFKGLAVPDKQPQWDEDDNFRNPDVHDR

SEQ ID NO: 40241 - protein, 89 aa, A.fumigatus
AISFLKILQIASNTLIHDFEWIQSFVPMDLESITCESRKLSNQGHGSCFATKVKFLGPRTKDSTSPRPATFRVREHLNLVDDSNVIRLS

SEQ ID NO: 40242 - protein, 73 aa, A.fumigatus
LEFASANSPFPQDVEQIEHRRPPNPDMDALYILSPQTHIVDCLMADFERKRYRRAWLVWTSGQSFVLIGDSTV

SEQ ID NO: 40243 - protein, 167 aa, A.fumigatus
ILVRTTLTVVEVVSLCVSLGEYPIIRYYRPRTPTHEASVLCSHLARFIQNELDQFAQSQRDFPPPSPRPRGVLLLADRSMDMVAPLIHEFTYQSMVHDLLPIKDGDKVTYTTVINTGSGGGQKKDMEINEEDNVWVEYRHQHMKDVLEKLGRDFAKFREAHPQFAEE

SEQ ID NO: 40244 - protein, 239 aa, A.fumigatus
YENRSGASHLLIRLTVMLVAYRNYIQDTAIAHGADFRKDLTKSVTHLIARNTEGQKYKFATQWNIKVVTMKWFTDSIERGMVLEETLYHPLLPQEQQGVGAWNRTAPPAKEKAADAENSSNPRPRKLRRIASTKLVDQNEGIWNAIVGAGFENNELRLSTNSQLKNEDVTSSKITRKASVVQEAKSFASETTFAEAQGSRQDTSEVRQASNNGFLDGCYFFIYGFSPKQVCTASFSPCF

SEQ ID NO: 40245 - protein, 68 aa, A.fumigatus
EQTPQVVRPKDFDGTEHAVYPAASEGSTTENCHGSHGNSSASHLLLSFPQTGNIKEVPDLHLSVDLSS

SEQ ID NO: 40246 - protein, 103 aa, A.fumigatus
TELATIASQMGAAHKFDLTSDVTHLLVGEINTAKYKFVARERSDVVVLKPEWVEAVRQSWMQGEDTDIRALEQQYRLPTFMGLAICITGFEDSMRIVPAPPIC

SEQ ID NO: 40247 - protein, 391 aa, A.fumigatus
  UNSURE (239): Identity of amino acid sequences at the above locations are unknown.
GFHGMKICSTGFSRIDLLHLSKLVDLIGEPLDSSALTDTDYVGATYDEYLTPKASVLVCNNSGSINNEKLRHTSEWKIPAVRVDWLWSSIKSGQRKAFEPYIIQRLSQHEKSLEVRAGSRTEQKDVFESSDKPNRSAKSDSGTRESKKHGINGSTKSTPVEKPSKPSSEDESVKAPPPYKRPSQSASVSPTKETRPPNTASPSNKRKAPDHVTTSAQAAIQLAVSGFLKQARTANSRSXSDTTDQESDSLRRRRRKPLLGRAPSDSSAQGVFCRASSIDTLNEDGCGSAAESIGAEGFNSFLTGGRFEPSESQRRIEDQENEEPAMTQLNYEDPDAVKMREELFSHAGKLSNKTKSSDQGVIVGEVRELEDIGWGTGRRTRKAVKDSEAEL

SEQ ID NO: 40248 - protein, 124 aa, A.fumigatus
LSTTAVLTTAYMLSSIPHTLPPRLSRKLAATLSEMDYVHSNATRISTEVRRILRIPAGNLQTSLAQGIEDLAKRKQEVSKTKHESEVASKYFSNLFRDSGENRRSVEDIDLDAPLPGGLAAVQG

SEQ ID NO: 40249 - protein, 728 aa, A.fumigatus
AISRTIDTLKELQDMNRQWPAHYPSVQSAPGSPGSDSQRPGLRQSQSYFESEHNQSEPLPRPGQIRRAATMSGSDDLAESSAAAERRPSPEPRLMSPQIAQEFSILKLDLKLGALSQAELVHSLEKASIASLLDGKISQSIKHLLSLRDRIEDTSSKVLITGDLNAGKSTFCNALLRRKVLPEDQQPCTSIFCEVLDARENSGVEEVHAVHKDKQYDRNDESTYDVYTLPELENIVIDNSKYMQCKVYVKDVRTIDESLLNNGVVDIALIDAPGLNSDSLKTTAVFARQEEIDVVVFVVSAANHFTLSAKEFILNAAHEKAYIFIVVNGFDQIRDKQRCERMILDQIGKLSPRTYKEAAELVHFVSSNAVPVAPPVQMEQSGGGSGGGSDPHGDDDDDHSDNRGKGKGKEREKIRDFENLEGSLRRFVLEKRARSKLAPARTYLLNLLADINSLAAVNRDIAQSELKRVTDELAELEPAYENGKKKQVELGEEVEKCIDDSCEDVYNHTRSTLTDTISRVSEADLGVEYPGLFSAFQYAEDLKLAMLEQIATSVADCEDYARAKTAQGVGFIQNIGLLHVGEDKFAPLNFRADAMFRRGRRHTLARQVDTEVEIWDFFDITGLWERQEKMAGTGIAMTAVTVLGGRAFGGSWVDSMLSAVKILGPNNLRRLLLPGIVAAGKFPAVFNSAIRDFELTFNNSRLDYSLHAFVNPAYTSPSSLTQACRYSV

SEQ ID NO: 40250 - protein, 118 aa, A.fumigatus
PSISAKRYERLLKAYIESANTGATAKAGPPKKSKAKGAGESSGSSSPAKRKPAGESSKGRAKKARMLKEGVLESAHRMIEQRLSPVKEEEGSDAEEEKAQGANADATAVDDETLLGQF

SEQ ID NO: 40251 - protein, 211 aa, A.fumigatus
KCPPTPRPTVGTSVVPMPISSLNASKISTDLSRSVNRVPHVFILYRDAIPLTTHQVDIGKVATVFKYSNVLSARNRLRNLSKRYGFPNLECRFPSTPTKAGKAGAIVEAAKDDTAGDDPSSSGETVQSTPSKPARKPAGRKGAKVNSKPIPATGPVSADGSTSPSKKRGPRGKGKLAVAQEAAVMESVEIPVKKDNGNVKMEDGGAIKVEA

SEQ ID NO: 40252 - protein, 81 aa, A.fumigatus
LAIGLEWAFYKFSTCYQTVINELSLFPNMMVPILKPNDEFQTNSMLRTSPWGDSTAKGNIKAQIKPSFSQLIARILQVPKF

SEQ ID NO: 40253 - protein, 81 aa, A.fumigatus
DMMTQHDFVTLRLMIPFPVYVFYLYLRIITINHQNPFVKSSISLPNVSVLKTGIFRLAGSAIVDMEAHDYVMSPVCNVCTW

SEQ ID NO: 40254 - protein, 197 aa, A.fumigatus
  UNSURE (103): Identity of amino acid sequences at the above locations are unknown.
VHSLTTTCMSFLPATRSSLFGFFTFGMAISSVQLAANNLTTIENLNRRSAVWTLAIRVPRHILSKRWAPTFRTITYPLPPVPPAESEVARESPGGEQHVFAIXQTLPGENPFDLGSPLKNIQQVMGFSLLEWLLPIKQSPCADHSSNESAFALGPVVTRLKKEAGLEVSTESESADPVGAAETPQHEQRRGKHRRRN

SEQ ID NO: 40255 - protein, 185 aa, A.fumigatus
KTVDYLIHPAHHYDRRSRSGAGAAILAIYYVLLIPVLATYLRLLYNVVLSPGYLPRGTACTQNQTGSDGSKHRHRRHRRRKSGHHLSKTTEKTDRSDGGDVERGLEYSARAKAYPLDAEGLESFYTKDVFVCQPDGRPVYCSTCCQFKTDRAHHCREVDRCVRKMDHFCPWYVGIIHGLLQWQGD

SEQ ID NO: 40256 - protein, 184 aa, A.fumigatus
  UNSURE (116),(179): Identity of amino acid sequences at the above locations are unknown.
NRQLEHRIWSISNRLMHSKFSSLNADNTGFSHGAYNSNLPVQGFADRNARRPNIPHINTSNPASTRSDGMANSGTAFDMNFTPLLPSQLLLGSPSQPGTPSAFASPQFANFGGFSXASASAHAQNHQTQLGKPTQAAPNAGLYPGMMATERLGELSLVERPTVSNWWSGEGLVMQQLGXPGSGN

SEQ ID NO: 40257 - protein, 73 aa, A.fumigatus
RLIRCRPGAHLNVPGFCLGEATLCPCELPCPLLDVIHVFLIISFFVFYLNMLQSLMMDTLSFFIIQRNKHSTI

SEQ ID NO: 40258 - protein, 146 aa, A.fumigatus
TCLQGSQNCHSFSSIVRIIRSNVSSIPIMPGSWFTEGMDKTLNININDSLSGCHDMSSYHAVTVSSRQHLHISRQASLQSPSMLYEDLPETYFAGHSGRATNMNKVYSQTYMYICCNCGDGPKVYNVQPRCTECNHIVCGSCKPVK

SEQ ID NO: 40259 - protein, 319 aa, A.fumigatus
  UNSURE (316): Identity of amino acid sequences at the above locations are unknown.
YTHSVDPAARLVKTLFLTSVIIFTFFALVVMIIVLLMKVVCAVLAKKGRTGPAWGHFLGEWDVVARGVLYRLVFIGFAPLSTFCLWEFTQRDSPAEIVVAAIILASISGALVWAAVKIILLMQKSISMHRNPAYVLYSDTTCLNRWGFLYVQYRATAASFILVVIGYLFVKALFISLGQTVPIVQTVALLVLEGLMLIGVSVVRPWMDKRTNTYNIAIAAVNFLNAIFVLFFSGVFDQPGIVSGVMGVCFFVINAALTLVLILLVIYASVMAVISKSPDTHYKPMQDDRGSFIQSQARLGPELDDLSAVAPRGMVXTKY

SEQ ID NO: 40260 - protein, 194 aa, A.fumigatus
SPWTPVSMPNIKSLHKLTDKQTDSKMHFKLSTAVLATLVGVALSGPLVARDAATILSDLSTIKTDINTLTQHFNEFTGDLLQALAAQAVEQQLESDIDQATADAKATSALSAADSTSVTNALLGLKPDIVTSLDAIVAKVLPSFLCRWCINETNCVETAGRLRRRGQLRPLGPECPAEQDGCPVRRASGYCHCD

SEQ ID NO: 40261 - protein, 62 aa, A.fumigatus
KPQVDSAGVGSFVLSDLNALQSKTDALSGALQDIATATDKDTIASGTQDIDAAFSSAIAVFS

SEQ ID NO: 40262 - protein, 291 aa, A.fumigatus
  UNSURE (37),(55): Identity of amino acid sequences at the above locations are unknown.
PGRLKKRARGYPPDGQGKQGWCGILLQGGHDPAPSSXMAWRKEGEIVTSFRFSSXYAMPDVYAGNATLTQISSAVNATHYTLLFRCQGCLAWNHNGVTGSAPTSAKQLVLGWAQAVAAPGNPSCPGEITLQQHDAQGIWVAKLDASAASASYEAWAALANKTVPGHCSGGGGGTGPVGVPVPPGTTFDYVVVGGGAGGIVVADRLSEAGHSVLLIEKGPPSTGRWGGTMKPDWLVGTNLTRLDVPGLCNQIWHDSAGIACDDIDQMAGCVLGGGTAVNAALWWKVTSSLPL

SEQ ID NO: 40263 - protein, 98 aa, A.fumigatus
AFALKHEWRNQADTPCVDAVVMSQYLGRGSTSRGRMTITANLDTVVSTLPYLRDQHDVDAVIQGLVNLQNALKGVGLNWTYPAPNITAEEFVNTVCRV

SEQ ID NO: 40264 - protein, 110 aa, A.fumigatus
LPLLRKLQTNSYRWKSLRAPDARITGWVGNRTRFGESSADHDQPGTCKMGTDDGRTGGTAVVDTNTKVYGTDNLFVVDGSIFPGMVTSNPSAYIAIAAERAADRILALAT

SEQ ID NO: 40265 - protein, 160 aa, A.fumigatus
RSPTATRIIHPSGTNCNNGILPSSSVCSTPSRTFPAPFCIPCVTTHQLVVRRRHLVGSHRHRRGFHFSFEVTTLCVSLYVLDFAIGPVLLAPLSEYLGRQLVYVVSWFLFIFSCRLPSPPTSAPSSSAVSWQVVPVWTARLEERGGGGGALKSILVRWVI

SEQ ID NO: 40266 - protein, 191 aa, A.fumigatus
RATNKKPYPLDWTYNFPAGWQAEDMVSPTNRVFNRIPWTVRPSADGKIYMQQGYSVIAGGLQAAGWQELTLNDNPSAKNHTYGHTPYMFSHGERGGPLATYLVSASERNNFKLWMNTTVKRVVRTADGHVTGVEVEPFLDGGYEGVVNVTAKTGRVVLSAGTFGSARILMRSTCLLFLAFWFCLFLSHGLC

SEQ ID NO: 40267 - protein, 74 aa, A.fumigatus
WSRPFGDGLGLFWVPEEVVAPDQADTFWDDLFSWARPCKDQLQAKNEESILVHVHPKFLSPFSGSLSEQSYFYG

SEQ ID NO: 40268 - protein, 73 aa, A.fumigatus
PCQEDPSDHGPPRLHWPVTPPKVLRVVDALQTTDKHGVTCPINWLPGDDVIIPPPVSTEDANKKFGEIREVKP

SEQ ID NO: 40269 - protein, 83 aa, A.fumigatus
SANGTDSHKAWIKDIDEVNGSKLTFPIIADPSRKIAHLYDMVDYQDTTNVDEKGIAFTIRSVFIIDPAKKIRLIMAHPASTGR

SEQ ID NO: 40270 - protein, 87 aa, A.fumigatus
LFLSHHPVNILEHSSQLITSSFQEEIKMGRKRKSEGAADSNPPKRVRKPNFNADFLFIGLSIDSKLPSASCEGHSCRQSANVRFSAA

SEQ ID NO: 40271 - protein, 97 aa, A.fumigatus
LTYTLAHHTESAFDPAHPYYDPKSKRDNPKWEVVHVEFRRKFKKMVTLNDLKAHATPGGPLEDLQVLKQTRLSVSSVTPAQWKFILGLAGESSESAE

SEQ ID NO: 40272 - protein, 93 aa, A.fumigatus
LIKIASNIKISKISGYGAIGGYGAAHPQRGSGEGAYGTDTTYFSVVRASKRSLVQMVQAIRHCDPMIWMENIVGILLASVYLRTTEFCLVRLI

SEQ ID NO: 40273 - protein, 220 aa, A.fumigatus
RRACRWSGGHQPHGGPSAVLPASGGGVGHDQTDLLGRVNNENGTDSESDAFLVDVGSVLVVNHIVQVGNLAAGVGNDGEGELGAIDLVDVLDPGLVGVGAIGALAECQRTYSCLGNPWIQLTRPISLTLRAANSGSSLAKAPSSVVQTGVKSSYSIRDQPSFFQSSGLFLHAAIWEIGGTNRVGEEDSPAVANELVEGDRTIGGISFEVRGSRAETETVG

SEQ ID NO: 40274 - protein, 115 aa, A.fumigatus
NSSVRLTAPEAPNSAPETPQGPKRPVGRPRKNPVQNGTETPSRPILSESEEPKIDDEESDRSYWLMKAEPESRMEKGVDVKFSIDDLQAAEKPEPWDGKSLDSGPLQYNGMLDRS

SEQ ID NO: 40275 - protein, 375 aa, A.fumigatus
PSCSSREALPESTLKIRPLVRRSVVTWPERFSSLLASTSTVWLPSARRQISWVSRHMQIAHSTRISADKTAGTDLLAIARTDSEAATLITSTIDHRDHAFIVGSTNPNLQPLNDLMLAGEQAGKTGEELQAIEDQWIAQAGLKLFDDAVVDTIKAGVHVNKDALIKEYLTAAKGKSNSEARAIAKGITGVDIYWDWDAPRTREGYYRYQGGTQCAINRAVAYAPFADLIWMESKLPDYAQAKEFADGVHAVWPEQKLAYNLSPSFNWKKAMPREEQETYIKRLGALGYAWQFITLAGLHTTALISDQFARAYAKQGMRAYGELVQEPEMEQGVDVVTHQKWSGANYVDNMLKMLTGGVSSTAAMGKGVTEDQFKH

SEQ ID NO: 40276 - protein, 78 aa, A.fumigatus
LSSCPAHPRPEIPLLSCNLSPFNFYPFSIMVASDIPPLQFTPIEDIQERTSRLRKSFLEHKTRDVEFRLKQLRKLYWA

SEQ ID NO: 40277 - protein, 291 aa, A.fumigatus
SAFNFPFQLTLGPVIGAIAAGNTVVIKPSENSPKCAAVMQQIVEASLDPSCYTLVQGGPTEVQALLAERWDKIFFTGGANVGRIIAKAAAPHLTPVVLELGGINPAIITKNANPRLVARRMLWGKTLNAGQICTSQNYLLVDRAILPAVVEEFKKAYKEFYPQGAKASPDYSRIINEGAFRKLKSMIDNSKGKILMGGTMDENERFIEPTLVQVDSPDDSLIVQESFGPLIPILPVDNLEEAVNIANSIQSTPLGVYPFGNKADTDKSRSTTLSRRQNPATILDTGPTHLT

SEQ ID NO: 40278 - protein, 124 aa, A.fumigatus
STVLSMTRSGGAAVNDAALHIPTLPFGGVGESGHGAYRGKASFDVFVHRRPITTSPGWLEAILSIRYPPYAGKLSKFKVASTLVPDFDRDGNKLRFGWLRTILTLGGGTAKAGAGRAAVVAAGE

SEQ ID NO: 40279 - protein, 101 aa, A.fumigatus
QSNITDLSPLQKKVASFTYGCLEPTMLTQMAKYLDTVYVSGWQSSSTASSTDEPSPDLADYPMVSSYLASTLCSVGLVLIPYCAEHCPQQGKPAVHGTAVP

SEQ ID NO: 40280 - protein, 126 aa, A.fumigatus
TIHPLICFWGFFLINHAFLFSIKDHEEQIVEALAQDLGRPRFESEVAESLWMENDIVFVSRNLHKWVKDEKAEDIDFNYKFMNPKIRKDPLGCVLVIGYELAICDLPDYILTLGGSNKVHSTSPFN

SEQ ID NO: 40281 - protein, 146 aa, A.fumigatus
NLFIPVTMGFLEDEDQKYWDDVQAVKAWWKDSRWRYTKRPYTAEQIVAKRGNLKIHYPSNDQSKKLWKILESNFEVRRFERSDRATSLTFLLSRKKLPVSPMAVWNQQCSPRWPSTSTPSTFPAGRALPPPRLPMNPPPISLITPW

SEQ ID NO: 40282 - protein, 121 aa, A.fumigatus
FRIAQNTVPNKVNQLFMAQLFHDRKQREERITTPKDQRSKLPNIDYLRPIIADADTGHGGLTAVMKLTKLFIERGAAGIHIEDQAPGTKKCGHMAGKVLVPISEHINRLVAIRAQADIMGE

SEQ ID NO: 40283 - protein, 311 aa, A.fumigatus
IPQRPNCAWRPRLRRCDRGRSQECRYRLPYVNILRYQRTIDSLRSDCADCDHVASATAIAKGATHHTPEKPLWLIHTSGTGILTVEDFRANTWGIERTKEHNDWDGVDELMNLPDDSFHRNVDKIIIGAGQRAPDSVKTSIVCPPTIYGPGRGPGNQKSVQAYWLASAVLKRKKGFLVGEGKNTWHQVHVQDLSNVYLALGDAAAAGCGKATWNEQGYYLAENGSFVWGDISRAVAKVAYEKKLIPSPDVEPLSDEQITELNQWGLYAWGSNSRGHAIRARKLFGWSPQQPSLMDLIPQIVEIEAKALGLM

SEQ ID NO: 40284 - protein, 89 aa, A.fumigatus
PRSSHCCLELRFAGALCGSLIDSANNTRRQLVSALFTTTGRPLHRIFLFVPYIHSPFSCWFDFLACTDSFTYKDRYMSCDLSEISRFSL

SEQ ID NO: 40285 - protein, 587 aa, A.fumigatus
  UNSURE (587): Identity of amino acid sequences at the above locations are unknown.
GARLDEAVMAPGAGGKRKRGDRSWSGDSGNDGLRPSPHRPGNLNMAQHNHGSHSNHPRDFPETRGRVRRQASRGGRNSNNLSRRPSNDIPNVNTGQKDSPMSPPARDVPDSSQTNGFPPTVAAASIPPSPSPAPTVQQTPAQAQASPKPQSQSLPSPAPPVRPPPGPPPPYDYEYVTESVVEDWMSTGRQKVIKDGVQARDQEDASTLASIYQEIIRAAFYGRLSPTDAGSVIKEIIGEEVAAQDIDMVDDRQPSAALDTRSLFLDTLSILTDADPSNPALRPLVFSTGINAALLRLQLETPVLQTLGLVRDTFTRIGIRKQTNLLYRQSNYNLLREESEGYSKLLTELFTTSNNEPPTSEVVEDTFERVKAMIGAFDMDVGRVLDVTLDVFAAVLVKQYRFFVKLLRVSSWWPKDDISRTLGGNDRDSGLPNWALPGSAGWVTTDEERAEIMRANEQRDREFWNRVREIGIRAFFEIGRKPISEEERKRIFPESTTLSEEEMETRKWIEETGTLPPKGNRVAAQLLGFKLRFYSSKARDKSDILPDNLIYLAALLIKVGFISLRDLYPHLWRRLHHGGRRIRASVX

SEQ ID NO: 40286 - protein, 339 aa, A.fumigatus
  UNSURE (18),(20),(24),(44): Identity of amino acid sequences at the above locations are unknown.
HLMDYSAITQDPDHPSGXDXWASXRATQSSYTASNNNDIPPSPXPPHHQPSYNGDQEGDDFGPRSSENGAPDSPDLSARLQSAQLGDPDYAVEQPPYATQAQYTNEPRSQLPGRSQTGARQNAKNGPAYKIQAKITGLERTGKKDPILRFDVHVSGVLVAFGSPAVKQTDVGHQTNVPKFRTTQYRDVRRTHAEFAKLADHLISANPEVLVPAVPPPLTPAGAGTEEDEIRVKASMQRWLNIVMSNEILMQDDEVVLFVESDFGYSPVVRMKQPATGVRRKVLKQFAPPPDDTPELQDARPIVKMFYLGTMDASHKVDRVVKARRGRCLDVSLGWKRIH

SEQ ID NO: 40287 - protein, 294 aa, A.fumigatus
YKFRSGLGLAESDFGVKLGQMHVQETHPGLANAYKKLGKVIQTVGDYHAVQATAEATTLEDPLSYHSSDAFIVKETLTNRHILLRELIQAQQATRSKRAAADRLKVSSSVRPDKVDEAINALDEAQSHEDYLTKRTQRVTSNLLLEKRAWFERTSNDMLNSLREYTLRQIEAERRTLATLESVRPDIRSIDSSGGLSRLGREAHPAVRRANLASSQGPKGDAWSGIPRRSDSLGRSLSGSFVAPAVDEDDETNRSGTAKGRLRSPSGVGSIVVDDDEDRLDAKNAASRLATSTF

SEQ ID NO: 40288 - protein, 80 aa, A.fumigatus
SYSHLTSFSSTGVTGYIGGDVFYAVSQAHPDWQISVLVRNREKAAQLASKYPNVRIVHGDLDSADVIEEEVKNADIVFRT

SEQ ID NO: 40289 - protein, 243 aa, A.fumigatus
  UNSURE (5): Identity of amino acid sequences at the above locations are unknown.
KGVLXWTTLPLHPVLPIIDRYGMIQGCQNTLYNTRITPHDVVHHSNQFDKSNILQVNPIESYLHGSNVDNPYFYHQPRVQHRTTLQASHEMASDLITGSCACRHISYTASQPPSDVTNCHCTTCRKQAGAPYQSWATFAPGSLTWDKDKLPSVRRSSAFATRGFCPKCGSSVSMKYDYEPELLSVTTGTIDSAHQGKIPKPSCYLFLQEKVAWFDMPDDGVERWDRFSPDMAESLEKWQTMSS

SEQ ID NO: 40290 - protein, 79 aa, A.fumigatus
QIVVGLSVQKIGLFTNADASKGITNKTQRLKDGSFELEAQKGSIDSCGENQRPQGRIARIGIGKNRQGVQEQRARVKSC

SEQ ID NO: 40291 - protein, 227 aa, A.fumigatus
GDPIASGSSLSMSSHTKKDDFCLECHWEAFHLDGKDSQDGAEASAQPPEWSCLDEDHHHTSLAHCATIDEACCDVDDCSVNCPSVCDGFRECDEATACSLSHCDDKDCKSTDAVCFDEHCFSFADHNGQAADHNNLDSMLGLAQPLSLEACGLLPSSTIDQNQMQVPSKRTENATSGFVNTSQCADAPVSFSNNVSSLSSFISPLPVPSSARRFTQSPWECAISPAE

SEQ ID NO: 40292 - protein, 337 aa, A.fumigatus
  UNSURE (336): Identity of amino acid sequences at the above locations are unknown.
IPPGAGKPSTTLSIYMMAKPTIVLIGTCDTKWDELCFTRSQLLIHNTCAVLLMDIGRTPSPHRSIAIKHPDLTSTDTDTHNAPKLSNLPRSEYIHRMTSHAITALTNLHRTGSIHAVLGIGGSCGTALAAAAMRAALPVGFPKLMVSTMASGDVSPYVEETDLTLMYSVVDVAGTNRILNRILTNAAAAATGMAVSYASHAQAPSDTSHSKTQIAITMFGVTTPAVNTIRDRLQQTINCEVYVFHATGAGGKAMERLIREGQLDAVVDLTTTEIADEIVGGALSAGPRRLIAAAEAGLPQIVSVGACDMVNFGPRETVPARFRGLHHGAGRTSAQXG

SEQ ID NO: 40293 - protein, 140 aa, A.fumigatus
FYLFFCLSPILAHKSSKNQLEAKRSCIKNAPSNNPSRSAGSTPPDHRRGLNHRRSRSWCVPQPLTYLQPKQLIIQYAGIGLSAKFIEKGGADLILVYNSGRFRMAGRGSLAGMMPYSDANQVVVEMVRLLRTFCILHLHG

SEQ ID NO: 40294 - protein, 321 aa, A.fumigatus
SDTLNNNVAAFGRKIRYRHWWLTGYVDSLHIYTSPSQAQLDETGIGEAIARNLAAKGCSLLLNFTSESSRARTEELCASLASTHSIRCVAVQADLLHAEEAVPQILAAAKQHFTSPEGKFQIDVLINNAGVSADRFLNDPVKGPIDREYFNWHYSINVLAPLLLTQACAPFLPTDRSGRIVNISSVSSSIGFTGQSVYGGTKAAIEAMTRTWARELADRATVNTVNPGPVIGDMYFATGEEFWKQMQGFQDATPLSKMDEDDPQLKELSEEQICLIKEKMGGRRPAFTSEIAGVVGMLCTADGLWCTGSVVCANGGMKMGF

SEQ ID NO: 40295 - protein, 233 aa, A.fumigatus
CRTRMPTRSLLRWFVSYVRSAYCTYMANNTCQANEVLPVVEHTPVLAGVCGTDPFREMRSFLAQLRGLGFIGVQNFPTVGLIDGKFRQNLEETGMGYDREVEMIRLAHEMDLVTTPYVFTVDEGERMARAGADVIVVHVGLTTSGTIGAQTALSLDECVGVVQAIRDAVVRVNPEVIVLCHGGPLAGPEDAEYVLSRTRGVHGFFGASSMERLPVELAIQENAQAFKRLKIRQ

SEQ ID NO: 40296 - protein, 78 aa, A.fumigatus
SIDTKDNDLPPTQSVNPPLNPPTHQTSTLPYPPRLHHIISRPQASIRSSPEAITTRTCTFVQENSSISKPLLNRKIPS

SEQ ID NO: 40297 - protein, 118 aa, A.fumigatus
RNSYETAKDEFEIATDSTASSTIYAASDRESARDALNQLLAVYSLYTTDIAATAESHAPQELQQGDDAADERGQLVNTDFDPSEIPAPVRDEVRRRVGQRVRELSNAVEALEERAHVE

SEQ ID NO: 40298 - protein, 71 aa, A.fumigatus
  UNSURE (70): Identity of amino acid sequences at the above locations are unknown.
LTPAGLIYNPLGAWLHDKVNSRRGMYITGFVGIIITTSCLAAMTAEYAGTTNKAGNAFGILFIYLYLAFXG

SEQ ID NO: 40299 - protein, 174 aa, A.fumigatus
KRYACYYAKDIGSFGWRFPLALQCLPPLVLLVGSPWLPRSPRWLISKGKHEEAKVVLERLRQSPDDPDNLVAKEEYYQTAEQIRLESERLSEYGNVWKAVVKKKSYRKRMVIGFLTQWGAEFGGPLIIVSILLVKVESSTYNLTEQLRGFAILKSRHEGRYAFASERSVADNSW

SEQ ID NO: 40300 - protein, 98 aa, A.fumigatus
DLPNGDQTHRHGILPFWAVCRYVHPGCMVRTATNMDAATLILLETAPMGFNNIGWKYYLVIICWSAFFIPGKTDTQVLDETSTNASKLFTSSSRRLHA

SEQ ID NO: 40301 - protein, 127 aa, A.fumigatus
HRQSDKLSKMKLNTVLSLAPLLGAATAQGQHEQEPFTLNVRWSNSMGTLEGLLNANSGAFWSGKPTVSSCPENVQDCPAVNTTSFVSQGSKLFLNVAVPGGQQGIARLFFSFPFLPPSSIFFFGRQR

SEQ ID NO: 40302 - protein, 102 aa, A.fumigatus
YLFCGTVYISPEGQLTYTVPHSGYIPDGSLADLPIMKDGFLNPFLTLWLCSVDKDAKQWKVWAEYTNGTTGAITNNGSNGQSACTRFALEAQPYKGDKAWEF

SEQ ID NO: 40303 - protein, 66 aa, A.fumigatus
SPLISAILDARSFNARLRVGVMSGLLTSGQSPVIYRIALLKASKALFMTMGNAPQSSFLSALIAWN

SEQ ID NO: 40304 - protein, 89 aa, A.fumigatus
PQGSAFHKLFRFTRLTAVFRQEPKLWYGIGILYDRYGSLDHAEEAFSQVMRMAPDFEKANEIYFRLGIIYKQQQKFNQSLEVRSSVSYL

SEQ ID NO: 40305 - protein, 128 aa, A.fumigatus
ATEGRKLYRILIRLLIYRLTTLQFDSAQAAYRRVLDRDPNHAKVLQQLGWLYHQQSNSYASQEKAIEYLEKSVSAGKTSAHVLDPEQALILPFFRQHRCTKLVPSWSLLHVASQVSQGVRSISTGCLP

SEQ ID NO: 40306 - protein, 122 aa, A.fumigatus
  UNSURE (63),(111),(120): Identity of amino acid sequences at the above locations are unknown.
YESCNNQIADALDAYGRAADLDPTNVHIKARLQLLQSQLSGSNQNSAPAPAPQPQDVHPQAYXAPGVGAPPAPQWGAPAPNGGPHPPASGSSKADRRLESRHQRSTISESXAAPASQRFXSP

SEQ ID NO: 40307 - protein, 93 aa, A.fumigatus
LAVFAIIGSLTELMGDLDGAMNAYEQALRHNQWSIPAMNAISCILRTKEQFPKAIEYLQNILKLDPTSGETWGSLGIWNPFKILICLLSHHGD

SEQ ID NO: 40308 - protein, 600 aa, A.fumigatus
  UNSURE (175),(223),(231),(317): Identity of amino acid sequences at the above locations are unknown.
SCLFLDNTDAQSWYLLGRCYMSQAKYPKAYEAYQQAVYRDGRNPTFWCSIGVLYYQINQYRDALDAYSRAIRLNPYISEVWYDLGTLVSQVARSLFGDNTRETEVADHRSCSMNPATTRLRMLLTLMAAPLILILQMFTSRLVCNCCKASSQAPIRTALLRPLLNLRTFIHRLTXLLVWALLQLHSGERQLQMEARIPQHPDLPRQIADWNRGINEVQFQNQXQPQPANGXDHRDQVRGPVVFQQPSPRQEPGRAFPDGVRAPAARSPKTTVTGSGAFAPAHALPQLPNPPPPPHDRAPTGSTPFGCDTRGPLPPAXNFAAPPTGPTGPNGAPASAGPLPPYPRPFTPPTEIRPIREERPSSPGSTYPHQQYHHGPSVPIQGASSTGIAGGAPAPASAITAAEAAAREREDRPTSAMKRGREWEGESGPSKKVANEETRVRLDDQVARRVTPPNRMPSPGEMQRRGSSEARREDQRRVNESYHPSEAAHHPPTLPSIQHMPQHATGSSLPPMNDGPAPASNGPQAGAPSAQVKEEPARNEQVPAHEPAARKMDVDENYDDDGDDEKRTSTAAKGSPAAGSNSNGVLSNGAQTSQSKQESA

SEQ ID NO: 40309 - protein, 1429 aa, A.fumigatus
  UNSURE (339): Identity of amino acid sequences at the above locations are unknown.
FNMAPYIGTQEGSPSSLGTFSHVQLSKDTNVASQYWEELFHSVGSQPRLACVPLDHQWPRAETTVLASDGLLEAATTFSRTHNISLADLIYAVWAIVSARQTVSGQSTALFTVTGRSYPSAKQDTPENGRAEQDYPLLLSVPEDVDVLSWVRSVSTAAATASALSYIGYDRIMERTSGMRPQVKVSVTFEVDSHDTMAPDDDFPLVFNIIASARLQLSMRHNATVPRGDVRALLDRFAATLQRVTANHDATVSSVDIMPPAERQLLLDYGKAPLKPKSGMAHSLIEEQAKARPDAAAVQYETEPPLTFSALNTRANQLARQIRPYGTKYIAVHLRMSTXFIVALLAILKSGAAYVILNPDALAAGNPSSSKNSSLGWVLVDISTAGELANEVQLGSLLSQASSHDTGDLLHVQDPSSVAYVIYTSGSTGKPKPTLLEHQAVFNGLLAFPPIEGLRQLLFFNPAFSAAQRSIWATLAVGGCLCLASKENLTVHTAKMINTMDINSVDMTSSAAALISPDDVPSLRRMVLGGEMVNPAVIQRWEHRVELLSSYGLSECTQLNWRHRLQSNVSSRLIGQPYDTTTSYILLPGTTELAPLLVPGELCLGGAQLARGYLHRPDETAKRFIPNPFGKGKLYRTGDMAVRHADGSVELIGRIDFQVKINGHRVDPGEPNSIIQAIEEVEDSAVVPASVNNRTVLVAAVVSRPDTEWEALVRKLRPFLAARLPLYMVPQFWVSMPALPVNANGKIDLVAIRRTVEALGESGQLLPERSSIGSREERDLTDSEKVVRSLWAKVLSLSESEISLEDSFISLGGTSLEAIQVVSQLQVLHQLSLRVEDILLGETLFQVAAAVQPQPVEGKPDNDTISAALFEVAPSIESVGISISSIEDAFPVTPFQEAAIANTMMGGTSYIYRRSYSFEGYSPDDVKAAFETLMKSDGWLRTTYVPHGTSFLQVVKKTADLPWETSDMDVTEYLQKQTSKGMYPGELWWTAAALPNNVLVITAHHALFDFWSNEFLIQDLTSVLQGTPRIQRRGFRPYVEYLQQHDPVAMQEFWQGYLEGAVPSHLGSQIAPENTVAAEVHCDLKRTASQRRVTPGVLLYAAWAIVLGLANSTEDVVMGVTFSGRDAPLAGVLQMSGPTLMVAPLRVKVNKVTPLDKHLEDVQSNLWAVARNAPYGLRKILKASGQAKDLFDTMVNFLIKIPTSTPAGGLRQLPESNLGTVEYTRIELRNESLNRVTLTSTLEPRYAQALADTLAAILGAASDQPLTKLGEFRLVQPVPRLMERLDDPVGSVPVSAVHTIQAEDRVESPGGELAHSALQTMAVSHPSRTAVEDISGARITYAGLAIKMNQLAGLLRERGLELEQIVPIMLEKSINTIVAMFGILVAGGAFLPLGPKNPPGKKLGNPRRLRCQTGHCGSAECRLFPRHLP

SEQ ID NO: 40310 - protein, 355 aa, A.fumigatus
GGYGSARAFYINLCVGAVCAPVYLFLLPNKDPRPGVSLQERANTMDHIGGILTIGAMVTGVMAVSFGGVMYPWNSGRIIGLFCCSGALFILLGIQQVFTIYTSVAHRVVPVEFFKSRTVLILFAATAAGGTAIFVPVYMAPLYFQFTRGDSTLESGVRLLPFIILMIVAVMTNGALLSKFGLYMPWYLVGGVLVVIGAALMYTVGLTTSVAHVYGYTILIGVGVGFFAQASFSVAQATVAPELVPSAVGFISLAQITGITLALAIANAVFFNESVRSLKTILPGVDPGQIKDTISGTRSEFFQSLEPGVREQVLEALVDALSKSYILVMTAGALVAVLSLLMKREKLFLAPPGGS

SEQ ID NO: 40311 - protein, 94 aa, A.fumigatus
VRVKLNNVPFQKQLLMILLATGNKYHKVLSGDNCWAIANQYGISLDQFYSWNPAVKPTSCQSLLPDYYVCVGVAGMLLSRSHYSPHLAMYLLSD

SEQ ID NO: 40312 - protein, 516 aa, A.fumigatus
RCCGQSILIGHIERNHVLLYAFVMFVASSSSPSTAPGHNLGLILKSDGCRMDRFISRKRPRPSPSAGQQTPAPDEDSTDMKLAMLLSLFPDIEQDALLDILISSGGSVEDASAVITAQRAYKPVKKRAGGVPAIQTSMTSHITTEAGLPPKRQLTRKGKTLHLFSPEDVAAHTPCSIIHNFLPPDEADALLLELLDESKHFSRYRFQLFDRTVESPHTSSLYVATPEEIRQQTSEYTYGGRYRSNVRQLTPYLRAVSAKVQRAVNDEVQKRIRACYPGGKKLKYQSPKEWVPNAAFVNCYDGPAESVGYHSDELTYLGPRAIIGSLSLGVEREFRVRRIVASDDDAENNSEVSFMVSTADSPSRRKTTSKGIDGRGDAQGQISIHLPHNSLLVMHAEMQEEWKHAIVPAQTVSPHPLSGNRRINITYRWYRDSLHPRNIPRCRCGTHAILRCVQRKRENKGRYMWMCYAGHEPGKKGCTFFQWAEFDDDGEPLWEIKPTEGGAPTLRNFIEEDDKQ

SEQ ID NO: 40313 - protein, 125 aa, A.fumigatus
PRGVLRHFKGRAGELGKCWTTHVPVHNSDGKFKNPSLKENCRLQNGHSYCVAASDLTTRSTDSAEEASRMDMATGVEAADLPSPTQGGLAANCNAFYKVKTGDSCWSIINDFGNFSIYDFYRWNP

SEQ ID NO: 40314 - protein, 113 aa, A.fumigatus
YQFEYLLPVTSNSKESTTHCMMSLLHSEWTAFLAQNPTVSHDDESRNRRFLSSPEGRVLAEQVSSVDTTVPARDNHLIPIRIYTPKDHSSDAVVIFYHSGGFVQGSLDTEDSM

SEQ ID NO: 40315 - protein, 88 aa, A.fumigatus
PTLTHRVNKLTEIKVSCRHMALGGPSTVISVDYRLSPAHQYPIPLNDGWDSFEYIITNLPTLLPKHGASARVVISGTSSGGQIAAIVS

SEQ ID NO: 40316 - protein, 192 aa, A.fumigatus
ADAEWHRTCQMVCLIVDYSQPELNIDKVIRFTTQDSLYDLAWSEIHENQILTASGDGSIKLFDCNLEDFPVQNWKEHNREVFSVHWNLVAKDTFCSSSWDGTVRVWSPHRPHSLLTLPTHSCTYSAAFSPHSPDILSCVTSDSYVRIFDLRTPASASNHLTLQIPIHAAPASPIPGKASSPPGAGSKRATAK

SEQ ID NO: 40317 - protein, 92 aa, A.fumigatus
PVLSSVYFNCSFQTLYPVFCTMLHFRTEGYNGCAVKYSPFFDNRLAVAASANFGLVGNGRLFILELTPNGIVPAKWYVSLSTIHSRNSTLTR

SEQ ID NO: 40318 - protein, 113 aa, A.fumigatus
RSEKVHSRTYCISASGYFLGLRSLFFACASQPWIRDSFSYFLTFLAENNACDIAFLFILDSAIIIIYIQLHSSYPPIRRNQELGVIPEEPKLPAVWFSAPIPPPTPPPSSHPS

SEQ ID NO: 40319 - protein, 184 aa, A.fumigatus
ALVTNTLCSAHEMEKQYSCQFCNNRFKNKNEAERHQNSLHLRRHSWSCAALPGYQAAFHPSTSPTAQTNSGPSHDACGYCGEEFPNFPQPDWDRRFEHLTSVHKFGECNNGKKFYRADHFRQHLKHSHAGTSGKWTNVLENACMKEEAPPELKDTTRSSGAGSAAPETTGSLTSNKISEVLSPC

SEQ ID NO: 40320 - protein, 551 aa, A.fumigatus
LRWTMDFPRLSPPLINVHEINSGGYDQSHSTDGSPKNMSGQSYSPLRPMPIPVKSITNFAPPPLPPPTHITDLEDGHDAGWLFANARNHPGSAKLAPINPGSSLFGGHRRLESVCKTDRMALDELDGRQSGLPVSTSPKAHIKIEPPPAMEEGFRNSITINAPGSILKGERDFSRRSVKDSSDAYDQHLLSKIGKPLSPRQSISLGNETKASLSTLPIPPRNFGGLPSPGVSDGPTLDVRWPSNSQSGAISPGTKVGWRDYLGHRSPSVESSAPSSAVEYDHSAFLRDVYRRRGGGTTPQSEETLSLPSRSNRGSYDQGVFSDIEGDFSTDESLPSRYFNLREATPPYLDASKSGTKRRASSPPREPVQDDRHAPHVTTCNGDLSQRRTSGHPYANTLSVNGGYIQSHGTLSAASSLSLRTSGTYSSAAMSIGGSSMTSMSTFDRPSPGGLSPSSDFDALNDRPPISSTSPGGLPSHQSVRNAQVPDASELRNADSTTKLSLQTTLNVPKSAAPKMAGLYICDCCPKKPKKFDSPAELRYDLTILSAVTEH

SEQ ID NO: 40321 - protein, 61 aa, A.fumigatus
YLLLYRYVLGHEAMKRMSSSNVLVVGMKGLGVEIGKHNIWFAKYGQRLTSSFSQERCPCWG

SEQ ID NO: 40322 - protein, 82 aa, A.fumigatus
  UNSURE (66),(76): Identity of amino acid sequences at the above locations are unknown.
RALSAKNVALAGVKSLTLYDPAPVVISDLSSQFFLQPQDVGKPRAEVTAPRVAELNSYVPGTVGPXLHDGPETRYXLWVPKG

SEQ ID NO: 40323 - protein, 61 aa, A.fumigatus
RIKLGPCVCQSMYNIPIFDDKPFKLRLRSDPASEELRYSMSLTQSGISMRHKRSSEFSAPQ

SEQ ID NO: 40324 - protein, 803 aa, A.fumigatus
WTPGRMLHEILLSLSGQPSPLFAFNTEEDIVPEDAFPLSPPEKALLTSLARLSRLHAKLREQTSLISSSHPSIICRAVSSAINAHHLGGFQRKILEVEKAILAEDSAYVGGYGIVPLSTIVGEFSPWTRRLEWLWDVTRFVLPENRTSSAHGCTGSALIDYLRTESQTGYLDLEEIALHLITVAESAWIRQLSTWLLYGNLPIFGKDDFFIQKDNSSQMDDSSSITNFVMQTSLLPKFVSLHTASSILFIGKTLSHITAKRKGATMGFDSGAPPVTLQGEHIAHLASLGSPISASKLSNAVDSIRLSLSQSVLSKLLPLPKILEILSVLHDFLLLGRGEFATALVSHADARLSERHRIPELLAGRVRAQTELEGLVVKDGDVVHALAHTWAELYSLQNEEDPVDESLDLARDLVRLSITDSKNRHTVATHSDEIGSDLVAELSDVSFEDLLFPTRTSISVEVRAPLDLFLSTSDIAVYSRIHSYLLGIRRAQIRINDLWKHSFLRKSYPSPWGPPRSNTPFGQSKLKLGRQRDNIRLSQMRPVWATSSAALFVLSEIGSFFQGEVVNGCWQHFREWIQGGLATATSSTSSRPETSASLKSRYSDSPIEGRVGIDQSSHSAPQRLDPETLTVAHHRYLFSLVQSLFLTDKPFTEALRSLLSLIDHFIALIIRLESVQKNMDLETDEGVVDALADYPREETELLEALRTARMEVEKGIRDVVARLRDIDDSRSGEGRKMLDLLKHARATPLADRKNGSGVNAQICQYLPRKTAGVDQLLMKLDFGHANGSLGTTAPVLGDSFDLE

SEQ ID NO: 40325 - protein, 336 aa, A.fumigatus
SAIWIEASLPSIPQCNPVEMNQSPLYAWAAVSQVKPAPPPNSGTSSTTRAMSPVTSPFNLDRFYHPTGSHHGTTNIRQAYLLSEDVRAFDAKFFSVPPGDAEAIDPQQRLLLEVTYEALESSGHTLADLSNSNTGAFVGLMSQDYFALNGQDVDSVPTYAASGTAASNASSRLSYFFNWHGPSMAIDTACSSNLVAVNEAVQALRNGTSRVAVACGTNLCLSAFTFITLSKLSMLSPTSRCHMWDADADGYARGEGVACVVLKTLSDAISDRDPIEAVTREVGVNHDGRTKGLTMPSAKAQAALIRNTYARAGLDPTKEADRCQYFEAHGTGTKAG

SEQ ID NO: 40326 - protein, 101 aa, A.fumigatus
VAPFWDPQEAEALMRAFFPQSDSEGELFVGSIKAVIGHTEGTAGLAGLMKACLALRNATFPPNLLFNKLNPDLELFTSHLRVPTANQPWPELSDGTTRRLG

SEQ ID NO: 40327 - protein, 318 aa, A.fumigatus
GFHLSVSPEQREALPWYRQALLKNAELLLHLVNDGKHPFAPQNWVSDTREDIFKMMDSYPTTDADFNLTKAVGEHLLLPSVLNGDTSILQYMTKDNYLERYYVDAIGFQLLNFLIAGVMEPLCLKSPRMNFLEVGAGTGGATKAILEKIGYSYASYTYTDISSAFFDHDAGHFQSHASKMIFKALDITKDPAGQGFIPQSYDVIVASNVLHATESLRSALEHTRRLLRPGGYLVMVEIIRNDVMRHGLVMGGLPGWWVGENDGRYGGPSITLDQWHKMLRETGFSGIETNSPMRDPVGVPGSIIVSRANGLKLISSPS

SEQ ID NO: 40328 - protein, 131 aa, A.fumigatus
HPHSTSTASTTQPAAITVPPTSARPTSFPKTCARSMQNSSPSPQVTQRPSTRSSACSSKSLTRPSNPQAIRWPTCPTRIREPSSASCPRTTSRLMARMWTPSPLTLRLVRRRVMLPADSLTFSTGMARPWQ

SEQ ID NO: 40329 - protein, 185 aa, A.fumigatus
LCDNSVNSFGLGGTNAHCILETYNPPTASDPVIEIDMAASGTCCIPSVFSAASDRSLATLLQSTLKFMDENTDVNMSGLAYNLSTKRSALQRRVAVSATSIDELRDKIKSTIEAASENDATLHSTSALPEPASLLGIFTGQGAQWQGMGSQLISSIPLARRTVEELDSSLASLPSYHRLSWTLED

SEQ ID NO: 40330 - protein, 183 aa, A.fumigatus
DPPFMNPRRPSSPVVKTLVVTAPSRPWPCSGNICSRTAYLPLVILYLSITSRFDSIAVLCCIYNVRIVEKWFDSQDTGFHSILLISYLDRSISPLHPTMQPSRNEPIAIIRMGCRFPGEASSPSKLWDLLHNPRDVARDIPIQPRPLLPPNRQPSRYHQHPPGLPPFRRRARVRCKILLRPPR

SEQ ID NO: 40331 - protein, 374 aa, A.fumigatus
KIDSTTPVGKASLSQPLCTAVQVILVDMLRAAGVKFQAVVGHSSGEIAAAYAAGFISAWDAIRIADYRGFYAEMAAAPGGEKGAMLAAGTSFEDASDLCQLDDFAGRICVAAHNSPSSVTLSGDIDAIALARRVLEEEEKFARRLKVDTAYHSTHMHKCSVPYLTALRNCNIQVQQPGPDAPQWFSSVRNGQVISSMESLDSQYWVDNMVQPELFCPAVQTCLKYVDKAINCVVEVGPHPALQGPAKDSILAAVDQEIPYSSTLNRGKSSTVAFSDTLRFLWCLFGSADETLRAFQQTNYPHTPTTMTRGLPTYPWSHDRGYFAESRLIKTFHNHPLPFHDLLGIQTADGAREEWGWRNILKMNELKWLSEHSV

SEQ ID NO: 40332 - protein, 206 aa, A.fumigatus
  UNSURE (39): Identity of amino acid sequences at the above locations are unknown.
GQVVFPATAYICLAMEAALQLAQGRPVKSIDLFDLEIHXAIASHDSTGTELLTSMTKVSALDTEWEEITADFSAYSTISKDAANLGLNCCGRVRVLLGEGEDSPSHFSPRLPPLGKLTAVDVDSFYKILRDDFGFGYEGPFRALTNMSRKTGFATGTVRCERFDDSETSLLFHPGMLDSALQGLNAAHSAPGDDRLWTIVAPTFCR

SEQ ID NO: 40333 - protein, 80 aa, A.fumigatus
REDQYVPVSVEPVTQRGDLFRPDRTYWLAGLTGDTGRSLADFMIAHNARNIVLSSRTPTVYEDWVEWHKSRGVSVRYFGG

SEQ ID NO: 40334 - protein, 158 aa, A.fumigatus
  UNSURE (112): Identity of amino acid sequences at the above locations are unknown.
AKVLVRLKLIIAYQPFLLRDITSFQSVKQIHDAIKESMPPIGGVANGAMVLRDSSFMKVSFDDFQAVLGPKVKGTINIDRLFSDPNQLLDWFIGFSSVAGTVGNPGQSGYTXGSCFIKALVDRRRKQRLAGSVIDITPLVGLGFIERESHGRLNKGPL

SEQ ID NO: 40335 - protein, 322 aa, A.fumigatus
YLTVNYRSMVELRSLCVYCVCTVCVLCVGRYIGKLFCLSIQIPRLFPIPIDPPPASPDLLPRPAGRLHWIHSHCQALRRRTPIRCVRPPTAAPRSCTARPPRGRPRGGPPQTHRPRVCWRSPDRRCSCSTWPRSRRDARKTLARTSAASSHPRAPAGSSAAARPAGRGRCCRCGRRPPAASGTPGRPAPSGSAPRSRPRRRSTRGPCGRAPCSESSLPTAARLSASAVRTAPAPTAPSRSAPSAPTAAPQSPWRTASPRSIAVGSGPGSSAPRGPSRGTACARCARSAATAGPRRSSRAPGNRTPARSSAAAAASGSRLHPR

SEQ ID NO: 40336 - protein, 146 aa, A.fumigatus
HHPRGGPGAACACPCCDAGHLFDRWSEGDGGRSRAEADGRGHGRGCQGSAGSPAQHRADPAGGGEEGVGGPLCGGEQPSGRVDQVGCCVREHQDGAGAGPEPAVCIARGSVAAAGQPRSGQWRAGAVQVTDAGDGGKTGAGREGPE

SEQ ID NO: 40337 - protein, 826 aa, A.fumigatus
  UNSURE (11),(89): Identity of amino acid sequences at the above locations are unknown.
FLGGGGEKKGXKKKKKKIFFFLGGKKKPPPKKGGGSRGPPPPKKKKRGGKKTPPKGGGKKRGGVFFFPRGFFGPRGGGPFWEKKGGKGXNRGGGPPPKKGPPKKFSPPKFFLFPPRGGPKNFLGGGEKKKGKKGKKRGVSRPDLAAKLAQAESARSQSSEETSLRLAEKDKEVAELKQAVAKSQEELQAAREAAAKELSEKIAELEAAHEAAVAKLKAEHEGALASAAAAHAQELSVAKQAAESAGSMHSEELQKLREELDAAEAAAEKGREEAISELNAAHQAELKALQDKLNASEQALGEARQALEASVSSAQAVAVQEIESLKEKVGALEAQLSTGQGEIQSLVEEVQSKQAEAEALHQNLTDFETQLKAKDAEKDEQLRDLKEKAAASEKALEEQLQEAVAVAERHAQALEALKAEHAAALEKAKSEAAGSHESALSALQAKHDELLAANRDLETAHAQKVAKLEAELQSTLERHAGEISSQTELREKEIADLRKDFEETKAKLLAELEASQASKAAEADAEHSKAIEQLLTLQEEKLSSLRSELESSHKAKLDELQKLHDTTLAEVQEQLAHARAAMQDTSLIDGLRATVADLEQKLMDADMAVAAKEALAHQHSTALTQLEAEKKELEARYAAVSSQVDELTKSAAASESIKTELERVLNQLSASREEVSQLQASHEAVNGELEQFKSQTRAMEEKLAQGEKDLNDQIERNLSLLNQLGDVDSTISANRKRVRELEAELAALKADKDSGKGSVGLEGSRWAGEDGANPNNKSEESGPTAAAEGEDLGSSIEGTVGDPLFTRGIHPGCPFPVFDVILMRWT

SEQ ID NO: 40338 - protein, 122 aa, A.fumigatus
IDPWAVRSRSMLRIIPSDSGSSVRQCRAYSASTDGAVAKCSISTDGSSAKSVAHRVPEIDCSRVWPRIECTAWPISWNSVRTLCSLSSDGRPPPFVPGSGKSHTSAIVGSCRSVWVTSSPTG

SEQ ID NO: 40339 - protein, 151 aa, A.fumigatus
WRWSTRRTTRGRRTAAASTAPPSTSRSRSSTRACRSPRMRRRRRRPGKGFSGISTATGPRTTATSSIGRSPTNSGSMCLGRAATRSTARRASGTRTRCCGGGADAADGSASPERLAVRMNPMQTAGWSREEIRRCGRWVDGDWEETGYLDR

SEQ ID NO: 40340 - protein, 79 aa, A.fumigatus
LRAAHHAWPGARSAHSHETQPPRSWPFRAPQHAPPSAPPRLVRVSRPRQPPPGVAPQEPFPKQPPSLSDPSAAHPSRRP

SEQ ID NO: 40341 - protein, 248 aa, A.fumigatus
RRDPDAAAAADDRAGVRFPGARDERRGPAVAAERAQRAHAVPRDGPRGALDPGPDPTAIDLGDAVRHGLCGAAVGADGALRDGAVGAGAVRTALADRRAAVGRDDSEHGARPHGPRVDLRRGRERGADPDGAGRPGVPLAAGGRRPHRQHRPLPAGLAAALEPAGARGCDDAADVLARVFRASLRLRGHVLQLHLRSGDRQQTLGRCVWGGPPRGRPRGGRAVQERGAAVGGRTQRMGVRRRSAWQCE

SEQ ID NO: 40342 - protein, 69 aa, A.fumigatus
FQTRDFSSSGRIKYEQGILSIVLHTYNQPISTKENSPFRKLVRPRAHSGRSLPTAALKAAQSFQLRRRR

SEQ ID NO: 40343 - protein, 143 aa, A.fumigatus
  UNSURE (55),(133): Identity of amino acid sequences at the above locations are unknown.
IGPGNPPFFPLFPLFFFPPPQKVFGAPPGGKKKKFGGGKFFGGPLFWGGAPPAVXPFSPFFLPKRAPPPGPKKTPGKKKNPPPFFPPPFGGGFFSPPFFFFWGGGPPGAPPFFGGWFFFPPQKKKNFFFFFFXPLFFSPPPQK

SEQ ID NO: 40344 - protein, 283 aa, A.fumigatus
PVGEDVTQTLRQLPTIALVCDFPEPGTNGGGRPSLLSEHSVRTLFHEMGHAVHSILGQTRLQSISGTRCATDFAELPSVLMEHFATAPSVLALYARHWRTDEPLSEGMIRSMERDRTAHGSIYGAVENEAQILMALVDQAYHSRPADGGRIDSTALYQQVSQQHSSLPEPADATTPPTSWQGFFGHLYGYGATYYSYIFDRAIANKLWVDVFGAGRHAVDRAAGERYKNEVLRWGGGRSGWECVAGALGSANESNADGRLVEGGDQAMREVGRWGLGRDGVSG

SEQ ID NO: 40345 - protein, 265 aa, A.fumigatus
FHSSILRTLHFTRYRHALTRSRKGERKGKKMPEILLPDTSSITSSTASSLLLYTDHQHQTALARRKSLPLRRLSVWLSRRTSKQGLNATDDNGYSHHHHHHPHTLTQGENYPDYDAQRITSDFNLHRQREHEHEQGRRNRKFTDSEAERHLAESYAAYCRAFTSAGEHLYHQKRRTWMMHGEVDLPVMTEDSAHVHAHPEEDDADGKREGLNPPDTEPSPPPHILTPSLYAEMRRVASDQKRARKRLRERRLWSWFAWIRPRESH

SEQ ID NO: 40346 - protein, 189 aa, A.fumigatus
VHRISITSNTGNGHPGWMPRVNNGSPTVPSMDDPRSSPSAAAVGPLSSLLLFGFAPSSPAHRLPSRPTLPLPLSLSALSAASSASSSRTRLRLAEMVESTSPSWFSSDKLRSIWSFRSFSPCASFSSIARVCDLNCSSSPLTASWLACSCDTSSRDADSWFRTRSSSVLMLSDAAADLVNSSTWLLTAA

SEQ ID NO: 40347 - protein, 153 aa, A.fumigatus
ASASLAATAMSASISFCSRSATVALRPSIKEVSCIAARACASCSWTSARVVSCNFCSSSNLALWEDSSSDRRLDSFSSWRVSSCSIALLCSASASAALDACDASSSARSLALVSSKSFRRSAISFSRSSVCELISPAWRSNVLCSSASSFATF

SEQ ID NO: 40348 - protein, 145 aa, A.fumigatus
DPAASLLAFSSAAACSAFSASKACACLSATATASWSCSSRAFSEAAAFSFRSLSCSSFSASLALSWVSKSVRFWCKASASACLLWTSSTRDWISPCPVDSCASKAPTFSLSDSISWTATAWAELTLASSACRASPSACSDAFSLS

SEQ ID NO: 40349 - protein, 187 aa, A.fumigatus
  UNSURE (98),(176): Identity of amino acid sequences at the above locations are unknown.
SSSCDFATACLSSATSLSFSASRRLVSSLLWLLADSAWASLAARSGRETPLFFPFFPFFFSPPPKKFLGPPRGGKRKNLGGENFLGGPFFGGGPPPRXPPFPPFFSQKGPPPRGPKKPRGKKKTPPLFFPPPLGGVFFPPLFFFFGGGGPREPPPFLGGGFFFPPKKKKIFFFFFXSPFFSPPPPKK

SEQ ID NO: 40350 - protein, 86 aa, A.fumigatus
SRHFYTSYTMNDPVTESIHQKGAMPEDKPFSETPRRVDGVSQLCMSCSMFLLKGDIGADVSIQTRAMFLMRHQTTVGRSASSVRLF

SEQ ID NO: 40351 - protein, 79 aa, A.fumigatus
FSPKDEVCSSSLPLVLYQELTSSAVVQELGREGVLPFSRLWASNKPFHSPAAGLFEHWVVSIIIMLAPPPGDAYNFLLK

SEQ ID NO: 40352 - protein, 145 aa, A.fumigatus
LSSSCSARFSPFLPLSSLFLPPAGFMRRFSSARLPLVLNSARPPLSSPSTKPLLLLSRSASLFSSSPSTSVNRIAPRRFPLSQVAKRYCSYRRMCMSRRTDVPSGSTNVTHGREVLPTNVKPVHYDLTLEPNFEKFTYDGNVIIE

SEQ ID NO: 40353 - protein, 84 aa, A.fumigatus
SRNSRSNSETRFPIGSHCARRYRARKRGSVFAKEGYWSYAAAPFSKPEIWHTPDYNTYAPNRKRGQASIYSQRVNAADDLPSKT

SEQ ID NO: 40354 - protein, 172 aa, A.fumigatus
SPCVYVDSTILIMTTRNGGEKNYLEYVYRKPKFLATAMFAAYAVLLGWAASNSVVFGEYILNAADVEVNRWNQRGIGLACVTAAFLIHALAVKWGLRLQNLLGVVKLVIILFVIVAGWVALAGHTEAETPHNFKNAFEGTTGSGYGIVMALYNVIWSFIGYSNANYVSHSQS

SEQ ID NO: 40355 - protein, 768 aa, A.fumigatus
SMRGPALRGEDPRLKIADFGFARSLPATSLAETLCGSPLYMAPEILRYEKYDAKADLWSVGTVLYEMVVGKPPFRATNHVELLRKIEKGEDRIKFPEENPASDEIKALIRALLKRNPVERLNFPDFFQNGVITSPIPGLVADDQPSIPQGPPADPETAEATPRPDSRSGATVPGGTEREREGPSLPKRDTGLTQRPPSQNQRFGTPQTTTPMRRIGSGDRPPSTPKESTPPMTYPQRPSAVSHATAPGRQELVDRNATFTAMERQKGRNTFSEGSPQIDRQADKLREERERAAQDVAFERDYVVVEKRAVEVNAFADELAHSPRIQGNISRGAQTGALSRRSTVHGPTPSNPSPPQATVGKAMQVLSGRSRADSMHNRQGSYERRYGQSPTSATSAISKALNMASGRLFGMGFSPPLAITKGGRSPPLAYNPFPAYPAHGSLMIGDGAKSNLALDEDTKTVQILEECATRSDVVYGFAEVKYKQLVPLAPSVQTDPSSKLNLAGERENPDSADGGLTVDAIVTLSEEALVLYVKALSLLAKSMDIAGAWWARKNRGDGFGDSAMSRASGASTLAGTRINNVVQWVRNRFNEVLEKGEFVRLKLIEAQKRLPPDHPSHPDNHSVGSSLGSGASVDVVVSPGVSAEKLMYDRALEMSRTAAINELTGEDLSGCEIAYVTAIRMLEAVLENGEVPRFGQDKDDTSKDSDKIVLDAVQADERQVVIKRESLPPSRKPTSADDPGSCRQHPESASSSSQEAGDSCETSTDTFC

SEQ ID NO: 40356 - protein, 96 aa, A.fumigatus
CFYPDEGNVFDATPDDRRQIGVVSASFLIFNRVIGTGIFATPATILGLCGSVGLSLFMWVAGTAIAMAGTAVYLEWGTAIPKYDPPACMWIPPYSS

SEQ ID NO: 40357 - protein, 131 aa, A.fumigatus
VIRSRDLSSLTGILTARQALSETRNPVRTLKIAAPIAIGSVGILYMLCNIAYFAAVSKEDMLSSGQTVAAKFFGNMFGARAEKVMSVFVALSAFGNVLSVIFSQGRSMFKLVAPGVVSRTNKFGSCPRTWP

SEQ ID NO: 40358 - protein, 139 aa, A.fumigatus
GAANPSSLISYPLSIVNVFVSGGLIYIYLTRSTRFPDWAPGIRATLPVTIFFFLSNIYLVIAPYIPPSEGQSVYEELPYYLHCVVALGIFALGAIYYVVWAIVMPRFGRYMLVKETVVDADGWSRSVFTRLPLAEAERV

SEQ ID NO: 40359 - protein, 151 aa, A.fumigatus
QKVSVLVSQESPASCEELLADSGCWRQLPGSSALVGFLLGGSDSRFITTCRSSACTASSTILSLSLDVSSLSCPNRGTSPFSSTASSIRMAVTYAISHPDRSSPVSSLMAAVRLISSARSYISFSAETPGLTTTSTDAPDPSEEPTEWLSG

SEQ ID NO: 40360 - protein, 61 aa, A.fumigatus
HPTRMAVELYWPDLKVRDSLFLREGGCNSVSQRNTYDKMCLIIMQIFVDAPRWVCSSFIMQ

SEQ ID NO: 40361 - protein, 62 aa, A.fumigatus
HFPKSFFSHHLIPPRRSGTVARTYSNKSHSRRHLSCMIATYSQLKCAMYVTTEHYVPRITPR

SEQ ID NO: 40362 - protein, 83 aa, A.fumigatus
PTYASISVFLGFIFRGCFKCSVWNPYGSTYPVTIYLGHCFCLQGNYTSLGKVPTAFLLFYTAIKYIDISMVQLSDIVPLCTEY

SEQ ID NO: 40363 - protein, 73 aa, A.fumigatus
DCTGSEVCRIRGEHGRHTKAGVGILYLLIYTCQDFAMVFDLSFLLLASLASPVASAITYCSSVNTGSSYSASR

SEQ ID NO: 40364 - protein, 63 aa, A.fumigatus
SDKSKTETTDSKTTTTAPTTTHNTVSIQTVAGIVKTITVPGTEPSATPTSALLQARRDGIRGW

SEQ ID NO: 40365 - protein, 135 aa, A.fumigatus
VALTTSLCHQVISNLFLLTDISIYQSNGLCTDTCNADYAFAILQGKQCWCSNIAPNKATNTDISDCAVGCPGYPTDSCGDASKGLYAYIQMSLHNPSGTAAAPSSTDSTKSTVSSLCLELRPHATHLLPTGPISH

SEQ ID NO: 40366 - protein, 77 aa, A.fumigatus
HCLSAAKVSSHVIIPHALDPPKSGESSDDFGLAGKYICMPSAKFGLWTLTNCTFSVSERSKVTVKTRRYVVASLLWA

SEQ ID NO: 40367 - protein, 65 aa, A.fumigatus
FLTFNKHLSLEYKFTSLIHQLLSTIEYMYLIGLASISTVIVLVLPVVVFNPQLDHHIIASLRLSA

SEQ ID NO: 40368 - protein, 74 aa, A.fumigatus
LGDLHCVGSVILNLSGILLSFYKLHFICNKCTTLSIHTKKFQVICNFSFNYSLLITTIANMTELAPLSLCFFAE

SEQ ID NO: 40369 - protein, 333 aa, A.fumigatus
SVCWRVCTDCKFAGSRDHLPTISFFTKDGSGYTSRNSTVSSPTPLVSPTTMYPSQPSPYSYQPSAASAPPQPGYISPPESRRALEEEKEKQLQPQRQSLPSIHEALRNDSPLPYPAPPTSGPLPQAHPHPPHALVGRSAGDGPAGPPNPFSNGAPAGPYTREPAYSQLQTEASRSSLASITTQESRNPSLQSLNSSKSPTHSAKTGLTSIAGSQTGSGYEYSAPTSAGSIASPNGYTAYSQPFTFQSQPPPNAPTYPLAHHDTRPYAATPWKPGAPEPPRVEELKNGLAGRPAVPVQPQGDSAKRHLDIYEVETSLNEVCILITRTMFIGVVR

SEQ ID NO: 40370 - protein, 76 aa, A.fumigatus
  UNSURE (20),(24): Identity of amino acid sequences at the above locations are unknown.
PSIVIENRPSRFVATVATSXKLQXWRRGPDGARTLCNACGLHYAKLTRKMGASKAASLGSNLKPKAALDPTPPGTR

SEQ ID NO: 40371 - protein, 161 aa, A.fumigatus
  UNSURE (49),(106): Identity of amino acid sequences at the above locations are unknown.
IVELSTRTLDFSRHYATRAHHTQRSGPMLGTLPPLHEIEDMIHLQHRNXDALMRLPNAVLNQEHALAEHMAQRKAFNAGRVHDSEHMAMYQEKFKGRGGFAGPNTXKTKRGNSTLFLAIFLHLCFGSGTILCSSLGLFHYFPERHFPRLGKDFIHANQASL

SEQ ID NO: 40372 - protein, 128 aa, A.fumigatus
VSSFRTTSPRTTPTMVTRSQQLTPDDESQDSDASSSVSEIFSDGESDSDSNSDLELDSEDSDNEDDSPEDFSNDDGQLPPEYYLEQAESLDISQLRQKRYSDGTQEKLDETREYWNRLVPILTLNICQ

SEQ ID NO: 40373 - protein, 69 aa, A.fumigatus
IVREGAKYWKIGATTLGTQGIHCNGLKNQTALNCLSILNNFILLDASRNIYTGSILLTPLSRNNQITVD

SEQ ID NO: 40374 - protein, 75 aa, A.fumigatus
PWCKILNISIYVGNGLEQNKLPFGQHERVCLYRSVPDYDSIISLEASGDQIERLPNIRDEHGRTLVMGKVLVFYL

SEQ ID NO: 40375 - protein, 242 aa, A.fumigatus
RFKTLSRFSRFSSILTVETFAGPSIPSIPPTSVAPLPTSDPLPSNNIYYPPDAGLEFDQAIQGHGSMDPSMSPSVPITDNVGSQVMASLPSVDKSPGPDSGPSSYPTPSTHHVNTPAAGGPLIPPSACCSPQVYQAVSTPQSVSTPYAKSAATPVGLSMPGSDAGASSYPTPSTNYANSPRLDEPQQQARDQPIVGLLQSCTFTNKNVRLNNNQIEEIIEVGASLLPREPFEILLPVLEQRG

SEQ ID NO: 40376 - protein, 94 aa, A.fumigatus
FQLLLALTIQNPKAVKLFWAIQHRSVCRNSLKALNVEEHTEQAYVRTKDQSWIKDNFRNLKLVPIRYAQFASLLRYPKGKIRAPTQPSFQGTSS

SEQ ID NO: 40377 - protein, 216 aa, A.fumigatus
SHGSQDLYPTMLTNQFRFSSNAVTVTQVVANLGALSGGTLCGWASQIFGRRFSIIVISIVGGALLYPYTFVHDKSVMAAAFFEQFCVQGAWGVIPIHLMELSPGSIRTFAVGTAYQLGNLVSSASSTIESTIGERFPLPPTEKVKHRYDYGKVICIFMGCVYAYVIIVTFFGPEKLGRQFDVAHDRDMEIVTAHRGAVEEDPEKATAAHITRTKCF

SEQ ID NO: 40378 - protein, 175 aa, A.fumigatus
SAHSACRALFGIAMGGLYGNAAATALEDCPMEARGIVSGLLQQGYAFGYLLATAFARALVDTTPHGWRPFYWFAACPPVLIIAFRLCLPETEAFRQRQAIRAEVRGGVTSTFFEEGKVALKRHWLLLIYLVLLMAGFNFMVRINRLRTANPIQPRRIQLTWSNSPTALRTSIPPC

SEQ ID NO: 40379 - protein, 92 aa, A.fumigatus
LVQVAFFGWTWDAFDFFTVSLTTSQLAKQFDKSISDITWGITLVLMLRSVGSITFGIASDRWGRKWPFVVNNILFIVLELGTAFCQTYKQFL

SEQ ID NO: 40380 - protein, 102 aa, A.fumigatus
KKDMPDGGLSPTSQEEQTTENTNFEHITRKGHHYGKSLITTERGQGWVYNEAIYGNHGESHNPFMNNGLILTASADNVNTVDIILEQYKHDSSHNSIRRFPP

SEQ ID NO: 40381 - protein, 74 aa, A.fumigatus
RFACNRLVRTRDTLSNGFLQWKISISRASDLHIGFTMATVENGHASDGIVKSVELRSRPRKTNPFRWTFGLVVR

SEQ ID NO: 40382 - protein, 69 aa, A.fumigatus
HICTVHRSPGLRPWTVVIPIWTVIRYHLHCRFAFTISNIGHWLLLNNPFSDQKDKYKRKDDEQRNKLPL

SEQ ID NO: 40383 - protein, 817 aa, A.fumigatus
  UNSURE (628): Identity of amino acid sequences at the above locations are unknown.
RKVLSSMDQQTQSAVASAEKSLVFESTMTTTATVGPVTHPTLSPAEQTAQAREKIASDLQTWQRRFATAVEKGSEDLEERVEEIVESYIRSGVNSHGESLITALETVVQDEISSVKLRINELAESLPGEEAPEQEGKVQDELLKEIRRAAISVRDRAHAVREWRNSFDQELTRRTSAAVNSTLDVLDSVRDLGLQEIGMRWAWMEGVTYKDWAKYHALKAQFEDWKNDIFNVGMQHVKVEEAKELANDILDRGMEVAEDAAKELARLKDVGRWKIAAREASDDFETRIGDPPPLPKRSKTDEESKSAEANIADTENHQSMEGSEQATSGTVLDSEGTAAHGKGDSENDLCFDDDIPLTHDKLSVSHDDSLPKHSRASDVSSAADGFSPASVPEADPSESVEPVKMALGVAAAESVPKQDASEHHVFPEQLHELVSQADDQFAKVTSAAGQAWSDGSVASLAHQVASSITSMAADVTPLAYISSVASSKLSEGLSLASAQLDRVRATATPTTAVEQNRILLDAQRRYYEAVGMAHDHYSAFVSSASRAVYGAPTPTGHLEQMASKASENWESLVSAASEHFYGSRSHYTPPALSDLVLQYEAIEQLVSELIVGKEPSFTEKALSRLHAXYETPYPVSALSAASSYVIGEHTATASAPFGSDTNVPSVENILHNANEQFQSAINAVSVQLYGTTKGPFEKATSSASSAMSAASAHISEAVYGTEPGYLEAAQEALEHAYASAESAIRNAVFQSASPTEAEQGAFASATSKLAEAVEGAQGQLANLASSASSLASAAVETVTSKVEVLTSDDDTPVKDEL

SEQ ID NO: 40384 - protein, 167 aa, A.fumigatus
KAAKTLAARQCFLPLTHAHNRLLSAFPSSCSCKWTFNRPRSLKPYFFLACPTLAIEFYLERLGRPSYNPADGSLRSPGEDLGASGLTEYMWDVLYWTWGCMGAACLFGDRAWWLWIVIPIYSVWLAYTTFTGMKSGLAGMGGADTPVAESKRQKKMEKRGGQRMQYR

SEQ ID NO: 40385 - protein, 477 aa, A.fumigatus
ESSDRRWKQHYSSMDFSQGHHHQYAGPTNFPDLMNDSAFAMNNKGKERDFEEPDTCRICRGEGTLEEPLFYPCKCSGSIKFVHQPCLVEWLSHSQKKHCELCKTPFRFTKLYDPNMPRNLPAPLFLKQLFIHSFRTVVTWLRFILVAFVWLGWLPWSMRAIWRALFWLADGHWSGGDASQQLQARQSAGNETTSLAAGVTTSVLQTPSAVLSNTTNSSSFYAPVSSMFTFPSGDPLLLTVAKKVISALFSSAIPSGNGSSNSRPLNVTTGLYKHRHPSWLSDVKLLNSLTSSPTINNIIIDTLEGQLITLLVVLSFILVFLIREWVVQQQPMANIADGEREAAVQMIANNRPNRNDDRPRPEPGAPVHRADVLGDEGEHMAEHGIGGDDVGIHDIHFLRPTRRRSLQGGESADLPAAESVETAGFATFPENDSDSDNGANADHLARRSPTRANQGGWAGVRLSETSGPAAMVTRSRF

SEQ ID NO: 40386 - protein, 83 aa, A.fumigatus
LHVPYGQINAFSRMLIGEGTWAPIQMVEKLSSVTANDIRLYFPELLGKMHIEILIHSNLCKEDALNITKLVDSTLLPCRLPES

SEQ ID NO: 40387 - protein, 111 aa, A.fumigatus
FTMKAHLLALASVIPSALGCLHYVGQIYLAPGGPQLQTAWIIDDGTLVCDAAWGQSRTMAGYKINCKNGYSLEVGADGGQAWYGTPHGNFRWTQGYDRSDNFIVWDNWRYC

SEQ ID NO: 40388 - protein, 76 aa, A.fumigatus
LTGFQPQFSSTTANEEGSQPWKMMQEIQNLFKPEMAAALEANAESNEMDEESLELELARLQFNPARPNIVNAEEQY

SEQ ID NO: 40389 - protein, 111 aa, A.fumigatus
SISRVLIVEEPAGGNVKGAAFNLPVDINRDTSACPACYFFSKAIRYPREDTVEGLRVEIVRIGIGMGKHTFTLSVLVVICHSDSKTDPAPGETSTVSFDWEVAKGPGNILV

SEQ ID NO: 40390 - protein, 137 aa, A.fumigatus
DKVFENKTVASTMTYTDTSLVYTSLFVCPEVWSTSSYYYEHGNNSTTSCQNRNLAQAIKDLSHNFTYSLLSLNGGNTTVDMTDLTCRNYYSYGSTALLGVYLSALAVMIACVVVGFLALRRNGVSYNNSFSGVLLTT

SEQ ID NO: 40391 - protein, 66 aa, A.fumigatus
CLAVFDRPKASIYTEDLSRALRVSARLRTGTVGINKSFSPEVETPFGGVTLVVQDVGQEEWVYGIS

SEQ ID NO: 40392 - protein, 388 aa, A.fumigatus
  UNSURE (19),(357): Identity of amino acid sequences at the above locations are unknown.
VSMPQMGLRAPNGNKTRTXEVITLGRFISEIVNLRDDQGDTALNLAGRARSVLVPQLLEVGADPHIPNHTGLCPADYGVGVDMVDPNAQSQQGGSKNDSFIDHLAKTKKEIFDGAGPLQKAIDQDILTTFKATMAQISAIVQETLGGIDKELATDLSKKQEKFEHWHSKIRETAKARQIEQKRLDDLKSKSSNRVELSRRIKNLERSSEDLLVTLKEIHGGNFEPSKMTIVGDADQDSGVDMTEFDALFPETFDPTSGFSEKQEAFLKSLTSPEILQQRIKCYQDFNQEILAEVDRLKSKNVVLGQNYRRMVMACTGWTGEQVDEPARRLTPCVKDLNDHPVPEDEAIDNLMKDLRXEWVPVTGPNNFSCFCATSRHLPGIGPIPPPG

SEQ ID NO: 40393 - protein, 474 aa, A.fumigatus
QFFLFKAVYSNVSVYEMEVNGVAVMKRRSDSWLNATQILKVAGVVKARRTKTLEKEIAAGEHEKVQGGYGKYQGTWVNYQRGVELCREYHVEELLRPLLEYDMGPNGTANAGNDTLDTPTKEQAMAAQRKRLYSGVDNRGMSQPQQGTFFQNISRTAATAVNAISKARFDSPAARNADSRRSSIMRKSSHQIGSQESQLPTFSSQQSMYSVASDSGFGSNAQSNGRFNGPDVATFETEESIEPPRKRIRSSSNQMPSFGLQREHSSLSMQEPTPTEPNDSFYQEMDGPASMADGNRHGTDPLPPATTPERFQKMKLIMTLFLDKRTKDFSNHPALLQLTGEDLEIPLDEYRNNALHWAAMLARMPLVYALVEKGVSIYRLNGAGETALQKSVGTRNNLDYRSFPRLLQVLAPTIDMVDYSGRTILHHIAVMAATGGGGHVSAKHYLEALLEFIVRHGGTSISQHAPNGVEGTQW

SEQ ID NO: 40394 - protein, 121 aa, A.fumigatus
IDSDDERLNYIEWNCDQVRRRIRSFIESGEMKIGEFQNAIGVSSRSYLDFMGQHGRDKGSGSSTYINAARFFKKRELQGIKPLRKKRAAKESQKNVAEKYDVSSIHLDGESDPELPGWGHL

SEQ ID NO: 40395 - protein, 106 aa, A.fumigatus
LAAWEQHRAGGDDQGAVSACSGKGGPHGANGGAVCGAGAGVIGEVVVEGEVDDGVAFGGGFLEDIQLFNGTAYGLGALVFKLFDSTLTASQAEDFMSRREEFFDDG

SEQ ID NO: 40396 - protein, 77 aa, A.fumigatus
RLRGSFRKTSETLSVVSVFMSLFSPLKSDKLDHYVPEDTEINSLESQIVRKRQAKTTMASGRKTPLQPSLKVVQRTL

SEQ ID NO: 40397 - protein, 187 aa, A.fumigatus
MAIGILLETAAFLGASWSNKIWQLYLSQGVCFGWGLGLQYLSTTYLIPQWFSRKRSLAAGIATGGSGTGGLIYSLATHAMLARFSIGWSYRILAICQLVVNSFCLLVIRDRSAQDHSSSRTLKINFSLCARYEMWLYIGWSFLSVMGFMVIWFSLATYGRSVGLTSTQGAVVTAVMNIGHMFGMPAV

SEQ ID NO: 40398 - protein, 320 aa, A.fumigatus
KPSCHIQIPSVFHFIMRVFVTGSTGFVGSAVVKELLSAGHKVLGLTRSESGVEQLENQGAEAIRGTIEQLDILKKAASECDAVIHLAFNHDFTDYAGSCATDRAAISAMGSSLAAAGGDRALVITSGTMLLPRGKLGDEDDAPDMTHPMAAARGASEKVCLDFAKQGVRASVVRLPRTTHGLGFSRFTGSFVSVALQKGVAAYLGDGQNRWCAGHRDDAARLFRLAAEKATPGSVFHAVGEESVPTKEIAIAVGKKLEIPVVSIPPEKAEEHFGWFWFGVAADNVASSAKTRERLGWTPEGATLMEDIPAIVDFIKSQAV

SEQ ID NO: 40399 - protein, 388 aa, A.fumigatus
VKCGSCQARGEDKFDGEKCVTTSLEQPLCETSLELRDGYCISEETPICDVGVWNGQYCLFDETPHCPSPTRFNGVECVSTQPPTCPPGSHVHANQCRGDKPASCPPPLRLVKDHCVDATPPECPTGFTLVGTVCRSVKPPHCPDGQMYYNGNCIIPTIPQCPDGFPPVGDKCLADVQPECPPGFRVEGKNCVSTENPECPPGLDRVGADCVHRGSPSCAPGTVPDGNRCISLVPPQCPDGLVPRGSECVANDNPECPPGFRFLDNHCVSENKPQCPPGSTLVGEECVVEKAPDCPPGTEFHSGMCVSTKRPECPPGLELKNNKCVRTSEPECPRGQKFNGSFCASTDDPQCPEGTSYDGARCSVNANLSCYELQYCPPTAPSRNVLVK

SEQ ID NO: 40400 - protein, 208 aa, A.fumigatus
  UNSURE (53),(125): Identity of amino acid sequences at the above locations are unknown.
VEGVNAFDYMVLARMIHFFVPDRRIGIFKPSMLAMIFVVLDLGSFVIQLTGGXMAGAGADHDTMMKGIHIYMGGIGIQEFFIVLFLFIAIQFHRQMLHLNRHGRLVGPKAKWRSLLYALYASLLXITVRIIFRLVEFSSGNDASNPILQHEWYMYVFDAVPMWFAIVVWNVVHPGAIIKGPDAKMPPSPPAQDIMLRFLLFRLQKEEE

SEQ ID NO: 40401 - protein, 76 aa, A.fumigatus
CPAHVRGKLTTCRCVDFTIPLGQVDYDSPVTMVTEQWPVTINIIARRGCDFMLFNMIKQLAEEGVLRSVTTGRTAL

SEQ ID NO: 40402 - protein, 175 aa, A.fumigatus
FEPADIHGTGGIRPHPGSHLECHRRGVCRSQGRSSVDPGGSDAGGKSEPVLFLTIANTSQSSGNVYVGCTNNGVQNCGLMQAYAGSVSFNPNDPQGSITQMIIDGTQGTAQGGGLVQWFNNENVGANTGGNPYNVLRGYNSGSINFNDLDDPQGATASYVSDVANRLQVSSVCQN

SEQ ID NO: 40403 - protein, 641 aa, A.fumigatus
GPTTVFRNRQVGSYEERPFNMNPWKSVFVKCLFFCTAVSGISNREIPMTDVQPSAQGITYELGNVTYFANIEHPRAIFDLDYTTTSRLVPSAVLLVNQSLVTGSYLKSTISSYLTDDDVFSADFLHAIYFTSTVPRSRLDSTAEEYLRSLGVAGLLFNASSFDRIPSNGYALKEDHDAPLPPGPFTILVNNGSISFLDTYRLYVDNFRTFVTGVYSSNDGVGSFAALPAMNPRLGGPLIPAPSRIHSWNDDRPLAGKRVAVKDLFDIKGLQTSAGSQAWIHVTPIADSTAPAIQRLIDLGAVIVGKSKLAQFASAADPWNWTDEQAPFNPRGDGYLTCSASSSGGGCGIAAYNWFDAAIGTDTGSSMRRPASVSGTFGNRPSQGMMSLEGAVPLNAGEDTVGVFSRDPVEWAEFAKAWYTPSLHQDPSINSLPPLSVPDTTAFPKRILYPVEYLPLANPAAQAILEKFLHGMIRVFNMTIERTNFTATASNASIYPGAAGDAMVNWNLLYDAGATLQLWTQSTKVYGPLISTWAARNDGRFPPVDAQWREAWTRYDASHITQSGYEQALHTKAAAVNWFQEEVLYETSDSCSEAVMICDGGTGGLPSFREQALNNSPNATFMSVFPEHADVSCSGICTLFG

SEQ ID NO: 40404 - protein, 213 aa, A.fumigatus
  UNSURE (10): Identity of amino acid sequences at the above locations are unknown.
CPRTWRSAVXNIGGSATLFLYGGCVWTFFNHNGGCNGDCQANAVRILSSAGSVYLYGTNVKAISNIVLENTAAAAKESDNSGGWGGVVAAYLHNVGSGSRTRRSSNANGAAVTGNGLNWYSSSLTSGASGYQDPEYYYCFRGSAANFPPIQNWMGFTAMFDLNQQTSMALVESGPIQGAIWNAIVEVSAAAKVDPRLILAVVMQEVSPSLYSF

SEQ ID NO: 40405 - protein, 91 aa, A.fumigatus
RRCASICHDWKDGFVARSKDSVFILTTNEDNDLILGYKRNRRTRQYLELMTCIVCSYFLERNERRQMTESLTQNASYQKDNKPNTRHRDAD

SEQ ID NO: 40406 - protein, 133 aa, A.fumigatus
GGGGTRYLPAPALRLRSVDETDTKLSREPRRIRTISESRPTGSLISRKSRGGGGGERERPRPKPIRESRGSKSRSRRGQSRSISRRKGGGPSRGSRKSRSRSLSRSRGSRSRSRNSARPGKPRPRPPKGAPRG

SEQ ID NO: 40407 - protein, 307 aa, A.fumigatus
CGQRAYRHPETGEKTTIFLGYTSNLISSGLRDTIRYLVRHRHVSAIVTTAGGVEEDLIKCLAPTYMGSFSTPGAGLRAKGLNRIGNLIVPNSNYCAFEDWLIPILDKMLEEQEEAKKKALRTGDEEDELHWTPSRVIERLGREIDNEDSVLYWAARNNIPIFCPALTDGSLGDMLYFHTYRSSPQRLRVDIVDDVRRINTMAVRAARAGMIILGGGVIKHHIANACLMRNGAEHAVYINTAQEFDGSDAGARPDEAVSWGKIKADANAVKVYAEATVVFPMIVGRLFCPVQPNSIGRRLGQPQLRRQ

SEQ ID NO: 40408 - protein, 86 aa, A.fumigatus
LSISSSKMTNYHSGSAEALPPSSATNAVLVASEPVPKGSHEVRGVDFDRFQGRDITVAELVDNMVHMGFQGSAVAEATRIINDMVK

SEQ ID NO: 40409 - protein, 208 aa, A.fumigatus
  UNSURE (204): Identity of amino acid sequences at the above locations are unknown.
VFRRVSVVRGRSEMEMLTVADDYWEKNFHPDLDDPEYRPVEKGRLTWKIKGVRGTKDAPNRSKIMRSPPAYIGGYWWTIKFFPRGNNVGSLSIYIECSPTLPQPDKTLPETEIKVMRGPADSGLNNAAPELDMKFARTEDTASWHEQFTAQYPAAAASRQDPPKDTWRVSAQIGVILYNPDEPRTGWMQSSCDQFNPFSQRRSXDSSN

SEQ ID NO: 40410 - protein, 139 aa, A.fumigatus
IRILPSSAMDTRMDTAVTVEQLPPAVTLSVDAPSSETVTVGTELPEPTSENNVTEIPENTPLDNVHPQSHEPSDPIPAPQPPQPELEHAYWAEIEEDTSVPDEAEMKEIESTADGDYSAYECRSFVEFLWFEDEARWRC

SEQ ID NO: 40411 - protein, 213 aa, A.fumigatus
KSPTGFCTSSHLTCCRLPARLPSFNLFSYDLVMSSRYPPSSGFNSRDRSPQRFGDRRPPAGPRGSDDASLAPLGREPPRGPKALIDHPRGAPFGGRGRGFPGRAEFRDRDRDPRDRDRERDRDFRDPRDGPPPFRRDIDRDWPRRERDFDPRDSRIGFGRGRSRSPPPPPRDFRDMREPVGRDSDIVRMRRGSRDSLVSVSSTLRSLNAGAGR

SEQ ID NO: 40412 - protein, 109 aa, A.fumigatus
CWGAVYIAMTMFHGRYAARPRERTSRFQIGDKDQKAMGFLCRSRCSTQSCKIINFLFFFSESAGEKYYIGVNVLDSTLSLQSKHMQAYSTSFAENIYTPRALDFYPHAV

SEQ ID NO: 40413 - protein, 191 aa, A.fumigatus
IESGRAAFKVNLKMAAARRMFGGRNCRGPQPMRRPVIPIACRRKLFRPVCRASVQPHRIPPVVSFNCSLPPSTLLPSTHLPAIIAIDSLIMSLSSASSTLLRACARQQLPTTRAAVASCQQRRGLSEASKSSSFDSPFGNSHEYQSTLKIPSFSKYASNKPPRSNQVFSYFMAGALGLGSAVGAKATVQGR

SEQ ID NO: 40414 - protein, 71 aa, A.fumigatus
TVTDSELLHREGVCTHLGCVPIGESGDFGGWFCPCHGSHYDISGRIRKGPAPLNLEVPQYSFPDESTLVIG

SEQ ID NO: 40415 - protein, 106 aa, A.fumigatus
RMTATAVSRIDNLEFLADVIPKTTTYKQFKEKKEKEANKDAAFEKGQRTLNGTMPSMIKENGEGGQQKADKPSISPRAPSLSTLMADRTVEAQTGENDRDVEMVDQ

SEQ ID NO: 40416 - protein, 81 aa, A.fumigatus
  UNSURE (44),(75): Identity of amino acid sequences at the above locations are unknown.
KSLRNTIAGDSAIGVIWYHVEQVADMQFFLQNFFVNMSASADVXAQAKVEIGLDSIPEGKNVRVPFIRQASRTLXYSENPY

SEQ ID NO: 40417 - protein, 121 aa, A.fumigatus
PTNPQVIIKWRGKPVFIRHRTQDEIQEAQQIDWKTLRDPQPDEDRVQKPEWLVMLGMSSRHLILLYAFERLLIANCSIVKVSALTLAVSPLVNPVTSAAGSAPATVPTMISPAVSGRVLPL

SEQ ID NO: 40418 - protein, 320 aa, A.fumigatus
LFGRTEERLREARQRVREAKNAYAAAINRRSASQREVNELLQRKHAWSAADLERFTHLYRNDHTNEVAEMETQEALSAAERESEEAAAQLSKSILSRYHEEQVWSDKIRRMSTWGTWGLMGVNVLLFLVFQIAVEPWRRKRLVKGFEEKVIEAIEKEKAINHIEILKPQPALTSTSPSSKEEAAEPTPTSTAAGDTPTTDESTPAATDETITSEPVVWDSDPIPTFVTNITAEIATETTEDSAPKSATINGVEPRKSQLSRILPPLPPPTSLDSWRHTLNELFSDRSMVITQRDLTTVALQSAAAGAAIMGLVIALIRPR

SEQ ID NO: 40419 - protein, 192 aa, A.fumigatus
TAPQHHVHADYALTAKENCGMSSMPGSSTAPRSPSVLSERRSWRLSGLSVTSPVDPSPPDDNGHPNAITDEIREIKRYEDFTTIDWVQDAIQEQARRRAKRRDGSGFWDQEGTFGWRRKVSESYHAGQAWLVITIVGAAIGLISAVLNIITEWLSDIKLGHCTTAFYLNEQFCCWGAEGGMHIAYALYSWWS

SEQ ID NO: 40420 - protein, 159 aa, A.fumigatus
  UNSURE (22): Identity of amino acid sequences at the above locations are unknown.
GGFQAYLAPINKLFSVGFKVGXCTADSIINLALCCLGYVPGLLHAWYIILKYPEPDYDDPNYEPIPGHAGRRQDTESGRVTYYYVSHQPIQHPSQRSYGTVTPQNQPAPSPAPKPQQQAPKPHHEEGQGGSSDHAQGDSRPPPTYAEAVKGDHKVQTHD

SEQ ID NO: 40421 - protein, 192 aa, A.fumigatus
LAMQPMPLLLRQSLRSSANFARTSLPIRPQFLPAAGPNLQPAQEIQRSFSVCVRCQFRSQSPLYSSPEKDTSKDDAATQQSKDGSSTLTPGDESAKVEPDAETQRPSPAAGEQDTLQGFYQDAKNEPKRESAEKKGLPSYLEERRSQLSKQFTEMMDNLQSNIFVAGQRLNDLTGYSAIEALKKDIQLQGGF

SEQ ID NO: 40422 - protein, 245 aa, A.fumigatus
IFDPQSVLMNSPGGRNPEFFQSLSGLFTSRSERRRSITSTTVNTDRAVEQFPRQSQNRRISILRRLAGPRENAKRFLRLGAPPSNCSPSPPLTNTASATATHLMSRTVRPRPVSEIIVSPHDAQILVSAAAARRMRSDSSSTVSMSLGPASGQDTPSASDATASFPALRHEKIVATGSGIAVGIALTEPVLFLQGYDQNDPSTKKSAILRGQLHLKITKSVKVKKISICFRGHAQTDWPDGMFSS

SEQ ID NO: 40423 - protein, 114 aa, A.fumigatus
FSFTGSRFVRFSNVFVVFPCYQRLGNSIRPHTKHLFLIKGDDNTFANFPDRLRAVVARALPAIKVTTVVYPKYETRGGLKECVGKFREWYVYVEMTGLDCSLFICDLADTTLLE

SEQ ID NO: 40424 - protein, 84 aa, A.fumigatus
NSFLGIPPKKIHFHDKKDLVTHGVIYFNHGDTALMQNDYGAHFYQHTKPVTSVTGKDGSTTTTRELFSKSGSSPSLNQSTAKEL

SEQ ID NO: 40425 - protein, 277 aa, A.fumigatus
RLSLQANHAYSRSFGKNEMPSSNQSHHQRNYRMFPIGDYLYNFEFPIDGSLPETIKTDLGFVRYDLEAIVERAGAFRPNLMGTLEVPVIRTPAEGSLEQVEPIAISRNWEDQLHYDIVISGKSFPLGSQVPIAFKLTPLAKVECHRIKVYVTENIQHWTADKSVHRLQPAKKVLLFEKRADSASVSTYPGSSMRVTAGGGIDWDHRAAAARGEEIVDRNRTNLLGNLANDSGVGPTEMEFNVQLPSCHEMKNRDESQRLHFDTTYENIQINHWIKVR

SEQ ID NO: 40426 - protein, 216 aa, A.fumigatus
IVLRLSRLDERDPNKRRHFEISIDSPFHLLSCKATQANIYLPAYTTPSSEPGLPAQEYECGCPGAAMVNRNSSSSQLLVSDREDAPNGGTVSRSFTNGSGGLARPPQAHLAHEANERFPRPMHLLRAPSFAPPAFEDVPPPPPLITPPPEYNSIVGNNDRDAVLQDYFSRLSFYEEGDGDERGRGRVDVPLTPGGRVNRSMDVPREWVRLGEPAVQ

SEQ ID NO: 40427 - protein, 86 aa, A.fumigatus
LGDDQVYLLERGSRPDDIDNDVDVCTIAVPNGCQQLLHKFAIVRQLLLDAISRNLTTFVGILVDDAISAVEGAFGTWGTGRVCTAL

SEQ ID NO: 40428 - protein, 99 aa, A.fumigatus
VPDHESLFRIALSPASGDDSRGPPFGSLTTGDASADTPSGSFASGDEFPDTPSGSFASGDEFPDMPSGSFASGDEFPDMPSGSLFGSQTLISRPSASLV

SEQ ID NO: 40429 - protein, 70 aa, A.fumigatus
HWVVIKCGISSCAEYLNAGCSRSGLLVDHPVTCSSVDAEVSCNYSFKVAKEEFTDRWWKIKSTAKFQSVN

SEQ ID NO: 40430 - protein, 198 aa, A.fumigatus
IHHSDMLLSLLVLKCSANSTGAPCSECALHGRDCIVDEYADKRRKVARDRIQEELAYYREFVQQLLAAIRHGNCTDVDVIINVIRSGASLEKIHLIVAQSLSHTNEADGLEIRVCDPNKEPDGISGNSSPDAKEPDGISGNSSPDAKEPDGVSGNSSPDAKEPDGVSAEASPVVNEPNGGPLESSPDAGLSAILNNDS

SEQ ID NO: 40431 - protein, 193 aa, A.fumigatus
VLYMRNRGLATQENFAMKGEPLRTHFLVYKYSETTSERWYAASRWVSSMESGPPRLESVQARLGQCLYLLSSSRANECWYTFGTALQLVTALGLHRKWPAKMSKHGNSYLEQQLRKRIFWSAYTLDKYLSVMFGRPRLLHDEDTDQELPDEINDEDISEEDPRRRTGSPDSMMIASVLHYRFVNRFYAISSCN

SEQ ID NO: 40432 - protein, 88 aa, A.fumigatus
VIPTRPMALRSGSAIRTRSRMAYLGTRLPMRKSRMAYLGTRLPMRKSRMAYLGTRLPMRKSRMAYLRKRLPLSTSQMVGLWNRPPMLG

SEQ ID NO: 40433 - protein, 71 aa, A.fumigatus
AAGIEVFSATRYPAFNYNPMSPAPVFSFFNWHGGFFTALATGSGGVPSSSQVTNPARLQTLTKALRLRKRR

SEQ ID NO: 40434 - protein, 326 aa, A.fumigatus
KTDLCRVPVSLSGPMRASLMDGVHTHLSPGNGTVVGMSTDGAYLAGRKRKASDSSSPATKGPVQRQKITRACDYCKEKKTRCTGTLPCMRCTRLALRCEYNAAYSRGLPPAPLPAPPSSSLLVNYADEDHARGDTRTARRSVSQRSSRESPRTGVGLRSQHGRAGSEASLRDSPEPVVTDFEGNYLGPASGVSFLKRVWSRLHQDESSAIPGELQDENVSRNTSVFKFGDKPYSNYQEAGFTLPSFEKARELVGIYFDFSIVTYRFLHRGSVEEWLKQVYADNICFANPPTGVMVARTAIILMIFAVSTLYEEQRPGDPGEFRNER

SEQ ID NO: 40435 - protein, 389 aa, A.fumigatus
SLLRDTLCMLTGSDSLQPQRIRVRTDENAPVALPGNKTIHHRNKSTPALSAAFQNGTTRNGLRRAAFGDVSNTANLVKGSRDDASLAGKKQVKVVEKAPAVVPARRTTILSQPAQRPMSMTSLKGLVNNASNLKALEPSAKQMGITQHAQNTRKPLNKRNTVFKDTLEPLAETKESASKEHVTEVTDDNEGTTTSLPATGQGITKDDARLIQDSKIQSDDTEEYSIVNSDDIDRANRDLYKADDDNCKVQVIEQLHEHCANTSEADDLPKSHRESASSAHLAQSEPEEYWDEEDDENEEDDGYVTARSYRSRGDNTTGGATTILFPKYNSQVRRELALAKQVVEATRTAEDIEDEYWDTSMVAEYSDEIFEYMREQEVCCSISLTDLAS

SEQ ID NO: 40436 - protein, 188 aa, A.fumigatus
IRMLPNAHYMDNQAEIQWSMRSVLMDWLVQVHHRFSLLPETLFLCVNYIDRFLSSKIVSLGKLQLVGATAIFIAAKYEEINCPSVQEIVYMVDGGYTVDEILKAERFMLSMLQFELGWPGPMSFLRKISKADDYDLETRTLAKYFLEVTIMDERFVGSPPSFLAAGAHCLARLMLRKGTWVRSLALSQ

SEQ ID NO: 40437 - protein, 153 aa, A.fumigatus
TPSHVHYAGYTYSQLYPLVSLILECCEIPRKHHSAIFEKYTDKRFKRASLFAEAGIKEGFCLPEVTKEATSNERNSHYEPAHHLETSLSCVHSLIYEPLYLSTYSKPGNSLTSISAFQRAFFSLLSSLEPNVPNPQLAISCSYNDIITWMTIS

SEQ ID NO: 40438 - protein, 74 aa, A.fumigatus
HDGPISACCRFVDGWLRLRGWARIGVLVSRLRLMLDEIIAARIDNPGFSPASNDVGDRVIEIVKKLVEFNGLDQ

SEQ ID NO: 40439 - protein, 187 aa, A.fumigatus
GIDEVVMIYYVYEQWAMDMIPRHPPSFIRKSTSIGHPSPAAMTIPDRSHGRPRRAPPEAWAPPASSLPAGGQGWERWSAEQSAVAVAARQRRPAPGTAAGRGCGSAPLRRKSSCASPARRRRPRSGSRMSSGRWARRRRRARCAGTGAPALPRPIYATPGRRPACGRADRVRRGWRWGTNAGRGSWA

SEQ ID NO: 40440 - protein, 105 aa, A.fumigatus
DLFGIFSCAFCSIEIPASSSLSLALKHCDSNFHPGYTRHSSVDSSPRPLSSIISRSLHYKTKLSVLIMSDLQGRKVFKVFNQDFIVDERYNVTNELGQGAYRIVW

SEQ ID NO: 40441 - protein, 123 aa, A.fumigatus
FYAELMECDLAAIIRSGQPLTDAHFQSFIYQILCGLKYIHSANVLHRDLKPGNLLVNADCELKICDFGLARGFSIDPEENAGYMTEYVATRWYRAPEIMLSFQSYTKASMSYLILVAIRAPIC

SEQ ID NO: 40442 - protein, 483 aa, A.fumigatus
IIMQRLHSFSQLRHASPLKLFALAAAFILVSASLVFYSRPASPSDVDLLPSQPSTGNEIENKGTCYVDLDFLRSQGYNETAKYARLEIAVRRTANFTGFSDTLPTRFPAYQKIRLDTADHEAPLSPETCSPAVTIQAPLPVAPPNASHILFGVATTLRRLDDSLPAFAHWAAGTNARIYASVDSDTGSPIRRVEQRAKELDVRLTIIQSDEERLDQYFSLLRVLLKHRDASTQWAVLIDDDTFFPSMRNLVDRLATYDATKPQYVGAVTEDLAQVFSWSYMAFGGAGIFLSIPLLEQLDKVYDDCNSFKTTGDRRVARCIYSHTHTKLTWDRDLYQLDLRGDASGFYESGRPLPLSVHHWKSWFQADMVGLGQVAAVCGDDCQLHRWRLKDNWFLVNGFSMIKYTSARNVDLMEKTWEDSKYRGGDGFAFSLGPFRPKDKGKVSFRLRNATQQAGSVRQVYIHDSGPDEPPEVLEVVWKPTSG

SEQ ID NO: 40443 - protein, 223 aa, A.fumigatus
SADMLTTIVDVWSVGCILAELLGGRPFFKGRDYVDQLNQILHYLGTPNEETLSRIGSPRAQEYVRNLPFMPKIPFQRLFPNANPDALDLLDRMLAFDPASRISVEEALEHPYLHIWHDASDEPTCPTTFDFHFEVVDDVQEMRKMIYDEVVRFRNLVRQQSQAQAAAAAQQQQQQIAQQTNVPIPDHQQGGWKQEEPKPQEVHAAGGHVNDLESSLQRGMDVQ

SEQ ID NO: 40444 - protein, 76 aa, A.fumigatus
DFFYICPVHLQDRHFCSPIVDSEQAAANAKQEALAREIEIVKKEYEEKQRRKKEKEKEKKADDEPKNSDKKSKKSD

SEQ ID NO: 40445 - protein, 107 aa, A.fumigatus
LINRSSHRLGSLLMDLDALAGIIAYKHAGDSVPTVTAAVDRITIEHPLMEICDLELSGQVTYATGRSSMEVSLQVTRVPAEGEPVKPEDVLITCAFTMVSLDPATKK

SEQ ID NO: 40446 - protein, 78 aa, A.fumigatus
VLSIKMWETSTDIPIRPVPIAPLLVENAEERLLFHKGEENYQAKKALRTRSLLEKAPDAEESNLIHNMWTKEMAYLSE

SEQ ID NO: 40447 - protein, 200 aa, A.fumigatus
VSDNNPFSCSNADANAGTDPESPAQRPDNMVFMSDTVLKSAMIMQPQDRNRHNFMIFGGFLLKQTFELAFCCAASFSHARPNFISLDPSTFENPVPVGSVLYLRATVAHTEPLQRDGTTYTKVQVRVDSKVRDVEHGSKKSTGQFNYTFLVEKDIQVMPRTYGEFMLWTDARRRAQNAAAMVTGSKEPSTLRNIKDSVTE

SEQ ID NO: 40448 - protein, 63 aa, A.fumigatus
WSNFQFAPGSVYFYQDQGPKGVPLACLMSSNQEPAASGLGRLSAFIQDSGLKTHIPTRLLGGP

SEQ ID NO: 40449 - protein, 66 aa, A.fumigatus
LYEHSLFYYRAIDVPDQSAYTMSDPNNPNIEQRSTPQWALYQRENFLKAREGKTVPFNTGMFSLTK

SEQ ID NO: 40450 - protein, 288 aa, A.fumigatus
  UNSURE (180),(237): Identity of amino acid sequences at the above locations are unknown.
KAQPRRLVCPQGRVSMDKPDTKALHRYYASSNAGMSNTHLANRQAFYRHRIVPRQLVDTNLRDTTTEIFGHKVSAPIGFAPIGINKIYHPAAEVAVAKVAHELNLPYCLSTAGSTPIEKVGEANGSGPRFYQLYMPHDEELMLSLLNRAWKSGFDVLVLTTDTWQLGWRHDDVANSNYAXYRGIGADLGLTDPVFQKRCQEAGIDIEKTSWPLRPSGSTPSGMGRAWSWDTIPCLIXKWKVISGGRPVVIKGIQSVPDARKCVQVRGDRNRGNNLAAPQVDGPNVCLV

SEQ ID NO: 40451 - protein, 114 aa, A.fumigatus
GSHLIFLLPLKNLYNSILVLEVTYCSCADAAVMGFIAGCPEAGCTISNQYNYQPDVTFSRTYHSCTPSLLMALPTSVSLSPSSTDRINGPATSASSAPFFFISSAVPPPKPVAR

SEQ ID NO: 40452 - protein, 122 aa, A.fumigatus
FSYLIPRSGLRPWICQLDIHSIGCGSLRRIVSLAATRNLPCTVMTESESLGSPEKGDPTANLSDINNTQRSETGDDEEIKRAKSDQDDAYQEQSTTKVVLLLVSIMMTMFLVALDRTIISTV

SEQ ID NO: 40453 - protein, 105 aa, A.fumigatus
LWTKAIPQITNEFDSLSDVGWYGSAYLLTCCAFQLLFGKIYTFYPVKAVMLSSILLFEVGSVVCGAAPNSTAFIVGRALAGIAAAGIFAGSVSDPVSLKVQVLTV

SEQ ID NO: 40454 - protein, 131 aa, A.fumigatus
VVCIVYAVPLEKRPKIQGLFGAVFGLASIVGPLVGGAFTSHVTWRWCFYINLPCGGLAMAAIPFCLKVPDRNTTKVTWTEKLKQLDVPGMCCLVPGVVCLVLALQWGGQKYDVRLSQRRGCLTPVLTASVE

SEQ ID NO: 40455 - protein, 228 aa, A.fumigatus
LVYFLPIWFQSIKGVSAVDSGLRLLPLMLSMVAASILSGVTTQKVGYYTPLAIIGSCIMAIGAGLLTTLQIHTGHGKWIGYQILYGFGMGMCFQQPNLAAQTVLPTKDVPVGIAVMFFSQLLGAAAFVPVGENVLANQLMMRLSGIPGIDSDIVTSGGATSLLSLVPSDLRGTVLTAYNEALRKVFQIGLIVACLTILGTASFEWVSIRKKSEASSGVGNGHAPKEEQ

SEQ ID NO: 40456 - protein, 247 aa, A.fumigatus
  UNSURE (21): Identity of amino acid sequences at the above locations are unknown.
ADDLQPKSTAPFVPFRVNSQXAKASFTPFRSTSNPTTRSNTPPKTSAPSSEDSTLSSITPVCLLISSVRGIHLNVPGAWFDAQANATMTERQMWAKTWDVNVTGTHLLTSALMPLLLKSPDPRLLFVTSGAARLAGTDDLRLPINRSPPAGWPKPAGMTATAYRSAKTGLSMVLREWGRILKNDGVKIWGIAPGYLATGLGGGTAEEMKKNGAEDADVAGPFIRSVLEGDRDTEVGRAIRREGVQEW

SEQ ID NO: 40457 - protein, 158 aa, A.fumigatus
TTAGDPGMNEKCGLPGNQGDSAAEHPGNCTRTEPDEGRQKKLEDEIGTTIKVAAERQERTAENPHLLPETVKVTGVHASAAAATGPPYCILSERKKIFVILLVSFAAIISPISSSIYFPALNSLAKDLNVSVSLINITITTYLVRHPRIDGKQSTESS

SEQ ID NO: 40458 - protein, 222 aa, A.fumigatus
  UNSURE (119),(120): Identity of amino acid sequences at the above locations are unknown.
IFQGIAPSFIANFADTHGRRPAYLICFTIYLAANIGLAVQDSYASLLVLRCLQSSGSSGTIALGSAVVADLSTRAERGKYIGYASLGVDLGPALGTIMGGLLDHYLGWRAVFWFLVILXXVLGDRHCYHLARNLPRGGGKRLRPCCQVESACMADTAAEPEGSKANANAGLSHHRETASTRQSDRICPDRHRQGSTHHSDLQLALVLRLHGRLEHLDFPAAK

SEQ ID NO: 40459 - protein, 292 aa, A.fumigatus
  UNSURE (1),(2),(275),(288): Identity of amino acid sequences at the above locations are unknown.
XXSSGTVIAIILPETCRAVVGNGSVPAAKWNRPAWQILRQNRRAQRQTPTPDYHTIEKRRRRANPIASALIATDKEALIILIYSSLLFSGYMAVLSTLTSQLQSRFHFNSIQVGLCYLPIGIGSLSSRWTVGRILDWNFRREARRQGLAIEKNRQQDIRHFNIEAARLAVTIPLVYCACLCIVAYGWVMEYKTALAGPVVMLFFMGHLTSGAFSSLSTLIVDLNRQSPATAVAANNLFPCLLGAGSLAAADPVIQHIGIGWTATLIAFLWVLLSXAYVGWISMGAWMXKRTY

SEQ ID NO: 40460 - protein, 162 aa, A.fumigatus
ATHSRHIKLLQLLRPCNLGSIPVRHFETKGDGSHRQAPTREIDIEAPSPCYVRGKRAPNQRAYNRGQTEDGPEKSLDFGTLLERNCIDDAYHLDRQHLHFQGNWITHRSSKDPRGSNTSESSANDESRGVGRSSANDRANFEQQDATQHNCFHGVEGVDLSE

SEQ ID NO: 40461 - protein, 112 aa, A.fumigatus
  UNSURE (60): Identity of amino acid sequences at the above locations are unknown.
SQLNTVASKIVLITGANTGIGFQVVRALCNSTQTYSIIVGGRSPAKVHSAIRAIQSEFTXCQSQFYPLQIDLESDDSIKHASEDISTKFGRLDALVNNAGMSFDLFCPRYTS

SEQ ID NO: 40462 - protein, 105 aa, A.fumigatus
ILVPCLEGDYYLQARCIVHSTRAYMFWIMFTSFVHKHLVMPGLDRQIMYTTCLAEILEYLQSILVEFHTLASIPIRTATVTASIGQPPNNNSLTWHDVIEHMRGM

SEQ ID NO: 40463 - protein, 150 aa, A.fumigatus
RLLSSATSILNRQSSNNLQTRETRRNMSLSSIKGLLSNYSPVSESLDLEKIYHYPLRNASEDLESASGSEANKPIQREGGEKKESKIIDGRTVSDAIIGLSDGLTVPFALTAGLSALGDTKVVVFGGLAELIAGAISMGLGGYLGAKSEE

SEQ ID NO: 40464 - protein, 182 aa, A.fumigatus
  UNSURE (158),(159): Identity of amino acid sequences at the above locations are unknown.
CFTSRESYRATLKETRNKVVADPSATTETISEIFAPYDLPSELVSQLTDHLSASPMLPSFLMNFHHTLPEPSGSRALICALTIALGYFIGGFVPLLPYFFVGPHDAFIALRWSIATMAIALFLFGYGKTCFVSGWRGRQNIRRGFIGGMHMVLVGGVXXGSAMGLVKGFQLLASIGEGHGEQ

SEQ ID NO: 40465 - protein, 78 aa, A.fumigatus
PCRFRSQRGVDPRFGWYASFILVPSGSLENCSSRSGLNYGSATKCHTMAATIKRGTAIITRLLIVCSTSQLLWEGTAC

SEQ ID NO: 40466 - protein, 270 aa, A.fumigatus
CRSWDSLRRSQILKVENIVDMALLQRYSSGLIFTPQKALNRGNFVRNPPDWLSKGPKVEENWSLELQTLEGLSHWVWSVTFSQDGQLLASGSDDRTIKLWDPTTGALKHTLEGHSDSIRSVAFSRDGQLLASGSDDETIKLWDPTTSILMQTLEGHSDSVWTVAFSQDGQLLASGSHDKTIKLWDPTTGNLKHTLEGHSDWVRSVAFWKDSQHLASGSDDKSTKLWDPTTGNLKHTLEGHSDWVQSVAFSQNSSGISPLAPSTYSGCWRY

SEQ ID NO: 40467 - protein, 60 aa, A.fumigatus
ISCRSSNTRRQYHPSPGLISFSFDRTSESYLPKQALQFSFRNYLVDNPTKIKKFYIPIIA

SEQ ID NO: 40468 - protein, 61 aa, A.fumigatus
  UNSURE (56): Identity of amino acid sequences at the above locations are unknown.
RKIKSCIQTTVRAHVLFSNPMLTGNFTLFPFCPFSVSPLLPSFTSPCSQIQVLGAXMAGWI

SEQ ID NO: 40469 - protein, 249 aa, A.fumigatus
AHRLFFLLVCNMAAKLQFLNNLPREIWLSIRDLVLPSASANELKIAPALWSSIFKSDRWLNMATREFKCSPILIGCDLSAFRPHRVSNRIYLALIANDYSGDLRFRQDELLETFQDGAKFDADTYEVKLPSGIVVNIYEVITGSETAELPLEKLFSRENSGVHTEYCFYTKKVIGSLGPADIIGLHGPCHKWRDFKYGGAIRVPYGGKVKQYFIQAKGKRELWVVKRDDESKLVSSFSKEPRNEQGLLY

SEQ ID NO: 40470 - protein, 73 aa, A.fumigatus
PAQVSSILHPVSDLSLQAFSKISCTCFLNTNYSLCFPDKAYEATTNKLYYIWQVKLSTKWNATFRVDPNSQSM

SEQ ID NO: 40471 - protein, 76 aa, A.fumigatus
MTVIKVNKYRETRWTIFALISQADHSWQIQCNVLDIAAKSITGIAAVNLTEFTEPTSARYSFPVWVTCYMITQSLY

SEQ ID NO: 40472 - protein, 78 aa, A.fumigatus
EYWVSGTYRCISENIYVSIIRINYLVSPKLFRTPISTKCIQNQVYNYLSKRGLAAGGLLGLYYSKHITTTPPLQRGLS

SEQ ID NO: 40473 - protein, 72 aa, A.fumigatus
YNNKEVLYPIIFFSKKLLVTKYNYKIYNKELLTIIHYFKEWRPKLEGILLLIKVITNYYNLEYFMSTKLLNR

SEQ ID NO: 40474 - protein, 75 aa, A.fumigatus
KNLGLFCIKKIISLHAYKLDLLASIKIHPVFNVSLLCSIAKDPVPGQRQPPLLLVEVDSLEEWIIKDILDSCWEY

SEQ ID NO: 40475 - protein, 139 aa, A.fumigatus
AHLTLSFFFVFPSFNSVIRSVPTSRMKYAAFLPTIGALVSQAIAIGVQGTAEGFASSVTGGGSATPVYPSTTDELVSYLGDSEARVIVLTKTFDFTGTEGTTTATGCAPWGTASGCQVAINKDNWCTNYQSSAPSVSVT

SEQ ID NO: 40476 - protein, 186 aa, A.fumigatus
TARIGRQHYVLGTEASNRITLSNNYIDGESDYSATCDNHHYWNIYLDGSSDKVTLKGNYLYKTSGRAPKVQGNTYLHAVNNYWNDNSNHAFEIGDGAYVLAEGNLFSDVTAAVESSSFTGELFGSASASSTCQSYIGRDCVANSFSSSGTLSGSNVDVLSKFKGETVASASAAGTSPASSAGQGHL

SEQ ID NO: 40477 - protein, 139 aa, A.fumigatus
TVAMPIEPFVSATPLRFRGIPDSLAVFHLEGSECCLIHADNPLSGHQGVYLNPKVRVGYNGPAYEAVHPAGSWLSPQYIALALWENRFRRWATTTLFKKFVVRRRLAQWKALSSGRHEPGKFCLINEMQVLVANGWAHV

SEQ ID NO: 40478 - protein, 101 aa, A.fumigatus
RGNDFSPCGCPQVDDVIELLNTNEGVYAAACSIDYSRPPLYYDTFALRDSYGDEHVMQTWPYFRSTVSRHALFNMSPVPVKSCWNGMGRLIFPFSHSTLCS

SEQ ID NO: 40479 - protein, 479 aa, A.fumigatus
QYWSLLPSTLAHFLYSSLIPVSSLILTQSHSTSISQFPPYPNMLPVFHADNFKTWTPPFRIRSSSMRSRLHPPSNKSPAIKFRQSPLPQALPLPKHQLPARPPAEVCIHASAVTPSGTSRDPQSPSRESFRLHSATTPARTPAISSDPQHAERLEQSLRNEPGPSSAPDLATSRRVHDAIDASIDAPFFPEDALRYISSPSVSSSDESWQEFPQAADEQNDILIDPVILTNNGPWETEDECQHIHADGDAVNSETICQYPDPPLLLRDTRAENRNSNAYPEAQEGNSRLDSLLHSQSHAQVSTDNKPEAHIRASSNPLEVPNSGQQSKTRKRKLQKSHGQPQLCKWVRGSSATASKENSFSSLRSHFTSVSVDERLQFLSWLFEGALPRCMSESDLGVSTRIAQPTHYESQPADSTALPETSRKGMPWSSEEKDLLLRLRRDEKRPWSDVVRLFSDQFPGRSPGSIQVFWSTTLKNRAH

SEQ ID NO: 40480 - protein, 131 aa, A.fumigatus
VHLRPLFSSAILSPSGCLDLKLENIMVSFEDPTVLADFMDPQLARPTPFKIDSAGRPVYQSRNDFGPLKSLRSIPQLVDFGLATRLEEDDDWGVWPIQPDHYRAPEVILGNGWQMPADIWNLGVLVRSVVL

SEQ ID NO: 40481 - protein, 129 aa, A.fumigatus
QIYRHAEEPERIVALKIANNNASSAGHEREVEEHISMADPSHRGRSVIRTLLDSFEVKGPEGSYPCLVYPPMRESLSMYQRRFNDRKMPLPLIKTYIRALLTGLDYLHKVCRTVHTGRFIFDLYSRRQY

SEQ ID NO: 40482 - protein, 103 aa, A.fumigatus
SSSTTTDITFSRRLTGSNSVMDTIKPFISRFSALLRKKPFPMPFPGPPLPPGILVDEEISPVYDSKYFYPAKPGEVLADRYQTLVKVGWGVSSTVWLARDLQG

SEQ ID NO: 40483 - protein, 302 aa, A.fumigatus
WGSDSDKTALTNDFKLLRNNFTNVPIILGEYDASPTNTEPAARWKYTDLLAHAAAQYNFAAILWDNGLDHLDRTTGNWRDPTSLQIITKTKSSTKNSLPDSTTDASATSQSSSAYIFHQVGTPVTSQTLPFIFNGNTLRSIRDSSGTTLKQGTDYSVSGSNLVFTASYLSKHFSASTKPGIIADLTLVFSSGASPVVQLVQWQTPTLGSTSVAASSVSGDLSIPITWGGVPKVAAVKALTTSGKYLVDDWTQVLGPLQQARTVRNFFFRAGTYLTADSLLCPDLQQPVEVRGLECHFNVWGY

SEQ ID NO: 40484 - protein, 61 aa, A.fumigatus
PLTLFCVQTYSNQWKFEGSNVILTSGAIDAVKSVGQTTVFTFEFYPRVAGGVNTVNFTVTV

SEQ ID NO: 40485 - protein, 63 aa, A.fumigatus
YGKNQSTVADIDNSVKQGVSACPSITFKPRTDDLFSFQSILELSDPKIDCLSSKAKEEWTSVM

SEQ ID NO: 40486 - protein, 69 aa, A.fumigatus
NQNLKAQGSNSLHIARVQPATRTSGPYGALDLSFLSFCMYGTGFPVAKLCSNVNLRVTEMPMVGHAKPR

SEQ ID NO: 40487 - protein, 76 aa, A.fumigatus
CMFKKPATVSMEEWYVPITVLSQVYFIPMRIYVSSENTEVYPVRSAGILRSLTGGYVFYESGTHLMNEIRSLQHSV

SEQ ID NO: 40488 - protein, 231 aa, A.fumigatus
VPFSTAPHASFTDAGHPSAESAGETCSLYSPTWVSSVRFGFFYRAFNPSTPPLTTPSSSPNILLHRPPDPRLRLRRPLPRLSSLPLQLPLRLRHRNRHKGACLPARPPASSNRHLSRQHLHDRPLRHTRRHRALDHHGPLHRPYRTSTHVPQRGPSPTLHLPPAHPRHRRRAAVERRRDAGPPAPSPQPLGGSLEMVPPEPVQRLCGAAAQSAPGPCRDQILRRGGAECVL

SEQ ID NO: 40489 - protein, 243 aa, A.fumigatus
PHPPPALTYSCIAPLILGFAFVGLYLVYQAYRYNFLFVYDIEIDTKGLVYPRALQHLLTGIYLANICMIGLFAIRAAIGPLIIMALFTVLTVLAHMSLSEALAPLYTFLPRTLDTEEEQQSKEDETQALLRHPRNRWEAAWKWFHPNLYRDYAALRRKVRRDHVEIRYSEEEERNAYFEPCIRARTPTLWIPRDKWGFSHQEIIETHPSIPITDEGAHLDEKNKFVWDKYDPSLPLWELKVLY

SEQ ID NO: 40490 - protein, 599 aa, A.fumigatus
GNCSERSPQLPRGFINWFGQFLKISDAHVLHSSSMDGYLFLRFLRVLCSTCFTGCLVTWPILIPIHVTGGAGNTQLDALSFSNVKDPTRYYAHAIMACIFFSMCFWGLFQAKSLIRDTAAYVFYVVTRESLFYANLRQAYLNSPAYVRRISSRTVLFMSVPEDYKNEQKLRQVFGDSIRRIWITSDCKELMKKVRERDSLAYRLEKAETNLIRTANSARLCAFKKGVITSDTCLDCESGTHSWRKKIRRPSHRVKLFGPKVDSICWLRDELVKVSKEVEYLQEQHKNGKMKNLSALFIEFNSQSDAQIALQTLSHHQPLHMTPRFIGISPKEVVWSSLNLSWWQRIVRKFAVQGGIAALVIFWSIPSAAVGAISNITYLTSLLPFLGFIDKLPSSLKGVIAGLLPSAALVLLMSFVPIICRCMSPRLKSNRNKRTLLTLVDSVLARRAGAPSTAHVELFTQSAHFCFQVVQVFLVTTLTSAASAATAQIIKNPLSAKDLLAQNLPKATNFYISYFLLQGLTMSSMAVVQVAGVLVFKFLSTFFDRSPRLLYRRWASLSGIGWGNVFPVFTNMGVIGTFRILLPRIQPLNPTTNHTLLQP

SEQ ID NO: 40491 - protein, 136 aa, A.fumigatus
PHSTPSSRAPSTQKKSSSRKKTRRRPSCAIPATAGRQPGNGSTRTCTEIMRRCGAKCAGTMSRSDTPKRRSGMRTLSRVFGRARRRCGFPGTNGGLVTRRLSRRTPPSRLRMRGRIWMKRISLSGISMIRAFRFGS

SEQ ID NO: 40492 - protein, 102 aa, A.fumigatus
VNNARDLRLLEGSQCNSVLTTDITYIGLSDYPHATTRIHANYNNGNAHKTVFQSEKSSTSIIKLIISITITAIRLITTIHVFLNFSRRLECLNLLHHHQSMT

SEQ ID NO: 40493 - protein, 168 aa, A.fumigatus
IRDTNINAYPLKLGADPTSCFPPFVMSAQDEFNSLVANNQEKFSTHPEDRDNSDRDSEPASDNNTNHDDHAHFSDSEDFDDTAMGSRTTTYQVPRTKFDANTGPKGVIADAQAFERARKRSFRKTLLGAAGMDYKHHRSNSKSITDDANLLQNSSSTTGVEGSALSVK

SEQ ID NO: 40494 - protein, 83 aa, A.fumigatus
RLQVWDVLRGDKVGSLSGHENRVSCLGVSNDGISLCTGSWDSLVSALKAIKYSPLLFRFIVFLVFISQSLIFLFVVKLKVWAW

SEQ ID NO: 40495 - protein, 151 aa, A.fumigatus
LSLHTNQPPRPAAPSLSTLPFCLFLSYCRLPASSPGHPNPIPWDSQRRLLRHRFTSSPAYSHLPNLPIPGTSFLVEMAADMSGEQMQAKITAARREAEGLKDKIKRRKDELADTTRTNPLSHYLLQSFNSWNCSGLFTAIALQMSMFHFGY

SEQ ID NO: 40496 - protein, 199 aa, A.fumigatus
TVRQVAQNQTDALPRIGMKPRRTLKGHLAKIYAMHWSTDRRHLVSASQDGKLIIWDAYTTNKVHAIPLRSSWVMTCAYAPSGNYVACGGLDNICSIYNLSSREGPTRVARELSGHSGYLSCCRFINDRRIITSSGDMTCMLWDIESRSKVTEFADHLGDVMSISINPTNQNIFVSGACDAFAKLWDIRTGKAVHTFAGH

SEQ ID NO: 40497 - protein, 153 aa, A.fumigatus
PEKSLPGVLVLYAQSTGVGRGSIRDLVYSSLTLAINCGWLVLPQWVLLSPPTSISSLLFDRCPYGGRLHATALLMVLDNLTLFSGDFELKYMVKTNFLGGASLSKPRITSYGVREYQILRWATFSSPIRLTCRLQPEMTSIAYSSTDSLLLVL

SEQ ID NO: 40498 - protein, 70 aa, A.fumigatus
KWLAASGTHPPLPVEENFPPLNLNQLKVFFIHGNLRVSRVKPPVSISHIAHLTVITKTGGSYVGMETSLQ

SEQ ID NO: 40499 - protein, 582 aa, A.fumigatus
LEQVEDLFYNVPTRRRAFRSASEEYAKILDVVGRYAVHCSGIAFSCRKHGESGAGISTPTAASTVERIRQIHGSAVANELVEFQVEDSKLGFRSSGLVTNANYHVKRTTILLFINHRSVESTAIKRAVEQTYSSFLPKGGHPFVYIDLEIEPQRVDVNVHPTKREVNFLNEDEIIECICDAIKSKLAQVDSSRTFLTQTLLPGVTTIEPLNRNNPATGLSVESDSQVPRTPAPTKKPYEHSLVRTDSRVRKITSMLPPAIQRTPSGPEAAESDPSQVVEEGLQYETTDREPLRIALTSVKNLRAAVRSTMHNNLTEMIASHTYVGLVDERRRIAAIQSGVKLYLVDYGMICSEFFYQIGLTDFGNFGIIKLDPAPKLVDLLRIGADAEREAHIASGGPVSSQETTQPEQTGTAEESEIFANAPNIVAKTLIDRREMLNEYFSLQISAEGDLLTIPLLLKGYLPSLGKLPRFLLRLGPYVDWTSEEECFRTFLRELAAFYTPEQLPPPPPEGSNASDHKEIPESPEEQPEDAVLRHRRLQIARMLEHVVFPALRARLVATTRFLRGVVEVADLKGLYRVFERC

SEQ ID NO: 40500 - protein, 66 aa, A.fumigatus
VKRMPHLRVGITCMLFCIYLEYGLFINAISLAIEAHSSSLLMVLLRLCSSCSSHLRSSYLRNPVSQ

SEQ ID NO: 40501 - protein, 285 aa, A.fumigatus
SLATVRLCINSPDRNILWTRIYTRTAQLSLNMATVLVQQQTLRHATPPPAGISSSLNLTRTPSPVPNKHLPVCPPGTSTAALRTAVQSTKEDKKVTSLLYPPDTFLRVNKSPSIYSIDIVTLAAALDYWASQPLPDPSQVFPWLHGLHPENHLQLGFFTNRRRSLRRIPQCWRGITIVKVGGDLSTSRLKGAVSPSEILAPSGWDFIPSDPKEGFSVRNFQIQTPKLATLSDIVVYGQDGVHKKQLLEVAEKIATAQYRWRNKNDPDGLLPTYHTFILSSQSFSA

SEQ ID NO: 40502 - protein, 76 aa, A.fumigatus
SEHTLDSYIHSNCTAVIEYGYGVGTAANAATCHPSASGNLLVPESHQNPVAGAKQTFTCVSAGDFDSSFADCCTIN

SEQ ID NO: 40503 - protein, 317 aa, A.fumigatus
FFFGWEDRSNTSPVHWERLEMCEMTKASEISKNVWQGPTPDYILQCGSGDSVHVEDFDLLIETSDLASIPGPRYLAKLNRQLDDDDGPLRLEFPSSGSLVVPSAETREIDDLVSTVRWIYYLANPDEPESPTDVGGDIAMTLLQRKPRRILIHCPDGYTESSLLVIAYLMFAEGIPAHEAWLRLHCDRKRNFFAYPSDVTFLSTIQTRLLHESPATHSESLSSVPDPPWFRYCDGSLPSRILPYMYLGNLGHANNPEMLWALGIRRILSIGESVSWRDFDVARMGPDNVMHITQVQDNGIDPLTQEFDRCLEFISEF

SEQ ID NO: 40504 - protein, 80 aa, A.fumigatus
GMDVLEARSKAPIAGLVASPSTPLPTPLMKPWRPSFSAPCSGWRASPPMPLAKLFANAFPPAVRPYNACFGRFRDFDIRR

SEQ ID NO: 40505 - protein, 451 aa, A.fumigatus
  UNSURE (412): Identity of amino acid sequences at the above locations are unknown.
PLEGDADSVVRVKMKSIEVIYNPSFLVEIVKFFEPPERHMESIGAFLDSAGATVEEIRQQTRAGLEFALEEHKKVDAHFDIHAPLIIVPESITQESSLCLILDAGHISVNSELVDRQTMRDLQAKQKRQYVENDYKELEHLLYDRFLLKLDSTQVLIGPGVESTKSQLTSEVKNRNFHIIDRINVDFVLELCIIPKSTELTRTRISGHLPELHASMSDTKYKGLMKLIDIAIPRFDEGGVSDCPPAKSSSESTTTSNRARSASFQPSVPRELPVVDEDSDSETDHEQTKKSVDRLLNIHRKEFEFKFTVGCLRGSLFRSDPDDQFRDQLLVELVAEGFELDYYTRPFDMVAEIVLQSLSVDDYIEENPIPDFKRIISSKGFDADEDKDLFHLKFVRVKPDSPEFSSTYEGIXMNLDMSISTINLVVTRKTLLTLLDFVLLTFTSPEQPRNP

SEQ ID NO: 40506 - protein, 1489 aa, A.fumigatus
TLWSLGRHFSPCWILFSSPSQAQSSPETHKPSSDETVQNTTVLTQDTEQPGKIRIKADLKSIALILNNDGVRLATLSLNTADVGLNIVGRSMLIQSRIGSLTLIDDVNTGASATSDLRRLLTIEGDNFADFKYETFDPESTNYPGYDSEVYLRSGSIKINFLEEPYRKIINFLVKFGKMQAIFNAARQAAASQANQLQENASKMRFDVVVKTPILVFPGAVRPDRPRDTVTAHLGEIYAKNTFVPLDEDAESPAVNLISSGIRNIRLTSKFHFEEDVVEELEMIQKVNLEFSICYLEHQNDNPRPDMEIEGSMSPINLRVSQKQLKFLLELSKTVPGAFSTDYEQQELEAFEDLPTSVTDTSKGADWKLAQTPQEHERIAEGSGSDDETWAKLDMLFKVDSVGLELILAKDDEPVGDLEGSSLSKFSLNDTQVKLRMLTDGSLESELLIHSLSVRDSRNQDTNKFRKIMSLINNDVQQQFMASLSMSPGPEKHLIAMLTIDSPRIILALDYLSALQSFMNSVFTAEEPIAVEEIEEADETSEPRSSSTESPDQTATATPGEDSTSSAAKTTISFRVNLVDAQIIMIANPAIAHTEAIVLGTKQVLFSQQNVSTLQINKVGMFLCRMDKFETSRLRILDDFTLELSMDSRPQEKGPSLTSIDVHIEPLVLRLSLRDILMALQIVNKASEMRANRSQEIESGDVKRVSDGRQPSAKSTRRRSSAARSSHAPALKSRRASGASGKPASQRAASERSAILKREELSAQIDGVRVILIGDLHDLPLLDWSVKKFTVDVRDWSSALNADTSFDTFINVYNFSKSAWEPLIEPWQLGFHVAKEVDPEVFSIDAYSHKNMELTVTSATIALASKSFQFLSTDQDVLSKPRGADAPYRIRNHTGFDLRVWADVSTGEEGPAAKLSDGEEYPWRFEDSTAVRETLAPEGQGGVVGVKLEGSGFESINRIPVAREGEFLYSLKPKADGVLHRLLVEVKLGTDNVKYITFRSPLVFENNTQIPVELGILNHKEGHLLKIEKILPGDARRAPVGAAYLHSVLIRPDQGFGYEWSTEPLHWKDLLRRPTRTIKCISESGQQAPPFYFQMNATYNSKDSLTNVYPYMRIRIFAPVEIENLLPYDFKYRIYDKNTRKDWTNFLRKGGVSPVHVVELSHLLLLSIDLEDTVFRQSEFAIINGNAQDYRREHMLSLKDEQGIPLRLKLHYFNVPDSGGAFKVSIYSPYLILNKTGMPMEIQSKAFLQSARSAAGEGLNPDPRHGGRALPYMYAYQSDDPKNRSILKIGDSAWSKPQSFEALGSNFEVVLSDRQGKSEFHAGVSVTEGEGKYKMTKVVTISPRFILKNKLSEEILVREPGSSSVLTIKSGNLVPLHFLRQIAEKQLCLCFPGVNNQWSSPFNIADVGTVHVKLAKANQRQRLIKVDIIMEGATLFIHLSLETRNWPFSMRNESDSEFIFYQAVSISARYMTRIHANTQTVFIESIRGG

SEQ ID NO: 40507 - protein, 709 aa, A.fumigatus
NPYVEDDEDDRTSGWRPIRYRLPPRSIMPYAWDYPATKNKSLVLTCNGKERHIRLTEIGNLIPMRIPPSRPGEPQKIVDINIVADGPTQTLVLSNFKQSRSLYKQQKAQTSQTSVSTGFEVKELDSDVNFKAQLRLAGIGVSLINKNLKELLYLTFREIEIKFRESRVYQTLNTTIKWIQIDNQLYGGIFPILLYPSVVPKTGKEMEAHPIFHAMVTRVKDDSYGVLYIKYATVLLQQITLELDEDFIFAMLDFAKVPGASWSEEQEGKLCDEDLKIPEPQNESASQDVYFELLHLQPMQLDISFMRTERVNAENNMQPSNPLMFFVNVISMSMGNINDAPVRLNALMLENARVSFGILLNNIQSHYTQEFLRQVHVILGSADFLGNPVGLFNNVSSGVAAIFYEPYQGLVMTDRPQELGMGIAKGATSFVKKSVFGFSDSMAKFTGSMSKGLAVATLDKEFQDQRRMSKSRNRPKHALYGLTAGGNAFANSLASGIGGLARHPLQGAEKEGLQGFIKGVGKGVLGLATKPAIGAFDLASSTSIPQENEDVHADCCLNLAEGVRNTTTVFDAEGLDRVRLTRFIATDGIVRPYSQREALGQFWLKTADDGKYFNEDYIAHLELPGKDMLVMLTYDRIMLVRSKRLRTEWDIRLTDIQTISKERTGMSITLKGGANGPFIPVQDESSRNWLYRQIAIGSLPPITCRVNGC

SEQ ID NO: 40508 - protein, 165 aa, A.fumigatus
RHLFTITGPAGLAAAIRLKQLANEAGNEEFRVILLEKAGELGAHILSGNVLQPTAMNELLPDWLSEENPSRFEGATPAREDKMRFLTKNLSFPIPAPPQMNNHGNYIVSLNELTKWLGERAEELGVEIYPGFAASRVSLQFGWLRPRRCDERPWCWTGRQGQGQF

SEQ ID NO: 40509 - protein, 116 aa, A.fumigatus
AERERTTRRTSLSICRSLIGTSIRTSLGPSTGALKTDFVLLESMSTSRIQASSTAFASKLMPKSKSWFLRAFFFFLMQMLTTHSCIHCKTCDIKVPTQDINWQTPQGGEGPKYFKT

SEQ ID NO: 40510 - protein, 117 aa, A.fumigatus
GFLHPTLSRESSPQWYAGLHHQIYPFLGDIPVCFNLDSVYRQLAPSKTTRRDPFWTTWSSHNSHESQDCFLGSSFVLGHGDVRANKHIPHPKSPYFPACSTPTTTDIAFFGSLTLCF

SEQ ID NO: 40511 - protein, 175 aa, A.fumigatus
RSGWVSELRSWVSRFTLDLLLAELVYNSDGSVLGVATNDLGVGRDGKAKDNFERGMEFHARVTLLAEGCHGSLTKHVIKKYDLRRDSQPQTYGIGLKEVWEIQPEKFKSGEIVHSMGYPLSSDTYGGAWMYHFGENLVSIWLVVGLDFSQPVAFTLRRVPEAQTPSPVQGGLGGR

SEQ ID NO: 40512 - protein, 81 aa, A.fumigatus
LLPMAPVLASLLLFFSVTKQDIEEHFSSHGSGKITEIKLMNGFGFIEYEDAMDARDVVPGKISLGSPALTSDRIIWLTITI

SEQ ID NO: 40513 - protein, 133 aa, A.fumigatus
LFASRFNLMTTAFSVIHIGPAHPAAVILLSMSMTGDFPRFAVTAPAPITGNARLFRSAATIMNVMATAVAPFFDLGLKTIPLVVLTMTPMMPGLHHLLATMMTHTWHRDPTDVLGHPQEATIHLMTAVDTGRI

SEQ ID NO: 40514 - protein, 305 aa, A.fumigatus
RRCGRFNRKSSSRERSCILWDTHFLRTPTVVPGCTILERIWSAFGWSSAWTFPNPWLSPYGEFQKLKHHPLFREVLEGGKCISYGARALNEGGFQSIPKCAFPGGALIGDTAGFLNVPKIKGTHSAMKSGMLAAEATFNALQNDNNGTVFLFDYEDALRKSSIWKELYEVRNMRPSFKSPLGLYGGILYSGLEAFLFRGKTPWTLKHHGTDAASTKPASECEKIEYPKPDGVISFDILTSVSRTGTNHEEDQPVHLQVADWDKHTDVAWPKYRGIENRFCPAGVYEYVEDPSKQHGVRFQINAQK

SEQ ID NO: 40515 - protein, 167 aa, A.fumigatus
AYVLKYLGPSPPWGVCQLISCVGTLISHVLQWIQLCVVSICMRKKKNARKNQDLLLGINLEANAVLLAWILDVLIDSSRTKSVFNAPVLGPSDVRMLVPISDLQMDRLVLLVVRSRSAHTGQDIEADHAVRFGVFDLFTFRCRFGGCCICTVVLECPGCFAAEQEGF

SEQ ID NO: 40516 - protein, 133 aa, A.fumigatus
ARVEDTAVKSERGFERGPHIAHFVQLLPDRGLSKSILVVEKEDSTIVVILQSIESSLRSQHARFHSRMSALDFGNIQEASSVTDESASWKSTFRNRLEATLVEGPSTIGDTFTALQDLPEQGMVFELLELSVR

SEQ ID NO: 40517 - protein, 165 aa, A.fumigatus
RTASSSRHLSRIGGPAAVSKLARCALTFRAGPQAMDTVPATAVAPASARRSNNESRSVYAWGPSIRSRTYSQPQRQNQLRAVDSARPSGRSTAQTPASPSTSPYTSYSPRRDHVRPFLPQGPRRATPQVPGSHPPSTTRRTDTPFYECRLGGSEKASRLQTPRPF

SEQ ID NO: 40518 - protein, 309 aa, A.fumigatus
YPHLMHAILALGATHYSLVSPNGSEYSSTALVHRGKALKELSAAIGKGPECTTTDMDVILATCYALVFQAYHMHDGLVDFAVMVRGCGVITNCIVDKYQTSQLFHLQTEEEAAEVALSLADEPVSSPLLVDSLLAAIDRLQPLFQSAIHHRFFRALRETLAGLAISQRAAFVRLTRIYAVWYKADNREFLTFIAPANHVSRALFMYFLVIELVMLPVYIRLRELSGTTLITTDLTVRQWADAIYRELPSSIRELVELPMEIIAADENTARSTRGTRSDSVFPNLHAQFFDMETAAWLGCAKPGGVGVLE

SEQ ID NO: 40519 - protein, 252 aa, A.fumigatus
IAYPRKRGLRMSPVVPSLLSSQYSHLLVRHRTPNQPGDNPTKLISQRPSPTITMQFRFKERLSYQGNPQELETFMKRKLERSTSAQESPKPEDPEKQTRQERTALHDAAEFGYPNFALTFIEQGNDINAVDAKGRAPLHVAVQAGQEEVANLLIKKGADVNVHDNDGLTPLHFAVVLRSVALARLLVQAGATPRAENAHGNTPFLFAYLFEEDEILECFAETSRPKAEAVPSSTLRGYLVNMRSWAKMRSML

SEQ ID NO: 40520 - protein, 205 aa, A.fumigatus
ATNAFCHECHMLTLADFLDKASTANKSVETLAPLCNNLPYADAQFDCVIAALVLDSVDDLRGVLLEVVRVVDKSSSNARVILVQGAPYNEVQKLVNAVCTPLSSKSIGPAHQGLLLHSAMKILADIGFGMTSLHPLSTSYSFDDKSSSDRSNDLAEMLGNVWFPGEEKLAQMKQQLISPIENLLHDHPGFLQNELVILEAVLHAH

SEQ ID NO: 40521 - protein, 305 aa, A.fumigatus
RSYYEPHNRNPAMEVDAAILFNELGTRYEDAYADSPGLLEVTEYVVGKLPRSSHVLDVGCGTGKPVAAALASAGHTVYGIDVAENMVSIAASQVKGTFSRADMRTYTPPVKMDAVFAIYSLFQIHPSDTHKMVYRFAEWLKADGILVLGVSPSSGLVGGTDVHDLVWDCMRCKATWMERPVSELYFSQTAWLNLLREAGFAVEVENMFDYVSKDPKHTRTETHYLIVGRKLEPQPLLGPYPWPEGLPGKSMRNEPAWRRLQGHLFLTDDERMKLSSMLEGHQRILDIGGGLEGEPQTHSAMNATC

SEQ ID NO: 40522 - protein, 61 aa, A.fumigatus
CPRCSELAKAHVWQQHTFIIGTKRFVTDFRGKRHYDRGLSYRARSSNIANKPQFNRMVTCT

SEQ ID NO: 40523 - protein, 237 aa, A.fumigatus
  UNSURE (237): Identity of amino acid sequences at the above locations are unknown.
LQFPEAIWGADPLEFYGGFHNLSFDANASFNSALAVNGSVKWKTARALSHNFAPGKTRTELHVSFPEIDWKFTQAVYGWSALQYQAWARGSLNTGHWAPQSVAIFTSGLLEIVIDGKRHFGGDFYNYGTVPIIIDLSTGDHAVELRLVRDVRASGAIGEPTIVVSLAAEIRNEPLSADNESMLLPDMCLGKLGTPWASINLHNNIADRITILAISSIGVSANSLPLCRYERRVTRLX

SEQ ID NO: 40524 - protein, 471 aa, A.fumigatus
SPRHQCRATHPLRVCREHQFPWLRVLIQVEYVPYNLWQDFEPLLSFVLSRSRSSYKHELLLSNVAGIPILQQHGSIDDNVPVFHSRLMHELLGQTQWRSQYDELQGQNHWFDGVLTTPSLLAFYNQSATFPRRPRLPLAFTITVPSSANIAKGGIYVDQLRSPDRNGVVQVIRDARSGIWYVNTTNIHRFHLSPRVLNFTMPSALVLDGRDCFEMGYIRPERMWFLRDSRGRWTVSEREDWRQLNERYGRQLGTVDAILRTKGPFNINICSAGLEHIAVQISRNFLQYFAADSQLSRQCGSLIYPDNNQNRVVDSGNVVTLALGNELPSSKLKLFPIRIQGQGLSLFQGCCWPRADTEASPQSSLNRECNEYEFPFERGMGALFLRPLENERLELVVWGADLSGLEQAARFVPTLTGVGQPDFLILGDSCRWQGHAGAYAAGFFDRSWQISSGSYIRIDASVNEQRLRNGA

SEQ ID NO: 40525 - protein, 103 aa, A.fumigatus
YSTVAGDQYGNYLIQWILMNAAPHQRELVASHIRYCLASLYLYQYNDAHAMIIGSTWFLCEAPNLVHAWQCFAATHPIPPVPDPGRACRSAVSAISTMTGIIW

SEQ ID NO: 40526 - protein, 218 aa, A.fumigatus
VGANTLQTYISPLEPLNYRRLLDKNVSCDWKYIVDKIICNNDQQASIFLQQKLKVGTAEQKYDIIEAITHQAYPLMVNRFGNFLVQRCFEHGTTEQVVAIANAIKGNTLSLSMDPFGCHVVQKAFDSVPEEHKAVMVHELLCRIPETVIHRYACHVWQKLFELRWSGEPPQIMAKVNEALQGMWHEVALGETGSLVVQNIFENCVEDEKVTVAPVPRS

SEQ ID NO: 40527 - protein, 106 aa, A.fumigatus
RPAIEEVIAKIDVLAHGQFGNWCIQHICEHGAPQDKTRAIEHVLLWSVDYSMDQFASKIVEKCLKIGGSEFLDRYLSRVCTGRTERPRMPLIDSEFLQTVQPYTTD

SEQ ID NO: 40528 - protein, 292 aa, A.fumigatus
QDYPALWLCHDCNRCCNLWWHHGTRFLYLPVSPMYDCANRVHLQRGSEVFNGLAHFIKGGIFFWYGLLTLGRWMGCWADFGWAWNIKPSSSIVGKWKAKIPSGEFTESLVIFLYGASNVFLEHLAGWGGAWTATDLEHVSISIMFFGGGLCGMLFESKRIRGWLNSTVLPSPAHASVHGSADPAWQTPDTQGVSLNPMPALVILLLGMMMGSHHQTSMMSTMVHKQWGNLLVGFSLARGMTYVLLYLKPPTSYLPSRPPTEIVASFCLIAGGLIFMLSVSVLCPSLSLKNCY

SEQ ID NO: 40529 - protein, 78 aa, A.fumigatus
FTWFFGLSAAFMTTVFLFLRSAWISKSTHMNKRRTTSLTWTTANDCNGTYTAESSYIKQLTYFLGFATAYPEPMRMGG

SEQ ID NO: 40530 - protein, 88 aa, A.fumigatus
REWKGKKEKYKRKIGLGSYLLIYSRLPWLSYYILLPFSFPSTISSYTSFSPTNIPNVIIIARHPGSTSEPHLVQLRFRAIRKSHRPLK

SEQ ID NO: 40531 - protein, 455 aa, A.fumigatus
IVANLTRLLTTGLRRYALSTLVNKLLGNDKPIPFEFLINGTFLRTSIDEYLTANGISAETTLEIEYVRALIPPLHIASFQHDDWVSSTDVLSATSPAATWASATISQGQEKILSGSYDGLLRVWNMSSQIVATSPAAADGGHTASIKAAKFVTPNQIVSAGLDRTVRLWKYAESDEGFSGTIAPQLELYGHKSGINSLAVHALSNRILSASSDNSVGFWSTKKSDAPAAPDDLLPSAASRSSKRRKLNSSVTVPQRGPLALLSSHTAPVSAAIFDAKDSTVGYSASWDHSMRTWDLVTSALVDTRTTSHSLLSLEHLPELNLLAAGTSARHITLIDPRASATTISAMTLRGHTNAVVSLARDPHSTYGLISGSHDGTCRIWDIRATKTDKDGAVGESVYSISRKSLEEQGRSDTKRVGGEGVKVFSVCWDKTVGIVSAGEDKRIQINRGEGVLSA

SEQ ID NO: 40532 - protein, 140 aa, A.fumigatus
DAFSPSRRVRLVAQHENTRPLQLKVEDASAKVRLIQTEIAFNQAVTRTLEEVRELCQRLDAGRRNLEDGRIMAAIDTVDAVEHSVQKDSLFANTNVKHILVQNVAELRNQIAEDLRARWNNLLKVDKQAGSFEVAKNDSK

SEQ ID NO: 40533 - protein, 342 aa, A.fumigatus
RRIGALLDDTIAATARLDLLVPASQKLQKDLLLAIVEPILLPNQDGYSRPIHVAEGSIHVQPEPAITTVPQLLHRVSTALGFLRQCLPSSISDSFSDTFVPTLASKIISSWLSSAIPTDLAGLADFEAILDSVLKFAQTIETLGWHGQEELVSWVNQAPRLWLTRRRADSLDQVRKVLAGSHGMTKQVERVEKEEVSRADEVLLENATSDDWDASWDDDSGDESKEIPSGTQEGEDDVAAWGLDDDGTEEVVETKVGISESADDDDADAWGWGDDEDGDERVENQPAQETHKATPVIGRDIGHRAPREVTLREHYTVTDIPDSIMAIVRQQVTDVEAISQPG

SEQ ID NO: 40534 - protein, 317 aa, A.fumigatus
ESTTLSRIFRTPLWRSSDSRSQMWKPYHSLGKLASIYDLYMRLQQLSHDHTRIISSPAGLLALPTLILAMFKATAPSFYSLKFNAGQMYLYNDSLYLVEQLRTMVEEHKLSRLSSDLDALEKFGKLAYSKEMQTQRTIVTDLLDGAQGFSQCSEQPFLGECENAICATVDRIRDVYKEWQPILSHSALLQSIGSLVASVINKIIIDIEDLGDISEAQSQRLVSFCNQVSQLEDLFMPPSAEAERVPITAVYVRNWLKFQYLINILESSLADIKFLWTEGELRLEFSADEVVDLIEALFAESDYRRKAIADIRRQSRG

SEQ ID NO: 40535 - protein, 143 aa, A.fumigatus
LCSVSFKLADWVTAKLRALRKWPHRPPYFFPFPLRLTEQVSGIDENFQTRFFWDSYCPEFNMNDGSNSDATATSSAAQRQVRVQLTSKQEDIALPDNTGPILVPTSRSFPSGIIRLNCRKSDASAYYRSATICAFDTGEQTPW

SEQ ID NO: 40536 - protein, 74 aa, A.fumigatus
QNHACILERDKNNSNFSYSTKKPKEYVRYILCGQYAFAPVDLNSLILSRTNDANCLVPANTEDLDTFASNALSI

SEQ ID NO: 40537 - protein, 384 aa, A.fumigatus
LSACQPLIVILLLTLLRRLQYVTSILQNVYYGITIRAGEPRPQPPSPRYARHRRRIFILVVTSYLLYTLYETFHQVQVTGDFYRALGVSPLADERTIKSRFRRLAAQHHPDKRGYGDGDPSDDYFVYLKLAHDTLLDPAKRFAYDRFGPYILSWGDRKTMQDFLFAGLHRSVPQYVVGLVTIIILNFTYWSNWGRYVSHQPRSFLKQWDQSTNLNQWRFFTFAALITLEAALITRPKALFMPGFYIPPAIRSLLGISPTFYLLPFQILTLAQRASVTLHIFISQLTPPEVSKGSSSAPGERIHPQTMQRLAQLAQLSRATDGEATRLLQLGLAPFRGDREGIATLRKGMKEGLVLSSVRASPEVQQAIAQVMERKKPEKNSKAD

SEQ ID NO: 40538 - protein, 128 aa, A.fumigatus
TSEEEKHTHKPTNNETTTQRLDIPIPFFHPPSILPYYSSLTLLFLSFSTSPNIITTTTTTTASSDYVTSASPLLPTSALPDFCLALTKCRPPLSNVLEPTSSAQPTQFVHLTLTSRSHLHPNHPASHI

SEQ ID NO: 40539 - protein, 162 aa, A.fumigatus
TKGKAWPEEEAQTVRPCSLAVPLSFTTLLTLAFYSDDGTGDSVKVTSSRLGPKANMGAINAGLRALDRSGTPCRKWERKALQLKSFTGVQWQLPSWRAPRPQKIETNDEVKEATLDTGDSDSKANQSASGAPSEKSNSGDTELTPVPPNITEASSPAIVMTA

SEQ ID NO: 40540 - protein, 182 aa, A.fumigatus
PQPLSRVKVKEKKNHCFTSQEKGKHLSIQMKSMAAATSTTNGRSNRSAAPKAIVILRLSPELLSRFASPDVKEKATKKNSTSASPPVKEKEPSSPASSSADLPVPPSSVDNASDAASTPAPGTSAADTPRRNGLPAPKSGTKRSAGQATESFSRPRGKPGPKKKPRLYVLVPSPSLCLLPPC

SEQ ID NO: 40541 - protein, 323 aa, A.fumigatus
KSEKKVLDLRQVDLQHSDRLDLGRSHCTMTVDAMDVDSSPAPAAVAEPERKRKHKHKDHSSKKKRKHDSNLIAETTVHETTSKKSSKSKEKSKQKSSGNAPLPSGSPYVLTTATLYLPLSPISISPTHALASLLAEHLSPLLLTYYSPLQGVILAYSNASISSEPPSASSPSSDPQDNPQPLTLAKSADEYGVLYVYLTATFLVFRPQRGQILEGWVNVQSEGFLGAVVLNLFSVGIERKRLPSDWKWVPPGEEEEGNGFNSSGKPKKKVFSSTEDEDDSEPSSHFDPEKEHFKPISLASDANPFSETMDPNNGPAADDDDDD

SEQ ID NO: 40542 - protein, 345 aa, A.fumigatus
RIVFSRRIGFTADVFGKWIQSTILSPWKTLPLLLLAQYTAKGRQLAAERSRSFQVLQLLTLLAVLRHVNAWLNTRTLNNGVSDRYDWDREVVVLTGGSNGIGRRIAQLLGDRGIKVAILDIHSPQEDQGHLPPTVRFHKCDITSPSAIAAAAADIRATLGEPTVLINNAGVCSGKTILGGTEADTRIQFEVNTLSHYWLAREFLPHMVKRDHGMVATVASLAGYTTTPNMVDYSATKAAAISFHEGLAAELVTRFHAPRVRTVLLTQGFTQTALIGQLTPEDTWFNPLLQPETVAEQLVRQILTGNSGHVVVPGSSGWLSRNLRSFPPWFQHSMRSWLERLMRAD

SEQ ID NO: 40543 - protein, 756 aa, A.fumigatus
CDITTPVVPSHSRQSPSHQLRLQTVAKFSGSTFQFPYGCLSRTEHHLDRSLQPTMFRALMGGGRSSDSRSTTSSSKSSSRRRTNSKASSTVSRKSSRGDDRDRGLGDLSAYSSSGSRSKRYAPSAAGDSVASSYATAEPGIAVEHDRIIIERTLKRRDTDEESGRDRYSEIRDRDGRSSRRRDRDRSQSRERERPRSERIERAQLEDDAVESRDRRRERSRTQPGDTYLPPVSPSMPIQPNSPLVYDPHVQQQFPGQFPAYVAEPYRPPNPAGEAADYYGDQGQSVADQPGVRPKPPPIIPSSQAHLMTASPVANPPPEPSSMGQVGAAAAYFADDAELEVDPAPGRPDRPTAGTTSEPPKPSNTTFGISGIAAGAAAYGAGGSLPLPASPTSPPEPVPMTAPYAPPVTSSTTKPPHTHGIGASVGAAAAGAAAGYMLGHHQHHSMSSADHLSQYTMQNYDESSQYGLGIPGPTVYNAPANAEWHAAGTGTAVPYAASPLHPHHAAVHHGAPFPSGSLAFQQRQRGPLDKFIDFWRDPEGVGMFEEYTEAIGVCKYCFEPGTSSRDAPRKHHYRQRRSSGERYASGSRVGKASRYTSSEDEGRRRKKSSRNSWLLPGLLGGIAAKALFNTKDFEDTYSVRSGRVMTVKDTESVSTARRSQTSRGVYRRRSQSRDRESRIIYSDSKSQYEDKRHRSRSRSHSSSRNRRHSALRDAAVGAAVGSGAIALAKSRDRSRSRSRSRSRFPKKVQGEKVVDL

SEQ ID NO: 40544 - protein, 354 aa, A.fumigatus
LWPSLAIEAAVAAAAAVVSQRKSKGRKSSTSDSSSFLDISQPARKSVGGGIASFFTASSENRGKRRVKKRRSIFSFNNSSFFSLDADLAFVPGFARKHARKSTKKSSKKKDRDVDAALLGLGAAATALAATSHRRSRRAGEILVAKETRSRHSDYASSVTNDEGWEDLDSGDQSSSSVSSALAFGDTGLFGSDESQSSDSGTSKWGWRWGSKKNKKKKRASSPQGRFPTGAALAAGALGTAALASTQDRDSRLPRQHASSSSGSLQHVAPVPTNDPTLVDAVRVASLPHAEPAFVRPGPIPLQQPQPMTPVSQAVYATQGASIPTYAAPMAPPAFPPDIVRFQHAARRKDVPHP

SEQ ID NO: 40545 - protein, 382 aa, A.fumigatus
LIFLHFGRTRLQELDLSHNRLVSVRHLDSLPSLSKLDLSFNQLKHIDVSSPLRMLRSLKLANNQLQTLDVSMFSSLNLLYIDQNFLSTVSGLERCRALEILSVRDQRSGNEKNTYLDIDLGKVKDIRKVYLSSNKLSTRALSPSAPLLGLQLLDAASCNLQSLPVDFSSNFPNLKVLNLNFNSLSGVTELVGLNCLSRLAIAGNSIVRMRRLCQVLSRMGRTRQGQSCSLHQVDLRGNPLTLRFYPPALTGNGKEVDQRRIRAIPEERKKRAAGGLDLASALADAGSHERDMRPTLWATTAETEREIDDPYTLPTADAQADQKYLSHLDDATRLRRKIFELMLYAGTGGSIKFLDGLEFRPVLTEGSDMDHAWSKLEATPGC

SEQ ID NO: 40546 - protein, 1275 aa, A.fumigatus
LLKRGSVQPRGEDDWESVFKPPTPGSDTKQKDAFAKMKPADDMWDFTKSSSARRHTRKPSKLSIETSGANSEDSLDQDSERSDGAATVQRDNQGPTGSSTPSSTGTLDIKKGPDNNAHDHNKSSHGASRNESQIRTASGLEDLRNEGITPIVFSRVNTVEGQATSEVIKSALKQVTNKLERLSVGARERPDSRASDSALLHQQSELLDSLPEEDLLDTTSHSLPQDLSTGTLDYQGRGAFANVRGEQYLNDALLPQRRFSPSSFLSQRLSPYLPSNSRIRSSPPFYNKISRATEPPTLPRPSSAYARPPSGEGNPIAMPSSGSPLKLFGNHDTFTNNRLLRRMSQFEETFGDLSEEDEPVSPSEEARRKGQSRNFLHVRQETPGDRSMRRQERPRSRNMMKPRISRFGDGELDHFDFSDTSPYEPKFLNNDVEESNFRPSSRRKPSGRRQHPRRSAFGNPSRDTEIHRPSSSRESRRPQPSVGQMDNPNDQENQWIRDTPAKDPNPKRRRTILSLDMTGGESCGAGEATGQPTDNLSLLQRSLIQHGLDHGNEESLLPQESTPRPRTPTPSQTRSSWRKRSSSNREGDPNARIGAGSPQEARIPMVKVTGVNEQIRKGSITTQDFLNEATKIMDIIRAKGKPAGGLSSVEESDSEGDGAETYEDESTREEFSRPPSREGVDIRKLREPKEPNPRILSHLKRFQEHDDPEFGVNSSVMSLHLEKGESKGGENVEHPKRKHPGNPNEERSTEVGPALTMDTHVSSKSLSSRSIPTASSFSSHAKGVLSSDIVSRLIPEQVNGFTYDRSKHQWVKEKHEQSQEKPKGDDSEEDPFKDIPDLSVDELQEMMRVHSLSSLDKTKSFPPSQRGGNLTSSVGTKISDAKSSSDSQPAIVQPPASGSTLRSKSTRFTSSAPNIDTGANPWGTDELKDAETSSEVEHEIQLHEGRLSKPPRHDRDIHHQARVVTISFSSPLVSHIVYNDGSQTGSVRDAANTIEQGAQTIAQGPHGRPRPSQLIADRGSLETQTLLQHLLSKTENKSEIVDNDPSILRRESGNIESTPDKDHPENSMMYLTQTGSDTTYSFHLSPLPDFTVDGIDQPLHLELSYVAQRTRSTSLRQIHGTFALATEDLVKHLTEAEPFEPYWDHVRRLVLRDKGLITLHKLSEFCPRLEDLDVSDNEIGQLGGVPASLRTLRIPRNCLSNLTAWGHLVNLQYLDVSNNELDSLDGFGSLIHLRELKADGNNIRNIDGILDLNGLLTLKLSNNSLATIDFATGEM

SEQ ID NO: 40547 - protein, 106 aa, A.fumigatus
TIIGIFLTSCHLRSTPYSSPQSSLEAASNQYSLLVRFLWSCIYSVIRCLVPTNNYNTKPTCNLLAPIPSFPYLKAYTNSTPFCNRLWLRLPLSAPTPRQSMDCCHH

SEQ ID NO: 40548 - protein, 556 aa, A.fumigatus
  UNSURE (521): Identity of amino acid sequences at the above locations are unknown.
FTAGIELEFKPLRNDPTNVTPRPGASQTVTHKTGIPIAALDISPQRTHAVIGGKEILKTIRVSPDRLSEEFNLRNAIISYSSTHHGGSGLSARHKDQLTVRDVKWSHGNYDRTIATAVANGRIVVYDLNRTGLEFCRFQGHSRQVHRLAFNPYAPALLLSGSQDSTIRMWDLRTASAERGVSMCGSKEQYVGNSDAVRDIRWSPSDRFVFATATDSGAIQLWDSRKNCAPLMRITAHDRPCFSVDWHPDGQHVVSGGTDRQVKVWDFSSTAERRQKPTFQFRTPQAVLNVRWRPPSTDKESGDWQSCQVVTSYDKEDPRVHLWDLRRPHIPFREFDRYDAHASDLLWHSKDLLWTVGETGAFTQTDIRYAPHVIHQRPTCAAAWSPTGEVLAFVQKRARRSISGLSATDFTDRLEMEHSSGELLGQSPTEEVLDEPSFISVRARPSKPSSTRPPKSLSSTPPGPPENPPVLPLGETLSKIPPPGPRQLGVVGSVSGATSDPVVFRFLARHYSPLLEAPEDXCKHADLLRALLDSLTQNSERAENVSLTQASTYLGR

SEQ ID NO: 40549 - protein, 106 aa, A.fumigatus
GWQSTIFTNKAACFDCSSDPFISRSKQSKFSTYGILKIYLDLFHNDFLSPADQSSFCFILESRVSSVSRQVGLRALLASLKLIPDIQSPPFYPIITPPHRKGHSAP

SEQ ID NO: 40550 - protein, 60 aa, A.fumigatus
GGYRDTGLMCNRLRCPGSRSDVSWIVPKRLELKLYAGCKLIGGGVVKVKPSKGSRCDNER

SEQ ID NO: 40551 - protein, 243 aa, A.fumigatus
LRKCGPASPVVKTEAPLPPQSARMSGYERGHSPPPLTKQHDAAGAQTISHRHGDSIDSRSSYGTSAGSTRYGENSSKRSTAMSSRRPSFASIAQESHQFTEEASSGGAIHLEPLMEHPPSAEQSAGTESQKHGGKGGSFSGFDFGVATTEKPFPDPLRVSSHTNSDRLSSTRGSAELFFRSPSQSSFGSPADWLDPDETRSSSASSANVSYKSFRPLVSDMEPPSASQSEPKDVPRERHRFEQ

SEQ ID NO: 40552 - protein, 487 aa, A.fumigatus
QPLRNHFLIHCGSRPIRIQTGLAAHEAPLSSSSEAHRKARLAHPLIGWILMKPDRRLRPPPTCHTKAFDPWCQTWNHPVPRNLSQRMYRGKGTDSSSESNTSVSKFARALGLDFPHHATENSTSSSSESSPSEARSGTSISSLPSEASLSRRKPSETSRLGVVKEQPANGNQQPVLPETEQTESPADLEPPRIPASFLSPDSPTDPAINKGSLSLVVDKATTTPPQPSEPSEPRVPLVRQESHDPQTEPPERPTITRSATESPVRPPPRPKGRCRGCGEAILGKSVSSKDGRLTGRYHRECFVCCHCRSPFETADFYVLNDRPYCAQHYHELNGSLCSACNKGIEGHYLETNERSGPGPADHKKFHPDCLTCRTCGIPVKGEYYEWNGQVYCERDARRAAASMSPNRMRRPTLPSSPLAARPPNYPPMPPGYPRRPGPGPGPGGPGFGPGPGPGSRRPSGMLDIPRGPPPAGARRFPERRTTRLMMT

SEQ ID NO: 40553 - protein, 220 aa, A.fumigatus
GMYHLSSLLYSALILFYPLGARENAIAIDDINGNKLGNLPERIIPLLAEALESVPSATPWSKRLVLGCWSAAFFPLCESYLPGFETALIGFDLWYAARVLRGSPAAVNVNQKVLMGMGRGFLEEARAAGRRVFVWTVNEPSLMRWSIEQGVDGIITDDPGRCRSMVLDAVKGASPGTRHDERVTVSQRAQAWAVSLLVVMFGWLFRRKFLYPLEKRDKSE

SEQ ID NO: 40554 - protein, 287 aa, A.fumigatus
PGRPPLRESSGASWGRPAWYIQHSGRTTRARTRTRAKARPARPRARAGATGIPRRHRGVVRGTSGQRRRWQGRPAHSIGRHGCSGPASVAFAIYLTIPFVVLALYGNPTGSTGQTVGVELLVIRRPRAASLVRFEIVAFDTLVACTAKGSVQFVIVLCTVWAVIQHIEIGRLEWRSAMAADEAFAVVSPSQAAILGRDRLPQNRLTASPTTSFGTRWRTNRRLCRRSSDCGPFRGLGLRIVRFLTYERDARLARLARLWRSGGCLVYYQGQTTFIDSRVRRGVGTEK

SEQ ID NO: 40555 - protein, 161 aa, A.fumigatus
YSPHPNLTQPNMNPSKSKPQTIAHRGRIKHPTATNPRSCQYPENTLESFRAAAAAGCDAIETDLRVSRDGVIVLCHDRSLERVYGVKRLVDECTWAELQSLKTTQAPHVRMPRLVDFLAVLCEPGWEEMWAVLDIKVCTTSLVYSTLLLFYSTLWGQGKTL

SEQ ID NO: 40556 - protein, 99 aa, A.fumigatus
SQLQCRPETEQVMQEIILAEFRHYTIIAVRHRLEMIVDFDRVVVMDRGEVVEVGNPAALKEKAGSPFGQLGAAAAAYQLCATSVQYSFYPYLISMEIYL

SEQ ID NO: 40557 - protein, 262 aa, A.fumigatus
ETIADHRPAGAGQGGLTAAARLKMLGVDSLIIDKNESVGDNWRLRYRQLVLHDPVWYDHMPYVKFPAHWPIFTPKDKLAEFFECYVKMLELNVWNRTTISHCEWDEQTTTWTVSLSQKQSDGTCQVRTFHPRHIIQATGHSGKMKMPYIPGMENFQGKRLCHSSQFPGAEKNGSGKKAIVVGSCNSAHDIAQDYQEKGYDITMVQRSTTCVVSSAAITKIGLKGLYEEDGPPVEDADLLLHGTPNTSLESASSSHHFKRSRA

SEQ ID NO: 40558 - protein, 270 aa, A.fumigatus
SSCSVLAPRDEDETALGAIARLKTFNEAVMPEDRDGPGEEDIVPDTNWPDRGLVKLCNVSARYISTTVSNTDSESDSNSVVHGAAKPPLALKNITLTIHPGEKVAICGRTGSGKSSFLALLLKLLDPLPSTSNNHNHEPPVLIDNIPLHRIHRATLRQRLIAVPQDPVFLPDGTSFRANLDPTNTATPEECQRVLEAVQLWGFIQEQAEGLHAPIRAGTLSAGQRQLFSLGRAMLRVPLSACVRRLPPIRKGPRVMIKEGSSSSMKSAPV

SEQ ID NO: 40559 - protein, 202 aa, A.fumigatus
RAFTRRMVRRWKMQTFYCTVPLTPVLKVLQAHITSKEVEHDRELLDGLERAGFKVDHGPDGSGLLMKYFQRGGGYYIDVGASQMIIDGKIKVKQGQEIAEVLPHGLRFADGSELEADEIIFATGYDNMRTQTGMLLGNKVADKVSDVWGYNEEGEIRTMWQDSGHQGFYFHGGNLATARYYSKVLALQIKALEEGIHRYGEI

SEQ ID NO: 40560 - protein, 82 aa, A.fumigatus
RHNKTVLVKTNCLSSETSTTTTGSSSATTSAPTTEAASTKTTSPRSSTSSGGAASATTRCTTSTSGASATTSATGGLLRFRA

SEQ ID NO: 40561 - protein, 134 aa, A.fumigatus
WHSIVASRRTWTRAVYFYNIVAIEAANFDMHNKISRKKKFLQELPFSHNAIIRQYWSRQTVYRRKPPLPPRGPPLPPPLLPPRKPPPPKPPPLGPPRPRGAPPRPPRGAPRPPLAPPRPPRPPAAFFGFGPRQS

SEQ ID NO: 40562 - protein, 246 aa, A.fumigatus
  UNSURE (67): Identity of amino acid sequences at the above locations are unknown.
CHVLHRLPSPHRSELLRLFRIGRRRVIVLSLPPTYCARLPNRWSELADTAMASEESKELPVRPAEGXDANATAPPKAAKATAASNNDSLPDFIIERNKLFEELWQQYLEELKNKPHPEINVLLDLGDGNPSPVPAKAWETTPGSFLRDVPKDISANVVLAKIDGKELWDLNRPLERDCTVSYVPFDSPEGREVFWHSSAHCLGEACECEYGCLLSHGPPTPQGFFYDMAMPDKSVCHSYFFPTCAL

SEQ ID NO: 40563 - protein, 99 aa, A.fumigatus
WNKSLTLENSRVVRESDWPALDSRASRIFKEKQSFDRLEVTKENLKKMFAYSKYKLHYIDKLVTGEKSTVYRCGTLVDLCRGPHIQNTGKIKTFKIMQV

SEQ ID NO: 40564 - protein, 236 aa, A.fumigatus
NSSAYFLGDQNNDSLQRIRGVAFPDKKQMQEHLKFLEEAEKRNHLRIGKDQELFFFDEVSPGCPFLLPNGTKIFNALQALLRAEYRKRGYQEVQTPNMYDVGIWKRSGHWAHYKDDMFKLDVEKREWALKPMNCPGHFVLFGHRERSYRELPLRIADFGVLHRNEASGALSGLTRVRKFQQDDTHIFCTQDQVRGDLTLSFTSYCQLTPPKIASEIQGLFDFLQSILRIVRGLLSS

SEQ ID NO: 40565 - protein, 86 aa, A.fumigatus
AKFDPTLTRSQTVMSVFSSMRYCLGDPHDHGALWAALGFMPFGLFFDFMDGKIARWRKKSSLMGQELDSLADLVWQLRTPEGSRRS

SEQ ID NO: 40566 - protein, 72 aa, A.fumigatus
SPSVVANFQPNLQIKDKVDDLYAGNTTNLTQKVQMGARLHGRQVWDAEAGSLVVKQYSEATAAYFFPILATV

SEQ ID NO: 40567 - protein, 60 aa, A.fumigatus
RHFTVSRLPPFENFSGLRTPDISINSNTTIKMSFRGGGRGGFASGANRGGNFGGRGGEFE

SEQ ID NO: 40568 - protein, 72 aa, A.fumigatus
TYPSPLVANRVTDPLHQTPIGKVDEVLGPINQVYFTIKPQEGIVATSFKPGDKVYIGGDKLLPLEKYVLQHL

SEQ ID NO: 40569 - protein, 122 aa, A.fumigatus
ISFGLAPAACAFALGARTLVDHLLLAFFVLCGLTRLARFNVTVAVLPKDKTGKSKYFEGTPIPTTLGIASLMAYWVSQGWILKDLPLGLAAQGTPFEFHPVVLLFVLHGCMMVSKSIKIPKP

SEQ ID NO: 40570 - protein, 359 aa, A.fumigatus
ASQYPHALLCLLPKMWLDRISGHSTPSCVPLDSRSNSPAPRRSSSLLSPAPPNNRPSPNRQGSSLSVLLTPSDSTTSLPATARGVNGSVLKQGAARSRPSDVADPLEVLKDIIGKQKADVETNECLKASAPEAKPLHLVETIDFGDLSLEEFVSQVGEPRRATSADVSAQTLQQFEKERDKYQELHAAITSCDDVSKSVEVYLNDFQSELGAVSAEIETLQTRSVQLNAMLENRRKVEQLLGPAVEEISISPRAVRMIAEGPIDENWVKALNEIEARMTSIEAKVSGSSSTKAIEDVRPLLNDIKNKVSIISIGPNFESVLTRVAGSGKDPGLPSVPDQSIAFSEHQCSNHPAAALGQV

SEQ ID NO: 40571 - protein, 334 aa, A.fumigatus
  UNSURE (329): Identity of amino acid sequences at the above locations are unknown.
FEFLSYFYAYGLTRSLNCQVIHAGIYYGTDSLKAKLCIRGKQMMYDLCAKRGIPHRNTKKWIVAQNEEQWAAALGTHKLAQTLGVPTRLVGHEEAQRREPEVQALAGIVESDTTGIVDSHALMTYLQGDFEDRGGDCAFLTNVTGIEALDGGRAGYRITAVSADGAETSITAETLINSAGNGACAINNMVLPRERHRTPFYAKGTYFSYSASFPRTSVLVYPDTLPGHGGLGTHLTLDLGGRIRFGPDVEWVDDPTDLKPSPARVQQALPEIKAYLPRVAPEAISLDYCGIRPKLGRGGAVNTGKGFQDFVIQEEAGFPSSTTGGRKDXEHRCG

SEQ ID NO: 40572 - protein, 134 aa, A.fumigatus
REWQAVERIRDYLVSQIRALRSPNINAQIIQQQRLVKFKDLYSYISRAHPQLTGEITQAYINTMRWYYLSHFSRYLQALEKIKVYPSDRNDILGGDPSAPKTGSSFLSSCSSLQSRLMFHRAYYLLGSLWVRCA

SEQ ID NO: 40573 - protein, 392 aa, A.fumigatus
CPRSEHCVLRTSMLKSSSSSAWSSLRTCTVTSRELILSLRERLRRHTLTLCAGTISLISVAICRPLKRSKSIRVIGTIYLEETLPRRRQVRHSCPVALLCSQGLCFIGHIISSGRSGSAAHDPFSLGRRIDILRTSNHMALSAYLAEEDNAFHGIEVPFRNFNLALVDNISAEYSFMTEMFSTLSFHQISRKAVEIFEPVFALGQGLTKQLIENSTDSLGVLICVRLNQQAAFELQRRKVPVADSYINGINMQLWPRFQVIMDLHRESLKRVASNTGRSAVSALSLAGGDDLTQSSAPHFLTQRFGQLLHGILVLSSDAGDDEPVANSLKRLVAEFDGLLTKLSRSGGDAKRREKFLFNNYSLVLTIISVSRIIHSGMCLISDREHRIPMAN

SEQ ID NO: 40574 - protein, 173 aa, A.fumigatus
NGVRCRSRGRTMLLIAQAPFPALLMSVSAVMEVSAPSADTAVILYPARPPSSASIPVTFVRNAQSPPRSSKSPCRYVMSAWLSTMPVVSLSTIPARACTSGSRRWASSWPTSRVGTPRVCASLCVPSAAAHCSSFCATIHFFVLRWGMPRFAQRSYIICLPRMQSLALRESVP

SEQ ID NO: 40575 - protein, 95 aa, A.fumigatus
SKSMLGSCIPVSVRLLICHGYPVLPVRDQTHSGVDDSAYTDDGQHQRIIIEQKFLPSLCVTPAATKFGQQAIKFGDQSLQTVRNRFVIPSIAAQH

SEQ ID NO: 40576 - protein, 165 aa, A.fumigatus
FTVYFAAFLLSGCPASMHMSPLLLHTSTIERPSYNCLQLSSYSGWALSTDICSFQHETFESADAGASATYPMQCSALRKNGHVVIKGRPCKIVDMSTSKTGKHGHAKVHIVALDIFTGKKLEDLSPSTHNMDVPNVTRREYQLVSRPAKAMSISPPDVSLICFAA

SEQ ID NO: 40577 - protein, 67 aa, A.fumigatus
  UNSURE (53),(66): Identity of amino acid sequences at the above locations are unknown.
SWGNQWYVCDYMAGYQLDTCVAVFCLMMSTEGYFKPRILKPADLLLRHAHCLXCRVGCESVRVQTXF

SEQ ID NO: 40578 - protein, 234 aa, A.fumigatus
VNPHINLFFFNSRGSVGRPVTHRKGRGWRGGFLGSAIEQYIKLDMNKWLRVLRHLELMPRPLGQDWSEIWLQKFSGTITIWPKSIPSDFYHILSDLSPERIARMLHVGKQSAFPKIQFIKNRLKIENAIMQGLQQCSSGGGRVMSPILSRRRQDRAQEHADRMVERLDQSFPERQSDYKDESHYAEVSDSLSATSSRPHTPDARRSSMFEEMRRQSAVFFDDPDMYADEDAVTT

SEQ ID NO: 40579 - protein, 543 aa, A.fumigatus
PGVGIVACLPMRGAVTPSDVDVKLLAASKQALGIASQQRFFSLLYIHYECYPTMTSDEKSATRDIYDPNTLPDYDREFIEPDDLRQFEKALNAPEAAPLVALNDWRPVNQRVRKSRRTKPRRSKDETREGVLYTVLKWPFLFTVFAWITVLGFAYTLTRLYIFLYEQFVTWRGKREQLRRELSMQTNYQDWLKAAQALDTYLGNLKWKETDEYAYYDHLTINKVVAQLKQTRKAAEMEMQNGRPGLSDPPAVEELCFLLEACVKNNFAGVENPRLYSETYSGTKDLVQEYMDEVHSCIRLVRDSKQISNEDKYQFFKHLDTNFGRTALCLSGGATFAYYHFGVIRALLDNDVLPEIITGTSGGALVAALVATRTDEELKQLLVPALAHRIRACHEGFTTWVRRWWRTGARFDTLDWARQCSWFCRGSTTFREAYERTGRILNVSCVPSDPHSPTILANYLTSPDCVIWSAVLASAAVPGILNPVVLMTKKRDGTLAPYSFGHKWKDGSLRTDIPIKALNLHFNVNFTIVSQVSFAFHWVTSYK

SEQ ID NO: 40580 - protein, 69 aa, A.fumigatus
VLIFLWVRDPPYWGCRDALGTYLHSMVWYGTMVEYFEYLRVVGIRYFLPVIFFLAAFFYSYNLCKIIMS

SEQ ID NO: 40581 - protein, 68 aa, A.fumigatus
YKRKPIYSRGMSYANVTHHVQKKWHYATGFPSSFAKIPGDRLRMVTWRLLTPLPTSHQPSMQASENRN

SEQ ID NO: 40582 - protein, 148 aa, A.fumigatus
  UNSURE (30),(31): Identity of amino acid sequences at the above locations are unknown.
EPFTPWASRAFFSVMRTCIFAHVGIRKTRXXWAAEINNLAKSVPGAVGSIWLRLSLFYILGSLMVTITVDPKDPDLFGASGTNASPFVIAYRNAGLVPLAHIMNAVVFISVVSTGSIQVYAGSRTLMGLAHLKMAPKVTCSTPASPGS

SEQ ID NO: 40583 - protein, 193 aa, A.fumigatus
LNSSQFFGKADKVGRPVAGLVLTLVIGGGLAYLNVSNSGAEVFTWFSNLTSLLTLFGWGMICLSHLRMRYAWKVQGRSPSELPWKSWTYPVGAIWGLFWCVLLIVVEFYLSVWPLDGKPTAKGFFANYVSVVAIIVIYIGSMIYYKGPLLNDARSIDLDQFRRFYVDPRDEEAKAEKAGVKKYLAKGIGFVFN

SEQ ID NO: 40584 - protein, 69 aa, A.fumigatus
CWLVFRPASMPSFHSSLHRTQPSLAKDGPNRPSLHVVAVSVASFPFLLPIPPQTSAIGVGVGLDADCTQ

SEQ ID NO: 40585 - protein, 500 aa, A.fumigatus
GFGKQGQTGVVRIFITPDAGWYLDLPPCPPSILLSIARSLLWPKMDLTVLRSMSSRFPWPLSLSSFLSPRKPRPSALVSVSTQTVPNSRPPSVKVHTPSPEEELHARREIARSDAEDWLQSLVGQDNIKRRLNEIQTWITICQRQGKDPRQEWYNIVLEGNEGTGKSTVARVYANVLFSTGITDVLTFREISGAALAAQGCEGLKHLISDMVDTASPSAQIVGVLLVEDAHLLVTSSSTRTQEIFNALFEAMERTTGRVIVVLSGHPPHMEGLVRSHPRLERTICCTLHFADFTSNDYLTMLAQSLRERYNGKLEVAGGLDGPFMQMAARRLARAAAGNGPRNVHAVQRLLDTITLRQLQSHMTQEEDNLEEVDTFFFSPEDIVGLRPADVLAKSRAWADLQKLVGQEAVKASVSELLDTIEENFWREARNQRPFSVRVNRIFVGPPGTGKSTVARLYGHVLADVGLLSSGKGELSIFETETAALTTAVVEMRVSQRPDV

SEQ ID NO: 40586 - protein, 475 aa, A.fumigatus
DLLDSSIGKVLLVDVSDLDESSQIWLKTLISQLSLIPRHDRCVILVGTNSSIEALVQEKDLLKLFRQHHIVQFHSFTKAQLRQILEMKLHDDEVHVTSEALDNAVKLLEVARMRKDFNNGRAIAHLLGSAHSAYERSRSQGEGTQSQLARILVPENFEDDLSSCRSKLDFREELKYTLVSDDLITLLERYRHDLKAAWLLNTDPTRRVPLAMVFKGAIGIGRRIFARLIGRLYYDMGVLDSGKFMECSATDLALNACNPSTPTRSLLERARGGVLFIEDAHRLSEIESAARTINDLVYLMPKYSRDTVVILAGSGPEMDLLLCNQPRLSSLFQEEVVFKSPTPRECLRLLDQRLQQEKIPGSRPFLTDTRTETYREFTRAMQTLSLFPCWSNARDIDVLAMWMVSSVLRAVPLDGDSLCAPQLTEEQAMACVIKMYNLKRDRLRFNQDPKVKSLPRNLSQPRSSPSIRSAVRFPV

SEQ ID NO: 40587 - protein, 112 aa, A.fumigatus
PEQVSNCSAIVEVLAHASDFEKFNSIIQRLRSNMNFVVVQLHFKDLTQLCFGERMELNDVMLSEKLQQVLFLNQRLNAAVGSNQDYTAIMARNERQLRDESFQPNLRRLIKV

SEQ ID NO: 40588 - protein, 208 aa, A.fumigatus
IYHGDRFHLMPIITPAYPSMCATHNISMSTKAVILRELQRGGDIVDKIFLKQLTWNDLFARHSFFTQDYKYYLSITASSRTKEAEAVWSGLVESKIRHLVGALDRKPTIAVAHPFPKGFERVHIVSNEEEAEAVKNGSTKYQDKGTKTETTDERKDAAHQAAALSGVENAEVEPVGEKSVNGDSHIIYTTTYYIGLELKPLEPGMYGA

SEQ ID NO: 40589 - protein, 69 aa, A.fumigatus
FWSTPAGYKMSTPPVRQWGVTPPISTALPTPEELAANDDLISELKAQNNFESPAETERRWDQPGYISLC

SEQ ID NO: 40590 - protein, 63 aa, A.fumigatus
CFALTPCLLSGRKQVLQLLQRVTHEFVKVVSRKKGLSPAAVEAAGGKIFTYGSYRLGVYGPGQ

SEQ ID NO: 40591 - protein, 154 aa, A.fumigatus
HNRRDIDNAIGSDIDTLVVGPKHVLIDDFFSDFPPVLEKMAPPGAIEKMTPVPDAFVPIIKLELSGISIDLIFARLIVSSVPLNLDLKNNDYLRGLDEKEVRSLNGTRVTDEILELVPQQKTFRLALRAIKLWAQRKDIPSVSLSPLIISRQPC

SEQ ID NO: 40592 - protein, 138 aa, A.fumigatus
HRLTGRAIYSNIVGFPGGVAWAMLVARVCQLYPHATGSVIVGKFFRIMNKWAWPQPVLLKPIEDGPLQMKVWNPKVRASKALHCILRDIDINDRFTMATGSTLCLSSPLRIHRCVRRTTSQCPQKRLSFASSNGEVIL

SEQ ID NO: 40593 - protein, 170 aa, A.fumigatus
STSAEAGTHVVKTDEDKVLNPKKYFIIIPALFGNGQSSSPSNQPNAGPFPKCSFYDNVRAQHKLVTEHFGIRHLRAVIGWSMGGAQTYQWATQYPEFMDVAIPFCGSAKTSLHNQVFLEGVKSALLAAKHVPSAGSGKIGDLKADQTLGTWSAEDREIGLRAFARVYAGW

SEQ ID NO: 40594 - protein, 295 aa, A.fumigatus
KRVGSSQVHVSDRRHRPPRRQYIARPLPPRSRRRAVRVRPCRCMGAGPLLLSGRTVHHQRCTLCSRGGESGPSGLDTVRQRRDLWVQKLESEGLCHGESAWAVRPRATALDHNRGYPNRRARWRIQETHKFPQGRRRHRQRRSGVRHACFRRRFATGYVRTLSVVDPILSKNSRKQRKTLPLPHWRSLRLLPARNPLHPTHHSPTTGSPLPSGNRRSHPRRLLRPQDNRPAQSPNRHPRRNRHPRHHRNGRRGSDRLPRTRGARDPPRCSAGRNAPAVRQGYAGHDESEAGDGAG

SEQ ID NO: 40595 - protein, 282 aa, A.fumigatus
KYLFLYTKSTCHPQKKYPALPRESTLAQLPPEYPADAQEQIVQLLSTSSLNRLVVLDDDPTGTQTCHDIPVLAVWDVPTLIKEFQQDSPGFFILTNSRALPPLDAEKLIRGICENVLEAARSTSQTVDIVLRGDSTLRGHFPLEADVAQSVFGPADAWVLAPFFFQGGRFTINDVHYVAEGENLVPAGLTQFAKDATFGYKSSNLRDYVMEKAPGRFAPEQLHSITIEDIRTGGPDGVYRKLISFPKGGVVIVNAAAESDMHVFVAGLLLGTSERFLSLIQY

SEQ ID NO: 40596 - protein, 171 aa, A.fumigatus
VRTAESKGKHFLYRTGAAFVSSRLGIRSIPPITARQLALPSPRETGGLILAGSYVPKTTAQLKVLTDTRGATGTLAIIEMDVADLIASPERAERVIRRVVQQAETHLQSGKDTLVMTSRKLVTGRDELDSLAIGARVAEALVKVLQQIQVRPRYIIAKVGNRALRSENPSR

SEQ ID NO: 40597 - protein, 90 aa, A.fumigatus
RSDQRHSSDHRTLRTSTGAKPMTLAPGEAVAMSLAAFSVFSTFRPTMQASAPRWTRARTCALQMVPAPPVQKTTLFAEGHISGLVAMSPF

SEQ ID NO: 40598 - protein, 184 aa, A.fumigatus
SCRPLRIARAASTAVERAVSLNHKSTVVCVSDSACQSTKYLTFCYCAEILATLLNNGTSPITGKRILETTTVDEMFRNQIPNLPNFAAQGIPPSKPDLTNEIAHLYPSPTPQGWGLTFMLTGGSTGRSEGTAHWAGLANLWWWCDREKGVAGMICTQLLPFADPQVWSLWLDVESAVYRGLAQD

SEQ ID NO: 40599 - protein, 172 aa, A.fumigatus
ETDRTSQGLSYSASAVTIPSLSLLPTSANALRSLNEVKRLNRKHGLRLTNIANACLIFAYSVSPKHRKHPYLIWMCVASIVGSYGMDFWFHRELGLKAWARSLIRDSGCMSFSRGNSTKKDEDLVVVEAEESVNGESVREEMARERRLQCARAVCSGLALAMGIVGLWGDRK

SEQ ID NO: 40600 - protein, 72 aa, A.fumigatus
QPVLTGNIAGFGYTFFNEKLRDYSKPVGYDEFSGHIYDMLQPLVHQPGEKWEYGVRSSASNAIFYDHLLIVV

SEQ ID NO: 40601 - protein, 138 aa, A.fumigatus
  UNSURE (14): Identity of amino acid sequences at the above locations are unknown.
GRVFAWEMAKLGVXWNTLSEPVFGPQACVTCTPDAPVPITAQRFLRTSMVCSPGQKEEWWTMPWNVSIPGHSGMYRFAENPAAIMRYLDDAVLPSAVLTCQRPSSVSKRASTTTLLKAQSFFTWSTWSTWSKYRLSSS

SEQ ID NO: 40602 - protein, 152 aa, A.fumigatus
FDPITGFLRLTMTSLSPQAVTALKARVDAACADQHKGIPGAVVVVVGKDGKEHFAHASGKRGYGSEEAMTLDSVFWIASCTKTITGIACLQLVERGRLSLDDSDQVETICPELKEVKVLQDDGTLVEKRRGITLRMLLNHTGEWTSPRDSQF

SEQ ID NO: 40603 - protein, 231 aa, A.fumigatus
LGLAIRFSMRSCETTASRLVTTNSQDTSTTCCSRWFISLGKSGNMGCVRQLATLFSMIICSLWFKVNIDWAGVMVERVTGQSLNEYFHRNIFEPLGLNNISMFPSASMKEKLAYMNQRDAHGHLSSRDHLLRRPLIVQTAADRKSCFNSGGAGCFAQPQEYCRMCLGLCLSIYKILNFLLLRRNPCYTAKQRHLTHHRQANPRDNHSRRDVPQSDPQPPQFCRTRHPSFEA

SEQ ID NO: 40604 - protein, 439 aa, A.fumigatus
  UNSURE (108): Identity of amino acid sequences at the above locations are unknown.
RRTAPSTAWWWRPALTQTKAAGRSKRPMGERRRPSTSLSPPGSLQSGTSPSGREWIHSRALSTTPPFGRASTPSMSEESAARLSALARQGCKSRRPGVQRRARSRCSXGLPTWPFPMRKRALSAEAQQEAKALYPELFSFREKAFAAFLYTFSEKSLWEDNEEEREAFLEKLWAEGGFRFWVANYRDYLFDAEANRIVYDFWCRKVRQRIGDPKARELLAPREPPHYFGVKRPCLEETYFEQFNRKNVEVVDIKNNPVVAFTETGIQLEDGTVHEVDVVCVATGLDITTGGMTNMGLTSIHGTTLKDEWKDGAYTYLGLTVSGYLNMFHLYGPQGPTLLSNGPTSVEVQGRWIADAIKQIERQGIKYIDPLPESARAWKKRINELSDLTLFPTTRSTYMGGTIPGKVFEQGNYTGGIPQYLAEIRAALPKFDGFTTVKY

SEQ ID NO: 40605 - protein, 276 aa, A.fumigatus
  UNSURE (93): Identity of amino acid sequences at the above locations are unknown.
HRRRPLAGQNGRWENGVVQVPHYRRRVLCKAVHPRVAGNGYIPGHCPPLLLLAGRAHHRCPKKALRGYRHWRVRGASHAGLGSKDGLAQGVPXDSQLGHFPCENAPLAPRLSKKPKRSIPNCSRSVRRPSRHSCTHSVKRVSGKTTKKNGKLSWRSYGPKGASASGSPITATTSSTPKPTASCTTSGAERSASASATQRPGSCLRRASHRTTSASSVLVSKKPTSSSSTGRMSRSWISRITPSWRSPRPGSSSKTAPYTRSTSSASRPGSTLPLAE

SEQ ID NO: 40606 - protein, 69 aa, A.fumigatus
PSANKVVFCTGGAGTICSAQVRALVHLGADACIVGRNVEKTEKAASDIATASPGAKVIGFAPVDVRKVR

SEQ ID NO: 40607 - protein, 106 aa, A.fumigatus
LGVPYVIYLPVWVASDCFIVRPSPLGTGGRIIFVSATIHYRAMPFQAHVAVAKAGIDALSHTVSIEYGPLGVTSNIIAPGPIASTEVHFPPSVFTTGLQGAAAWRS

SEQ ID NO: 40608 - protein, 243 aa, A.fumigatus
  UNSURE (229): Identity of amino acid sequences at the above locations are unknown.
RNPNMHIRKELSEYASLRGTTGPYADNLSVDVVIVGAGFGGIYCLYEMRKLGLKAVIYEAGDDVGGTWRWNCYPGAAVDSEIPEYRYSIPETWKDWTWSTNYPNYEELRRYFDHVDQVLQVKKDCAFNSVVVEARFDTDEGRWQVKTADGRTASSKYLIIAAGFSAKRYIPEWPGMDTFQGIVHHSSFWPGEHTIDVRRKRCAVIGTGASGVQVTQAWGPKTGSLKVFXRTPNLAISHAKTRP

SEQ ID NO: 40609 - protein, 75 aa, A.fumigatus
QTVHNSAGAAGNFLASIQQLSVNAFKSVIDIDVLGSYNTLKATIPHLVESAKKHRVDSESRMLSTCRFGSHLTVS

SEQ ID NO: 40610 - protein, 131 aa, A.fumigatus
RSSSRGGDSLQCLVSKLRIRITLHLLVLISWSPVAGAQEKIATLRYRHELISGSIAQLEDRVARNTAELEQMSQSYGEEYGDYDNPTTATLEVTDADIEREMEEIRELERRKRALEARVSGMERDLGGLIG

SEQ ID NO: 40611 - protein, 696 aa, A.fumigatus
RKMPAERRSLRSNSKSDTSSSANGEKARSNSQSSSSNKDKAAPNRAAANKAKSPTPAASSNNVSNSGMGEQRDQPHTNGVNGSEDIEMGEDTAGGPTSSFNTRKDRKGDEKMTVVVPPSKGSRLSGEKGQDREEDVVMEAAETDSQKPESEVDPRVKAIQGSFLFPAAVLMDACLTITVITWAIDIKTNFTLLERAVAHFDPRFTLRVLRSISSMRKHITADVLAEVIVETYPPSSATAFFLLEAIDQSGAYESAIASSKMEVDSDKNKSAPKEILPEVDTYLSILVQIYLYDKKDIQGGAKFSTALTERLRTLNRRTLDSLAARVYFYYSLFFEQVAPHPPSPAAAVTSIRQPLLAALRTAVLRKDVDTQATVMTLLLRNYLSTSHIPQADLLISHNRFPPSASNNQIARYLYYLGRIRAIQLQYTDAHGHLIGATRKSPSSHSARGFYQASHKLLVVVELLMGDIPDRAIFRQPALERALHPYFLLVQAVSVGDLDGFLNIVNTHSATFRKDGTYTLILRLRQNVIKTGIRMMSLSYSRISLRDICLRLGLDSEESAEYIVAKAIRDGVIEATLDHEHGYMKSKEVGDIYATREPGEVFHERIRACLALHDESVKVGSRSFFFFFTAPLSPPPPFFFKGFRSSELAFEFITNICVFFCVGHEISHESASPRAQERTGGSGTGTRARQRDSGGGY

SEQ ID NO: 40612 - protein, 181 aa, A.fumigatus
IVRTLGCSWTLLYLLFFFFFKIATPSEINYSYSRLSMRARTVSASGLVLSSRRTPSTSICWQCLRDDLSKQLQTHARNYHPTRRKDASPFGAAVSAAQTIFKGLPKAPPGISVDPLRIVGKELKFLTKNIRQLLGSGHPTLDKVAKYYTRSEGKHMRPLLVLLMSQATAVFTGGARASCQR

SEQ ID NO: 40613 - protein, 727 aa, A.fumigatus
ISQDPTMSSSSVYEPDEDEEASDSDIESRYSSTKFSASSLSIDDFERLESTESKDEDAREVIPRSTRGTRAQILDTLRTSLGIGCVDAYSVELTGTANNTSFSTVGRENYNPTQNGVAIWTSQEKEILFSMLDRKGKNGVAEIAQAIGSKSELEVQEHLKLLHRGLERQHVRDSHSRTVVLGEVPAALEISQECCKALDDYAELLALEEQRAEDVVGRKLHQNLWIVDREVAEMVEEQLEERDQTPLPGSSVYVTAEIFNINKWIRLSERFFMNAGGPRLEDNWVNVACADETPSITADALADFYALTVSVTRRLVHSTLFFAMSRLRNMRETGNRKARIVRSRDVKTALNVLNMPQDHFDFWVGLARRCSLQVADLRHKKGWQSELMDYDEVEEILSGKAPVDESLDARSASRRRSESHPPHDTEDDDDDVSDVYSYASSILSSPEVAPIDEPSVNLEEEHAEEIDQLNNAAEELRLWNLMGQPAPARISSLASNTEQGFKLRKPIGERKTKEDLVNWRDRTLYRSDWEEYGHEVHDLYEELSENRRKRRRIDRHMVSRGSPISVASDRDHEVGGNDDSQGPRHYAVKNHLRADDDRDSDDAIQIEETNDAMDIEGSNHAESGSAGSRDSKMNMGTDPLHQSQEFSDGEQNHPPWSWEPEVNATASEQQDSIPNSKEEVVAVETRKLSNIGVEYDFDSDASLWREEALFTRNERLSGQNPRGGACD

SEQ ID NO: 40614 - protein, 603 aa, A.fumigatus
FFSQRWQVIFTELIGRIPSRNEIGDKSLIIVHRKELVEQAAQHCRRAYPDRTVEIEMGHSHASGAGDIVVASVQTLTRGNRLAKFDPKRFKLLLVDEAHHIVASSYREVLKHFGADETSADSPVLVGVSATFSRSDGLKLGAAIDHIVYHKDYIDMINDNWLANAVFTTVRSEANLSKVKKDSFGDFAIGPLSKAVNTENVNNITVRAWLANAQDRKSTLVFCVDVAHTKALTETFRNYGIDARYITAKTPKDVRMEQLRAFRNGEYPVLLNCGLFTEGTDIPNIDCVLLARPTRSRNLLIQMIGRGLRLYPGKEDCHIIDMVATLNTGVLSTPTLFGLHPDEILQNAKAKDLRDMPLEKTTTGTGTALAGEETEEPPPTPDDLDVNLTFTKYDTIYDLIADLKSEKHIRSLSPHVWVRVGDHRYVLSDASGWLTIDKEEDTSRAYRPRLNPDPTSIANTPDEPYIFTVRHVAKFKNSDDSIMHTRPRLIATAPDFETALRAADTFATKEFEERYVSVRQTWRQLPATEAQVRFLNKAKVRHGSIQRKHLTRGQAADLITKLKFGGKQRFEARRAERLAELRKQEEIEELRKQGDVRVGPVEI

SEQ ID NO: 40615 - protein, 135 aa, A.fumigatus
SPTSNPKNTFALSAHMSGSASAITATSSLTPQAGSQSTRKKTQVERTDPDSTLTRPLLPTHLTNLTSLPSATSPNSRTPMTASCIPVRDSSPQPPTSRPPSAPQIHSQPKSSRKDTSRYGRHGGSSPRRRRRCAS

SEQ ID NO: 40616 - protein, 199 aa, A.fumigatus
QETSTGASAMISTSDNSKSFDSFAEYLKTQIGHTLAAGSVSRGLAKSPGDVTPPSQANKPATLPALEAFLEATCVLPLLGGNFGSFDNLVGNTTHGCAVHTKATFSDAVLQFVQESDTSFLIIDMYFHAFGRDLRVTIEFRSERMIVSRKEAHCSNMSGDMMQHCLSNSDPVIRTSSTAKLIENDERSWCSFREYLLRL

SEQ ID NO: 40617 - protein, 74 aa, A.fumigatus
YVSPQANNGRRAIMRRTIIRIANLITLLEFIFALWGNLASFRGAIVSSVGPEYHIIVVFTLRIGFDIADLFLGL

SEQ ID NO: 40618 - protein, 64 aa, A.fumigatus
RWVKLNKAALCAQAQDPPLFLSITIPGQDVSDRPKERTPTSGGPGWLMPSCKPRLEQFLLLHCS

SEQ ID NO: 40619 - protein, 231 aa, A.fumigatus
TCIAVIMAQIGCYLPCRSARLTPVDRIMSRLGANDNIFAAQSTLFVELSETKKILSEATPRSLVILDELGRGTSSYDGVAVAQAVLHHVATHIGAMGFFATHYHSLAAEFDGHPEITPKRMKIHVDDEERRITFLYKLEDGVAEGSFGMHCASMCGIPNKVIERAEVAAKQWEHTSRLKESLERRKGGGFIGLGWWSDVAWALRETPADTPSSESVSDLSLEVLRKAIEAL

SEQ ID NO: 40620 - protein, 877 aa, A.fumigatus
AKKQISYVESDSEGEDDDDVIFGPNRRNNRASKRRKVSPESEDEFEQGDEVGYSDDGSSHDSSTAVVGLRTNILVEMDDFIVADDSDEEAKPSKKRKRPSNATTRKASSPPAPPSPVEDLDLGVPDASSGTALKWTYDPENLEPRQNREIQATQKSNAAPAKQKVHLKEPEERYPWLANIRDIEGHPPDHPDYDPRTIYIPPLAWAKFSPFEKQYWEIKQKFWDTIVFFKKGKFYELYENDATIGHQLFDLKLTDRVNMRMVGVPEMSLDHWANQFVAKGFKIARVDQSESALGKEMRERDGKKAGGKEDKIIKRELSCVLTAGTLVEGSMLQDDMSTYCVAIKEAIVDDRPAFGLAFVDTATGQFSLSEFVDDVDMTKFETFVAQTRPQELLLEKSTISQKALRILKNNTGPTTIWNHLKPGKEFWEADITVKELDASEYFVSQDDDNLQAWPETLREARDKELVMSAFGALVQYLRVLKLDRDLITIGNFSWYDPIRKASSLVLDGQTLINMEIFANSFDGGSEGTLFQLLNRCITPFGKRMFKQWVCHPLMDAKKINARLDAVDALNADSSVRDQFSSQLTKMPDLERLISRIHAANCKAQDFVRVLEGFEQIEYTITLLKDNGSSSEGVIGQLISGMPDLSSLLEYWKTAFDRTKAKENGILVPKPGVEEDFDTSQERIEQLHRDLDNLLKRQRRELGSTAICYRDNGKEIYQLEVPIKVKNIPKNWDQMSATKQVKRYYFPELRSLIRKLQEAQETHSQIVKEVAGRFYARFDENYTTWLAAVRIISQLDCLISLAKASSSLGHPSCRPVFVEDERSVLEFEELRHPCLLSSVEDFIPNDVRLGGEVPNINLLTGANAAGKSTILRMVSRQK

SEQ ID NO: 40621 - protein, 264 aa, A.fumigatus
SLTVQYLIAKPSMTDSQTTERQRNSLSTHRDSDPRPPYDSITPHAMPPTPPLRPGSGFHSNGHSPSTSSVSAASSSALMKNTESYPQAPIGLPSPTDRSSISSQGSVQHAASAPYASPAPSVSSFSSPIEPSAPSTAAYYQKNPAPNTFQNPSPFPQTSTASLPSPGHQQMISPVTPAWQHHHYFPPSSSTSYQQNHDRYICRTCHKAFSRPSSLRIHSHSHTGEKPFRCTHAGCGKAFSVRSNMKRHERGCHTGRPVATAMVQ

SEQ ID NO: 40622 - protein, 60 aa, A.fumigatus
MSLDATDWVDHREQTSVHSPKKPKFSLQSTWSWNSKKTTTEYVRKTVPLTAGRTPFSLQL

SEQ ID NO: 40623 - protein, 74 aa, A.fumigatus
PGETSIELLKLIATTTKISRSPWAYSTRTKYLRNVCILYSASGTDFTPTIVQTFQNILRNVKKELSHNSIETEL

SEQ ID NO: 40624 - protein, 92 aa, A.fumigatus
QALKTLKLLLVYLVQMGTVSFQNRDIKTVCGIFLYQGMSHWSLRYIGQSRTHELCFKLTGQFYLRIVSRIKDDTYLQRLFNRGRIINGSREN

SEQ ID NO: 40625 - protein, 63 aa, A.fumigatus
VASCYIGILYLRTVSRESAKYLKTLGCTWDLLSNCRLKSHSACIKMAYDDLQTSYKSPNLIPT

SEQ ID NO: 40626 - protein, 359 aa, A.fumigatus
RRYCAGGLSKQSALKVSYYRGFLAAKLEKLSSMKGSMLAVGLSKKDTEEYINRIQDSTLVVACINSPKSVTVSGEAEQIDTLHDLLQQDEVFSRKLMVNVAYHSSQMQKLADEYQSAMGTLEKPSCEKKKIPVMLSSVTGDWVSSLELMDPAYWVRNMVSPVLFSDAVSRICSSSRKQTRKIDRSHRYHMAINHLLEIGPHAALQGPCRDILKSINKQADIPYLSVLVRNKSAVKTALDCAGRLHCYGYPINLALVNKTAYSGTNQRHVLSNLPEYPFNHSASYWRESRKSKGYRCRRFGRLDLVGIPDPDGNPMEATWRNIIRVSEMPWVHDHKINNTILYPAARHVGHGGGSDQAAC

SEQ ID NO: 40627 - protein, 133 aa, A.fumigatus
KTVPGREVQRSREPYLLESKHAIRQRNQASSQTTKGVDVVLNSLSSEGLIASWESIAPYGRFIEIGKTDILSNAKLPMLQFEQNITFAAVDLGRDDNGSPTRCDSGTGNYIVIVKGGEDLPSGSTSSLWHIRH

SEQ ID NO: 40628 - protein, 286 aa, A.fumigatus
DAHLEGISFESWKASTTPKAQGSWNLHELLPRRMNFFVLMSSVAGIYGARGASGYAAGNTFEDGLARYRVAMGEKAVSFDLGMFLNVGVLKDNLALRERTLASTVFQQITESDLHALLDIYCNPSLDEIPLLKSQVVVGMTPKLREKGMTTTEWIRRPFYQHMTLAEGTDAGILGKAEHTNFAALFASAGSVADITAAVTEQLKIKLSKMLSLPLTEIDVDKPIHQYGVDSLAAVELRNWFSRELRADIAIFDILGGANIASAVGLAVRKSDYRRAEWDLDRAQLK

SEQ ID NO: 40629 - protein, 149 aa, A.fumigatus
KKISKGKMTSKYRVLHIGDNIKYNHDVYERFASEFEIIQPTAAERERGEFMRALKERRWGDFHAIFRPFWNTGGEMGRWDAELIPLLPPSVRIMASAGAGYDWADVYIFAQHGACAPNPARRQNHLANSDDKESYTATAPPPPQNQSPT

SEQ ID NO: 40630 - protein, 565 aa, A.fumigatus
RLPWTAQVACIATDTQSIWHWSTKLPTVELTKDMCSVTFPNTRSTILHHTGARAEKARATDAGDSAVWTLSVSQIQMATPWKLPGGTSSESLRCRGFMITRSIIQFSTRRPGMLVMAVEAIKQLVEPDKVIVGFNIKDAVFSSALHIPTHADGIETNLHMKRVREGKADSSGWYEFRICSYDNNTWIENSTGSIQAAFESGEMGLNTNGRVEHEWQKGLVQSYQNAAYKCSEPIDASQFYEDIFACGYHYGPNFKAITALRCDGKPNGQFVSDVRTYRWVEDASSAVAQPHTIHPTTLDAVIHMMAGIVTYGSQKKPVAVPTRIDQAWISNSGLSHPTADSIKVHASSHRSATGDARYSMTAVDCEMTRALLTIRNLRVTALESSEGVSEDDQLQTENLCHHIEWKPDLDLLENEEIRAFCGSGESISEDPVQYFTELDFLVTTYVDKVLKSIPDVKIDHPPHMQRYMEWMVDQQRALELGYSPFSSATWRNRMKDESFVNDIHAKLESTNKRGLLVSTVCRNLFKFVKGEIDPMVLLFQENLLDDSYYEMVSQGATMTFRMTAR

SEQ ID NO: 40631 - protein, 523 aa, A.fumigatus
LISSPTVGESLYSSKSPGRALSGRRLSLACLKDGGEVRLSLLCPKAEIAQASLTLSGLEPYRQKNPCADPAQWDRHLKEAGFSGCDVVMDDYSHGDCQEASLILSTAVDDTPAVEKSLKISIILDPANYAQVELAGELEAQLVRAGLANVTQRPVGHSLIQEDPTNSLDITVLEGYSPHLYEINEQEFKRLQSLLSSTRNLIWVNGGGGQEPCPKYRLVDGLFRVLREENHRTRLTILSLDQKASIKHQAQQIAKLAISAVTHDTSIDTDYTELDGMLHVGRLVHATGVNQEISAKKLPQQKALRQFGAGPRLRLEIGSPGLLNTLHFVEDTSHRKPLKPTEFEVQVKSVGLNFRDVLIALGRLDSEALGAEFAGIVTKVGPSCRKFQPGDRVLACYPSRHANYVRLKENMAVIKIPDTMLSFSEAAALPVAYATAWIALNQIARLQQGETILIHSGAGGTGQAAIQIAQLLGASVFTTVSNENKKRFLVEKYNVPENHIFSSRSTLFAKGIKLPHKQQRASM

SEQ ID NO: 40632 - protein, 69 aa, A.fumigatus
SPDELQKSKSDTNVNNPAYGQPMSTALQVALVDLLDSWGVVPSAVVGHSSGEIAAAYFCLPIYSLFQCD

SEQ ID NO: 40633 - protein, 123 aa, A.fumigatus
QPDDHDLQVHSLPRIRQFARYLDAQAHKNPHMKILEVGAGSGAMTQFCLKVLSTNSENDATVPRYGQWNFTDISGSFFPKAQDLFASQGTRMRFKMLDIEQDPGLEGFECGTYDMVVAFLVSS

SEQ ID NO: 40634 - protein, 143 aa, A.fumigatus
TVLETRPEYLFSPNETYLIAGGLGGLGRNIARWFVERGARNLILLSRSGSQNPHAPDLIRELEAKGARVATPACDITDRECLKAVLYEFGQTMPPIKGCVQASMVVSVSLISRYPRTLTDIFAFIGRSFRRHIFRILESFYHA

SEQ ID NO: 40635 - protein, 179 aa, A.fumigatus
TFPLSSESFSARLRKRTGAYVSGKNTQRHIQMTPEKMAKNPSTQRQPAPEPRKPPMIGPIAGPQRGAAEKRLIAMPRLAAGNISAILPPALPNGDDPKKPAKNLSMINVWIFPEPAHPALKSVSKQKVIVKTLRRPNTSLIGAQISGPNANPRTKRDIPRVVTSLEESNSFITSAMPPE

SEQ ID NO: 40636 - protein, 517 aa, A.fumigatus
NIQSNQKSIGEFMDCQRSNINLLPLCYAGSNKEIGTVVAPTMAGFEGEAPQASKIPYWRLVFDPKVVTDEVINHPYAGRGTDDDPFVVVWISGDSRNPMNFSSFLKWSLTILVSLTTLAIALISSAYSGGMAEVMKELDSSREVTTLGISLFVLGFAFGPLIWAPMSEVFGRRNVFTITFCLLTDFNAGCAGSGNIQTLIILRFLAGFFGSSPFGNAGGSIADMFPAAKRGIAISLFSAAPLCGPAIGPIIGGFLGSGAGWRWVEGFLAIFSGVIWICLCVFLPETYAPVLLRKRAEKLSELSGKVYRSKLDIERGKLSLQQTLTTALSRPWRLLFREPIVFLFCIYMAIIYGILYLCFAAFPIVFQEARGWNEGIGGLAFLGILVGMVIAVIYTFPENMHYAKLCRQTTGRLPPEVRLAPSIVGAIALPIGLFWFAWTNSPSIHWMVSIAAGAPFGFGLVLVFLSVFNYLIDAYTIYSASVLAANSALRSLFGAAFPLFTSYLYSGLGGSRDITVC

SEQ ID NO: 40637 - protein, 147 aa, A.fumigatus
PLANCFVGIHWASSIPAFLALACVPIPIVFYLYGARIRKRCRYAAEADAFMQRLVQSNQQEAQREEPVIEKANAAVEPATVDVERDSETGSLSTVPSAIDMSRKASCVSKISGRWLGRTATQYEENPYDIDRINTRNSAISGHYQRD

SEQ ID NO: 40638 - protein, 90 aa, A.fumigatus
KNIYQLLLCSLASIQYVHVKATPYFQQHTVLTVSHQLHWLYSHYTDDYSPILNNDDLSSELQHCSLSEHVIHTIAHNACVEYSFHPFRGS

SEQ ID NO: 40639 - protein, 426 aa, A.fumigatus
GGAEPCSRLDGFEAKGSGSFGEVAWFDGGATTSGRSRGSTRVQDRAKRSSLVDVASLRSKTISERDGTDGWLDNVLSMAYIGPIGESKEEYYIDISDQSGWAHLWLFPVAGGEPIALTKGEWEVTNILSIDKPRQLVYFLSTKHHSTERHLYSVSWKTKEITPLVDDTVPAVWSASFSSQGGYYILSYRGPDVPYQDLYAINSTAPLRTITSNAAVLNALKEYTLPNITYFELALPSGETLNVMQRLPVKFSPKKKYPVLFTPYGGPGAQEVSKAWQALDFKAYIASDPELEYITWTVDNRGTGYKGRAFRCQVASRLGELEAADQVFAAQQAAKLPYVDAQHIAIWGWSYGGYLTGKVIETDSGAFSLGVQTAPVSDWRFYDSMYTERYMKTLESNAAGYNASADPEGSRLQECAWWGADPAWDG

SEQ ID NO: 40640 - protein, 134 aa, A.fumigatus
RNTPCRTLPTSSSPFPAAKPSTSCSASPSSSPPRRSTPFSSPPTAVPAHKKSPKPGKPSTSRPTLPQTPNSSISPGRLTTAARATRAAHSGAKSPAGWASSKPPTRSSPRSRPPSSLMSTHSTSPYGDGVTAAI

SEQ ID NO: 40641 - protein, 111 aa, A.fumigatus
RRWRATRQGTMPVPIRKVAGYKNVRGGVLIQHGTGDDNVHFQNAAALVDTLVGAGVTPEKLQVQWFTDSDHGIRYHGGNVFLYLQLSKRLYEEKKRKEKGEAHQWSKKSVL

SEQ ID NO: 40642 - protein, 736 aa, A.fumigatus
FVQPGQNEITIIGLDPRVDPDSIRVDGSGSATITDIQTDKVPRRESFEDVYPEESDSELSDALVTDSDEDIGVDDSELQAVRKEIAEVEAALAKARGNQVMSVAVSDFMDGYGKKLSMENADAAKLNDFLQLYVQQHSVECDRYHQSLVQIKEAEKSLDRLNRKRARLEIAYSKAKEAALKDVRKERKKRLREREEKKKKKQQLRSERKQFWTQTVSQVIVHLDSHSIMTPGSSRRSSIVGKAGSDADAIDVTLRLTYVIPGPCWVSRYDLRISTPSSSARLTYRAEFHNSCSETWRDTQVILSTSQASFSGLEERIPQLQGWHIKLDPNSTGLPSWNNILRSLDESGQPHAQAKFLRQQLAEMQKANQQRLNNIPRVPMQAQQAAPASLFGGAPAKPAFGQPSFGQAPAASAFGAPPRAAAESSLFGLDAPQQQAQSQQQPQTMPVIERGERLDSLPASGFGMAMQSQAAPSGSSNLNPGNQDDREDEDEDEDTQTIAAASLEHQDSVKQDYGLTTTYDLPGRRTLVPSKVHRRHVLAELDLKSMTLTHIIVPKIRAAAFLRARIQNTSSVTILRGRAGMTVDGTFLGTTNLPNCSPNDAFNISLGVDPSILVTYAKPSVRRVGGGFFSKEHTAVFRRACWVKNTKSIAVNLIVSEQVPLSEDEKLRVQILEPRELEKEGDQAKMAMEGKGSGSVSLAKNGEVKWTFKLQPGKDIRLTLEYEARVPPGNEVEVVR

SEQ ID NO: 40643 - protein, 111 aa, A.fumigatus
TPFQTIKRQQPSFIQANARQVFANVQSRRQYSSEIADAMVQVSQNMGMGSAAIGLGGAGIGIGLVFGALLLGVSRNPALRGQLFSYAILGFAFVEAIGLFDLMVAMMCKYV

SEQ ID NO: 40644 - protein, 213 aa, A.fumigatus
LDNVFICRRGPSCSQSCNGSPGCLSPTVRIPWYVTSPSHVNNFLLFVSGKALTNIPGSGRPGQLPPPPFGIPPPGGPNGAPPGMPIRTSSPSIILFLFFRSNTDTPTAPPGGRGLPFPPPFPPAPGGAPGGLPPPPLGNMPPGQGFPPVPPPGGFPPNFQIPPPGAGGFPPVPPPGQPGFSPSPGPGMSGPPAPPGTGSSSLPGPPPGLSEKR

SEQ ID NO: 40645 - protein, 106 aa, A.fumigatus
LWILCTGDYCDVYLTHDSMSVRKAHNAGRNHLRNVVEYYQRTQPLPFRSHSLSLTVLTIGTEIGQEKAQSVIDSITSSYAAEGQAVPNPAMAPPGAFPPPFGFPGM

SEQ ID NO: 40646 - protein, 77 aa, A.fumigatus
RSTDMKARITSQVIRHNDQPELNHRFSLSPGGGPGKLEEPVPGGAGGPDIPGPGLGLKPGWPGGGTGGNPPAPGGGI

SEQ ID NO: 40647 - protein, 193 aa, A.fumigatus
SLLAPYQWIRRVSKRFSACIELALMMYRYVDRKQAESLNLIHSTGSSVSIRVDNKTRVGYAPRGRKSVRLESKKGYDMGLFIFDIIHTPYGCGTWPALWLADTYNWPLNGEIDVLETTNRATEGNVVSLHTDKGCTVKERRKQLGNAQYSTCDDKHGNAGCTVQARRATYGQELNEDGGAVWLPSSAFLGQKY

SEQ ID NO: 40648 - protein, 376 aa, A.fumigatus
VMVIVALFKAGCEILAKNGRMKSDKFSDFRNGWKVVARGILFRLTLIGFPQMCVLCLWEFTQHNSAAEMVLAVIMFLSVLGALGWAAFKVILLAKRSVVMHKNPAYILYSDPTCLNKWGFLYVQYRATAYYFVVPVLLYLLIKAMFIGLGQPSPVVQTVALVIIEAAMLVAVSVLRPWMDKKTNIYNITIAAINFVNAVFLLFFSEVFNQPGIVTGVMGVVFFVYNAVFSLVLLILVLIASIYAIVSKNPDTRYQPMRDDRGSFIKSQSQLTTELDALGATARGDVKDTSYKSSPFDDDNGSFSSGNGASIGRQNLQASHDTTPHRQAPVSPVDPSVPLFPSDGRGPPHYGRSPSPIPYRAQHNASPWQRGAGYDH

SEQ ID NO: 40649 - protein, 111 aa, A.fumigatus
SRRRPRQTRGARPRWRRGTRHTGPRARAETRLAGRRDRRESPSAGRRNLKIRRESARWRDRRKSLTRGHVAEGRRRKASRGAAWCWGERRWKGEASTARWCCWSVSVRAEK

SEQ ID NO: 40650 - protein, 130 aa, A.fumigatus
ATRPEAESPSDSSPRKATTWAYSSSTLSTHPTAAEPGPPCGSLTHTTGRSTGKSTSSKPQTELQKATWSPCTPIRAAPSRKDGSSWATRSTRRAMISTGTRAVLFKLAGPHTGRSSMKMAVLYGFRPLPF

SEQ ID NO: 40651 - protein, 122 aa, A.fumigatus
VKNTDPFQIYAVELREAGIRVWGFPRDSIPDDISSMERRPDPSSWGPALADFPSTHCDIPSHFSNQSIIVNIDLCGEMGAQREEYNDLYGCPATCQEFVARNAQNLSQAYWEFRSFRIYQTM

SEQ ID NO: 40652 - protein, 92 aa, A.fumigatus
SSPLSCSRFMTSSEFNLDLHVLAKGYTIPETQEWNWILGTARFAQWILTVSVENDHTPHPVLLARIRVLHKPARVEMGSVPFIMSAPAVSAG

SEQ ID NO: 40653 - protein, 79 aa, A.fumigatus
SWHTWRIVWDRTLSTWQSETITWYMDGQFFHQITGSQIGDSNVWATLCHDPLYFILYVAVGGTWVCLEILLELCILPNV

SEQ ID NO: 40654 - protein, 154 aa, A.fumigatus
ITVADQFFVKHLSLSAEDAHMLHQKYYKEYGLAIQGLTRHHTIDPLEFNREVDDALPLDNILKPDPKLRKLLEDIDKSKVKLWLLTNAYISHAQRVIKLLKVDDLFEGITFCDYSRPPLICKPSQDMYEKAEIEAGVPSTEQCYFVGMLFSFAL

SEQ ID NO: 40655 - protein, 64 aa, A.fumigatus
ALSGKLVRTQVPLGWRNVKTLYHQYMDGIKPPTLVSEEYRQMYLETVQSMCNEAAVSDEGDEKF

SEQ ID NO: 40656 - protein, 61 aa, A.fumigatus
CYGLIAYARESNLDLHFPHLFLIDSSTLTVISFTLGEQWRLRNVPLGQYLILTHGQFSSLT

SEQ ID NO: 40657 - protein, 342 aa, A.fumigatus
LLNPPHQIAKRQLLHPNYSSAPGVLSTTMTGSTSYLDALQRDGFVVIPSLLTAEEVEHFRAIATEATTLARTGQWPHFRTVPKQFPPWPKTAPPASEGGIWGVQHLLHPQMPNRTEFARFYFSEKVLAVAEELLGVKGTSTEATEPLVMELFNLLVAPETKDFELRWHRDDIPETVSPEEEMRLLQAKSPQGRQSHAQYNLALCPDSSLIVVPGSHRRVRTETERSAGPYEPELPGQLVVELRPGDAVFYDSNILHRGVYKAKSQEGEETRLTLHGSIGLKVSASGSDADEKVRATAVLQHGVGSWVHHEDAAFGIGERAKKMRANLIALGTGEGVGYSLQG

SEQ ID NO: 40658 - protein, 75 aa, A.fumigatus
  UNSURE (50): Identity of amino acid sequences at the above locations are unknown.
RSDIRTDFFWTIYNRAAVIIMTITRPSSAVRRSSSVHVMVHNVYMYIGAXQVRAYFIHVFLRIFTTPAEHASKQR

SEQ ID NO: 40659 - protein, 594 aa, A.fumigatus
HSSGRWKSRESALFILNQLLRDFNEVSQQISFELANGFHNFVTFAIQQEEEFLRARGYLMAGVLAQVASEAFQPTAISYFEATLKAIAEDPSEVVKVSCIRALQDLVASLPASTTVPLQVPVISALSEFIAAHDLQEPSESDDLKVTLAETIRDTIMVNPSVVLSSVAIDVLFNIASNGATNFQLTMIVTEAFEDIVQSISEQGADAFIRLCEKVLPSLMGAIDVGNLTHENALTNFAADLLRALTEGALQPLPAGFVETVMPKLNRLLLDSYDAELIRPATEAVRHILSHDFDQFVAWRDPQTGKEAVEVALIIIDRLLGPSVDDNAATEVGQLAAELVERAGAERLGPYLPQLLRAVAQRLATAQQAQFIQSLILVFARLTLINAREVVDFLAQVDINGQSGLPIVLSKWLENSVNFAGYDEIKQNIIALATLYNLEDPRLAQVQVKGDLIIQDTGRIKTRSQTRNNPDRYTTVSAPLKIIKVLVEELAAASGNKEIDAATAAALEEEDSDDDGEWEDIPSNTLDLSLGITKQELMAFGEGGSEGVFGVRKRDDETQAFLLDFFHNASSKPGFDQLFAALTPDEQEKLRSLG

SEQ ID NO: 40660 - protein, 89 aa, A.fumigatus
PWKRNSMAAECWLHNVQEGVGTYVASACKSFYCLCSSLAWRRIIMFCIVRERDGAADRDEGYSVALLNGYSPRDADGTVLGTSETNIWI

SEQ ID NO: 40661 - protein, 333 aa, A.fumigatus
YNSCIITPHPSRFPLFNSPKTHELKLTTNRQTSDEDSLCDAQSIIDSNFSLASTTRDYLYENGRRYHAYRLGHYPMPNDEEEQDRLAFMHHLFKLLVGGDLYRAPILNDGRPKRILDVGTGTGIWALEMADDFPDAEIVGTDLSPIQPNWAPPNCTFNVDDAESDWTFTPAEAFDYIHARSLGGGIGDWNRFLRQAYRHTKPGGWVEIQEYETWIRSDDGTIQRAPMLLDWQQKIDEASTRFGRPMNVASSLAGWMQEVGFVNVTDDSYKVPLYSLSLSMWLRSCERLVVVPSGLMAQESPVERNRESGQDHTVRGRGAVYFSVVYSRARLEW

SEQ ID NO: 40662 - protein, 142 aa, A.fumigatus
PEPSRPRRTLTPTPSAQCSHAASASFPHPPGTSPCTLPDGEYYYHRTPHPPVEAPPPTDPATQAHTARHCAPSPYAPADATRGPQSARNPDTAPDYTAHATADPAGSWPAATASPPPATPSREYHRGASGARSPSFPARQAD

SEQ ID NO: 40663 - protein, 202 aa, A.fumigatus
  UNSURE (3),(4),(5),(7),(8),(10),(11),(12),(13),(14),(15): Identity of amino acid sequences at the above locations are unknown.
WNXXXGXXGXXXXXXMSGTFQPRGEDIASADFPDEWPELLPSLLQVINDVNSSAGTLHGALKVLLDLVDTGFSEEQFFGVARDLVTTLFNIATNESRKPMLRALAVAVFRSCFDTLEMVLEQHKVAVKQFMDEVLSGWSPFFIETLKAPLPQAPSEQEESKEGEVPSQWRGIIGLKLQVVKVGCLNNLETSPTRTNGIILHC

SEQ ID NO: 40664 - protein, 180 aa, A.fumigatus
TLMKIRMVFPGLMTAQSPVYFSTVWTELSNIQSAYHDFYIQDERQGRLEDVDGLPYTLDFLVLEELDLIQALLKAPPVKAELQQQLQNAGQAAATASWLPEILKLASSYAQITTEEEGLWDIDVNLFLSEETSVTANYTPRTCSGDLVIKLGEWLKVTTVEGLLAYMNNLFADSTSTYVF

SEQ ID NO: 40665 - protein, 106 aa, A.fumigatus
NPTYEDMILLSSLLGPAKPPVATQDDIDLAGGLYRLVELAGSLVAEALDGAGTIQIPDGERCLICLGDYEAAEELRQLTKCKHVFHRDCIDQVRPHLRMRLSVQPA

SEQ ID NO: 40666 - protein, 802 aa, A.fumigatus
TIIATSHSHIFVAMGQSSSTQRNQHHTTPSDQSTFLRTDRDQLNLNEDMNHRSNSDQAEDTALPSGAEPNDGISHTSHLAQGNPGAATWQATGTPNAEQPHLTRMESIHEEDGSRHEPDQQEYRSAILARMAARRQSTMSRLGSRILPNSVIRGLLNSEEETPAEGQAHRHGIVARSVPRSDSYSSSRFSPFTSLSSRSIARRRLIRVPYFIPRADPSLTPDTHTSLASLDSSSEQATQPARGSWRRSARLNRVRNSLSAPITQIFGHPSIADSEMTEHPHFREDLGDHPEIRLPPLSAMDTSMDFGHAHELDSVEAAAGDNHLPMPPLFSQSTQNASASRQLPGTLSARPSRVLRRDEHTPLSRVLQLAAAAIAAQLSGAAGPVLPNIQSLGNDGIEGSLENFIQSLQHATSAQTASNDTPSASGENSPPQPVNFLRVFRFANSDNPSPAASSNHSTTEPDSASSRGDGMDVDNPAGNNEGRTVTLVVVGVRSVPTGSGPFGDQQSNAAPGLDALLRLPFLAPGNPPRAQDNSPAVPLADNRPQFVPNRQQHGAPGPLSTNIETSHQGLRSARRFSDAGSRVPFPPLPSTLSESPPGPHPPPSTPAEPGLSAVSSGASTPNRRLSSASALPSNPLPQVDEHPLMQPSVEPAPESTADRIPFQPSHQRRRSDSEYARHRELGSGAVRRNGVVEPDTPPPAGRSWLIYVVGTNLSENHPAFATPSLFTDVSCVFGMPRDSKLIQFIEPHLRRYDSPFVASWTREATGCHPGRHRSRWRTISTCRACRIARRRGFGWRWHDPNP

SEQ ID NO: 40667 - protein, 64 aa, A.fumigatus
EWKSQQCVQAGRSIRLLIAKRPTACGNRSNAHNYQSNGAALVIPGGIVNVHTIATTTCRIRLRS

SEQ ID NO: 40668 - protein, 188 aa, A.fumigatus
PAPSFARALCSSPPSCLNDDANNAKKGPVYLTPDQLALYNGTDPSLPIYVAVNGTIFDVSANRLVYGPGGSYNFFAGRDATRAFVTGCFQEDLTHDLTGVEEMFIPLENEEEDKKLSSGERKIRREQDRRVALGKVRKQVAHWENFFRNHKKYFAVGKVVGLENLPKEKRELCKAARQQRPKKREVVG

SEQ ID NO: 40669 - protein, 61 aa, A.fumigatus
TALTSDGASPVSYPCLNDFDVSLTLSRSGKSSIASVVFHKMPPNETLFLESTTRIQKDSIQ

SEQ ID NO: 40670 - protein, 243 aa, A.fumigatus
VLPCTAVSCSYTVFSSFMDFQVWDFPGQLEYLEPSFDLEAIFGSLGALVWVIDAQDDYLDSVARLNRTILTVQQYYPNINIEVFIHKVDGLSDEYRTDTFQDIVQRISDELSDAGYENAPVHYYLTSIYDYSVFEAFSKVIQKLIPNLSTLENLINTLANNCGFEKTYLFDVLSKIYIASDTRPVDMSCYEMCSDYIDVIVDVSELYSWDHPDRKPKGDQIQEAESHVVLHDETMIHLMEMNK

SEQ ID NO: 40671 - protein, 245 aa, A.fumigatus
WQVSPMSTHPKSRQLHNMMAGSSTAFLSDDGAFAAQLNGKDLIIHLSPLCSDFQEVEIVKLKETPIRFLRFSRPNQLAQSDTINRQKESAERRILCATDTRILVWDLHPLQLHAEIENVEYGALNIDFGADENEIIVFHAWNTKFTIHSLDSGRSQVIKSPKVSHYNGFGFRPRTRQLAILLKPETSDVLTIHEYRSYELVNRVNLPTSDAQGLKWSPDGNWIAVWDAASAGYKTLNIYSRWKPF

SEQ ID NO: 40672 - protein, 90 aa, A.fumigatus
FHCTVKDKAQHAVVLEKQTAERLQKEVQSYRLITVATLVDRLKINGSLARKALADLEEKGQIKKVVGHSKMTIYSMCPHCLHFYKCGCRC

SEQ ID NO: 40673 - protein, 98 aa, A.fumigatus
PDRNHHTRQFCYNINPPPPSSSAAAASPPYRAPSSPWANFPGRPPFPPQSTSCGYGRNSPSEPPASAPCPAPPSYPAPAESSSPHCSASCLPPHSQGG

SEQ ID NO: 40674 - protein, 75 aa, A.fumigatus
DRISDFSTSYLLGDGFTIMERDVQLVYNLNSFRAAASAFRYIIYMVTLLVVLFIASLYYVHLALNSLSRHSTLQD

SEQ ID NO: 40675 - protein, 133 aa, A.fumigatus
QGVGRRVGMALGAAFIILGTIVQATCTNLAGFMAGRFLLGFGVATSATAGPAYVSEIAHPSWRGSLTGLYNVLWFAGGIPGTFIPWRTSQIEGTMSWRIPIWVQMVFAGLVLVLCWTIPEVCPSLLFFFFIYL

SEQ ID NO: 40676 - protein, 246 aa, A.fumigatus
AFFGQWSGNGPVSYYYPQMLAGAGITSNTTRLLLQGLQNVCQFVGAIFGALLTDRIGRRAQLLTSTALMVLLFSIITALNATNVDPPDDETGGVVVVVAKSAVVARAQIAMIFIFGFVFSAGWTPNQAMYPVECLRYESRAKGMGMNNFFINVANFYNTFVTGIAFTRAGWRYYLLFIFWDVLELAVIWFLFVETSRRTLEELTAIFQSRNPVKASLARDEVLIPQVEQEVEMRRKDYDRRKVDLT

SEQ ID NO: 40677 - protein, 226 aa, A.fumigatus
SDSAHRLFMIGRSFYRLPFERYCPSSASGKRPHSLRRWFQRNLFFRSSVTIDRVQVAHSLATAPSTARAQLPQYGRRPLPPTPLAHAHLSGAAEHKHHENHAQLRRLHPRRRRRRHSHRRPDRHHHRRRRPAQTDQNDARRIPHLLRLDDRLGELPLRARPRLLHTLPGDAAPDARQEQHLQSARGAGGGWGRDRRATRVPDSAGRGRQLARARAGGRAAYPRGGL

SEQ ID NO: 40678 - protein, 101 aa, A.fumigatus
SPRWLVSRDKHEEAIRVLATYHGDGDRNAPLVQLEYREMVEDISNTGADKRWWDYRELFNSRETRYRSMLVILMGNPRPSQSMSFMSFHVNSCQFRQTERY

SEQ ID NO: 40679 - protein, 241 aa, A.fumigatus
RSVSLLRTMVRQRPRLLLLPTDAGRRRHHLQHHPAPPARPAERLPVRRRHLRRAPDRPDRTARAAPHLHGADGPPLQHHHGAERHQRRPARRRDRRRRRRRRQERRRGARANRHDLHLWLRVLGRLDAQPGHVPRRVSAVRVARQRHGDEQFLHQRGQLLQYVCDGHRLHPRRLAVLPAVYLLGCAGAGGDLVFVCGDVATHARGADCHLPVEESRQGVVGARRGVDPAGGAGGRDEAEGL

SEQ ID NO: 40680 - protein, 82 aa, A.fumigatus
YTVQSSASHRVKDLPPLLRRNGQTQRIIPPPESTPTLPWDSPQAPTWCPQHTAPQTKPAPRADPPFPSTPCYTTCYSHTATD

SEQ ID NO: 40681 - protein, 240 aa, A.fumigatus
PGLEHQKQPQRKYTSCSIRLHRDPCSPRDPVDISTYVRVPFHWRSSMQFEVRSTEDSVKHEGIPNFPIKSPRSTLSYPPSPLLVPSFPLPLLCSLLYRSLPSLCLLRFPSFFLIVPPPCSLSSPSLLLLPPRFLFSPPLSTRDLSLLLISSLLSLSHYPCLTSPSLLGLYHLFLLLSNSSASSSSSLPPLLPLYSPLLPLLFSPSPSSFPRANNLSFLSPSHPPPLCFLPRLAFHSTSLP

SEQ ID NO: 40682 - protein, 63 aa, A.fumigatus
SFRLISTSCSTCGINTSSRANDALTGFLDWKMAVSSSSVRRDVSTNKNQITASSSTSQKINSR

SEQ ID NO: 40683 - protein, 92 aa, A.fumigatus
NPPEVPFLTPPPPFLCPLFLSLSSARYSTGLFLPFVFSAFLLSFSSFHLPVLYLLPLFSSSPLASFFLLLFPLAISLSFSLALFSPFLTTPA

SEQ ID NO: 40684 - protein, 113 aa, A.fumigatus
INSDAPLGFPASTNLVPPAYGTANQTGSPRRSALSQYSMLHDMLLPYSNGLNPLQTASGICSTSSSTSTCELAPPSRTVRHTRSSTVPTPATSSSSCGLKMLFLTSVRRGIAR

SEQ ID NO: 40685 - protein, 104 aa, A.fumigatus
ILNPTLEPNPSELARFYNSSMYLQQFVRTMALLARSPVASTAIKQCIKLNCYMPISTLYLSLDPCQIFQYSSPISQQVYSSISFSTSMSLIYIYCHCPIFYGIP

SEQ ID NO: 40686 - protein, 207 aa, A.fumigatus
QARKIPYSVTRQEIIQFLGRQARLITPQQGCAIHIIMERSTAKTMDCYAEFQSANDAEETATRINRIYETGRAPRLGNRSVDVEFSNQDALLKDLFPRAKCIIWKDAMPTAVPNDDPFSTGFSGFFTSEEIVNAIRHAEIPHRVSNLPSIQSPVCLLVCSKLTRLSVSILCEVSSAHLRVHHQHTLQGKPLSADAIVRRTYMRETIC

SEQ ID NO: 40687 - protein, 193 aa, A.fumigatus
PSDLTMEGKDTNGQASGHESGYAFTSPYPQSYNMLPFGAPGMPGFAPQQGQYMMAPGNPNPSQPLQRRGPFMYSPFYGMQSMAHALPGVIGQVHGMHSPMPASNTKLQLSVRPKQTGFTPTGSHWAPGSSLHQLLEHDSASRDIATQAVDCEKSFDTVALPAEMPIGSQVHNRMPSQWGVVKIANVSQAFTCL

SEQ ID NO: 40688 - protein, 238 aa, A.fumigatus
LALKRKTVHSRAISCLFSGPMPRRSSRAVPAPAAAPAPIPKRRASDRTSAASETDLKRQKHNSTTAKKVVRSTARKSKYFEDEGNEESDPESSHASEVGEDSDPAYEDKNLSYPSTESDSEEPEVLSTGEERTKRSTRKTANPSGGRKIPARRGGGNEAEEHPNEDIAASLKDKELWREGVSTGLGPGKEVFIRKPKARDPGDIPYQDHTLHPNTMLFLQDLAKHNDRQWLKGIDDRI

SEQ ID NO: 40689 - protein, 186 aa, A.fumigatus
NRTRYFKVIQLQIKRVITQRRVMSNPEVCTIPEVFESRKRKILADLSVPDTEYTDLSPKGSVDEGIRDLIRDINALPGLVTTSSCSGRISVFLEGRKKQNDHQQDQRQFAPSGGKGAGKWLYVSHDPLNGRWTGRDNDDFNSTQGKDCPRSLHELFGMVPGNGKPPGLKGGHAPRLVRFHYDPMVG

SEQ ID NO: 40690 - protein, 67 aa, A.fumigatus
PESTDDLQPNCGVLVCQSSAQCPVFFRSGEGNERIGDVDLESSMRGVNKVAAKKSSIDFALLEMCFD

SEQ ID NO: 40691 - protein, 414 aa, A.fumigatus
PHTGISKNAAIHTLQHFHGVQNWNYISRTICLRSKLPYEPRNFLPISHTSSLSSYPPLSYCHHPHNRMKLHHFLLPVALTATAGAQTLNIVAHEDDDLLFLSPKLLDEIRSGRRVRTIFVTAGDAGNGADYWISRQEGSKAAYAQMSGDENAWTQSDAGIPGFNIPLFTLNNDPNISLVFLQLPDGNNGGEGFGSGSLQQLWQGTIPELTSWGGSSYSRDDLVNVLRNLADDFGYDHINTQDFVHDYGDGDHSDHHTTAYFVHEAFADCASSASITGYMGYPVVSQPANVDGELLQEKKAVFYNYASHDRNTCSSDEACRGRDEALWIEREYIVSEIDQSPCRKAASKAPASTTSKASVSTTSKASVPTASKGSASPASKGSASPAIKGSVSTAVTPSASPTRPHKVISRPLQA

SEQ ID NO: 40692 - protein, 298 aa, A.fumigatus
  UNSURE (27): Identity of amino acid sequences at the above locations are unknown.
GEPRFFCPSWWPPVLVQNRSPGRDVYXCTWGGNMTVEISQNFQRSGSRTRIAFEPFRYQASVAHDRFNRTSVNAFFSQLQLLVKSVNIELHHLLSEHLTLTAKDERNLNEEQLTKYLTNFQVKTQYVVALDLRKTGIVAKEYFFPGIKCAATGQTGSNACFGAIRAVDKDGHLDSLCQLIEAHFQQSKIDAAFLCCDLVDPAHTRFKVYIADPLVTLARAEEHWTLGGRLTDEDTAVGLEIIRGLWSELGIIQGPLEPSAMMEKGLLPIMLNYEMKAGQRLPKPKLYMPLNRDSPKPR

SEQ ID NO: 40693 - protein, 384 aa, A.fumigatus
EESLSSCPLPFKMIYSRPCSSYTFLVAAAIFAVVILWREYAWKFKSQLLLNCSAPPTSINVTGSAIPNQVHYVYILRDVDADFAFQFKHFLSLYSVLQHWHPDTIYLHTNANPKTIENARAGKTGKWNQLIFNTPNLRINHVEPPTVAGNGKPIDQIEHKSDFVRVSTVCEFGGIYLDWDAHPVRDIKALRESGFNSITGRQANGEIMSGTFMAKKDALLLQMWKAEMHKVYDGGWTTHSNSVVTRLGQRLARLPGEVLIMEQDAFGPGSWTTPENIVLYGIHNETVSNLENATDCRSLPSYDEGVTDRWDRPQDFPSWERDYSHTYILHAFSPARNGNPVKDFKHITPKYVLERQSNFARLLYPVTRDMCRAGFVEVNDSYAG

SEQ ID NO: 40694 - protein, 192 aa, A.fumigatus
NDFMWTGWGCRRGDCSRDRALDRRRGRAFTRRRGRAFTRSRDRGLARSRDRRLTRSRGWGFARSFPARGLVYFADDVFPFNPESFITSSAGLIATACVPVVASIIVEYSLLLLKKLSIDVSWLRHDRIAHVTSDGCAAGTISERFMDKISGGVVVAMVSVSIIMDKVLGVDVVVSKVIGQIPQHIHQIVPGV

SEQ ID NO: 40695 - protein, 170 aa, A.fumigatus
FMTESVPTMFPADRVGVPLIGQLALSPAAGRMSVRLRIYTCTVPESQGLYDSAAAESETVCFSMASIVSQRLLLPQRCRTRHSVCEICRSFSSRAPLLAGHNRWSQIKHDKAKNDKAKSRERQTIAKEISSATQSACLTPSLPRSAHAYFFFCSVGSRSQVQPPINSCTL

SEQ ID NO: 40696 - protein, 79 aa, A.fumigatus
LRKHTLSGDCKDLSQTVSRGELRLELRLIFACIQYSKKVGYCFEEYPPIPFAKYSAKRAAKVVPDNTSDRWRREGQYLE

SEQ ID NO: 40697 - protein, 221 aa, A.fumigatus
LRVCRGQRMLTFFFAVWGADPKFNPRLTLALSNAKRAGIPKTVIEAAIARGQGISVTGEALESVTIEAILPHSVAAVIECQTDQKARVLQDLRYAIKDAGGTVTPTTYLFEKKGRIIFEKKDGVNPDDYLDQVIEAGAIDVATDDEDRLVVFTEPTETKSVGETLTKVTGLAIKELDIIWDPNKDTMVELNKDEQVREIEDILSTLREDPSVQDIYLNTST

SEQ ID NO: 40698 - protein, 574 aa, A.fumigatus
  UNSURE (8): Identity of amino acid sequences at the above locations are unknown.
NCTPQIHXSQPFPIPKKMKRQFKKPAPRPGEDDDEAEVSEPSVSKKAEPGLYFLLPDLLRQLSTQYMKSTTSNRARAGIAACYKYVLRSLGDKLVEERYGQIANHLLFELLNHPTVTYNRFRLLMTRRFVKGILEETVGRETLRENSQLNAAKWLINEILKDYPQVLQERREPSKYTLASTLSALSSLISSLGSAFGAMAEACREALLQVLPHPSYTVQIHAAHCLRNFVLACPHQLISCVTICLNSLSREIGQLSTPRQAPRRCVGYANGLSAMLSTSRLQPLYGSVDVFSRVFTQATDLLKTSGKSELRAASTQVQVAWILIGGLMPLGPSFVKIHLSQLMLLWKNALPKHLGKDNIAQRGYLEMSFLAHVRECALGSLLVFMDFNSKLITADGARRIAAMLQNTIEFLDDLPRQKSVADLSQRLQPSLQLHDLTTMVRRRVLQCFSKLIDVHPLSHADVISQTTLLSLSISSFADPEYTQPAPLESSIAAATAQFETLWELCDNFGFGVTGLARQYIRATLSGKQDNENGPAWSAVDLSDQDIDDAVSLSSTSWHARSALTIAVDFSYLPS

SEQ ID NO: 40699 - protein, 445 aa, A.fumigatus
  UNSURE (376),(391),(406): Identity of amino acid sequences at the above locations are unknown.
KFVVDADPIVRTIGAEALGRLCDGAGNTLMTTQVNWLVDTIVDNREPNARAGCAAALGCIHAQVGGMAAGLHLKTIVGVLMSLCNDPHPVVHFWALGGLERVANSAGLTFSPFVSSALGMLAQLYNADTHNEEAASLATSNIEMTFLTPVVISRCVDSLINVLGPDLQDITKTRNLILTLLRQFQLEDNPALVTESSKCLDHMSLYAPGFVDFSGFVTRLQNELSAGNPLMRDVAIRALSNLMKRDATSVLRAATPDLEEQIWLAYDDTPDNLVLKNMILDWLQHTALTETEQWIQRCQNTLTKTRLKVEDIPPTSAVKTAVNDMPDDEVAGFAYAIAGAGQSETVNETVTGQELLKWQTRNFVMSCLSQLLATVXEAILPDQTIPAELAXQHKGGDIVRMAFSAXTANVVKLKVWGLENIEQVLKETGLSLFFNRAMIWLDFGT

SEQ ID NO: 40700 - protein, 367 aa, A.fumigatus
LLQDIPAPVQSFLRQYLSSWNGRDNKEEVLSLLEYLPVQDFDILRANFLTPLEAAILGSGPFTMTVILDLYSSLIRQWGVKLRSSPSVSAESRPLGHLITHAELLALSILESLSVASNTGNKEPRKPAALSVLEFYCVLANLFSYAPVNGQIRLTIPLAPTVYTLVFTPILSSISIISSVLASYKMSFETSLTSEILQVPGSTNSLYPTELVGQFNGYVMDVCNLVWRNRGLNGDDPNALGCLLPPATTSALTQYIRELNEASRDRKREASFFFNLSSIFSLSYHVALCNMSAGCFADIEEENNITEGKPRLRKPVTQKALSALEKDGGVKLTWQEYRVRMLDWLDATGSRGIGNLMRSTMKALRKD

SEQ ID NO: 40701 - protein, 96 aa, A.fumigatus
WSSKLGRCVQINILDAGILSKGTQNVLNFPDLLVLVQLHHSVLVRIPDYVKFLYSESRHFCERFADTLRFCWFCKDHKPVFIIRRYINGSRLDDLV

SEQ ID NO: 40702 - protein, 100 aa, A.fumigatus
TNQGRRFGILPVRNATLAITSAYYRGAVGALLVYDISKHQTYDNVNRWLKELRDHADSNIVIMLVGNKSDLRHLRAVPTDEAKQFASTFVVQAAPQGLIY

SEQ ID NO: 40703 - protein, 79 aa, A.fumigatus
VDSPANEFNLDSKFYPLVSISQPAQSKWTFRPIKGADLGYCRSGTLPWPLHLPITVAPSVPFLCTISANTRLTTMSTAG

SEQ ID NO: 40704 - protein, 68 aa, A.fumigatus
ACFSKHPHRFAPSIHDPLSKWTHMLLEIYRIVSSKALDNGDSGQAPLSSGRTIEVSKAPDTESKQGCC

SEQ ID NO: 40705 - protein, 69 aa, A.fumigatus
AICEYVCCPGSSSGIDLLTSARNTIGENNLSFIETSALDASNVELAFQNILTGSLPLFMTPCPNGLTCC

SEQ ID NO: 40706 - protein, 68 aa, A.fumigatus
CNPRIINSTLWRRQFARGTPKHFARIRACECSCTGPRTTNRRTIINIAGSIAETQNSASSNRDFTYNL

SEQ ID NO: 40707 - protein, 430 aa, A.fumigatus
TLFQIYLLLLCGLVLFTPVETLVADRDQRNNHKYSDAWLEGFDDTEPSIYRIGEELRRNELVAISYPAPDSRMSNVLLAYSPKSSDFAFLNADSAHFRTSEDVFLNVAVRSQLRGFDTITARRERKRLHAGSRKPVPFALINTSDPPSRATPTGALATRPRSVGVPDVSAPEAARPVNDMSNHPIHISRDSDVLLPKASAAPDVAKPSDAANHLGSTNTTSVTPELSTQHSGADNLHAAPQNTLRELELVNVAVQDPAQQTGELLSTSQVPLPKHRTPQAATETSPITSEARTAPEAAPGFPRLGRHDASMAQSIAGNVKSPSQPSENILDLDAVFKEQFGVTYDLLATVNDAEKPTKAQVFYLMFPAGSEVVQEEYEVMHEFLRRHNAVTYSNRLPEDWERFARTIHKGVVLVSQEVPFTNNPTAALTQ

SEQ ID NO: 40708 - protein, 598 aa, A.fumigatus
ERPFQPDVDMSDDDDISITSTAPSEQESEYEVETILAELEFDDGIKYLVKWANYPIERCTWEPPESFCNEQTLIDWNKKKNSIAEGKRPAFDLVSFENHLAALERAKHDRKQRRAAKRRRLGLDGAPQSHPAAESPSSNNVPDPRIPGDTGFNDIEVDRSKASSGQTPRTNASTGSAQLQTQQLPKRPPPPVLFGTAPAPTRPKRMNSSETPKLFNLSTRWKYEKAKTYEPPPDVNKLQLIRQSDWPARTGLTATKTGLYSVNRPSTENDANTARLGSHKVVSPTRDDSSSAKLGTYDASSPNESDLSSVKAGSHDLNSSKQSNASLVNLGLYNVSSPKSVTWGRLATNNVNGSHGISDSALDPQSQDVSSPMDLDSDNETQGQISQTREDWALSSPKRVQDGSYKPNDSIPDTYRPACGADTWIPARPLQDSWCASHDSVKPNTIPPIHRQELEDYPIRKLPTREPKPGAYIVKSQQQYFWNPGELLVYLYYGLEKKEIGSARLCGLSPESRSRLMSTKRGSRINIWFQHTCNLEEYNVLCENTVSQFFPTFLPIRSSEHSFKFTFFCFAVWFCLLPLKRLLLIGIRETIISTPMLG

SEQ ID NO: 40709 - protein, 203 aa, A.fumigatus
ILAAANLNNLSMSTPAFSFGTDNRTPEFLAKFPFGKVPAFEGTDGTKLVESDAIAQYVAESGPAAAQLLGTKPVERAAIRQWIAFADGEIQSPVIPLVLPRIGLAAFDEAVEKKNLEKLERSLAYLEGHLSGRNWIATEEKLSLADITVVSALYWAFSTVIDREMRQKYPVVVSWYEKTIESEGVKQAFGEKKFIEKREIPKA

SEQ ID NO: 40710 - protein, 60 aa, A.fumigatus
YSVSSLGQVFGSNTTTATAPHYHNIRVYGFWFGTRGKLQELVFETIRRFAVDGDAGAAND

SEQ ID NO: 40711 - protein, 77 aa, A.fumigatus
CLRTSPKPGSVPPPIIRFVIGDSEWADSVICQPQVLVIVLFAVSNQVCFEIPVELETEAVTMMLPELQTLWVEVPRV

SEQ ID NO: 40712 - protein, 370 aa, A.fumigatus
NPGMSRNLSNCLRTPNSTHVRSPLLRPQEQGLILAVPRLMSQLFESQIFIQIGERHFQISRDIFSGPGDSPNFFSLGFAIFFANPRELFPGLDRRNLLRPPAIVPPRVTHRSGDVFAELLHLLRGYPLQIRNEEHRAELLRDCRYFHLRGLEQKLIPHHISFNPIRQQSEILIRLDDVRPSGISHARDDSSKYPSSTTRDRVTYARPFVDETPHDLILEIGDESTVLDARAMRAGFLNLAKARMSSLAQVVAKSVGLEGPLYRTGESANFSPGGDSFSIRFERETALVLNGQSVDYLDLPGGTAESSDRPPAKRKRAEDDPESGSMVVKKGQWRLVVESGPAASAELVLIAVKLDIYTEERARNRSTGPL

SEQ ID NO: 40713 - protein, 598 aa, A.fumigatus
  UNSURE (214): Identity of amino acid sequences at the above locations are unknown.
TSILSSYHFWAEEGKHHQDVVYHPAAPLLFLVFLLHIQLRSILDGLDPRVLVDSGYSLQAYSTYIILILEATTYYYSSAVFIMAEQAVTAYVPLDVPLPPIPEGQVFSDLQWRTLLSLADTVIPSIRSTSLPKSVSTKVVPESTFKDAVSTLASHIHDPDATQIAEQYLEENASANPQFVEGLRRLFAEYIHEERKSGINLILNALKYVAPAIXTLSTDLLTTSSSKAGSLILTGSTTPIQDQPFEIREKIFSSWETSRIKPLRAIYRAFTAIFKKTWATVSPTIRSVVGCPRVPIHGKPADGFEYEFLQFPPGAEPETIDTDVVIVGSGCGGSVAAKNLAEAGYRVLVVEKSYHYPSKYFPMDFNEGFVSMFENGGATTSDDGSIAVLAGSTWGGGGTVNWSASLQTQGYVRREWASKGLPFFESHEYQQALDRVCDRMGVSNDHTEHNYSNRVLLDGARKLGYAAQPVPQNTGGSNHYCGYCTMGCHSCGKKGPRETFLADAAKAGTTFIEGFRADKIRFKNTKGGRVACGVEGTWTSRDSYLGTAGPDRTTRKVIINASKVIVSCGTLHSPLLLLRSGLKNPQIGRNLYLHPGEF

SEQ ID NO: 40714 - protein, 272 aa, A.fumigatus
NRYCPPPRLSLTTIVVLSCAVFDEEIRPWEGSALTIVVNEFEDQDGQGHGVKIENVVMLPALYLPTFPWRDGLDYKLWAAKLPRMSGFIALTKERDAGRVYPDPADGRVRIDYTVSAYDRKHIVEALIATAKIAYISGATEFHTSNREMPPFIRPTEASDPNAPEGVTNQALQAWIAVLRRKNPVDPERTQYASAHQMGTCRMGSSPRTSVVDPECQVWGTQGLYVMDASVFPSASGVNPMVTNMAIADWASRKVVRSLEKANHGKTVLARL

SEQ ID NO: 40715 - protein, 91 aa, A.fumigatus
FEPHLHKRPTARPGPERRDDGLGDGDHVPIRQEAAPHYRAARHEHRPRHGHRRRLHPGAVAGRAPHRRSAPGRRGGDEAERLARKARRGDP

SEQ ID NO: 40716 - protein, 323 aa, A.fumigatus
VQEGAIWNDVDLNDETPGRIARRLGLTELYEMIVDAGVRAELFLNRLDGYEPLSDDEDDQETGQGEDAANEPAAEEDQDEAPELVETTAADASAAEASTEGPGPDVTSSRYLDSNLTFTNDRLLDQDQNGVMMAWETEIMSRSAKKLLPTTGLRVMNIGHGMGIVDGFIQEQSPAAHHIVEAHPDVVAEMKRKGWHEKPGVVIHEGRWQDILPALVAQGETFDAIYYDTFAESYADFREFFSEQVIGLLEQDGKWGFFNGMGADRQISYDVYQKVVEMDLFEAGFDVEWEEIKVPKLEGEWTGVRRPYWVVDNYRLPLCKFMD

SEQ ID NO: 40717 - protein, 84 aa, A.fumigatus
LNPLTDCTLWLCYESGTQTHGNDVTPHNKDSQSNVIARKENNESLPSLEATEPDQFRKCNKCNRCNKGKNNQSTLKNASGIYTL

SEQ ID NO: 40718 - protein, 1204 aa, A.fumigatus
ILAVFASQRQTHSYLVSVTDNVRIGTSANIGLLHSQPRTYLVPDRERTKPSPPGLFSWVGPVFRTSSSEFIQKCGLDAYFFLRYLRMLLKIFVPLGCIVLPVLLPLNKVDGKDRNFKNATGTGDTWNVTGLDQLAWGNVAPEHVQRYWAHLIMAIIVIVYVCAVFFDELKGYIRLRQAYLTSPQHRLRASATTVLVTAIPDSWLSVEALESLYDVFPGGIRNIWINRNFDDLNEKVKQRDALALKLESAETDLIIKCKKAQLKQAKAAAKKTGMSAKEVEGKQKQATDEHALQLAAGGGISSGDPHQAHTLNQILHRDVHGKHHDEPGEPKRRKPFDPAVEAVGMVGQGVGKLSRSVLGTLKRVEGDIDSTLTRSGGYIPDTGTTAPLQQRAPDVETNNAEQPDPWRPSNDSIAPSIENGNAASMNENGAPSNAPRSRSDSKPRRPFWKSRVSSSYSKASNRTEPDEFPLTAPEDPAEGEASNEERSHNNEKQKGKEPRGRREGDEVDGEEYPVAYNEDFDSEDYGEPLWKKYIREKDRDTMRLPIFGLSWMPSLWLIGKKVDTIDYCRKEVARLNLEIEIDQQHPERFPLMNSAFIQFNHQVAAHMACQAVSHHLPKQMAPRIVEISPDDVIWDNMSIKWWERYLRTFGILAIVCAMVVGWAFPVAFTGLLSQLSYLENAFTWLSWISKLPDWLISAIQGILPPLFLAILMALLPLILRFLCRAQGLHTGMAIELTVQNYFFAFLFVQLFLVVAISSSFSTIIDNVTNVTSWPELLAQNIPSSSNYFFSYMILQALSVSAGALVQIVSLFSWFILAPLLDNTARKKWGRTTNLNQMQWGTFFPVYTTLASIGMFNPTGTTSDVANARNTGLIYCVISPLILVFNVITFGLFWFVYRYNTLYVTKFRFDTGGLLFPRAINQLFTGLYVMELSLIGLFFLVRDVDGNVACEGQAICMIVVLILTVGYQILLNEAFSPLIRYLPITLEDDAVRRDEEFSRAQRARLGFPEEDQTDTIEHQLAEREHQEHEADRRAHEIELKNIEACSGRRASTQTGTLQNNRHHSWADRSSKTRSKYFGTPSSGSVPTLQRVREKIAHDAEAQGSPPGNIGHALFAGIHDELEDLTPDERDQLTQRAFQHDALRAKRPVIWIPRDDLGVSDDEIYRTQRFSKHIWISNEYQALDGKCRTIFSRSPPDFSEVDLIQL

SEQ ID NO: 40719 - protein, 267 aa, A.fumigatus
TGHPRPRRTDACGPPSSAPSTIPTPSMKSPVSYTSTAGALPPETASWVSPCSTGSSPSGAVCLTAEYRLAPEHHQPAQLEDSYSALQWMSDYAAELGFNPRKLVVCGSSAGGNLTAGVTLLARDRSGPQIRGQVLIYPWVDDGMDYVSMRQYADIAPVRDVDAAVLANYAFGERREHADMYTVPMRATNFAGLPPTFIDVGEADVFRDQDIAYASALWKDGVSTELHVWPGSWHGFDVFVPDAPISRRARAARLEWLRKLLSVPDGI

SEQ ID NO: 40720 - protein, 769 aa, A.fumigatus
SSFAFSSLSSFQPCERALITKMEGNSTVALRQLSLSTVSSRSYQALGYSQNDLSGDSGASHNEEPPAYSHVSPAAQVPGRGYSTTLHRSPGVLLPTLLYAGLAIYAWVAIVYLSFRPMSAKSWGALLTENRLYSESVDYARNEGIYRSAVVIWTLIAIMTLPWLSPVCASAAVIYVQNQKTADSLQMRQVTNLADRRWLDLSLYKALVSGGWKKHGSTFLILAIVLHLVAGLTYPIQSIFLETTTINVPQAMDRVASIADLPSLEYPDAAISLIGNDILAVRRALSDADSVTVQPFLWQNTSGVQLHTLSDILSLNDSFYAQLPTGFNTGVLRQFAPRVNSTATYETILASEFPSNCDSTPGSFYSRHYSEYAMSEYRRIWGVTACMPSNWTKSQWQKTRARQEFSETLYLNFTSSKGNSGDTPADGKLYRVTVSTTAGYFELPNNMNDGKHGPLLEQDPVGLCGADCHYQTFDPDLSLSRIRRDNITTTDTLDAVSWDPLATVSKGPLLTTALALFGPGSFLDTFAAKIWAINDSFNRANVTARICLDGPPLLDLMLYQSYSTKHYCLDAPMGTRYGASAADPLIHQWIDYFLKVEDRFPMLFTAAAFLSNKQLLESVSGQWWIYQDLGTEMIIPTISLAGIIVGSIMMALYIIPMVGLAFYAAWYPRWTERLDSFTMLRLGATIGDKLLPLRAAKSVDRIPVLDEIPGVVRDVSIPDGNVVLPVGTLGLGDGRPLEGQRRYEAYKESDEPLTPMECRTLQSRINDDP

SEQ ID NO: 40721 - protein, 62 aa, A.fumigatus
LQGYVMLQDGGSGLQGENNSTLFQNHLDLGLDLEAVALGFQCVQFRGDFVLPGYVVKLTLAE

SEQ ID NO: 40722 - protein, 84 aa, A.fumigatus
LMRSTCWRPWQKAQVPAVSQPTAVVTEADTPDGPGLADQIDALNGTGNPAAQPSRFGEFGGQYVPESLMDCLAELERGFPRSCE

SEQ ID NO: 40723 - protein, 447 aa, A.fumigatus
DQRVGGRGRRPRYRLSRSLPLLLPRPILLTVLDWPTRSTPSMELVILLLSHRASVNLVDSTSPNLSWTAWPSSSAGFQEAVNDPKFWEEFRSYYPYMGRPSSGHVANRLTEYVGGANIWLKREDLNHTGSHKINNALGQILIARRLGKTRIIAETGAGQHGVATATVCAKFGMKCVVYMGAEDVRRQALNVFRMKLLGASVVAVDAGSRTLRDAVNEALRAWVVDLDTTHYIIGSAIGPHPFPTIVRTFQSVIGEETKQQMMEAIGKLPDAVVACVGGGSNAVGMFYPFAKDTSVKLVGVEAGGDGIDTNRHSATLTGGSKGVLHGVRTYVLQDEHGQISETHSISAGLDYPGVGPELSSWKDSDRARFIAATDAEALIGFRTLAQTEGIIPALESSHAVWGAMELAKSMKTGDIVLNLSGRGDKDVQSVADELPRLGPKIGWDLRF

SEQ ID NO: 40724 - protein, 175 aa, A.fumigatus
WIRSRYRQGSQGSGGRLSGYQRSTYQPLLASMYPTFRHGNVRACKGGPANTWELQVYPEEMISTGISAIDTMNSIARGQKIPIFSAAGLPHNEIAAQICRQAGLVKKPTKDVHDGHEENFSIVFAAMGVNMETARFFTRDFEENGSMERVTLFLNLANDPTYVCLCLLRLSALFD

SEQ ID NO: 40725 - protein, 160 aa, A.fumigatus
LLSRIERIITPRLALTTAEYYAYQLEKHVLVIMTDLSAYCDALREVSAAREEVPGRRGYPGYMYTDLSTIYERAGRVEGRNGSITQIPILTMPNDGKQICEQILLRSLSSSGLTVSLDITHPIPDLTGYITEGQIFVDRQLYNKGCQPRRLKSFPSLSRY

SEQ ID NO: 40726 - protein, 124 aa, A.fumigatus
RVLLLRRVDETWDCPTAFVTDKRYSSSFELLLIFANLSCESLQFASYPYLFVDLRGGENKRFLSTAPFRVVARPEQSIVSQANTLYWPVKVFPAIPDFWTGKRRELLVLNAELEYVYNQPERRS

SEQ ID NO: 40727 - protein, 346 aa, A.fumigatus
DRAWPKEGSECKRSSAFSRAGRWWYGWAYVLLHLRTLYLPRPDKHFTGDRGIEEKLKATTLSDQKLTLVHSAKQGPHMLDVHPRTSFDPGSALSTPFGSDDEAELSDIKRAQKLTMQLSAIDTSVPNRSIRTIIRGDFTRLQDESEGGRRRQRKYLVATDLSEESVYALEWTIGTILRDGDTMFAVCAVNEELGIPFGSSVQIGEGAQAMQDSAAIVGSQTEETVFKSSNDSITSNLPRALLGRLGQGTDSKPSSVDARGVPKGQQERNRAVEIISQTCVRLLRKTLLQVRVAVEVIHCKSPKHMITEAVRTRPDAYESATNACPNTLTNLPLDRRTRAYTRYRGS

SEQ ID NO: 40728 - protein, 69 aa, A.fumigatus
CRNAWRAFSRFSIVMEFFLFPLILYDYDLLPWGAEMIFSICDLLLLALFYLLYLSTTVYCVSTFYVVRV

SEQ ID NO: 40729 - protein, 105 aa, A.fumigatus
NCGRGSLPHRSHTDDHLAPSSGAALPDLSSPSPIASFSAQRSSAKDPAAMTESFVDPRMANVKPRIRYNTIGGINGPLVFLDNVRNWAGSQRRRKPICDMNGMTC

SEQ ID NO: 40730 - protein, 84 aa, A.fumigatus
TKVEFTGHSLKLGVSEDMLGRVFDGSGRAIDKGPKVLAEDYLDINGQPINPYSRVCIRPSVTAMSGLARVVQLIRGNSRSTPRK

SEQ ID NO: 40731 - protein, 244 aa, A.fumigatus
FVRDALDVFISSAAQVQDDVACLHGLGEFHGAPDGVRGLQGGDDALGLREGAEADQGFGVGGSDEAGAVAVLPRAELGADTGVVQAGRDGVGLGDLAVFVLEDVRANTVQHALAAAGQGRRVSVCVDTVASGLDTDQLDASVFGEGVEHADGITATADTSDDGIGEFADGLHHLLLGFLADDGLEGTHDGGEGVRSNGGADNVVGGVQVNNPGTKGLVDSITQSPASGIDGHDRGSKELHPEDI

SEQ ID NO: 40732 - protein, 298 aa, A.fumigatus
LLLLIIVAAGVLLRIQHCPSASGAPGTATSYASLKRFPGESSEPSAARRSSDNSDQISIGKKKIVDRNKLDNNDMPVLPKRTIQIQLPEKPPREPSHQHKPSQTKSTMAAMMSGFDLKVSLPSFARGRTPSRQSSSRGASLDSRVPQRRARSSSQNRRLGSNQLNLLSSSKPTKPATVKEKPPPMNNTHATHSDPALPESVSNGTSVTSPDKESESPEPGINAATSSAGDERLAKDLYDSENNPMDSSEDEPDESSSNDDDSDGEIERGRKKAPNASDQAPSLGQVDGGTDGRMYCFI

SEQ ID NO: 40733 - protein, 98 aa, A.fumigatus
KPVVGEEALSSEDKLSLEFLEKFERTFISQGPYESRTIFESLDIAWNLLRIYPKELLNRIPKRTLDEFYARSARKLPAKDTRDNSAENVVGAAPLIET

SEQ ID NO: 40734 - protein, 563 aa, A.fumigatus
ATVRPTTAIISYFAKPSALALRPSIVTGTYPNRGWMETYHGHVRTPADAIILFEACRIGLLPRVQRRLSEKERQSIQSGSVFVWDEREAGMRRWTDGKSWSASRVSGSFLTYREMEGKRGGTVTQPLRAGKTPDSRGSDDDRGDGADDGPDGYRYKPDGLMKQSFSITTSTGQHLHLISYYSRSHPAAATLQQPSTDPALRHVRPQKGLYPESTVNDQQNLPVVTRGPMAGATYSVPHPMSAYVRAGATHPQSYTPPYAWPPTPLGTPPTITLPYGASYLSAVPTPNGPAIAYGQPPPHHHPALPPPPPPQHGLHPQYDRSVHPGHPAESSLPPAIPPPMAQHTPLPALTGRSPRLAPDARDNYQRSPRDYPTPSVDPRIPSPRMQAPSTSHSNGVGQSGRSPRTISQAPPTSLPQVSPPSLNGTSKPGDIQSQQQHIHYLCHHRSQHRGADERRLGSLIIHLIRTVKQTQLSSLGRQSPRRKTDRYPQRKYWVWGRGYAGFAAAGSGLYRLHLDLFFLFIVYQLRLAACRMRSTVISLIIRLSLKMSLRPVPGNRRWRPAFF

SEQ ID NO: 40735 - protein, 109 aa, A.fumigatus
TGLPNQATSNHNNSTSTTSATTVPSIGALMNGASGPLSSISSAPSNKLNSPRLGGSPRAERPIDIPSENIGFGGEDMQALQQLDRVFTAYIWISFFFSLYTNSVSLLVG

SEQ ID NO: 40736 - protein, 63 aa, A.fumigatus
WIGGPYSKDLAQNGVSHSYYDPDWSGIKFGNLSFTAGWTYMVIIRPRRNRCIVTSKHLAQFKL

SEQ ID NO: 40737 - protein, 71 aa, A.fumigatus
WPSHRVRATAATSPPGSSTTASAATWTASAIRPVSTSGSSSGKLITTRYSTTNGATYTSSGTHRTLSSLGS

SEQ ID NO: 40738 - protein, 61 aa, A.fumigatus
NLAAAEIGGYFEPLKHDFITKSSYSCAADIAIAYGLEYGSHCSVGVPIEGVVLYLLPALEG

SEQ ID NO: 40739 - protein, 241 aa, A.fumigatus
  UNSURE (202): Identity of amino acid sequences at the above locations are unknown.
VLVKLNLLKVSVTLTGAARTTAPRINQPSRLLLLRQRPNSAAPLLHFTTSPRSSSAVRRPFANMAINSAPESSLLSLLYRSYPAAVSPDATELDLLHASPKIFPQTTFSLEEQASIKQWLDTISGLQNALTKDDKSVVMAILGQLNSHLASRTTLLGTKPSVADIAAYALLAPLVEKWTPEKRTGEQGYHHIVRHVDFVQNXRLFALQIPDEEKISIQVNELRFVPNLWDPNEYKEPTNKV

SEQ ID NO: 40740 - protein, 287 aa, A.fumigatus
ASGSRNRADHQTRFDFYFKSCSAQPATMPPKARINSKNSVEQEGRVLLAVSALKNKEILNIREAARVYNVPYTTLQRRLKGHTFRAELRANGHKMTQNEEDSLIRWILSMDQRGAAPRPSHVREMANILLAQRGSTPTQTVGEKWVYNFINRHDEIKTRFSRRYNHQRAKCEDPKIILEWFNRVQITIMQHGITLEDIYNFDETGFAMGLVATAKVVTRAEMLSRPFLIQPGNREWVTSIECINSTGWVLPPCIIFKGKVHIEGWYQDTALPADWRIEVSENGWTTD

SEQ ID NO: 40741 - protein, 179 aa, A.fumigatus
ICTENDIILICMPVYSLHLLQPLDVGCFSPLKRAYGRLIEDKMRLGFNHIDKFDFLEAYPQARTAIFSADNIKSGFSATGLIPLNPDRVLSQLNIQLRTPTPPGSRSTNSVPKTPYNLKQLKKQETTLKKLLRERIYSPPTPTKAVLGQIIKGYEMAMNNAALLAKENHDLHAAHEKHL

SEQ ID NO: 40742 - protein, 75 aa, A.fumigatus
KQKRSRRQIETAVGLSIQEGQEIIQRRDQAAEAIPTIPPEQVVDTEQRPQWAPPRCSDCHILGHRRLQCPQRKNN

SEQ ID NO: 40743 - protein, 521 aa, A.fumigatus
PIFSKPILAVIYRAYHVLPQYELPSSSIMTKVNIIFALFNLIPAILAICSTQSPFYPPPSYNRQSSEVWEALGLVEASLSNLLRNSNNLNTSSYSIEITPSRSTLWSTFHTAKDKNLTRPGADRVDETSRYRIASITKVFTVLGILQQHAAGNLSLEDMVDKYIPQLRSSHHDGTRSSGSIQWDKISLRSLVSQLSGLPRDWVQGDFLTDPESVNTTTKCDSDNSHRPCTAEDLFDNLRRRRALFAPNKESTYSNLAFDLLGLVLTNVTGTTFEEYIPASILDPLGMAQTSFVKPPDSVSVLPKGIAWYSDVDEPVENPTGGLYSSTHDMSILLRYILSNYKDIADAKLNWLLPVSFTAGMGSYYGMPWEIFRADRILLPDDKRRARTVTFFTKDGGVPRYRSIILIAPEYDLGITVLTAGDETLLEVIVDMVIVPLIRAADALAARQVKETYMGRYTSSPTKEQTVNSTLTLTYTSTHGLEINEWISKFHRCARLHIQALSVPRNHKVSRSVDPLWSLQR

SEQ ID NO: 40744 - protein, 68 aa, A.fumigatus
TYRSCMAVMSILGFGSIRWRKTNSPSHSTACYAVVFCNEQGIIGNISGVKHSDGAAFSMVYKVRCSRR

SEQ ID NO: 40745 - protein, 83 aa, A.fumigatus
AGCSNMDPKGNLLSKAFQEFLPWGISKQRNYNGYATQLKVSSGGSCFLCLPQSISSYTNPPSFPHAGAYYRLIFLLTVQKCQP

SEQ ID NO: 40746 - protein, 187 aa, A.fumigatus
VQRTLIDISSIQLRMDIPLGSFDRFIVYKTWKHDDSVIYHLATWTNITAYFTNLLFPSCKVTVIFLKVQLPEYPDAFNALGDEGVELSDNVKYGLDDDIGTELKQKIEMWNSVSSADIKQFCDKHIDQVEVGIQEAGYFRIVTVVWEPEKGSLPRIAGMHKFIENNWIWKKEAGAEKVLRMPLPVHY

SEQ ID NO: 40747 - protein, 540 aa, A.fumigatus
STKIPGKMVEVCGTIHRDGQPIMHVTSQFLYRGSYLDFENTFQRKDEVPMQVHLASSRDVAILRSKEWFRLDEPDVELLGQTLTFRLQSLVRFKNKSVFSHVQTVGQVLLELPTKEVIQVATVDYETGTSHGNPVIDYLQRNGTSIEQPVYFENPIPLSGKTPLVLRAPASNETYARVSGDYNPIHVSRVFSSYANLPGTITHGMYTSAAVRSFVETWAAENNIGRVRGFHVSLVGMVLPNDMITVKLQHVGMVAGRKIIKVEASNKETEDKVLLGEAEVEQPVTSYVFTGQGSQEQGMGMELYSSSPVAREVWDRADRHFIENYGLSIIDIVKNNPKELTVYFGGPRGKAIRQNYMSMTFETVNADGTIKSEKIFKEINEDTTSYTYRSPSGLLSATQFTQPALTLMEKASFEDMRSKGLVQRDSSFAGHSLGEYSALAALADVMPIESLVSVVFYRGLTMQVAVERDEQGRSNYSMCAVNPSRISKTFNEQALQYVVENIAEQTGWLLEIVNYNVANMQYVAAGDVSVHPFFLNISVF

SEQ ID NO: 40748 - protein, 164 aa, A.fumigatus
LCQLRALDCLTNLLNYLKAQNIDIPALMQSMSLDDLKAHLVKIIHECVKQTESKPRPIVLERGFATIPLKGIDVPFHSTFLRSGVKPFRSFLLKKINKTTIDPSKLIGKYIPNVTARPFEITKEYFEDVYRLTNSPRIAHILANWDKYEEGGENTSRATGTNTA

SEQ ID NO: 40749 - protein, 1168 aa, A.fumigatus
  UNSURE (20): Identity of amino acid sequences at the above locations are unknown.
PKGLDVIQWLQDRDSQPDTXYLVAAPVSLPLIGLVQLAHFVVTCKVLGRQPGEILERFSGTTGHSQGVVTAAAIASATTWESFAKAAKDALTMLFWIGLRSQQAYPRTSIAPSVLQDSIENGEGVPTPMLSIRDLPRSAVQEHIDTTNQHLPVDRHISISLVNSARNFVVTGPPLSLYGLNLRLRKVKAPTGLDQNRVPFTQRKVRFVNRFLPITAPFHSQYLYAAYDRILEDLEDIEISAKSLAIPVYDTKTGDDLRQSGDTNIVPSLVRMITHDAVNWEKATVFQGATHIVDFGPGGISGLGVLTNRNKDGTGVRVILAGAMDGTNAEVGYKPELFDRDEHSVKYAIDWVKEYGPRLVKNATGQTFVDTKMSRLLGIPPIMVAGMTPTTVPWDFVAATMNAGYHIELAGGGYYNGKSMTEAISKIEKTIPPGRGITVNLIYVNPRAMAWQIPLIGKLRADGVPIEGLTIGAGVPSIEVANEYIETLGIKHIAFKPGSVDAIQQVINIAKANPKFPVILQWTGGRGGGHHSFEDFHQPILQMYSRIRRCENIVLVAGSGFGGAEDTYPYLSGAWSSSFGYPPMPFDGCLFGSRLMIAKEAHTSKNAKKAIADAPGLDDKDWEKTYKGPAGGVVTVLSEMGEPIHKLATRGVLFWHEMDQKIFKLDKAKRVPELKKQRDYIIKKLNDDFQKVWFGRNAAGEAVDLEDMTYAEVVHRMVELMYVKHESRWIDASLKKLTGDFIRRVEERFTTKEGQASLLQNYSELDTPYPAIDNILAAYPEAATQLINAQDVHHFLLLCQRRGQKPVPFVPALDENFEYWFKKDSLWQSEDLEAVVGQDVGRTCILQGPMAAKFSNTIDEPVQQILDGIHQGHIKGLLQDVYGGDESKIPVIEYFGGRLHEAVSELDIDGLTISEDTNKISYRLSSSPSGDLPDLDLWLRLLAGKSYSWRHALFLADVFVQGHRFQTNPMKRIVAPTPGMYVEVSYPEEPSKTTICVREPYQSGKLVKTVEVKVNDQGQISLTLFEGRTAEGGVVPLSFLFTYHPEAGYAPIMEVMDGRNDRITEFYYRVWFGTKDVPFDTPTTATFSGGRETITAQAVADFVQPVGNTGEAFVDRPGKEVFAPMDFAIVVGWKAITEPIFSPTNKGDLLKLVHPSPRSSSGYLVLNL

SEQ ID NO: 40750 - protein, 116 aa, A.fumigatus
RCWKRTQMDFEEDRFADDEEHDDLFNEDEETKAAEKRIKQDQLKANVFDLKDEKDYEEEELREKKEREARRILGKKVRKALKKREKNYDYSSGSDANPYSDDEVCSLGSNLVTQLC

SEQ ID NO: 40751 - protein, 121 aa, A.fumigatus
SSDDSEAERLREEERKAEEDKNKKDSAPSTRGNVTPSGRPKHTEPLKKGPGAASRKRLGSPNVSDASGTDTSRKKAKSKHSSQPTPQPTSRALSPTAPPGQVSFFNRNCLFIVLISIGTGW

SEQ ID NO: 40752 - protein, 136 aa, A.fumigatus
CRILIDFFEDLLRLNRAVRVDCLESHRHVVLANGFSTGTTKVDSELLGIVFDDINDGQAIVLDEMTIRPIPNLPGDRAAAVQLHTHSLLLRALPSEDIGGYWLLDFGFAQKNLIFCFLVAGLNLDDFTTSHHTDML

SEQ ID NO: 40753 - protein, 140 aa, A.fumigatus
SRALSTRRISSGRSTTASTARSNRRTSRRMCRRWCRLVRSVVLFCKFRFLLWIRQLSHPNSAFLVCDRIGRIWATRQLCLLWILGIGIFLGANGSLAAIYAGRFIAGLGVGQTVVVGPVYLAEIVSIPSHTVPMQADRRG

SEQ ID NO: 40754 - protein, 73 aa, A.fumigatus
APASIRGLCTCVFTGFVYLGIVLAYFTNYGCQVNLGDNTHKRWVSEAATAGESIAADQSRRKCQPVCTSSLPA

SEQ ID NO: 40755 - protein, 142 aa, A.fumigatus
SAAVASSPPPSTTSASPSTPPSSSASSAGPVSTSSPSTETSPSTTTAPASPRTTPPSRASSASCTRACASASSPPPATPRAQSTTSASRASSTPSMTPPPSPPPRKTAWSSWAARATSSSASTRPRRTASPTSPARSGSSTK

SEQ ID NO: 40756 - protein, 262 aa, A.fumigatus
GPRVRCAGDHGHRAVPPGRTRGDHGRWLARHRQGDLFHPEEPVPHLPDGHVADSLAVVRRRLHHPLRPRSLQAARYHRVQREPARDRCVRDRQARRSHHLRPVPGRRDRPQALPPHRYHPAGHRHDLRRRLPDRRPGDGHRRRLCPAGVQAWRQPRRHRHDLYLRVRLGARLELDAVPAHGGALPAAHPGPGDLHRHDAALCQPVRQLARGAQHVAAHPARRHHSQGHVLVLCGGDHPRWSVGVSQCARDSRAVAREHGSAV

SEQ ID NO: 40757 - protein, 67 aa, A.fumigatus
LTPIVASSRPTGKFFTARLNGQTNIFQIEWIKVSTVTPYLQEEAHWIGPSGGPLCAALAAHRCLPGT

SEQ ID NO: 40758 - protein, 134 aa, A.fumigatus
TQRRPGQVQTETPRPDRGLFLQPAPARRRLQIPRRKTHDQPPSLRRPLLQRHPPHPQHRPAPRPRPRARSRPRHLRRRRHPLRRRRLPHPGQPRHPAHHPPPAPGRAHRHRHRRRLHRGRKVLRAPQGPPRRRP

SEQ ID NO: 40759 - protein, 233 aa, A.fumigatus
  UNSURE (4),(17): Identity of amino acid sequences at the above locations are unknown.
MNKXEDAPGDSSTPVTXATSFIFFFNNITSQGLPFFAPTIVRTIYPHNSVCSQQLHTVPPYVVGAFFTVLFPFLSWRFDRRMVFFVIGPLLMMAGTIMFLPTTDAMIRYGATFLIASGAFAFGALCNANASNNVVSDTARSSAIGTTVMMGNIGGLISTWSFLPFDAPNYHIGNGLNLATSSMTMLLGALLWGWMRWDNKRREKVDVDQALAGLSLLQIQDLDWRNPAFRWRD

SEQ ID NO: 40760 - protein, 127 aa, A.fumigatus
SWEVIVCPSLFGHHPPQFSCSSLLPGILNTKDETMAGGPKKPVNIFRLKNLNEPKEVFNWRLWFSVLSFGLMGAARGVDEGLISGAFNSKDFQRTIHYSEYSQVEQTNIKANVSAMVQIGSVGGALL

SEQ ID NO: 40761 - protein, 358 aa, A.fumigatus
EVPTSLHIIFAGLIFLLSFLQYESPRFLIKKGKYEHAIRNLARVRHLPEDHEYVVQEITAIEQSHQAELEATMGAGWLGIVKETFFIPKNLYRIYLTVMSQILSQWSGAGSITLYAPDLFKLLGITGSNESLLVTGVFGIVKLVAAITCALFLVDVIGRKRSLLIGITLQAIAMIYVAAFLTDVPEMGIVDDFVLPESKLGVSRGAIAMIYISGFGWALGWNSMQYLLTAELFPLRIRALATSIAMTLHFANQYGNSRAVPNMLLPTQHGGITPKGTFWCFAAVTILGGVWVFLSVPETAGRSLESMDRLFELPWYKIGLYGNKDAEERDQVVSEKMQMEEEMHGTAAHQETVEKSRV

SEQ ID NO: 40762 - protein, 351 aa, A.fumigatus
GLLAVPFVLHSQPTAVYQEHSENLVAVAADTHQRYAEIFRDVEKLIDDHSRPLAPPVLASHLTLSVDHERNAAPGKSKLKLLVPTAGSFFSRLPLEDAFKYQDAKRMISRRRFVAPSFNDIRLTLNTAQLLGLVRGPGLDLVTFDGDVTLYDDGACLTPDNPAIPRIIRLLHQGVRIGIVTAAGYTEGAKYYERLKGLLDAVHDSSSLTPAQKDGLVVMGGESNFLFRFDSASPHRLSYVPRPEWLLDEMKSWNQEDITQLLDIAESSLRACAANLNLPVAVLRKDRAVGVYPYDRSKIHREQLEETVLVVQNTVERSVVGSRLPFCAFNGASPSSHPLRPPSPDFLFTCM

SEQ ID NO: 40763 - protein, 107 aa, A.fumigatus
NYAGKSRDEIAADPMSAAVIGIKGSQVLFSAMGGEDGLEATETDWARRRPKTEFWLELQNYVNVLSGRASAGKPLWSCYESKHFPSCCRLYNTDLSIDIDPSALTSS

SEQ ID NO: 40764 - protein, 287 aa, A.fumigatus
LHAREKEVWGRGTEGVGGRGGTVKRAKGQSRADDRSFHCILHDEDGLLELLAVDLAPVVGVDTDGAVLAEYSNREVKVRGASAQRRLRDIEQLGDILLVPGLHFVEEPLRAGDVGEAVRRGRVEAEEEVALAAHDDQAVFLGGGEGGGVMDGVEEALEALVVLCALGVAGGGDDADAHALVQEADDARDGGVVRGEAGAVVVEGDVSVEGDEVETGPADEAEELGGVEGEADVVEGGGDEATAADHAFCVLVFEGVFEREPAEERARGRDEEFQFGLARGGVAFMVD

SEQ ID NO: 40765 - protein, 72 aa, A.fumigatus
MGSENRGGKRPTVVVDELLNIPEDLRVALMGVGCYGHEVLAMFLVDSGGLRVQHKGDRQKALSNELPPVDME

SEQ ID NO: 40766 - protein, 404 aa, A.fumigatus
CVPHQHESATLSPLHPRLLHRLLVRRSPVHLLLHLHLLRHHLIPLLGVLVSVQTDLVPRQLKQPIHALERPPGCLGHTEKHPHSTEDGHRRKAPKRALGSDAAVLGGQQHVGHRARVAVLVGKVQRHGDGGRQGPDAQREELRREQVLHRVPAERPAEPGDIDHGDGAAADAKLGLRQDKVVDDAHLRDVGQEGGDVDHGDGLQGDTDEEGALAADHVDQEQGAGDGCDELDDPEHTGHEQALVGPGDTEQLEEIGGVEGDGAGAGPLRENLRHDRQVDAVQVLRDEKGLLDDAEPASAHGRLEFGLVGLLDGRDLLHNVLVVLREVSHARQIADGVFVFALFDQEARGLVLQKGEEEDQAGKDDVQTGWHFLRDWSAAIDSPAVAASLTHRLCVLSPRLTWQP

SEQ ID NO: 40767 - protein, 103 aa, A.fumigatus
LHRYGRFGPCGEELDGEFERRENEKKRRREAKFKTKLQDLKKRTRVEAYRRNRQGAAGGNFGDDLGKGGRHVHQWGRSVEDPETGIGVKKCVDCGMEIEELEF

SEQ ID NO: 40768 - protein, 658 aa, A.fumigatus
FTAQRSKSQADLTTDIDTDHQLGVRQENEREKSRLYLSKCSQEVAFHVVPTSHPAPDLNDLELSNHMYANHNMPQQSIEEAYIQQQRQKQQQQQQQANHMMAREVALQNHQPIVTHYSDNSNVSRAPNQFLPTVARDIMDKSPLEAQQTHATAIDNRRQAFESGLSDERAGAAKQQYDNTQAAAKEETQSQQEDQIQDTDGWNFDENPAQESRSAHIPPHRPDMDAFPNANFAGPKSPSRGGSVSHRRKSSGSKRKTEGATDVGAGAIQKQDPIFKVRFALRGHLDVIRSVIFTGGGSPSEPEICTCSDDGTIKRWIIPASYGAYGSHGGSSGNDLDITSYFTHRGHVGAVTALAACSPSQNFSNGGRALGDGWVFSGGQDASVRVWERGRVDPKATLDGHTDAVWGLCVLPGTAGTVFGDSSSHYGGPDRILLASGAADGRILIWAVSAPPQVSSPQAGSRRAGGSRRANSISSGSNFPSSPQPSTATTTPFHYTLVHHILRADSPSPTCISPLSLAGVNFVVSYTDASILVYDTRTGEEIVGMASLETYDGTPSTGVNSVVATTIGFDGSAGLDPSRTLADEEVVHGATGSSAVEGVIISGYEDRYIRFFDANSGTYADMHDFLNESTDIFLSCCRPMHIHDAGPPRGYRCTFLIS

SEQ ID NO: 40769 - protein, 97 aa, A.fumigatus
MKALTFSCPVVGQCTYTMLAHPAAIAALSLSPDGRELVSAGHDASLRFWNLEKRSCTQEITSHRLMRGEGVCAVTWSRDGRWVVSGGGDGVVKVFSR

SEQ ID NO: 40770 - protein, 158 aa, A.fumigatus
  UNSURE (131),(144),(145),(148): Identity of amino acid sequences at the above locations are unknown.
KKKTQKKKSLAFQDSDILVTTQFLLCTTRFVAMGKGRRMKKQGPPAPLDESKITLYKKRKAGDVESKAESGKKRRRAEDEEEILKAVPKKKVNGAVKGKEDKAVATAVSKKDANTNSKPAAKGKTYIYGLXTTKICPISITIKXXWAXNEFDYLEWPQ

SEQ ID NO: 40771 - protein, 102 aa, A.fumigatus
APDWVMSTVDQSTVTTALSSSSSNRHQGNDTYSIPKHSGTTSTITITMNEVSFVKSYLSTLDSRPIKLRSDHVFDPEQVGLRVPVRLPPISYYLSHTPRIMY

SEQ ID NO: 40772 - protein, 196 aa, A.fumigatus
STQYTLPRLHAPHPEMPKKTKQPLAPGSSKSITVHLKSARNPALEFSLPNTALTTTSVQDLKDAVRERVTDAQGNKISLDKIKILYKRKPVTGKTIAEVLADEPGMLSGGKEVEFGVMIIGGAQVAVSAGAGERAGAEQKESYEPPKPAVGPSGESVVATEAFWDDLQGFLEQRLKDYDEANKLRVLFKEAWRSSF

SEQ ID NO: 40773 - protein, 63 aa, A.fumigatus
SPSSPLLPCLSLSLFPSHFNFPSPIFYFQLQIFTSKTSNNLALLPFIYLLLILKKKKNSYQAV

SEQ ID NO: 40774 - protein, 130 aa, A.fumigatus
GSQTNSFASEMVENMKVVASSDVELTVEERNLLSVAYKNVIGARRASWRIVTSIEQKEESKGNESQVALIKEYRQKIEAELAKICDDILDVLDKHLIPSAASGESKVFYHKMYVVFILSARLRRRWGRMY

SEQ ID NO: 40775 - protein, 168 aa, A.fumigatus
FGSKPEPRRSFQPRGEDFYTTRIIPPTLRIVKTSSKSRVVEEREVTALFSWILLCFSQPDSKQPHENYYSYYYRQIVTGVVPEPASASASTRTSTSIGTPASHLPLSTITTTAAASPPLPPFSLVSPSLFSPPTSTFLPPSSISNSKYLPPKLPTTLLSFPSFIYFSF

SEQ ID NO: 40776 - protein, 91 aa, A.fumigatus
INRKGDYHRYLAEFAVGDRRKAAADASLEAYKNATEVAQTDLAPTHPIRLGLALNFSVFYYEILNSPDQACHLAKLAFDDAIAGMSTLYPR

SEQ ID NO: 40777 - protein, 85 aa, A.fumigatus
HATELDTLSEESYKDSTLIMQLLRDNLVSFLSFGRFSHGVCPNGLRLSGPHLRLSPLLSRTLLPRRRRRPLPLRARSPLNKQGKT

SEQ ID NO: 40778 - protein, 60 aa, A.fumigatus
AGNDKAKPSQPFYADRQFAFSQEATDPLKSQRPPPPLRKYHGIYVGCTRILAYCKSTTTP

SEQ ID NO: 40779 - protein, 96 aa, A.fumigatus
WCPCDMFKGERKCDITTCHVLLWNSIRRLESCMISALYILAADLETCLTYTLLPCEGFGLHPVPFLGSLDFIVVIFTSFPSPPLPHIFSLSFTTVA

SEQ ID NO: 40780 - protein, 65 aa, A.fumigatus
GSHSIQPGQKYRVLQPIFSRLWNQGSWKKSWNIVDILGCASAASLKEIRSYALLEGPIPTDMGGV

SEQ ID NO: 40781 - protein, 63 aa, A.fumigatus
EAMNPKSSLRGSIPGRSATRSHHRTYGIYVAVGLFGYDWGREGSEYMEYALNLEDCSHKGRCR

SEQ ID NO: 40782 - protein, 142 aa, A.fumigatus
PYLSGWGRKLSYCIAFSIDGATDVTRRYVRSPVKHGAPRNRVPEEVLVWIIHEIRKKRRESMSKTDQRRLMKEDEREEKELRACMASALAAEINNLIPREQTSGRPGEQKTPASMQDTPVDWVAAQQMGPGQSGPDRSQDGR

SEQ ID NO: 40783 - protein, 99 aa, A.fumigatus
RCPTSPPSMDDASPTCSTITEDVSPTASKIYAKIVNIKKGKADIMQSREPSHAGSWYSDNRSTLTRQLDQWLAHVPNEIEGIGSLPVPGSRVIIAPYVS

SEQ ID NO: 40784 - protein, 296 aa, A.fumigatus
LIETRKRIFILGPSHHHYLSTLALPQLTSYYTPLSDEPLPLDTELIAKLLSAKAVKPNGSTVSFTTMTRSVDEDEHSIELHLPYIHRLLQLQHPTKRTSQYPPLVPILVGSTSASTEQAFGALLASYLEDPSNVFVISSDFCHWGLRFSYTYYVPQAPKPGPKLPLSADALPQPSNDLDEFEERIELVSAGHSLQRRDRINSRESAIHESISAFDIATMAAIATGETENFLDVIQRTGNTVCGRHPIGVIMAAIEATRTQEDGKKGAFHFIRYERSSDAVNVTDSSVSYVSAFAVL

SEQ ID NO: 40785 - protein, 91 aa, A.fumigatus
VFRSSQPLTLANRKSAVSGWFSTHFGGEVPYSKNWVFPSDLLWYDRWQEILNLGPRFIEIVTWNDYGESHYIGPLSSPHTDDGASKWVMDM

SEQ ID NO: 40786 - protein, 93 aa, A.fumigatus
SLKLLVSIKSWTDRTLNFKLLFSQMMPSFDSNVPVAFAETRSILVPDWNVSICLGAKINLAIGTALKHLRQDTSAQKERLDKIRVIPLQPLAS

SEQ ID NO: 40787 - protein, 185 aa, A.fumigatus
IGITSNRQSAADYDDDMQRAKALGIDAFALNIGVDPYTDTQLNFAYESAARNDMKVFISFDFNWYNTGQATAVGQKIRQYASLPAQLKVDGKVFASSFAGDGLDIPALNSAAGTEVFFAPNFHPGVGDFNAIQGALNWMAWPNNENNKAPTPDHNVSVAEGDSKYIAALNGKPYIARESFEAPNL

SEQ ID NO: 40788 - protein, 210 aa, A.fumigatus
LLLPGIALTASLRPHNGWLEMSKPFIAAYKAGEKSANNYITEDKLIYWYRPTPKDINCDSTDTTMQGNPNNSSGNFFRGRPNGYESMTDEVFVVSLLKSPATVQVTSGSSSKTFQAQAGASAFSAPMGVGKQQFSLLRNGQTVMSDTSLKDIVDSCICGIYNFNAYVGTVPPEKTIDKLQPAGLSMLYQGLTVPCPTNTLGLSSPTATAQ

SEQ ID NO: 40789 - protein, 153 aa, A.fumigatus
NISYCESIHLLYTLNIFEFSNTWSLTYLLPTIPAEFWDCIRAVELRWAFPGHWLPSKDPVKTVYFSAGRQQWVETCRALTRMKGLQSFTLQLMGNWFCEPVEKIPVFLEPLRELSLKNRWKLQLPRQPYYIKEIRNIDRDLRQRGIDCSVRAA

SEQ ID NO: 40790 - protein, 348 aa, A.fumigatus
LPAGDLVLHCALFAKPTAESERLVKYLVQHVPHCLEVKSVDGYTPLMIAFSLVRPTYAKILIKAGADQTVRDKKGCNILHHLFCGVSSPSVERLDDFQKMLGLVDPSLVSSLLVERSSHGPGSLTPLAMWMMRALNTTNTYSVYGNGSNYEGDNQMETLRIILDFAQSTGQKHLELLNGAGNSIMHDAVRCQLLKTLEILFERRPDLLHRENASGLTPAEVAEASWVTEVTSNPPGWERRYRFTYSSQYGESLVDRRPESFVEEGDEAPTMKRRIYDFCRSKAETLREPDVKRRLVTLFEANEVARRLVAKDLQENQNFGGAARRRRWDKHDEREFGDEVREWLPEVF

SEQ ID NO: 40791 - protein, 954 aa, A.fumigatus
SHQTIPYGERFHARKIEKLLYTKDLLLNAEWNKPKDREVNLHRHPAFFGNFEDVIEDCCGFCPVPITPEEKELTEEESKIYVSGRIKFLQDNPGRQEIGSFNPITETDWTGQCFLIAWCPNANVYTDMAYVGNTAGLCQAIVDNDVEGVKQWLSPDFDVNRRDFTGRTPLHLAVMTSTPEIVQCLVDHGARLVARLADGRTALHLAAARGHVEIIRILLTKSEENEDEEARKEQARKGVSSGKEAHDGEEDAELIQHPSAESEADAQSFATGSFVKVHKDANSAQDSVPDDSSDQDPDVYDINVIAWDSHASPLHLAILNGHIAAVEELVSSFGADVLLPVKLLHEYNNSPRAAILTLVLALQLPIEQAKAMTTKLLQLGASPAQADLDQKTAVAHIAALPKYTELLDSYLQHDRPAVERALNYIATSGWQFSPNAETALKTAIKSGNVIGALKLLDAGASPTIAFDEFIKSAQVHIDGIRNNSSEQVKRRFDANVTQPIILSVLKDQPSVALKLLARGADPNTLTKEGHQIQHEVHARAYRHGKSLLDCVREKLNALRAYEPETDSPEPPRPLEHEDSYYLSPFREDTYQLWTAKAALRSAHSSLESEQKRYDDDVKCAANRKGVDEKKAAVQLTLGEFEKLEEELLARGAKEFKQLFPDIRTPSDNDGNHYGSCATKSESFRVTFDFRRPDLNDITRGRLYPTVGAPPVPSVCCPSRMLTVFRFEAAWCGDLETIKSLTLGTWGPDKQRPPLEIATKDQRNFHPFNIAVLRGHLDVAKAILAIAQVQYKPQDEQANVRYRLRATTNHDDGCSSDDEGDEDDNDNSDGLDIERQILDEKFTIDNIGEVKTQVESRTPPLSLLEDCCSAEDFIETSLPEDRKPYNLVQYAICKDDVRLLVFLLDLGRELSAKSGSSEQTIFTVGQRDLTVAMQLGRVRCLAELIKRMGAGIPLD

SEQ ID NO: 40792 - protein, 91 aa, A.fumigatus
INRLSDVKDFPSLIWNADEGFDEVEAWGLWFAEGTAPLTEGYFEGLETIGIQRIDTNSRLYMDDETIISVFTDDILFLYYCKGKEHANNLN

SEQ ID NO: 40793 - protein, 427 aa, A.fumigatus
LEESPMGGLSQSDGCSPGSRLLPEKRLPFSEISKASRTPQREAAWRSPQLVFVGIHKFGDCKNLKCMLQSSSALLILTEHSVRNQVLCIQPLQTILSLSQYFTKQNMADSYTLPAVPAKHSTFIDYINSRPHESIPDLVRPYNEYDAVLRKIYAQQPSHPAIANKLINLVPLFDGSGSADLRIRARDLASEPEELKAKYLMPLKDEDRKAHGSPAVVSSFKQFQTNFNLFSESALSDLDWSNVVAAGSAVTTSLLPVPEEYRDSKRGLREYYHQKFAPASDVDLFLYGLTEEQAIEKIKQIETRIKDSILAETSTIRTKNAITIVSQYPTRHVQIVLRIYKSIAEILTGFDVDCSCAAYDGSQVYLAPRAVGAFVTQINHVDLSRRSPSYENRLSKYARRGFEVFWPLLDRTRIDPVCHLTEHYEWR

SEQ ID NO: 40794 - protein, 107 aa, A.fumigatus
VRVLSLTIFFTPVIVLSFLSLLQNCAIITEEDIIISLLDCCNPALKSRVNNPIGVPITLVSGCEFVESRRRTLYTGLKNIFNQYNTLIAIPHPFVIIPVFMKSTMPE

SEQ ID NO: 40795 - protein, 73 aa, A.fumigatus
FAMSVGPSVNLMLYLVPFLRQCIRICASGQKLQGHGWLIFEDTQYDRLGYVSIESSLHLLGGVVPYSIDVHLR

SEQ ID NO: 40796 - protein, 98 aa, A.fumigatus
LITRFIVDSKQNAFLPLLIKIHVTASVLDLRQRVVLIHHFLVFLHFHLVIRQNVDASFAHDHPGNLAVLDTATQDENGEFVEDLALDDPRQRTGTVRW

SEQ ID NO: 40797 - protein, 311 aa, A.fumigatus
VPCLAEIILDFLGALDGNVAVVLLETALHLVEAQVDDLADFLPGEPVEDDDAGDPVQELGQEIIAESAHDQLAGLRVNAAILGGRAREELGSQVGGHDDDAVLSVDNSALAIGNPTVVHELQKNGEHLLGCLFDFVEQKDGEGPTAQTLGQLTTSIVSHVAGRRTNHPAQRVPLLVLGHVEPDHGLGVVEEELGKCLGQQSLTGTGGTAEEEAWRRVGVTETRPLQPNGIGDRSDSLLLAHNDLAKVLLHVQQLVPLGGLESGDRDTSPTGDNLVDLIGSDRVGQQGLAIVTMSSTTFLVCLDAIGLESLD

SEQ ID NO: 40798 - protein, 192 aa, A.fumigatus
DNRVLGFFDLLENALHSLFELPPVLATGHQRADIQGKQPALGQIGRNIGVHDTASQTFDNSGLTDTGLTDQHRVVLRPSTENADDSTNLLLTTNDRIDLALSGQSSHVNGELLEVLILALSVGRLGVYPPCTSDLLYRGVDQLDIGDVRIRQCPLHLRILNDREDEVVNGNVAVFLRLGQLGRRTNDFGKGG

SEQ ID NO: 40799 - protein, 145 aa, A.fumigatus
NALSRCCPRILGVMIRMHKLNPQGVSLRNVTYLMQGKRVFIKDIIHYILPPDGKLASIAPSLKRIKRGVGTNGQTTGEENGVVNAHVDQGSNGQDQTGQNGHSKSRASEPYPYDTEPERGNPTVMPKELLSRFHFAFIIRDPFHP

SEQ ID NO: 40800 - protein, 170 aa, A.fumigatus
QTQSIAQSLSPPKRNKIRVAVSIDLDAVSGWLGTGHHPDNILADYSAGFFAAKVGVPRLLRMLAKLNLADRCTWFIPGHSAESFPDEVAQVVASGAEIGLHGYAHEGAYQMTPQQERDVLVKCIDIATKLTGKKPVGYRAPLYQLRESTLDLLEEFGFEYGAFPPLFHYK

SEQ ID NO: 40801 - protein, 156 aa, A.fumigatus
HPDASLTDHDCHPFFAPRRPALQPIDFSQPASTWMHPIPSAGANAREDRRPLVCVPCNWYMEDMTPMQFLPHVPNSHGYTDVRVIENLWRDRFLWIRENEEEPIFPVLMHPDTSGMAHVIGMVERLLGWVKGWGDEVEFCQTREIARWFRERNATE

SEQ ID NO: 40802 - protein, 76 aa, A.fumigatus
GSMRPSLVVGRERNSAPRLEVMTTMQFLASTILPWPSVIRPSSMSCRRTVSTSLAAFSTSSNRRMEKGRRRRLSVS

SEQ ID NO: 40803 - protein, 168 aa, A.fumigatus
VSPDRSASSLLTLSESSLILASWIALLRCFSLSYFSRKGRNSSVTLAASCLAASNRALDASSFSRSRAWISICSWRSLLSRLSRASGSDSRVTLTAAAASSMRSTAESGSRRAVRYLAANSAAVTIAPSRMLTPWWTSYFSFRPRRMEIVSETVGSLTRTCWNRRSNA

SEQ ID NO: 40804 - protein, 189 aa, A.fumigatus
PRASIGFSRLAASIPPSPLEPAPMRRWISSTNRTIVSLDSSISLRTPFILSSNSPRYLLPATNEPTSRESSLHWARLAGTSAFTIRRARPSTIVVLPTPGSPISTGLFFVRRLRMRMTRRISSSRPMTGSILPSLARAVMSMVNFLRFSFSPSASAVLESTRRVPRICCTAVSISLTLGMFASASARCT

SEQ ID NO: 40805 - protein, 1025 aa, A.fumigatus
INSGFTCLRLARSLSDSRSVDYISCWHVMGIDCSGRRWNPLVSSWGNREASRHCEEWADDTQLQLYLAPLSSAQAVSSLLLCLLSPSLSLPDTQFRFTMNGAQFTDRANKALLDSSHLAEQYAHSQILPIHLALALLNPPPDDSKDQQTATHPSHDSSTAPLFRQVVERAHGDPQLLERSLMKLLVRLPSQDPPPDTVSVSPALAKVIRASTELSKTQKDSYVAIDHLILSVVQDSQVQRALADANIPNVKLIDTAVQQIRGTRRVDSKTADAEGENENLKKFTIDMTALAREGKIDPVIGREEEIRRVIRILSRRTKNNPVLIGEPGVGKTTIVEGLARRIVNADVPANLAQCRLLSLDVGSLVAGSKYRGEFEERMKGVLKEIEESKDTIVLFVDEIHLLMGAGSSGEGGMDAANLLKPMLARGQLHCIGATTLGEYRKYIEKDQAFERRFQQVLVKEPTVSETISILRGLKEKYEVHHGVNILDGAIVTAAELAARYLTARRLPDSAVDLIDEAAAAVRVTRESEPEALDNLERRLRQLQIEIHALEREKDDASKARLEAAKQEAANVTEELRPLREKYESEKQRSKAIQDAKIKLDSLKVKRDEAERSGDTQTAADLEYYAIPETKALIERLEADRIKADEERRARHGDNGEALLADAVGPDQINEIVARWTGIPVTRLKTTERDKLLHMEKYLGKIVVGQKEAVTSVSNAIRLQRSGLSNPNSPPSFLFCGPSGTGKTLLTKALAEFLFDDPKAMIRFDMSEYQERHSLSRMIGAPPGYVGHDAGGQLTESLRRRPFSILLFDEVEKAAKEVLTVLLQLMDDGRITDGQGRIVDAKNCIVVMTSNLGAEFLSRPTTKDGRIDPQTRELVMGALRDYFLPEFLNRISSIVIFNRLTRKEIRKIVDLRLNEVQRRLEQNNRNVTIQCTEEVKDYLGEAGYSPAYGARPLARIIEREVLNKLAVLILRGSIQDGEVARVVMREGRIDVLPNHEVEMEEDEEMVDEDDALAEIENGSGDMDLYE

SEQ ID NO: 40806 - protein, 161 aa, A.fumigatus
TGSPASSSSTGSPGRKSARSSTCASTRCSAVSSRTTATLPSSAPRKSRIISARQGTHQRTVPVLWRGSSSARSSTNSPFSSCVAVSRTARLPGWSCAKDASTFCRITRWKWRKTRKWWMRTTRWRRSRTEAVTWIFMSKGKKAFCLESTIKRVMSYDMFFI

SEQ ID NO: 40807 - protein, 121 aa, A.fumigatus
HSSPETTSQSPSSGKIPPHPPTPSPTPTTAPPSQSHVPCHSYPDASAQGRWVPPHSPESTGTDPATSSRSPAHPCTRASWARAAGIAWGSCLPCTSCRGRRRGGADLRVRLRRHLGSGASR

SEQ ID NO: 40808 - protein, 139 aa, A.fumigatus
PSDPRAGHGRSPRLFPARVPEPDLQHRHLQPAHQEGNPQDRRPAPQRGAAPSRAEQPQRYHPVHRGSQGLSRRGRVLTSVRCPSSGADHRARGPQQTRRSHPAWQYPGRRGCPGGHARRTHRRSAESRGGNGGRRGNGG

SEQ ID NO: 40809 - protein, 434 aa, A.fumigatus
AEPPTFFPEYTGKDGATYVYRHLSFWTSGFFPGSLYLLLERQAKNNSSTEPCTPHPLVLQQLCQWWTVNLHQNATLNTTHDLGFMIAPWAIKAWELHRDARAFSSLVTAANTLASRFCPKVQSIRSWDTCVTKRYSFTDPSRDFLVIIDNMLNLDMLFWVAKETGNRHLYDVALAHARTTQRHHIRANHSTYHVVNFDQETCTPKEKLTNQGYSDESCWARGQAWGILGFVQTFQWTGDPSFLQTSRQLADYFIKNLPGDGVPYWDFDAPVTSDSPRDTSAAMIASCGMLLIYKALRAQGKYDESEHYLVAVKRIVEGTLSKFLNPPTFKFIVQPSNRGIETYEDGLPCDHEEKPEPGFLAVSESAATNGMNGRGVNGTESKKPVAETILTGATINNYEFAPRRWANHGLVYADYYFMLLGNMLLELGLVPSLP

SEQ ID NO: 40810 - protein, 71 aa, A.fumigatus
RLQTYFCQALDKGTLGFASIMGIQTDAHLVGNEYSWLGTILYIGVLAGEYPTNFLLQKLPVGKYIASKYVC

SEQ ID NO: 40811 - protein, 121 aa, A.fumigatus
WSAVRPWRPGPNRLFLPCICGLCKLSSRAFEPISLCRPAIIGTAIIFTIPPTPKTRAGLLIAFYCTQFILAEGNLLFSLISRNVAGQTKKSTVLAVTFIAWSASNAAAPQVRLSSPPEGSD

SEQ ID NO: 40812 - protein, 357 aa, A.fumigatus
SCFDTPWGLKLVPAQPDGRQENPKRIFDDPLEDLQSLFLAIHDKHHEFPLRLRPSVPMSPRPTAPPPDLDQLDCNKDKIPACQSCRRKKAKCDREQPCSQCVRFNVICLYENGRLKPGLRAGAVEQLQRRVETLENMFIGQGILWQKIWDTVSNSAVGVEQNDRDFERIGVDQVRHRVKDTLLQLAEDNGGCLRSVVDNVPEDNIERDAPPVKRRKLDSQSSATERPSPSGHSASAPLNAHDLPSRDVMNDLVEFYFANVHHWIPILHVRKFREQIQTTEGWDKAIHILHAIVATCIRFSHHPGAGTIEARREMAVASRQKVILNSMESFSVENLQALVIIAFDTVGHIASSHNRIH

SEQ ID NO: 40813 - protein, 544 aa, A.fumigatus
IGSGRGPSAWSIVGSMTRTVEQLQLSVEESQGDRGSGEGEFLIQRMVFLKPSKFWWQAEERRRVFWTVFLMDRFCSVSTGWNLSLTSADVKRRLPCEGALWEKEYEVRAPFFGISDKSTLSSSSPNIVDNDPAKGDPEQDAIGGFAYCIEATESLTLVINFFLQHALNLQNAQKAQLWLMKFKELDLRLVQWKLFLPPKWRTASVLNEDGVMDPNLTLAHMTHNTAVILLHQSIAYPPSHWKQCPVRLPSVASAETCIEAAAEIATIGQQFLDHSPILTNPQFSFCLFIAGRMLLTHSTYTKTAIPDQLDSIATSLWEISRRWAGPNTPGLENLASVFAKRLLNARRHASGRTSLDIRRTVYSDSTERADPVPEQNSDGNEGPADSQARTNLPRGSFDGSGHSASPKLPTYAGDWSNRDPMQNGPSPNGSLYNALSLAFPPLPLSLQPQYASISEAHMLDPALLPKDHVPSLYPAPPVETLHAQPLWDPVAQSYNDCNNNPNPDYASRFVNLPSSPGHRISRYGDPSMNGENIPPNGEVPGNIR

SEQ ID NO: 40814 - protein, 162 aa, A.fumigatus
IGGLLAYGVEHYRGHSIKSWQLLFLVLGVATCAWALFMGWYLPDSPMKAKCWSEADKRLMVERVRANETGIQNRVFKKHQVLEVLRDPAIWLYALLQMTSCLIIGGLGVFSNIIIKSFGFTTLQTQLLNIAQGGVTIAVMVGGASLATWTKQTILTMHLWTM

SEQ ID NO: 40815 - protein, 133 aa, A.fumigatus
LQIEFEFQTRREKAYLIAIQFNNWVLDLDLGTFGSHGARLVQTERGYSGPAGRSRERGRGKSTLRTRYSSRGRERRRGSREDRGSRRGKGRKANSGGIERGRSRRGTGVEGASRKSGTETERAHIDLGLGNSQ

SEQ ID NO: 40816 - protein, 190 aa, A.fumigatus
SSPGSVPASFSANLSAMIELAPILMLAKGPAWTSTGVPSKLCIRLGLIASFIKAAKAPPAPISSQVTGSPLLEVATTMRPNLSRMSSRLLLNARMAIHSLATEMSKPVSRDRPLSVGACPTVMPRRWRSLTSNTRRQVIVCGSMSRRAKRRISSSVRSSGFVLVMPSFLSLLNMMGWNSRLPFLTGTSRL

SEQ ID NO: 40817 - protein, 83 aa, A.fumigatus
SREMAMSEGTGRTTLRGSGVTCLSRCFSKYALAEVTTFFSSMATVMGPTPPGTGVICEATSTAASKSTSPTRRCPDFFEGSGL

SEQ ID NO: 40818 - protein, 269 aa, A.fumigatus
QTPFSRGLSDGNASEMAIIDIQHTAPGDCLRINVKARKTADFFLGEIVRVRFSNAKLLESSEHDGLEFALALFDRDQSLVKSSILLGGFMEHASFNGGSQKVVGSSNRVNVTGQMEVELVHGNDLAVASTGSATLDTKCGTLTRLPDIGKHDPVQVCAQRLSKTECSRGLALSKRRRSNTAHQDITSITAVSQAVENTQTDLSLGVAVRLQLVGSNANLRGDLSNGLGVLITGDGNVGRNRPDHLEGKRRNMPVPLLFKVCLGRSNDVL

SEQ ID NO: 40819 - protein, 204 aa, A.fumigatus
QHGNCHGTNTSRNWSDLRSYLYGGLKIDISDETLSRLLRRIRLVVNANIDNNGTRLQPVALDELCLPNGCNNNVGVLHDAGDVRRLGVADSHGGVCIFQQVADRASDDVTTAKNHCLFAGGIYSTCLEEVHNSQRGAGNEERMATSFGQLSNIYCAETIEILFLGNCRCDCMFRQVAKKKKLDEDAVHRRDPCYPWLFPEGSSG

SEQ ID NO: 40820 - protein, 156 aa, A.fumigatus
SQINMSSLRLSSAFARRSLHACAPPRSAPLYSSAVRFSSLSSSTSSVFSTSSSSFSTSAAVSRPQRTLASSSLPASSRWSGVTSFRLNQSRTMATEGTKIKVKNPVVELDGDEVGFLSSGLKFEFDLQLDRLLPPVLYITFAGFHCHKRVGRAFSS

SEQ ID NO: 40821 - protein, 234 aa, A.fumigatus
RRVCCATSLHSNHSLTSSSSVAVSQRYNQKHSVCCPQSTGTPSGQMLIHCRGGTVFREPIVIPRIPRLVPGWNKPIIIGRHAFGDQYRATDIVVPGPGKLELVYTPENGEPQAIKVYDFTGGGVAQTQYNTDDSIRGFAHSSFKMALMKGLPLYMSTKNTILKKYDGRFKDIFQEIYESTYKKEFDAKGIWYEHRLIDDMVAQMIKSEGGFVMALKSEFVLVSSHYECLLLIDV

SEQ ID NO: 40822 - protein, 820 aa, A.fumigatus
PGVTRIPSVHGIFVQLLLLSHLSEHTVTSAVAEEKDFDGFGAINIGELAKRGGHPLFVPCTPLAVMDLLKASGVNPAGKEAVVLGRSDIVGSPVSYLLKNADATVTVCHSKTPDIPRIVKNADIVVAAIGKAEFVKGDWLKPGAVVIDVGINYKPDPSKKSGQRLVGDVDFEAAVEVASQITPVPGGVGPMTVAMLLKNVVTSAKAYFEKQRDRHVTPLPLKVVRPVPSDIAISRDQYPKPITQVAAEVGIAPHELEPYGHTKAKISLSVLDRLAHRRNGRYVLVCGITPTPLGEGKSTTTLGLTQALGAHLNRIVFANVRQPSQGPTFGIKGGAAGGGYSQVIPMDEFNLHLTGDIHAITAANNLLAAAIETRMFHEATQKDAALYKRLVPVKKGKREFQPIMFRRLKKLGITKTNPDDLTEEEIRRFARLDIDPQTITWRRVLDVNDRHLRGITVGQAPTERGLSRETGFDISVASECMAILALSNSLEDMRERLGRMVVATSKSGDPVTCDDIGAGGALAALMKDAIKPNLMQSLEGTPVLVHAGPFANISIGASSIIADKLALKLAGTEPGEDHEAKTGFVVTEAGFDFTMGGERFFNIKCRSSGLSPDCVVIVATVRALKVHGGGPEISPGAPLHEIYRTENTEILRKGCVNLKKHIQNAKMYGVPVVVAINRFETDTEAEITIVREEAIAAGAEDAIPANHWAEGGAGAVDLAKGVLAASSKPKDFKLLYDLEGSIQERIERIGKAMYGAEKVEFSELAQKKVDTYTAQGFSNLPICIAKTQYSLSHDPALKGAPTGFTIPIRDVRLAVGGGYL

SEQ ID NO: 40823 - protein, 145 aa, A.fumigatus
LTSEDYDGDVQSDVVAQGFGSLGLMTSTLTTPDGSAFESEAAHGTVTRHYREHQKGRETSTNPIASIFAWTRGLIQRGKLDETPDVVTFAEELERACIDVVNEEGIMTKDLALACGRKEREAWVTTKEYLAAVERRLKSNLKARL

SEQ ID NO: 40824 - protein, 64 aa, A.fumigatus
LLEVDICKCLFYHMAAADQSANQWMNPHSYALAADIQTIPGLPTAPGYLNVDIDTETGEIDGLF

SEQ ID NO: 40825 - protein, 70 aa, A.fumigatus
SKSSALISFQGIEYRDQTDDKVTVEAAEAIKKYGVGVKCATITPDEARVEEFKLKKSMLCHLTSFEPFSN

SEQ ID NO: 40826 - protein, 114 aa, A.fumigatus
PKPQRNLPARGFRPIYYLVGMHLFMAYGYYKLFYGIREQHELAREKVWSRLHLVPLLQAEEDRDQVRRHFADKAREKELLGTESKVYNSDRYVEPMGLKVVRYSWLTLFLLRLL

SEQ ID NO: 40827 - protein, 136 aa, A.fumigatus
SSPCLRICPHRGAMRLYSTRQVLNYWFSQRRTQITDRTNPNHSVTSLPAASDPSTTSLECTSSWPTATTSSSTVSANSTSSPARRSGPACTWSRCSRLRKTVTRSADTSRTRLVRRSFWVRRAKSTIPIGMWNPWD

SEQ ID NO: 40828 - protein, 206 aa, A.fumigatus
HIFCSNAHAFHNPANWGGLPHDMRGVVERILTDRFWQAGISTGSRDEFYAKITASRSSLEGFASSVRGKVRAVRESCYSMLFSMSRLREHFYGFAELPGPLSQALFKDSPHLSSHQFSVLLNISRCLIDDCPVRFRAQFLPPMLATLFTNIDRKVTAEWDLIEQRKEGLADGDLTDEMKSESILRQLTYSAVLMVASLLDPQRGGA

SEQ ID NO: 40829 - protein, 477 aa, A.fumigatus
FGNITVSKFLFGDTSKESIIEIPQGQLYLVRPLSPKGYSELIFKDAAATIRRTGQEFQYQLVIQRAYEEGEEELADEEDEQDPSNSLDKDEKVFLLDQGLHFRVEAREGGSKILAWNDLSGDTGDLFEFVCDPSVPADKVSTFELAAWQCQYERKYRKSAQRATEQELQEFSFKGEKTIPAASPISSPVKSRTHSVASAGESNAAMARDVEYSRSKGLIKPVGEGEERTVAPPSAAQPVAKEILAKEKAELHLFDFPSGTFILQDPNVVATVSEVGTWQYWLQISGEDKEWLGQAVVADINPVFNFEYLSFIFNHYGEDGSAYSWLLRFKDQATEERFQEGLMQALWEQLNEMKWTKVKENDREYVLDAFQDLTMEDAETEEQDEAEAESEDEEEEEQDESQRSEHYDSDEEQEDVSTRDDDGNVNSQLAVGYKHDRSFVVRGSKIGVFRHTPDNNLEFSTNISKVETPKGKLFSPK

SEQ ID NO: 40830 - protein, 64 aa, A.fumigatus
VMLHAEDRNMILQNGDEPHSLYRMDLEYGKVVDEWKVHDDIPVTTFAPENVSLHSRLRLTPMSN

SEQ ID NO: 40831 - protein, 241 aa, A.fumigatus
PPIGQEPNWVDADLKQYASKNDFSAVATSEKGYIAVASNKGDIRMFDRLGINAKTHIPALGEPIIGLDVSADGRWVLATCRTYLLLIDSLQKEGKNEGKLGFERSFAKDSKPQPRRLGLTPAHVAQFQHETKKPISFTPARFNTGVESQETSIVTATGPFIVTWSLKKVIAGRKDPYTIKRYAEDVMADNFRFGSDKNVIVALPNEVNMVPKRTFPKPTRESIAGPPVTPSRRSPRWGSRL

SEQ ID NO: 40832 - protein, 239 aa, A.fumigatus
HHEGLLQDIRLTSIVDPDDEPAEPSAPQPPPALSDSIRHFVLSSPEIFEPVMLFCTHALRMRDTRCCSIITRVIRSILQDFAPPNHSPTIVTIREFISSEVLKACITSVHEPYFVDMQKDLAQLIASIWVLYGSSSPTPRSVILSLPGMDEQRVASTEAALLRSTAARQQRALVLDLLEGLRGVSIAEQGKILGSREERRKARSALQERYMSNEMEGQQISKVDINDGPDLGGVADMFG

SEQ ID NO: 40833 - protein, 342 aa, A.fumigatus
SKMEDDDRPRKYPKLNHDEVQEGSEPVMTGAVGAVHDDDAESADSDNRASPSNDRIDNDVKQACDEEGQDAHGKDGPPTLSKNQLKKLKRKEHWEAMREQRKVKRKEKLVAKRERRRAALEQAKQEGAEATEETRKAFESTQKKFQRSTLLPVTLVLDCSYDDLMLDKERVSLGAQITRSYSDNSRAPFRSHLVVSSFNKLLKERFDTVLGKTHENWKGVRFLQEDFAEAAEMAKEWMQGPKGGQLAGVFADKADAKPEDGEIVYLSSDSPNILTELKPYSTYIIGGLVDKNRHKGICYKSAVAKGIKTAKLPIGEYIQMAHRQVLATNHVVENMISGAGAG

SEQ ID NO: 40834 - protein, 711 aa, A.fumigatus
HGEAVRRSHPLRRPSQHIMPRPKRTIEELANKSDSDDENYSDRPVRSSRQSARSKSRKKPKPTKKRARRHSNDDITSDDDDILDDVDELDFDDEDEEDPNAPKNARGLTARKAATNRPVYNEGDSSSVDDDFEEEDDSEPTRSPKKRKSTVVTLKVNALKRQPLPESGRRMTRRTRDPSEDIVALTNSGRHMELVERGTHSPEMEARRSRRGSRASKRLNFGPEKVEIDEKPEVFEPIEETSMEVKAWQPEIMESDHQGDFEEGVPSGQDSGEGAAEADEVGVVPESENGDVKHQEEDDEDDEGPTTRRRRGKPSRSQPTEEAQPDEEEDAHPRRSGRKKPRSSQRKRQDDESDFEPEEDESNDDDDEELSLSGKSHGSPRKASQARDDEEQDSTAGRRPGLRKRASRSRGQSEVRGDIAEELAEELEDLRGDRPRRRLQTDIVYEKPRRSRKDVDYRIIRPDLILPIEEAENEVNESPSRRGRGGGGSSWQRTLFPTYGPFGGGGPPAILAPPGAPAATGGVDSDSSDDEVMQHPKTGGSVSGPPGAGLLPSAQTHGADPLQGPSGTPANLGKIKDKQALADADPLGVDVNVNFDSVGGLQGHIDQLKEMVSLPLLYPEIFQRFHIVPPRGVLFHGPPGTGKTLLARALANSVSSEGRKVTFYMRKGADALSKWVGEAERQLRLLFEEARKTQPSIIFFDEIDGKCSRRL

SEQ ID NO: 40835 - protein, 981 aa, A.fumigatus
RCYVANVHLLTGLAPVRSSKQEQIHASIVSTLLALMDGMDGRGQVIVIGATNRPDSIDPALRRPGRFDREFYFPLPNTEGRRAILDIHTRGWDPPLPDHIKDELAEITKGYGGADLRALCTEAALNAVQRRYPQIYKSDQKLLIDPKKIDVTPKDFMLAIKKIVPSSERSASSGATPLPKTVEPLLRRPFSDIKTILSEILPQRKRLTALEEAQFEEPEGPKSFRREQMQQEFDTSRVYRPRMLVRGPFGMGQQHLAGAILHHFEGLHVQAFDLPTLLSDSTRSPEAAVIQLFQEVKRHKPSVIYIPNLQSWLNTVGPTVISTLLGLLRSVPPSDPVLLFGVLESTGEEVDNGLLSNMFGFSKKNFYDLKAPDYDARYEFFGRVIDYVKTPPSDFPDPENRKRRELETLEVAPPPPPKPAPPPTKEQLKAQKKKDHQTLNLLKIRIQPIMDQIKKYKRFRTGVIDESQIRYLWEEDDPNIVTSDLPIEQRTTFRPFEKAFDKHGVPGLRETVSGKFFYNMEIVTIEKRLSNGYYKRPKDFLADIKRLAKDARQLGDQERLLRANELLSNVEVDIATIEQAEPALVAECENVYLRELEREKLAAEQAKKAAGEGGYSRLSATGNVPHGNTDSGPSSGPVVLGESFPDGQARPQTPTRRSAVSFLTNGYHEGGGSDLNDLSNHATISNGSHESRGDGDGDGDGDVYMTNSEDHSGEREAQGSSFGPSAQPRPPYSHTAPSQQVRRESGFSSLSQKGPMTPMAPGSQPNDYTNEASTTQTTSDKKSSVQSSVPQNLTQSPMAAHGLRHDFPDLTQYPDRVSQEEHLPDTQQPESSQPSPHPRESLPGHADFAAGESQSQPKHQPPVPLFEAPVKQPSHVPTALQSLLNNEDLSPKVSLEHGLIDNLHNQLTQRTSGCSVEQLEQINSNLMDYIWRMRGEWNRNKVAAGIRDTFNEVLEDMQAMQEIGPISQRTKEQLGADIFHA

SEQ ID NO: 40836 - protein, 216 aa, A.fumigatus
SLSMISGCQALTSIEVSSMGSNTSGFSSISTFSGPKLRRFEARDPRRLLRASISGLCVPRSTSSIWRPEFVRATISSEGSRVRRVIRLPLSGRGWRLRAFTFNVTTVLLRFFGERVGSESSSSSKSSSTLLESPSLYTGRLVAAFRAVRPLAFFGAFGSSSSSSSKSSSSTSSRISSSSDVMSSFEWRRALFFVGFGFFLDFDRADWRDERTGRSL

SEQ ID NO: 40837 - protein, 351 aa, A.fumigatus
TNNCDRGSGRVVETLARTGGFAADVARHRMLETLQHVLQVTGSVDAMRPGGAGHASSVRVRLLHAAVRSRILDLVKNKPEYYDVDKYGIPINDLDCIATINTFSTSVVWIGLPRQGILLREREIDDYLALWRLVAYYMGAPHEFLETRAKAKVMMESLLASEIHPTETSKILAQNIILSLENTPPTYASKEFMEAMARHLNGKQLSDKLGLPRPTLYYQALVYGYCIVLMWFAYTFRLLPSIDQAMIKVRMHVLLRSLTVNYLCADESQFRRKKYYKIINDKDEGLGGETFFEFKYVPFYTRNTRLGKRKPPKRAKRGVEFLALMGLLFAVAAAGALLGSILRLLNKLQRA

SEQ ID NO: 40838 - protein, 295 aa, A.fumigatus
GIIPTVTSFTDNSSVIEGLIVQFPVWAALYTSASIGLAHAVSRGLGLPVWVTPACAFNNTTSLPLLLLQSLESVGSLKLIIPEGDSMSGAITRAQSYFLLCAVVSKTIGYAVGPKMLQNGNNQDERRDAQDTDAEAGQSNNGDYADNDEETSEETSLLPERVQKARRKVTGKFRRVGRWVSSFLPERVKQELMAPFESPFADVAILCTIIGAALGLVPQLHRAFFRPYEEGGIFNAWLTSSVKNIGKLFTTLQIFVVGGKLGASFQRMKASGNSGEIPKKAIVTILLVRLVIWPA

SEQ ID NO: 40839 - protein, 224 aa, A.fumigatus
VSSRRRSYPSCFTLSDTDRSGSLLMCPPEHLRNQAGWEGPISSSRERLLSELSSEYRYLPSWVSDDPIADLLPESISPSVMIPNNRLAILLNHVKQNQINRCLYHNTATPPSLYSDHMCDRNDFPLRTGVELRQHSDEVWYCQFSHDGSKLVTAGRDRHVYIYDTSNFSVYRQLEKHEEGVAHVSWSPDDSKLITCSQDKKARVWSVEVWMSSLISGVRLSSLT

SEQ ID NO: 40840 - protein, 358 aa, A.fumigatus
SSRRVSVNPPLVQVCSPGSAPEPGGRADLPIFDLADNSSSNTPSSVAPDRPNLPIPLEPTSFTSAPPPRSSTDGIPSSSRFESGAGSDSTASSIDNPPTSAGTRRRRFSTIDPSAFTGGTGGVSGNFTPSQEQASVQSHNPRAEHPPSPKRRRLANMRPDGISSANGFSQASNGLSVSPSRKTVFAHSSNSQPAHSSSNGESQKNGPSKTSKKSSSYFGHDREEVTRILIQSLYELGYDGAASLLSMESGYQLESPAVGIFRKAVLEGRWAEAEDILIQSFTPDANVREPGFSSGKPATTEKLLLVENAEKNEMLFYLRQQKFLELLEARDLGSALTVLRHELTPLNYDVGRLHALSR

SEQ ID NO: 40841 - protein, 65 aa, A.fumigatus
FDTDDCVKRSWITSFTMTKPTLPLPFWRIIDELTMSNPAYFPLPLRKLGFNILNHSNIPRWQYYS

SEQ ID NO: 40842 - protein, 76 aa, A.fumigatus
VSSCGPPSIPTRYSSTSQLGYSDSTSFDHFYIMGDTCTCTSSGDCPCNGPQSCTCSNNCACKGCGVCISWTLSGNW

SEQ ID NO: 40843 - protein, 113 aa, A.fumigatus
LFYVDEIQERPCTRCIKRNIGHLCHDEPREPSKRARSEHEHSTAEEDGHSNNEFSNAQSMPRNVDVQDAAGQQILPDGTVALPPSSVSAVQHNTIPSSSAQNSLGHNSQQRKF

SEQ ID NO: 40844 - protein, 330 aa, A.fumigatus
GGRLYSLTGANDRTVLGYNEWLGGQSQFQDMHTFHPSYMFNAPEVTNEYNLLGDFLSSSLLDDGGMFSNDNLQGIYSDPTLINSMANLDNTALLQQAQPSQPTQSQPHQNDSVQGPSSTVVNDKARETYYMTAADPSGSDPPEERMNKLLKAKYDAGLLKPFNYVKGYARLNQYMEKNMKQSSRQKILRQLDKFRPKFRERMQSLTDIELILVEMWFERSLMEYDRVFASMAIPACCWRRTGEIFRGNKEMAELIGVPIESLRDGKLAIHEIIVEDQLVSYWEKFGAIAFDNTQKAMLTSCTLKNPNSSNPGNGIPCCFSFTIRRDNHNM

SEQ ID NO: 40845 - protein, 131 aa, A.fumigatus
SSIHRPSAHATQIQTWLANASTSEQSQRVDTFVKLLDNYLGDIPLFTTAPSSTIRRQLDTEGTKLWNACTQLMAISADSCVPKLLSKGLTTSQFASSAAILIITVKAFAFAMLDCATSAQKQGIESTCVNE

SEQ ID NO: 40846 - protein, 76 aa, A.fumigatus
FTDLYHNKTETKDRVFLYLMGEYVKSNKLVAEARGHTPSSVKVIFQAICLRHARLTRTGLQANPPIRTALRSLHSN

SEQ ID NO: 40847 - protein, 61 aa, A.fumigatus
YHLHQDRRGGASWRGWTPTISAYQIFLSPLHVHAIESLFWPTYKLQKLNIFEQSFSVSIIN

SEQ ID NO: 40848 - protein, 111 aa, A.fumigatus
LHPWCQQRVIEAYCKRNGIVVEAYSPLVRNYKANDPTLVDVAKKYERTTAQILIRYALQKGWVPLPKSDTPERIVANANVFDFEIGEEDLAVLNGLDQGSAGAIVEAVENE

SEQ ID NO: 40849 - protein, 216 aa, A.fumigatus
IYSSKVSPSLSSIDSCRDTNTMSSKLTITDLLPLPNSDVKIPRLGFGVYRSPTGQCVQSSLRALEAGYRHIDTAQFYGNEKEVGEALRKCGIPRSDVFVTTKILSPAGSPEATYQKLLESVEKIGGRDGYVDLFLIHSSSSGSAGRKELWQALERLLEEGKTRSIGVSNFGVKHIEEMKAYAKVWPPHVNQIEVSSMVEKPFQVDSDSLWPEPEVH

SEQ ID NO: 40850 - protein, 89 aa, A.fumigatus
ISCSVRSLILPGAVMPDALSKTVPIWCAVMNRALFPSDAAYHAVQLPPNYLGASEESQIERRIDGFVKSLKVLFSVYHHCTLLSPATLD

SEQ ID NO: 40851 - protein, 284 aa, A.fumigatus
LKVQDLKLDLDDLRQQLGKPIRVAWANRSYFYPTDLHKKPDYNLFVLCSASKRVHGAEVSEGGYIQGAGDDSEGWAQGLTPPVFWAHKAILLKTPEEDLPELVEELVKEHRDQDTAEQATLVAPTRNLYISQTNASINDCGLYDLVIDCNGRPEASEGDPKRLNLGCRLSKLGSRDLRQELDKVRAFVSSQLATDPSRSLLVTCETGKDLSAGALLAIICLFYNDDGMPPFRTFSCLPYCFHHLVSHSFLFLTVLRIVHNMPGEAINRQAIHTTTSCLDTVIKT

SEQ ID NO: 40852 - protein, 549 aa, A.fumigatus
  UNSURE (451): Identity of amino acid sequences at the above locations are unknown.
VILIHLLEILGGESLGRYASKPKLRVQKFENVNKSLDFIRGRRIQMTNIGAEDIVDGNRKIILGLIWTLILRFTISDINAEGMTAKEGLLLWCQRKTACYEGVEVRDFSTSWNDGLAFCALLDIHRPDLIDFDALDKKDHRGNMKLAFDIATNEIGIPDLLDVDDVCDVAKPDERSLMTYIAYWFHAFSQLERVENAGRRVEKFINNMHGAWEMQNSYERRMKELLRLIRAQREAWKNASFEGTYKDAKEQARQFSLYKRNEKRRWVAEKSDLAALLGNIKTKLSTYRLRPYDPPEELRLEVCDNEWELLTRDEHERSQLINETIRDIKNALRRSFADKANDFALTLKTLSLAISGLDGDVEDQLEHVKRLNDNLPPLDAFLETIAELDEQCVEANIEENDFTTYTLDELSYELSLVKSSISKKLAFLENQLVARNMTNLTPIQLEEFESXFRHFDRDSSNTLHELEFSAALASLGLVYDEEEMHRSTSETCGPARLAQDGGVSFGQFIHFMVSVTEDQHTAEQFFQSFREVADGKVCSPQPERFRSRY

SEQ ID NO: 40853 - protein, 149 aa, A.fumigatus
WSRFQTAYYDFQLTLSLFLRHNSPTEKNELTWICNSPRTNHNFQFAFADRVALTVIGSTTDMTTTETVRFEPGFVAIVTGDFLFIPLVCFNTGFFQHALLVVPDVHAVTVTPHRPIGMSGLDLLLKPFVVMAANSCSSVSTAGQEDYAL

SEQ ID NO: 40854 - protein, 138 aa, A.fumigatus
CQLTFSSFLPSKKSLSSFWIRGIRVEPPTSTISSTWLFSRPESLRTCCTGSSVPEKALALRSSKRARVIDELKSSPSNKESISTVVCVALDSVRLARSQAVLKRRRALASPERSFPVFFWNSFLKCSRRLVSKSCPPR

SEQ ID NO: 40855 - protein, 203 aa, A.fumigatus
RDSNFLVKASSLDLNLAASITALGLFPCKNTVRQRSRRTINHLFDFSGGELANSVGDSNIGGTARRLLRSGDLKDTIDIDLENNFKSGLASLHGRDRSESKLAQGGVVSTVCALTLINWELNGRLVVYNSRKGALLDGGNSLTAGNNRGENIAFHGNSKGKGNDIQKQQVLSFSRGGLTRKDASLHGGTISYSFIWVNALRHN

SEQ ID NO: 40856 - protein, 122 aa, A.fumigatus
LEDMTGDVGGLMPTNLLKLLTIEKVTEQLLDSRDTSGATNEHNLIDLALLKARVLENLLYWLERARESLGVEILKAGTSDRRVEILSIEQRVNLNSCLCSVGQCTLGTLAGRSQTAKSSGIA

SEQ ID NO: 40857 - protein, 87 aa, A.fumigatus
EILSSLLLEFLLEVFKEVGVKILSTEMSITGCGLDSENTSLDVEKRHIESTSTKIIDQDITLFFGFSGAESIGDSGGSGLIDDAENI

SEQ ID NO: 40858 - protein, 68 aa, A.fumigatus
FVIYLHQDHRRDFLGRKCLGFTQIFNLDNGVSALVNYLERPRLNILLHDRIFITSTNETPRLVSKRTS

SEQ ID NO: 40859 - protein, 93 aa, A.fumigatus
VRTKQVSCHVYLSHSRSSLTDQPRRLIGRRYEDPIVKKDIESWPFKVVDQGGNPVVEVEYLGETKTFSPQEISSMVLMKVYHELPGILSIVHS

SEQ ID NO: 40860 - protein, 255 aa, A.fumigatus
MKEVAETKLGKKVEKAVITVPAYFNDNQRQATKDAGAIAGLNVLRIINEPTAAAIAYGLGSGKSEKERNVLIYDLGGGTFDVSLLNIQGGVFTVKATAGDTHLGGQDFDTNLLEHFKKEFQKKTGKDLSGDARALRRLRTACERAKRTLSNATQTTVEIDSLFDGEDFNSSITRARFEDLNAKAFSGTLEPVQQVLKDSGLEKSQVDEIVLVGGSTRIPRIQKLLSDFFDGKKLEKVSWHQSSNVSGHVLKLIMA

SEQ ID NO: 40861 - protein, 176 aa, A.fumigatus
SINPDEAVAYGAAVQAGILSGKATSAETQDLLLLDVVPLSLGVAMEGNIFAPVVPRGQTVPTIKKRTFTTVVDNQTTVQFPVYQGERTNCADNTSLGEFTLAPIPPMKAGEAALEVVFEVDVNGILKVTATEKSSGRSANITISNAVGKLSTTEIEQMINGTSTALSHCVLTRKQT

SEQ ID NO: 40862 - protein, 111 aa, A.fumigatus
LMVRLLRCLTVFLQGNKPNAVIDAAKFKSSDEAFTKKFESRQQLESYISRVEEIISDPTMSLKLKRGNKEKIESALSDAMAQLEIEDSAPEDYKKKELALKRLITKAMATR

SEQ ID NO: 40863 - protein, 149 aa, A.fumigatus
DFVLIQADCSQGNCMQQVVYSGLYSGLLMIFSSQHVKPITSAILSSDLSLTPQPDPHNILQLNISIPPPTKELREQTVVAARAAMEKAAGAVRESRSVSHKRLQDMQKKKLARPDDVRKAQDHMERLTEKGQKEVKELFDAAKRALERV

SEQ ID NO: 40864 - protein, 305 aa, A.fumigatus
CSVNGVLELGFRPRVPWCGWEATRCFWEKMTSNWVLLGPYTPRQWGSLRWSLGIVARVGKHAKVADLAKHSTVPVINALCDSFHPLQAIADFQTMHETFTPKAHGLSSLGLEGLKIAWVGDANNVLFDMAIAAAKMGIDLAVATPKGYEIPAHMLEIIEKAGEGVSSPGKLIQTNVPEEAVKGADVLVTDTWVSMGQEAESIKRLKDFEGFQITADLAKRGGAKEGWKFMHCLPRHPEEVNDEVFYSQRSLVFPEAENRLWAAISAIEAFCCQQRENSYENRMVSIEKASRNQISKVDRIPFCPN

SEQ ID NO: 40865 - protein, 431 aa, A.fumigatus
ELVKLSPSSQEPFHRSLRNRSNGCMGLSFHLYSFYPLTQAPQGSASQSGSGFPSRRSYPSLNHVSLAPLTNRFPIDDDTEPEDYFSPRDERSADTSTRTSYLSSFSVPGTPGVLSYSRSGSRVRLHSRSKSSSRIHRSDSSLQSQDDARPLHHHQHAHGPKKKHTSSSRHQPSESAGRRDAEWMLRAGIALASSTREEKGQSWIVKRESSTSLVSETNVDSPVLARRSRSGRSTPAAHSRWGSRAASRRNSRHDLAMTSLDALPTGSGSNARDSTRPHEETRHFIPDFVDERIRAEMAFIQQFEDGYASASDEESDSEDEIDEQELQRLTRERGFGLGGWIDRMVEWTLFGVEDLPLSANVQSAELAKHPDSSPDNDSVRDDHSSAAELTDDNASVSADESIASTVVEKPGENGGWADVGWFLRVMKRALS

SEQ ID NO: 40866 - protein, 63 aa, A.fumigatus
HFGSSAKPSRIDSFLKLISPFGILESTRTGLMALPRSPLSSEPSEELEKEAADVVDASTLPPG

SEQ ID NO: 40867 - protein, 211 aa, A.fumigatus
WHPLRGCFGSLGEDPTAVSSILYETPVTPTNPPKRHILNCLVQNEPGVLSRVSGILAARGFNIDSLVVCNTEVEDLSRMTIVLQGQDGVVEQARRQLDDLVPVWAVLDYTDSALVQRELLLAKVSILGPEFFEELLQHHREITTPGDALEGQKENKAGDAQAKKAEFHPRHLPPSQALRHKHEHLDAITRLTHQFGGKVLDISTNNCIVEV

SEQ ID NO: 40868 - protein, 199 aa, A.fumigatus
VIPSTDFYTAKFTPYSVVGFSQFHISTSFTMACGLKLAAARFGALNGQHLRQRVSLNGLRQYSSQTTPPISPFAPRHFLSIADLTHTEFATLVRNASSYKRSIKSGSVPQNLLGALNGKTVAMMFSKRSTRTRISTEGAVVRMGGHPMFLGKDDIQLGVIGPLYATAVGVSSMVSWHRGSRRQACESCRPREALNRSCD

SEQ ID NO: 40869 - protein, 62 aa, A.fumigatus
IHYLTLFCAQEASAHTDTWLGHYKSRMRRKFHTAARRQFILLFKKACLRIVNATYFIKPRAG

SEQ ID NO: 40870 - protein, 64 aa, A.fumigatus
REHKTTGITSVIASFLPVKLHHNTTDTNLHKPLPFPSFILLTFPSHFCFYSATAAFFSLDFCAI

SEQ ID NO: 40871 - protein, 226 aa, A.fumigatus
  UNSURE (58): Identity of amino acid sequences at the above locations are unknown.
WLETLEHRCLGGGYYVQMGERHPVLVDEVIHKSPRRSVSSALQVLRNYQSTLQNSFPXGGNPESDYAYNRVRQPLGNLLDALSDFTPHFLPPQETQASVSLSYLDGATDIIHALPRWHSPQNNIERDSAYDEICKAWILVIREAAKRGGGIQLQYGGWDQKLAKHNQNAGGRLQAAVNELGNSLGWMHGPDSQGYGSSTGGDLVSVREQLLSGTYGLGTPVKVGPW

SEQ ID NO: 40872 - protein, 113 aa, A.fumigatus
LHLWSSTAEFTLFSPLPRTLIDIMSVQAHAYYAEHEEVGSINYSVPFQVPPGVSKTPRLPVEMNPDGIGYDALKRALGGSLELDAMATVGVRVGHYTATIDYHSKGIRANVKI

SEQ ID NO: 40873 - protein, 263 aa, A.fumigatus
LPTRNMGAENQQIMRYDIIQKQAVAALMNEVEKENKEPVKGHGNRAGSWAQIAGSMTKVQCQPKETLHYLSPMSMSSVSGSKQSHSIDGENGARAMNFSGAPLSPEIAEAKAGVVRIYGRVTREAIRFVTTRIHEGPLQEIRIETNERTRVTFQYASHALAFVKSNQDMEEMLGYGRFGTGYTVEMAEIINWNDEHRRMNQPIRERRRLSFARKRLFADNMSPEKWKSDVRAVAGLGNIDFLWVFNSGNGEFHVIGSLYTHEG

SEQ ID NO: 40874 - protein, 84 aa, A.fumigatus
FFTVLHPFTLLVIFLCLSIILFTGVCTYLFSYTISATMVRIGSSLLLATLAATTVSAASDPPKCSQDSHCPEEWPCCSRKFKTT

SEQ ID NO: 40875 - protein, 217 aa, A.fumigatus
VQLWIPDHGFLQFNSHMFFLFLDNHGGNASVSGGNTFGDWHEYTIDWKPDAITWSVDGEVKRTLKKESTYNETSKQYMYPQTPSRMQLSLWPAGQASNAPGTIAWAGGEIDWDSEDIKDPGYYYATFGEITVECYDPPSGADIKGTKAYIFKDKAGLESSVQITNNKTVLASFGATGLDMDVGASSSASGSANKTSSSANTVPSGNGGSGNEPWQLP

SEQ ID NO: 40876 - protein, 109 aa, A.fumigatus
LMAFAPSAIRSTLFSRYFRAFSTISTFLSLTSESTARNMSEITQTATLAAGCFWGVEHLFRKHFGNGKGLLEAKVGYCGGSTSSPSYRAVCTGTTGRMLPFLGTCWSKL

SEQ ID NO: 40877 - protein, 117 aa, A.fumigatus
CSRYSFFSVTDAEAVQLTFDPSVVSYGSLLEFFYRMHDPTTKDRQGPDVGTQYRSAIFTHGEEQHKIAEEITDKVSKQWYKQPVSTQIIPAGQWWDAEEYHQLYLTKNPSGYECPAQ

SEQ ID NO: 40878 - protein, 73 aa, A.fumigatus
RLTINIATAVFTSTAVARRVLEAFNKWKDTRAVYSGVSVTYSSDPCEKELVLVNDTARSGFAKNLNFAKKSMR

SEQ ID NO: 40879 - protein, 177 aa, A.fumigatus
PNHSSTSVYGQCGTGAYCLGGCDPLMSFSLDSCTPEPICQGKTYKDWSNLDNLASNTKYLGDASKSDWVYSGYPKVEDGNLLLTMPKNSVGTLIANNHYIWYGKITAKIKSSRGAGVVTGFILLSDTKDEIDYEFVGADLTNVQTNYYFQGVLDCKFNCGSRTMVFCNLTHICFFFF

SEQ ID NO: 40880 - protein, 217 aa, A.fumigatus
RELLKRNPPTTRPANNTCTLRRPPECSCPCGPLVKPATPRVPLPGPAVRSTGIARTSRTPVTTTPPLAKSPSNATTLPVARISRAPRHTSSRTKPASKAPSKSPTTKPCSPPLALLDLTWTLAPALPLRDLRTRPAAAPTLFPLAMVALETSPGNSHSGSSGSGTSTSDGSGSSTGFSQGSETFASSNKNAAPSQNERVLNGSFFAVLVAVVALVTL

SEQ ID NO: 40881 - protein, 71 aa, A.fumigatus
PLNHHKVTYSTFHVTNKQKTVRNTWPSFHDPSIHIVEQSYIPTDIIWTPYLRHSQIILSPLMMNIAGCIVL

SEQ ID NO: 40882 - protein, 168 aa, A.fumigatus
IEENNCRIISKGYAGRPLSLVSHQTSPTASHLDSHFSILQSQYTNHRMKPFTARSAFTASVLLLTTNLPAVFAAEMVSQGCFSDSTPLVDQGPYTYQSNGYCQQLCMKTSNNLVFALTKGSNCLCGNQLPAKSAKTADSDCNVKCAGWPDVMCMVFSITFRGSVAVLT

SEQ ID NO: 40883 - protein, 160 aa, A.fumigatus
KFYFHDEQISHIEKMTSGDLDEGVHEITSAETAYTDAPTVKRPGDEDLYAEKDAHSSLAGSPAQSAMDVKGTAIDIPYAEHESLPIAVPRLKHRGLFGQLTLLAEVENPKTYLRKTKWFITFIVALAGSTAPMGSSILFRKSLPAQMANPLVDALSLSAN

SEQ ID NO: 40884 - protein, 410 aa, A.fumigatus
KACRRTIYLVSFSLFVLFNVLSAVAHSISMLIVMRMLSGGASASVQAVGAGTIADLWDPHERGRAMSIFYLGPLCGPLLAPIVGGALAERWRWRSTMWFLAVYGGILVIFIFFALPETLANRKQPHGDEQAPVEQQLSRMSSRQVVHFTAKWLKALKMVFLDPLKIVLYLRYPAVLLTVYYASITFGSLYVLNVSVEHTFSTNPYNFSTIIVGCLYIPNSLGYIAASVFGGRWMDQIMQREARKAGRYDEHGELIYRPEDRMRENAWLGAFLYPAALIWYGWTADKGVFWFAPVSGLGFCSTGWGKTNLVFQMAANFFFGIGSMLIFSMSTTMLTEFMPNKSSTGVALNNFMRNIFSCIGSLVTAPIIDAIGNGWLFTILGLVAFASSSVILAMKVFGPRWRKSMDAVSH

SEQ ID NO: 40885 - protein, 193 aa, A.fumigatus
LDGLTGGGQNTFSVYLTGLSSNVAYYHDDDASTSANANSSSTSTTNGGSTVTTGSQGQVVTQGEQTVVVTAPAGNGVGATNGLNEEKNKDGPNTAAIAAGVVVGVVGFCSLVGAGFFLWRFRKRTNVRPQYSNNAGATEHFGKPMSQDSMSDSRFDGDFMAQRRQSNGSIDDDQDFSRRILQVRLFSSALGIS

SEQ ID NO: 40886 - protein, 68 aa, A.fumigatus
RSRHILPLQNGLGLFLTRSYASNVTIFVKSPRDREMTGPVTHVQLIVSGYLVESVGFLDGSPLSRSAL

SEQ ID NO: 40887 - protein, 397 aa, A.fumigatus
FRGSREDDSLGSFTFLHFCFNFSAWFSLSLQDQTSLRMPASDISDAELPPRYNFIDDYSEGAHPQILESLLRSNTTQQSSYGTDEFSNEARRLIREKLHASEDEVAIHFVPSGTSANLISIASCLRPYEAVLAVESGHIVSKEAGAIEATGHKMILVPGVNGKMTPANLERVFEQNQFFPHMAKPRLVYISNATELGTIYTKAELSALSAVCKRLGLLILVDGARLGVALSAKDNDLTLRDMVDLTDIFWIGGTKMGALLGEAIVVKQHLAEGFVFHLKQHGALLAKSRVMGIQFVELFRTHLFFDLATHANNMAAKISANFEKLGYTLAAQTETNQVFAILPDRVIRRLQDRFGFYIWEKREDGHAVVRIVTSWATDSLQVDKFNSWVQQWTELDV

SEQ ID NO: 40888 - protein, 106 aa, A.fumigatus
ENGQWAMGNLNVMASYDSCFTLQNMYKKLIMDLFNHLCSAPFNNCTSITGVFKGTKGRLCLMCSLTHRIYAANIPSLISGTAFWLVPILSQELATRGEKTVGSFHG

SEQ ID NO: 40889 - protein, 471 aa, A.fumigatus
PPKRANPLAWPGLTTRIDSLIVIVVLYSQAKVKCIHEGQPPCRRCQRAKRTDCQLTDTYSSPSRRSKRTTLKSQRQRRVISGPTTALNSPPLPPEPQPDRPSPWCAENPVEALPSSTIIAACETYRKKFPVANFLHYPSLIAELSSNPASVDPVFVAALLSLCVRFMPDHRLEAAETYAEYACKQLAHRAFEAPSLYLAQSLVMITFYEWGSGRPYKAWMYSGMPALHVPYTRLMMSGMATYMIQSLLKTADDSMEHNPQDFQASQTQYEQLVRTYWCCFAQDCELSSGARQHFALSFRQISVPLPTSDRDFNFGRLSSHRLMPSDMSKHSPLSRNLTIDYGLTIVTRGFDIFVRILRFANESRRGRTLTLPQDPSSPRVVWQRLKEELDEWRFLQDVTVRYPATSAQAHVALGYGELFAYINLVYFMRYLPDSLPRLAHSNSSLVSSFYIETSSYPVSNLMPTCSMIRSP

SEQ ID NO: 40890 - protein, 90 aa, A.fumigatus
DYLPPPHHHRVTAYCCIHLTFPRIECDQYSTYNGDGTLALDGHRDPSNMFPGILSFFPNIGSFYLFQFLEGLEVHQASTNTIVISELPAL

SEQ ID NO: 40891 - protein, 60 aa, A.fumigatus
TRRNRVMHKAIKPPPACVKQQDTKTQNSEAVRPTMTGKNPRVTQMQAENQDNELIFLLSG

SEQ ID NO: 40892 - protein, 466 aa, A.fumigatus
ALSWFAPLTSKLARDTNRWTFSQDIRFAVRAEVQHREPFVAFFSYLRSKFDRITSSKSNTTLSILIALLSIAFMRALFLPSLPQSIPDLVKLSSFARSFEPLIYYSENGVQQIGTLQETGVAVWDLSESVRGTNMTSAPIIVRQLDELSESLKTLSLELTRFFANVDSDVDSILIVMDWAKRELETLSSQPPSSLPSIVLDNVHDLLSRLGTLERTDAPSGEATSSQLTTTPTTFGRVVTAVLGQTSAQRTQATLMRTFTEFLSVLEESINSELTHSTALFALFESIDRQFLNLQRTVVRESDAQERAEGEMLSSLWTRVLGPDAAMVRKYEKNKRLLANVRSRTVANKHLLMDHRGRLLTLKVNLETLRRKLVSPLVRRNDSVSFVGAVEGGSGRSHGRMLGPVEAVIEGQIRGLESTYDYLRSVREKQKAKLMEMVYGSGRKIPSPSMLPDGSDDLGSDTIEGV

SEQ ID NO: 40893 - protein, 184 aa, A.fumigatus
  UNSURE (177): Identity of amino acid sequences at the above locations are unknown.
GGKTNVSLQSLEACGRRSCRSSEMSSSTTSTPDKKLIYPESLGYGSKGERLVAGVVPLSHDKTRVLMIQSVGSGGWVLPKGGWETDEALAQQAACREAWEEAGVICTVHKDLGLIPDMRPSSVLTSSAPKASYQFFEVTVDREEDQWPEMHKRKRQWVTYAQAAAALASRPELLEAXNRSSLKR

SEQ ID NO: 40894 - protein, 79 aa, A.fumigatus
MNTAQLATPDQPVISNGSQYTHNRLPVPLASMYYSLDISQNSRVGASPLVPRLSSEVILHSYFMINSMECKDHEGDCIM

SEQ ID NO: 40895 - protein, 260 aa, A.fumigatus
  UNSURE (61),(64),(93): Identity of amino acid sequences at the above locations are unknown.
DFIAKMDYEMDIEPTGPQVTVREVCSSCLRKNVESSSSSREDAVDGFFQAEPYRVDFKLSXVDXAFANSFRRVIFAEVPTMAIDLVEVEKNTXVLPDEFFAHRVGLIPLNSKNCDQDVEYTRDCDCEDHCARCSVTLTLHARCTGDEIMPVYARDLVVSGERANEWVGDPVITDPEGKGPLICKLRRGQELKMTCVAKKGIAKEHAKWAPTAAVGFEYDPHNNLRHVDYWYEEDPIKEWYVLIFRFFFGLVPFLRCKSSR

SEQ ID NO: 40896 - protein, 151 aa, A.fumigatus
FFVSFSGSSHFYAAKAVANDLPRPVSANAAWEHAAPPDQPFDYDAQPNNFYIDVESIGNLEPDMIIQQGIVVLQRKLATVISSLSGAGNGGRNGLPEDEDMLGVRSPDAYEPPEGMDGGFTAYANGGTSAWGASAATPYGATPYGGGGYGF

SEQ ID NO: 40897 - protein, 107 aa, A.fumigatus
PPPFAALLPRGENQTVGSAKESLGNLIGNDNLRREGQEQNASGKAQEAKGQLQDWGEGAADRAKGALGSVGAAVKGDRTEEDNWRDVHDEGKVRHIGAEVDMEKRYD

SEQ ID NO: 40898 - protein, 311 aa, A.fumigatus
SRCVFFHRNLMTSGGSSVIRHSGTTKSNVELINSLRANFQAAQQLAAAAEAEAKPTERYKAWTSMQDDALYIPAIDFSQHGLAEERSQYDITVKLFYLPGIPVSRRCAHTRQAIDLVLKELHVDSIDLLIVSFPGILFDAEDDSEGEVSSDDGSEEPDDFDSIIQSWRTLEGLHEQGMIAQLGVAEFGSDRLARFLPHTKVKPSVDQINLKDCCVVPKSLILYAKQENIQLLTHNDCNDILPVGTTRELLGPGEKGAGILASAPDADDGIKGDVEPQWVVKYTSVVKDRGVVENKGYFALADVGTCIQTSS

SEQ ID NO: 40899 - protein, 61 aa, A.fumigatus
VDSAIMYRNEKACGRAIQNSGLDRSEVFFTTKIPPGSMGYERTKRAVDASLQEAEVDYFDL

SEQ ID NO: 40900 - protein, 209 aa, A.fumigatus
TLRSCTAMKKPAVAQSRTLVSIAPKSSSRRRSRQARWGTSAQSAQLTLVCKRPRWIILICRYLPVHGPDACTESYDRILIHAPYGGKDARLGSWRALVEAQKAGKTRSIGVSHYGIHHLDELEEYIKGGEGRGKIDVGQYELHPWLDRSEIVEWLKKRDIVVEAYSPLAHGYRLNELILKTLGKIHGKSPAQIMIRWSLQKVSVLSVYI

SEQ ID NO: 40901 - protein, 80 aa, A.fumigatus
RKIPLVLHHSAVFDHRRVLDHPLWLNIAFDPVVGIWSGRKDSSALLAWTQQLPCRAYWQNIIAVVMRKQLDILLLRIENQ

SEQ ID NO: 40902 - protein, 62 aa, A.fumigatus
EKYDWMSGLLEAFMIYTHDSVVYLSYEKINIHVQSFVIIEEPGYCATLYRTMQRRKMCTLQE

SEQ ID NO: 40903 - protein, 169 aa, A.fumigatus
DYLVLPSTEARHQVDVLRQNLAKDNDYYSYSSRIHPDRVITETNATDSYQNVLFSLLRFRSYVGAYPRKITVVTHEFKRQRFMECHFPALGLRAGGQASCPGAVVGINPPEEVTPLASLISGEEKSGIGLWRLDPYGVGEELAAKRVKRGWKPGKGSRTVCWDEVGRCR

SEQ ID NO: 40904 - protein, 282 aa, A.fumigatus
QQSRTMASTDPYTPPPLPSPFTNTTPPPQLLTQGAEAHLYKTVFLSPSTPAALKVRPSKPYRHPILDRRLTRQRILQEARCLVKLVREGVNVPAVLALDWEGQSGEKGFGGAWLMMEWIEGMVVRVVLERWEKYMKRNQAGLGAEELEKEEARVRDLMKRIGHAVGALHKAGVIHGDLTTSNLILRPPTRAEQQPAADETNPSMEGDVVLIDFGLASQSLQDEDRAVDLYVLERAFGSTHPRTEPLFTEVLSGYKESYKGASSALKRLEEVRMRGRKRSMIG

SEQ ID NO: 40905 - protein, 71 aa, A.fumigatus
APIKWEPVDVTPILKDGKTTIPEEAIKSVQKNYVALKGPLAVSQPRALAVHISIILRWNLADSCWQGSCFP

SEQ ID NO: 40906 - protein, 72 aa, A.fumigatus
AACVSLRLVLFAFFLRPIRPFLVAFFVCPGLLGPYVFFPGTGSFTSFNLDLESHRTGASRSLASIAGSFSAS

SEQ ID NO: 40907 - protein, 250 aa, A.fumigatus
DGILQTPVGKGHVSLNLTLRRTFNLFANLRPCRSVAGYKTPYDNVDTVLIRENTEGEYSGIEHVVVDGVVQSIKLITREASERVLRFAFQYARSVNKKKVRVVHKATIMKMSDGLFLNTAREIAKEFPDIEFDAELLDNSCLKIVTDPTPYNDKVLVMPNLYGDILSDMCAGLIGGLGLTPSGNIGDECSIFEAVHGSAPDIAGKGLANPTALLLSSIMMLQHMGLHEHAARIQKATFDTLAEGKVCSIP

SEQ ID NO: 40908 - protein, 133 aa, A.fumigatus
KRTQGAESYRRRPPLLVPVPPPLPPFCLDLVVCARVLLVVGEPPVSPSASSSSLSSCAPSDPSSSPSSFAPVSSDPTSSSPAPDPLRASISTWSLIERVPRVPWRALRVPFLPRDGAGDERGSITGQELESCE

SEQ ID NO: 40909 - protein, 91 aa, A.fumigatus
GKYTVTLIEGDGIGPEIAQSVKDIFAAAKVKLVLLVCPRAEELRTKIVVGPHQVGARRRHPHLEGRKDHYPRRGHQKRAEELCRSQGSSCC

SEQ ID NO: 40910 - protein, 649 aa, A.fumigatus
QLLLEDLNEGLFKSHLKLHVEDADPLPQLDNIEGHNFFLFDQPAESVTDAFSDTQVDDNLSHQNNDISEAGSDSIWTLENLQNTTIPEIARRSWERYHDRSSLEPMSAYFSESGGKGFDSALTRQYSRNGSKDAGRVARNDVFFHALFRLGLGWNSVFFRYNKQRKAFERVSDNIRVSGVSLAVVNGLTEEVLRCGTAMYNLRDFARRTRIKPEGFSARSAFASAVAMIIYTLEKQIINYFKEVSSLIQIMTLFQRCGDLVGALSNIVEAVQKAASDAQVISAVIEKAAHYSEAFGSMENLFRELVARVIAPWLQYVEAWVGLRTETPALVDLAAKSEGFVAVERYEGRAGSRSMKASSLQYRYHPEQMPTFIPAEQADLIFETGRSLRLLRRYHPQHPIANDAILTKDSPNLRCAGSWSDIERIQKKAQQYETQLRSEILKYSQGQRVGQVEMDKVLAEEQMQKFVSAGDDPAISPAFELFDIDDSKHTTGLLASDSSLENDELGPLFDASTLEVSRPIHPHRKNFGPEMISAVSLSLAPLLSSQALLVDFSCLHLLFKEHKLRYHLTLQWRFQLLGDGFFASRLSHSLFDPEMESGERRSGVVRSGVHTGLRLGNRDTWPPASSELRLVLIGLLVFTTGLDGSELRI

SEQ ID NO: 40911 - protein, 136 aa, A.fumigatus
RIQMVRNFYNDYSHDSNSCPVIEPRSSPAPSRGRKGTRNARQGTRGTRSMRLQVEIEARKGSGAGEEDVGSEETGANEEGDEEGSDGAQEESEEDEAEGDTGGSPTTRSTRAQTTKSRQKGGRGGGTGTRRGGRRR

SEQ ID NO: 40912 - protein, 88 aa, A.fumigatus
SDRTPIIQIAFCSSLSFSGQCYVTMPPKKKPKLADVQAESVQPAADTPASEGAGKPENGHDLVSDPWTDEQETALLKGIIKWKPVGKF

SEQ ID NO: 40913 - protein, 261 aa, A.fumigatus
TYLALSQGVEGGLLNTSSVLVETHVLQHHNTGQEQSSGVCEALASNIGSRAVNGLEDGAFITNVTGRSEAETTDQAGAHVGQNVTVQVGHDKDLVVVRSGIGNDLQARVVQQLSIKLDIGELLGNFAGSVEEQTIGHLHDGGLVHNTDLLLVDRTSVLEGETENPLRSFSGDELDALDNTIDNNVLNARVFTLGVLTNQNSIDVVVRSFVTGDRAAGTQVRKQVESTTESKVKGNMTLANRSLQDSILVLYLCGPQGREVD

SEQ ID NO: 40914 - protein, 265 aa, A.fumigatus
GRRRHCIKCFLGAGYALSPHIFRPLFITTIKWVSSTNISLVYNMAQLSLSTESISTLSSEMSHFGGSRSESFGTSYSEDEDADHFVHDAAASVYDSLKDGVTSDVVQLELVSLRMTANASDHQVRRAVVTAFMKRTQQLIEGGKGAGEAIRDLFGTYREVVERCMFDRDSDEKTDQVDFLLLLQQDLVHRPRGETVLLFAAKELYDLELFEEEAYEQWWADERSSASEEMRQVRSQTQQFVDWLANAEEEESTEEEESEEDSDEE

SEQ ID NO: 40915 - protein, 330 aa, A.fumigatus
REPCRYQTLLMRTYVDDKENLKWCPAPNCEYAVDCPVKQRDLNRIVPTVQCACKHFFCFGCTLNDHLPSPCKLVKMWLKKCEDDSETANWISANTKECPKCHSTIEKNGGCNHMTCRKCKHEFCWMCMGLWSEHGTSWYNCNRYEEKSGSEARSAQAKSRASLERYLHYYNRYANHEQSAKLDKDLYLKTEKKMTSLQSQSGLSWIEVQFLDTASQALQQCRQTLKWTYAFAYYLARNNLTEIFEDNQKDLELAVESLSEMFEKPVPELANLKVDILDKTAYCNKRRVILLSDTAQKLKQGKLYSLHNVDAWHKADNHISSGVWSFNVEW

SEQ ID NO: 40916 - protein, 237 aa, A.fumigatus
LARPSTRGEDDHYAARVRNLKAYDAVSKDIISRWTYPLCPDTNLLPGHTYDLRKGNLYAEQGVTLARSCVVGRQTVIGKGTSIGDKTTVKNTVLGRDCKIGKNVTLDGAYIWDGVVIGDGTTVRQAIIADKVVVGKNCSVKPGALLSYEVRIADGVTVSEGRRITKASREEDGGLPANDLDVVGEGGEGHEYFQEEDEDEDDTVSNASSGLGMHYLPTFSGPSLSPLSNGCQVLISP

SEQ ID NO: 40917 - protein, 85 aa, A.fumigatus
GRADNPGSAGPAHAVYFGTYEVVKEMAGGNVDEGHHPLAAGKCSNSNSIDAGKNTDILQAASGAAATIASDALMNPFDGKSSSMD

SEQ ID NO: 40918 - protein, 69 aa, A.fumigatus
HLEIVIKQRMQVHGSVHKSLLQCATSVYRAEGLHAFYVSYPTTLLHDGAFHGYSIRGVRVNLESDEPIS

SEQ ID NO: 40919 - protein, 317 aa, A.fumigatus
IFTTPPLTRKRKAAEAAITDQEPSITATEVSVADSRTATGKTSSNKRPTRRRDKLTDQGPDADSVSVASASITVQNKQKATDLVTPASTSMDSDDDFMTDASSADDFLDTQGSEDESLGEGMLQRFSVSYSTDAVFLLLLEFGDEFDGGFSQDKDLLGNTKKPYEVDFRVLSPEDIDREQSQQVNEVSQILGLPPESSAILLRFGRWNREKLIESYMDHPEETLEEAGLGTNFDMTPKTEVVPGFMCDICCEDGDDLETYAMRCGHRFCVDCYRHYLAQKIREEGEAARIECPGDGCHMIVDSKSLSLLVADDLKER

SEQ ID NO: 40920 - protein, 155 aa, A.fumigatus
SSSNGCKYMAPYIRAFYNAPRPFTAPRVCMHSTSHTLLHFCMTVPFTATQFVAYESISKVMNPSHEYDPFTHCIAGGLAGAFAAGLTTPLDVVKTLLQTRGLAQNEEIRSARGLFNAAAIIKRQFGWRGFLRGARPRIISTMPSTAICWYVVIRA

SEQ ID NO: 40921 - protein, 69 aa, A.fumigatus
RWCRQRWKGKLNYEALAPKGAVTSLIKFSVKGEERGVIVLSYHVWSLDVTGVGRLKSLEASMHCYPRHQ

SEQ ID NO: 40922 - protein, 72 aa, A.fumigatus
  UNSURE (53): Identity of amino acid sequences at the above locations are unknown.
PQGKLSCLPNASTSIGYIGQAAEHFDLGAHIFVLKISLRGAAASMSPMKEALXYQAQNTRPKENLCTQYLNP

SEQ ID NO: 40923 - protein, 420 aa, A.fumigatus
LDSAVDRTYRNKHFAAAWKKSTHGGPKTSTANGAPASGQDSQDEPVVLPTPELIASFAHLPIPRAEPEIEGTPPPPCPIANIPTEVLLVILRHVALMDPASFCRMALVCKRLAYHFANEQHIWKRLCQGFEFGFKSMHYSFACDIHGNPEYTMRQRYTPFPFSVPVQIPKPLSSWSQVFQMFPRIRFTGVYLSTVNYTRPGAASSYHNISWDSPIHIVTYYRYLRFYSDGSVISILTTAEPLDVVPYISKENMKAARATSSHRHHQRNTSDPGITLAGGAEPIPPVALSALKEARRGRWHLVKPLAASESEDDNRIPSVSDRPPFPVRTVHTPALDPRDVIIETEGVGSKYTYTMHLSLRSSSGGSKPANPTATPANTSKNTKLVWKGFWSHNKLTDDWAEFGLRNDRAFVFRRVRGWGM

SEQ ID NO: 40924 - protein, 730 aa, A.fumigatus
YFLCQQKRSHTRLIMPERVRIVFDDSDDAPVPKKVPEAEQIQGSEPVKRKDQPTDHPKKKSKKRKVEWPSDTRSQESPSSNETQSEPVSRDTNEKDAVNGVANGTYHHSKNKKHKMKNQAPQGAKHKFTSLREKAKALYETRKNLPIFPHGDEIRQKLRVNDVMLLVGETGSGKSTQIPQFLVDERWCRPTKATVTQDNGSKKELTVGGCVAITQPRRVAAISLARRVAEEMGTPLGSSSPASKVGYSVRFDTSTSPSTRIKFLTEGMLLQEMLHDPSLTKYSAIVVDEVHERGVNVDLVLGFLRNLVSGKKEGRGGVPLKVVVMSATADMESLIDFFKEGLQGQGDTKTTKGNNDQQDSPQANGEDKVSVCHIKGRQFPVKTIYSPAPVHDFVDAALKVIFQIHYKEPMPGDILVFLTGQETVEALEHLVNEYAAGMDPALPKVQVLPLFAALPQVAQQRVFLPAPPRTRKIILATNIAETSVTVSGVRFVVDCGKAKIKQFRTRLGLDSLLVKPISKSAAIQRKGRAGREAPGQCYRLYTEKDYLALDETNTPEILRCDLSQALLNMKARGVDDVMGFPFLTRPPRESLEKALLQLLSIDALEESGKISSRGQHIDKIHKTPTLGRVLLAAAEHGEGCILDVIDIISSISVENIFLNTTSEEKKEEAEKARRDLYRREGDHLTMLATVQAYAAENTDRKAWAERHMVSHRAMQSVMVCCHYSSPSNAL

SEQ ID NO: 40925 - protein, 120 aa, A.fumigatus
  UNSURE (17): Identity of amino acid sequences at the above locations are unknown.
LLQDVRKQLTAQCRQAXLLPSASDSRNGSTNSATREPSPVLILQSFLRGFSTNTARLVPDGSYRTVVGNQTVAIHPSSVLFGKKVEAIMYNEFVFTNRSYARGVSAVQMDWVGDALTGAL

SEQ ID NO: 40926 - protein, 101 aa, A.fumigatus
APYHTAVFSSKEQGASNTKVLIVKQAKWRSSHPLADLTDMSSIRIGLVTSYFIAASLWQECISDVPMLSEGRKLSVLQCERKQFCTPEFITEQIRGTFCGL

SEQ ID NO: 40927 - protein, 82 aa, A.fumigatus
LCSATPLDVVRVRLQSQSSVHNASPYTSHTTQTLKHLPPNLGVTACCREVFWFGQDPQVCMVGPGTGTLGLFITIAKGRDMQ

SEQ ID NO: 40928 - protein, 63 aa, A.fumigatus
LEIDFFLCIYQNDKGPGEPHDEVYSPEALFRSDWLQTFDIHFDNELAHDYYGDGKKLAEKYET

SEQ ID NO: 40929 - protein, 185 aa, A.fumigatus
ATRRTGTLGLYFAMKILGYTPYHMYEVALVQGTPGMAALLEAVIAEHNRLSGIKRFDKGDLDKLTADYDVRVHVPIAFWILTMLQCLIEIPSFLGPALLDEYAQDPEVKIILTERDPDRWAKSVNGTAGFVVKAAASFPLNVLKHFDEELGIFLALNTTVYAVVADSTKPGQPGNEAALRRNYVE

SEQ ID NO: 40930 - protein, 336 aa, A.fumigatus
  UNSURE (9),(322),(335): Identity of amino acid sequences at the above locations are unknown.
YRPPPLRLXYRHSADPSAPVVKIAMYDMTSFHRFEVSGPGASALLCRLMTGRVPDVGQIAYTLLLNERGGVRSDLFVTRLGAEMFQIGANTATDFAYLSCEARRQGQKSPRQWVQVREVTGHTCCLGLWGPRAHDVVRTLTTDDLSNTGLPYMHAKRTTLGGLPVTVLRKSYVGESGWEIQTSAEYGHRLWDIIWAAGQPHGLIAAGRAALNALRLEKGYRTWGVDMTSEHDPFEAGVGSAVQLDKQEDYVGKAAVQRLARVQPTRRLRCLTIDDGRSMVMGKEPVFWKNKAVGYVTTAAFGYTIRKPIAYAGFFIRSETVXRWTWNISGGRSGXR

SEQ ID NO: 40931 - protein, 75 aa, A.fumigatus
VAPGEYWGDLLKFFKKLTGFGNQVLFLFTVAAQHFGGMRHNQIAAEKSANSTSSPHCPAFHILQSAKSKNTGRRR

SEQ ID NO: 40932 - protein, 328 aa, A.fumigatus
GEFSIDLAISERPSSINDPLLEEPHLLYCSVCGTPTTDISDSGPTEEQGVERKKGKGIYQKRLRYMVMAAEASSQLALLSDLTPPSLERTWLTAPHPTLPIVATCSSDKTVRVYSLTNFRLLSTISGGHKRSVRTCAWKPHVKGESVLATGSFDATVGIWRRWDSYGQTERGIEDWRHADSHDHVDGMGAAGINNGGGDSADEDDEEWRFAVLLDGHDSEVKSVSWSPSGMLLATCSRDKSIWIWEDLDDGDNNFETVAVMQEHQGDVKCVAWHPVEECLASASYVDTIRLWREDLDDWGQVACIKGPPGHGMVRRLGGRRECAVRTN

SEQ ID NO: 40933 - protein, 103 aa, A.fumigatus
RRYEWFECACCPPNVTRTLGCLGGYLWSYKVNNETQKATVNVHLYTSATLRFEVADSRIEITQKTQWPWNGDVTFSVNIDGPPVNLELRLRIPGWASTWEVSG

SEQ ID NO: 40934 - protein, 223 aa, A.fumigatus
LASKGHQGTVWCVDWEGAENVPSAPTDLPDDDPVTAQWKKAHALSGPRLVSCSDDRTVRIWRRQPKEQHQHQAQPSPSGGSGIPSIIRPTGSDEFWDEECVLPQAHDLSIYTVAWSKRTGLIASVGADGRVVVYEERFIVGSTAEAMETDHPTSADGTAADSPAALRTEWRVIATVDGAHGIYEINHVTWAKRADRGRIEGTDEEVLITTADDGTVRVWTLKM

SEQ ID NO: 40935 - protein, 602 aa, A.fumigatus
  UNSURE (531),(592): Identity of amino acid sequences at the above locations are unknown.
TSSATQIMIRRNSDIEIQLPDAGPTVAPESVTEPDVDMLPDEQKPPLNLPARIAARFSRKSSLARRSSATSSRRSSISSLHSHHSNASSNGSSSTDHVAQHLRRTSILENRKARLADRALHAEKVRLRAALAAATKNLQREERALAAQQSRERLLAQITAKCEEEVRRAKKKAEDNRERLAAEHARLRLEMAEKFAEAEKRRLLYQQTQRRHRTSSLPATEEQKMAQVVTKSLTRDAAARTIQRVWRAHHAKLVMQEFRSLNLTVNRIRTMSFEDVGAMLSDENVLSATARVLRLCGLQDMESGTVGGRGAVRTFLSSYLIVTHPAEVLSSNGEQEQDLISKARELLEEFEQVTPILAGCYSPTVISTDLQTFCEAYSVFFSAFHAWKTHDSSVLIEIMLAQFVELELIWQTVKDDRAGGVADDYWQGIRQNQILLLARLKRLAGSDKAMQMVRDSLKKAKRERKRTTSKQAIPRSAEVAPSSAEALTESVASPLSESFNNVESPVFRELDKQRISPHERFTQVLTALPEXRALVHELLINKEYKVDETQYTTPRKQIMKHMCDMMRRDVDAGMGANGTVAMATVIQDRLLXCCDPETHFTF

SEQ ID NO: 40936 - protein, 160 aa, A.fumigatus
PYCGTVTQSIYYAYFTSYLSSKLTYSFFFAAGFNSFASRSAKLSPLLSNYQNPTVIFDWYGVATEAVIGAVSRAGRQSHRLQDGERGIPLILHTLYGNTTEYFSDLPSTLPIIKKKQYEWRWQNPFPVQATQGWLIGAQSSLFPGDEAARSRTHFVWSIL

SEQ ID NO: 40937 - protein, 90 aa, A.fumigatus
LLSLGGRKVGPFSLSLLYPSAGDGGRLHSIIIMCRFPPSNFPHLILIYYYSPPYFPPTVRFYWSRILSITFPLSADGVLKCFIFFSCVPV

SEQ ID NO: 40938 - protein, 62 aa, A.fumigatus
LHLAYRPSLHPDYFPLPSNHNAITIASSSIPLSGPLVAAQAYLTTGLPWVAPPTRRPQLPIN

SEQ ID NO: 40939 - protein, 484 aa, A.fumigatus
RNGKMVNGTAAVLEPTFTGYVATTQDALILFEACLTGILHHVPRRPHDRERSHLVRSGSVFIYEENSSGIKRWTDGVTWSPSRILGNFLVYRELEKPFPPGEKKRAMKKANRRPVPSARPGEPYPRHDSNGGSYSPSSTSGSFGDRSHQSDVERALVGSLVDSYGFKDSGLVKKTMSVTVSGVTHHLVSYYSVEDVMRGVLNPPSMVESLRYIRPRAELTQKQSFRAPIDDLETGGLENPNDPSHAIYGYRPQLMAPPGYAMPNPHPEFYLHTAPYTAFHAPQFAPIPGYSIGSSMPAQPAPNPYLPAPSAPAHVQQKTEDYPQYRNPNPAPSAYGTSFDSISHAPLSSSMPSTLNSSIPSSLSERNRSTSDQSVSAYRNSSISSRSVATDVTSPIDPSTPATFSRGNSFSLSGHMDGPSQQPPEQRGIAPAFDPSIPRRESIPAHYYAGSDRPQYYMGATAPAAHASYPVSTWTTAAPAQPQM

SEQ ID NO: 40940 - protein, 72 aa, A.fumigatus
SGCLIEAIFDVIDCVRLVAKPTFMEGEDVINIRIDRGISRIPRHVDWDVLIFQLMDFQGQRPVIQAQVPLLI

SEQ ID NO: 40941 - protein, 137 aa, A.fumigatus
TKPPLRLAMRFSLAATTLLAGLATAAPSSSKNDVNLDKLARRNGMLWFGTAADIPGTSETTDKSYLSILRKKFGEMTPANALKVSQSDSTPLLVSALTDDVIHIVHVYRARAKCLQLHSRGLLHGLGRSLWSRRALP

SEQ ID NO: 40942 - protein, 284 aa, A.fumigatus
FMYTEPEQNVFNFTQGDYFMDLADHYGHAVRCHNLVWASQVSDWVTSRNWTATELKEVMKNHIFKTVQHFGKRCYAWDVVNEAVNGDGTFSSSVWYDTIGEEYFYLAFQYAQEALAQIHANQVKLYYNDYGIENPGPKADAVLKLVAELRKRGIRIDGVGLESHFIVGETPSLADQLATKKAYIEAGLEVAITELDVRFSQAPFYTAEAQKQQAADYYASVASCKHAGPRCVGVVVWDFDDAYSWIPGTFEGQGGACLYNETLEVKQAFYAAAEALENKPCTVC

SEQ ID NO: 40943 - protein, 363 aa, A.fumigatus
FTVLDHVPFITRVIQRLRRCLLNWLKYPSPSPYVQHQTKDQNVLGTPYLLIEYIDPMRGKMLSETWEEGRHNTTLRTNLFRGLSRIMLTLARIPLPKIGSFTLDEKGYLSLNNRPLTLEIHQLENEHIPVDMPRNATYATVDSYVNDILAFHESRLRHQPNAVNNIEDGFYQTSALMVMRSVWSCFFRRDLLRGPFFLNLTDLNQTNIFVDEDWNIKCLIDLEWACSHPVEMIHPPHWLTNQAVDLISIGDYEILRKEFMMAFAEEETKIELPVRLYPILQGGWERGTFWYSLALSSPTALFKIFYDFIQQRFSTAHDDPAFWKITMPYWTFNTYEFIKNKVRDKEQYDVCLREAFEIGDPHG

SEQ ID NO: 40944 - protein, 96 aa, A.fumigatus
GTRSNTMSVYVKPLRLEILMARPYKLNALHSLPFTLAPLTTTLFFPLEVLYCSLKVLNGLLPSVLLCSFARRRELVEGLGVHLHSHLRLFNFTIIT

SEQ ID NO: 40945 - protein, 60 aa, A.fumigatus
TTFNLLHPLLTDIYAFRSTVTFPVFTSTIHFCIFISPAEMVRKRRTRKLFTSEIISLLES

SEQ ID NO: 40946 - protein, 500 aa, A.fumigatus
PKMLSRMGSMLDDSSLAADASVLVSLRSITTHVSRTLATALGTTTMVCVLSMMMAGPWTRVLFSSLSSRYTGVSMRARVAIEVCLGDIIRRVTDVFQRRLLQLGRVDSFPCALWEAAIVRTADVINEDCSLRIEAEFSAMTVSELVEETRVFLRLQDHQAGVRPFISHVEVQFMMDLIGTEALCHHLLGSSLGHGVKSFLQRRLRGVVVGRDWLLRLLDDFSQGQAVSRQDGGVLVDDDAGDSKGRSNGTGVLATGTTKASQMMGSSFISASLGQIANRTGHGLIRHLQETQRDLFRRVLGLALFSPFGVDLVRQFVEQLRSNFKVERLVLVRTKDVWEVLRQQATKEQIGIRHRQRATLAITSGTGVGRSRFGTNIEQTIPPGEDGASTRCHGVDVELGGLDQNASNLGSEHMLQMAGEARNVCGCATHVETNDGNLLSGIIAGGRETDHTSSRTRQDRLQPAEATKVNQATVGLHKFEATLSLLFQTPFKGGRDGINV

SEQ ID NO: 40947 - protein, 708 aa, A.fumigatus
VHFLSPSIPLRVFTSSPHTYTNTMEEESGKITISIDRGGTFTDVHAIVPGRPDIILKLLSVDPGHYEDAPTEGVRQILELVTGEPHPRGQPLKLDRIRCLRMGTTVATNALLERKGARSVLFTTKGFRDLLKIGDQSRPSIFDLTMARPGVLPESVVEVNERVVPCHPSADKDCFPGARIVEGVTGEKFRVVQELDLDAVRVELQRLKEQGYQSLSVALVHSYAYPEHERLIGELAESMGFSVTLSSKLQPMIKVVPRGMSAAADAYLTPVIKLYIDSISAAFEGGLEQQRECRFEFMQSDGGLVDFRRFSGLKAILSGPAAGVVGFAATSYDPTEKIPVIGFDMGGTSTDVSRFAGHLEHVFGSKVAGVLIQSPQLDINTVAAGGGSILTWRNGLFYVGPESASAHPGPACYRKGGPLTVTDANLFLGRLLPEYFPHIFGPNEDQPLDLEVTTKLFNELTDKINAERREKGQSEYTAEEIALGFLKVADESMARPIRNLTEARGYETASHHLACFGGAGGQHACSVAASLGISRIIIHKYSSVLSAYGLALAEVVKESQEPVSADYHASQSTLQKRFDAMTQAATEEMVTQGFRADQVHHELYLNMRYEGSDTSLMILKPEEDSGFLDQFRDRHRREFGFNSERAVLVDDIRRAYDRRFPKCARKRVHSSQLKEASLKDVSHPPDNVTKAYFDGNSSPHRYPSVSAR

SEQ ID NO: 40948 - protein, 440 aa, A.fumigatus
VITPVFDRPGGTEIMFYVASRGHHADIGGILPGSMPPKSTELWQEGAAIEGDKIVSNGVFDEKRIMELLVDGPAQYEGCSGARCVSDNISDLKAQIAANARGISLIQALFAEYGVETVQKYMYAIQHTAERAVRDLLKGLHKKFGGRPLEAVDYMDDGTPIKLKVTIDGSDGSAVFDFAGTGPEVYGGWNAPIAITHSAIIYCLRCMINADVPLNQGCLAPIDIRVPSPSILSPTKTAAVVGGNVVTSQRITDVVLKAFRACAASQGCCNNLTFGTNARTDPTTGETLPGFGYYETIAGGSGAGPTWDGESGVHVHMTNTRITDPEILEKRYPTLLRQFSLRPGSGGKGLHPGGDGVIREIEFLAPMQCSILSERRVHRPYGLEGGEDAQPGMNLWVTTDKETGVERQVNIGGKNTVSVGTHDRFVIMTAGGGGWGAAQA

SEQ ID NO: 40949 - protein, 297 aa, A.fumigatus
  UNSURE (297): Identity of amino acid sequences at the above locations are unknown.
QLDCRHGARLDAADKNWHLTSPTPYDPPLSYGGWLQSRALGARIINLLQSFDDQPPVSSIVPSDEPKFPSSLPNSKKKRRFIIHTSPYLRCVQTAIAVSSGISQHYTDSDIVHPAVASNSTQANGHSMGSTADSRSGSTSSPITSSPSLSGPNNHRCLLRVDAFLGEWLSPDYFDQIIPPPKSERLVAAAKAELLRRGDDVVPEADTANKPSTGNFPGGWGGFTNSDTARVDGTVNSGGPSPGVTHTPGQRTRAGSYDSLNSAQTPRARRILGKINTDLPPIPDGAYVPPTPSYAIX

SEQ ID NO: 40950 - protein, 374 aa, A.fumigatus
VNLVCSYQLEPRSHAMSDPEPPRIIRCGAPRDNWRTGFVSDHSGQAGHLAIGWIGARQARQWVRPLDHVEKVKVVLAGSSIVRASDTQNQEILFAVKGAAASFGIVTEFKVRTEEAPGLAVQYSFTFNLGTAAEKAKLVKDWQAFIAQEDLTWKFYSNMNIIDGQIILEGIYFGSKAEYDALGLEEKFPTSEPGTVLVLTDWLGMVGHGLEDVILRLVGNAPTWFYAKSLGFAPRALIPDSAIDDFFEYIHKNNPGTVSWFVTLSLEGGAINKVPEDATAYGHRDVLFWVQIFMINPLGPVSQTIYDFADGLYDVLAKAVPESAGHAYLGCPDPRMPNAQQAYWRNNLPRLEELKGDLDPKDIFHNPQGVMVVS

SEQ ID NO: 40951 - protein, 294 aa, A.fumigatus
KTSVTRLIMSPRHTSMATLARIDTPVYLLDKLEKSTRVHGPAIIIDKTQTIVVVPNAVASVLETCVVIDLKDTKTDASAASDESSNIDPIRLSIFGHRFMSIAEQMGRTLQKTSVSTNIKERLDFSCALFSPDGGLVANAPHVPVHLGSMQFAVRYQHQKWLGNLKDGDVLVANHPSCGGTHLPDITVRSTIRSAILFTDSIRLLRPSLTAPAAPRSCSTWRLAAITRTLEASFLDRCRPNPPSYGKKELLSRATRSSATAFSTKNASWSFWLTGPLSTRAAQAQDVSATTSRT

SEQ ID NO: 40952 - protein, 145 aa, A.fumigatus
RPSGAPHADPAVFELGVPVLGICYGLQEIAYRLGKDNVVAGTAREYGHADLNAQRLDNQGHVDKLFAGLEEHVKVWMSHGDKLVKLPEGFHTIATTANSEYAGIAHETKPVYGNSPIAAQPFSYLLTQPQAFSSTPKLQYDPFAQ

SEQ ID NO: 40953 - protein, 73 aa, A.fumigatus
LILQGDKRVYAEIIILRAVETTDCKLTLGIDGDFVLRYIISVMTARAFPFDNEFLSKCATRIINEVHGGKFES

SEQ ID NO: 40954 - protein, 237 aa, A.fumigatus
  UNSURE (237): Identity of amino acid sequences at the above locations are unknown.
RSHRHSVPPRSYSMILSLNSRQSARRSNQAQHTPDGAKLLRNFAVDICGANPNWTMSKFVDQEILRIRKLVGETDHVLGAVSGGVDSTVAAKLMKEAIGDRFHAVLVNNGCMRLNECETVAETLNKHLGINLTVVDASKRFLDGLKGVTDPEKKRMFIGATFIDVFEEEAEKIEALAENSGAKVKWFLQGTLYPDVIESISFKGPSATIKVCLPRLFWGVCYSHISLDASQCRCTAX

SEQ ID NO: 40955 - protein, 91 aa, A.fumigatus
CNGRVLGEVTPERVDIARKADHIFISMIREAGLYDKISQAYAALDPSKAVGVMVRLVASLNWFQSNSSCRVTSASTLRSSFCARLRPPTVS

SEQ ID NO: 40956 - protein, 74 aa, A.fumigatus
ALRLYPVNLAIHVTDKPGEGHFTASPLDHRFPLGLSVKPHSSKELKLSQWYDQRNDIDFYAAKGGQWTKNNTQS

SEQ ID NO: 40957 - protein, 261 aa, A.fumigatus
TTTVKMTAPDIHPPNFTSCLDQTQSSLFSIIPPEIRREIFAYALAACEDTKNPYSKDTYWTRPGYDAPRRTYTELLRSCKRVYQEAWFMPFTYAEHAFYLTWRDRAPKQLSPMAFQQCLDLIHQMHGKVEAGRIRIFAQLFMLEKGHAMTALLDMTHFYPRSITLTIRYTDFWMWEENQPLYISAGWVNRICFPESVRRFSIDFESIERRKDEVEYIANEAAEKWFFRRKDGRFLTADKADMSVSQWNGEFYIEQQEMAEG

SEQ ID NO: 40958 - protein, 145 aa, A.fumigatus
QTPQNRRGRQTLMVAEGPLNEILSITSGYRVPWRNHLTLAPEFSAKASIFSASSSKTSMKVAPMNMRFFSGSVTPLRPSKKRLLASTTVRLIPRCLFRVSATVSHSFKRMHPLLTRTAWKRSPIASFMSLAATVESTPPLTAPRT

SEQ ID NO: 40959 - protein, 96 aa, A.fumigatus
RHLSKLIEASQSFNRKSDLCRHHRIHTNERPYHCTVKGCNKSFVQRSALTVHFRTHTGERPHACNFAGCEKAFSDVRPPPHITHMYCSLNLRSPQA

SEQ ID NO: 40960 - protein, 73 aa, A.fumigatus
LKEHVLVSRDTHENEITSPRLLATSIVWSSSLALTPQSNQFQERNPAAKSNRPNLILHGRTYTTAILVWPGML

SEQ ID NO: 40961 - protein, 194 aa, A.fumigatus
DTLDHIGVQSTLEEPLDLGTGVLGQGLDLLRLLLKDVDEGSTDEHALLLGISDTLEAIQKALAGINDSEIDTKVLVQGLSDSLALVQTHASVVDKNGVETVTDSLLHELGGNGGVDTTTNGTENVIGLTHQLPNPKNFLIDELRHGPIGIGTTNVDGEVAEELGSIGGVLRLVRPSCTLPTIERKDHTVTSGWN

SEQ ID NO: 40962 - protein, 99 aa, A.fumigatus
HSPTMRIQSSLSSWFLSSALFTGLASASGSFDCRNIIAEGIKYDLYGLHGVHTIYHVDKAEDYIVNTTYVLDICKALGKASIRGDLKCGTSKNSACHGT

SEQ ID NO: 40963 - protein, 116 aa, A.fumigatus
LLFYSVVCGFQYKYTPDGSEEISHAFPIAGLDPLGHGSKDAEVTRLKGDGQEGLLVKLAGGEYIDKDKKKKDARAVIEFQCDPDRSGLEGLSFCGGGRGGGGDAPIFTTGVEGYAL

SEQ ID NO: 40964 - protein, 184 aa, A.fumigatus
TGFSCCDLGTMQTHYYRSPASPNHQSGRYELPPVQSVTSPSGPFPQGTSAGLCSAPPSRPGSGLRMAQLLQPLGQPPSTTSTYTRSYESSGSPAEVPPIRSDVSSLNGSVSGGSTLPPASAVGQQQQQPPPPPPQQHHHSHHHQQGHLHQKRAYRQRRKDPSCDACRERKVKVITIRASPMTID

SEQ ID NO: 40965 - protein, 81 aa, A.fumigatus
LSYPQCCLSPPFPPSGINFIYTTKLSLYKLSIINLSLELASPRCSQVNPTDATLSVGDTHTLFQARRGTNSPDELAFHVAI

SEQ ID NO: 40966 - protein, 89 aa, A.fumigatus
SRMYLSSSVLLYSCTPSGWMLLTHSRYKIGDAFFQLPLADAQSLLASSTEQIDLEVSRLEETLGDVREELQQLKVTLYARFGRSINLET

SEQ ID NO: 40967 - protein, 64 aa, A.fumigatus
LSARDKHRSSDPSAFGDTPFSDVDDPVDGGDYDDVAAVVVVVAAAAAAPPQMQVEELSPQIQIH

SEQ ID NO: 40968 - protein, 76 aa, A.fumigatus
IIWQYSPSTLSFLNRSMTIDTSVYHLISSHPNRTAMLLYPAPHGPPPTTVKSVSKSTKNQILKPIKPIATKLSTLT

SEQ ID NO: 40969 - protein, 97 aa, A.fumigatus
AATNDIRYVGNKIATLVMQLLGCDVAALNTVHFSNQPNIRRQVESTNIQQATTLATGSLKAHGQQLKRLETYMRVSARAISRILMSCCRVMPLVLRQ

SEQ ID NO: 40970 - protein, 553 aa, A.fumigatus
PLLLLALEDYFKSPYPETLATLYNAVNEMDLSLMPKLSLLERQILQASNAKDMFIEKFEQMIQQRLIEEGEPVEDSPPSPKKPAPRYALPRDTHEFESRVIYNDIPIPVKVPTVIWPEIVGDFSLIKLIQTFSTVHATAPQAFPLHPHLTTNGSYTHPIIVLVNAMLTQKRVIFLGHNRPSGEVAEAVLAACALASGGILRGFTRHAFPYTDLTKIDDLLKVPGFIAGVTNPTFANHPEWWDLLCDLPTGRMKISSHIEPAPVTEGLLYFQQSSFLQNYTPSAHPDPTGDNAFMEDVQRSITNRHGENAIRAKWRAYITKFTRVAAAFEETVYGASNLYIIGPNEELSPESPSGVQADPLDPTTLRGHGYVWPDEATKQRELIASVSRIEGWRTTRSYYSFIQDIAAMYYPARPIQKPDLHHHHDRLRTLRLSHADAGAIYLAFSKAVKDYAGICQLLTVTPESQAGLLYISMGLFHPDQTVREATADLLDRIAAHPAGRHFWAQLSRFNKLAYFRVRRERDAAQSPVSGTGSSLGAPQSLIGIATGNASRRS

SEQ ID NO: 40971 - protein, 234 aa, A.fumigatus
  UNSURE (179): Identity of amino acid sequences at the above locations are unknown.
SGTPFVNHITLRVLSGIKITSLSTLAEAITAIHATYSIPHVIITSVRISQFSSSPEATTDSLTVIGSTIKSDDSPRLFRVDVPALDCFFSGTGDMFAALTVARLREAVFAADSTLRSTKSWVSPDDVKATDLPLAKATVKVLASMHSVLERTLEARDAELRAAASAEETEPGLVEERKXKGRPCADQTPLGKVVPNRRFLRKPDCEFPPPIGKGRSGSRGFNIEGLNKPLFRLT

SEQ ID NO: 40972 - protein, 62 aa, A.fumigatus
QHDYNVPVYITYNDSEYIYLVIQFLDIIFSLFFFLSLSCGWGGGFHLMCIVLGDTAFNDMAV

SEQ ID NO: 40973 - protein, 132 aa, A.fumigatus
HSTGNHTGYRQFKGTRSTAQEIRDLYEGLCQSHLTDFDVMLSGYAPSAAAVEAVGAIGLDLQRKAESNPGSFFWGMRNPILVELPANGERSTVLDPVMGDQGRLYVNDDVVPAYKKIIHHADLILPNQFEAE

SEQ ID NO: 40974 - protein, 237 aa, A.fumigatus
GAYFHSHLSRSLLPRSDSLPTPFDTKSPYNFRAESCPQFFNDFLSNSTVTSCYPISLLLHDSTSFFHTLTSATATSHVLDLSCAASVDTCASIFNRLATDLLKADACGKDYELGNPLVASAYTGFITYEPVYRAACLKNPDTKDYCFVDAATNASSPQNLDTYSIPAGYTTDEAPWPTCNECLQASMDIFSRWAQVDGQPLTTSYLPSALALNRHCGDNFANVNITVGEKAKTTSGA

SEQ ID NO: 40975 - protein, 250 aa, A.fumigatus
HALPYRLEVNSDPLWAMSFIQFSAKMKSFSHFSPYWPSRPSQWGETMGPDVCSTSQHHQSGNPKTTSRLSTLITLLMVLLLSSVVSAAAIPDESPPLAHGAFLSRTEAFPGDHLDSGQARYGKTWVIESSLADEAATLPILVAPDEDVEEHTFIRTCHARFYPGPTRCRHPLTPNLPTTSEPRAAPSSSTTSSPTQRSPPAIPSRSSSTTPPPSSTLLPPQPPPRTSSTSPAPPPSTPAPPSSTDLPPTC

SEQ ID NO: 40976 - protein, 375 aa, A.fumigatus
NTVDPSSPVVKTYSHLINARTGQAINVRSPSTEITVDERPRSAGTIQTLRALDRSRPRSAISSTSHNIWVESLLRRWENPAFRRPERPITAISDGESHRNMSDNGLIRPFDCSRGSYGLDDFGLAKFRGRLSKSHLATANVIAQVDRKFILVKLADGRSSRSALVLIDQHAADERCRIESLFGAMFADGHRQVQSIRIDPITFDIPLVEAALFGKHADSFASWGVGYTVERKSSARAALVVVTSLPTLIAERCRLEPDLVSDMIRGEIWKHEENGQGALALSDQRAQRSKVHRDELGVETEGNWVDRLTSCPQGIIDLLNSRACRTAIMFNDMLTAEECKSLVGRLAGCMLPFQCAHGRPSMVPILDVRESEEFL

SEQ ID NO: 40977 - protein, 252 aa, A.fumigatus
RIERSSTCYQLITPPHPPPSQKIMPYSSTPEASTTPLADYFWIAGVDGTEVLETFRRLGDEYRANSATSPGPALTDTIEEDADAEEAHDSRFDGLSRPNSTLPGWNSFQRFSMRSENAAEGNANGSNSNRSSLTIKGAQSPRGSSFLEDFDFDKALFKFASERDSFLSDLSLSAGAITPASRPRSRLRTQKITAEETPSQPSSLLRSGIGSVRRHMAFRDMNSMKRQPSVARQGESIPGDIRHTAPSTLTIY

SEQ ID NO: 40978 - protein, 707 aa, A.fumigatus
TLFFSWTASIRTSRRLSNYNSVIPAPQPLEFSPTMHPLKRRFEPVLLDRYPTKGMTEELKQRGTFPDYVPMFAFPNDINIVSSDQRPRSTWHGFTMTTDNGSRLHAICVIIWIPLNQRAAEELEKRCEEWRKENMTDEERELAASLGERLASERAKLSRLLAKLPTVVSGSESREQLEDEISAVEEKIGLMTDLLRPVRHGAASKIEGLTDGETGFWIPRAYGILGREENMTSFWKEWLKAIIVPMTDGGVQRVPPSSPRMGVWQPLERYVMNLCTEAFSPNSSKTQVELAVRELRLFARKEAVNELPGSRNTDLYALFRTLSLSNIIILFEYALTESRIIFLSSHTSMLYLATRALVDLLFPLQWTGVLIPVLPARLIQALEAPCPYIVGIERRYEKVELPSDDFVLVDLDADVIESTVQPTPLPRHQRRKLLSLLQLAAPHHSRCAVPTGPPAYAIETFPFDAFMSENPSMFNARAQSTQLAKYVSLNSSAFGQQSVLPTTFQPLIFNAYLYARNEQAASRGFSSKGSDRPSTGSTSKTGSPPSPRDHSPTSGHFPPSSRNDSGMALQASLREKRSGHFDASSRRSSSFGMEMRPGVPRRPSAPFLGHAPNLSVTTLNTEYNSGSTYAPSVYAQSTVAASTIVPQSVAQPIHNAEGTCWVEGHCLQVVPADDKAVCAVCDERAEDGMYRCSAVFTGGEKACSGSQ

SEQ ID NO: 40979 - protein, 143 aa, A.fumigatus
FSERNIYVSAEDSMAIWRIDGNQHASSLHSFRPIETPDFDVLPEESEGNIRERTKTITKHLVKENENAKDASINYQTYDLYMKRALLLNYAPPGYSIGPFFESSTTVIRHGKIVRRRSAKNRLRFKLAGKTSTMAKKLSEHEL

SEQ ID NO: 40980 - protein, 450 aa, A.fumigatus
RWQRNNYPAARLQGLERDLNLSDADYQTGLSILFVGYILMQVPSNLILNYMGRPSLYLGFFTSAWGLVSLLTSQVKSFGGIVACRFILGLVEAPFFAGVLFYLSKWYTKKELALRMSIFYAGSLLSGAFGSLIAAGILKGLDGKNGLAAWQWLYIIEGAITIAVGIAVMLFLPDFPSTWKRLSEEERHVANRRLAIEAADADVDEAGKMSQIKGLKLAFSDIKTYVLAIAYMSITGASGFQNFFPTLTSTLKYDHFISLLLVAPPYVFVVFYSMAHSHLSDRFGNRFWFFFYPIPVTIIGFIIFMTTDSFGPKYFSFFLMNIIFAQNGTIYAWIGNAIPRPPAKRAAAYAFINSIGNSASIWTPYTYRKQDFPHYRPALGVCIGLQTLGGIMAIIMYFHLRSLNKRLERLDDTEVTLTDKEIRRLERTAEIEGIDLAAARRLQKGFRYIV

SEQ ID NO: 40981 - protein, 225 aa, A.fumigatus
STQLSILYYIRTKGSLIDAFDAICRRAGQSCHAPSQEFMVCTGIDRIETGVPAYLVFEKCKRANGGIKNSAKALTIATGRTPSALPAQTAIGEGYQPVLIAARRMFKHVPELEYYVLDIERELLAKDLSSFHVITSTNCIHATQNLMNSLSKIRKMLRNDGVIALVEITRNMFWQDIAVYLFEGWWVFMMGANMRDPGLTDVAWTSGEEPETNTIRIIGGFAGSG

SEQ ID NO: 40982 - protein, 78 aa, A.fumigatus
VVPSLEDSALLDFPRYNLTSNGHNLSAFGDFRASPRAYDSLVVFIHYRMPYDEHFFCSIQIFIWNPAIRARVQRVSWP

SEQ ID NO: 40983 - protein, 192 aa, A.fumigatus
GFLRRAGCRVVLKYHSINEAGRPPSSSIESINNHPDFLILPFSRSPSNLSRNFIMNLKTITILLSLCETLFAVPIQGSQKDKRQGLGGFNFGDLASMGTSGTSAGSNTNPFGSLFSGIIPSTSSSGSSAGTGNMILPAGALTSGSQTGNDETNQGQSGSGDFFQGGEDGEEAAAVAVQDGNEGDGPEDETVA

SEQ ID NO: 40984 - protein, 104 aa, A.fumigatus
  UNSURE (37): Identity of amino acid sequences at the above locations are unknown.
RTARVLDIFRSYYGGLICVCWSPDGKYIVTGGQDDLXTIWSFPERKIVTRCQGHNSWVSAVGFDPWQCDERTYRFGSVGDDCRLLLWDFSVGMLHRPKVVRIPL

SEQ ID NO: 40985 - protein, 91 aa, A.fumigatus
TPQVYTEISIFRTLTDKVNEMTKGSGPRNTAYRDSDHEQLIGSKILIYINGVTITITLAWLDFLLPELHATQRFVMFFFFFFFFFFFFFLA

SEQ ID NO: 40986 - protein, 321 aa, A.fumigatus
KNDFPLGTYELKDDLHLATPPPHPSEAPIINPNPLATVPTPPTSGVKVSLVCVSPRSRTPSFISKQIVTAPPFGDGNPALVPAPVKDGLKRRKPKNNIIKSSSSFVSRVITHEVATKRLSERSPEGLFAFANINRAFQWLDLSSKQKEDPLAKILFTKAHMLCHDINEVTKSPSHIDVVMGSSAGDIIWYEPISQKYARINKNGVVCNSPVTHIKWIPGSENLFMASHANGQLVVYDKEKEDALFTPEIQNQSAEAVKASSTQPLQVLKSVNSRNQKTNPVALWKLANQRISHFAFSPDQRHLAVVLEDGSLRVMDYLKEE

SEQ ID NO: 40987 - protein, 426 aa, A.fumigatus
ELEKEYCPPLDSALFTAIVCDYDLENPAQVQQLRDTLDTLKLSAWEQEDLPFDPSGTSGLSPGASGDADGILSEPSGSQNGTAPSRETDITSLASDFSSVGLDDRRTRSQGNSNSLRYTINPDGSLSLSGASENDKVCYLTDMFPSLDRFTVQHSLRKSDGDIDRAMDVLLNIAFFDEQQEDEDGTKLAIPKGIDGFEECSTGGTGRKKNRKRKGKNKNDPVRGLSSPAASGYLQDENIPLNKWDAGQKDIEFICSRTLPVLKKEAVTSAYHANGASLPLTIRSLAMAHAPEEKHINGHPVMLAQVAELTQEFPSVAPILLGGLLNITRNSTSAAGELAVAMLTRPAAPSVSNLIKITTAPPPLDLDDDEPKRPPVESRVLRKYGTAPVTAGDHFVASAEAFHKASAAYRRGKSDKLMGGAAAYYS

SEQ ID NO: 40988 - protein, 107 aa, A.fumigatus
ADSESKETAIRSTSSARDPRTRGSWPNLPSSTSQTSRLCQRLLPPVRFYIKNSASCVLTNFPSAESQTATATASATATATATTNAAASLIAPAAVGSFIWGLLVMVV

SEQ ID NO: 40989 - protein, 82 aa, A.fumigatus
AASDGTLVRHNIHLYILLLATALRILKSCHRHYISQKMTGKKQTQVPGHRSVNARNSTLSFAYIDKTTGILALPMTCLASLS

SEQ ID NO: 40990 - protein, 81 aa, A.fumigatus
LRIKRNGYQVNFVSTGPTNTGILAQSPQFNVTDVKTVPKTTSTGEILHQKFCIMRSNKFSLCREPNRHRDCFRYRHRYRDD

SEQ ID NO: 40991 - protein, 307 aa, A.fumigatus
VMADVSGNMLKRPRPEDEDDNAQKRTRSNNGSPLPAQGGNAPAGKVDIEKMVAEARAKAEAVRARLQAARGGAPAFTPAAPSPSPTPPPATSAMSKLEQMKARVAAATGRANATAQQRIPVPPPPPPPFDDDDGSSRARGGLDVGLHPALLSDTTDFRSGKGRQSAQSKIGTGHRTDSPLPGTKDRAGLDLSGPSLEEIKSNPYFDPSLGPKATIAKPRQSRQLIFNQKGKYIQQAAALRRQAQLEDMKRRIAERARQAGIDEDLDVEKAFLVPAPPAIEWWDEGLVNGNDYSAIDDERNLKIDTPD

SEQ ID NO: 40992 - protein, 256 aa, A.fumigatus
SCPWWFIRSGSGCLGRSCVSPTLMLCVFLRQLSLVIAYFGPFWLTAFSCTTCRQNSWSCTGHPGHIELPVRVYNVTFFDQLYRLLRAQCVYCHRFQMARVQINAYVCKLRLLQYGLVDEVEAIEAMGTGQGNKKKSAKDADDSGSEEEDDDDLVARRNAYVKKVIREAHAAGRLKGIMSGAKNPMAAEQRRTLVKQFFKDLVSIKKCSSCSGYVMSLSLSPCYFYRLLTMCKEFHLVTGEIVSRRFSGSLCLRSLD

SEQ ID NO: 40993 - protein, 223 aa, A.fumigatus
QKLQYEDTNPDKLLRDKKKNIDGLISKKAFNTLMNMKYLKSVVDPGEAVGIVASQSIGEPSTQMTLNTFHLAGHSAKNVTLGIPRLREIVMTASAHIMTPTMTLILNEELSKEHSERFAKAISKLSIAEVIDKVKVKERIATAGSRFKVYDVEIALFPAEEYTKEYAITTKDVQNTLQNKFIPKLVKLTRAELKRRNDEKSLKSFSTAQPEIGVSVGVIEEGP

SEQ ID NO: 40994 - protein, 109 aa, A.fumigatus
RTAEKSSWVNFFAASPPNESRHLFLQASSQRKSHCQRFLSLKELQVIMATFARPVASSISGIEFGVYSDEDIKSISVKRIHNTPTLDSFNNPVPGGLYDPALGAWGDHV

SEQ ID NO: 40995 - protein, 980 aa, A.fumigatus
HQKMQQLQRVCYVVITLPMLFLSFADDVQRISPSYRRDRFSKIFRKPLPEKSRLAMVQAGFQAPNSLILLQQAKKFDMKTKESMANSISDTANAVSESHGAEEEVARGNAVVAQAESKKSAAGDAGQYMPSPEVHAAMVLLFEKEKEILSLIYNSRPLPKKEAKVSPDMFFIKNILVPPNKYRPAAPQGPGEIMEAQQNTPFTQILKNCDIINQISKERQNAGADSVTRMRDYRDLLHAIVQLQDTVNGLIDKERGASGPAAGQAANGVKQILEKKEGLFRKNMMGKRVNFAARSVISPDPNIETNEIGVPLVFAKKLTYPEPVTNHNFWEMKQAVINGPDKYPGATAIENELGQVTNLKFKSLDERTALANQLLAPSNWRMKGARNKKVYRHLTTGDVVLMNRQPTLHKPSIMGHKARVLANERVIRMHYANCNTYNADFDGDEMNMHFPQNELARAEAMMLADADHQYLVATSGKPLRGLIQDHISMGTWFTCRDTFFDEEDYHELLYSCLRPENSHTVTERIQLVEPTLLKPKRLWTGKQVITTILKNIMPPGRAGLNLKSKSSTPGDRWGEGNEEGTVIFKDGEMLCGILDKKQIGPTAGGLIDAIHEVYGHTIAGRLISILGRLLTRYLNMRAFTCGIDDLRLTKEGDRLRKEKLSQAASIGREVALKYVTLDQTTVPDQDAELRRRLEDVLRDDDKQSGLDSVSNARTAKLSTEITQACLPKGLAKPFPWNQMQSMTISGAKGSSVNANLISCNLGQQVLEGRRVPVMISGKTLPSFRAFDTHPMAGGYVCGRFLTGIKPQEYYFHAMAGREGLIDTAVKTSRSGYLQRCLIKGMEGLRAEYDTSVRESSDGSIVQFLYGEDGLDITKQVHLKDFDFLTSNYVSIMQSVNLTSDFHNLEKDEVTAWHKDAMKKVRKTGKVDAMDPVLSVYHPGGNLGSTSEAFSQALKKVWDICYHSHSTYLSLTKATVRGHEP

SEQ ID NO: 40996 - protein, 116 aa, A.fumigatus
SGSPLKPSEHVRNMLHRLHYQLKAGNNVVISEFRDTLRIAAAILCGSDYFQPSILHHLVILPFQLFSEESMNMGVALWLGAIYENPKLGPRILAEAIEAWEETIQRRKGLFDRSFE

SEQ ID NO: 40997 - protein, 168 aa, A.fumigatus
VYYPSHLKFGVLMELRLFSYVDPMYTKIELLPSDKALLLKKQQKAQATLAPHLIALRFFESHFNAVRLNSAQNRRLFSRLIDRTTVGLLQTSGHPLARELHFRIVLFGLRVIQDSFQPEKVAWWKLNDQLLSAALDWFKHPPRFVYPILMMSETIAYSILDQVVLWGQ

SEQ ID NO: 40998 - protein, 105 aa, A.fumigatus
PHQYLLYWAAVNPTEALTYFLPAYGNHPFVLQYAMRALESHPIDVRFYFVPQLVQALRYDALGYVERYILETAKQSQLFAHQVIWNMKANSYKDEDSQIVRYDHP

SEQ ID NO: 40999 - protein, 66 aa, A.fumigatus
KFISSEPSIGRMGPELVRLHTVDLRQATSLRIFAFQTYSVYLSVWNPASLQVYYSTFKRHKSTDAL

SEQ ID NO: 41000 - protein, 96 aa, A.fumigatus
FGALIGQLGDNRRYTFSIVGSGLIVSLVRTDKSSYVRVQGILDDKHVDSCPLALCQELYWPGHWQIESVEKWSIAFRCVNLQVGLIIEISSPAPKW

SEQ ID NO: 41001 - protein, 132 aa, A.fumigatus
GVPQNRRVILEELSESRICSRQRVRLNGNGIARSRRFRDLVCRAGSSSVSCYKPYSKLTGANYFFYYGTVVSNGAGIRVTYVTQMIVGGVSLGTTFGGLYVIEHYGRRKLLITRGVWMFVCFMGFATVGNFS

SEQ ID NO: 41002 - protein, 110 aa, A.fumigatus
VAELYPSRYRAKAMALATASNWLWNFLIDFFTPVITGDIHFAYGCVSAGSLFAGVVIVCFCVLEDRGQTLEEMDMMYVRSACPGMGEAENGYLQPQSTGLLRRKLWTGGQ

SEQ ID NO: 41003 - protein, 437 aa, A.fumigatus
QPDPLKPTLDRFMDTLISSFSDEERDFYEREFSFFNDITGISGKLRPYIKKSKPEKKAKIEEELRKIKVEIGVYLPSNPDGVVVGIDRKSGKPLQSHAKAPYMATFRIQKTRTRGDERESQGQSRSSTAGHDASTKTLSAPLHSPSSQETYEVWQSAIFKVGDDCRQDMLALQMIAAFRSIFASAGLDVWVFPYRVTSTAPGCGVIDVLPNSISRDMLGREAVNGLYDYFISKYGGEHSMRFQEARTNFVKSMAAYSVISYLLQFKDRHNGNIMIDDAGHIIHIDFGFCFDIAPGGVRFERAPFKLTSEMVAVMSGTSHPHIHSHSGSNGGLGLPGGHSNNPTSTQPYRWFESLVIKAFLASRPFCTKLSHIVSLMLDSGLPCFKPDTLKNFRDRFVLEKNEREAAEYMRELIRKSYMSVSTKGYDQFQLLTNGIPY

SEQ ID NO: 41004 - protein, 303 aa, A.fumigatus
DCLYISSWIGCLQFTKMGAGASTPSVPPTDSAPAVTCPVDHKTREVWLQQHKASGGAPHPLPGEEEKTKPKLQRPLSTDREVSSIPRAFDASSSASSSQAPAACPSPYAASHGTPSNAEAETGHDQNTGNWIYPSERQFFEALVRKGNTPATTSSASELATTVASIIPIHNAVNERAWKQILEWESLAPSSDPGSKKCGGPKLYSFRGLGVDPQFLSPRARFNSLLGYQKPFDRHDWVVERCDGERVEYVIDFYQGKSSGTDGAAAGLTANAGPGKLSFYLDVRPKLNTFEGWRMRFRRFTGL

SEQ ID NO: 41005 - protein, 517 aa, A.fumigatus
RGIRPHERPTLNERPIYLHTYHVLLATAQSIVHLYYDYDRVPIPVVRPDSGASDRRTHPLEPVSKRIQWALPRMIRGGLARSALVAAICPFAYVLLLRRPAWSFTLYFAKLFWNFPRSAADPPGVIPDLGFGLLIRTAISGALLTFCWQFANLFFSMFISKEPLKLGQPLTAEAKDPNGSLLTGLKAKKETVKAFAFWELCLISQQFPDRRKAIFNDIDREGGSTWTQILQSATEVIEGVSNRINEKKNPTSNVKPEEQTDKSQPVLHTLPRLAEPPKEDNIFASSPKAVSRHEKIGEAFSSAAKKYGQSPDWTPAARARARDVFDRASSVVLSPERKQKLLASSRELKMLTGPTSKPENVHPLLAQVLRSPVGLILRQNYARRLSGIVLGTPHANLSSIIDAIESLTRLLIASLAEDQYGKVQSDVPRVVRLFTETITVLEPFINGGLDAHWTDVNFPPSSDPDAQAEARRVPEVGLVLDTVRSCLRDLLSAFNLYFKDIGLVRKDLPFSKRNCRG

SEQ ID NO: 41006 - protein, 334 aa, A.fumigatus
TASHRIFRPPNVHSLVSPTYVPSVRLSKMPTPHCLNCLLSRCELFLRTTFPPLRFSQAQLLVSAAIVRSVADFYQLPQSPLELSRIARQGSGSACRSQMGGYVAWRAGEREDGSDSLAEEVAPASHWPEMRAIILVVSAEKKDVPSTEGMQTTVATSSLFATRAASVVPERMAAIETAIQNKDFATFAEITMRDSNSFHATCLDSWPPIFYMNDVSRAAVRLVHDINRAVGRTVCAYTFDAGPNAVIYYLEKDSEVVAGTIKAILGPNTEGFDGPFYDILKNVTASVVPLEKVDSRAVEILKNGISRVILTGVGEGPISVEDHLVSATGDILAS

SEQ ID NO: 41007 - protein, 172 aa, A.fumigatus
PSQKWTQQKLSSEFKATLEEFQTVQRRALEKQRASAVAARTAVEEREHGPADGTTQQQQQLLEEQPRLANQAEVDFQEALIIEREAEIRNIEQSVGELNELFRDVAHIVHEQGGQLDIISENVERVTTDTRGANVELRSASRYQKNARNKACCLLLILAVILVIIVLAVTLG

SEQ ID NO: 41008 - protein, 172 aa, A.fumigatus
PPNPSCGDSCFLLTGSFRYWGKRDASLNLPTNSSLSVTLSQRSLRTLTTASCSAIYPAADELILNGKPQDIQTSKRTLACLSNLRSLRQALENADPSLPKLSTLPLRIVSENNFPTAAVFASSAAGFGGHCPVRGRFLSASTISSGAQPYCPSGFRLCLSISDGWLRCLACW

SEQ ID NO: 41009 - protein, 69 aa, A.fumigatus
VCPDLEPLFASSSSRERFTHFIFSSLRRGFQVYREVCASCRSLTRVPWRSFVGVMHTVDEMKAFAEEHE

SEQ ID NO: 41010 - protein, 114 aa, A.fumigatus
CGRSRNDQSTDITKHGIGWALGVVCDFLFMQHRQQTNEYEQSAVRPTSTVNTAPRHNSNGWVIFTDTALLGTSCNCLIVSFSARKLDKWTINWNRLILLWGPPGTGKTSLWYVK

SEQ ID NO: 41011 - protein, 254 aa, A.fumigatus
SLTDRISRGLSQKLAIRLGKHYPQSKLVEINAHSLGSKYFGESDKLVSKAFESIELLLEEEEDSFVCVFVDEIETLAARRERALSSKEPFDAVRAVNALLTGLDRLKHHHNVIVICTSNLVTALVSVSSKALSRDILKSVQDQAFLDRVDIKQFVPHLSNKTIYGIYKECLEELSWRGIIEGASFDVVQVKPEDPQTALQYVEQPARFLMLPMFEEMLLNYQIFPNAIPKQLADAASASVVSNRSRVEDITAGA

SEQ ID NO: 41012 - protein, 126 aa, A.fumigatus
RPSPRNTNDDTEPNDQGEIEKRPGKLSDYIPPPYKNEEAARAANGGALPPDLSLIVKGRHGGCNYIFSLLTGYPDEPPAGAQVAEGMNFNPYFPGTGTFSLPYLILVSTNPHLRYCHGPCPVRWCR

SEQ ID NO: 41013 - protein, 95 aa, A.fumigatus
  UNSURE (95): Identity of amino acid sequences at the above locations are unknown.
SRLIRILGIAMARVLFDGVVEYEDGTPATTSQMAKDVTEFLNWAAEPEMDDRKKMGAKALVILTGLFALSVWVKRYKWAPIKTRKIVYSPPVPRX

SEQ ID NO: 41014 - protein, 409 aa, A.fumigatus
RNKLTDHRSEAVLPHYWLAKMTVQFPTSDGEADPGATSPSKFNALQTFRRLWELVSPARPEDISSRETDCHPPKTTVQRRRQSIADQSLDRDEHLAEKVTSHRIEDTVPPEKTVLYLAYGSNLCAKTFLGKRGIRPLSQINVVVPSLQLTFDMPGIPYVEPCFAATWRRAHLSKEAEAGEIGTVESPADADTFEQVALLSEGSASMPLVGVVYEVTITDYAKIIATEGGGGGYKDIVVDCYPLPKSQSPTDPIPEHPETKPFKAHTLLSPSEDPDPSHLTSKDRKLPPPYRRPKSCYAQPSARYLDLINTGAAEHNLPLPYRRYLSQFQPYRITTVRQMFGKAIFVALWVPALITIISLSKLLAGPDGRSPPWLVRGSNLLFNVMWTTYDYFFAPIFGDGERTMEDTCS

SEQ ID NO: 41015 - protein, 131 aa, A.fumigatus
FDFGIEAAIDRSLAVKGGTGPADALYIDDIPVPPISGNQALVKIKAFGLNRMDLVQREGQYPLPPQAPETMGVEFSGTIENLGPDANRDFKVGDEVFGLAYGGQLTKTAICLTTADNSTHRGLCSIHCSIY

SEQ ID NO: 41016 - protein, 123 aa, A.fumigatus
TWITATQALYLVGEYKPGQSVLWHAGASSVSIAGIQLAKADGAKAIYVTAGSDEKIDFCVKKLGATAGFNYHTQDWSAEIQKATNGEGVNIIVDFIGATYFQGNLDAAAKDGRIVNLAVMGYV

SEQ ID NO: 41017 - protein, 84 aa, A.fumigatus
LPEGVNIAPFLRKRLRFEGSTLRSRDEQYQKKLRNTLVEHALPKFKDGSFKVFVEKVFPMEQIIDAHKLMESNQTKGKIICTVS

SEQ ID NO: 41018 - protein, 70 aa, A.fumigatus
YTYQGCHQIACTDHDHIVMVLQPVKSCEQGIYCSNSIKRLFATQSAFPSGCQRFDFVYKHADKRIFLLFK

SEQ ID NO: 41019 - protein, 352 aa, A.fumigatus
  UNSURE (14): Identity of amino acid sequences at the above locations are unknown.
LAMTSILGRTYPLXGIITGIGQVEGVTCMIVANDSTVKGGTYYPITVKKHLRAQAIAQENKLPCLYLVDSGGANLPHQADVFPDKEHFGRIFFNQARMSSLGIPQISVVMGPCTAGGAYVPAMSDETIIVENQGTIFLAGPPLVKAATGEVVSAEDLGGGQLHSTISGVTDYLAVDDAHAIVLARRSVANLNYPKTSVPQVSADTIKEPLYDPAELDGIVGTNLRRQIPAREVIARIVDGSEFAEFKRDYGTTLVTGFARIYGHQVGIVANNGILFSESSLKGAHFIELCAQRKIPLLFLQNISGFMVGADAEKGGIAKNGAKLVTAVACADVPKFTVVFGSSAGAGNYGMW

SEQ ID NO: 41020 - protein, 104 aa, A.fumigatus
LCCVSYSGRAYSPRLMFMWPNAKIGVMGSEQLSAVMEAVGRTADPELKARIDRESEAIFSSARLWDDGVIPPAQTRHVLGLSLAAALGGRVDEDAQTRFGVFRM

SEQ ID NO: 41021 - protein, 89 aa, A.fumigatus
MPKDIGILLYFHLSYSLCILLVESAPDNHPSDLTRTGSNLIELRIPEQPPSRDLVDIPITTHKLNSIQSTLGGSLGSVQDGAGAVLRSD

SEQ ID NO: 41022 - protein, 76 aa, A.fumigatus
LLLTFVIHIFVPFSTQPPSTALAVVFILTTSEPAECSDIANAPIFSPDRRPGRNRAFCSSVPFKDSWFTQSCECAA

SEQ ID NO: 41023 - protein, 171 aa, A.fumigatus
  UNSURE (153): Identity of amino acid sequences at the above locations are unknown.
HFLCSTVIPAMRGPSPLLRGLCSRATALSYPRRLPTQRHLVITYSRVSSRSVASYTHPHHASAISVLPTAVDTTSDEFRENARQMKELVDRMASLHKTIAQGGPQKAKEKHVARGKMLPRDRVTALIDPGTSFLELSPLAGHDVYPGEDVPAXRHHYRDWPSGGCHLYDCG

SEQ ID NO: 41024 - protein, 87 aa, A.fumigatus
TVRSAQDPLAIPSEHLRLHGRSRCREGRDRQKRCQTGDCSGLRGRPQVYCCVWIQRRSRKLWDVVSTLVMLLLSRRQCIRLTLLRLL

SEQ ID NO: 41025 - protein, 157 aa, A.fumigatus
TPSSARHMVLTIFLSLSRELYMKQGQGFLLVFSITSMSSLNELSELREQIIRIKDDEKVPIVIVGNKSDLEEDRAVPRARAFALSQSWGNAPYYETSARRRANVNEVFIDLCRQIIRKDMQGNSSSGSDNSARKREGTGRYDKKKEKKRRKGPCVIL

SEQ ID NO: 41026 - protein, 174 aa, A.fumigatus
  UNSURE (148): Identity of amino acid sequences at the above locations are unknown.
LATTQIFRGDDFTRRCLDQRRTSQEDCPLVLDNDRLIAHGRDIGASSRAGPHDHRDLRDPKRTHSGLVEEDPSEMLLVGEDICLVREIGTTRIDKVEAWKLVLLGNCLRTEVLLHGNGVVCSSLDSAVISHNHTGDTLHLANPCNDAXQRVRPPQDRRHGQLRVKAPGRTSLDQ

SEQ ID NO: 41027 - protein, 101 aa, A.fumigatus
IFIILFRCLRILESLLEECLLSFTNGFRSIPISDFVQDPLQDKNAAHLHSRIKVAGNQTSQGIRTAHRGRAAGVERASTRVHEYVMSLFFSSESQVISALV

SEQ ID NO: 41028 - protein, 128 aa, A.fumigatus
LSVVCAVGGVGKSCLTGTYASFPVSPLSPLFTRSENCVVESSISIHEARDLTSTAQFVQNVWIESYDPTIEDSYRKQIEVDVSRFRPLRWNSNTDFSRAGNAFWKCMFSQDLVVWENCHRCWLESTDT

SEQ ID NO: 41029 - protein, 93 aa, A.fumigatus
GPDADYIVVYAKTEPEKGSKGISAFVVEKTFKGFSCARKLDKLGMRGSNTGELVFEDVFVPKENLLGELNKGVRVLMEGLDLERLVLSAGPLG

SEQ ID NO: 41030 - protein, 141 aa, A.fumigatus
LGFNRIMQAALDLVLPYTHTRKQFGAPIAHNQLIQGKLADMYTKLSASRAYTYATARHIDNSAATGEVSIRTQDCAGAILYAAERATECALDAIQLMGGNGYINEIPAGRLLRDAKLYEIGAGTSEIRRMVIGRAFNKEYA

SEQ ID NO: 41031 - protein, 91 aa, A.fumigatus
SAGSIALSYAAHSQLCVNQLSLNGTEEQKARFLPGLLSGEKIGALAMSEHSAGSDVVSMKTTAKAVDGGWVLNGTKMWITNVSSNQTYNSS

SEQ ID NO: 41032 - protein, 70 aa, A.fumigatus
GRTSVWVSDATSLPEARRIGVSNFQRRRGKSGGQVRDEYREEYDPGRGGYGRAYADDQRRREEEEYGKGR

SEQ ID NO: 41033 - protein, 381 aa, A.fumigatus
  UNSURE (319): Identity of amino acid sequences at the above locations are unknown.
LLPRLKISPFVRETLLITSQLSEKNGSAQNERIPSLTRWYIDTRQLTVTNPSLPLLETLQPSDQEAVKRFYHLRDRHMSLASNLLKYLFIHRSCCIPWNKISISRTPDPHRRPCFIPSPALTEATDEPIPGIEFNVSHQASLVALAGTIIPQSHGASPNPTTVFANPSPSSVPAPSVPQVGIDITCVDERHARTSSAPSTRDQLAGYVDIFAEVFSSRELDTIKNLGGRFPADAQDGEAVEYGLRLFYTYWALKEAYIKMTGEALLAPWLRELEFTDVIAPEPAPAPGQGSAENWGEPYTGVKIWLYGKRVEDVRIEVXAFDTGYIFATAARGAGLGAESRPLSRDAGVSVSVDRWMHMENIDIDRDIAPCATGVCQCTKK

SEQ ID NO: 41034 - protein, 102 aa, A.fumigatus
FSKVPFTQQRSKFMSFSQSQQTRRPIMVRGPKLTGAYRCGEIKRLVMGLDRYNKTPCGFCFVEYYTHQDALDCLKYIGGTKLDERIIRTDLDPGFEEGRQYG

SEQ ID NO: 41035 - protein, 174 aa, A.fumigatus
  UNSURE (26): Identity of amino acid sequences at the above locations are unknown.
SCSPNLLIGPKKGGQDLLGGFDVRVXRNHFGRQTESFEAPLDLPFLGPTEHSFPAVFIRAPVVEKILPHQQGIQVDETQRDETVVAPSRQPQDQAAKAAMADEVEVLARLSGRAAELAAVGTHIDAEKETGDIVAVKQGNVFGTSFHPELTGDARIHSWWLRQVEESVRKRNGI

SEQ ID NO: 41036 - protein, 81 aa, A.fumigatus
PWRDQAQRCVHVGIVIALYETNWLLLVLPPISTEGLTAADVDRLTKTAQESMLKALLELSDQDRDEIDSDVKKATSTAVEI

SEQ ID NO: 41037 - protein, 102 aa, A.fumigatus
PKRGAWPPRGEHGEEMRKYRQSVFIFPEGTRSYSEKPELLPFNKGAFHLAVKAGVPIVPIVAENYSHILSPRNMRFNPGVIKLKGVCMWGLLLRCMRLTGSS

SEQ ID NO: 41038 - protein, 99 aa, A.fumigatus
YCFLQSGITMASITVGVLALQGAFYEHIQLLKKAVSEQSSTTQWEFIEVRTPQELDRCDALILPGGESTTISLVAARSNLLEPLRDFVKYVRAITARLS

SEQ ID NO: 41039 - protein, 431 aa, A.fumigatus
  UNSURE (370): Identity of amino acid sequences at the above locations are unknown.
DILVAASKVDVDALMMGEDDELSVEDNDQLSATVICLSTRTGRVHICLELDGVEGQWLPKLRKNAFSTPLSEPSDLVLVESLDTLRQEDQHLNDWPTFTNDIVSRYSFFVTTATNVTSISLSSWVQRLEAELRSEDTAGSAFRLQVLCEGTVSLRERIIEVDDDGSAAKGESDHLASSLVFYDYDLGYLLLSHHASRPYAAIMDAPEASLPPVADMGPIGSGAQQSTSILPPKRPPYQVPSILYSDSPLEFFVEKHVPHRQRQSLKEQVRLSPATLDLVAAAHRILSAHTNALERAASDLFRRCERLQGEMKEQLKQLSDVAERIKGVSSDIGEDGQRRGGSKSDEALDKKLKAAKERQAQLVERNESLXKQVLKSGGRPLSEKEKAWLSEVEALSASLEREKNEEKKDQSLSQRLETVSFIGLMNHTLWC

SEQ ID NO: 41040 - protein, 124 aa, A.fumigatus
EGFDWHGPFQPRDEDALLIFPTENLAPSLAPLLHPDLRKDIATRVNEAILQSQGARKEARLRNLVKLRAWAEQKAREAKKDLPEKLDLGLYDGNNVKNAQSTSQNGDSNDTVMANNGDVDPMIS

SEQ ID NO: 41041 - protein, 827 aa, A.fumigatus
YCNDALAPRGEDRCIGLLKDIYLKTSRTELKLAIVDSFLQRTTDTEESVATLARQTFEEVWLTPFHELIDSSQDGSKLRVGLGERVTLIASLVQRSETALETLGFCLKKILSDNSKTASLNFKVCKAMVATMFEKLVEDESSEKEFQQALLQTITVFAKANAKLFSPDQLETLHPYIGNLATAEDLFIFRSVVVIYRCVLPYLSSAHNSLLKEVQNDLFKSVAKLARSELNEVMACLWTINGVLRNTDRLVKLTISVLKPIQHYRNVDLADNANSAIVARAKSYIRIAGCVGRHCDLEKYEPHFKNAFPSWKGGSVAGLMIDSIVPFTLPKQPLELRVMALESVGSICQSWPAQFSRDEPRKILSMVFKEDNASLQNIVLKSFAEFFAMHEGKAEKSVVPSAEKADQENSTRLGGSLKASDNDGAAALIAQHFLQSMLRVAQSRQDAYALTAIELIASINRQGLVHPKECAGVLVSLETSTVPAIAKVAFDTHKMLHQQYESMFEREYMRAVQEAFYYQRDVVGDPSGALARPYIAKLAPLFDIIKTSNSRYQKKFLSNLCSKVDFELKKLDSTGDPPEHLLLTRFVAQNLAFFDYGQLAELVSAVECMERIVSATGTVVAHSIEIEIFPPRMEAPLGELSSEPVPQGPGNAEPPPQVNPSVLRQLATAAASLSMLWEARTYLRRLYGIHAHVREKDGKAAAKELNKSATKVQGVTGDKFWDAISRNMEALNSEDQMISKCREFATLLAIDDEFKVGQDEDAEGNSFDAVADLDDTGPGPGSLGGQRPGKRRNSVSSQNPAKRPRGRKSGSGKKRASTEPEDDMIWD

SEQ ID NO: 41042 - protein, 304 aa, A.fumigatus
NHPASIDRIRHCRIEAPSRTPPLYAMSTALLRSRPNTAALRRICLVSHRGQFPKPNSSISIVTSRALHTTRRRPVTQQRISNILHSASLSVRYESTGKDPMAKAARKSPALNILVKSFTYCGFFIVMTGVAVVAFFIYDATTYREDPSSEDIPVSELALNPRRGGPKNLPIAEVLVGDNDSEAMVQQNDKPRLVILGTGWGSIALLKNLNPGDYHVTVVSPTNYFLFTPMLPSATVGTLGLRSLVEPVRRIIQRVHGHFLKAEAEDVDFSEKLVEVSQVDANGKKQNFYLPYDKLVIAVGECGP

SEQ ID NO: 41043 - protein, 201 aa, A.fumigatus
TSCSNSMTRTAPAPSTSANCTNSSTRSTPSSPPSRPPPSAPTNKANIWAANSPRSQLRSPACEPTRSNTETSTTSFTNPSDTSISAAWHTSATRPSSTSADSISAVAFWPCTCGEASISRRASASAHGACWPWTGPREHFLDEVCFFAHVLSHESIAKLLSLNRSYELLIGPSGYKQPALACHRKGHTTVSIHPCGLLLDR

SEQ ID NO: 41044 - protein, 149 aa, A.fumigatus
VWTTKGCVTNPHGVKGLEHCNFLKTIDDARKIKNKILENMELACLPTTSDEERRRLLSFVVCGGGPTGVEFAAELFDLLNEDLLHSFPKILRNEISVHIIQSRSHILNTYDEALSKYAEVRCFTCFADIKTIDEANTYRPVLTVITLKS

SEQ ID NO: 41045 - protein, 313 aa, A.fumigatus
SPDKCASEGGPRRQSFVHSSREWPAGGEGNPNGFLPLVDRSWYVITILVCDVLGTDYCTDRAELCKKLCDKLEAQNNKHALETDTHLRLIGAPLGDVYAIGDCSTVQNKVADNIISFLRTIAWEKGQDPQKVHLTFREWKDVANRVRKRFPQAANHLRRLDKLFEQYDKDRSGTLDFGELHELLHQIDTKLTSLPATAQRANQQGQYLGRKLTKIAAALPGMRANEIEHGDVDNIVYKPFRYKHLGSLAYISNAAVFDFGGLNFSGGVLAMYLWRSVYFAESVSFRTRCMLAMDWAKRALFGRGLFLRTCSFS

SEQ ID NO: 41046 - protein, 257 aa, A.fumigatus
CNDGREDQLLHFITSDPQIFAIRNSPEAVLAAVDEFARTKDFLMNVGPYKGGIITDIIATEQPSSILEIGGYIGYSAIMFGSAMRDTGVLAPRYVSLEMNPKFASVSRTLVEVAGLSDVVEIQEGPCRKSLHRLAAGTSNKGPSSKKWDILFLDHSKISYLNDLKLAEELGIVAPGSIVIADDMKRPGNPMYSDYVMADTATKTEAYMPFVGCLSDGGISLGNPYLIYQTVLLEGLEPTGHMVSFYYPRLLRFAKAS

SEQ ID NO: 41047 - protein, 68 aa, A.fumigatus
VRDVYYEDAHNIQKLCNGMSLIIKLYYYDKNKRLTAVLNNIFLNIYICNDPKSSGTFILCLLQISSPF

SEQ ID NO: 41048 - protein, 61 aa, A.fumigatus
NLAAAEIGGYFEPLKHDFITKSSYSCAADIVIAYGLEYGSHCSVGVPIEGVVLYLLPALEG

SEQ ID NO: 41049 - protein, 66 aa, A.fumigatus
PLDVGCFSPLKCVYGCLIKDKMQLGFNHIDKFDFLEAYPQACTAIFLADNIKSGFSATGLIPLNLD

SEQ ID NO: 41050 - protein, 77 aa, A.fumigatus
  UNSURE (2): Identity of amino acid sequences at the above locations are unknown.
SXNSVLKTPYNLKQLKKQETMLKKLLREHTYSPPTPIKAVLGQIIKGCKMAMNNAALVAKENHDVCAAHEKHLQKQK

SEQ ID NO: 41051 - protein, 85 aa, A.fumigatus
VGMVVTSISVYVGTTLTYSYCSDRYKSQAAKVSIFNNYFRQTCIHYLLLRLAIQTRVCLLPLTLWSRYPYYYLSRRVRKFVIGKE

SEQ ID NO: 41052 - protein, 71 aa, A.fumigatus
EVLGARELVDGGEYRLWRVADGKYLGITGYEVEKLVFPAVIALVGSFNSQYIQASRGVPYQDIFLRLVKPL

SEQ ID NO: 41053 - protein, 112 aa, A.fumigatus
  UNSURE (64): Identity of amino acid sequences at the above locations are unknown.
YGCARSPPPPPAPPPPLPPPPPTPPPPPPLPTPPSPPPPHPSAHPPPSSPPPSTYLRRATTSIXILLHPETDTINLGLQMLRGPTQPISSRFPYNNSLPPGMSQQCLLNAEV

SEQ ID NO: 41054 - protein, 72 aa, A.fumigatus
GFKIASNFGRGQILWYGDPLGCVIRSLTDYVSTTGQSFSVVTALSISNDLSKFIITQNRTLLWILLTLRYIR

SEQ ID NO: 41055 - protein, 76 aa, A.fumigatus
KRLMAAAWMSRMGVKTIMIDQKSHQTRCGRADGLESRTLEILDSFGLADKVWAQANHTVEIALWVRPPSCLQKQFH

SEQ ID NO: 41056 - protein, 182 aa, A.fumigatus
LNLCRVQGSTADGKLERQSVSANSKPGWSRFHESTLSQGEIEEYLMEFVRTGKHVEVKRETIPTSFEIDYAMINDHDAFPIRVNLEDVPCNPKTPFDGVATPNSELSEAPSDDSGYAGMGTTVEAKYILGCDGAHSWVRKQLGLRLEGESYNDCGGVLDIIPLTDFRELSRIITTVDIANPT

SEQ ID NO: 41057 - protein, 188 aa, A.fumigatus
  UNSURE (88): Identity of amino acid sequences at the above locations are unknown.
FTVYSSFAGSPLPRHFPQACKTLVIWMCPLPPAPPRTPPPSPAPPPHTPPPPPPPHPPLPTPPPPLRTPPPLLPPPQHLPSSCDDQYXNTSAPGNRHHQLRASNVTRSHPTHFIQVSLQQFVATWYVSTVPPERRSLTVSIERQKQNLSDHDADQTSRIMGSHIPDRNVCTNMYSLNCISVARQRHVS

SEQ ID NO: 41058 - protein, 445 aa, A.fumigatus
SPPLTLLIQPDHPADIRKRFIIKSKHGTLMMIPRERKLVRVYVELPPEVANRYRADRNADILTEQVATIMQPYTLKTNRIDWSTIYTVSSPFLCSFDAVPGTPKLITNQVGQRICRKIGLHNRIFLAGDAIHTHSPKAGQGMNVSMQDTFNLGWKIASVIKGVLHPWVLETYQEERLPVAERLIALDQRICRGMCSQRSGHPEVQQGHFDEDHKRALEDENSSMSGLAVIYQPNSLVTSTAWDAPLPKDVASCISRPSVAQNLQVGARIPSVLILNQSDSQACHLQQILPSTGQWNLLVFGGDIADADQKSRVQDLADALNSSGSVFEKLNDPVSVARRGFPALGVYLIHCADRLSIELNDLPMVFRPWTKDGVDYGRVWADGEAYHHAGGGKLYSSFGIGDKGCMALLRPDQHLAFLSDINDVESLEQFLRSIMPEATQKPMPI

SEQ ID NO: 41059 - protein, 563 aa, A.fumigatus
GGEDIITMRIVRISKWATTPMEELSLEELADVKAANITDWVLQPQVLRSIYREFKAFLTEFTDQAGQSVYGHKIKTLGEVNSASLEVSYVHLSSTKAALSYFLANEPTEVLKVFDQVALDVTLFHYPQYQDIHKEIHVRISDLPIVYTLRQLRQQHLNCLVRVSGVVTRRTGVFPQLKYVMFICQKCNITLGPFQQEASAEVKISYCQNCQSKGPFTINSEKTVYRNYQKLTLQESPGSVPAGRLPRQREVVLLADLIDSAKPGDEIEVTGIYRNSYDAQLNNKNGFPVFATIIEANHIVKSHDQLAGFHLTEEDERQIRALSRDPDIVDKIVRSIAPSIYGHQDVKTAVALSLFGGVSKEAQGKMAIRGDINVLLLGDPGTAKSQVLKYVEKTAHRAVFATGQGASAVGLTASVRRDPLTSEWTLEGGALVLADRGTCLIDEFDKMNDQDRTSIHEAMEQQTISISKAGIVTTLQARCAVVAAANPIGGRYNSTIPFSQNVELTEPILSRFDILCVVRDTVDPNEDERLANFVIESHHRSNPTRPLRDQDGNLVDSEGNRID

SEQ ID NO: 41060 - protein, 99 aa, A.fumigatus
EGYRLYKHGNRLPPTPEEIAKREAAQRKAEEEKEGEIPQELLRKYILYAREKCHPKLYQIDQDKVARLFADMRRESLATGAYPITVGGFLTWSSFKLSH

SEQ ID NO: 41061 - protein, 73 aa, A.fumigatus
IIILYLLHHRIFMLDLLLYYSAPTMPHAHAMSTSLLAPTYSWVDSTLPYPRVFSPVTSHLVDHTAEVSHPQCP

SEQ ID NO: 41062 - protein, 125 aa, A.fumigatus
RRSCQPRGEDHFPARWDPRYTLHSGTVAFPDRRENYQVHASGPRTPATGSKTNYYANYKDAVTGFLVNGTLPVDANQGVHSLTDVPVFAQGPCQELFGGVYNSIDIFFNMAECLGLAQTKKPKGK

SEQ ID NO: 41063 - protein, 121 aa, A.fumigatus
  UNSURE (57): Identity of amino acid sequences at the above locations are unknown.
RCVACLLILFWSVILATISLTDGNLGELDGQISPRLAVNLGSNNPFRNRALSPAGCXTSGSRPPRPTFTNPFLDDTDSLSSPRSAPVGTLFSPVEQQDMTSNTRELFVRLSYSLGGFSGPI

SEQ ID NO: 41064 - protein, 264 aa, A.fumigatus
SPVLVFHHDGPFDACNPHRNRKGSRTAPMQAFPKDSPNMALGGSGPVNKNINLDQFHGTMEEGFNDYSSTGAARSGEAVSFDPKSRIEPIHGAESMGLGTSTFLEGAPASRAAMQRRASENENQLSQNGGLQRKKSLAQRLRGINKPQGGRMASPDASYNPPLSSSHSGPLRANEKNPFFQDYDDAWDKKGARINTAEESRSGIEGGRARSSSSPKQSTNLERRFTNERSNTGGEDGKSGGGGGFINRMKSLRKPRPERRISND

SEQ ID NO: 41065 - protein, 319 aa, A.fumigatus
PIIKDISAKDYSKYSNSSIIDILLEMPALVSRQISTPESNISVQNGTKVPSTTSCGLLVNAARKGNVDVIRFLIYLGADVNEYYDGVTPLLAAAIAGQEAAMTELLQNDASPTARDSEGCTIFKLLLDNGHYNIAEMLIKKYPDLTVTDPRLPKGEKWLREQFEEISDNVKDPKSKPSKEILEYLISGQLPQEEGRSVSDVYWEHILLRYIGDVPLDIKRNYSRSLRLSLMGTFDRFFLGHEGIKESARLLNSKLPTTAYTIEGTVVDGDGGWVTERWSYHDAYGIDVRDGIDSFLIDSEKGKIMVKMINYNVCEKTKG

SEQ ID NO: 41066 - protein, 92 aa, A.fumigatus
TADGSPLLAGDVLASSLPWWATMLAVAMPALEMALIIAGWLYCGLNAKRLAPSGVVGHGMLWLSVVVGLSLCIRALFTLRNQGKRPFGRDLA

SEQ ID NO: 41067 - protein, 217 aa, A.fumigatus
  UNSURE (2): Identity of amino acid sequences at the above locations are unknown.
IXSELPSHSTSPVVKTMGTALASRFLEEKYKVAVWNRSPEKASSLLGKGATLSHTAVDGINASDLIIICLLDNAAVEATLAGALDHLHGKTIINLTNGTPDQARKLSDRFVSHGARYIHGGIMATPSMIGSPYALVLYSGSPDAFKAAEGDLSVLAKCVFLGEDAGTASLHDLALLSGMYGLFSGFLHATRLREVEHARGQVHGPPGSVAGGNDPIH

SEQ ID NO: 41068 - protein, 73 aa, A.fumigatus
RDGQSRLMRGSTPAKDRISPMQLVGIQNIIDASEAQQVSAEFIRPMKEFMQKAVAAGHGGDDISSLIDFVKST

SEQ ID NO: 41069 - protein, 71 aa, A.fumigatus
SLSHNRHTDLFLGRLARYVYERCRVDSVIGNELLKYIVLKADVLCTVVYVMLFTIQLSWSSLALAIFFLFI

SEQ ID NO: 41070 - protein, 319 aa, A.fumigatus
ASFYKPNNPVLHQICYCHLSILMPDLGTSKHRSSRACTACRAKHVRCDAALPRCTRCVGEEKECVYVKSRRGGRRRVLNTLTSSMNGTKMDQESFISILPILSQTGTRELNPGFNLTTSTSAPSGTVDDQLLSLYYRYFHSAHPCAVPRFAIQRYAVSDRRAIQPLYAVMKYIGSLHNALIPSSQLKDHVEAELAVARSTDHVVSPFAVQAVLLYSIAVYWCDETEKGLDLLEEAIQMALGLGMNRSNFATEHGRNDPILEESWRRTWWQIYITDAHIAGSTHSYPFRTDGILMDVHLPCEEEEYESGVGGLPSGMLCC

SEQ ID NO: 41071 - protein, 340 aa, A.fumigatus
HRKKNTNSSKMSIPKTMRALLQPSIEEPRLVITADHPVPTATEGTDEHLIHVHCVSPCANELNWAKAFPALQQREQIPCYDVAGTVVTAPPSSDFQPGTEVYARSNYLRPGCARDYAVISGADLARRPQNLGWVASTAIPLSAQTALQALFVQSGIGELGDQAWKGKRVLVTAASGGVGIWVVQLARLAGATVIGTCGPRNVEFVKSFGASNVINYREADLKEWGQRPENQVDLVVDCTGKKSLEDAWWCVRDGGILISICQPPEQVQPEECKGKNVRNFFFIVSANRADLEKVTKLVEEGKCRGVVDSVWPLEQFEDAFKRLDEGHARGKIILDLSLNH

SEQ ID NO: 41072 - protein, 69 aa, A.fumigatus
RIHNGNFPILGLLLVYIVQEIGITLNCGVALLYAEMRILAFQYGTSGKDNDENKIDNLNLDFDKSAWTT

SEQ ID NO: 41073 - protein, 663 aa, A.fumigatus
VKTLVGLDDLHVEGTGDIPGLGNLLSNLLDTTHDLLIQRSRREDQSSIARVHPSGLDMLADGVQEELAVGGNSIDINLLSTLDELGDDDGVVGRDSAGVEKLLLELVTTVDNTHGSTRQDVTGTDQDRVTDRLSEALGLGNRRELIPSRLIHTDAVQDLRELVSVLSFVDILRIGTKNVGTASLLQAEGDVLGQLTTDGHDNTAGTLEFVDIHDTLVAEFLKVELVSSVEVGGVCLRVVVDHNSLLAHVPQRQGGVDRTPIELDRASNTVDTTSQNDDAVVIESDVVGGSVIGGVEVVGISGELSGQSINLLDPGSDAEALSASADIIFGGTNEESDLLVRETKFLGLQHHLLLDAKQAANLLEFIVAIDNVLELVEEPLVDFGQLVNLVNRIVLVKHSLTNGQPAAISGVLQGLIQVLKFVTLETYEARIDLANSLLERLLKGTTDGHDLTDRLHGTANVPLDVLELAQIPPGNLGDNVVETRLKVGGSGLGNRIGKFRESVSQANLRSSVRQRVTGSLGSQSRRTTETCIDFNDTIVKSIRLQSVLHVTFTNNTEVADDLDGSGTEHVVLFIRKGLTGSNDNTVTGMDTQGVKVLHVADSDTVVGGITDDFVLDLLPALEGLLDQDLGSKGHGTRSQILQLLRILSETGNPDLQARKPNGQ

SEQ ID NO: 41074 - protein, 71 aa, A.fumigatus
FNMLYTSCSTCSASVAASWPCTSLFSTYWCSFVAAASDAKAQDSAKVTTSSGFGNPVALVACLELICLKRG

SEQ ID NO: 41075 - protein, 134 aa, A.fumigatus
FGGLQSLVNSVDGDGLGNGDVDLLQSLGEQVTVLTSLEGPDACSQNSDTVALKDAHAVHLYTKVQGSLTTERQEDAVGAFSLNNVSHIFGGNGEIVHLIGELVIGLDSRDVGIDQDGLDTGLLESLEGLRTCDY

SEQ ID NO: 41076 - protein, 545 aa, A.fumigatus
LLSESLVMADRSEADIPTDVPPFARPLAPYIRTRQEALRIRQALTYYLRSQIDFAEDDSENPNCHSQSHLSLCVPQDAAVNVKRIPAELTGLRKEYLQALQANLAARKEYHSLTEKVASAKERTKGSKTEPPSIDPSSELQTYLRLLRGRRRHAKLQVFQHYLHELKERDSNISERIGDRASHSQQIVSLEETEEECKPTGRDADDGIEGLIHKLERAVIRAKAQLDRERSLLDGLKSQLASDSTDVPPAVKVAALQRTRDELVQWVEEKLVSVGNADDAPVHDLSPEEIEESTRLVEDQKAEIVAQYIAYVEARKRVLDAASRACQPMTMPSTKPSRQSIDLGKLETGDRSSLGPLEVLSFTSENILPLSKAQRALALQKNYLSGLLTKERSMTLRILNRLSDESHLLPEYPLLTHQPRFKHISSRHATSATGLPKPDEVVTLAESWAFASEAAATNEHQYVEKRLVQGQEAATDAEHVLQEVYNMLNQDLEETLRDLQSSEEDSIDIWASEARSTRPRTRGTRSQKQSKGPWAKLDGQLGMTE

SEQ ID NO: 41077 - protein, 162 aa, A.fumigatus
LTLHSSIITGSQALKALKEAGVKSVLINPNIATIQTDHKLADEVYYLPVTPEYVTHVIERERPDGIFLSFGGQTALNLGVQMNRMGIFERYGVRVLGTSIRTLETSEDRDLFAQALKEINIPIAESIAVNTVDEALKAAESVGYPIIVRSAYALGGLGFRFR

SEQ ID NO: 41078 - protein, 104 aa, A.fumigatus
KKKKPPHTGALITSPKKLLWYLHLFWREILVNPLGPIPILCSSPENRIDSYPTYSSKSHPIHLFSPPVCFLFSPNSSLIASCTSGPRPPVLPNSSLVLPCQLGV

SEQ ID NO: 41079 - protein, 187 aa, A.fumigatus
SSISIIFSLAQCAMVLAARCGQATSSILRQRCLTESRRSAFALRPFSAQTTARSTASGLRLQQKVASPLRSQQLRSFSSALRRLASQANNPPSADSYLASGVVKPGSNLVDVKKVLVIGSGGLSIGQAGEFDYSGRLQFGSYFCAWYPKAALIVDSTISEMPSWTGTKRNTTKKGQKKPFSTEDSSD

SEQ ID NO: 41080 - protein, 673 aa, A.fumigatus
RPPNQLATLSLSVRLTRLEVWVSGFAENPEELKNLASRSMTLAPQILVEKSLKGWKEVEYEVVRDAANNCITVCNMENFDPLGIHTGDSIVVAPSQTLSDEEYHMLRTAAIKIVRHLGVVGECNVQYALQPDGLDYRVIEVNARLCRSSALASKATGYPLAYTAAKIGLGHTLPELPNAVTKTTTANFEPSLDYIVTKIPRWDLSKFQHVKRDIGSAMKSVGEVMAIGRTFEESFQKAIRQVDPRFVGFQGDKFENLDEALKNPTDRRWLAVGQAMLHENYSVDKVHELTKIDKWFLYKLQNIVDCNNELKEIGSLFGIQKEMMLKAKKLGFSDKQIALLVGSTENDVRARRKSFGIRPWVKKIDTLAAEFPADTNYLYTTYNATSHDVTFDDHGIIILGSGVYRIGSSVEFDWCAVNATLSLRNMGKKTVMINYNPETYSTDFDTADKLYFEELSYERVMDIYELESASGVVVSVGGQLPQNIALRLQETGGAHVLGTDPQDIDKAEDRHKFSQILDSIGVDQPAWNELTSVAEAERFAESVGYPVLVRPSYVLSGAAMSVIYSGDELKEKLLNASAVSPDHPVVITKFIEGAQEIDIDAVASNGKLLLHAVSEHVEPAGVHSGDATLVLPPASLDEKVMGRVKEIAEKVAKAWNITGPFNMQIIKADQGLH

SEQ ID NO: 41081 - protein, 62 aa, A.fumigatus
MGIDCTDVWRSSGESPVIVPPLMLKVGTMAVQYSAIITPVCSVWIGISDALSYGICNFCNKK

SEQ ID NO: 41082 - protein, 191 aa, A.fumigatus
PRIQLIFILIRQGDLEAYVAHVLDRLVRHSNALDTESLCILKGVSCWSIRADVHVTDYDGNLVDAACIGVMAGLQHFRRPDAVVKDGQVIVYGLDERVPVPLNITHKPLSVTFHTFDEGKRVILDATRKEEQASEADVVFGMNNAGDVCFVSKFSGSPVDALVFVSKSSVALEKVKEINAIIDKALQADFC

SEQ ID NO: 41083 - protein, 137 aa, A.fumigatus
YSFQNAFSGEVIYESWTLSFYNVFFTVLPPFVMGICDQFISARLLDRYPQLYQLGQKGMFFKRHSFWSWIANGFYHSLLLYIVSQLIFLWDLPQGDGKVAGHWVWGSALYTAVLATVLGKAALIPKSSPRGWKDPRY

SEQ ID NO: 41084 - protein, 703 aa, A.fumigatus
RRSLPAPSIMASGRPPGLHPAAGRDEDLMQMEESTPIYSTGQRPPVNDDYLLRQYNIDDSDQPQPRPSVSYDSFVGGRAPPAAGSHASTSAHPPAQPGAYLSDPYSGAEMSRTYSQTSGLNNYQRYSVDDFDDDRDMHGYYNMDDDDHMASPHRVRQAKDRNSILGLGGGLMGRAKHMLGMGPEYSEMDLPLTEAGARAARVDSVEGDTAAPRAQKKSRKSDFKFGFGRGKVDPSTLGPRMITLNNPPANAVHKFVDNHVSTAKYNIVTFIPKFLFEQFSKYANLFFLFTAVLQQIPSVSPTNRYTTIVPLMIVLLVSAIKELVEDFKRRNSDKSLNHSKTQVLKGSAFHETKWVDVAVGDIVRVESEQPFPADLVLLASSEPEGLCYIETANLDGETNLKIKQAIPETAHLVSPADLSRLSGRIRSEQPNSSLYTYEATLTMHAGGGEKELPLAPDQLLLRGATLRNTPWIHGIVVFTGHETKLMRNATATPIKRTAVERMVNVQILMLVSILVSLSVVSSVGDLIIRQTQAKKLVYLYYGSTSPVKQFVLDIFTYWVLYSNLVPISLFVTIEIVKYAQAFLINSDLDIYYDKTDTPATCRTSSLVEELGQIEYIFSDKTGTLTCNQMEFKQCSIYGVQYGDEVSEDRRATADDGGEPGIYDFKKLKENLHSHPSADAIHHFLTLLATCHTVIPERNAVDPD

SEQ ID NO: 41085 - protein, 277 aa, A.fumigatus
YQAASPDEGALVQGAAALGYRFTNRMPRSVLFTTNGQEYEYELLAICEFNSTRKRMSTIFRCPDGKIRIYTKGADTVILERLGPDNPIVEAIVQHLEEYASEVLRTLCLAMREIPEEEYQQGIQIYEKGATTVGGNRAEELDKAAELIEKDFYLLGATAIEDRLQDGVPDTIHTLQTAGIKIWVLTGDRQETAINIGMSCKLISEDMTLLIVNEENAQATRENLTKKLQAVQSQGTSGEIEALALIIDGRSLTFALEKDMEKLFLDLAVLCKAVVCW

SEQ ID NO: 41086 - protein, 122 aa, A.fumigatus
VTALTFHSIHDADSLIVVYPPLQKALVVKLVKRHLKSLLLAIGDGANDVSMIQAAHVGVGISGVEGLQAARSADVSIAQFRYLRKLLLVHGAWSYHRISRVILYSFYKNIALYMTQFWVSKL

SEQ ID NO: 41087 - protein, 71 aa, A.fumigatus
ERERAAKEEEQREYDIARGNPLLNPQDFNLKRRWDDDVVFKNQARGTEEKRGKEFVNVSLISRGSRMALII

SEQ ID NO: 41088 - protein, 235 aa, A.fumigatus
TSYQPYQLDSHDTSKQSHINPLSASPSQSSPPSTTTSYTTATKMPPSQPLTLIVATTPIRTSENLPTRLGIGLHGTLPWPRIKADMAFFARATSRPPRPGTTNAIIMGRKTYDSLPQNLRPLAKRINVVITRDSTGSVRERIMKELEAKRAKAAAAAASEQAQAQAQKQEQVQAQTDALVSTGLEDALASLEGSYGAEGRLGNVFVIGGGEIYASALRMSETQSSPRGWKDPRRS

SEQ ID NO: 41089 - protein, 1654 aa, A.fumigatus
  UNSURE (20): Identity of amino acid sequences at the above locations are unknown.
FGYVPIHISLRQHGVFSLLXIVYRVFHRNVVKKKGIAYTFFVNDEAENGVSSTGPADEEDGDDGEETDPMLFKATQLEQTRLEFDRPRGQIAIITLEIAALVGLVITFVIVLNTNAWGDNGMLPAVGKLISWSYILFLVLVRFILSTLKLQSSPRLWNHTAALYGMQWLFNLFVFRSAVIYPSSKRALTLSAVEFALSTLLFIIAVTTRRGNKAVVVQREDGLEPPRHPTASLLSLVTFSWLDPLIWKGYRQPLELDDVWNLTTSQKAATVLEDFRRKHPKGSLVWRLGRYFYGTLLLQGAWTIFSNLFTYLPTLLLKAILEYVEDPRSTTAYAAWLYAILLFSSGAIQGIADGQALWIGRKLGVKLRAIIIGEIYAKALRRKAGSSPDAPKKKEEPQKVSKKNRIFSFGGKKKKKATVDSENPAPAESTKADPAQLANVGTIINLMAIDSFKVSEVGAYLHFLWASVPVQIIIAVTLLYRLLGFSSFAGIVLMVLMLPVNLFIAKSFARLQNQILAGTDARIHATNEVLQNIRIVKYFAWEQRFQDIIDEKRRAELKSLRNRYILWSFAATVWYGTPILITFTSFFLYTVVEKKKLTPSVAFPALSMFSLLRVPLDQLADMVAHVQESKVSLDRVDTYLNEEETEKYSILSTGTDPETTPKIALENATLSWGTPKKDSHGDAPDNGEAFRLINMNVSFHIGKLNIIAGPTGSGKTSLLMALLGEMKLLEGRVRLPGGTANRAELPVDPQTGLIESVAYCAQEAWLVNATVKENIVFASPFDESRYRAVIKACALERDLSILDAGDQTMVGEKGISLSGGQKQRISLARAVYSRARHLWLDDCLSAVDSHTAKHIFREALRGPLMMNRTCVLVTHNVALTVPQADFVVVLDNGKITAQGRPDDVASSGVFGEDYFKSRPASRASTPRLSRMPSDGSDGHAEEQPSTNGKVNGSSKPTTQDQKGDNEQSKLTESKAVGSIKWPTIQLYLRSMGPWSYWISAALVFSLQQVGSVSTNIWIRQWANSYQVEANGSVDAGTYAAATTLKFPSFNVRGVPRTSNSYVPQFGVQRSPATDGDVNVSYYLGVYALLGIGYVLISLFREGVLFWGSLNASSRIHRRLLETVMHAKFKFFDSTPLGQLMNRFSKDIEAVDQEVAPVAIGMIHCLASVIMIVILISVITPGFLIAAIFISMIYFALGAVYLNASRDMKRLESVQRSPLYQQFGETLNGIVTIRAYGDGPRFIVDNHRRINAYNRPHIYLWAANRWLAFRVDITGALVSFFTATFVLINIGKIDAGAAGLSLTYAVTFTENVLWLVRLYSEVQQNMNSVERVKEYLDVEQEAKAVIVDSRPPADWPTGGAVEFINYTTRYRADLDPVLRSVSFAVKPGEKVGIVGRTGAGKSSLALALFRGLEAEQGQILIDGLDIGTIGLRDLREAITIVPQDPTLFTGTIRSNLDPFHLFSDEQIFTALRRVHLIGSGTSGSATPITASTGSVAEAHLLSIHGADVDGASVQDNKNIFRNLESPVSESGSNLSQGQRQLLCLARALLKNPKVLMMDEATASIDYNTDSKIQETLRELRESTIITIAHRLQTIIDYDKVLVLDHGRVIEYDHPWTLINKQDGLFRSMCENSGNLEVLLDGAKKAWENKRLVDDS

SEQ ID NO: 41090 - protein, 166 aa, A.fumigatus
ESHSARVRLAQAVFCSHYKVYQLRLRSRRIIQTNPSDSLTLTMHILPTLSSLLLAGAATTAALNNSYCAPKSGDAQVVQYAWALEYMVQQYYASVATNQTFLNSAQNSSTANVVSNLQGIGHQNRLGVRAAQQLRKRIGNFTSPGLQLHLPRSRQRPGLPDDRPGV

SEQ ID NO: 41091 - protein, 72 aa, A.fumigatus
SGFHHTVAFMTGWTVVVVHNDCKDLGYATEGTYKRVTQREYAWHKLYSVPTIRYINCAYGLDASFKRTPVTL

SEQ ID NO: 41092 - protein, 251 aa, A.fumigatus
AASCWPARPPPPPSIIATAPPSLATPRLSNMPGPSNTWSSNTTPPSQPTRPSSTRRRTAPPQTSSPTCRVLATRTASASAPRNNSASASATSPHLGCNFTFPAPASGQAFLTTAQAFESNASAALIGLEGYTQAPEVSFLIARLAAQHAGHAAYLATTQQASVFQSNVTSLVRAYSPSYVLSNGTSPGQLGRYFKGCVSAPQPPCGNLTVGPLIATFGNNSTSSSSSSSTATASSASGTATSTGSSNRRFW

SEQ ID NO: 41093 - protein, 186 aa, A.fumigatus
VLGSVKIYFLPAGGFGNNTTYSPFRFLPEPPIARPRRSGRTRSGASRGGGRGGRRARRVVTKGSDQRPDGKITARRLRRRNASLEIAAQLAGAGAVGEHVARAVRAHQRGNVALEDGGLLGRREVGGVAGMLGGQTGDQEGDLGGLCIALEPDKGGGGIGLKRLGGRQEGLAAGGSGEGEVAAQVR

SEQ ID NO: 41094 - protein, 263 aa, A.fumigatus
CSARDMDGADLQRFRVDSHPSDEQPRSLSSLADDAAALAATQHQHHQSHTQELADPQDAQSLQPLQTALEHSELHLHHPQKQQHHQNAGHPLNIPASMQPPSRPGEPVNTELISPRQFNEKLHNYHQASREHTFPGSLSDGQQTQSCLSHSGNQDGHHEQVLSQVRSDLAHTAVECNGNGADDVTHMRNTSLQVSPSFPHHLQLQPQSNGYSVAPELSRQDGCLKDMKLVPNPPDLEYWREKLFNVDETITLTEDQYVHAVLI

SEQ ID NO: 41095 - protein, 91 aa, A.fumigatus
ASSLSAQSQLNKAYSSPFVQRVWIALEIKGIPYQYIEVDPYQKPQSLLEVNPRGLVPALRHGDWGSYESSVLLEYVGFNPHFPFLEEAIIS

SEQ ID NO: 41096 - protein, 223 aa, A.fumigatus
NSVKLGYLTTWPATRFRTYFPHVDNVYSHRSTQRYKRKPFVSHYWDCRLKGRPPGTPKSDDPNKKKRKRTARQRDLCDVKIKITEYFPGYGVAAVSDFAATGPETSFPSSEFLPSVNSLFHESSALGQRRGSQPFGVLTPNPTLPEDHPGANGERFFTIQRVNGNGANGKNDGVGGGHRHTLEESDRVKKNSVQRYLLKEAKEKKKTGSVSVRSVLLFTSCQI

SEQ ID NO: 41097 - protein, 122 aa, A.fumigatus
MCSRVCLLTRSRYLLGQALGGILFPPYSEAFGRKKLYIISTALYSISCLVVAAVPSLSGATVGRFVSGFLSAIPTTVVIGSIEDMFNARDRVWMVCIWAITSNLGLIVGPILSIYVVADLDW

SEQ ID NO: 41098 - protein, 301 aa, A.fumigatus
RRWLFYIAAIVTGLLTFLLLTIRESRPSLLLAREVAQLRKASKVESLEGVNPDHTPDLHSFVRLALSRPVLLFFTEPIVFIVSMISAISIALVYLFTEALPPIYESFGFSPRQASLPFVAIGVGLSLGLLTRFFDLYIIDQHRQQGRVLLPEHKLLGLWLGTPILAGGLWVFAWTIPPGVKDLHWSVSVIALLLVGYSLTELDYVLGGYLTDSYLSYASSGFSALSFLRSILSAVFPLVSPHLFSALGANLAVTVLAAMATIFCIVPPLFTRYGEKLRARSAFAKQSLTTYRQYSVDENGY

SEQ ID NO: 41099 - protein, 139 aa, A.fumigatus
VSRNPTLVSRPCAEQLQINRHIVPSFYRVLQEQEEQKQTANVQELQDGLKALITAANPEGPFFLGPTISFVDVQIAPWILRLSRVLKPYRGWPDPEPGSRWAAWVNAIEANEHVKATTSSDELYLDSYERYARGYTFTA

SEQ ID NO: 41100 - protein, 705 aa, A.fumigatus
ASKYLLSPSGDLKPLFFPIFCLERPAPAAQQSSKMPHRAASPAVSENEFDITGALFQNDSDSDNEQPSAKSKRQPPKKVPSQALDFLGDVNEDDNDDEAFIAEQQTSANRKASNLKGRTVKKGGGFQAMGLSANLLKAIARKGFSVPTPIQRKTIPVIMDDQDVVGMARTGSGKTAAFVIPMIEKLKSHSTKVGARGLVLSPSRELALQTLKVVKELGRGTDLKSVLLVGGDSLEEQFAMIAGNPDIIIATPGRFLHLKVEMNLDLSSIRYVVFDEADRLFEMGFAAQLTEILHGLPANRQTLLFSATLPKSLVEFARAGLQEPTLVRLDTESKISPDLQNAFFSVKSSEKEGALLYILHEVIKMPTGPTEVSQQRKEEDASAKNLKNKKRKRAEMEKAVNTRESPTKHSTIVFAATKHHVDYLYSLLCEAGFAVSYVYGSLDQTARKIQVQNFRTGMTNILVVTDVAARGIDIPILANVINYDFPSQPKIFVHRVGRTARAGRKGWSYSLVRDADAPYLLDLQLFLGRRLVVGREFGDQVNFAEDVVTGSLPRDGLSQSCEWVTKVLDDNADLAAQRTVAAKGEKLYMRTRNAASLESAKRSKQVVSSDNWTSVHPLFQDETSNLEAEREKMLARIGGYRPPETIFEVNNRRMGKHENVDALDTIKRVRSTLESKKKRAQANEKSEFLEDGPDDRKGSQRSQRN

SEQ ID NO: 41101 - protein, 92 aa, A.fumigatus
KQTSQICAHCIMHSAGAVCDFSSLRVGYSNSSMKTHNPNELRPLKMKQQEVLNIIRQDMYFVMNCYESGSYSQTAEHNHYGELQLLFLRWKA

SEQ ID NO: 41102 - protein, 294 aa, A.fumigatus
SPRRSVHKRMKSPSSSKTVPTTGKAVNEAKETESEGAFSDEEETFPPAWQITCRWHSHSEWKSLLVIFKFKDNKARKRARHLSRTLNTSCPIPRNNTSLAEDRAYGVHSVPNSNFAQPSRSATMDLAGDDGGRGFGEARTLMRWDKRHKKYVARQNDEDGSKGTRIFRGESGAKIAASFRSGRFDAWKRENRLGRLPRVGEAEAANLAAGLNAAISGKRFRHRKEQAPKKADPLRGDYEKMKKKAELAKERAMSKAGGAAPRGKSELKSTDDIRIARKLKQKRREKNARPSRKK

SEQ ID NO: 41103 - protein, 187 aa, A.fumigatus
TWVGATQTSPGVITHIKSEDMQIGLFPNPSVEASVENSRLEEFTSFLAAGGTKFQVVEDMQLPRWEKVVWNAAWNSITALTMVDTQTWLTSSADATPLTRRLMGEVIAVGRGCGVDLDKGLVDRLMDKINALPGIGSSMQVDCRNGKPMEIEVILGVPLRRANELGIDTPVLETLTCLLRAVDGRFR

SEQ ID NO: 41104 - protein, 88 aa, A.fumigatus
SSCHSFLTHLFIPLINKMYRNFLLAVLALLSASAHAHTTFTTLYVDGENQGDGVCVRMNRDASKASFPIEPLSSKDIACGKVLPYHGF

SEQ ID NO: 41105 - protein, 451 aa, A.fumigatus
VPRLTDKGYDGEKAVARVCPAKASSILTFEFREYADGSRPGSIDGSHKGPCAVYMKKVDDATADNNAAGDGWFKIWQSDYDAAEGKWCTEKMIENNGHISVQIPADIEGGYYLVRPELLALHASQDNPPDPQFYVGCAQVFVQSTGTAKPATVHIGEGTYDLSLPGMTYNIYKTPLELPYPMYGPPVYQASKTASASPALTNTASANAGSDQAEFAPAPVASGSTGSEKSTDTGSANTTPTNAASANTESGKSADTASGNAASTNTASEKTDSAPANVCKNKTKRNKNKKKNKNKKKRAMLVQTKGLKPEGCILERDNWCGFEVPSYTDEQGCWAVSSSSPSFLQRIKLTETVIQKLLGSSRRMLEHGSPDRLSTLPDLVRQMHGARRIMQQQGVPWSAKCRPGSHAEEGFVGGVDQDIWAGRTVAYQEKKTYSCLALRVNLDIHLEAIEK

SEQ ID NO: 41106 - protein, 191 aa, A.fumigatus
PHQCLALSTILGDKVSFPPTHRYKSCTNSYFSQQNSKLQPLCFVSPTTVEDVSTAVTTITNSNCQFAIRSGGHTSFGGACNVANGITIDLRALNAITLSDDRTTLSVGVGASWGDVYAFLDPLGLSVAGGRAAQVGVGGLTIGGGISYFSPRYGWTCDTVTNFEVVLADGTVVQANENENPELLVALRGGA

SEQ ID NO: 41107 - protein, 137 aa, A.fumigatus
LSDLCPLTTTDYNTDHTSASLSPPSSATKSHSPPPIATNHAQTPISRNKTPSSSLCASSPLPRSKMSLPPSPPSQTATASSPSALAATPASAAHATSPTASPSTCAPSMPSPSAMIAPHCRWASAPPGATSTLSSIR

SEQ ID NO: 41108 - protein, 153 aa, A.fumigatus
LTPVQCQALTSILGPRVLYPNSTAYKSSVDSYWSQQEQLISPSCVLSATSAEDVSKALRVLVPKACKFAVRSGGHGAIAGIANIQDGVTIDLSALNWVIPSADRSLVSVGPGQRWGRVYAALDRLGLSVPGGRDSPVGVGGTTLGGGLIVNME

SEQ ID NO: 41109 - protein, 173 aa, A.fumigatus
SLLTDRLGGFGYFATEAGFACDSVVEFQVVLANGRIVNATKDNEHDLCLALKGGANNFGIVTNFIFRTFPLGRVWGGHIYYPVSTLDQQLDAFYRFTSDPNYDVKAGLIHNFAFTPATGPLLTNLLAYASPEENPAPFRSFTSIQPQIMASTKVMTLEALAEEGGSLSPNSRQ

SEQ ID NO: 41110 - protein, 176 aa, A.fumigatus
DITLTTMTLQVCSNNSRQLTFAVTFENNLDLLTQVFDIWNASTADVSAIPSIQWSLSIEPIVPAIAHQSAIKGGNVLGLDVPRQGLVLALLSATFNHSQEYPIVRAAAEKLSNNIISAAKAACAYNPYIDLNHAAPWQDPIASYGDRIQAFLRQTAGKYDPQGVFQRLCPGGFKVN

SEQ ID NO: 41111 - protein, 105 aa, A.fumigatus
SVQHTISIPLNQEMTSRDIRNIYQERYAGEKLVKIIGEAPLVKNIAGRHGIEVGGFAVHSSGKRVVVCATIDNLLKGAATQCLRKCSRLVVFRKDRLLIRLSQRT

SEQ ID NO: 41112 - protein, 883 aa, A.fumigatus
VFSRHCVRSKTIESCRMLVDKMFSLRTTVRRASTSKPLRALSAPHAVSSARLSSPRHALKASAVPLLQSRSYSRAADPHLSSTRSTVVQLLSNIGSKREVQQYLSHFTSVSSQQFAVIKVGGAIITEHLQTLSSALAFLNHVGLYPIVVHGAGPQLNRMLEAAGVEPHFEDGIRVTDGKTLALARKLFLEENLKLIEELERMGVRARPINAGVFYADYLDKEKYNLVGKINGVNKKPIESAIEAGCLPILTSMAETPDGQVLNVNADVAAGELARALQPLKIVYLAEKGGLFNGDTGEKISVINLDEEYDHLMTQWWVRHGTRLKIKEMKELLNDLPRTSSVAIIHPADLQKELFTDSGAGTLIRRGNKVHTKTSLSEFEDLEKLKDVLVRDREGLDARATVDRYVEGLKERDFKVYYDEPMEALAVVLPPSKDNSSSFPHLATFTITKSGWLSNVADNVFAAIKKDFPQLVWTVKENDENLTWFFDKADGSLSRDGEVLFWYGIESGEEVKQLVQEFNQHGRQMFGDINLEARLQRAAQAATNIGKGFGASGASVEQKRAFSSTANALRAARFGRPAVSPRVVRSYSTTNPNPPLGEKNMSNNRPSKVALIGARGYTGQALINLLNAHPYMDLRHVSSRELAGKKLQGYDKREIIYENLSPEDVKRMSANGDVDCWVMALPNGVCKPFVDAVDQGSETGNVIVDLSADYRFDDKWTYGLPELVNRGKIAQATRISNPGCYATAAQIGIAPLVPYLGGQPTVFGVSGYSGAGTKPSPKNDVQNLTNNIIPYSLTDHIHEREISAQLGTSIAFIPHVAVWFQGIHVCTSPTFIYWPLFYILVSGTDVVRTAHHQHSSQPGDDFSRHPQHLPGALRRREACEDHR

SEQ ID NO: 41113 - protein, 162 aa, A.fumigatus
CLSVQCIYCQQIRAKNTSRQKQHLLECPGLRGQNQTAQTAPNGIGGANGYSATPNGAAATAPGAGPGGPGTAALPTPNGPMMTNGVNPHATSMQTPLQNMQGRAALPTPGPPTGPASATSSHQPTRATPKSKTKASTSNLPALPLDDVHVFTDRGWKETRSA

SEQ ID NO: 41114 - protein, 146 aa, A.fumigatus
PHLDSTLMSVRRCWDLRKPRNTYIPTVSRALSSVHHQQLIRCHHTYNFDLLQLLNHTIPRDTIVKMSNRAEREAEDMYEAENDASPVSADVIDNSYVGETRSELRNQVPVQPDQDDYEDPMQPPYSNTDQQLGTYSTSGTMLVLSD

SEQ ID NO: 41115 - protein, 474 aa, A.fumigatus
EDDSNISTMSEQEFPLLTWEEVHQNLVLSSRSRSTVPDLLGANKITSLLSASSYLLPERSISPQTATSHPQTHLYGGFYLADPPSGDQQPEAPKPKSSKRTRTDIEPPDGSHSRKRGRPRKTAGEGEDPHEVRQHSSYLALVSILPIKLTGQRRRMQIRLAQRAYRSRKEASVSSLQSRVLKLESAVEQISAAFLSFSDELIQSDVLTSHPRLTLRLRDTVQLCLSLAKGANMTEDQNITTNVSSPSEESHSSSEEKESQRRQSSLATSPPSRESTGSQGLGTLQATGFREPAEDKYPHEAPSLDLSAFIERLHFACLYEGYSALSNTAVGMDVLQRPFRFLLRLMDRKRVASYFEACLHAKASRKRLDEWNEIPYFKIGGAGTHYPRKTKASSNETLPRWENIQDPTSELPQEIQHELDGEWFDIQDLEGFLLEKEVAFVVGDTNSSDKRNVVNAAHLIQGRHLFLLLVFSSY

SEQ ID NO: 41116 - protein, 580 aa, A.fumigatus
SLFIVNHFLSLILLLSWPISGLYILSIFSSSSQIDSAHLPFLPAIARLHPGRCLIHSLQAILSSILRLSSDRLESFSAAFLTLSDHRSLVLVIVRQCNMAPSSLLLSVGSLITSSLVSATALEARQSQTYQLAESWQGESFINDWNFFDGADPTNGYVTYVNQSFAKQSGLVKVTESGSFYMGVDYESTLNPNGAGRESVRIESKNYYTEGLYVIDIEHMPGSICGTWPAFWSVGKNWPNDGEIDIIEGVNLQKANKIVLHTSGSCDVSGSNDMTGTLSSSECGEASGTVGCVVKGTNGSSGDPFNESGGGVYAMEWTDTFIKIWFFPRSQIPASLASGNPDTSSFGTPMAHLQGSCDFAERFKAQKLIIDTTFCGDWAGNVFAESTCPMSDPSSPMQSCVNYVAQNPAAFKEAYWEINSIKIYQYGVSAASSAAVSQATASKVEGTRVSAQAANTATPTVPAPVETTTVPQPAQTNTVATSAADHATPSSAETTTVPAATGAPSVSATEGGDSELESTSTVYVTSTTTICPVAESSSAAAAGGKEDAPSNGTSGAEVAATSVAAAAPAASTRRGRGYRV

SEQ ID NO: 41117 - protein, 161 aa, A.fumigatus
FQLRIAALSRRHTGSPSGSGNSRGLGRRRCGVISSGSRNSVGLSWLGNSGCLNRGGNGGRRGIGGLGRHPSAFDLGGCSLRDGGGRSSADTVLVDLDGVDLPVRLLESRGILSDVVDTALHGAAGIAHGAGGFGKNITGPVAAKGCVNDQLLCFEALCKVA

SEQ ID NO: 41118 - protein, 120 aa, A.fumigatus
RTSLLPVDPSIQHWLDAAELLQKSHLQYTRVIPGFFMDYWGMPVVRTNLTPYIFGINIQHCQAAIPGDGNDVICMTYAYDMAAFLIRLLDVADWPEFSIMVGDEVTYNQLLEMAEEIRGQ

SEQ ID NO: 41119 - protein, 92 aa, A.fumigatus
PESYYLIQKSRSDPALDRTRQVQVDYNNIPSLVQVLEQHTIHTIISAIGIFDATTSQSQLNLIQAAEESSVTKRFIPSEYSFIQTKEYFPTY

SEQ ID NO: 41120 - protein, 68 aa, A.fumigatus
HQGAVKVWSSWTLSFRLSSEESASTKAYDQLPQCLLFVLSLVGIYKQTAGTLITFVFTTGMDASKLDY

SEQ ID NO: 41121 - protein, 144 aa, A.fumigatus
RQRMQRYVFRKHLFYFASMLICLYSVFSAKFTPDNKYILSGSDDGNIRLWRANASDRSGIKSARQRQKLEYDQALITRYSHMPEIRRIKRQRHVPRTVKKAAEIKREELAAIKRREENVRKHAKKGALPPRRSEREKMILTHEQ

SEQ ID NO: 41122 - protein, 86 aa, A.fumigatus
EWQLHNICLWRQFCSMTIDDNSGSLYDAYSISRNLLVAYILLMALGHHSPSLTFSSSGDIWLDNTPCFDLSAADDPCKAARSIPLK

SEQ ID NO: 41123 - protein, 106 aa, A.fumigatus
FDGTTSWMINFCNHSSCLHYADDSMSVNGFAQSLDIGARLTMRMIERPLDVIDRGIWHPTAFQDLEPFLRGFLLNSLLNQVIKLFPMLYSVTVGDKARVRLPFGEP

SEQ ID NO: 41124 - protein, 494 aa, A.fumigatus
ALSYCSIRPSFLLHLPSNSGIMPPSLTKQITQIEGVRLADANDIEWDITINYPGKSAKGTIVAITPHRSSSPNDNCSPLALPALTHPHIHLDKAYVHSTREYAHLLPAEGSFQEALSFTAQAKKQFSQADLMKRGEWLLAESVSAGVTAMRAFVEVDHTVKLTCLETGLKLKDEWKECCNVQIVCFAQDPIFSGEYGDENRDLIEKALERYPQIDVIGTTPYVESSTDAARRNIGWAIETAVKLDKHADFHLDYSLDSSKEALVWYVLQALQRNNWTSQSSSRRVMFGHCTRLTSFTDKEWSDLAKEIRDNDLPVSFVGLPTSDMYMASPYPAANAPHNRPRGTLHVLKMISEHGLDAIIGVNNVGNAFTPWGSADPLSLACLGVGIYQAGTQKDAELLYECVSTRARAAIGLLGSQGGSNLMLKEGDQPDLVVLHNVDDTGCNVLRPRNSVADVVWDPPARVSRHIISNGRLKLPPHPMYPGTARYAFKDSDA

SEQ ID NO: 41125 - protein, 648 aa, A.fumigatus
KQLIKVGEIDKHFYTPCNVAYSVQLWGMSRQNGATSSLASTLETTHGTPRTISSPHPSVSTVEGNTANSTPPSSIDLSSKTSCSTGTVRGKVQIPKLSAATTELLSRIAGNIRGDQQKNDNFTTRWSTSIFDPSLNSLNFQKFNTMKASSTIIELPTAPFAYTNNTLAPTAVSNQAPITSGDGSSRPKKPVTIAPKPSVTVSAGPSATLAPSQIQQTLPSQPTALIPNPPLAPLAPSQIQTTFQPQPRGLKPKAPLVSLAPKPAKVPDGNPQKATPGQRSRKNASNGSRKSRKRRRGGDSDGEDIIRAGDSSSDESDVAPTATQTKSGRQVNRPSLYVPPASSPAITKANGTSSHGSETIGARRHKRVFRKTKEAYVNCMHCQRGHSPQSNAIVFCDGCNRAWHQLCHDPPIDSDVVNVVEKEWHCRECKPVQISIVQPTVVRSNPDLQAQALRHPLQHHVPSPKTEVGGERFSAEERRGYLSSLSHASLVELLVTISDRNPSLSMFPSNLKELQLSKFLFTSNTSAGPVSAATSTETITTTETPVSHSGKDTTSEKPSTENTEEPLPSASSSRKRHWYESDEESEYEEFQEHRLYPRAGNGFRLSLNADDVDIMREDPDCPTFSYALHGPAKARAEANETAPVWGAA

SEQ ID NO: 41126 - protein, 217 aa, A.fumigatus
LGTPTVLINCAAAGINSQPVLTLPAEAFEKTIRTNLLAVFHTCQVFLPGMLSAENGGTIVNISSVLGHLSAAGLSDYSASKAGLSALHRTLEAELRVSRYDGIVKMLLVETGQISTPLFKSIKTPNKFFAPVLEPVHVAQKIITAIDEGRGGLIRLPAFAVLIDWYAVLPASIQRIARYLSGIDRAALQGSSAADRSKHGVLSSQISPDELKVKEGE

SEQ ID NO: 41127 - protein, 108 aa, A.fumigatus
HDQASIVPYRSYQTLDGDILFGGGNDRLFGVLCDRLGFPEWKTDPRFITNRDRVKHREELDDLIEKRVKQKTTQEWLEILEGSGMPYAAINDIQGTLNHSHGKSCADV

SEQ ID NO: 41128 - protein, 76 aa, A.fumigatus
HGIVRVVQARGMVTEVDHPACGPVKLVNTPIKYSHATPGVRRPPPTLGQHTDEILKELLNYDKADIDLLKKEGIVS

SEQ ID NO: 41129 - protein, 110 aa, A.fumigatus
FEFSKVQHDEGLFHNHRAAHGAVRLYEQYTGTYSSFQPSPYNVWGRLLETQEARYHCSQTKCNSISWSIGDIGAISDTTNIAITTYGSDPKSSSGTAGAVSNTNNIPTTA

SEQ ID NO: 41130 - protein, 268 aa, A.fumigatus
  UNSURE (15): Identity of amino acid sequences at the above locations are unknown.
WTESTATPFRDMTAXYDGARRLQEKSHVPGVLPLDTEFGSATILTKRDTGVEDIINDNVRKVADLGPSHIMSTTSPSPISQSPDKGWLEHLTFDLFMKVINRTLFHPFLAWVGVLSLRAQATPYTHISFMIATGYAAFLTVLALARAMNQRLAHGLPRPVDLSEEVVVVTGGASGLGLLIARIYGLRGVSVAVLDIKAESDIEGWEEVTGVDYYRCDITDREAVERMARRIKEEVCNRFARLQPCGRYNDMNIYEIMLIFLSWVHRLC

SEQ ID NO: 41131 - protein, 197 aa, A.fumigatus
YIMDGYHVSHDPAVEYTVEPTTGRKLNILDVPGGKSSNPAPKTRRGSNDVVKGRALSPSKIHHPKPSKPYASRQIRETDFAPTMEDLTRRFAGSRMSDEYSYSNSPPSSVGSSLSSRSSGSTSPSSLSSMSDPPTPICRCERYGITRKGDRVKLDCGGSRCGYVTESSDASCSESDSDEEYRRARTAVRRQGIVVRR

SEQ ID NO: 41132 - protein, 106 aa, A.fumigatus
KECGNDGWWKKLRWKVVVARLLLLLMPGEFNAFRPDYPGTVIATILLPPSMKDQSYGLWPKLMKRYGAHKYPYTYMLDKNDAQVASIKQAPEHRSSSLGLIPTVSS

SEQ ID NO: 41133 - protein, 60 aa, A.fumigatus
PIISHDRKLKKGLFECRLCNNKHRISQVHIPYAAKLLFQELAAMNIAARMFTNRSGVSVR

SEQ ID NO: 41134 - protein, 116 aa, A.fumigatus
RCCSRCLLDEPSLLLLFLSFFSSKLLLVRAAFSLEVSCALVALVFVIVVITASSILLITFPTLYQKKSSNLSLPQFALSDELCSLVFLFIYPCSGYFLDYTIFFTRFSILVAGRRC

SEQ ID NO: 41135 - protein, 87 aa, A.fumigatus
SLVLLQSSTATMTAVQLKFSLRTSSNVKTVHLVGSWDNYSRQIPLSRDDSKPGSWVGKFRFQTSMLKLGGRYWYYVSIRRCRIDKGS

SEQ ID NO: 41136 - protein, 426 aa, A.fumigatus
RLGVCASIIPFPDHNQSPRNTYQSAMGKQAMGVFLTNFDQRMETMANILYYPQKPLATTRSMEFLRFRELPAGQNAIVAIACYSGYNQEDSVIMNQSSIDRGLFRSLFYRTYTDSEKMVGLTVVERFEKPMRSDTIGMRKGTYDKLDEDGIIAPGVRVSGEDIIIGKTAPLAPEAEELGQRTKAHTKLDVSTPLRSTENGIVDQVLVSTSNDDLKFVKVRMRTTKIPQIGDKFASRHGQKGTIGITYRQEDMPFTREGVSPDLIINPHAIPSRMTIAHLIECQLSKVSALRGFEGDATPFTDVTVDSISRLLREHGYQSRGFEVMYNGHTGRKLVAQVFLGPTYYQRLRHMVDDKIHARARGPTQILTRQPVEGRARDGGLRFGEMERDCMIAHGASAFLKERLFDVSDPFRVHICDDCGLMTPIA

SEQ ID NO: 41137 - protein, 141 aa, A.fumigatus
MNTSERAQQSSNRPSKKMTTSPSYAFSSSSATPILLLKTKSTPHDGYEEFFSAHGYNPAFVPVLEHHFHQTNLHTVKDLFTSGSLNAGPRRKYGGLIFTSQRAVEGFARLVTSEVDGTYCLPCPQQAWSELKEKYPQANGL

SEQ ID NO: 41138 - protein, 198 aa, A.fumigatus
GTREATPSPTPYGSKTLARLCCSRTPIVLCRSGKFASSSDNVSDMSPNDGIKTCQFNLTSLLLYSSYLRLSETGYSTLTLSLHFFHIDLFTYRSEAFQIITMSDFTELNRQYFRSVHDQYRVQSAFLTNPHSKLASSYREEFRQGQELIFNEVQGRRAWISDTWNDTKSGKGHKIRMLEYACGPGAVSAVCISNRLLR

SEQ ID NO: 41139 - protein, 83 aa, A.fumigatus
HECLCFRSYRYCFWCYWLSRSLHCQQARYVNEMTRRVEADVDSQLANQGCTVVVPFREEMTKRHLKPTGDLGRVVFIVRDRLF

SEQ ID NO: 41140 - protein, 79 aa, A.fumigatus
VAASCFFMRWDELLMLRRNFSYTDVHVDGTERIAEAVAKYDVDRFIHVSSYNADKNSPSEFFRTKVRFGPLRAVAAWQY

SEQ ID NO: 41141 - protein, 63 aa, A.fumigatus
LIVQAWGEEVARSIFPETTIVRPAPMFGFEDNLLHKLAGVTNLFTSNHMQERFWPVHVSSAPI

SEQ ID NO: 41142 - protein, 175 aa, A.fumigatus
TEKKALAPFVDHIVGIDVSEEMIKQFNINAQETGFADKMHGYHGDLLAEPVPDHLSGPEFFDFDLVAVSMALHHFDKPDMALQRLGERLKKDGMFLIIDLVLEDEHSSNSLQKAFPQASATVRTHGFTSDSMQKLFEEAGMGQNFDYKVIQEPIVFRKEGKEIRKTVFIARSQRS

SEQ ID NO: 41143 - protein, 72 aa, A.fumigatus
EQLSRNCSVTGMLTGCFVIGPLSEVCQSSPTIRVACSSPNMNAFALGHTATVFGATGFLGRYIVNKLGMSTR

SEQ ID NO: 41144 - protein, 161 aa, A.fumigatus
AQHQSNSSEHDAYPSIQVIDVGSALELMLHDDTTAGQTFELYGPKNYSTAEIAQLVDREIVKHRRHINVPKAVLKPMAYYLNKLLWWHTISADEVEREFIDQKIDKTAKTFKDLGMEPAELSDLTFHYLVRHSPSFKLLPILIPPPERLQKFLLLRSASRH

SEQ ID NO: 41145 - protein, 88 aa, A.fumigatus
LTVHGMTDDQERLSFLTSLADKVNKPDTQEAYVYALAEVANVKQRLQDLDGAQKDLEVCQKVLDSFDSVETVVHASFYKVNADYYHVS

SEQ ID NO: 41146 - protein, 102 aa, A.fumigatus
PYVKAKQEFAAYYKNALLYLACINLDDLSESERVSRAYSLSVAALVSDTIYNFGELLLHPILDSLTETPHSWLRDLLFAFNRGDLTAYDVFTTGLEGHAHRN

SEQ ID NO: 41147 - protein, 131 aa, A.fumigatus
VDHHQLTLILDVLGTPTMEDYYGIKSRRAREYIRSLPFKKKIPFKALFPKSNELALDLLEKLLAFNPAKRITVEEALRHPYLEPYHDPDDEPTAPPIPEGFFDFDKNKDALSKEQLKSQLSLYPLASLKGR

SEQ ID NO: 41148 - protein, 137 aa, A.fumigatus
KLATMVQQPPQGGSRKISFNVSEQYEIQDVIGEGAYGVVWWVISIVRSDSLAPVLTCSSSAIHKPSGQKVAIKKITPFDHSMFCLRTLREMKLLRYFNHENIISILDIQRPRNYESFNEVYLIQVHSSAQAHTHAHV

SEQ ID NO: 41149 - protein, 141 aa, A.fumigatus
LLGQELMETDMHRVIRTQDLSDDHCQYFIYQTLRALKAMHSANVLHRDLKPSNLLLNANCDLKVCDFGLARSAASTDDNSGFMTEYVATRWYRAPEIMLTFKEYTKAIDVWSVGCILAEMLSGKPLFPGKDCKLLCFEEFP

SEQ ID NO: 41150 - protein, 249 aa, A.fumigatus
  UNSURE (5),(6),(16),(36),(48),(55): Identity of amino acid sequences at the above locations are unknown.
TATGXXKDNLPNLGIXKRFTTVLGRENNNGSADEIXDTPTRRSTDGRXVHHPHHXENAPYTTDFVSDVANKASAMAPTADGLVGPTANLRGAAAHTKLATTSTIPRAKAIAYLERTLAEVKRFKQELAFNPAHQAENRYPPAAVLYGKSVPTVYGARVWSPEQIKRQDAYDDLAFAAGDGVCLASAAMLPPGYRIIKDGLVKSERGHVGLLGDLEGVGQCLRALVRGRREGVGLGPSPGPGPQPAAPFS

SEQ ID NO: 41151 - protein, 197 aa, A.fumigatus
PRLDQHGCAFDDGINGLETSSLHGLAGFCTGQYRTQSRETDTATHTNQIDNPIGHTQSASSLDTTADILDLSAELLPQLHALQPREEGLRQRREASHNILANQLLRLCDVALLRNLHLQLAPAEPEIHDLLDARDLALGQLRIVFGDLVAAGDTEVYATLADESRDVCGGEEDECNREVLDQCDVEAGFAAELDVTA

SEQ ID NO: 41152 - protein, 141 aa, A.fumigatus
SAQPPISAAPQRTRSSQQPPPSPAPRPSRTSSAPSPKSSASSRNSPSIPPTRPRTATRLLQSFTASPSLPSTARASGRPSRSSGRMPTMIWPSRLATASVSPRRRCCPRGTGSSRTGWSRASAGMLGCWAIWRGWASVSGL

SEQ ID NO: 41153 - protein, 155 aa, A.fumigatus
NRLRDGNPIMCRRTPTQLIEDDQRTGRCLLEDVGRFRQFDHEGRFTRQHVVESSHASKHGVQHAELRGPSRHVGPNLCHNGNQGYLPHITGLTAHVRTSDEEGSSLVTVQINVVGDIAIKQKLLDHWMAPLFHVNTRLIGIFGLHISWLASNCSQ

SEQ ID NO: 41154 - protein, 180 aa, A.fumigatus
FILLFSTEGRLQQATLDLLSGSDIQFRRETRLDIALVKNLPIALIFLPAADIPTFVGEGRVDLGITGRDQVAEHDAQLAEGEVSGVEEIMDLGFGGCKLQVQVPQKGDITEAKQLIGKNVVTSFTALTQAFFSRLEGVELGQKLSTKIKYVGGSVEAACALGVADGIVDLVGMCCRVCFP

SEQ ID NO: 41155 - protein, 171 aa, A.fumigatus
LSSILTGAESGETMKAAGLKAIDTVVESTAVLVKSRSTKNPLVDLITSRISGVISTSPLLRLNCNFAYGRSLQPLKDTSCASTTSFAPGSRLPRRLPPASGRPQSPLWRRRAGWLSAPWWRKRRLRRSWTSCSKSAHRTFWSSTLPTRERVRGFLFFFVYSFLDFYAARDL

SEQ ID NO: 41156 - protein, 507 aa, A.fumigatus
LDCTGADILLTWKQCTRPELLTVLQTLQTIAQEYVDVKTPQDSGFTSPILGEAIARVPSILGDVVKFLNKINMHAARNDDKYEFFRESEETEGISEHKCGIASVEHELEEHRSVAAGILKWPKVTYVTSSGIEYLIEVENSAAAIKRVPASWVKVSGTKKVSKFHTPEVIQLLRQRDQHKEALAAACDQAFAALLAEIASNYQSFRDCVQSLATLDCLLSLAAIASQPGYVKPEYTDQTCIHVEQGRHPMVEQLLLDSYVPNDIDLDSDKTRALLVTGPNMGGKSSYVRQIALIAIMAQIGSYVPARSAKLGMLDAVFTRMGAFDNMLAGESTFMVELSETADILKQATPRSLVILDELGRGTSTHDGVAIAQAVLDYMVRTIRSLTLFITHYQHLSNMAQSFPDHELRNVHMRFTESGSGKDEEITFLYEVGEGVAHRSYGLNVARLANLPAPLLEVARQKSSELEERIRRRRLARLLADVGGLIEDPAKGDENFFQRLISNAEQL

SEQ ID NO: 41157 - protein, 289 aa, A.fumigatus
LRSPQRLPRGKMTLSSSQSSPPSTQNLKRKQQTISSFFTKRAPSAEKRSNDIEDGRATTQKGAEMPLRETAGDQNNLEDDEDGDVVVRAPKRVKTNGVDPENGFGRNIKEASNIARRPDPPLSSSQRTNLYKFASSQADDAGIEKTDDPEARQRQLEREKLHKLFVKKLGGADCLIGIGRDATTEAPSGTEDVAEGDEDDESPPQPRSKGKGLSKKGGSKLTPLEKQVIEIKRKHMDTILVVEVGYKFRFFGEDARIAAKELSIVCIPGKMRFDERKSVQNTFSVFLRR

SEQ ID NO: 41158 - protein, 385 aa, A.fumigatus
WMQLQTDPSEAHLDRFASASIPVHRLHVHVKRLVSAGYKVGVVRQMETAALKAAGDNRNAPFSRKLTNLYTKGTYVDDVEGLDGATPAASGGASPATGYMLCITETNAKGWGNDEKVHVGIVAVQPNTGDVIYDDFDDGFMRSEVETRLLHIAPCELVIVGELSKATEKLVQHLSGSKLNTFGDKVRVDRVAKKKTAVAESHSHVANFYAAKLKAANTADDAPASNLLQKVLNLPEQVTVCLSAMIQHLTEYGLEHIFELTKYFQHFSSRSHMLLNANTLVSLEIYQNQTDHSAKGSLFWTLDRTQTRFGQRLLRKWVGRPLLDKERLEERVNAVEELKSPERTVHAERLKIMLGKIKSDLEKNLIRIYYGKVPCDLIVLARIFC

SEQ ID NO: 41159 - protein, 100 aa, A.fumigatus
WCHQYVSLAPIELQLCLRSFITAAQRYVLCQYNILRSGLSVASKITPGKRAPTITALEEEGWVAVSSMVEKKKIATVMDELLKVGASDILVLNIANSRTG

SEQ ID NO: 41160 - protein, 77 aa, A.fumigatus
KSSRVITRIAVIIKTSAWGIKCMQSVEELTKKAQQAEVPVLDSALIPHLPVGHGLKPGDTGPPPPDRPAAQHARARS

SEQ ID NO: 41161 - protein, 207 aa, A.fumigatus
SVQLILTFYAAIGADKAVNLSHARIKVLEAAKAGAKLIVLPECFNSPYGTQYFPSYAETLLPSPPTKEQSPSYHALSAIAAEAQAYLVGGSIPELDTSTKKYYNTSLVFSPTGSLIGTHRKIHLFDIDIPGKITFKESEVLSPGNQLTLVDLPEYGKIGLAICYDIRFPELAMIAARKGAFALIYPGAFHTTTGPLHWALPCSRSCG

SEQ ID NO: 41162 - protein, 103 aa, A.fumigatus
STLAPFIRLLVLFTGPFLVRARAVDNQIYVGLCSPARDTNATYHAWGHSLIVNPNAEVLTEAAETETIIYADLDNESIQNTRKGIPVYTQRRFDLYPDVSAEK

SEQ ID NO: 41163 - protein, 74 aa, A.fumigatus
PLMFRDQGTKDVRLDPQLNKKVWEAGVKGVPFRLRVRISRKRNDEEGAKERLYSYVQAVNVKDAKGLHTAVVDE

SEQ ID NO: 41164 - protein, 158 aa, A.fumigatus
ERRRYRPRGCAQSARVGPLIHSSTNPAWNALLTKQKRALGLPPSDSSELHSILSAVDPTNTGFVPYAPFVSVAAAKLRSRSDEAMSAEVDAAFQLFTKGTDGPITLGHLRRIARELKEDNLGDELLKDMILEANGGAGVNAGVTLEQFHDVMTRAGVF

SEQ ID NO: 41165 - protein, 468 aa, A.fumigatus
RRLTTRLGTDVTEAIFRLGSTSPASVLLDSVDLLEKKSPKADENIQRIRSSLPEAVDTCVKAAGHEFDVYWQKRLLKAASYGKSVLDLYNSDEFVEMTEKLRVLKAVRDYQIGLPLSYEQYLRLTPEKLIERLVNRHEYLLSIRISEYLQIPADRIYVHWASQKVKVSTVDDEAVCKLIVQKLEGKPGISFEQIAQAAYDEGRAHLATQLLNHEPRGGKQVPLLLKMEEDEVALDKAIESGDDDLIIYVLLHLKSKLPLASFFRMINTRPIASALVEANARGEDTELLKGLFYQDDRPIDGSNVLLSEALNATDLPHKTEKLLLASKLLSDSKDATAVQQHKLLSEASQLLKVQEALDKDIADRAEFVGLSLNDTIYRLIKTGDGKRAHKIQSDFRMPEKTYWWLRLRALVAKRDWGELEEMAKKKSPIGWEVSKTLPILRYLIEHCPHPNISPNTTHIHKNICSHTT

SEQ ID NO: 41166 - protein, 178 aa, A.fumigatus
ANSRAMNANLSWQGAEEYGVRACKFWNNGFVALLSNNQLIAVSNYDEPRPKLLAPCPEGEISSWSLIPPPYTLSRSVEVLLAVDKTIFLIDSSEAEDKVLQNGPFKHASVSPTGRFVALYTAEGQVWVVSSDFQSKHTEYDPQSRVTPRTVDWCGDDAVVIAWEDEIHLIGPNGTAAK

SEQ ID NO: 41167 - protein, 695 aa, A.fumigatus
SSKSLYAVVVLFFWLAMNARRGGFDILTQSPFHNPQNSQHETFLQRLQSNNNTLTYGVAIGLLVYFVLNYFGVAPILISRALWNLIVYLTPSRIVVALDSKTSNLDSTDKALLSMNFQTKSEAMQRILGLNNSSLSSFLPCSTTFSGFGTALLGAKNHLPPGLGNWDNSCYQNSIIQGLASLLSLAEFLEHNIRTLGDKGSFSTHQALRGVIERLNNADNHDQRLWIPAELKSMSSWQQQDAQEYFSKVVGQVDHEVQQATKRRTRNLGLKMAGPVENIIGAEPHTDVDGADSSSPRLAERHLTRNPLEGLLAQRVGCMKCGWTEGLSLIPFNCLTVPLGGQYEYDVRQCLDQYMHLEPIEGVECAKCTLLRAKDQLENLLNQIEEDMKLPNTPDSSKVSGALRTSAEERLRAVEEALEEDDFAEKTLSKKCHIPSKNRVTSTKSRQAVIARTPKCLVIHINRSMFDENTGMLRKNYAAVRFPNVLDLNEWCLGTKSSSWGQMDIERWGTDPRESMLPEAGSASDVPGRFFELRAVVTHYGRHENGHYICYRKYPSDVFPAHVPDTVLEADGEKDKAERWFRLSDDDVQMVSEASVMSQGGAFMLFYEAIDRQGSDYTPTHGTHAVEDEKLESVCDLTTSNDMSTTSTITDGSPDTSPATSVSAADRFDVPLYKLQLLTDDHASSLGESSLEVTP

SEQ ID NO: 41168 - protein, 498 aa, A.fumigatus
  UNSURE (338): Identity of amino acid sequences at the above locations are unknown.
KTGAVLKMLANNFGEIPKGTGKLPGYAPVQAAEIYSRTHMALRHVMQLIPSGSGTLSPILSMQFPFDTDSAKANIAYTRNLLKVISYAPELQADILALITEKVVKIDVQIQVDMEDIEDEVGEDVLHAVSPEATMLEDDENEVDDNASVASDDSLDVESRRVKAIKDNILKLDGMIDSLFEYYAPPFTTGTLDDKENALDLLLSHFQSIILPTYRSRHSQFLLFHFSQSSPILVDRFAATCVQLIFNKMQPGILRQSAAAYLASFVARGAHISGEVVRDVFDLLGTHLNNLRLDYEATCRGPDLRRYGPVYSTAQALLYIFCFRWRDLTTAAMEGDTXEQIDELEPEDITFLPSVKEVFHQAIHSKLNPLKVCSPAIVSEFARMAQHLNFMYVFSILETNKRLRVSSFRSISAMADPRFSHVERETRAGDDLGYQLDAYFPFDPYQLPRSRRWLEDDYVHWRGIPGVDDQDEGDSDSDLDGSESEGDLSDVTETDEDD

SEQ ID NO: 41169 - protein, 387 aa, A.fumigatus
PSARTSDSSGGYLFEQCRPGSLLHSPPALYTPDEREASLPRLPSASHYLAGGPSREAWGPIHCDGSVGQHLRVGSIVRVRGIVQTPQVPVLGCSIHDVELDVEQIHLVVHREEPVPFSVYEAEIRTAEEDKVEGRRSHLPDRTRLNNRILDLRTPTSQSIFRLQSALCNIFRSSLDEQGFIEIHTPKLQGSATESGASVFQVNYFGRDAFLAQSPQLAKQMAIAADFERVYEIGAVFRAENSNTHRHLTEYTGLDIEMAIEEHYHEMLDVLDAVIKNMLKGVYGRYRREIEIVKHQFPSEDVVWLEETPIIRFSDGIKMLNESGWRDEDGNPLPEDDDLHTRDEIRLGELVKEKYGTDYYILDKFPVAARPFYAMPRSRRPALHQLL

SEQ ID NO: 41170 - protein, 93 aa, A.fumigatus
CTKGGSCNVDYIKIIFPRPRVAYYTILVIRAMQVNQIAPTYRVFFSSPSTVVLSPTSRSTIAPNAPITHLASKTATIPTTHRYPAVRHHIPRE

SEQ ID NO: 41171 - protein, 280 aa, A.fumigatus
LYTSSDNLGGLSSVTMSIKRALSKIRPKADDDSSKSNLSNGSSPRRSIFSSFLRDRDYVSSSDDGSDDSGSGSLSRNQQKRLAREQRRKQRSRLSEEQQSDDSERRHKEEIAQAAREETAEMRARYGELPLLQSTSRPREPRIRLEDISSSSVGQEVFFTARLHFIRRMSARLVFLVFRQRLTTLRGVLHEKPGGQSIAMVQWANIYAWVPSCACAASSKRPRCQCWAALFMTSSLMSNRFTWSSTARNRFPLASTRPKFAPQRKTRSKAAAVTYRTVHG

SEQ ID NO: 41172 - protein, 547 aa, A.fumigatus
RGSMAATAARSRLSSISSPRRTLCGSKRHPSSDFRMASRCSTSPDGVMRMATHCRKTMTCIPETRYGWVSLSRRSMGPITTFLTSFRSQLVRFTQCPDPEDPRFTNSFDIFIRGQEIVSGGQRIHDPRMLEESMRRSGINPDTMEDYLEGFRWGAPPHAGAGVGLERLLMLLLKLGNIRLASLFHRDPKSFPPKPPALLLRHPESSTIEPPWQREGRGSLAKDESELQPLEHLIANYGDATSTSWGDERFKIWRDMATGAAVSYVPSSNNYAVIPGNPLCDPSQYNRIITQFLQWMRRETKYKPIWLLCSPEVESILGDKLGWRSLSCIAEERVDPSRNQAASDGEIARKIRRAENEGIKIVEMKYGEMVPDDVREKIDARIQDWLANRKGTQVHLSEIHPWRDSEHRWYFYAVDKSGTICAFVALAMLSPHFGMQVKYSFDFPGSPNGVIEYIVTHAIQTAARAGTKSLTFGAGATATLTPGHNLHGAKIKMLQHTYETLAKQFHLVRKSEFRAKLGAHEEPLYIAYPPHGLGSRGIRAVLHFFED

SEQ ID NO: 41173 - protein, 351 aa, A.fumigatus
TRDGHRCTRSTSMASHAPPRWWLYIQAVFWRFLMRIGMFFHNLPAPRPPRPAFVRSVRSGNSQIRLHFYCPPDYQKNRREGRRLPVVINFHGGGFTLGCPTDDSRWAQCILEDVGAVVVSVGYRRSPEHPFPAAVDDGVEALQYLAAHATELGLDVTRIALSGFSAGGNLAVTVPLRLRSLMAKEQHGPPLDRANSTQQLLDTSGDISIVALFCWYPILDFEESRAFRRAASIMPEQTLPKFLTDLFDNSYLPNHEHRRSPYASPVRATDEILADALPHDIFLYICEWDMLMNEGQLFMRRLKDSGKHARAMMIEKARHAWDKSPNPFRDQAKVNVLYRDACADMKAIFDR

SEQ ID NO: 41174 - protein, 142 aa, A.fumigatus
SHSYSTSSLSTVMAEKTLASNPVTSSSPEAGDDQKQPKDINHVERVLSDGLKKDEADYSRMDKDLQEYVARGQVDVDEATSKRLKRMIDRRVLIIMILTYFLQALDKGTLSFASIMGIRTDLHLQNGQKVTLVFPFSLGYLL

SEQ ID NO: 41175 - protein, 101 aa, A.fumigatus
YSWLTTCIYIAVLIVEYPTNWIIQRVPIAKYLGINICLWGSVLALHAASKNFTHMVVLRTLLGIFEACCQPTFVLLSSMWYKREEQAATVTYWYVDHTTLT

SEQ ID NO: 41176 - protein, 169 aa, A.fumigatus
SSPCSSTALITAGDRFLRDGPILRANVPLADGFQDAIRKPRGCGRFDIRVRMVQEGVPETRLALLQPLQGLTLGLERVDEVDADRICRLKVEQLDNLRNDDGDPAVTAGPARSCKVVPSLLEGPAVEPKPCLGVKEVLDVNEKLPLGLGNVLGTVQELADLRQRQNGHH

SEQ ID NO: 41177 - protein, 177 aa, A.fumigatus
QSIRYMMNGGQQIVGGLLAYCFSLIGKDKAIHSWQALFITYGVISVLWGLFVIFWMPDSPMRAKCFSEEDKHLMVERVRANQTGMQNKKFRAYQMWEAFRDPQMYCYCAIQIFTTLPTSGLGAFANIIISGFNFTVLQTQLLAMVLGFYIIIVLLGSAWLVKKTGQNLFVMLGFVIP

SEQ ID NO: 41178 - protein, 109 aa, A.fumigatus
VFLFAPFSTTSAPSTDIHDPRSYIGTIVLMTVENKNLGTKVGLLISYYITLSFWSAQTLCLSMVSRNIAGATKKSTVVAATFVSWAVGNSIGSPPSFLPPPPTKKQTSN

SEQ ID NO: 41179 - protein, 85 aa, A.fumigatus
HESHPGPQVFLDRDAPRYFIAFGVHLGCYVCLTLAIIFLRFWLALQNKKKARVLEENGLSAADNNLTHAFEDRTDQENLHFRYIY

SEQ ID NO: 41180 - protein, 337 aa, A.fumigatus
TRMASQSTSQTDVHQTVKQLIYNLVNIRDATGKFLLRLQDGRVIDTKSWHGWEWTHGIGLYGIWKYYEMTGDESLLRIIEDWFAARFAEGGTTKNINTMAVFLTLAYVYEKTGNVTYLPWLDAWAEWAMYELPRTRYGGMQHATYLTENYQQLWDDTLMMTVLPLAKIGKLLNRPEYIAEAKRQFLVHIKYLFDTQTGLWFHGWTFEEGGHNFARARWARGNSWVTIVIPEIIELLDLEPTDPIRIHLIDTLEAQCEALQRLQESETGFWHTLLDHPDSYVESSATAGFAYGILKAVRKRYIGAQYRPVAEKAIAGRDERRGRARRASEYQLRHRNG

SEQ ID NO: 41181 - protein, 67 aa, A.fumigatus
YPRWLYIEIINTLDIFFLSAAKAVVKERGISIYSIGLIPETSGTPSPSTTLALAISYTGSSASREMT

SEQ ID NO: 41182 - protein, 160 aa, A.fumigatus
AFMFLRACRGSLVRIWTCSLAYSSASFQASSIESTTITSPNRSHEVPASSAVDRFFKSSVIIRIDSRPTASDVVMITAGESGPCSACERMSVATVKGLAVSSATIRISVGPAKRSIPISPNNCLFASATKALPGPAMKSTLSMVSVPSAMAAMAWTPPST

SEQ ID NO: 41183 - protein, 319 aa, A.fumigatus
SWRHQFNSVQQWLLAHRIDLHNQLKRAATSTDAGREAIPFRTASRVVHVDPASATITLEDGTQFQGDLVVGADGVHSVTRSAIPGGNVKASCCGKSAFRFLVSKDAALGDPETAALVERPGQLSIWYGTDRRIVLYPTSNNTVLNFVLIHPEEESAEEADESWGQSGNLQKMLQIFSSFDPAVLKLVSMADPQSVRVWKLLDMEEIPCWYEGRLALLGDAAHPFLPHQGQGAGVAIEDAASLAVVLPFGTTVEEIPERLQLYDEIRHERASRIQQYSRLAGRDRVDGQETADSKRSTFIPRNSHSNCVSVWLHQLQFWP

SEQ ID NO: 41184 - protein, 180 aa, A.fumigatus
QIRPAASLHLCFHSLLFYDTWSRSIKDVCRRAHDPDHPRDRSRCRRVPGACYHCRCVLSSPARLWHGVSVLTLRWSRRSEKLTACMTRIYNAALSAGVAFGIIISGLVTIKHDWRTIYWVGCALVGALTVVVVLFFPETAYRRVGNPLVERAVEIQKLSDSNNVEFASVPSILPKVSYLA

SEQ ID NO: 41185 - protein, 72 aa, A.fumigatus
LTDFKKGWGWACERVKAVDVVTAEGELLHCNENQNEDLYWAARGAGPGKALNLHHQFLMLILESSSWQASLV

SEQ ID NO: 41186 - protein, 85 aa, A.fumigatus
PSKVIGTNHVLPTKKAARFTGGLWVGKYLRTVTYQEVTSRQASGELGRLCGRAARAENFEGHARSGDLRAYNYLGDQFEWIQRDI

SEQ ID NO: 41187 - protein, 384 aa, A.fumigatus
RTLLPWLSCCLLGRRSRKYQSVFSCMMRFAMNARAASNNTLGWPAVIVSMDRKPLTVSVPLSFLEIRTLTALVYGFTNYNFGHDEWDNSTQRLREWTWKRIPNPYWRMPIAFGPMPGPRQNHLGIPRDGTKSTFTTASIKFKTSRTVLQNLFPPGRRGWRFSAPDTVAYASFSQTTLNKMEWLGGSGYHHIGLYVHGVEYVKKDGTVIRGSYLPILFESLTDPIVSGREELGAPKLYTSVDIYRREKSYRIRTGWQGALWGHFLLEDLVEVDPASAPGGFSGEADEGILVHKYLPQTGRLNKNKAAEEYAAFDPFSEAVPIPNPRKVWTSSKASFQIDPLDWEQLPTLHHVISRLAELPVYEIASARVVEGEGVPDVSGMRPIE

SEQ ID NO: 41188 - protein, 246 aa, A.fumigatus
KQLRRCTSLHWLLPFSKYFWAGINALPTSRLFSRQLSSSLVTLHFTMADTILKTTETIEHVEDSQSRDLFHLHNLGHVRLRHEHTNEVILIPAPSLDPNDPLRWSTGYKIYIAILVSLAMVMCNFMAAGPTVAMVAIATDFKEGGNTTMSDWISRAAYFFNNSALMQGVSCLFWVPLLNKFGRRPVYISAFILYFFMILGAGLSKTYAGELTTRTILGIGAGAGECLAPVTIADVFYLHQRGYGMA

SEQ ID NO: 41189 - protein, 163 aa, A.fumigatus
ATWRSLRFWSGETYTDESFWRMFVRPFGLILIPPIFWATIVMSVTIGFLVAVVSNFASAFSTTYGFEAWQSGLCFIAGMLGCFLGTFAGGPFSDWVADYFTRRNGGIREPEMRLPAIIPSVIAAPLSLVLYGCGIANGWHWMVPTFGLGLCMFVLSFSFKPST

SEQ ID NO: 41190 - protein, 162 aa, A.fumigatus
SRQTQTAIFFQVTILHSTMRIIWRASADPAVYEEARVGRVFNHRRPRRYPLAVVKATCLEDIVLAVKLAKEKKCRVAVRSGGHSWAAWSVRDESILIDLGDYKHLEVDAEKRMARTSPSMTGKEINGKLIKEYGLMFPGGHCPDVGLGGFLLQGGMGWVCRV

SEQ ID NO: 41191 - protein, 200 aa, A.fumigatus
RQIPHATIAAMHLAGADEIYVLGGVQAIAAMALGTETMDKVDFIAGPGNAFVAEAKRQLFGEIGIDLFAGPTEILIVADETANPFTVATDILSQAEHGPDSPAVIITTSEAVGRESMRIITELLKNLSTAELAGTSWERFGEVIVVDSIDEAWKLADEYASEHVQILTKEPRQALRNMNAYGALFLGEKTCVSYGDKVCP

SEQ ID NO: 41192 - protein, 79 aa, A.fumigatus
PTLSCREEKSWALPSYILLWTSIAGKNHIEFVQDGKALSGAISYWKTWSKLTQRQPPEDSVEKLMKGSWYTNIYLRPVD

SEQ ID NO: 41193 - protein, 60 aa, A.fumigatus
LRANQPSRTLLFSFPLNNSYNIRSGKRTSSIAYFSYLMHYRILLAGCISSLELLRIFHQC

SEQ ID NO: 41194 - protein, 86 aa, A.fumigatus
VFFTSMAVIYLLTPAACFGFLLSFYTNPWIDQSGYIAAYGAMAGISGGCLLFFIPLFFWGKSIRHASMKWSLVQFVFWKDDREVGE

SEQ ID NO: 41195 - protein, 174 aa, A.fumigatus
PTSSIPHADSRIILLAGFPGVITQFHLELIPYPKRGFRSSGYIYPISKYYEAFSWIVAITPDFDRDTEIAVVSMYPEGSNEICLFVLLVTLKHTPEEAEAALTPAQQSRPAGTIEEWFCREDSLENQYVNQGKANPEGHRYCAENAYVHNDADVPKVLEEAFTTLPHRKAFPPW

SEQ ID NO: 41196 - protein, 409 aa, A.fumigatus
YRVEKLYDNAHAFSLIPAFCFSDFNLEFTLDVYPSFHCLHCLSRYPIVHLAVSMGRTMLVCLVGSITAFSVLTDLAISITFYRLRESASNGPNPTKCSSLLSLSAVNFLLVSLLSYLLYSESEPQATEWILRKFKARALFCLIIFLNIGIITGERLQHLYVSKPKSSSSSVWLSLNIAHAVVWTISAYCQGFLCALSFVLPDILNNESGRASNPPINIGRTAESVFSTTNLISPQSPQWRNPLLSPVPSFLDPLPSPQSEMSVRTSILRSPLPKYCTCKDPEPLFVQPRRREKSLQSTPSIDTVIRCPESNGEMAEGISPTPTPTTRKPLIEDNEKNIRPLFRPSTPHLSPMPNMSTAIIAPLEGPNQVSVTVPCQRENVDPQLSSETAQPVLPFYVLNATARNSLAQY

SEQ ID NO: 41197 - protein, 242 aa, A.fumigatus
PIRARLLSQTSHFSASAESHPNMKALVPITSAVLGTTAVGVYLFRQNLKSRISINAQHGHLPRSISSNITTAPDEVFTEQTVAVFDSASISVPRGKLPALPTEELLTRLMRRNMSSFTRLPQAYILRAMSTEAEKPSFKAANIERLDFKEGDLVCGTYRVILRTPGKVEFQLKPMGAVRGRLVTTITEKDDRMVIMNETLMWKPKGEKGVMPLETAVGKWMHELTAWWMLDSGVKYLMNLKN

SEQ ID NO: 41198 - protein, 106 aa, A.fumigatus
QHLALERTFLAYIRTSIAVAMQGVFIAQLFRLQSKTADHARLGYYRLGIPLAVTCHVVAILVAFMGAHRFWRQQSAVAHGKVYAGGWELNWIGAFIGLVGMLPSFK

SEQ ID NO: 41199 - protein, 156 aa, A.fumigatus
RIHGRSKSFPTFTSREVESSTLHVLDTCLLILIYILNTNLLLPRIINIYETCKQKWNRSISLGARREDKQTAKRGDSSIELVYRQFFKFIKYLTPESSIHHAVNSCIHLPTAVSKGITPFSPFGFHINVSFMMTIRSSFSVIVVTKRPRTAPIGFS

SEQ ID NO: 41200 - protein, 91 aa, A.fumigatus
PTHTCDMAAPCRAHAAKLLHLPAEVIQLIVDHLWPEETTSLLIAVPKLAYLVTVEQLWYQDGWGYTILHCAVDKNDEAIAHLSSPRIARAR

SEQ ID NO: 41201 - protein, 240 aa, A.fumigatus
SHCAGEYLPKVRLYHVVFQFLWGSIDCFCSIIEQVSRYSSVPVAVSAVQQQHYQEHHVKISKVGADWHHSGTLPPTLTTAHITSIQQPTSQNVPSEYILKNQSLECLVEILQSLDNWASQRIDGPAAGVTNLLSQKSLDNSRESMDTNAATFLSSPRVEGTDGSTGRSTPVAEDDPSQIEKVKQRKTALMNAIQQFNFKAKRGIKLFIQEGFIRSDSPEDIASFLFRNDRLDKAMIGEYL

SEQ ID NO: 41202 - protein, 143 aa, A.fumigatus
GGLMTAVNRSTAGFMPMLLMVKVPPWYSSGLSLFSRARLPRSLIWLEMLERPRLCTFLTTGVIRPLGVATATLISTVLCWRMTTWPFSSRQLELTAGTFIRAAAQALTRKSLTESLYLPSAEALRAWRSFRSFVTDRVVETKK

SEQ ID NO: 41203 - protein, 738 aa, A.fumigatus
MADVENGSSQEPNQTLLVLPQGDNKENTVDTSTPVETEDAVEEDSKPPLPLESQRQKIDLDEVTDSNSPQIKVDSSEITETADRPPSPPNDAADAERPEEHGSPQRDLKANDVTNSGNDQAEAPPGDSGDKQDDGAVPQFELTPGTRLRSDSRSTTATYATQRSVPVSSAVFIVNALETIGASKEAKKSKELDDAVKSALANVKQSDRLPIDPELIFRPLQLATKSLSIPLQVTALDCIGKLITYSYFAFPSSQDRKSSEIEATPEQTPLIERAIDAICDCFENEATPFEIQQQIIKSLLAAVLNDKIVVHGAGLLKAVRQIYNIFIYSKSNQNQQIAQGSLTQMVSTVFDRVRVRLELKELRLREGEKGQENTPDAATAETVEVPLSTDQDQTSDAASVVAPDQPVAKEPGEKLTLQSFESGKDVTSVADNAPTMVTRAKLSQKRTQSLSSTSGEEKEDGDGTTDDDEDEIYIKDAFLVFRALCKLSHKILSHEQQQDLKSQNMRSKLLSLHLLHYLINNHVSVFTSPLLTIRNNSNSSDAMTLLQAVRPHLCLSLSRNGSSSVPRVFEVCCEIFWLMLKHMRVMMKVCLCAYLLSLTGSNSSQKELEVFLKEIYLAILEKRNSPAFQKQYFMELVERLADDPRALVEIYLNYDCDRTALENIFQKYVCITSCSNSFGAVLIVFAASLNKSHDTRAYLSQFLQSNSSIIKNTMSRYQKWAQIGITAGLCLRHSRQRT

SEQ ID NO: 41204 - protein, 171 aa, A.fumigatus
LYHSYSTWHHGCLSCPNAHSQRHVVKRRPLREAASRYSQIQGCCPVWFTLDISWSNRIDNDTDQIYRPQLPALSALSRFYASKCMSSRFFLLSVTFTHCRLDPNHAPLQPFRPTPSSACLPSRPRCPQETLELGRRRPVIPCRRVMFSWKSRPIRHRWTLNFKRKVSWPRF

SEQ ID NO: 41205 - protein, 376 aa, A.fumigatus
AEKNFRGPLSPIANAQKQPIAVLVEEGTDVAPFESFTLEDAGGDKGTAPPKESKEEPKAEAAPAPSTPEPAPAAQEPETSTEKLQPSLDREPNISPAAKALALEKGVPIKALKGTGRGGQITKEDVEKYKPSISAAAAAPTYEDIPLTSMRKTIATRLQQSMRENPHFFVSTTLSVTKLLKLRQALNASAEGKYKLSVNDFLVKACAAALMKVPAVNSSWREENGQVVIRQHNTVDISVAVATPNGLITPVVKNVHSLGLSSISNQIKDLGKRARENKLKPEEYQGGTFTISNMGMNPAVERFTAVINPPQADILAVGTTRKVAVPVETEEGTSVEWDDQIIVTGSFDHKVVDGAVGAEWIKELKKIVENPLELLL

SEQ ID NO: 41206 - protein, 84 aa, A.fumigatus
  UNSURE (73): Identity of amino acid sequences at the above locations are unknown.
PCASTAFPPHTIISMPALSPTMSAGNIGAWQKKAGDSLSPGDVLVEIETDKAQMDFEFQEEGVLAKVLKETGXKDVAVGTVCIG

SEQ ID NO: 41207 - protein, 239 aa, A.fumigatus
LVDAYLGLKIWGKMWGTCSRYRYISGSIETLRDKKDGPVYRRERSDSPYQHGSIRKHTMASLDTKYPVETTEPALAKDDSPAGADINPRAERALVWKFDLRVLPVLAVMYLFNSLDKSNVGNAKTAGLEKTLNLKGNEYNLILSIFFIPYVLTAPFLGILGKKYGPNRVLPCMMFAFGLCTILVVAVFNFSGLLAIRWFLGMAESAFFPLVIYYLTTYVRLASLQASKLTEADSTAGAN

SEQ ID NO: 41208 - protein, 171 aa, A.fumigatus
HPGATFSSSKGEAPSSWHSSHYGISLARPRTHPSSPPMKNNSHTSASNATAPPSSTRNSTSATHSRSSATAPHGSSSLSRSASVCLCNRSSSSSPPSSNASATTPSRRTCTPSPPMSPAPLCSSSLPSAATGPAGGSPSWRWGSCSRSSGSSSTPQLTSRRISMSHILLPS

SEQ ID NO: 41209 - protein, 85 aa, A.fumigatus
VVRRGTSAPSVLLDVWYNNNIANEGRRVVLTSIAVPVANLMGVVSSNIFRSQDAPRYMPALITTASFGGHGDSVDLVVGWVDDGG

SEQ ID NO: 41210 - protein, 183 aa, A.fumigatus
LIFISSTAIEAVKDAIATRTSSQVIYYYCSFHLTTSQELVYLLGALLVQLSESYPEILDELQESFKRRALPQPDELVSLLLKFTKPLSELFIVVDAINESRKSAQILDALLTLLESSHNIRIMVTSTTLPPVSNPTINILRVQMKPSTNRTDIEAILDTQLTSVPALQRLPEHIKCRIKTCLA

SEQ ID NO: 41211 - protein, 238 aa, A.fumigatus
RIRQSKRSSHRTQSNTGQQRTTAWTRPRGSRRIWQKCLTYLMFDDFKQPCSDLRSLTKRRKTYPLLKYAAENWASHCSPSWPPGYPLVDAEIDGILSFFDTRHLPGGGNYTSWTQMLLSEAPAEQARRTEPLYYAASYGIIPLVDRLIQSGANVNAAGGRNDATPLIVACFRGQEATVQRLLEAGADPIIQDAAEMCSLEWAVRRQHRGTVEILLSHMRKSMGIGSSDLCWQCRACKY

SEQ ID NO: 41212 - protein, 312 aa, A.fumigatus
TDRSRFYRRGELARRLAIFYAAQSIASAFSGLLAFGVFRIQSGPLASWRYLFLIEGGGTILVALFTLWYLPRSAAHASFLTPDEKQLAYLRLQRDSSAIVNEKLNLRDAFKIFRHGTSWLILAIQICLGVPLQSVQLFLPSIIKRLGYDTVKTNLYTVAPNVSGAAMLLILAFCSDWTRWRFPFVALGFLFTFIGFVIYAAIDVEADINVAYFASFMMTWYVLLSLSLSNPHVIKLALSCAQGHLRAIGPPGRLVQQQHRKRGPPRCANQHCGPRREPHGRRQLEHLPESGRPAVYACADHHGVVRGARGFC

SEQ ID NO: 41213 - protein, 273 aa, A.fumigatus
VLSWWSTVLANKVVYNNQPPPDPQEVSMMLVQFRQELDDWRTAAPVYPPALLYSTSYYDYLYYTTLLLMYRPSPRNPTPDATSIVSCGDSSIQVIRSYWDSYSVGKIKWIWLTLNQTYFAGITILWCLEQNSRALRDGRPPLWQPDEQMMRRAIQAVIVLLEEFGKRRPGVERLGETFRCQSSMIFSQMAYQQQQRQQHPQQETPYPPQQPPLPPTPPSSLPAIPPPPVPLAPMLDDVLLVDGIPRQIDPQLAEQLFYSYDWFQEEMATYYTL

SEQ ID NO: 41214 - protein, 504 aa, A.fumigatus
LITKLPPSSLASDRYGLSFEHAFRLSRPTPVTATTMAAGSSARDKEFRDQLGKFRLESVVTPLPPLQPSTSSSQSKSPPRSVPPLFPPPNSTTSVASPLQPSHGTRPKRVSTACDFCRKRKKKCDFRYPNCSACTRAGVRCTVPPPGPQIASASVPRDQLENLQKRVEWLEDVLRRKTGLSVAGIPTGSNVDGEVDPDWWYQVPAIMARYSNRHSIGAGSVATSSPAGSGRGSSTGAPASDTSGFGTELPNVGEIFRDQLEHRRPSIARPTVSAPRVVRLPSLEEAERIAGNYFDSLGYQYPFLSRPDFTTLLRHIYAGGVPTPEDHYSYHITISIGLLIGSADEAQIDEFYRASQQTLSLALQNEDLAAVRALLSLALYTMFATTGPSVWHVLGTAMRLATSLGLHKMRSSASLVEEEMAKRAFWSLYNLDRLIASTLGRPLGIADEDISVGLPREFNDDWTEVPGGSTMTIPVQVVKLRRLFSRIYRYCEFFHGGLPFWLTK

SEQ ID NO: 41215 - protein, 75 aa, A.fumigatus
NCTVSNCNQCSVWAGENGLLSLLDYKTYRFLTAAFITYLCRRLLHGLAVLSLHSMSVTNLPATYLVTELWALATC

SEQ ID NO: 41216 - protein, 76 aa, A.fumigatus
ESSSGRPGLTLSPSQTQSINMMLLDLKQVAAVLLASASLAQAAVQGFDISHYQSSVNFAAAYNSGARFVMIKVCFL

SEQ ID NO: 41217 - protein, 489 aa, A.fumigatus
GFVGQIKFIGAEVATLTARPRQTSFKDLVNKFNQTVDQVLPLPTTSSSASKSPSRAPSPIGLVDSTVRPRTPSQLRELRDLPKARREPPSRWKSIDRSQEDFLSRSSQAGVVNNSALETPEASLPRRPFGGLLTVDTGVPRSGLGIPAHLRRRGSEGSIPSPNPALLDNPDRSAGLTPLTPTAWYLGRTPFLEAVSTGEGGSSHRRTRSDLSGVLPVGVVAQSPESHMAVLSPLHPGLGGSLESSHSKSRIPIPSTRLHTASVAEDCSRLKIDPLSNNRFDVQVPLPPKGISRLPKPSPKSPPAVADYDRTPIGMTSPRRREMTYGRGSRRGTERNTLLEAYIASPPKKSPPLRSSRPRQPVSQTNSTTSRSRVVETVSNLQRQLNRDQDLRSSRTRGRRLPELGNVDFATRRQRIQQAFNRTVQENERKEEEAAQLQLRAKAQESQRAHDEPTGSEQNPQGDTGIDRSLPADCNSDVNEISTGADHEE

SEQ ID NO: 41218 - protein, 894 aa, A.fumigatus
RLTLDDGGSSQEPPRLQIDTNVAVHDTAAKDPNAHPMTMDSPTLGLPNISTGEHAIRISSPGAADGHTACAETPVSVETNITALDPEPQASLSRQSLHASHRTLLSQIMQIRESSPDTSSCDEADYSFSDTEDRVSVPVLLSDAPCSEESVASSDCQIHSDAFVHSDQVGHAILNRWSIGSWSSSLHNQQSTDDHCDGSDDDLSQLQEVAQDGEVTTQSCSASSSNTPSVAGHQPTTYVPANREPVTEHKPDLVSERSAYIHPSAPNLARLGGWDSKRVSRLYIEELARGRGHSLPMPAIRASPEPRLERPTDGRTDSLTDDPVVISKADGIPLSEQVGHTASLIFRDDWEHASPSIADWMQAAATDETGPQQRDSNGISAADSISTTHLDTSATDRTGHEQDQNTMGLAIRVQPPQELESGEIQQISLTSSDPVTHSVTKGAINQSQQKPEAALSIQSIQTPSRFAPSQAFAPLGQVESAGSSEDSSLRRLQPTPSSHTLDSSATSLVPSTADQIRVDIRKCSPSPEQKRLKKRKHVIKELVDTEYSFGRDMKVVDDIYKGTSSSCLDLSPEDVKILFGNSDQIVQFSMSFQDALKEAARSVYVMPKSQRWSSTRSARNNHTNASRTDSEAANGADEVSDAEKDRLTFIGQVFLAHIAPMEKVYADYLKNHDAANKKLQVLQRNPKVAIWLKECREWASDLTTAWDLDSLLEKPVQRILKYPLLLSEIVDSTPSDHPDRPYLINALEEVTNISVRINEMKKRAELVGQVVGRKRKESDVRTGLSKAFGRRTEKLRQQVGLSDIFEDKQYDALSQRFGDSFFQLQVVMRDAEMYTREVQSSLDRFSEFVTAIEGFVDVAQSGYLDVESRWRELKMAVREIMATALPEHVSGADP

SEQ ID NO: 41219 - protein, 211 aa, A.fumigatus
LARRLFLSGRSKSGKCCDGCRRTDESRYLEREFLVQYKTSNIVLLRPSMSFMLLQTPNPLSLREALPDFSRTTHVFLPINDCRNVTEAEGGSHWSLLLISIVDGVAFHYDSLPPGNYWEARAVTQKFGTLLNRPIRFIHLEDSPVQENGSDCGVFVCLSMRHLLLKRLLTANANEKVSMSLGGRKVDARAGRKEIAKIIEGFRKEGERRRS

SEQ ID NO: 41220 - protein, 402 aa, A.fumigatus
ALRLMQDAQLAVVRKSVIDPMVTLLKLYDGPQRVMKKRDKRLMDHARFKSIKDRGDKPDKKTTEQSEQFVALNETLKDELPKLYSLTAKLMEACLKNFVHIQTTWFNILQRRLADLIDPFPDDIQQIIGDWSANFTLAEAQVLSLGMCNGSLLADTINLVNFNTPSTGPTISSPRRPSTVNSTSTRVGSNMGESPKVSHDFGNGGNIFQSPSLDAQSLRSYGRHRADSAISGRAAPESSELPRSQILQQITNSSSASAGPQPKSESFPSLPRLSLDSPFLVDVIATSSNNDEVSENPPTSPGGRYSGFFSSAMPMSDNPQDDAPVEDTTPKKPTVLFLAASIYEFNIDRARREAGYPYLTYVAGEIFDVIAEKGELWLAINQDDPTHQVGWMWNKHFAKLSS

SEQ ID NO: 41221 - protein, 90 aa, A.fumigatus
KTCWDEEAQYLTSYTEREIPSPDIWIHQFSDSHHNTCLTYSSQKEIICEQVSYRMHSTATMQPTLSVSQSFLRVCMSSLVTAIYQVIQSR

SEQ ID NO: 41222 - protein, 135 aa, A.fumigatus
SFTMATTSNMFMYSLTIQPPTAITQAILGQFAGTKEQQIVTASGSKLTIHRPDPTQGKITPIYSQDVFGIIRTLAAFRLAGSSKGMFDILPPRPYRRTNLVIRQASRAARSLSAEPTLLEAGRAPVGVADTGCCL

SEQ ID NO: 41223 - protein, 61 aa, A.fumigatus
IACGGVKTVNRGHGYTGNADSDQNSALMKAFWHDISIILEQYTSRFVAILTSTNGKQRKSR

SEQ ID NO: 41224 - protein, 179 aa, A.fumigatus
HWMLFVNCAERILLLDYIIIGSDSGRITIIEYVPSQNRFNRIHLETFGKSGVRRVVPGQYLAVDPKGRACLIASVEKNKLVYVLNRNSQAELTISSPLEAHKPQTVVFAMTALDVGYENPIFAALEVDYSEADQDPTGRAYEESEKLLVYYELDLGLNHVVRKWAHPVFTPEGWTDPRY

SEQ ID NO: 41225 - protein, 213 aa, A.fumigatus
FLSVAHQLYPLILIPAHTLRIMADDTATTEDSPITFTIKSSNDAKFTLTLPLSTQVSELKQKLSSSEYADTPAERQRLIYSGRVLKDNETLATYKIKDGHTVHLVKSAASNQRQGGATQSTATSAATGTSAAPAAGAVPTNLAAGTGNNPLAGLTGARYAGFAQLPGAGMFGPDGGVSVCYCRLRSFAWFFDRQLTDALDGTSSRRRKHAQHA

SEQ ID NO: 41226 - protein, 317 aa, A.fumigatus
MGPPPDAESMLNMLENPQFQSTINEALQNPAMIDMMIQQNPMLRDMGPGVRQMMQSPEFRRMLTDPSSIRHMLQMQRAFGAGGLGGGSAFPAPGVTNTTPEENRNNQNSNNANAAAAGAPPFNPFAPPALGAGNPFAVLFGGAPPAFGANPSSTSTAAGGDQSQGTQGATGSAAAGSTTTGEGQNQQNFQNPFSFLMNPAMFGATGSQGGQAGFNPFNPQQNPFLRDPALLSQMMQAMGAQGGAAGAGANPLAALLGGAGLGSPPPQDNRPPEERYADQLRQLNDMGFFEFERNVEALRRSGGSVQGAIEYLLSHPS

SEQ ID NO: 41227 - protein, 378 aa, A.fumigatus
AYVPSYFVGYSVTRYNDDEPIPLLVNKIFSDHTQLQYAYFDLPFVCPPSGKSHGGSPFGSGKSVSLNLGEILRGDRIMTSDFELHMGRNVECQKLCTVEVGRKDVKWGRQLIREGYVAEWIADNLPGATSFVTVDRSRKYYATGFKIGDLDFSPGTGKPRYFINNHFIIVIRWRSAPEGGKVVVGFEIYPKSIKASDYEEDGCPKQVHGNHEGLELYIPPNLSRLKEMYPESSYLPKEDDEIDDGAKLKIPYSYSVYFKEEPGIEWSNRWDLYFSNQGESSMTHWLAVLNSLIISGALGVAVYVIWDRTVQGDIKGRGDGAMEDGKIKLRSKSTEKKGEGLLDQGIDVERDADGSSDDETLEDLSGWKLLHGDVFPGA

SEQ ID NO: 41228 - protein, 114 aa, A.fumigatus
NYHWWWQSFLTGGSSAFWVFAYCIWYYFFHLHITGFVSSLLFFSYSFLACAVYGLLTGTVGFLTAYAFIRRIYRYDGPSSILEQADRDTARLRSIDSTYSLQSICRHFLAEISL

SEQ ID NO: 41229 - protein, 93 aa, A.fumigatus
ADGSSFMETFSRVPEYSGLLAPLVGSGMQLFFMVSGLLILSCLGVLNPSFRGGFVSVGMGLFVFAGLFSGYFSGRLYKTFGGVHWRKNTLIVS

SEQ ID NO: 41230 - protein, 177 aa, A.fumigatus
TALFFPGLIFCLIFILNLFVWAQASSTAIPFGTLIGMLALWLLIQVPLVYLGSWYGFVRAKPWEHPTKTNSIARQIPPQPWYLHSFQGAAITGLPPFAVLFIELLFVFKNLWQDKSGYYYVFGFLSTVSTIVIITVSEVTIIATHSQLCAEVKCPPLLCVFMKTNQSRIITGGGRAS

SEQ ID NO: 41231 - protein, 294 aa, A.fumigatus
AFGLIIRTLNNEPLDAPSTAQSKTYPLRLLIPHLLIGSIIGKGGSRIREIQEASGARLNASDSCLPLSSERSLVILGVADSVHIATYYVAVTLVEQLTERFGGPAASAYATRSGGPAGAVPGGMQVVPYVPQPAGGQYGHPEHFKRHHPHPNRAAAGAYGVPYLHGQPAPAPVAQPALHYGAAPHAPYAGAGPHQPAPYGAPQPAQARGAPTPATPVGGVMPGQPLTQQIYIPNDMVGAIIGKGGAKINEIRHLSGSVIKINEPQENSNERLVTITGTQECNQMALYMLYSRLG

SEQ ID NO: 41232 - protein, 200 aa, A.fumigatus
VKPDCTFDKMSASPSALQSTKRPLEDPSSPSGPNDQPEAKRPALDKVVKGDESETYTDAKAEPSAAPSATADGQGDTAVPDAPNGKGASTETQPIQSTASHGERATSQPEQQRPQDESSWIHIRAVISSQEAATVIGKGGENVSQIRRLSGAKCTVSDYSRGAVERILTVSGPQDAVAKVGFLIYPSLFERLLIQSRRLV

SEQ ID NO: 41233 - protein, 178 aa, A.fumigatus
AVKIGRFLNDSCQKISLEDSHAKCQADLLAPYLEPNSKVLSFYTTLNPSPSETETFTTNQVTELATLTFPSSLNPEEHKKLNSDLINLRVALTEKLDEKSRSKSWSMAQVHRPGTFQHPKSPSGEAFVYLLVVGWESVDAHMAARETKEFEESIKPIREKMLPALEGLGMKHVSFKKI

SEQ ID NO: 41234 - protein, 87 aa, A.fumigatus
SQAIDSLTDLTLEKVNNTTMDISQETVDKIRRFAQKRQKAEEFYEEHSVNPANFDAYNRKLDETLAELQAQVKRHEDELRKVRQQVA

SEQ ID NO: 41235 - protein, 342 aa, A.fumigatus
VVPFFFFFFFFLSLVATDKLTIQNSIRHNLSLNKAFQKVPRRTDEPGKGMKWQIAAEYREEYWKTQLRKGTTQSSAPSSPATKEPVSRSANNHSENVFNGKKSPAVSSPGFSSFPVAPVEAYTPERGSRVARGVDHPLRNTNPRDYEEPSPLPTHSATKNHGTGSALTRAYGLSDNVVNSPPVLSSSYYDDGPSSMITPAPQRQQPRLPPPSTAQVPSKFMPMSSPAQFWKFADIGSTPARPVPDMSPLKGEVGDGIGSFPSSSPPPPNLVSPSKPGTSNGLGHGRTLPPLRTEPNLGETRPGVNGAAKSERPMAPAGPDADDDDEEEGGFDLARFVPLLLI

SEQ ID NO: 41236 - protein, 68 aa, A.fumigatus
GAGGANGGLELIIIIISIGIIVVNNYQFDVSQVGDYPSKSTSQEQCILMIISRKLNVLTVQRKVMDLS

SEQ ID NO: 41237 - protein, 374 aa, A.fumigatus
MLTLLPQVDHHPSPPARPAKAQESADEADDSSPENELSANQDLVDLVISCLNVAREEVRVGRDHSNQKTENTQSIRAYAKIAGRNWTYYVKTLHVNIGREPDREPKLDEQSSPVTIAARALPDVHVDLGPSKFVSRLHAEIFYDGGETLSWHIRVNGRNGVRLNNVILKRGTDAIISCGDIIEIANTQMMFVTPGDKANIHPSFVARAQRIANGEEELLSWDPTQHSHPQPSQSSAVMNDQTSATASAGASGQPSLAPAPQFLKRQVTPPPRSPDTVGPRTAKQSPLYNRGMMMESTEEIDYSKDSAKDLKPPYSYATLIAQAIFSSEEEKLTLNSIYNWIMDKYAFYRHSQSGWQVGRPFFFFFFFFSVAGRN

SEQ ID NO: 41238 - protein, 455 aa, A.fumigatus
PTDSSTGGSFGRESGICELPGLHSYSCLLMKKCRRYYVHVPPHLRPRPLLLVPAAQVRKFIQEINRELEATLSIPEEREMGLLLDFNLDGVPQPTFIGQCTSREMKDELESTIPPRTNYEPPSEMDGSRLAYEQMIGHGIDASKSKSRSKASKAKKQIRLQAGIKSVQALRKMRCYLGLQPCHSLDLPKLIDERSWEEKGNDDCRMAQRLDETSDTGIPRLDLNNPTMFPFWQEPILISVDVECNERCPGQVTEVGISTLDTMELVDTLPGEDAENWTSQIRSRHLRVREYGHIVNRQYVTGCPGSFEFGESEWVSKGKLADVVQACFQPPYSFGVEDMDGVQVGSGPEHKHQKRSLILVGHNTAMDVKYLASLGIPVFEDVTAAFVERIDTAELYRAIRGEFNQHSLASILGELGIIGWNLHNAGNDARYTLEALVRMICRDTGEASAAASMVG

SEQ ID NO: 41239 - protein, 61 aa, A.fumigatus
VDDSFMTGRLTFSKIMSHSKLISGSLSGSIYLIISGFRNISLVFAALLRTPSGFTEMNTFG

SEQ ID NO: 41240 - protein, 786 aa, A.fumigatus
RRLCSSSHSESDLESFLLQVSIMATSDLVDHSPRHPTKAAQLASASNVILIDNYDSFTWNVYQYLVLEGATVAVFRNDEITLEELIAKKPTQLVISPGPGHPETDAGISNAAIKYFGGKIPVFGVCMGQQCMITSFGGKVDVFGEILHGKTSILKHDGKGVYEGLPPAVEVTRYHSLAGTHATIPDCLEVTSTVPLNDGSGKDVIMGIRHKQYAVEGVQFHPESILTEHGRTMFRNFLKLTAGTWEANGKSSSGSATVNGSAPKVDKKTSILNKIYDHRRAAVAVQKLIPSQRPEDLQAAYDLNLAPPQISFPCRLRQSPYSLSLMAEIKRASPSKGMIAETACAPAQARQYAKAGASVISVLTEPEWFKGSIDDLRAVRQSLEGLPNRPAVLRKEFIFDEYQILEARLAGADTVLLIVKMLSVELLTRLYNYSRSLGMEPLVEVNTPEEMKIAVELGAEVVGVNNRDLTSFEVDLGTTSRLMDLVPESTIVCALSGISGPKDVEAYKNDGVKAILVGEALMRAPNTSAFVAELLGGNSENNSKPAPSSRLVKICGTRSEEGARAAIEAGADLVGIILVEGRKRCVSDDVALRIAQVVKSTQRPTVEPDSTSPANTFSSDFFDHSTRVLRHPTRALLVGVFQNQPLAYILDKQQKLGLDVVQLHGSEPIEWASLIPVPVIRKFALDESGIARRAYHSLPLLDSGAGGSGELLDQSHVQKVLDGDDGLRVILAGGLDTSNVVDTIRKLGDSGHKVVGVDVSSGVESDGSQDPAKIRAFVQAVKAYEA

SEQ ID NO: 41241 - protein, 1053 aa, A.fumigatus
  UNSURE (821): Identity of amino acid sequences at the above locations are unknown.
LLKPCQNPLEILLPLQAFVALTTLAFMKLPLAMPSIINKSTPTSPSQSPYFLSKGEIGQLNEIFVTAGLESKTANPAAFSWGLLLHTLRELALSDKEIRELEQFHSAVDSFQSNTPHSNSGQASELSLYEELLECARSPTCTAEDSIALLTSDAMKDTMFETIVALATNVGSTSAVDDILTERWTRVVLLDLIRVVRIYVEYSPEIVGSVLAILEGPPTKLLCSSQSLSVATDPRWIFMNDDFLMDELFHLARSRFPYETVPFLKLCRALISKDMVNEEGIPQILSEMENMDTFTQIVPLEFQGYKTIREDENANLVTLTQPLAIFESSTARQIMDHDPSNALVVTSSSHVPSSTLGQVISEAKPAVIMWYHEYSCLSYLGSYLEEWNENGGFSSGVEEDNVAEIIGLMADLLVAAWVQPTPNEASSGAKRILEVASDGLARKSDIISLVFDIFERILHNIGPRAGLDSKVESVIACLRFIRALTMVLPGRVWPLLARSSLLGSDGKGGVMTAIVSATEVTSGDYPFLLECVKLFQDVVDDAASRAMVRKCPNNLSGKMTAASEWTSGVPTHIMRGILLNFVRTMVEVFNSNIDWRFNAPEQRLEINTTLAKTFERMIYYTYGTNDATKLDSKVTGVFSSSATYLLDVLRPQSRADLPFNPILRLIVDGLQTPATLHLRYLVLMEKQVRSTLELTTRLLEAARYLEQPTSLLEDQLFKASPVLVKLYSLLDAYRLPVILLFEILISGAALDSANEPPSLVGHLGAESSCLFLDVLSQFDKPLSDQKLQLAVWHFLSTIVSKRQQWLAVYILTGSSARQTMXQTDTKGGPTMRGTPFLQIALGMLSNIEHMDLRAALSLLEFVSCAQENWPWATPELRKTPQFFSSLVNYVSKLKIPSLPVQDQIFATRIAAVVADLCAVYLHSAKDMQDRTFYKTLIPLVFWYSKDAVDVSAYNTSLHANLKRNFEMRYSGCKLADFRRTSLQPRSLGRDYYYDIQLGDKLLSYDFAWSGTKNQGFAEEFERANINLSLVEAQVVRTVANFHLTNETILIIFV

SEQ ID NO: 41242 - protein, 62 aa, A.fumigatus
CGVRLDSRALGRLHHLSNAQSDIVGYTSFTTFHEDNANQICTSLDSSACTLFRPSSTDLDQP

SEQ ID NO: 41243 - protein, 732 aa, A.fumigatus
SIVANSAYKVDNMVGVKRPVDAGDERNGKRTKTKTVSATTKKSKAAPVKKSAPQKSSKKDVKSGKKDKKSKRKVEEEEDFDDDDEDDFDIDDIADSEDDEDEDVEMGSSASDDDEDGDIQQEKKQNTKDSVASTKAEPLKSMVTPWNFIFVLNHLANNTLFLDTNSSREAHAKQKTLLQERKAAKPNADIIARSKQLWERLRRKSHVPLEERKKLIAELFEIINGRVRDFVFKHDAVRVIQTALKYANIDQRKQIAHELKGHYNELAQSRYAKFLVGKLLVHGDTEVRDLIIPEFYGHVKRLIRHPEGSWILDDIYRTVATKQQKATLLREWYGPEFSIFKDEQASADLSEILEKNPEKRLPIMHFLHEMINQLVQKRTTGFTMLHDAMLQYFLNTKPGSSEANEFIELLKGDEEGDLLKNLAFTKSGSRVMCLSLAYSNAKDRKLLTRAYRDTIKMMAADLHGHMVLLAAYEVIDDTKLTSKLIFPELLNQGMEEEARNEELLYQVNDLTARIPILFPFAGDRVKWLVPEVDQEVLKEIREIRKETSKKEPAVRRRELVKAASPTLLSFIAARAESLLETSFGCQFIAEVLFDAHGDKMPALSAVASAAKVKSDMKDSPFFGRLLKSLVQGGRFNPAEKVVEKVQPPLNFHALLYEQIKDEIMTWATGPNTFVVVALTESDEFAKKDELLKTLKKGKKALEQAAAESGKDEKKKKAGPTSSGAKLLLEKIR

SEQ ID NO: 41244 - protein, 427 aa, A.fumigatus
  UNSURE (424),(425),(426): Identity of amino acid sequences at the above locations are unknown.
CQLLRRRDQMTSCHRPSWKVKRSAFSKMPRKSSRYDIPLATICPALTWLQLMEGNLSRARSSIRMSPSLSPAPSPAPGTQPLGLGQPVGGLYQSISRADRRVSALRARSTYTSAQDSANNRHSRVYSETNLPLTASTEPPTTGPSLSRSMSAMGSSTSSNFHNDERSFHYDTTRPYLTHRASVLPTPPPSGSIRRAHSANQSGDNSETPKGLGITTPNVESDNKHKYEKFNSEHPPHDPPSRAQSQLQVRDLQDQMKGLHIKISSLKVKAQEGSLRRRSLQSLRTPSPFTEGDQWYPSALELKNSNGSLRSNPGRGHPADAQESHHHQERQEPETVRNGFAYDQRNHRTEQPETKLQRKPSVASHAVSLNESLYEDAEEGGYDMDGSAGSDIDREALEEILREPLDDEDLGLHHGAGRISGGLXXXP

SEQ ID NO: 41245 - protein, 64 aa, A.fumigatus
VILRCSASKSCTNYICPEFGYGLIKHSSASPTWCWTRLWPSIASGMTMILAPCIHSKSISVSRL

SEQ ID NO: 41246 - protein, 60 aa, A.fumigatus
TQVPAIIDALLLFARLLVKVGCRHLVCINNVLHAIVPTDLELHAAKVYHGLYNQQALILL

SEQ ID NO: 41247 - protein, 199 aa, A.fumigatus
LHRVTCQPCGEDTDNRAIGVSVTKEALVNDSILNPDDAYRCLINLNINLQNRLYTDKFEWSLLHPPGMAEEFAQVTCADLGLGGEWVGAIAHGIYEAVLKLKKEVCESGGMISGMGGYGNEIDNQAANGTEAGWRYDPEGLGDEWEPKVETLSKEEIEKREGDRERQIRRLRRETARFSSTARHHTRYVAAGQWLFRRR

SEQ ID NO: 41248 - protein, 133 aa, A.fumigatus
RYGITSKFSTLPGFEADDCTNDCTYSPESKTYNLSQTLEGHSDWVRDVAWSPSILSKSYIASASQDKTVRIWTSDASNPGQWTSQQLEFDTVLWRVSWSPSGNILAVSGGDNKVSLWKENLKGQWEKVKDIEE

SEQ ID NO: 41249 - protein, 73 aa, A.fumigatus
VWHDISHEPSKRQDSGAYYFDFTISSLIIFTSISCWPRCLKHCPSSWNQASFGRICLKTIYFYSCILQENHFT

SEQ ID NO: 41250 - protein, 145 aa, A.fumigatus
YVVYSPFQAHPKFGTILASSSYDGKVLIWREQHQNATSPVAGSTWTKVFDFSLHTASVNMVSWAPHESGCLLACASSDGHVSVLEFRDNSWTHQIFHAHGMGVNSISWAPAASPGSLISSNPGPGQQRRFVTGGSDNLLKIWDYK

SEQ ID NO: 41251 - protein, 280 aa, A.fumigatus
NIKVLMPRQRRRHDFLVKLGKTFEKQANAGVDRFRAANEASVIAEVQAKEIQDEKERKKDMQRKRRRENTVRLEMQKKLEAERKANKANDAAEKAKFLREAERAQRKIKSTKRALEGVTSPEEIGEVTPLAPNLEGGTTSSFHIGRSSPSRRKSGRSGTSRPKKSKEQKQAEKDAAEAAYAAMENDEPLPLAPKEDPRKETLKKEAKGARSKETTPAPVSAFESKGYNQIYEQIWRDIARKDIPKVYRIKTLSLSTRQENLRKTAQLASKQSRKWQERTK

SEQ ID NO: 41252 - protein, 83 aa, A.fumigatus
PSTGSSRAAPSKSESASEPCRKKRCSALSSPAVRPAGVDFNTRYRESRTKDIAMWLADDEQAELIEQYEKEALHRGEVFGAGK

SEQ ID NO: 41253 - protein, 168 aa, A.fumigatus
FRTLLTSYLFWLVMPSLPRRPRTSCWRSTESTSRRLTTRPCLGGRSACASPPLRDTSRNTATTWFTPSRRSGTIWVSSAPVTGQPRVDLSVWVSKAPRSRTSPSGRTHSSAWSSTSLWSRPSSVSSSRRLACKPPLPSILLRPLLPPSPLAWLLKTGRCLTIRYCLHI

SEQ ID NO: 41254 - protein, 239 aa, A.fumigatus
LKFRRRKFRTKRNARRTCSGSGGVRIRCVWKCRRSLKRSARQIRPTMLPRRPNSSAKRKGPRERSNRPSELSKVSHRRRKSERSRRLLLIWKEALPAHSTSVAAPHRGASLDARGPHGRRNPRSRSRPRRMRPKLLMLPWRMMSPCLSLPRKIRERRPSRKKPRVHVPKKPRLRPCPHSNRRVTTKYMNRSGGILPGKTSPRSIASRPFLSVRVKKTCGRQLSLPASSLANGKSVRNRV

SEQ ID NO: 41255 - protein, 106 aa, A.fumigatus
ETGDRVAQEGRKQSVKPFVRSGSWIFLISQTELYSHFIGRKIKGAGTKSSGDTAVDGSDETIQPGKADHTIDLPPTVADVGAKVTNSEDLDFDAEDETALRQGSLG

SEQ ID NO: 41256 - protein, 874 aa, A.fumigatus
SRRLNCILTSLVERLKAPEQNLLGIPLSTAPMRLSSLARPTTPLICRLPSPTWAPKSPILRTWISTRKMRRLCGKAALANAQNAVKEAQERARAFNAEENPMAALDEGELNFQNPTSLGDIEISQPKMLTAKLKEYQLKGLNWLVNLYEQGINGILADEMGLGKTIQSISVMAYLAEVHNIWGPFLVIAPASTLHNWQQEITKFVPDIKVLPYWGSAKDRKVLRKFWDRKHITYTKESEFHVLVTSYQLVVLDSQYFQKVKWQYMILDEAQAIKSSQSSRWKNLLGFHCRNRLLLTGTPIQNNMQELWALLHFIMPTLFDSHDEFSEWFSKDIESHAQSNTKLNEDQLRRLHMILKPFMLRRVKKHVQQELGDKVEKDVFCDLTYRQRAYYTNLRNRVSIMDLIEKAAVGDEADSTTLMNLVMQFRKVCNHPDLFERAETKSPFSVGYFAETASFVREGQNVDVRYSTRNLIEYNLPRLLCSPSGRIDMAGPGNEHAGFRGKYLQHLMNIFTPENIKRSIDEDGAFSFLRFADTSINEAYEQSHLGVFERAVRRRGQSNRLSHLNVIYDDEEDEQTSKFVLPHSLFNIVQRNDRQAVRNVTVEGYMRDLMNVSEATFERDGLGVIEPSASPAASAPPITISCSGQVALRETQDTFFNVSVRHALFSTPSRQMEQQILEKKLDPAPFSLPPMLPKPISTKGRYTHIEVPSMRRFVTDSGKLAKLDELLRELKAGGHRVLLYFQMTRMIDLMEEYLTYRNYKYCRLDGSTKLEDRRDTVADFQQRPEIFVFLLSTRAGGLGINLTAADTVIFYDSDWNPTIDSQAMDRAHRLGQTRQVTVYRLITRGTIEERIRKRALQKEEVQRVVISGGAAGRS

SEQ ID NO: 41257 - protein, 191 aa, A.fumigatus
ESHKIPLYYIAFVFLFSHFPPSPFPIRLFSPLVSKLLSPISQHHQTNSCLDESLCSLAAVTMESLLQQSRAMCPFLKRTSPTALRTLATATRPSMSPGGGTMSNLQVIARRCPVMSKALAVQSARMAGAKRFTSTAAGVPGMSSKHFRPAQTRRALHSTGGNGANLSPDLYKNTDRRAYCSQPMDWRYIAN

SEQ ID NO: 41258 - protein, 526 aa, A.fumigatus
TVQPTFGTGKGKTPRATSPSTVAGPRPEVPAPAPFDYNAFYLGELEKKHKDKSYRYFNNINRLAKEFPRAHTASMEERVTVWCSNDYLGMGRNPEVLATMHETLDTYGAGAGGTRNISGHNKHAVALENTLANLHGKEAALVFSSCYVANDATLATLGSKMPDCVILSDSLNHASMIQGIRHSGAKKMVFKHNDLVDLEQKLASLPLHVPKIIAFESVYSMCGSIAPIEAICDLADKYGAITFLDEVHAVGMYGPHGAGVAEHLDYEIYASQDTPNPRSTKGTVMDRVDIITGTLGKAYGCVGGYIAGSAAMVDTIRSLAPGFIFTTSLPPATMAGANTAILYQARHKGDRVLQQLHTRAVKKALKELDIPVIPNPSHIVPLLVGDAELAKKASDKLLEEHGIYVQAINYPTVPRGEERLRITPTPGHVKEHRDHLVHAVQAVWNDLGIKRTSDWAAQGGFVGVGVEGAEEQNQPIWKDAQLGLVEYESLEQAVEREFQQAPRMQTATPIHPAAAPAASIPVGVAA

SEQ ID NO: 41259 - protein, 226 aa, A.fumigatus
  UNSURE (159): Identity of amino acid sequences at the above locations are unknown.
TSPPRRPPCRRRCKPISLSRKPTWTQRTLPTYTRSTCSSPTGWSPSASSPASRSGPTPSPPASPWPRPRATSPAASRRSSSPATPPTSRSSASSSSCSSSPAPYAPVETPNRPLDQAASASRIARECEASYPRPRATPPRPASSNSRIQANPTPALSRXPSSTPSAANSPRRALTSPRTTLPSCTPPSARSRCIFPRSPPRTAAPAPWAATRPTSWPPTPPICATT

SEQ ID NO: 41260 - protein, 152 aa, A.fumigatus
RVLKSTPAGRTAGDDNALHLFFLQGSLADSLFDGAARDEPVDGHLSGLAETMRSIHSLRVNSRVPIRIVENDRVGCSQVDTQTTGTGRQEEHKDLGPLLEIGHGVTTVLEFRASVQAAVLVVAVREILFHQINHACHLEVQKHTVTACLELT

SEQ ID NO: 41261 - protein, 127 aa, A.fumigatus
DIASKAAAVQAQVQANKPIPQANLDATHPADVYPIDVLVPNGLVTLRQLPGVKEWADTVSAGLPVATTSRYVSRRVEAVVKSGNTTHLQILRFILLLLEFARSLRSGRDPKSSAGPGSKRLPHSEGV

SEQ ID NO: 41262 - protein, 160 aa, A.fumigatus
  UNSURE (32): Identity of amino acid sequences at the above locations are unknown.
GILSSASGNPASTSKQQQQNTSQSDAGTLPDXVIDALRRKFAPQGSHLTKNDLTFLHTTICALSLHIPPQPAKDGGASSLGGNSPNELATDPADLRDDLRLESATILQYFRELGCRVDKPRESEFAKWNIKGGKAEAAARRIARLKIPVEFPKVSRGGRR

SEQ ID NO: 41263 - protein, 68 aa, A.fumigatus
IGRQRKLAQKELLLIGNDSATTKFLVFRKERSQYYVRYKPAKILTLDISDVSVGQMRTISVGIVPQTH

SEQ ID NO: 41264 - protein, 383 aa, A.fumigatus
  UNSURE (101),(129): Identity of amino acid sequences at the above locations are unknown.
VYKSATVDVNLLHFAPSTQAGTTTGVPMDPATEKLYVSAENARTFVQSVLTGNGVSPENATIIADCLVRADLRGVDTHGINRIPSYMERIRQGVLDAKATXVVNQVTPVVAQVDGQNGFGFIAAHLGMXRAIEMAREFGIGFVSVKHSNHFGMSAWVVQQALDAGMMSLVFTNSSPALPVWGGREKLMGVSPLASGAPAGKEKPFILDMAPSIAARGKIYKAARRGEKIPSDWALDGEGRPTDDPHKALEGVMLPMGGPKGSALAVMMDVFSGVLSGSAFAGHVTNPYDPSTPADVGHFLVAIKPDLFMGLEEFKERMDYLYQRVVGSEKMAGVDRIYFPGEIEQITHEERLKTGIPYVQAEIDALNREAEKVGAERIVIDRK

SEQ ID NO: 41265 - protein, 306 aa, A.fumigatus
SRLSSTVDVRTKHHDTYHYCSTTIKMTTDYSKKTNAELVEILKSRSLPHTGKKAEMVARLQEDDQNKAKAATAPAPAPAAKTDAADDVIDWEDDDVPAADTTAVKPSTEAGAAAIAAGGKGAVANPVAVPNQKVDTDPATTNDLKVESKGAAPSAESGAQGHEGTEGAPVEAAPAAPAEKKPAPDYSMGLPITEMEEELKKRKARAEKFGITEESKAAIAEAEKQLERAKRFGTVVHPTPAGGVKGLDEALPTEKSRKRGRGDNDQASRGGKRRDIGGRGKFRGKRRGNRNQNQRNEGTLGNQRPR

SEQ ID NO: 41266 - protein, 1139 aa, A.fumigatus
  UNSURE (775): Identity of amino acid sequences at the above locations are unknown.
RYITLYLICGLLIAANMSDGGFLPPLTDDAVLIASAADFEAVRKLQAERNAATAGKKGSRTFDSSSQRTDNSTKASLTETFDTTLYDREGPDKYAGYNTSIAVDGDEEMEDEDGGHRLVGQYTATRDQIDELAHGNGVEEEDIITGREKAARIADRETDYQKRRFNRGPLTPTRADPFAANTHANVETDGQTYREIMALRELEKEEERVQKLIAEKQARGEIGVTEHEATLKSEDKDNADAGSTVSVATGRKRKQRWDVSNEPTEAVPEAPQPSETKTKRSRWDQTPAPAVPGTTGEAPKRRSRWDQAPAITAATPVGNQGLATPMHPSQVGVPMIPTSFGTDISGRNAPLSDEELDMMLPSEGYKILEPPPGYAPIRTPARKLMATPAPVPAAGGVGGFMMQEPESARALGKQLPTEIPGVGDLQFFKPEDMAYFGKLMEGGDESTMSVEELKERKIMRLLLKVKNGTPPMRKTALRQLTDNARQFGAGPLFNQILPLLMEKSLEDQERHLLVKVIDRVLYKLDDLVRPYVHKILVVIEPLLIDQDYYARVEGREIISNLAKAAGLATMISTMRPDIDHVDEYVRNTTARAFAVVASALGIPALLPFLRAVCRSKKSWQARHTGVKIVQQIPILMGCAILPHLKGLVDCIADNLSDEQAKVRTVTALAVAALAEAANPYGIESFDEILNPLWTGARKQRGKGLAAFLKAVGYIIPLMDEEYANYYTSQIMEILLREFSSPDEEMKKVVLKVVSQCASTDGVTASYLKELVLNDXFKSFWVRRMALDRRNYRQVVDTTVDLGQKVGVGEILERVVNNLKDESEPYRKMTVETVEKLIAALGAADISERLEERLIDGVLYAFQEQSIEDIVILNGFGTVVNALGTRCKPYLPQIVSTILWRLNNKSATVRQQAADLISRIAMVMKQCGEDALMGKLGIVLYEYLGEEYPEVLGSILGALRSIVTVVGINQMQPPIRDLLPRLTPILRNRHEKVQENTIDLVGRIADRGPESVNAREWMRICFELLDMLKAHKKGIRRAANNTFGFIAKAIGPQDVLATLLNNLRVQERQSRVCTAVAIGIVAETCAPFTVLPALMNEYRVPELNVQNGVLKAMSFLFEYIGEMAKDYVYAVIPVLETRQE

SEQ ID NO: 41267 - protein, 136 aa, A.fumigatus
SGAGFFSAGAAGAASTGAPSVPSCPCAPLSADGAAPFDSTFRSFVVAGSVSTFWFGTATGLATAPLPPAAMAAAPASVEGFTAVVSAAGTSSSSQSMTSSAASVFAAGAGAGAVAALALFWSSSWRRATISAFLPV

SEQ ID NO: 41268 - protein, 69 aa, A.fumigatus
ILPRAAIEGAISKINGFSFPAGAPLAKGDTPINFSLPPQTGNAGDEFVKTRLIIPASSACCTTHADIPK

SEQ ID NO: 41269 - protein, 328 aa, A.fumigatus
ILEVCYKCGVKVVTIYAFSIENFKRSKFEVDALMDMAKVKLQQMAQHGDLLDRYGAKVRVLGRLDLLKPDVLDAVNRAVEMTSRNGERVLNICFPYTSRDEITGAIRDTVADYSKPLQSIRSNSSARTPFSEAQIALKIRAQAQSAKVEQDTISDNESTSVSSIPEEDPSDRSEGPDRVYEAGSGFSSSTTLHLGGHQDAANGKAPELGNASESGKIVFPSPDTITRQTLTDHMLTKGNPPLDLLVRTSGVERLSDFMLWQCDEDTEIVFLDVLWPEFDLWHFLPVLLSWQRRISKSKKNPRLKETLMVTSVKVLMPNSIPVGNVKGL

SEQ ID NO: 41270 - protein, 111 aa, A.fumigatus
FVACRTLESAQKLCQGFPNTKAIALDVNDAAALDKAFEQADLAISLIPYTFHALVIKSAIRTKKHVVTTSYVSPAMMELDEECKKAGITVMNEIGLDPVCSASTLRINVGI

SEQ ID NO: 41271 - protein, 191 aa, A.fumigatus
LLPLPRAVPDPRGPDRHPWYSALPGLPRDDQGAGGHWFPQRRGQGLPQLPHPLERGHAEDSRSHLIGREGPGVGHCLQDHLHGQRLGATASSPAFVGSPIIRTSRSPPAVTPWTLFAPLSSARCSTAPASGTWSCCSTSSVSSTRTAPRRLEPAPLLSTVIPTVTPPWPRPSVSPAELRSSWSSMAPSARR

SEQ ID NO: 41272 - protein, 102 aa, A.fumigatus
STMATSMHLSKLRNWFLASPPAEFIIAKLRELLIGALKQGPVPQHIAFVMDGNRRFARSHGIETVEGHNLGFEALARVSRPFSKICLLLQKHPPGSWLFVWY

SEQ ID NO: 41273 - protein, 207 aa, A.fumigatus
GIDHLYAVKTISEVHAEGGKITSFLSYCGGLPAPECSDNPLGYKFSWSSRGVLLALRNAAKFYQDGKEFSVAGPDLMATAKPYYIYPGYAFVAYPNRDSCPYRERYQIPEAQTVIRGTLRYQGFPEMIKVLVDIGFLSDEAKDFLNSPIPWKEATQKILGATSSDEKDLEWAIASKTTFTDKDWGQPRHLRHSLDRLLFGRADHPPR

SEQ ID NO: 41274 - protein, 135 aa, A.fumigatus
VRSSDSAFRASTTCTLSRPSPRYTPRVVRSLLSSPTVVVSLPPSAPTTRWVTSFRGPAAVFFLPFATPPNFTRTARSSAWLGPTSWLPPSPITSTPGTPSSPTPTVTPAPTASGTRSPRPRPSSVVLCATRASPR

SEQ ID NO: 41275 - protein, 170 aa, A.fumigatus
SRCWWTLVSSATRPRTSSTPPSPGKRPRRRFSEPPHRTRRTWSGPLPPRPPSRTKIGGNRVISGIRWIAYYSDEQITPRGNPLDTFCATLERKMQYGPGERDMVMLQHKFGIEHKDGSKETRTSTLVEYGDPNGYSAMAKTVGVPCGVAVKLVIDGTISQKVSHQHSFPC

SEQ ID NO: 41276 - protein, 80 aa, A.fumigatus
QNIIMVLHNPNNWHWVNKDASAWAKTYLKEKLRTLSAEEDGVSVKISDLLTMDGDVDVSQRKGKVITLFDVKLQLEYEGS

SEQ ID NO: 41277 - protein, 277 aa, A.fumigatus
FEIENYSDSASKQPVKDLVRSKLVPQIRQELGKLAPALIAEHGKDIQHAPGVDPSSGFATPPSYPQTSKGASPAPQTTTTTTTTNKVAVNTTTVTASDEFRTTAEEMYTTFTDPQRIAAFTRGAPRQFDGAQVGGKFSIFDGNVNGEFVKLDKPKQIVQKWRLAQWPEGHFSTLEINFDQNDVDAVTQMRVTWTGVPVGQEDVTKQNWDVYYVRSIKQTFGYVILPCSSIQLLPYHVPLRSRPTSWRQLLIALFVLFIAIGLALFSDRIHGVLETTY

SEQ ID NO: 41278 - protein, 76 aa, A.fumigatus
AEGRKRGRTEGREKTQSSSWTFSVADDTGQAQIQKIKDRRAAKEEKERYEKMAEKMHRKRVERLKRREKRNKLLHS

SEQ ID NO: 41279 - protein, 287 aa, A.fumigatus
AAGMAGKVIEYPFDTVKVRLQSQPSHIPLRYQGPLDCFRQSIQADGLRGLYRGISAPLAGAAIENSCLFFSYRIIQDILRATCYPTADSMPFSALLFSGAASGSITSLALTPIELIKCKMQVPLEASSSKMPGPLTLIAAIFRQDGILGFWRGQMGTLIRETGGGAAWFGGYEGVSAFFRKYHSTVSPRDSESLPIYQQMIAGAAAGISYNFLFYPADTVKSRMQTEDINSPGNSGHRQTFWSVGRALWKQQGLRALYRGCGITCARSAPSSAFIFTIYEGLRNCFS

SEQ ID NO: 41280 - protein, 71 aa, A.fumigatus
AGPYSKFRVGACVLTKAGEYIAGANIENVAYPVGTCAERVAFGTAIVSTSYDVSLSTWLVRVNAYGWPETS

SEQ ID NO: 41281 - protein, 154 aa, A.fumigatus
RLSPITSSEWPTEILGVEALSSNLSELSVSVRERAAKDAAKKEAKAAAAEARDAERKAAAKVQIKRVERNKRKHVTVITGLEVHGLENKKVAKELGKKFATGSSVTKSPAGVEEITVQGDVSEDVKEWLLELYGKEIPESNIELVEDKKKKTSG

SEQ ID NO: 41282 - protein, 63 aa, A.fumigatus
ITPAMPASLMLGSYEFYSSALCDICPRHDSTVLSASRRWTTCVAAPYSPALVNDSAFVNFKIY

SEQ ID NO: 41283 - protein, 102 aa, A.fumigatus
ATDPGPTMSRPLPAVFRPILGRRNFSVSANKRAINKVCASAQEAIKDMKGSSTVLCGGFGFSGVANTLINAVRDRPDIKDLTVVSNNAGMPGAGLGMLSAIR

SEQ ID NO: 41284 - protein, 81 aa, A.fumigatus
HLSGQLLESGQITKMIASFIGENKVFEKMYLNGDLALELTPQGTIAEKCAAGAAGIPAFYTPAAYGTIGRLDRDLRLQIRS

SEQ ID NO: 41285 - protein, 71 aa, A.fumigatus
EPSIKDAGIAGVIYNYIVPQSDMQSQLLAREIGVHKTLFNIHEDITHYVKDVRELSDAPFPRVLQEPRVVE

SEQ ID NO: 41286 - protein, 68 aa, A.fumigatus
RYGLSKTYRIKHSLNAGEYISTSHIVISAHINKSLAINQASSLPPVVAPSLVPDVKDVDRTRVEIVIP

SEQ ID NO: 41287 - protein, 113 aa, A.fumigatus
VRSGFTASNSQLTIAVQTGELPVRYNKDGTVKEYSKPKEVRQFNGKNYLLEESIFGDYALIRVHKADKLGNCQFRKAMNNFNEAMAKNAKYTIVEADHIVVFTTGLEGSAMVK

SEQ ID NO: 41288 - protein, 133 aa, A.fumigatus
  UNSURE (1): Identity of amino acid sequences at the above locations are unknown.
XVHAMLRSFSGAGKCKCRIPVSRQPVCGRSLRISSTLTPWNQSRRAASTVTSLDSFPNVGEKLHGFTVQEKKHVPELHLTAVRLKHDKTDADYLHVAREDKNNVFGIGFKTNPPDATGVPHILEHTTLCGSEK

SEQ ID NO: 41289 - protein, 92 aa, A.fumigatus
NRILTLLVADLRLIQTQLNTLKRSDPSTLSIHGVLAERLQSGIQSMHTPPDNGPDFAFPAPNMDYSWTIFDQQIMNLANPPWLFDDSSQAPP

SEQ ID NO: 41290 - protein, 1013 aa, A.fumigatus
STTRQTQITFMSLGRIRTMSLVLGLRRTPQMRLVYHIFWSTPRCVEVKSEKASVRLLREYKCAFRDGLIADMPPHCRYPIRDPFFKMLPRSLSNFMNAFTSADHTTYPFATTNRQDFQNLLSVYLDATLHPLLKEEDFRQEGWRLGPEDPRSILTQGEQSKGNLQSEDVVFKGVVYNEMKGQISDANYLYYIKYRESICPSLNNSGGDPQYITDLTHQQLVDFSKRNYHPSNAKILTYGDMPLSVHLKQIGEVLDGFEKGQADTDVKLPLDLSRGPLNVTVPGPIDTFASEDKQYKTSTSWYMGDTTDVVETFSVGILSSLLLDGYGSPMYRALIEGGLGSSFTPNTGLDSSGRVPIFSVGLTGVSEADAPKVKSTIKRVFEESLSSGFNDEKVQGFLHQLELALRHKTANFGIGVMEKTLSSWFNGSNPMKELSWNEVIDEFKKKYEQGGYLESLMQKYLMNDNCLTFTMVGTPSYNKDLDDQEMVRKEKKLSELVERHGSVEQAVSALAEEELQLLKIQEEAQNADLSCLPSLRVEDISREKERKPVRESKMDDIDVVWREAPTNGLTYFQALNSFEELPDDLRLLLPLFNDCIMRLGTGDKTMEQWEDLIKLKTGGITTSTLHTSSPAELGKFREGLQFSGYALDNNIPDMLQILTTLVTETDFTSPHAPAMIQELPRMTTNGALDAVAGSGHRYGVNAAAAVCSRSFWVQEQQSGLAQLQDTANIIRDAESSPEVLAELIDKLRLIQSFAISKGSGLRVRMVCEPSSASQNEIVLQKWLAGLPRNRSPTSPLDHTSVNSVANRVLYDLPYKVYYSGLDMQTVPFIDPSSAPLSVLSQLLTHKYLHPEIREKGGAYGAGASNGPIKGFFAFTSYRDPNPVNSLKVFQNSGIFARDRAWSDRELAEAKLGIFQGLDAPMSVDEEGARYFMSGVTHEMDQRWREQVLDVTAKDVNEVAQKFLVEGSRQSICLLGEKKDWADSDDWEVRKLSMNASGEPVIDPLSQDGAVASA

SEQ ID NO: 41291 - protein, 88 aa, A.fumigatus
  UNSURE (8),(15),(66): Identity of amino acid sequences at the above locations are unknown.
YTTFTPSXSFSSSFXRLHRSSASQEQISTPSSILIAMVGKWLVLLASQAWSKRKINKNVNPRGTLXVSVSQTLSELSAYAGRTKNART

SEQ ID NO: 41292 - protein, 120 aa, A.fumigatus
AAAVQSIPERSQSVQGALVYHPSSPDQDSSSILGRLERIESLLGIGKEGNRSSLLTIDPDLEEESDDVSSRGLWKAVERLKIITSPPQDQNIWSYAVVTRLWISYVAHTFVSLVPSRCAN

SEQ ID NO: 41293 - protein, 104 aa, A.fumigatus
GVDTNRHIRTEREVKKATRDLNQLLSNIESPMTRLETVHKKYTELLADMKKLDRDYAKSKKRADQLQKDQDKGKSELNKTVTMKDKLEKLCRELTKENKKVKVG

SEQ ID NO: 41294 - protein, 103 aa, A.fumigatus
PLHYSLRAKIKTIGEKFEMRELHYKALLRSKDAEIQCLTAKYEEQRRAAENEAARCRALSSQVSTFSHTEAELRSQLNIYVEKFKQVCFGVLYQAHHFCYNSR

SEQ ID NO: 41295 - protein, 62 aa, A.fumigatus
LSRLICLRIFLRYVCLYPGIHGQPATNDDEQGKYNVHADVYTKDGKKITCLDAHDIEFKIRP

SEQ ID NO: 41296 - protein, 372 aa, A.fumigatus
  UNSURE (119): Identity of amino acid sequences at the above locations are unknown.
WSAVDELVCMSPTIQGACRGGFTEDESLIGGCWQASFIVHLLACFSASNTFYTFSRKRLYRLFEASIDQPPATPSARRVRVDSNPMAASPLRYFANVIAGSAESRAHPDAQRDVWELAXWDPLPICLRLFCLFSPGHVLVYWVFLPTQLSDPRPSVTIVTTIFITTLLSVQMSFLSSSFTQQAKDSMVVHKEVLNEYDTKFVHPRTQPVMRDVGTQFSDPNTSQPGSDAKYNKVDTFTPTLVIHRGFKTSPNPNYVTFVDPEGASPPTSDIHYAKCFSQLYVAANTLSFTRCLPGCTRPRCVHTPTALPTHTECYGRWWQFGNLLARKFPLEAIYTGQYRPPGSEPSRVLIQRPRYPYEEAIKSLEKEQCAR

SEQ ID NO: 41297 - protein, 557 aa, A.fumigatus
SRPHQSHQQQDNCLLPKEWVTVEGLPGLEVQPVNNRHLRYSMDEVLHLHQGHFMNLSPRRRHDKRKELDVEEVENTHQERNTPDRSGSPMNSRDTDSGTGSPTIARRTRPTKLPLPRELASKVKEQQKDQPATPQDQDYGSLRNVRPKKPPTTLLYSSPDEVREQYWRKVRDKFEKESPSAKSQEKEKDKDKHKEIYYGAYKKIISLASSPKSELVKQRLKSAGGDLRGSPKSRITSPIIHPRLRPGYSSPSKSDNQLISQGKRQLSGVQRKNSDTDESILHFSTDKTDNATDSSINSHSSLSPVSGPSSSLTDWEDKFVVNMPSAKEPNPPTMSAQQIAEFQQSIERVHNDGGAMLDPDSLPSPRTGTPEDKDLSAVQPAKPTSFDGQDLPPPPPHSAGFEESPPSQPEHPRYYCPDEIGKNRISTIWEESASKSEKNVPKVNPDGSFLGCKEINGPNDKNPDEILLFSPVDRPRVVDVSSPMPRSPKERKIPVVRQRNPDLGEKTVAREEWKPGTLNMKLVQCSKPSPRTVCRETSCQQPEKTAQKSSKADRDSP

SEQ ID NO: 41298 - protein, 97 aa, A.fumigatus
VKNGWLILDHSGQTLSINASGNLKERVEEGAYVALEVKYGLITLIKQTADLCEQIKNVDLECPLEKGEMTLTKQVDLPSHIPPVRLPLSWYSWPTSY

SEQ ID NO: 41299 - protein, 112 aa, A.fumigatus
HVTDGPDAQRNFLVVDSKTETSAIEKAFQNFTQERKDIAVLLINQHVRCIAFYITRDQLAHRIRLPNASDTASTPSPTRSPPSSRFRVKTIPTTPKRTVCSSACGGYLVNRR

SEQ ID NO: 41300 - protein, 762 aa, A.fumigatus
VFQRVHSATNLLILSSDARVPAEATPRAVARSILYQLFDKRIGNVQLLQILSVAHERSKKATSEQDYDSLLWNALEAALSVALPGAKELVIVVDGVDEASCSETAMLNQLATATAKGSNVKLITLGALKPPTAAGQAFVQITEELIFDDIAAVVRSQLQQSRVFLGMSELDQETIVGRITEASQGSFLWGKLAAKRVRYEGTEESLHKAVDALLSAKLTLTDFALQLLQGPNVTEDAKNMLVWLITADRPLSFKELELLASIQIDKLTVADRKLDVLQVLKPLNVLVFVQDGQVFIRHGLFRASLLEIFSKGKLVSTVKDHHADLVTRLLIYIRATVTQENELSLVSLDWHDTDRLINRNPLLEFAVRYWVHHVRQTSAFTAKGEVAAAQEFAKVLPASITTLRLESTLWENVPTPTLLLYLTTVTNIYRQMLSANHVVTLQSIIFLALLNQRLEYTSDAIPLFFEAATLSRTLLTSRHIVTMQMARTFIELTQQMTTSTKTEIMVKREEVLLLLVECYKRHYGERSETVVTLLRQLIDHYTLIKEEERVKEIAASITSITTHHGRHGSSSANGGLEIHLNKGIDRSVDIGVGLSLDYEEGDEIIQESESYNVKEWIKKAEIYVAEGKVELAERTYVEIWQRVSREYRTHYSAYWEERKMTTVLAYSKFLVSQKRAFEASSVLTSLWQEYEQASISISETSVSYFQEVAKMMKVVGIYDVALLVYKRCSRYYESINSTHSSTYKEIQENIRTTSKEVVKSFS

SEQ ID NO: 41301 - protein, 944 aa, A.fumigatus
SNSVISETTIEEIFIGGSSSTETVEESSFTALHRSLELYISQHRWQDATRLHKKILRFVWPSLFAPSVQDVTLPEKYVDHCVELAARLSLCYHSRRRLSKEEDIRLRVYRAVRAERKVEDKLRERATAELLRFFEHTSQTEMIINLRQEMLGDYIEAYGAEHERVIKILWVLAELTRPRPIFIEYYQQIIRALNKDSQVCHPEAIEPMVIVATELWNQGRYVDALAYYKVIFNTFLTQPKLDPKFQVQELVQELFERYTRCLRSVHAELTVLHKVTVEYRARCTAVFGVTASITIRATLTLAKLCQESKRFLSEAITLYEELLKIESAELDRDEISVILDGLSEEQAESSSSSTHSERTSKVMRKRITDVRETHGWAHEESLTRMKEMISIYTERKETETVVRELTEATVQILMSETSSTRLIAAASTIASCYIEAGQTQKAVELSHEIYRQIVMKDVVNVESVQFDLSSKERTSLTFLAQLEYSLRRNTSVTVTEILASLTTEYVYFEEFRRLLTSKSSSIQTLTVSAARLYHFLVANGRQVAAARVFNDFLSYFAATEGKRVDLPETSRVKILVITILDHFSTHLSHNFVRSIGIASVHRVTELLKEQRYEAACDLALASFKYLSAHDSYRSPVLVKFAFILGMAIAGRDIVLYPDDAIRKKLLGVSAVIIQDALRVIDGLKIDLSQIGLHQLNNLIGLLGEQQDYQTLAWLLTKLWTSREAQRTWKPYITLALGRRLVLARYLIGDAKTALRLAEDIVYNCRRVHGACHPATLDSSVLLSQLYIGVGLRYQSHKNGQEMANRYYKKSAALHELLLRNFSDPSFAELECGLDNSMSLDGSAYDFDLGEPIGHVPDGESVRRHLYLLKLAVQRLGDWPKDYSEYERLNADLFREFASDLKGVEGVEKWDLKAYGAGKAEGNADILDTEFKGWEFLEGPAPVEG

SEQ ID NO: 41302 - protein, 108 aa, A.fumigatus
PKTVSDPKAIKLWLSPEDRVLGNVAEQSSHLAHDREEMTCLWMAPYLARFLKSPLKTLAIAGKPGAGRTVLASVIVDQLQHTIGGVSYATLFVPISEYSRESILQPTS

SEQ ID NO: 41303 - protein, 82 aa, A.fumigatus
ACHRWDGLRGPRGLKFAKHANLFVKSLSGRLGMGLASCGVCFCLNIILQLNTPSTFINVHTVIQSWLLIHSGISVSTGLPTK

SEQ ID NO: 41304 - protein, 113 aa, A.fumigatus
ILPIAFVYITMAPAGPRVQKPVGSAAWISTEKENFAQLVNQEMEEIEYPVRHEMDWLNEHMAEVFSSNQLCVLIYISIKPSTLADCKIAILLMCSKLLENSGVRHLAQHGSEM

SEQ ID NO: 41305 - protein, 908 aa, A.fumigatus
QPLSEIFTTSHNQGDRSRNVSPARSPVKPTAAPITTTPSEPKVSPAKTRDTAENALQPQYPDLTQNLNSFPQYNTDSGYHGMPDDEGEDQDDDVVLTQVQSETQTSTQPLEDEPVTTIENQNQPQRQSIDRRTTAASFHSAQEDVRQRGETAEPVEKPVQATNNETTSRQEKAASSTPQPEKKQPEAIVVADSASDQEPEAESKSESKPRAEPQTSPTKSSSTKQPAAPVEEEIHEKDDTPLDSLDDIGTPSDNSTPERPPIRKSSLSFASLPAREPLLKKSLGGSRLSRTSHVDIARVNNAAGPSSFGRQTGGHRNTAVDEEPALDDGMDIDEGRRGVQLQDDIEAEADATASKAHTKSSTQRLHEKISMLGKLQPSRPTKSIPSVTGLASAHVAYPELPAASAKSEVLHLESREPAAPEPMTIDEDDWIKLIESPKKAHAPRSPRTEVKINKSTNETSRPYSEKVSLPRAQDRSDAGAARASNRNITESIREKSSTPAYSSPQRPSHQKSASVSNAGHHASTTPVGSPAAERHDGPLSASKLKLQSIMKSAKGLFTNTGSVATAARLEASSPDELGLHSYNSASGNAARETQDRRPVQISSPLPRQEGRRTRSSTEREEKRKQKELEDRHREEEQAEKALIEERQKALQLKIAQERARMEEEERNAPPSAVAAPASSKKAQPLQRHQSREPEPSHEAVSRPPSRMSVSQQQSKQNDRRPVKPTREVLQKPRPQAVSIRVGSALSRQIPLTSTSVASSGPEPSASVAAPPSASKPPTLKKKASNSSLHTASSNSSFKSSVSSQSQRKVQLANERKREQEEREARRREEQRREAERKRAAQQQEELRRQEMRSRAEAERRERLAAEDAKKAAQIQAIEKRRQENARRLERQGSQQPTSERVSEFHEWL

SEQ ID NO: 41306 - protein, 151 aa, A.fumigatus
PPLKIKINHSDSLLIVVQQLLHSTQLRKTYANAERRLSLWRSLCKLPTMRQRQDRKRRLHPRLNPRRSSRKQSSWQIRHQIRNQRPSQSPSPSHGRNHKHHQPSLLQQNSQQLRWKKRSMKRTTRLLTPWMTSARLQITPLRKDLPSARAA

SEQ ID NO: 41307 - protein, 308 aa, A.fumigatus
ASIVQLERPLSQAARPASRLGSIQPFSRTINPPQPNPAKPPKRGLDEEASYRPVAMKSSTVQPSGESKRRKTEDEHNPMSAIRPTMAPPIRQSGIRKVGFHQYQITLVVYAHLALQESMKPPMYGHGQTSTHQQGSSIFKTAQPQRPAHPMDMAKYASGKIPFAEPSSAAPQLPGHKTPGASSSQRAPAKPSPNYPNSENIHLPEIATDSEDEDSDAEMLPVPKWAQPKELENILRQQEGMEADSIFGPIAPFSLEETFKADKKIKKFRERTSSANWSGADGLTQEEIRRDLAERQRLRLNGGWTFTS

SEQ ID NO: 41308 - protein, 511 aa, A.fumigatus
CFPAVSRSSSSARKNDRLQERLARAMAKSNAAGNGVSQSPPGTVYSPASSLPSNGTRSSLDIESSIISTTGIAEERPDSPLVREAHSLELPADSRTSHDSGAVSRNFKELTAPHIDEIVSTEESIAEPRPSQELGTAEQHETGDLESPRVSQDLKQAAKDTASDINSDNPAIAQLQAEHKAAETRWQEELHLYIERIDALQSKLKYLAKEAAESARKAAATAEPGSVEKQLREKDEKIALLLEEGQKLSKSEMDHRTAIKKLRQQLADNSKIQMETKKRTEKLERDLANLEARAKRAEAAEKRASESLSSQTKVARDLEAVTNERNALSQTVQEMKSQLARAVARAEAAETKAASDALEKEKQRTAQLEEELASVKIEREISEEKLRREVADLKEGIAQEKEKARLLEAELKGEQSVLESKMEALRAKAEEASSGSTGETQAKLLRQIETLQTQYAVASENWRTLEGSLLSRLANLEKERDDATRREGEMRRKMREVVSMAFVVLSILVAG

SEQ ID NO: 41309 - protein, 117 aa, A.fumigatus
TGIMSSTSLEPPTYLSSLQNNIRARPIPWEGAVRAGNITDDHLKKIKAVDKVRKEQRRQTVEGDLQGYVGLLAGNADSKSVLDSASKRTDIVQYILVLATDLISGNDILALYIEFLR

SEQ ID NO: 41310 - protein, 61 aa, A.fumigatus
  UNSURE (19): Identity of amino acid sequences at the above locations are unknown.
NESVSLYAFYDKREVSVFXVIQFFLHYVQNVLGVLALGGSLLGSSDIPALVDTSVYLVLLN

SEQ ID NO: 41311 - protein, 458 aa, A.fumigatus
PLFSFAFGFLWLIGCFPPEYSPGEFIYTTKSPSATSSTALSPRVDPFASLSPDQKSLLHHFIQDASQITACHSSMQKDICKMLVPMALQTPSLLYATMALSAIHLQALNNQSENVKSAPHIARLMALSLEHFRNELQTPSTKRSDALLATARTLCLAEIHSGAIHPNSWRAHVEGAKALMLATNHKGNESPGSSQGFRRYLDRWYQSIVSLTALTGNGPPIEESMGQSASEIIRQQDAPDYLDDYWGFTVNLSAVFRAIGAAAWRSQHERQRTGLISDDTDMASAQEAAILESSVRTLMARDASSQPTFYPGVAEGLSAECVREFMLCNEAFQHSALIQINRRLRRLPASSPLVQHSVKRILECTAQIGPSTGLSPWTMLTTPLFIAGCEAQGEDRERVRQLLSLLHDTIRVPNVLQSLKFLEQYWADQLNEDEGWSQYLGRLLLSWDVSEANMAQIE

SEQ ID NO: 41312 - protein, 208 aa, A.fumigatus
YTRTLHRILALTIVPYNSDVPSLSSALIAHPSPYKPFLPLLRHSTNAEDPIPLLTSTFLTRLVSHSLAASTKAAVRDEEALPQLYTYLSTLTQNPDSGLQDIGVQGLSALLRNSRSREMFWNQRKETIDPLIEILRAAAGTKDSSSASTLAGSSRAIEPGLSGGVGLQLLYRVLLVLWQLSFEGSLVGEGLQSYVHHLTYQSMGEVRG

SEQ ID NO: 41313 - protein, 207 aa, A.fumigatus
STFRDYEFVQLYTQLLRLSPKEKTTRLLLATLNNLLSSNRTTLLPVAVFVRLPALLSNLSGRHLTDPDLLEDLNALSEMLDEYTKTQTTFDQYAAELQSGHLRWSPPHRNPTFWAENARRILDEGNGALPKKLAEILSKSWDNDKQVLAIGCNDVGQLVKEMPERRSQLEKLGLKTRVMELMADKDESVRWESLRAVGEWLRYTFEG

SEQ ID NO: 41314 - protein, 116 aa, A.fumigatus
QENPHRRSLRGYPGKRKKTQILRTVKIQQPRPKSMSRSFNGCKRCKARRQKCDEQRPICGRCQAAGVQCQYAMQLQWGGRTFSRSRLGACMSNGGLQKLGMCSNDPCFPLLLVFFG

SEQ ID NO: 41315 - protein, 154 aa, A.fumigatus
QPLVMEAGLFPGLVYYLTFWYRHSERSIRVALILASATLAGAFGGAIAYGVGHMNQVHGLSAWRWLFIIEGAPSCASAVLVWFFLPDYPESARWLTREEKDLAAQRLRTEGSKGEAKAMTWEDAKAVLTDWRLYAHYAVRCLFLARYGPTTNAS

SEQ ID NO: 41316 - protein, 72 aa, A.fumigatus
QIYFGISAPFSSLSLFTPAITSGLGYTNIRAQLMTVPPWAVAYVVTTAAAWSADHFNRYTSPHLSTMPHNTH

SEQ ID NO: 41317 - protein, 60 aa, A.fumigatus
LSLLIVNYKDINEQHSDRSCRIQEKALVWKQDLRIVPLCAAIYLLCYLDRSNIGKHETNS

SEQ ID NO: 41318 - protein, 106 aa, A.fumigatus
SSSISDRIIVAGKGPRYREESYSISVKQNHFNMASTQGNVGRKVEWIEKLESMPHMNYIFLEGIVIVPYGFIVRATNCRLYLPSEHCKTAGLGTPMYTLFSDRRGN

SEQ ID NO: 41319 - protein, 297 aa, A.fumigatus
YRQPSQLVSLFSPQHVTHSVTHSFSLNPVASTTPVKMGSELGVTPDSKPEPVYSPVSIWWATWAGVWTVLVASGIAYLIARRDTPILRIRGLSLSLSAIILLHLYYTPVQFGTMIGPIMPGDAQFWIMGTFLPCGIALFHASNSRFLYVAKLQEKYVYNDLRHNFPPSQRRSGLLGRFKRLDYNTRVLVLVGIGMIAQIMLTVIMWLISRKWHPTWGIPGTEVTGPKMAQLSAMGRGWEWYEAKDSDLGWRARLTWLGGRVSFGNCFGPGSLPLLFSGNHAISAIPMAGEFRPSAVR

SEQ ID NO: 41320 - protein, 204 aa, A.fumigatus
WTRRICLSILVMEVFTVFLPCWEVMRHQVLQKETLDAIAQWEEKNKKNSSASKSLAETATLVESIMTGGKSTNGSVQTNHSRDSILTMGALEYALERDPAPLQRFSALSDFSGENIAFLTSVAEWKQSFPKAIRENTAPRDSNTEDLIRERFNRALRIYAEFISVTHAEFPINISSQDLKKLQDVFERPARILYGDEGQVDPAS

SEQ ID NO: 41321 - protein, 528 aa, A.fumigatus
PTIELIMSLTEGSTMLGSRPSSKEEVDRPNDLMPGPGGAGEPDAGGPPSTFSSTFQEAVFIFVIGLAQLFSVGGLGNAAFSGQEIGRSLNATSNGQMSWFQSAYSLCGGVFVLVTGRLGDHFGHKYVFLFGWMWMALWSLVSGFAKDVILFDIARGMTGIGNGALVPNSFALLARAFPAFSVKKNIAFAFLGFCAPSGYIFGGLIGAAFAEKVTWRWGFWFWAIGCLVIGAVTYFIVPHSVGSPIPGLSIKQFDYLGSVLGISGLILFSFAWNQASVVGWEEPYVYALLIVGILLIVAFAFSQSRVQAPVLPNPLWTRKGFAPVVTAMSFGWMSFGIFLYYTTMYILTIHKAQPLTAVAQMVPLVIGGLFATASVGIFIAKVPAQYIFGVSMFSFFIGCLLMSFANYSSVYWAFIFPSCLLVVGGPDLSFASSGILISNAVLPEEQGIAGSFISTVVQYSISIGLGIAATVEAHVNNGGQDIVRGYRGALWLGIGFAAVAFFHCGFLRPGHARSTRFSPQPRRTAFPL

SEQ ID NO: 41322 - protein, 61 aa, A.fumigatus
DSTLESCSRGRPPSTRMVCVAVFSSIVASCMPVTTLQEVTPSLRLNDWTCLIMATTGTPTI

SEQ ID NO: 41323 - protein, 127 aa, A.fumigatus
KGGPLFCRFFSSQVKKIITASIDLRRKPRFFHLAPFRSTLKIMGQKRQRDSKNLTLHSKKRKKAENATATDSDDGWDGIVGADELNWKEVALPDRLEDAGGFYGLEEIEGVDIVRGSGNGEVKFKVR

SEQ ID NO: 41324 - protein, 983 aa, A.fumigatus
STVVKAMETRQGAGNIALGYLFSQDFDLKKRHVPQGIVASSATLPYMRSALEQLSLLYSVASPVAAHVAAVHYAGENGLVSDYASALSLAEELGLGLVSSASVHEAQHMALLTTLLASVLPSVHIYDGVRVGRETTRVIDVLDQAGVARTYEAIRKTLDESRNRHLDTQGKVLELFASLNGELGTDYGLFEYHGHAEPVSVLVAFGTVEASLTAQVARSLANDGVRVGVVNVRVYRPFVEEEFLRVLPQSTKTVGVLGQVTDEQDVQEQGVRSALYEDVLAALTFASGREHAPTCVDIKYPRSQRWDLINTAAAFQLIFEKPIIPASGESAPLQLIDPATVQEYTFWDVDSSVCESAAAVLSEALAADSASNVTTSKSYDNLIQGGALRIDIRKSSKILDTPYAITAADTTYVGDIKLLGDIDVAASIKNKGKVIINAPGVKDDELEKKLPLGFRQAVAQREISLYIVDPSAAGASAPESSVLESAFLRVALPSQEGVGLKKLSSITGDSETLETVAKDLDKLLRQVEIPESWRISEEGTEVTQLSKDISINSFVPFDKDEAEPAPLLNDWQAAAKGLAFKEAYGTKKALRPETATKTFTVHVKENRRLTPVTYDRNIFHIEFDLGDSGLKYDIGEALGVHAENDPQEVSEFITFYGLNPDDVVGVPSREDPAVLENRTVYQALVQNVDIFGRPPKRFYEALAEFATDEKEKKDLLTLGGPEGAVEFKRRAEVDTITFADVLLEFPSAHPDFQDLIRIVGPLKRREYSIASCQKVTPNSVALMIVAVNWVDPRGRDRFGLATRYLSRLQPGTPVTVSVKSSVMKLPPKSTQPLIMAGLGTGLAPFRAFVQHRALEKAQGKEIGAVLLYMGSRHQREEYCYGEEWEAYQEAGVITLLGRAFSRDQPEKIYIQDRMRETLPEIIQAYIREEGAFYLCGPTWPVPDVTAVLEEAIATEAKNTGKKVDTRKEIEKLKDEERYVLEVY

SEQ ID NO: 41325 - protein, 743 aa, A.fumigatus
CEVRAMGRLNLRYAEALADWVKNDPLTQLPQAVAGKPKKSILKKKALEDENPEYEEEWSGFSDDDADRPENASSTVVEKPEKSDRKADKKSEKNADKKEAKDAKKKEAKAAKKEQKEKGSAIQRDMSINAGLSFAALQDTEEDDGADVSAWDSLGLSPEILTGLSKMKFGSPTSVQEACIPQILEGHDVIGKASTGSGKTLAFGIPILEHYLEKKRDDISAQKEQMSEKDSTPIALILSPTRELAHQLSKHIGELIAQAPGVNARIALLTGGLSVQKQQRLLSGADIVIGTPGRVWEILSTGQGLIRKMQQIKFLVVDEADRLLSEGHFKEVEQILNSLDRVEDGEVPDGEDQASEEESDPSSERQTLVFSATFHRDLQQKLAGKRKWTRGDIMDKKESMDYLLQKLNFREEKPKFIDVNPISQMADNLKEGIVECGAMEKVSFHMGSVISSLRLMTFQDLFLYTLLLYHPKHRTLVFTNSISAVRRLTKLLQTLQLPALALHSSMAQKARLRSVERFSSPSSDPSTILIATDVAARGLDIKGIDLVIHYHAPRTADTYVHRSGRTARAGASGKSVIICGPDEMVGVVRLAAKVHANMANGKKLPLESLELDRRVVSRVKPRVSLASRITDANIAKEKISAEDNWLRNAAEDLGVEYDSEEFDESNGKGRGRGRGRHQKQKEVGSVSKAELAGLRAELKQLLSQRVNVGVSERYLTAGRVDIDALLRGDSNTSFLGPVDPLNF

SEQ ID NO: 41326 - protein, 427 aa, A.fumigatus
KMGKSSKDKRDAYYRLAKEQNWRARSAFKLIQIDEQFDLFEHENPDKVTRVVDLCAAPGSWSQVLSRVLIKGESFGRRAWIEKKRKESEALKRIDHGSESESPAEEERKDDIAQLKPRRNVKIVSIDLQPMAPLEGITTLQADITHPSTIPLLLRALDPEAYDSASSPTPSAIQQPHPVDLVISDGAPDVTGLHDLDIYVQSQLLYSALNLAVGVLRPGGKFVAKIFRGRDVDLIYAQLRTVFEKVSVAKPRSSRASSLEAFVVCEGFIPPAIHDGSVGMDALKNPLFGGATIPPPVSPDGNIGIEVPDEDTASPREPLTVSEAATVSASDINQQTQIRMLHSQSSIPSLANKPQRFAVENRWIPPFIACGDLSSWDSDASYSLPPDYVNLDPVQPPTAPPYRRALELRKEKGGAYGKTKLGAVGRA

SEQ ID NO: 41327 - protein, 328 aa, A.fumigatus
NISRASRPSSPPLLGSSISDIKTTSGNRTRARPTPASPAISPACSTGGAHRHASPVEISRAIFCEEDRNPRAQMLPFINVIYPKLQDCYADMPECLLVENVTVPHAFSFQYAVPPPQVSPNLIQAQPSLTHMCSFFYHTTVMQIFGLLKANHEHFDPASIQRARNICIESALRIAGLIGIHRDKWGIGRMAPSTIQWLSIGMFTLLDALDSPDTRNRAAFIEMCIVARAFARRFPLAKGILRMIQLSANQMQVVLPAETDALFTDFETRSWEGKDRHTFSTFYPNFARVVRQGAAREEDVSMDRFLEKWDSLAISDPKEETPPDEGGS

SEQ ID NO: 41328 - protein, 201 aa, A.fumigatus
SVGYRHQSLYSRSFIPLLNNINNTDNIRSIKMSNPLQSHPPHILAVLDRLHAESAAQESSIPRTVYTTSSTDSFHTFMRNKFIALEQDKCHFIYQLARTLNATSIVEAGTSYGVSTIYLALAVADNLVSASASGPSKGTVIATEYEPAKAAQARKHWAECGEAVSSVIDLREGDLRETLKTNLPDRIDMLLLDSKSFSFFT

SEQ ID NO: 41329 - protein, 65 aa, A.fumigatus
CCRTVCVLTSCGPMMFPTVYATNTVAAMTVFLVAPATLLAPSVMIRLTTGPKNPVSAYPTTGAAG

SEQ ID NO: 41330 - protein, 94 aa, A.fumigatus
KPTTNTSIPPASSAPATFASRAPFASPGSSASTATNGASAAWPPPPSSGSASACLPSSMRWTRPTLATAPPSSRCASWRGRLRAASRWPRASCA

SEQ ID NO: 41331 - protein, 103 aa, A.fumigatus
RQTSRIGLTCFCSTVSLFPFLPRRPVAVAVADNVVWTPMALPTLKLVQPKLRYGAVVVSDNTLSAAEGYKDLLEYLRAPGSGFSTLTLPYKGGLEMSVYLPQQ

SEQ ID NO: 41332 - protein, 241 aa, A.fumigatus
KSVAFPSRRLLIPSWRHTSLPYQCRGDPPCQHCVSHGVKCEVDAMSDMRRKNAMDRKVAKLEKVADTLTRLINALRDRESRRVSQLLNLIRSNASFDELRLFLEQQFSHYELESTPELRDIQSQLSQTTDLAPLGWRYLRVDRLADDPVYKVPAKPWTAVTDDSELVSHLVSLWLTWTYPWFNWLDADCLIKHMQEGKLNSRFCSPFLVNAILAEACVCVLARMMSVFLFYFLCFSLLIRV

SEQ ID NO: 41333 - protein, 74 aa, A.fumigatus
YYSDYEEVFTVPGDLLTRGDQFFDEARRLFEAGEDEGDSPSLPTIQGLMILFVRSVASSDAKQWLSLTWLSEHR

SEQ ID NO: 41334 - protein, 167 aa, A.fumigatus
ERHRSACLQFPVRGPPPPSVPKSDPSSTLTDPYVQLLLPHNRNANLRPPESQPRTLRSRQHPARPQHLHRERPSHRRAHRHPPRQMGHRPHGPLHHPVAQHRHVYPPRCAGLARHSQPRRLHRDVHRGAGVCAPLPAGQGHPAHDPTLGEPDAGRLACRDGCPVYRL

SEQ ID NO: 41335 - protein, 80 aa, A.fumigatus
TTASRQITSGSLKRWQYIYIFAGVLTFLFGIWCGVMPNSPVSAWFLTPEERVVAVERLRMGHTGVRCHQHQAVADQRRCA

SEQ ID NO: 41336 - protein, 109 aa, A.fumigatus
TRDTSRSTKARPDATPARCRPSPPSKASRGPCIPGRRPADRLGGTAIPGAQGPLSARAGFGYRVIQASIPTRSGKTAAPGTAAVRRTRRYFGSDSTAAKRVCSLCRAER

SEQ ID NO: 41337 - protein, 353 aa, A.fumigatus
FPCMVSRGTHPLQHGCGVRAAEPVPVQGAAGRVLVCFPAGFVTRGSLGRDFEENLALLLMDVVQRVTARTAWKARRRLVAAFLDYYRAGGHLDSSQLTYARWETQQKGGATLEDIARLETAAALGTLSNTVPAMFWFMFNIFSRPELLNEVRDEVARRAVQVDAQGVHTVDLAEIKEKCPLLMSAFQETLRLRSNTVPIRVIFEDMILDDRYLLKKGGILQMPAHAINRDRTIWGSDADDYDPRRFVKINQSDSRKKANGFLSFGTSPHVCPGRHFATGEILALIAMLVLRYDIVPAGGVWKEPRTSKSAITSSTGPPAEEFKVLATARKEYEGVEWAFRVTEGKGKYGLIIG

SEQ ID NO: 41338 - protein, 170 aa, A.fumigatus
QKMIQVPSATGDPERLRADGELFDKDAALAVVSDVAMEIDPEVEKRVLRKIDLFFMPAMLVGYGLVYWDKAILGSATLFGMTNDLHLVVIDSSTTPPSKDTSRLSWATSIFYFGMLAGLYPMTFFLQRFKIQHVFGPIVMLWAVTCAATAGVTTWQGLFAQRFFLGTFIL

SEQ ID NO: 41339 - protein, 224 aa, A.fumigatus
VLSTDPWNCKPDNPKLPKLIGAISGFGPLIVSTFRYHTLDSILFQFPVGGICVIFIPLCGYVASRVPHTRIPMLIACCLPVIAGCALIWKSPWGYQPAAPVVGYALTGFFGPVVSLIITLGASNVAGATKKTVMAATVFVAYTVGNIIGPQLVKTQTVRQHYPELWTGLIICYGVTIAAAGVLYGILRRENRRREAMELDESQRDKMAFNDLTDKENPFFRYVL

SEQ ID NO: 41340 - protein, 151 aa, A.fumigatus
KGKKKKTIKDKSLTSTGFVESVVPTGFMTIVSGYYTQKEQSLRQAWWFSGTGWFTIIGGAMNYGFATDHVRLAEALAVHLHLCRGADLPVWDLVRRDAQLACLGLVPHTGRARRCRRAPSHGPHGRALPPTSSCRRSKTLRLISTCTSSPS

SEQ ID NO: 41341 - protein, 292 aa, A.fumigatus
QAGKERGGYGIAGKNFSGIVGDVLVGPERAPRRRPPANSNAAIRSLEWPHADRGSAWPEYTIVHEHETALKPDTLPWEQAACLPLSGLTAFQALFEHAGLPFPADAVGGGSEARIGKRVLITGSSGGVGIYLVQLAAMAGLHVVAASSSAERNGGFLKGLGADEVVEYAALGENVDGSFDLIVDTVGGKILRRCWAWVAGHGTLISVDSASFDFVNEHSKCGLNKGKEDVRALFFIVRSDAEALRKLATLADSGRLKLFVLQTYDLSQAQAAYEQASSKASGYGKVVIQIGD

SEQ ID NO: 41342 - protein, 402 aa, A.fumigatus
SVGSSGLLQDSNTMLRVYCLCWWLAVCKHVSGQVQTFTPAAETAIAYSVNVPASTAGSGSSGSGPIFIQMRSTKEVQWFAWGQGAVMQGANIFVVYADGTGITVSPRLGVEHVEPLHNPQARFSILNGSGISNGILTANIRCDSCITWPGGHEDVTSTSSPWIWAVKHGPMLDSDSVSATITIHDFSGVATVNMKQATGGSSENPFVGGSMSSSSSSASAALTINSESVRKKRIAHAVLMIVTFVLLFPLIALGIPLFPSARTVVIHASLQLCTLALVLAGFGLGISMARSLNFVGSYHPIIGIIVVASLVLFQPAMGLVQHWYFRRTGKKSLAAYAHRWLGRTAITLGMINAGLGFRLTGIGTSVAPTGAVIAYGVVAGLVWVGYVLTVSFLSYRKRHSRA

SEQ ID NO: 41343 - protein, 134 aa, A.fumigatus
TETNSHSRPRSTLSVVYAYKLVNCPGKTIVGLRVEFPPNASTPPHRHGGASVSAYVLRGTVLNKMNDDPMQVIETGGTWYEAPGCHHRISDNASAAEPATLMVSMVLDSDVYDRDGVDALIQIDEEYREIEPRK

SEQ ID NO: 41344 - protein, 78 aa, A.fumigatus
ASQTINHFSTMKAFNILSFSLLLTIASAAAVPDVDGTITKDAGNNKRARFCGQICLNNTGCGGKCPKCDMKSLTCKKA

SEQ ID NO: 41345 - protein, 318 aa, A.fumigatus
CGVNDFTFTDLTKPTHDRLVKIFSYLINFVRFRESQTQVIDEHFNKTEKTKARIDTLFMENQEMEQRLEEMRRSLKANEAQVKEKVRRNDELKARLLELRRNQERIAETLERVKADKARRQAQLEEKTERSVRTRQEVEKLRPYAMQSPVSLQSALTELSENLLREKAQIDAMEKRARALQTSSDTFTVVGNDVQACIKLLEDISVELQKEEEEESRASRNKEAISERGNNVREVEQTEKLLQRQLARWNERIEALRKNAQEKAEVAQARMDELRDVQKKLREERAEKQRDMERRRIRIEQTEKKVRLRARQHVVLLC

SEQ ID NO: 41346 - protein, 93 aa, A.fumigatus
PDKEIAGCINDIGIPFTAADLIKPNPQQIQMVFEWFAELLMNTTKETVEPAMRAAAEDICGDYPDIVPLETRNLMGFFISLRRLMMEVCRMSV

SEQ ID NO: 41347 - protein, 265 aa, A.fumigatus
PLAGSIVATYNELLRSDPDLTMPIAAIEALVLLLTHSPSSTISETLDLLEKSTAHLKKSIPNPIGLSAGTDLFQRYLITTLQRPGQLGPAGDFNAIRAHLLSNGRLFIRRAKESRDKIAAFGRGFIRDGCTVLTNGGSRVVASLLQKAADEKGGPSAVRFRVIYVLSSANGDVENTRAEPEGMETVRALRAKGVPVATISESAVAYSLGKADMVIVGAEGVVENGGIVSRMGTYQIGSSCKGNGKTFVRGCREPQVCPILPSWTV

SEQ ID NO: 41348 - protein, 133 aa, A.fumigatus
VPKVWSRMEELSRGWEHIRLGLLAKAMGKPLYVVAESHKFVRSYPLGQYDLPIEQHVINFKTEEDIADEAKQQSAESQKTTEVDSLEANPGSKGGGRSDVVDFTPPHLISALITDSGVLTPSAVSEELIKIWF

SEQ ID NO: 41349 - protein, 61 aa, A.fumigatus
WDGEPPYLHQSSPERSDTFSVRDILWTKSSTEAVMKDLSIPLFAILRYLPGFGTLERDGEW

SEQ ID NO: 41350 - protein, 186 aa, A.fumigatus
YIHQLIDVHRAVSRLSTIALRHPLTQMLLDDAGLLNGLQAVTSWNEFFDHPKGTILGLYAASLYLPSIVTAYLGDFLSQRFGRRITLALGSFIVLAGGFINAFASSAGMWVAGNLSVPLWCLWYYVLKLESCSGRAIIGGGGGLAKVAAPALIQEIAHPRLRPMLASCYYPFFYFGALLSALLCCE

SEQ ID NO: 41351 - protein, 199 aa, A.fumigatus
LRSRLRRARSGNESFPRLSYQSLTFNQVYKFRLLHDSRKPPLAPGQDSQPLQLIGMKLGSFPAVNEDQTIDEAVELAKESDIALLMVGLDQDWESESYDRPDLSLPLRMNDLIRRVATEAPDTKKVVILQAGSAVSMPWLEHVDAVLWPWYGGNEAGNAIADVVYGTVNPSGRLPITLPKTGAWTLRQTSTLSRARTKT

SEQ ID NO: 41352 - protein, 120 aa, A.fumigatus
YEEGIWVGYRHFNARGIEPLYPFGHGLSYTTFDYSDLTVGPSASSSPDSWRISVSARVTNTGTVPGAHSVHFYTSPPPPTMTSLTHPAVTLQAFAKTAVLRPGQSERVTVEMDKCKYTGP

SEQ ID NO: 41353 - protein, 462 aa, A.fumigatus
APAVVLPNATGLAATFSPTLPAEAGRLLAAETKARGAVGLLAPTINICRSPLGGRTFESFGEDPTLSGIMAAKYVSALQDEGISAAIKHFVANDQEHERMGQDSIIAPRALREIYLRPFHIAQALAKPWSYMTSYNKLNGTHCSEHEWLLSGLLRTEWGFDGLVMSDWMGTYSVAEAINAGLDLEMPGKPRWRQLSLVRQLMNAHKISPVTIDERVRTILKWVQKLVVLNPDTVYGRDDSIEWTRTEDQAADAALIRRIGNEAIVMLKNESSVLPVRRGKVAVIGPHAKTAVITGGGSARLRPAWCVTPWQGLVDNKPDQVDLRYALGCKGAKFLPVFGEEFTSMDGTTRGFDMLHYAIVDGKQASQPAVSEVWTNSDIMLADFSHPDLGDDYFTEIRALFTAPITGEWQFEISVTGQAWVYIDDRLLADLSKEQKRTSSFFGNGGNGTVITFSVTKGKVWK

SEQ ID NO: 41354 - protein, 1231 aa, A.fumigatus
  UNSURE (71): Identity of amino acid sequences at the above locations are unknown.
TTLGRTHMKHTTTQSLAAINSFSQDPTNQMSLRPLRALQNPTSMRGYALIFQAYLAFLLNSFRHLTGGGPXSYLGLYTLNDPERYDLEALEAFLLRASKPEASISSDSDSPDSDDSAHASPSQQMPEADPDDDLDYDLDSDEEDEALPQAPQLPNESLDEQLVQKGVSLIMNLTLQLARRQVIHQREVPLYAFLACFSRNYSHDCFKTLSLIGHSYSAIIKSHQFILLHWLHTEPFTIPERQPESMAVFIRNWMTNHFTGQSASPLGHVLVLRMLALYLIRTSASLGRIHPVAPHTLKYGQVTISQGHLRHFLAQRVQQLALALSNDLFLEFSYFREIQHTLDLDRAAQHEDISQQANSWSFLQAYLDQGAHDDLLQKVLPDSDWFIQVDGPSGPTLKLVRARAKAFLDSSSAWLKQLLAICHMTSGAPARGTEINQVIWQNTPINPRNLFLDPVSKLFLIRLAYSKTFRHTGQEKEAVRALPQSLSYLVLAYLAYIRPFEEALLIKLNQKLPEAHFLLFCDHRTCKPLSSKVLSRTLKNMTSESLAQPISLSPWRHLMQGFIRHGLGLHDPLAELGNDDLDDEALGADQMHHSRETGLRIYGRVIASFQGVRADIQIALVTFSQRWHAYLGLAPDQLIIHSLFYNREVWQPQADYSPNSPQPQPTRGMEFPLDQPIIQFHYPQKPKASPPARKVSIGQFNEFISLYGLPQASDQALRQQDLYLDLDLDQGQLARQLDLSRSNLASHQQLDEGLLDHMLKEFMQDDQVTFRSPEQRQAFHLIVKQVPYLFLVLPTAAGKTTLFLFGASLTTSQVTIVIVPLISLKLDLSTKAAALGLQPTIWEPGQVMPLASSRVILVQIEHLDHPRFNELADELITQKRLARIIWDECHLIPLAKSYRPIMLRAWHALALPVPMVFSSATLPHHLQAELVDMMKLGSLPEVPIVRADLTLPNMAYMVEKVPDRLPESEYAPYLRQFIKTFEMKHGPFGSSTTAQASAQATASARTRANVIIFCRTKRLVDALSDQMDPEAARFHSDLSDQAKLDQLDQFQSSRYILVATGAIGAGFDFHDIDLVIHFLPGEYEMTSFMQESGRAGRSPDQPGWSYCLVRAYQLRARPNQEGKALKVSTFLDYLGEQVCRRRIISRVFDSRAIESCDPSWALCDLCDHRQSRLGLVRQVVRQEEGQNLIQMNIFAWAVRFWHERYCLICFISGKLSILSIKSIDLLILLIY

SEQ ID NO: 41355 - protein, 153 aa, A.fumigatus
NSSRMMQSNPQRTDPYKPPSLIPQTEKEDDQLIKIIAPLFYSMTTLAPTAFRVSMIFSASSLGTDSFIILGTDSTNFLLSTRERPSRPLISLMTLALEAASTVSSFRLKRVFSCAAGAASSSSAAAGAAAAPPPGPAATAKPPTGRSGIFRRD

SEQ ID NO: 41356 - protein, 461 aa, A.fumigatus
RVRCLVLPFSHTVFQGLSNVPRFRAHFVHLLTEIVLSDLEVDRLKELRSQEELCKALRTVVASKQFGTEDLLSSLVAEAVLAVLPKNPVNFNVDNVRVVKIMGGSLEQSRVIKGMVFGREPEGTIKKARKAKVGVFSCPIDISQTETKGTVLLKNAQDMLNFSKGEEDRLEATIKELYDSGLRVVVAGSSVGDLALHYLNRFNILVIKILSKFELRRLCRVVGATPLARLGAPMPDEMGSVDVVETTEIGGDRVTVFRQEEANAVTRTATIVLRGATQNHLDDVERAIDDGVNAVKAITKDPRLVPGAGATEIQLVEKISAFADKTPGLPQYAIRKYAEAFEVIPRTLAESAGLDATEVLSRLYTAHHRTTKASESEESEEGSSEEEEAYWTTGVDLQAGSSTGTLDAVDEGILDLLASKSWAIRLASESARTVLSVDQIIVARQAGGPKPPGPNPNWDED

SEQ ID NO: 41357 - protein, 251 aa, A.fumigatus
PSSTHIDPDLIFQIGYIVSGGNPSFREWLLASTTHAGARVPLLMSAARYLNSLGNTAPVRTPALEKVEHLALHDRDPRAMTLHAKVLGLRKRYTDALRLIEQVMALIYPSKVPVAKDGGFGMARIEPPWRVYAWLNDKAQAQANADTKTGEVGTKTDDLLRSAALDYQDPESLVQYATARMRAGDLAMYEDCMSRGRDGREGRGVPSTRELLLSHFAGTVPAARGARDRGQDQCPRGSSRKASLKRILANE

SEQ ID NO: 41358 - protein, 100 aa, A.fumigatus
RLLSQMTGRRRFNCVSSHQELRMGQQSYEEVLRSTRGKILPENHPLTIMVNGVLRRLIPQAPIEGADWRVHVIKDDGMVNAFVLPGYAYPLTSRPAVVCH

SEQ ID NO: 41359 - protein, 112 aa, A.fumigatus
SRLNIPDLPVGGFAVAAGPGGGAAAAPAAAEEEEAAPAAQEKTLFNLKLETVDAASKAKVIKEIKGLLGLSLVDSKKFVESVPKMMKESVPKEEAEKIIETLKAVGAKVVME

SEQ ID NO: 41360 - protein, 103 aa, A.fumigatus
HHGLLSYATDRTHSGKVFVYTGILPICKDEDGLAAVLGHEIAHVVAHHPAERMSNNILKVGAVLLISMLFDISGQIPSLLLNLMYSLPNSRTQEVRLASLLRR

SEQ ID NO: 41361 - protein, 169 aa, A.fumigatus
HRDCYSHDAEDGAIIRNIEACQAISKTVQTSLGPYGRNKIVINHLQKMVLTSDAATILRELDVVHPAAKLLVMASQQQDAEMGDGTNMVIILAGELLKKAEELLRMGLKTSDITQGYEKAQNYALKVLEGALFGLAFFSHRFSGAIQCASLPSAFCSSTDRNCVVRPRS

SEQ ID NO: 41362 - protein, 255 aa, A.fumigatus
PPALRGILRAPCGEDSLARSAGVRIRVVARFVFFVSGLAVSDLALPSSSSPCLAFFAGGDSSSSESLSSISASLSTSIHPPESSLSSSSSMFHRSQAASSSASSTSSSSASEGRPFSILRFRRSSSFHFSRSSRPSISPVCCSPKRRSFFSPARKLIEASLPRSRLLSISAPTSLYRLSNPLAAMTTPLSLLFLYITRSCNKVSFIAKGCRAQISRMALRPAVATSDAAASETNSFAIFCTRGSRTSGGTKSCDA

SEQ ID NO: 41363 - protein, 374 aa, A.fumigatus
ELPLSVHSHQGLTLHSYQKRRTLLLSQFLGPNKPLEINASSENPSSPISSANIAPPAILSVRPPTADSASQNASSQSFAQNNVPGNGSFGYDRRVSMGTQGSIQDDSAFQYNRDSMALQPPERMPSSTSYDSLFLPKPQAPPIAQEDSRTATLLSQNYAFNPGASDHVDESAGAYDMTPGAVTRQSTMLDSQQAYFSDFAGQQQGDYRDSYGGGFHRYSQSDTFSPTANMAPPLIPASELPHGATINHLLPLEPRDIPFAVHDPHDKNTLMSTFDNIPAVLRHRARVHPKQPAYWVLDQKGKEIASITWEKLASRAEKVAQVVRDKSNLYRGDRVALIYRDSEIIEFAVALMGCFIAGVVAVPINNLEDYQSLN

SEQ ID NO: 41364 - protein, 151 aa, A.fumigatus
RRCLIPKSLRLRRAAKGKTYLVGLGSNFDGRHSTRTKMEISAHTRLGIDALDRIGLTDANLLTRIYKYSDYIQIRNPVYIPHTAGRYAAKRFRKAQCPIIERLTNSLMMNGRNNGKKLMAVRIVAHAFEIVRAFSARTWNSARQRLPGTNY

SEQ ID NO: 41365 - protein, 155 aa, A.fumigatus
TVATTARSSWLSASSPTLSRSYVHFPREPGTQPGNVCQGQITDASSLFSQIHIMTDQNPLQVAVDAIVNCGPREDSTRIGSAGTVRRQAVDVSPLRRVNQAIALLTIGAREASFRNIKSIAECLAEELINAAKGSSNSYAIKKKDELERVAKSNR

SEQ ID NO: 41366 - protein, 103 aa, A.fumigatus
HESAVFRSYIEDFRAQHYQYESHREIFMAAPTAATDTGIISLRELIDFIAHVADCYPTITKEFPQQLMDILTQHHLVLEPELREKIVGSLVLLRKKELLDSAT

SEQ ID NO: 41367 - protein, 73 aa, A.fumigatus
RFTQRHRPSPSRIPPSTTGAYGVTMSDHGEVEVENPSGAFQALPKDALAEMGTIKLFNKWSYEDVEIRDISLT

SEQ ID NO: 41368 - protein, 504 aa, A.fumigatus
  UNSURE (16),(21),(34),(36),(45): Identity of amino acid sequences at the above locations are unknown.
AATDIVPYSDHNTQAXLSGPXIFQKILMDLRSSXAXTTNHKLNRXMQTVLFNLVTSDRTSSKGLWAIKLTRELWKRQIWTDAKAVEVMKEACLSENEKVIVGGVRFFLGGDKEREEMEDESSDEETIDLARVKHQVGINKKTRKKSRAVEKAKAIVKKRERKKNQPHPLNFSALHLLHDPQGFAEALFAKHLQNTKSNLNLEQKLLVLQLVSRLVGLHRLHIMHLYSYFQKYLTPRQASVTSFLASLAQASHDLVPPDVLEPLVQKIANEFVSEAAASEVATAGLNAIREICARQPLAMNETLLQDLVMYRKSKDKGVVMAARGLLSLYRDVGADMLKRRDRGKEASMSLRAGEKKERRFGEQQTGEIEGLELLEKWKEEERRKRRIEKGLPSDAEDDEVDEAEDDAAWERWNIEEDEDSDDSGGWIDVESDAEIELSDSDDDESPPAKKAKQGDEEEGKAKSETAKPETKKTNLATTRILTPADLAKLSSPQGARRMPRNAGG

SEQ ID NO: 41369 - protein, 60 aa, A.fumigatus
YVNHTHGICEDADDSAEVFYKHHNFLLSRMLKGEEEVEWTKTHLFEHLCEKFPVSRSIST

SEQ ID NO: 41370 - protein, 96 aa, A.fumigatus
  UNSURE (35): Identity of amino acid sequences at the above locations are unknown.
LYLIDALMHTLMIFPLPLDEDKKFNILISRVVCIXKIQHKNIGYSGPLSRQLLCYRSLISEVRSTLRNLIEVVLASLLLSGDASRDRNDWTEMSIK

SEQ ID NO: 41371 - protein, 200 aa, A.fumigatus
YDSVITDCKNLAPTWETLANDFALEPNVVIAKVDAEAENSKALAKEQGVTGYPTIKFFPKGSTEPITYSGARSEEAFIEFLNANAGTNRVVGGGLNEKAGTVAVLDEFINKYISSRNAEELVAEVKKAAKGLQDKYAQYYVKVAEKISQNEEYASKELARLKKILEKGGSAPEKLDDIVSRSNILRKFVGEKDTDAKDEL

SEQ ID NO: 41372 - protein, 298 aa, A.fumigatus
SRPQRREKRQRRRIQEMVRIRKRVLLKQMARYVGGATEALKSRLLNQSLACAQAQSENLKSKKRNDSEDEVGSSNNADGESDKEATVEAEDSEEDEIDEEEEGEEEEEEDIPLSDLSEDEREDVVPHQRLTINNSAAINTSIKRISFITSQTPFSEHNSLVSKEPIEVPDPNDDLNRELAFYKVCQAAASEARRLLKKEGVPFTRPGDYFAEMVKTDEHMSKIKKKLYDEAAAKKAAAEARKQRDLKKFGKQVQVAKLQQRQKEKRETLEKINELKKSRLPVLFTQVPEQLLTCSLVS

SEQ ID NO: 41373 - protein, 67 aa, A.fumigatus
YAAVLSRLSLTAGSVLHERKPSVKVPHLPNPFEKIINAYINIQPLFCKNKVKFGLGVVRMRQGMILD

SEQ ID NO: 41374 - protein, 134 aa, A.fumigatus
DEYQVRLILCFTKIYGADLHRLPFIDDNDCGLGIAVRTYLDDLPLQADPTSPEARLEVKSKGKEWFQHSDSFTSNLEKAFKLWDAVSAKESNQFSPHELIFFFYQVYKGTQNASKEFKDVQLWKEANEWLSARR

SEQ ID NO: 41375 - protein, 216 aa, A.fumigatus
YFQYLVFLIEDNPAPASSKTQATMARLSFLLVSCLTLLVGIASATSAVIDLLPKNFDDVVLKSGKPALVEFFAPWCGHCKNLAPVYEELAQAFEFAKDKVTVAKVDADEHRDLGKRFGVQGFPTLKWFDGKSDKPEDYKGGRDLESLSAFIAEKTGIKPRGPKKEPSKVEMLTESSWKSTIGGDKNVLVAFTAPWCGRESFHQFFPFSWLCRTDLI

SEQ ID NO: 41376 - protein, 109 aa, A.fumigatus
TITDMFSRLLERKADKSGITDKDNDLFDIAIEDSGKSNSRKRSRGNESGGPSLKRQKKNEKYGFGGKKRHAKSGDAISSGDLRNFSVKKMKGGSKRPGKSKRAAAKGRS

SEQ ID NO: 41377 - protein, 724 aa, A.fumigatus
VGRTGAQYLSMVIHHLVVDLVSWRIILADLEAMLRGENPMANHSTPFQTWCRLQAEYARQYLSPQHAFPTDLPDHYHQDPSVFWGLAGQPNLVRDSRRQVFTLDEHTTRQLLGAANAAFATRTDEVLHAVLLYSFLKVFPHRIAPLTFSEGHGREPWDSAIDLSQTVGWFTTMWPVVAELQQNYSFLEVVCRVKDARRAVPCNGWAYFVSRYLNPSGRQAFQQFHPVELVFNYAGEYQQFNQAGAFFIPDMPEYQGSLDAGEQIQRFGIFEVFASVVRGCLQFQCMYNRYMKHQLEIQKWIESCRQTLIEGCSTLIAAKPSRTLSDFPLLPLTYSTLRELLDVTLPTAGVSVENVEDIYPCSPSQRGMLIAQAKAAHNYNASVTWSIRSRIDSRPNVARLKAAWCEVVKRHAILRTVFVESPWPESYMDQVVLQTVSPEFVFSRGSDSLPQSISSPGQTKWSKGQCQHIMRVWERDNGDILCRLDLSHAIMDRTTLAIIQKDLSLAYDERLLPGRAPLYRDYVSYIYQQDSESARQYWQGYLEGVEPCEFPTLNPVDPSITNEWGNLYRTLEDRRRLEEFCRTHSVTPWNVAGLAWAMVLRSFTRTDSVCFGYVKSGRDLPIDGIAGTAGPVFNPLPCRVHLTERLTARETIGRLQEEYLQSLAHQSFPLSDIHRLAGVTSGVLFNTSVAVQTEVASEAEEAKRSLEFTTVAMEDGTEVSWVEL

SEQ ID NO: 41378 - protein, 1158 aa, A.fumigatus
LAQDDMVITLVPRGGELVLHLRHRSRTLTTDQASTVLATFEKALCSILANAEAPMTSIDVFSDHDKAILWSRNRRVPDAVESCVHELIQKHCVERPHSPAVNAWDGAFTYGQLDELSSRLAVYLAAQGVGPNVVVPLCFEKTRWTPIAMMGVMKAGGAFLLLDPSYPLQRLKDICADIDCRLVVSSTTHEAMSRELASTVVVVGEDRHHWQLENTSHTITMPKVRPADALYVVFTSGSTGKPKGVVIEHRSYCSGALDHIRSYNLTPQSRVLQFSSYAFDISIVEQLSVLIAGGCICVISESQRKNSLGEAATALQANHAMLIPSVARLVRHEDLSTITSLSLAGECMQETDVSYWAQHVRLMNGYGPAECSALSLVQPCVLPHSDPHDIGYPVGSVAWVVDPHDHHKLVPNGAVGELLIEGPIVGRGYINNAEKTAEVFIEPPTWLRTLRGHCTSRLYKTGDLVRANPSGSLSILGRKDRQVKLRGQRLELGEVEANVQHCFPGALDVVADLLPSSRGGKPQLVAMVFQNAERAARIAPESDSKLIAEPSVDFMQSATTAETRLRQTVPNFMVPSMFLPLAQIPRTHSDKVDRNSLLKAVAAMSSIELQAYKASVDAGHCSTRAPSTEEEKKLAEIWADVLKVPVEHIGADDNFLLSGGDSIDAMKAAAFCRAAGMALSVADIFAHPVLSDLAKVAVPKSLNGSSTSHQPFSLSPVDSPKDLHMSLMEQGLVPPGSALADLLPGTQAQQFFIERGTFHSYNFSIRGPLDRCRLQKTCTAILSRHSILRTKFLQYEGRLIQIVLDNLETPFTHYTTDGDLLEFCKSLWERDLAALDGLGRLPCKFTLVSRSEQEHVFTIQISHAQWDGVSIPRLFSDIAAIYNQIPLPSTTHFADYVYHRSSRDERPAFDFWKKYLRGSSMPVPFPATNCQDREHKTQWTFQGIKNPRLPAGITMASLVKAACGFHLCQLLSQNDVVFGHTVNGRNLALDNVEALLGCCLNFIPLRVMLQPSWTVLDLLAHVQEQYTRALPHEHLELRDIFRHSTPWPADTQLSFIVQHQNIELHHNIALDGLQVQYSKFAQFDPLTEVWIFSEPHPDRLEIQVCANTRVLSEDQARALCRRLCDLIEFFSASPDCPLSKVVDHMDRPGLLAEEKVLN

SEQ ID NO: 41379 - protein, 860 aa, A.fumigatus
  UNSURE (381),(385): Identity of amino acid sequences at the above locations are unknown.
DAEGGCAAYALSMICQLVGSSQIDVRTEFDPKVIQAPIMQRIVHHFVYTLQYLLAHPDARVAEIPVVSPGEKQLLRQWNGIVPPASHQCVHEIIQQRQIERPTSTAVWAWDGQLTYAELGELSDRLAEYLATKGVQPEVIVPVCLEKSYWTTVAMLGISKAGGAFALLDPSQPEQRLQSICHQLNSAVILTSEKNRDLAGKLASHPIVLSLQSSRRWGHGPAKQAPATARPDHTLYVAFTSGSTGTPKGVVIEHRSFCTSALALNRITGVNSESRMLQFAGYSFDGSIMEMLSALMAGACVCVPSEFQRRNELVAAAAKFELTHAHLTPSVARHLLRGNPEFTKTLVSVGEPMTASDVADWASNGQCKVMNGYGPAECAVXTTIXAAVTSASDPKNIGFPVAGVCWVVHPENHDILLPPGAVGELLIEGPTLARGYLNEPDKTAAAFIPLPAWIKDIRPEQPHGRLYKSGDLVRYNADGSFQYIGRRDSQIKLRGQRIELDEVEKHVYQCWPGVIAVVAVEMVSFTPATQTLVAFVVVEEHVDTTGDILAAPTQEFTGQVAVAQARLREAIPAFMVPEIFIPLLVLPQSASGKTDRRRLRSIATACTREKLAAYGAVGTGTKREPTSVAEREMQAIWAQALNLPLAEIGMDDSFYQLGGDSITAMQVVAHARSKGLAVTMDSILRLKSISKIMSHESSLSPAIVHIDEEEDVWFALSPIQQMFFDRQPSGWDRFSQVFLLRVSQPVTASQLQMALHTLVSKHPMLRARFAKQHDGSWRQVITSKIQESYRCRSHRLNRRSSVDGVVSSGACSLSIQKGPLIAVDLMSREDGGAVPLHGNPSFSGGSSLMAHHPGRPRGYA

SEQ ID NO: 41380 - protein, 94 aa, A.fumigatus
GIIPTKAQGSLGFSDLKSKVYSILQMNEYSLSLSYDYWQIDMFSFPTLEYSPGAMTTYLVLDCLHQVHGYLSSFDRHLVTALATCISPRSVDLL

SEQ ID NO: 41381 - protein, 60 aa, A.fumigatus
RLIICYDPFAVDAPSWFVSFDSGVKRRYEPRFSYSVLPPYSDDSVALHYYNSLLIKLCMK

SEQ ID NO: 41382 - protein, 64 aa, A.fumigatus
QFAFDRSIGTILRISKSVESLGLQIPWPAATPQDQQRHPESPSDCPPNAPKIAWGLGVIHIVPG

SEQ ID NO: 41383 - protein, 404 aa, A.fumigatus
SILLLIDLDPLVSSANSASCPPPFILIPNDNPDNSHSTVPLVPSYASPKVSNRSASRSPGPQQPPRTNSVTPNPPATALPTLPKLRGAWESSTSSPDNREKESSVYYTTAWGSPYAAPSPRRLSWSLSQFAGIDRASGDSSPASMRSGIHHDPEINNTDLLKPSAAETSARHLYSNLLSHSPGRDLLSRKGGKSIKDFTQDWINQYLSGQPRTERSNWLSDDSGSEAPSFFTAQNHFADDASDDWLGLEEDRPGEDLLRTPTLADFVSRRALAANGENSLGRPKLKDSLHKRTDTLRQEDFWGFAYDKDPQSLTMTELKDTQHSAEMETGKAPSPAEKPLPPPPPADADSEPQSLSHPSESSSTPVPVKKPALDKELPTPTPTPRPRNDTRLAREGLHYCHPCR

SEQ ID NO: 41384 - protein, 1905 aa, A.fumigatus
  UNSURE (137): Identity of amino acid sequences at the above locations are unknown.
KIHNIQRRWRPARRRRRLRSRCLLRLQQTLIASPNHYRTPLRAHPLRYQSKSQPWTRSCLRQRQRPGPGMILVWRGKACIIAIPVDDKRGTEEFGYRLLSVEDVQQRLREWEDEGYDIRGFTVGAPEDLSDLELGGXSRRPFPDSRDVQEEWEAGKYTVSIPDKAEWDAYVSWLQEEKLRALGVSLGDEEMPPSISPASAALSQMAPFPGLIASPPIPTASATSNPLSIPHHFSPHFNQSANVSNGIGSLASPASQFSVQTPFFGVEQNLLPGYLPFQPTPPAQGALTPQGFFNVRQGNVTSTIGGNLPNLTSIMSPVSPLHDQGAFHPGLEELSLPSKDSQHGHSDHGPQEAVPGGTHPRAETPDHFHASNVEIAQPTPRGHSRGHNLSETLQKGLDQVGPSDYHLEESIERQLDEDDREPIRNNLHNSELFHSRWALPDNDHHGMQRVPQHLQQFYGENYVQVHANEGSDIDTNPSLSGAPQGHGSLTNNIPWHEPKPSSGSFVGGHKSKLSTSTLNVEAREFDPSGASTAQNYPPQGSAFQFSGMGGPAFTFEAGANFIPAGGFNVAAPAFNPAGNLGPSTSAQFSAGRAKIFGDIDLSQITKPPKKSKAIPIVRPDDNAQDSKNKANAEDDHGRVSADRHKRVRRGQSLEGDAQYAVPSHPLTETTNAQGSKASNVPRDVPAEGKENEVPGQIAHGLNQKEAVDEEKKSVERNDTPVSEASTWTPFDTKEERADVQPESQEQKQEGDKATQKPAPSVAGAAVNDEGPTKKTAETSAKSSFLKPTAKPFEFKPAVPEFVPTVFEQPTSAPAPAPEKPRNDLMASRYAVASRPASPKRDSVPSESAEPVAHAADDVPTVAADVPEDDLSGPVSEVDSPNDEELNAVMEQLNDGSDVGIERLSTPRPAYQPPESALEPSKEKRHVHADIRSEAPSPSPGRGPVVQALEVPKLDFDADSQASMSPSRGVIGGSHSPVRQLISRNEHISDWDDVISSGEDEKLVNRSRFFDRRVNDLIGSVLEERLLPLERALEAIQESVTMVTAGAHEKWLSRSVSAQIEESDADDEDDEYDEHGSYRARSPFARRDRKLERLKNVILEALATREQQQLPEPTENPELTKLHDMVMELHSLTAQKFSEDPMANLREMMQEVVSSQLVQYQPRPSDAEEIGADSLMLQIDGLKNMLRLTDERAEQEYKLRREAQDSVAELQRLLKLAEEEAARHSEAAESAEARLLQFKEEKIPYFEQIQFRFDTLEQEHATLKLTLAEVSSKNISLEGTLDEYRFSSDNWKRESDQAKSELEKTKAENEKLRGTIDHLKTRIEDGLSIRQNLSEKFDRLQDEMVAVTRDITRDQALWRRREEEHIAKYNELRTAYSREVKLREKLENDISELEQQEREAAKLKFIFGQSQQENARLEELVANLRLENHELQNKAARYEREFNEARETSRTEIQRTRTYLEADLEAANSQVNIVRAELEAQIIRLQSQLDNVRLDTDTARERYELLLEEASETKASALAAAAEAKERAMEEQRRTHERVLNDLRERHARALHNSTEDRQRAESHLMERLALADDKVHHLEDRVKHLEEKLEIANAAARAAAEAAQTVKAESSQSPVAHLTSPSMTFSKNSMVPEKISPQALRESILVLQDQLQQREARIEELEQELSGVDKDAPNKLKEKDTEITWLRELLGVRIDDLQDIINTLSSPSFNQHAVRDAAIRLKANLQMQLQERERAQSGQNFPSLPRLADLAASPRSLPLAAAAAWGNWRKGRENANSASEQTPSKSSNAGSFLSGLLTPPSSNFRQAPSNPGGAATTGWRRSSETRPLSNINTTPRPLSSRQTASLPEPPSTPPLLRRASYDHDAEPADYADASFGEDVESTADGLVSASPKGTEEGPFGPHLTS

SEQ ID NO: 41385 - protein, 151 aa, A.fumigatus
RGCVDPRGRRRLDATSEELSSSRTIRELSKPCPSCEAQTERAGGCKFMRCKQSFFPLWYIRWLMVVQVTYVVRTGVGTVGFGGSRAILRLTVFTRKNRVEYQGSKTSSLSPLDRIVSNFRLTASMPTNIISLISHFSLCNSKLTALNLAHP

SEQ ID NO: 41386 - protein, 771 aa, A.fumigatus
  UNSURE (541): Identity of amino acid sequences at the above locations are unknown.
NALIAHRGILSLSHRTILPFSESAGSSHSLRTENATCRYNGDTVASLAKRIIIPTTAFTTPAEVAERQRDPWSQSGKYGQGWVYFSVILLALATIIRFYHVWSDKMRIALYKEDLAGAMQGNSLQDEYELPSAATDSSTAQFFPAGGPLPGMKKQQSSISTIAPLNNTAAFLRWIFYRPLPVLRIGDLRIVFPSLGTSAVVLAAFVFVTLYTFVPQPLYYSSITVGSPPLAIRAGMIAVAMVPWIVALSTRANFISMLTGFGHERLNVLHRWSGYLCLFLSLVHTIPFFVTPIWEDGALIWYQQYLPRHVWIYGTGLAALVPLVFLCIHSLPALRRRMYELFLFIHMPVSVVFVAMLFWHCKDFLASWNYLWATIAIWVMSYAMRLFYLNWTNPFRMSFMIGEESAVTILPHNAIKVTVATTMRWKPGQYVYLRMPGISLLGRHPFTIASLCSDDFPSEYGENYRDLALVFRPFGGFTRKVLLKAFEYGPYKTWTAFLEGPYGGMRREMAAFDDVIFFAGGSGITAIASQLLDLIKKMRDXKAFTKRVRVIWALRSPEAIEWFREELRICREHAPPNTVHCHFFLTGPAQDGPGEQPGHDIVQEKIYNVLSGMDKRNSAYIREEAAGDLEREKELRRENEDAITSLPRIYTSPVIGSRQFTALPGLQSGPGNVPFDFGFSNAPSPPQKQTPRFASLPLQRRDGWRIDHVRPDIPRMLTEYSQTFGRRTCVFVCGPPSMRIEVTKTVAHLQQQVMMDSRRDEIFLHAENYNI

SEQ ID NO: 41387 - protein, 304 aa, A.fumigatus
PGQTCDILNETFYNIIHDIVAQVHRDEKVARMRSAVVVARQKAEEEVARRREDAGGKATGSVDSEDLKGIRVETDGAVFEDGKVYLKGNPLQTTKEIICPDCRLPRLLYPVTGVGARPPPDPYREYCQNQPLITKPGHDVHGNPFATDKLNPKKKKQTNASNTPASSPPTTPDSSFNKTQEKVSYPTVKCPNCPRYFVVTRVAQHLDRCMGLSGRQANRNKTPMENGNGSPSTGPPKRPLADDDAPPTLTKKKKLNTHKKLSGKKPPLPPSSKLRNGLTPDMAAAADAAASGDVDVKREAKDNA

SEQ ID NO: 41388 - protein, 204 aa, A.fumigatus
ILGQRAGAKRGKKAKAPLHSAGPVRRPENFGNVAGGYRKEDQDEEYMSAGTARQVRQDTAALRSKGSASSLQVPQRQSALSSLESSAASSRTQSPAPRSSGTPKNPPSASGPVLSDLLPNVKSKAAKPSTRQQGGGSSSKGALTTNNISDLTAAIAALEVSTNPTLGNGRQKCNCYATIHPLFEPAPNCRLLPQGGRRISAMRI

SEQ ID NO: 41389 - protein, 68 aa, A.fumigatus
IHGSRSLAACIFTTPGYFFFGFLPGNNHRGAHASDFFIAMNLSNDIMDDVVECLIENVAGLTWSANVL

SEQ ID NO: 41390 - protein, 387 aa, A.fumigatus
ILIFLAMAYQFFAKAHQSNKAPSSPPLSPPASSPSPRHSRPPMQPPSLLVLPQSSSPSATPNIASRLKPPAARDPLFQPPAYPHAISPGYQTPHPHVTIDPVSTAHIPSLTRITGLLLPIRYPNSFYTATITDPVIASVSRVAIYHDHPVAAAPSTTPSPAASGLGASTGTDKVIGGIRCRLERLSVGSETSSHSQKPEPTNLYIQTLHLLSPYRCCGIAASLLNSILFASPPSPSSSSSSSSFSSYNVSELVKHYNIRTVTAHVHEANEEGLRWYIARGFQVQEGLVENYYRRLKPSGAKIVKLVLQWSDDDGSDADGTSQSGSEQAQPGQNDARDQDEDDDWEKVEAEDSDDPDAQGVQFTESRILEGGDGPPRKRKADDEPQRH

SEQ ID NO: 41391 - protein, 62 aa, A.fumigatus
MLLRTINGISTSGFQPMPCNLCDLSDFLAEFLTRHGSTVIGTGAFNRTPFLLRRLKLLSDLF

SEQ ID NO: 41392 - protein, 63 aa, A.fumigatus
NPQNRCMSTPKKLSGVLLQGSKSLEFRSRSIWALKPNCPYKKFFLPSTTLLAKNNFSPSFSPF

SEQ ID NO: 41393 - protein, 70 aa, A.fumigatus
AAETSFFTSIHLRDDSSHQFSFNKALTSLVVILIPSSKVTESIELPGPQYHNNRYHVWRRNGATPASLRR

SEQ ID NO: 41394 - protein, 608 aa, A.fumigatus
TAYDSLRTVGSLLLTNADFRLFVEDLTTVGREIFSETALALSDTSKQVGEKLKPSEEERGAVKGAGADDGRAVSGEELRKEVTQVAEVAGHGLKATGRDAIDSAKEHLTGQERDTLLHRLKRAVIKLRERSDYSDSVATLSHLVQRYAQLYANAASEVVSTAEEEADVNEDLQQAMEQLWKLLQSYGDVEEWKKLEERFKDVIKHANKDPEFEKIMSEIGSALQEMLTDPKFFDKAPQKVDELKEKSKNVGTETTLRRDVDAFLVQAKRTLRTVPEDTQVSKLVDVTRKIYWDAWNGYQDRKSQLPSDMAEIFFPVIIRSIQYIPIPRLEISAPEMDLLIENLILEPGHTVNFSSFLPYRMHLTTRNDIDVLKKHSKRTSTDLKTTFTATVFGLNISASEFGYWIRTHAWPLFRIKDEGIASFYLDRRGIDISLDVEVGRERLEQIFTLRGVRVRIHKLDYKIHKSKWKFLLWLTKPFLKHLVRRVLEKKIAESIVQAAFALNRELVFARERLRAARIASPQDLATFVRAVLARLRLPESDVETRVGFRAPRSGAFKDVYAPGSIVKVWQEEGLRAQEAIEEGDQSQCLGRTWRNEIFDVVGRSWGST

SEQ ID NO: 41395 - protein, 280 aa, A.fumigatus
ALPLRDFYTGREIRFGIEKQQICDACEGTGSADRQVVTCPKCNGRGRVIQKHMLAPGMYQQVQMTCDACHGQGKTIKKPCPVCAGQRVVRREVETVATVEPGMDKGTRLVFENEGDESPDWVAGDLILVLEEKEPELAADEARRTDGTFFRRKGRHLFWREVLSLREAWMGDWTRNITHLDGHVVQLSRKRGEVVQPLSVETVKGEGMPFYSEGHLHEHHDHDSEPGNLYVEYTVILPDQMESGMEKDFWAMWEKWRKKHGVDLGKDSGRPIPLEGKDEL

SEQ ID NO: 41396 - protein, 144 aa, A.fumigatus
DRLLRKVDFINYKSDGGHREHQIRQRYHLQNDTDYKSYNALAGSLRQLAHKLSQLDPDSDPLRKKIESEVLDKLWRMGLLKQSREQGAGLSRVEREVTVSAFCRRRLAVVMVRTGMVETIKAVCFSTLFFLSFGLKKKKKRGGC

SEQ ID NO: 41397 - protein, 118 aa, A.fumigatus
HIVIKMVPPLKYYEKKSGSVNSPFLFTPTPRKQVSNNNEIDSSERSTSSTTNPTAATANTKSGNATTSKTTQTTSPTTRSPAPSASSPTSSPSSTRTRIRCARRSSPRCWISCGGWDC

SEQ ID NO: 41398 - protein, 87 aa, A.fumigatus
QYTTLALTIEGRPRPIATCKRSCDAACVPIITMRLITILLVIALCLVLALAKEDYYKILGLDRSASERDIKRAYRTLSKKFHPDKNP

SEQ ID NO: 41399 - protein, 112 aa, A.fumigatus
RERFMGSFKYDGRGDETARERFVEIADAYDVLSTPATRKIYDQYGHEGIEQHRQGGTAGRPANDPFDLFSRFFGGGGHFGHAPGHRRGPDMEMRVGAAAAGFLHGAGDPVWD

SEQ ID NO: 41400 - protein, 84 aa, A.fumigatus
REYVIAEHDAFADEPWIIKLTNYTRELYEKHKKPIIGICFGHQIIARALGARVGRSDRGWEIAVEPIILTDTGRVLFSKNVLVS

SEQ ID NO: 41401 - protein, 111 aa, A.fumigatus
WQLRKNHLLSPKSSISLSLMARLLRAAILECDTPIQPVKDRYGTYGDLFENLLKASLKAQGLDPQVDLQITKWDVVNGSVYPEPDDCDAILLTGSSTVSLAGPSATANVNM

SEQ ID NO: 41402 - protein, 161 aa, A.fumigatus
QAQYPYLITINTLVPALLAGNTVILRPSPQTPLIGERLLSYFTQAGLPPNVLQLIHVGSLDVLDEIVKLPQIKLVSFTGSTAGGVRIREATARRIVPVNLELGGKDPAYVRADADIPYVAAQIVDGAVFNSGQSCCSIERVYVHADVHDDFVAEVQKELQT

SEQ ID NO: 41403 - protein, 103 aa, A.fumigatus
  UNSURE (103): Identity of amino acid sequences at the above locations are unknown.
SLHQMHRDIAYEVPEGCVNLGSSAICEIHGLYRAGRIFSVQGHPEYDEFVVSKLIETRHAMGVFDDQLSKDGLSRAGKPHDGLVVGEAICKFLLDDPGVNRVX

SEQ ID NO: 41404 - protein, 265 aa, A.fumigatus
TVNRQVDCETIHHHIFNPTKMANQIRTLSPSTNEVIFEHQGTSLEEARKIAQASYEAFKLYKKITLSERKDIIVKALELIAANIDTLSNELTTQMGRPIAYSAKEIETMRKRADYLLSIAEDSLQEHPGQLEKGFRRSVKKEPVGPTLIATAWNVRSVRTSPHFRISNRHSTPTSLRSTRSFQPSWPETRSSSVPPRKPPSSANASSHTSPKPVCRPTSSNSSTLAPWTSSTRSSSSPKSSLSRSPAPQQAASASVKRLPAALSQ

SEQ ID NO: 41405 - protein, 168 aa, A.fumigatus
PNTCNDNARYKLGDPTDNSTTTGPVISRHAVKTIQSHIDDALSKGAINATPPNESFLSVPSQKPQGNYIAPTVLTNVTHDMTVMKDETFGPVLPIMKVSSDEEAVALMNDSEYGLTASVWTRDIARGEELIAEIEAGTVFINRCDYPSPVCTSPQFSFQKKKSGFTGC

SEQ ID NO: 41406 - protein, 231 aa, A.fumigatus
SDTMVGRLAGKNAIVTGAAGYVYHVPELCLVDQGQREQLTRNDSGIGLETTILMLREGASVLMTDISAAGLERAIAKVHEVVPQHDGRVEYRVVDVSKESEVEAAVAHLDAWGGLDVMFNNAGIMHPKGWRLGGDTGGNLGLDNEYQCQGGVVRVETRGQEPAQTRQEEGSIINTASMVALVGAATPQLAYTASKGAVLAMTRELAIVHAREGFRFNSLCPAPLKYVILIP

SEQ ID NO: 41407 - protein, 88 aa, A.fumigatus
SWVKANGFSTPLLQDWLGDDKEKRFRREVHFPTGRFGEAIEQAHAVIFLASDESSFVNAADFVVDGGLTKAYVTPEGPATEAPKNLGS

SEQ ID NO: 41408 - protein, 296 aa, A.fumigatus
SRPLVLLPTFLVVMPLNKRPRTEPIVRVRTGCWTCRRRKKKCDENRPVCGGCTRNKLSCHWPAHVSSRPVENDRGAIPVQTDQHSRGSGQMDEENIIIPHGSPQSVRSSISHGASSHSPFSPAVSPTSPAQSVCLPTVSPTGAIGLEDLDAASLVPMGYSHPRSNSQASIRDVMPRSLSMLPGYSPESYQLLSHYLATTADCMANGSTPVNPFLVQIVPLAFTSDLLLQLVLTQSAAHRAFRCRNDSDEVAQSHYTKALQLFRKGVTDFIDGKESNPLMLTVGALLMCFTEVGGLS

SEQ ID NO: 41409 - protein, 217 aa, A.fumigatus
CHWPMAIFPRSCGPMMRAQSGMSSKLHNKHRCRSTFKKLFETFFLVSIIFLLISGLILLNMSQDTITVEDLPALLEHDISVKVAGIDCDGILRGKVMAKEKFLGIAQKGFGFSSAVFGWDMQDVLYTTDAKIAPPESGYVDFIAVPDLSSYRRIPWEDNIPFFLVRFVQNEKPVAADGRSMLRAITDKLAEANCQAMAGGKFPGIGPSVSANECSGT

SEQ ID NO: 41410 - protein, 199 aa, A.fumigatus
CTYRTRIVTPIDEHGPGLNLRDQLLSARDIPRPHASSQPVLAIVHERNRLFVTGDLHDGEHGAEGLVFHDGHVVRDVREHSGGDVVPLGFLRGDRKEGFIGGSCVDGPLGECVVDVRLDSFHCVAGNDGAGGCGVVGWIAKFVPSVVIAGVRLLFRCGVRTRESLRLTSEAPSAPPRQNHRGRPRGHIPVRWSSSSAPS

SEQ ID NO: 41411 - protein, 160 aa, A.fumigatus
RKRIARPWLEVSFLVSARVCQLMSVVELEFMNFQTPSQDGYSNGSQTRDIAAFLERNAPSALRPMTAGSFSYSATRPVAFKKYFWDIFNTSARFNCGIEGWHTEGGPGVYEAVSELHFYDRNVANQPRPSKCVMLPKWQTGCPCLSKSSSRPFVAQTLIC

SEQ ID NO: 41412 - protein, 314 aa, A.fumigatus
RPAGGDTFGMDNDNFNQVPANVSTIADLFDTKNIAWGEYQEHLPYPGYQGFRYPESGPNDYVRKHNPAILFDSVTQDATRLRQIKNFTSFYDDLKNHRLPQHMFITPNMTNDAHDTNITFAATWSWNFLSELLENDYFTKDTLILLTFDENGTYKLGNKIYSILLGGAVPKHLIGKEDNTYYNHYSVIASLSANWGLPSLGRWDCGANLLSFIAEKTGYVNWEVDTSNLYLNHSYPGPLSTSSHTPNWPVPLTKGSCSAGHGILKAVRKTYKDMAPTYNYTSPVPYDAASKTNVGVKYTRKLVSLLDQSLTHEY

SEQ ID NO: 41413 - protein, 165 aa, A.fumigatus
PVSSPTYPLSRGFCPNGSSWYVCLLFDSFVNKTPTKSQLTVLAEQVSVVSAINSLQCYRSDEYAAQLYNARTADGRSFATPLSSRTFGTWTFLSAVVRMYAAYHITTPAVYDLAVWSFGLALAHFVGEWLAFGSAQLKGRFVSPLIVASVTLTWMLTQREAYLSA

SEQ ID NO: 41414 - protein, 285 aa, A.fumigatus
TRPTDCGRRGPADHGDLVYCFASFDICQGALESVCASRETGTFDIIMLLLSKVNSRTDSSQLRSFGPKGSWAVVTGASDGLGKEFSLQLARAGFNIVLVSRTASKLTTLAEEITTKHSVQTKTLAMDYAANNDADYEELKAIVDGLDVAVLINNVGKSHDIPTPFALTPEDEMTDIVTINCLGTLRTTQLIIPGMMQRKRGLVLTMGSFGGLLPTPLLATYSGSKAFLQQWSTSLGSELEPYGITVELVQAYLITSAMSKVRRTSATIPDPRAFVKAVLSLGLAT

SEQ ID NO: 41415 - protein, 70 aa, A.fumigatus
TISLHSFPCSFPFVFYFFKVAWSVQSFVGKFSQLATMVESVLDDISHRRFNPLRGSYVLVSPHRTKRPWQ

SEQ ID NO: 41416 - protein, 119 aa, A.fumigatus
EREGPAGRGHRRDHQTVRQPLRNALSLQHGHPPGAARGHRRGDRSFVPAPAFLPSAAAQRNRAEILGRVGPLQFAPLTYTLTNPSYEMMAEPQRDITPEQAAARLRACGGELYRKKMDA

SEQ ID NO: 41417 - protein, 100 aa, A.fumigatus
FLLTGLSALGSKLKKIFLGDDTSLISDPVNRGQQESPSKTTLPAYDPACYLCPGNKRAQGDTNPKYEKTFVFVNDYSAVKEEQAPYSPESGDSAFSNSET

SEQ ID NO: 41418 - protein, 261 aa, A.fumigatus
CAILLGVESFFLKAEPVTGKCYVLTFSAAHNLTLADLSPAEIIPVIDAWTEIYSAHLSPKSPLAAVAPATTLPPNSPIANMAKPKEQYRYMQIFENKGAAMGCSNPHPHGQVWTTSSLPEEPAMELEQMKKYRREHQNKHLLEDYAALESRKQERVVFENQAFLVVCPWWATWPFETMIVSKKHKRALVDLNENEKAQLAEAIAEITRRYDNLFETHFPYSMGIHQAPLEGTDEEIEASYLHLHFYPPLLRSATVRKFLVG

SEQ ID NO: 41419 - protein, 272 aa, A.fumigatus
VPTSHTHMVRTDWQLDFTPSNILLKFEGLDGLPEDEVLKVLGEPVKVEVFTESGETPSDPTAPKYLVRPVKFRNVPLPYVVDEILVIDFGESYDVTNPPQELGIPGSYRSPELVLKNTPGFGSDLWALGCTLFEIRTGRKLFDMFDDDDDSYLFHMVEMLGALPEPWWSTTWTHRKEFFKDEADSLGRAVLVDALAREKSNLSVESPSIDLALRRGLHYWDLGPGEEFSREIPPDEIEQLADLLKKMLPYVPNRRLTATEVLEYEWFRRDEN

SEQ ID NO: 41420 - protein, 69 aa, A.fumigatus
CKQRFDPHWLARGTEVPSVTVYFCSSSTTGVIICVMNIAAVNDKSPAGYDRLMLASTNTEVLKTRILAG

SEQ ID NO: 41421 - protein, 133 aa, A.fumigatus
AVGGFANVWLCQVLRNGVPHYVALKILMADYSKDDCPELRVERLRAVGLEKHICLPFDHFRIEGPNGSHLCFVYPVAGPRVSLIAHEFEDQDRSLRKMARQATEVMAALHSHGICHGGKFPQATLTWLELTGS

SEQ ID NO: 41422 - protein, 181 aa, A.fumigatus
SEPVSFLPVCAPSPAIQFLALTATASTVLKGAGSVGLALFYWVIGFLMAGSSLAVYLEFSSYFPSRSGSEVVYLEQAYPRPKYFLPTVFAMQSVLFSFSSSNAIGMCTGSWENISDRLVLAQYLFRLAEAQSTPWKLKGVAVASYSVAVLGEIAFFIVVRMLTVQSWHSTLKSSPRRENPR

SEQ ID NO: 41423 - protein, 138 aa, A.fumigatus
AMEGYGNALLRRRHYSVCQHSPSHNDETNNQSRVFKNAERVRTCNSLVTKTPGMFASVNNITDPATGDVTGYISNTGVPSISFLPQQELDVITPYSVFPTVLFDKGVGLAWWRNMVVAKKMQSNLPPALTSRSILIKA

SEQ ID NO: 41424 - protein, 246 aa, A.fumigatus
VDACRPIPVVNTRAAALYNREFRSVQQGKIGISLNGDYYEPWNAEDERDHAAAERRMEFHIGWFANPVFLARDYPACMREQLGARLPKFSPSDFALLREAESDFYGMNYYTSQFARHRDQPASETDYIGNVDELQENSKGTSVGEPSGIHWLRSCPDKFRKHLTRVYRLYGKPIFITENGCPCPGEDRMTCEESVNDMYRIRYFEDHLEAVGLSVNQDGADIRGYFAWSLLDNLGEFLAKIEENIG

SEQ ID NO: 41425 - protein, 62 aa, A.fumigatus
LYLAEWSDGYGPRFGVTFTDYQTLKRTPKKSALLLRRIFEERIGISTKGQAPSAPGVFRAEL

SEQ ID NO: 41426 - protein, 114 aa, A.fumigatus
RLKLSMRVSKLSYLALSWTALTDALPQKPNEPSCRFARQYTQREIVKDPSNFISDLLYWEGKFHQNNVSYNSGNGMSYDGTNIDFTTGESTVKHPFSAASKEVSHLQACCCRCC

SEQ ID NO: 41427 - protein, 106 aa, A.fumigatus
HLKIFYEGKGQVCAVTTIKNQSLPVDHPDQGYACEGSGRLNDPYEGELFTFWLQFFGGLSDEDVEQLWAVKKPMLQSVDYHMGHVGPITVQKGTSVDAGKGSPAHG

SEQ ID NO: 41428 - protein, 83 aa, A.fumigatus
INTNKSIDPYGSTESTRVDGKGVSALLTWDSKVTTVAALLGGVTDLVRQRMKAEGIYEEFISYAEVCHVLFNMPCPLLMGSLY

SEQ ID NO: 41429 - protein, 126 aa, A.fumigatus
GSLPVVNKVDTDFYLALLMQSYFLNNPIGRTRWQAFSRFVPGFIVFDHLADGRSTPAGAINAANKNHTWGQLALRTAEKIMGQAALFAHNPRKENLVHLKPDQVVGEWRDSTYGMPLQTSKLQPPF

SEQ ID NO: 41430 - protein, 638 aa, A.fumigatus
AIVNQACIRRLAPVARSIGLTDNCPKCDGEAALSTCTSCRRAGEHCTFDLPVGRRGPKSNKSRRHASLSADAHGQNVTLSSSLHTGQPVTTLQFSTVSPTPGPVVSLNPRTPRPSSLTSSPSWNTGLVDPALSLPEEQPSLSSLQRWHQLAGALHLRDPAADLEQTVNRCFDLFFEYLFPLIPLVHEPSLRDGLRFFVSQAARSGIGVTGPELWSSFVRGNPIGADSILDRANSLKYPELWPDSTFTLITAVCAEAAFLLPKDIFPEGERIADLFLKASRSCLHGYLEEDLEYPNANSVAIRYFHSNCLHAAGKPRFSWHIFGEATRLAQVMQMHDEMSLQNLSAVEAELRRRAFWIVYIGDKSAAILNNRPITIHKFSFDTGITTAYPSGIEDGTGVSSPSGTEPDLSPRMSFIAGFNANLRLWQTASDLILEMRLLESQKEVGMLTPRLLTVEERHRLGNLYVSFITSLDKLPQYLQTDTLLAPTNNNNISSHRRKQYVIQWANLNVSLHCLRLVIDQKLEDLGYYASGIEHPDMPLLRKTEIARDMLRVIREAPFWSLQVNGEPCVCFYCLFICCILLKAPQVEKIRLIGASLLEIIDQYEASPLSVRARNDLSILLDILTRLDSKASDTLRRPS

SEQ ID NO: 41431 - protein, 228 aa, A.fumigatus
VTVPAETAKQRLTSYTQAGYFPGPSAGESIDSDVVFHALALDGYNNLSQVQVMNSDDCFRHFLLNTTNQQQLTSFINQTATNIRRTFPAGLNTPVGMLIANPAFGPNEVYARNWTTGAYHGTVVWSWQLAMMAKGLERQLGRCDAGHQHAQPDFCADKVVYNNLRTAYNTLWDGIETNQALLSEEVWSFVYSDGRFNPAPLGNIPPPPGVGAQTGKPREPILLYLKRL

SEQ ID NO: 41432 - protein, 61 aa, A.fumigatus
WSTLDGIHIDMNHLNTGEVKYVFELLLILVLSNKLLTTVLLQPRYLDVNELISHCRFWLVY

SEQ ID NO: 41433 - protein, 121 aa, A.fumigatus
NSRNLLTGFDGSAGIIIAGYDPRHGGQVYSIPLGGSLHKQPYAIGGSGSTYIYGYCDAHWKENMTEEEGIKFVRDALQEAIKWDGSSGGVIRLVVLTSRGSERHLYLPDTEYTGPGLTNRS

SEQ ID NO: 41434 - protein, 514 aa, A.fumigatus
  UNSURE (350): Identity of amino acid sequences at the above locations are unknown.
IFVHNRIVINLSLLLSPSSPLSPSLAIETRCPDVPHFACSQCFLEADCCSATVALGFAITRAISFQSRPLFSLRLDMGSVVLNQPRSDRIDSSYTMLGGSINPSESVYRTSSHHTSSQLETGSSRSTSATTTPTSSTAPPSTSAAGSARLHSHPPPYDVPAYISRQSHINSVPSTRASSTTPGPTRTPPHSVSMSSTTSNNAHHPEASFQSTPYTSNRFGHASQTATEPTLVASYSHSSPASPRLRPTFQSLRSLGGSEASSPSRIKVRDLTHIQSFASEEFLAKSQRSQAPGSWYQERQYEISSMPVTDIIEMVAGLLTKITTTNDLHHEHVHRHIPPPDSTANLSPQXTSVLAFHGKNVPSITILSYLTRIHKYCPTTYEVFLSLLVYFDRMTELVNKCQLERLQRHWDRGATVHTDPSRSRFSDSSIGHHTQASPMVTPPSSAGIPAQDPKSPSCISPSLYPQDENESLAHFFVVDSFNIHRLVIAGVTCASKFFSDVFYTNSRYAKVRYP

SEQ ID NO: 41435 - protein, 118 aa, A.fumigatus
ADFTLQILAGILIAYSMAINFKDGVILGADSRTTTGAYIANRVTDKLTQVHDTIWCCRSGSAADTQAVADIVSYHLNMYGIVNNEPPSTQVAAALFQELCYENKDMLRLIIPPSLLIE

SEQ ID NO: 41436 - protein, 68 aa, A.fumigatus
VLGWPLHSIITTDECFPRSDHIYETQQYQAEAAFLLPEGSVFYFFCRAKVPFCSPREFACTMTWNWRW

SEQ ID NO: 41437 - protein, 213 aa, A.fumigatus
  UNSURE (203): Identity of amino acid sequences at the above locations are unknown.
QQVSIHSIKANIHMVELTSNVHGHLLDLGAVELLDLTHHADIVSSDEVDGNTLTTETTTTTDTVNVVLTVGGQVVVDDQGNLLNVDTTSQKIGGDQDTGRTRAELLHDNITLGLLHITVHGGDSEVTGSQLISEPVDLAAGVAEDDSLGDGDSLVEIGQGVELPLFLLDGDVELLDTFQGEFLLLHQDTDGVAHELGVTSRTXLGMVANSRTT

SEQ ID NO: 41438 - protein, 401 aa, A.fumigatus
EAIFRSPPSWFTWRGTWRSTYLNIPPSKVAILDCSSLFSDALHRPFYCTHISLDTYVSNIPSRNQITRLPDLSPEEFQAEWSSKPFILTQPVKQWPAYKNWSVDSLLAKYGDTVFRAEAVDWKLSTYVDYMRNNADESPLYLFDRAFVSKMGLKVGPPEEEPDATYWPPPCFGEDFFSVLGNDRPDRQWLIIGPERSGSTFHKDPNATSAWNAVIRGSKYWIMFPSSSKLPPPPGVFVSDDQSEVTSPLSIAEWLLCFHAEARRTPGCIEGICGEGEILHVPSGWWHLVVNLEPSIAITQNFTPRAHLTATLDFLSNKANQVSGFRKDVHNPYERFVENMRKTHPELLQQALDELQKKSDGRKRKWDELVHGKVAQEDAGDASEGGGFSFGFGDDSDIEVP

SEQ ID NO: 41439 - protein, 146 aa, A.fumigatus
SSYQANSSPLNLTGGTSKTRQKKKGLPWSIAKGFDTFLPISEEIPKARIPDPHNAFLRLSVGSQLRQADSTGLMLYRIPRQLAEISRVMTLEKGDLVLTGTPKGVGEVKAGDVMKASIEVDGKEIEEGRIEVEVKDREGRYVYSET

SEQ ID NO: 41440 - protein, 99 aa, A.fumigatus
TLLLSPKPSPNLIQNLPLYRLPQFSQSRLLPAFPFDTIEALSQVAILTLNDIKPTRHPLQPSFKSVRDVLQPLGAYIVIGVGCLCLFSYFIQLLLQFSD

SEQ ID NO: 41441 - protein, 70 aa, A.fumigatus
MPDITSLQSHPLEETDSHSFSPDDSFQEDLTGHDAIPCHPARRKSRVATLFLPMRISVMRLGRSIFCRMS

SEQ ID NO: 41442 - protein, 171 aa, A.fumigatus
  UNSURE (155),(156): Identity of amino acid sequences at the above locations are unknown.
QVLTISSQVSTPTVSSVPLLSSSVLSFPSSRVGLPITAYESTVINLGITGNDVIAQAQSGTGKTATFSISALQKLDPNVKGCQALILAPTRELAQQIQKVVVAIGDFMNIECHACIGGTNVREEHEALQEGPKVVVGTPGRVKDMIQRRVLRPTXXKMFILDEANEMLSVS

SEQ ID NO: 41443 - protein, 192 aa, A.fumigatus
GYTKFMRDPVRILVKKQELTLEGIKQFYIAVEKEEWKLDTLSDLYETVTITQAVIFCNTRRKVDWLTDKLTARDFTVSAMHGDMEQAQRDVIMKEFRSGSSRVLIATDLLARGIDVQQVSLVINYDLPANRENYIHRIGRGGRFGRKGVAINFVTADDVRMMREIEQFYSTQIEEMPMNVAGKFNHVDISLD

SEQ ID NO: 41444 - protein, 84 aa, A.fumigatus
SARHDLRGTGTFRATNAIWSIIIAIARVLPLCSVTFLAVPRAVTARPANMTSSVDAKLLKQTKFPPEFNRKVDMKKVNIEVMKK

SEQ ID NO: 41445 - protein, 92 aa, A.fumigatus
PDIKSLQIQLTGFLDKDTPKFCKDLWSLCLSAQENPQGVPKELLEAKKLELIQEKVALIHCLNGFKPGADTVSARSRPRKQRKKPAARGSKS

SEQ ID NO: 41446 - protein, 64 aa, A.fumigatus
AASDFAIRPQDENLILTFPPVRAGAVGLQDRPVPLPPALVPFPHLDRHPVDAYLAETDTNVAAP

SEQ ID NO: 41447 - protein, 64 aa, A.fumigatus
  UNSURE (5),(10),(30),(47): Identity of amino acid sequences at the above locations are unknown.
VSFVXTCFAXHLFYAGIQRGFTEQIYDIFXLLPQSTQVVLLFATMPXDVLEVTPSSCATPSVSW

SEQ ID NO: 41448 - protein, 69 aa, A.fumigatus
EISLVRVVVLVSKSISKGLSLLSDLCDYNPHWDLLSLRKLPSSQPTPHCFIDRSFSPVITTYFSRNHGF

SEQ ID NO: 41449 - protein, 70 aa, A.fumigatus
DHRLLRCYGPEARASSRYVSLVSTRWRGMCVASIDDIFPGVYAYGFERPSAIQQRAILPIIKGRSSYYGL

SEQ ID NO: 41450 - protein, 182 aa, A.fumigatus
  UNSURE (158): Identity of amino acid sequences at the above locations are unknown.
IAAEKAAEEARRKREQELARERELEEIRRRERFDRNRGRRGGGRGGRDFDRRPYRDNRSPPRRLSRERFRDPPSRREFDSYVPSGSRRGRRPSRSPSASPSRSRSVSSSRSPPRRRLPSRDRYKRRRSVSGSVSPERGDYRRPRRRNPDYGDRARCIXRSDSSRSRTRRRSSPRGWKDREGL

SEQ ID NO: 41451 - protein, 89 aa, A.fumigatus
IGVTCQDRHKAQPHLANCLDYKKVLPNWVNRYNPGAQRSKNSISIRKVSDVQGASMSTVYCRTNTLDSINQPEYQSQHTTICTSKPVMR

SEQ ID NO: 41452 - protein, 62 aa, A.fumigatus
AVADLRHKYVKNQAAYNTRATDVLSTMGLTRAEYRVQSHLLPCPSLCARVRPANSPCSSGFA

SEQ ID NO: 41453 - protein, 86 aa, A.fumigatus
MWLGFVTILTGNSYLCYFVVGWDIYLVFTPGSRHTSVYYAQLHGHLDRSRSVLLLILSNLFMPMPLTAGIKIYSVSADQSKNEAPK

SEQ ID NO: 41454 - protein, 318 aa, A.fumigatus
QMLNDASLFSLWRGDMMSGLETIAATNIPRSLSTTLPCPPKFWGFSMDEFAFYDIPDSITYILNATGQASLSYIGFSQGTAQAFATLSIHPLLNQQIDVFVALAPAMAPSGLRNRIVDSLMKASPNFLFLLFGRRSILSSTTMWQTILYPPIFVRIIDTSLSILFGWEGKNISWYQKLAGYLHLYSFTSTKSVVHWFQIMRHRTFQMYDDEVHAPFSVVASQRFYKPVKYPTRNIKTPIVLLYGGSDSLIDIGAMLRELPRGTVAKSIPCYEHLDFLWARDVDQQVFGHVFEALERYGPGEYSGKKGHRAAKPTNGLI

SEQ ID NO: 41455 - protein, 61 aa, A.fumigatus
VASLGLHLYTPVISLTFPPPGVSEGFPVKVNLNVTDEFPSVMINLAFPWFSCRRLFPILTV

SEQ ID NO: 41456 - protein, 274 aa, A.fumigatus
TCPYALLCTSQLTSWPGYGPSLTPKNIIDFMNKDGNVLLALSGKSTTASAISSLLLELDLHLPVDRSSVTVDHFNYDTLSASDKHDVLLLHRPGKLRSDTKAFLDGEGVVAFPRAVPHTLGDANPLIAPILRAPATAYSYNPKEDASSVEDVAATGSQLALVSAMQARNSARFTLLGSVESLQDQWFSATVKAPGDGKQMKTVNQEFAKQLTAWTFKETGVLKVGKIEHHLAEDGEITPEKLNPKIYRVKNETVSDSHLRFHCLFACSPFSTGL

SEQ ID NO: 41457 - protein, 154 aa, A.fumigatus
GSIAYLHAHPSQQVFSIELSEYNYDRYAPFEVPTGDAVQLEFTMLSPFHRLNLEPVRRTDNSTVYSTRFTTPDQHGIFSFRVNYKRPFLTNIEEKLEVTVRHFAHNEYPRSWKISGGWVWIAGLWSVIAGFLVFVVAWLYSAPSAAALNTKKTQ

SEQ ID NO: 41458 - protein, 171 aa, A.fumigatus
PEAAEPIIEFCHDRSKALFNLLSPGERLYKRGKEEQIAAQVAQASNFADICAIFGYEAEEHIVQTKDGFLIGLHRLAYRRGEEGRLVNRGEGTLEKKVVYLHHGLLMCSEVWVCLTDAQRCLPFQLVERGYDVWLGNNRGNKYSKKSIHHSPLSAQVLGLFDGRVCVLRYP

SEQ ID NO: 41459 - protein, 62 aa, A.fumigatus
AWRLSPGDALAQCLQESDCIMVQRHTPRECLSTPLVDELPMKCQQLRKGFSECKWVERICVL

SEQ ID NO: 41460 - protein, 65 aa, A.fumigatus
VVLSLLTPIGALPRSTFHIPSTTLTYNVTYLDANEPGDFLQEMHWRNACKNQIASWSSGTPRVNA

SEQ ID NO: 41461 - protein, 122 aa, A.fumigatus
ILDPIHLSRSQLSIKSRKNPSEPSTFRLITMTTPQFWSTPLRYLRWASHEKPAIFYSLVVGATGPLMLVTLPPIRRFFGDVDPEPIPLTYPRKAPIFFFSFSCSPCSLICVLCLSHANIFIP

SEQ ID NO: 41462 - protein, 67 aa, A.fumigatus
DYITVQTTHIRFSRIPSERLKYVCDSHIKYEPWATINSSTSACQACDNARCNYITIYIHTYKWRENS

SEQ ID NO: 41463 - protein, 156 aa, A.fumigatus
IFTMGDRSRSRSPRRRYDEDRSRPRRTGGGFRWKDKRHEGDRLGAEDSRLSRGYRDRGDRPRSPRRDRDSDRYRDSYRDGDRERRRPDDNQKDERREKKEKPEKKAVVAPQSSEPMIVGHVTDRLGTKGCNTMPGIRSYQFVSYAVSHLPNVVTLD

SEQ ID NO: 41464 - protein, 664 aa, A.fumigatus
RKQYTSPSIVRGMWRTPGRPLSTLSRITDSIAVRIHCRYPHTRSVKRGRAKANTMPGPADAPPEGQPDYSTWTTPSLIARITELERQLHSRNTEYATLPSKGVNEVGVTSSAPRPSEHPVTDTQELVPAKAGKQKRPLSPDDDITHTRAPTRPPKQPREIDPSKYNTRFIALKFAYLGQRYNGLEHANGNVTPLPTIEEELWKAMRRTRLIFPKNAEAFDDSRGPRELKPYAISWEGCDYSKAGRTDRGVSAFGQVIGIRVRSARPKRPDAETTSDVEMTSGGHADDTWDDIADEIPYISILNRVLPDDIRILAWCPNPPPGFDARFSCRERQYKYFFTQPAFSPTPGPLGFAMRGSGDKNASTHLREGWLDIDAMREAARYFEGVHDFRNFCKLDTSKQIENFERIIYHADIELLDPKDHPLGYVNQPGFQALQDAPARTSSESGTFTSPAAAKVYVFNLHGSAFLWHQVRHMVSILFLVGQGLEPPTIVRDLLDVSKNPCKPTYEMASDAPLVLWDCIFPDEASGSRKDALNWVYAGDPRQSKSQLGKGSGKFGVGGVVDGLWSVWRQRKMDEILAGALLDLAVSQGDQSVVRGEGSHDPISEKDNRGQKVFYGANEPRMGGKYVPVMQKRRTEPVEVQNARWLASKQRKVDKASEPAHGDD

SEQ ID NO: 41465 - protein, 73 aa, A.fumigatus
VADCNGQTVIQITDILKKQNILQPTPGYKQKGFLKKGLPKFKISPSEEIQQKLKEEILNPMAKIGHHVSVFMP

SEQ ID NO: 41466 - protein, 68 aa, A.fumigatus
  UNSURE (46): Identity of amino acid sequences at the above locations are unknown.
AFIDLAKLIFEAYIKYHVAFSARRGCWGPCLSGVSFTIHRPTAQEXPSGTSYLTYHWQHSSGEFTYCS

SEQ ID NO: 41467 - protein, 421 aa, A.fumigatus
RPWIVSHAGNVHISPKGSFSFPYGAAALTHRLNQLRKGKSPDEAHRAEEAFRREMESNFRMALEQLEIPDRLVEKARTEGGFPLYLSGGGFRGWGYLLLYLHQVRGQYYPISIINGYSAPKEDFENTEVLKKVARTARDIFRVSDRRREQVPSVAFLVNVLAKAVPYGIKEAHFCQGGVREGLLFREIPPFVRQQDPLEVATTAFARPSAQVIAFLMFGAIPARTEERTFPPSIRGTLIQAFANSLFVHAAMSKESSSTAALYSTSAGLLASTHGIPHSDRARLALMLQERYGGELPPREKDFKSRLRELLTPEEVWWIRYLGKLGLVLARLYPIGIIDPARPRITTEARWASNLGKHGNKTGIELKVFVQKVAYDPTQLKSELERDVRKIHKVGKRKNWIGGRDGWGMKVKAVVAEEVML

SEQ ID NO: 41468 - protein, 524 aa, A.fumigatus
CTSCPKFHLTRTKTHESPSKDIVQALDMELVAPTLLAIVLVCCCLHLLRSRASRLPLPPGPTLLSRPFREKDIATTFQKWNQRYGPVISFRVGSRTFVVLGTRQAAQDLLEKRGSIYSSRPPSVWMEKYLNKGLAAAFMPYGHEWRLNRRLHGSLLSAHHTNAYRSLQDIQSKQLLHDFLSTNDFSHCFHQYTSNVMFTLVYGKGRGKDDNDHRRLEQINELAGFVLQGASFWTFLMDLFPILDYVPRIFWKWRTEAARLHDRTMVVYRECCEEALTAECWNWSKEVTQKPDIMQLPWDNVCYSLGELYVAGIHTTKMVLELCVMVSILYPDVVCKAQQELDSMVGADRMPSFDDMKRLPFINAIISELLRWRPISPIAVPHAAIQDDEYMGYFIPKGATVIANQFGMNMDDAFFYDPSSFHPERYVENPDLPVSAFGFGRRACPGHRLARSSLFIVISRLLWAFHITSANKEPLTEESSPAAVKATFRVRSPHRQKIIERDWALAEKDERIVLSQIESRIRGK

SEQ ID NO: 41469 - protein, 174 aa, A.fumigatus
LGTVPETDVQRLQVNSPARTFIWVFLMDTAFVTFNNLPPRMVVKEMKMHVAAPESCFQAPTADQCYDAIRDWMPSASLCWKFSFRALFETLCIDDLTVKMQQAVAALGPLNLFTIISGRCPFHNGLFGLVISRITDILRYPLVGLPLPEFLQRREPALTDPHCAAKLQAYLAPP

SEQ ID NO: 41470 - protein, 424 aa, A.fumigatus
LATGELCQVVIMHVLHNRPVSPQKFPHKLQILCPGSAVPLLHRIRSQEKNETCALRMKTSPAYANLATSPHQCSICFKSYKRREHLQRHRNSHSADRPHRCPACPSTFQRADVLRRHLRTCDRIISSAYQGATRKRACDRCARQKKACNSARPCQNCSKRGVECAYSTPKNDTSAGTEIASPSISLGADSSNAAPAAATSVDLWTPRTGNDERPDSTGFDAFACPDLGLLQYCDQSWQDLFNVGSEDLSPTSGDRNYFFHFLDTFTSRTGFVSSFECGTLEQRFMVLYSIEEKERLSDAFWTIDMDQCSNQESNNSYGVSSQWLNDPLALQTHQILLLIKEVVMIKPRNSCVTISWSQDIEQRCLQFFSPTSLRKYIELYWLIWSPNVNFLHRPSFHPASSKPILLASMAIIGKTEKTNSFTPQ

SEQ ID NO: 41471 - protein, 92 aa, A.fumigatus
LKYIGACVSPNLEDNDNARMWFNCVEEAVFADEDFNRDPVSPFSPVRDRQKMQALQAAYMVCLYQNWEGTDASKKRIRRHRFSTVVSVGPPD

SEQ ID NO: 41472 - protein, 96 aa, A.fumigatus
VYILFIVSECQTHSQQMPTRDAHLQLQKWAQEYGPVYSLILGTKPLIVLSSDQAVKALLDKRSALYSHRQEMYIGQTLCSGGLRMLMMVGFQCPNS

SEQ ID NO: 41473 - protein, 63 aa, A.fumigatus
SHGADRFQFRKMVHGLLNVTAAKSYVPYQMLENKQMMYEFLTQPERFLSSPRGSKDPRYAYSA

SEQ ID NO: 41474 - protein, 1420 aa, A.fumigatus
VDEIYSCDCFRACPVISVASLFTGWERGHHQYQFPILLCSLCSSKFLILFVFVFSVSSSLLQHLPPEKFSNSQSSIANLRLPVCLLQPEFVTDNIGRIKDIRRRTRPSTTTSSTTGTTFSPFNSIDPNTVSGSQPATNGFSFGQSQSLSFPGASSNPSQPAQNGGSPFAFGSGGAGSSSFSFSTSFGGSGSSGNPFATLNTPTPSQPSENTGFSGFKGSMFNVPPAGSTTPGQQSLPAGGLFGTGSQQTTAPGGIFGSTSTSAHPNQPVTTAPSTGSIFGQNNATSTAPSTSLFGQSTSDKPSPFGQSTAFGGDSMQTSPDPKANAAVSKPVIFGGSASQPTFGASTGFGSPAGGSVFGGAAPAAQQTPAKPLFGTKPTEQATPTSTPLFGTTSQQPTAGATAPTPASTSATPTTPTATTLFGTASPAKPATPFQNPFQSSNLFSGTPSPSATPKPAEEKGHEQKAGEAAPTKTGFQFSSSTAGGNLFSKSETAAAAPSTTSSAGLFQAPATGSLFAPKPASAETSKPETPKANPFSSLFAPKPSTTNQATPEQKPSPAAAPFGSLFSPKPSTPNEAAEQPAASTPAVSSAPAPSPSLFTPQSSSLSTTSMESKIQTPSSATPASQGIFKANGAAPAQPTPSAKPPAVQFAESLRPSKLPTQLSEQQKKDFDLVYSLRMLNECFQREIARLNPATDDFDAAVLFYMRVREVIGAPTGPMSHKRKATDDESADLEQSAKKAKPFGTPSTNISSPSQKMNIGPSSITKTPSKLFDTNPTPPTTNGKLAEEKAETGVSVSLAGNRSDSDSATASIFAKSFSKSKADDSEPTSAVSPRPATPETNQPALFSTTPSASPAKPIFSSSTTAKENATSSSIFSQSTSNPGLTSSTTSVSTSAQNLFAPKPTGDGKTEAPAPPKFTAGTATNFFAQFKSIADKSAEKEKEKRKAEEFDSEEEDEAEWERKDAEKQRKKREELEAQSKKRAKFVPGKGFVLEDESSDTTEPKKPAETSTSTASSSVFEAKRDTVAKANNIFGHLSATPSEVEEDNDADDTEEASAAGEDADEESKGSSEVPASDRDGSRDAETSEADSKAVSVSGAEFSANESSDDGDFSKALTKSKQASSGSKSLFDRVQPKRQTDEEPKNSFSSLFSPSSKLSSSMTTPGTSTPNPFGSPSTAAPGQGDSVESKPSSSLFKSSNNTPSGGLFTSGPASTGTSTPSIFGQSSSKPAGDKTWKPDSPIKFADSTGTAPSTMSKPDSGPTTQSTDSSKPFSALFGAPAAGAKASGSGQSALGFSFGGPSQQSSSLLAPSTVTSATGSRASTPGMTSDTGAEESGDGEAAESLPQVDLARSRAGEEDEDIVIETRARALKIKPGAGWESQGVGYLRVLKNRNTSRSCIILRGDPSGKVVLNANWLKDIKST

SEQ ID NO: 41475 - protein, 86 aa, A.fumigatus
TTFWDKADRASYSNFDASLWHYFPATHSRRYGTYARIDLCYSHHTDSHDAIWYCFAGQACNAVPESFPVFKSFLRHALSISYTKAC

SEQ ID NO: 41476 - protein, 81 aa, A.fumigatus
FGAHKCSVSQTSYARNQSACSILYHPVGISGKAHIFFIHYCQGECDIQLDLLSIYLKPWAHIINNQCQHVCPESVRPEAHR

SEQ ID NO: 41477 - protein, 74 aa, A.fumigatus
SFSSDQPYLSSKLMQATGYCILSLTKKRLSIVAESKFPTQPPVNSKIPPLIQTVLGYDIESALSSRLLRKTKIS

SEQ ID NO: 41478 - protein, 80 aa, A.fumigatus
IEPMEYAEQISTLYTFADCGGKWINLLPCPSLLRSPHFGKSTVPDSVDLQRDTSENLAIALFETPAFKLVLDGRRWKIWS

SEQ ID NO: 41479 - protein, 96 aa, A.fumigatus
GPKNLRSCRNAGRLINYPLQRAFQINTRVRKGMNSITRQLKKAARIILIGAPGVGKGTQTERLLARYPELSSISSGDLLRENVRKKTPLGKSDRCY

SEQ ID NO: 41480 - protein, 72 aa, A.fumigatus
KAERDVSAATSQRQALEAAIDVAEHYMKALSLAATTNDKQSLDAKCKEWLSRAEKIKEVFTTGLDGSPLNGL

SEQ ID NO: 41481 - protein, 196 aa, A.fumigatus
PSCPLKGIKAEAAMQAGNLVPDSMILELISSEFRSKGWLPVTAPLATATSNHTSRPSTPLSPSASFILDGFPRTAAQALSLDTIVPVNFVVHLVTPPSVILSRIASRWVHEPSGRVYNTDFNVPKVPGKDDVTGEPLTQRQDDSVDTWKQRLHKFEETSKALLQYYERKGCLWRVEGDSSDEISPKLFAEIERRFC

SEQ ID NO: 41482 - protein, 180 aa, A.fumigatus
DGAFGPSFMTAVVSCQRALRTISHSKIQVHIRLAGIDAPELAHFGRPEQPFAREAHQWLTSYLLGRRVRAYIHRPDQYQRAVASVYVRRLLNFPPFRRRDVSYEMLKRGLATVYEAKIGAEFGGEAMERKYKKAEWWAKLRGVGLWKDYRRNKTKWESPREYKTRMGLEEAAQPGVEIKK

SEQ ID NO: 41483 - protein, 126 aa, A.fumigatus
RLTGIAVLGALSKALATIATQPLIVAKVGLQSRPPPGRGGKPFKTFGEVMRYIIEKEGALSLFKGIGPQITKGLLVQGLLMMTKERMELMFVLLFAYLRKIRQEKLRKAVDAAASKAKTSLPATLK

SEQ ID NO: 41484 - protein, 153 aa, A.fumigatus
AVMRWPPWASDTQAQQQSRKSSSEDDERQAAASSTTTSKKKDWESSVTAIDWAAFTEARTIIPTLILTSGFLGAFYIHRRYLRRFPDAVSITPSYFRRRSLLGQVTSVGDGDNFRIYHTPGGRLAGWGWLPWKKIPTSKKELRDKTVRLAPVL

SEQ ID NO: 41485 - protein, 81 aa, A.fumigatus
SRYRFVCHTGLQVKMIRQDFQRIDPKRRATLDHKKKQFASPVYKQQDYPHRLNFYDIPPTAEITLEQFEQWAIDRLKGMNG

SEQ ID NO: 41486 - protein, 203 aa, A.fumigatus
RMDDLTGRVKTRLQVQVKSDKTDGSDGTMHYESTLDAINKIVESEGIEGLYSGIVGSLIGVASTNFAYFYWYSVVRSLYMASDRVPKPPGTAVELSLGAVAGAVAQIFTIPVAVITTRQQTQPKGEKKGLIETGREVVNSEDGWTGLWRGLKASLILVVNPAITYGAYQRLKDIIFPGKNSLKPWEAFRKLRHVIQLWSPLED

SEQ ID NO: 41487 - protein, 348 aa, A.fumigatus
VRKWRCSRLSTVAKGVDPERWQSRMQAIPTSVQGEWTKTRSSPCTCARRPTAYKAVSKAIGSVAACSNDMASGKGKVALHETVTRFAKQPLPNTATRWPTQRALTQAPTRTTTPAPSKPSPSKSPEISPIATSMSLELQPAAKISTSTSSGPISCLLHTSRPCSAKCSASKLPGLLAIKRMVDFESCRLVSTGGAPPALSSTLRLFTPASGHIRLTCNRPPRSAISHSMGRDDLSAKVISLRAILMADAFVPKLSVVADSTSRVTMRIMGTSARTVRKIPCATALSGAVGLTCEPSVTQSKLHSDCIIAWSAVHSWSVAVVSKGRSNSSRTSTVDLGGSRGSPVPDAL

SEQ ID NO: 41488 - protein, 188 aa, A.fumigatus
LVQFNTPKEILLPDVAVWFQQQGVTVLLYDNRCIGASDGEPRNDVKPAKLVEDFHDALTFMARHPMVDEDKIILYGYSFSAMTALVAAGLDHRVGAAISVTPIANYDFREKEKNNVMALAMQDRVSTLAGNDPVYIPFVGDDGYNPAGWGNQYNMEQFRAFLGTSFFTNRTTVQSYYHVLALQPYGAM

SEQ ID NO: 41489 - protein, 227 aa, A.fumigatus
LPVVTFSSRPFSNHSPRSPPPQKQKMTLTYGHKRLQDAPEPIAIVSAACRLPGHVNGPHKLWELLQSGGTAVSNEVPQSRFSSEGHFDGSGRPGTMKALSGMFIEDIDPAAFDAAFFNLTRADAIAMDPQQRQLLEVVYECFENGGIPIEKVRGKQIGCYVGSLNGGKSLWMSRWSVADIIRILIDADYHDMQMRDPEQRVSGHAVGTGRAILSNRISHFFDLRGSR

SEQ ID NO: 41490 - protein, 1238 aa, A.fumigatus
AELEGTIKAAGHFARMLRVEVAYHSPHMAKIANRYEELLKEHGRLDDGSKTNKRSNRMISTVTEDEVTGAQVCDAAYWKANMLSPVRFDGACNKLLTNTQLAPNFLIELGPSNTLAGPVTQIARAAKVDNLTYAAANKRGPDESSRAIFDVAGHLFLQNADISLDKVNLGDNTPDKAKPAVIVDLPNYQWKHSTHYWHESLASKDWRFKKFPSHDLLGSKVIGTLWQSPSWHKMLRLSDVPWLRDHRIGSEILFPAAGYLAMAMEAVRQAALSTATAEARELLKTRHYRYCLRDVQFPRGLVLEDDAEVHIMLLLVPMAKLGQGWWEYKITSLAESDSVASSSSSTLSPEKWNINSTGLVRLETILEASSSRAPEHTCSLPLDNPTPGQMWYKSLRDAGYSYGPSFQRLVAVESTEGKSATRSLISLEPPRSKWEPQSEYPLHPAPLDSVLQSMFPSLHRGNRTKLDQLLVPRGIGELTVSGDIWKSGEAISVTTWNKVSGDASLYDPASRSLIMQLNSVSFSPMLDGRDSLYMSHVYTQLTWKPDFQLLDTDEKLQQALSGGDGAASSLVQDLLDLAAHKAPNLRVLEFNLVPGSSESLWLAGHPTPRAVRTALTEFHFAANSADTALAAQEEYAEWPAARTARFSVLDPFSKALAVPAGSSQFDLVIIRRPQHADLGELDILVGNLRRLTSDGGSVIFYDSKQSSLSGGRGLANGHNHFPAALQRFGLTKVRQTRDGSCIVAEVSPAQNLSLRNDFRVVIVRFSTARSTIIDHTISQLRQFGWTSTEICIYNASGTGLPRLPPKSTVLVLDELDRPLLTTATDQEWTALQAIIQSECNLLWVTEGSQVRPTAPLKAVAHGIFRTVRAEVPMMRIVTLDVESATTESLGTNASAINMALREITLADRSSLPIECEIAERGGLLHVSRIWPDAGVNKRKVEDNAGGAPPVLTNLHDSKSTIRLMASRPGSLEALHFAEQGRDVCSRQDMGPDDVEVEIFAAGCNSRDIDVAMGDISGDLDGLGLEGAGVVVRVGACVSARCVGQRVAVFGKGCFANRVTVSCKATFPLPDAMSFEQAATLPIALLTALYAVGRLAHVQGDDRVLVHSPCTDVGIACIRLCQRSGSTPFATVDNLEQRHFLTHELGLPEDHIFMSEPAAFPRALRHATKGHGLDVIISQPANRNLDNENMRLLAPGGRLIGIANGGADVGNLLPTGSLAPNCSFQRLDVTALPEKTIES

SEQ ID NO: 41491 - protein, 123 aa, A.fumigatus
PVQTRPATTLAQSMISPSHCYLLVGGLKGICGSLAIHLASHGAKNIAVMSRSGGGDQVSQGIARNIRALGCSLDLLQGDVTSISDVRRAFSQISVPLGGIIQGAAVFRVRQHSRSHSLLFISF

SEQ ID NO: 41492 - protein, 93 aa, A.fumigatus
FMTMAGPRIVPGYSQPRNINPSQVGNSTSSRFIVESCVLYSSIHQYPTMCLQCVRKCGTRPAAPSSHINIILSSEPSLISVWTRQPTYQTLEM

SEQ ID NO: 41493 - protein, 500 aa, A.fumigatus
LRSTPCSFTIDTACSSGLVGVDVACKNLRAGTLTGAVVAGVNLWLSPEHTEERGTMRAAYSASGKCHTFDAKADGYCRAEAVNAVYLKRLSDAVRDGDPIRAVIRGTASNSDGWTPGINSPSAQAQAAMIREAYANAGIDSSEYAETGYLECHGTGTPAGDPTEVKGAASVLAHMRPPASPLIIGSVKSNIGHSEPGAGLSGLIKAMLVVEEGEIPGNPTFLNPNPAIDFDNLRVYATRIRIPWPKESSHYRRASVNSFGFGGSNAHAVLDNAEHYLGKYWASLEIPRSHLSSYINLSDMLSLFDGRRSSKTVTRRPQVLVFSANDMDSLKRQISTLSAHLLNPRVKVKLSDLSYTLSERRSRHFCRAFLLSYPAKSGHASKIAVEEAQFSKISQEATRIGFVFTGQGAQWSQMGLELVRTFPGVVKPILEQLDNVLQELPADLKPEWSLLQELTEARSSEHLSRAEISQPLVTALQLAQLAVLQSLGVRAEAVIGHSFR

SEQ ID NO: 41494 - protein, 143 aa, A.fumigatus
LVAISVQLLAWAVGDFEYVEAMTQRKYSGKSIPVRVYTTKGLKEQARFALECAHRTVDYFSEVFEIEYPLPKADLLAVHEFVSGATMPPEGPTSTDYIASGHGCHGELGSGHVSYDRSSIRRGKIRHPLQEPHSIRRRSWCVS

SEQ ID NO: 41495 - protein, 116 aa, A.fumigatus
LFQKDPWIRKIGFPVLTVAEEPGQISIRQNRFLSTGDAKPEEDETTWWIPLGIKSGPRLADVNTRALVSKSDTNAGRRSRFILQNQQRSVRLLPHELSCRPSSEAGPIFGPVKYRR

SEQ ID NO: 41496 - protein, 312 aa, A.fumigatus
EGGKLLVSAEHILSFRTATHYIYSRVWSQISSSVANLRSVFSQNDSVAAGLKKFTLALASPAAEKIGWEFKADEDYLTVQLRKLLIGMAGFAGHERWVPILPVCGERKLSSLFSSIVTEAKQRFDLWASGKDKSAVHTNLRSAIFGITIAEGGRDKYDSVKEEYIKTDSVDGKEICLAALGRVTDADLVYDYLDFVFSDKVAIQDVHNGAVALAANSKVRHLLWEYMKRNWDAVEARLSANNVVFERFVRMGLSKFADHNIGADIASFFKDKDTSPYDRALVIVADSIRTNANYKERDERLVLEWLQSHGYA

SEQ ID NO: 41497 - protein, 71 aa, A.fumigatus
KDNSNSLGSVDRYDYLFKLLLIGDSGVGKSCLLLRFADDTYTESYISTIGVDFVCTRRKGIPLSIQAPSQY

SEQ ID NO: 41498 - protein, 92 aa, A.fumigatus
WDTAGQERFRTITSSYYRGAHGICVVYDVTDMDSFNNVKQWLQEIDRYATEGVNKLLVGNKSDMEDKKVVEYTVAKVRVQPCLSPFSFLILT

SEQ ID NO: 41499 - protein, 164 aa, A.fumigatus
NPLTAIAKFLTLGTESAKASKITYDKKSERVSFIFSQEISPSDIVLSIGFTGTMNNAMAGFYRSKYKPAVQPTADTPKEGDFYYMLSTQFESCDARRAFPCFDEPNLKSTFDFEIEVPKGQTALSNMPIKSERDGSKPDLKFVSFERTPVMSTYVSTNTLVLIC

SEQ ID NO: 41500 - protein, 88 aa, A.fumigatus
VVQQCLLKVLLQLIILPQAMGAMENWGLVTYRTTAVLFEEGKSDTRYKNRIAYVVAHGAFLSLRHNDCVWLFSKTEPQNWPTSGLAIL

SEQ ID NO: 41501 - protein, 89 aa, A.fumigatus
AEGVQQAFQLDSLRASHPIEVPVRNALEVDQIFDHISYLKGSSVIRMLSDHLGQETFLRGVADYLKKHAYGKSGLRVRLQKKAAENDVR

SEQ ID NO: 41502 - protein, 96 aa, A.fumigatus
IHALLSRNPTLMPGVGQDSFYKINKDLSGFYRTNYPADRLAKLGQSLDLLSTEDKIGLIGDAAALAVSGEGTSAALLTLLEGFKREENYLSVPSIF

SEQ ID NO: 41503 - protein, 64 aa, A.fumigatus
EFADSLGIPFLETSAKNASNVEQAFLTMARQIKERMGPATVNNKPTVQVGQGQGVQSGSAGGCC

SEQ ID NO: 41504 - protein, 66 aa, A.fumigatus
HRIVRVQYFCYYCYLGTLGRHFLIKLCMVDTDTIIVPYLTNNASENHPYPSLDGSVPDQLLTDLVF

SEQ ID NO: 41505 - protein, 118 aa, A.fumigatus
SLSPYRLLRDTTPLQRGIIRHLILILDLSQSMAEKDLRPTRYLLSLRYAQEFVREFFEQNPISQLGVLGLRDGLAIRVSDMSGNPTEHISAIQALRDHDPKGLPSLQNGLEMARGALL

SEQ ID NO: 41506 - protein, 272 aa, A.fumigatus
PGVDSHTPSHGTREVFVIFGSILSSDPGDIHQTITTLINDKISVRIAGLAAQVAICRELCSRTNAGDDTTYGVALNEQHFRELMMDVTTPPVTYSQKKATSSLLMMGFPSRTVETCPSLCACHSEPSCGGYLCSRCNSKVCGLPAECPSCGLTLILSTHLARSYHHLFPLMNWIEVPWQRASRSLTCFACGIYFPTVPPKDQWQATESQAKGMSVSSRYECTVCKNHFCIDCDLFAHEIVHNCPGCQSGISGLAIADRPRGQTGTEEMDTST

SEQ ID NO: 41507 - protein, 75 aa, A.fumigatus
SRSVYRHSSKGSSLTGIKMINSQPANPGCKAFVQPKLVPPVHSHKIAKPLVGQFCGSVLENSHTQSLCLKLRNAP

SEQ ID NO: 41508 - protein, 102 aa, A.fumigatus
LTQYPYHHHRLTNRHSYSSQLFEETMADSDEEYVGEVSDEENDVNGIRYARETVPASRPKRRRQRRGAEWEVSRTWETLVEGADGTISSTVEGLLEAGKRKR

SEQ ID NO: 41509 - protein, 65 aa, A.fumigatus
WGFRLVLWRRVPLCVRVILNLLVEGTYVHDAIAKSVGSLLNAPLAVLHLYFQHILHDLIITCFRS

SEQ ID NO: 41510 - protein, 136 aa, A.fumigatus
TVTATVNAAFYSFQNARRIREPLGTRALSQNHLCPKISMPSSSSSSSSGSPESASSLAIDSPSVESSLSSPSPSTSEVPSVDSVPRSRKPYLYLIFVPHKRRLPPAWSLLYFPARSPKKGRVDFDLLDSRSGGSPK

SEQ ID NO: 41511 - protein, 65 aa, A.fumigatus
VLPSPRSIVPLSHQFVDHTCFFLIATLEVPNSVDLLSQNSHSVVLRKQELVTNVIKIVMTGRIMM

SEQ ID NO: 41512 - protein, 120 aa, A.fumigatus
IRYNAGHLVEAALAHRLLYRNDDLLSPILKYVALLAATFGNKEGQKAGYPGHPEIELALLRLYKVTQDPEHLRLARFFLEERGNPSGGKERRHYYDVEAEVRGERKHEVPEAYPAARSYW

SEQ ID NO: 41513 - protein, 124 aa, A.fumigatus
KQTCSVCLPISIENTHRCIERSTQCDCPICGDYMFTSPETVVFMRCGHSIHQKCLSEYSKSSYRCPICSKTIANMESTFRNLDRTIQSQPMPAEFKDTSALIHCNDCGAKSVVRYHWLGLKCDM

SEQ ID NO: 41514 - protein, 209 aa, A.fumigatus
MITRCESYNTAQIRLLHGEASDSLDRAGGDNRDASASPMPSTFHGTEEEASISLPLAQLRVDTSSPSGADSSPRFIASSSAEQNGRFSSYSLTRGRAVSPVISNYFGLPPDRESNRSKSTLPFFGDLAGKYSNDHAGGNLRLWGTNIKYKYGFLDRGTESTEGTSEVEGEGDDSDDSTDGESMASDEADSGDPEEDDDEDEGIDIFGHR

SEQ ID NO: 41515 - protein, 156 aa, A.fumigatus
DKTVLEYSDRCSTMPDTVFNMEYPQESFRATTFAPDSFWAQRRQVVRSQTLRHQLQMLKDTGRYDAFKLKWHPSYSDPCTVWPVPNHLFWDSDVAKWIEGACYFLMDYPDEEIDAAIRELVEMIQNAQQSDGYLNIHYTVVEPGKRFTNLRDMHEL

SEQ ID NO: 41516 - protein, 117 aa, A.fumigatus
PRIARYQQAHVPIAQQQTIEGHAVRAMYLLTSVADLVRICEPSSDVANKFVPALHRLWSNMIEKKSYVTGGIGAMKQWEGFGIDYFLPHGTDEGGCYAETCAAIGVMMLAERLLKVS

SEQ ID NO: 41517 - protein, 437 aa, A.fumigatus
VEFQTIASNVRCCLGPFMSGLISSLLIETIVRQARRLSNQTDSHPPYDDDLADSLPITQSSSSSATYDGNDHAEVSSRNGDHETSARGTPSVPSPPPPSELSSWRHDMSPNQSRSGTAIVSPQSLRGLYENEHVDGVRTYTAPEVTGADSPSVSLRNMVLETNPSAQESHHYSASHDNLDDIGDQFLLPEDDGMGVLRKKIHAIRDLQCSNEEKARMIHELMTERYNASRGRKDLIPTSPRTLSSSSPQLSERSVTPISRCGSLSSDHAPTNPASRAPTSHQIEDTYKLTAEDLKPTFFPKSESDSPVCDFEDADAEDVEVACLGCRHYRRNVKLQCFACKKWYTCRFCHDEVEDHHLDRPKTENMLCMLCGHAQPAAAVCRQCGKLAAQYYCNICKLWDNDSNKSIYHCNDCGICRIGQGLGKDFFHCRVRKPRID

SEQ ID NO: 41518 - protein, 105 aa, A.fumigatus
GLSHPPPAGAQAKRKFPSAHRELETRSSTPKTTTTTSSPSTTMASRPTVTIATADGKPSGATLPLPAVFTAPIRPDIVQYAYRNPEIPGRREARERGMEERTSSG

SEQ ID NO: 41519 - protein, 60 aa, A.fumigatus
LCDCRQVHTGMAKNKRQPYAVSEKAGEQTSAESWGTGMLNLLDWGEGERLGWEVFTKYLY

SEQ ID NO: 41520 - protein, 428 aa, A.fumigatus
KSDNRHSLVKMMFSKSGLVAVAMLGASAVEAHMKMRQPTPYSDSSLNNSPLAADGSDFPCKLRDNAFVPPSQETIAQIGEVMPLTFTGSATHGGGSCQVSLTTDLKPSKDSKWMVIKSIEGGCPANVDGNMSGGADVPDPFEFNYTIPAGIEPGKYTLAWTWFNRIGNREMYMNCAPITVTAGSSKRDAAPVAEKVEVEKRSANFPAMFVANINGCTTKEGVDIRFPDPGDVVEHDGNPSNLQPAGEAACSGTPAWTVSGGSGSPSTPSTSSSTPAGTSAGVSVSVGATVGATPTAEPESSSSEPAESEGAPGVFAPTSATVFPSTPTASAAPTSSSSGAGSESDSSSSSNGALTGPCSTEGLWNCIDGSSFQRCANGQWTTAQQMAAGTECTVGQNAQFTISATAVKPRMINAMRHRKRAHGGHRHA

SEQ ID NO: 41521 - protein, 259 aa, A.fumigatus
RQIYRRFATASALAASSVPSLLFARGHRIANVPEVPLVVESKTFENAAITKTKAAIALLKALGAGADLVKVQKSKKMRAGKGKLRNRRFRQRRGPLVVYNPEVDGKELVRAFRNIPGVETSSVFSLNLLQLAPGGHLGRFIVWTSAAFEALDQVYGSTTTPAALKKDYVLPQNLVANADLARLINSSEIQSVLRAPKGEARTKRAVVQKKNPLRNKQVMLRLNPYAAAFSKEKLGQKPVESKEKPARPAQEFINTLREE

SEQ ID NO: 41522 - protein, 180 aa, A.fumigatus
TVLPSRSPPAPASVMQPLSLRKSRLRSAPPTSPPCSSPTSTVALPKRALTFASPTREMLSNTTETRATSSPLVKLHALVLPRGPSAAALALRPPLQPLLPPLLVPVPASASASAQLSVLLPPLSLNPAAASLPSLKVLPESSLPLRLLSSLRRLRRPQHPRLPLPVLAPSPIPLPQATEL

SEQ ID NO: 41523 - protein, 92 aa, A.fumigatus
LGGGGAIGMGGFHKILILSAGRAVARIPRVSGGGTHRAGQAAFGNQCRSGRMFAPTKVWRKWHQKVNLGQKYAILSTSRAVGEKTLDGDSWE

SEQ ID NO: 41524 - protein, 166 aa, A.fumigatus
QMPFLTSSNMFQYFTGHTATLYQGDKLIVFGGENEHREYLSDIVILDIPTSTWTQPEIRGQIPRGRARHAAVIHDEKLFIIGGVTGENNVILDDLCYLDLKTWTWSRSWRFTARFDHTAWVWGDRLWIFGGLDPDMERTTDIWWLDLKGSPFLGTPSSQGTVDSLE

SEQ ID NO: 41525 - protein, 378 aa, A.fumigatus
  UNSURE (46): Identity of amino acid sequences at the above locations are unknown.
SQGLAVSWNSVFTRYRGFPGIINRMTHSPDPVYSIPTQQLPGRSGXYAANSGSVQVRNSGRKKPIAPGAISCHKFRSGPYVPALFAGTHFQAHASGVLLRLITPSETVRTYECKLSALELDTLRWQKLADGQEIFKPGYRWHYCTVDASGTKAWLLGCSLDVGAAPGNSDENHMSEVLCIDLEKYGLLGNELATLSPDQSRALVSERSGLPPISGLGADLSAVFDQPPESGSDADFIITANPDDIESPDDVAEDVAPTESRPAFLPANAPTSPPIHVHRIILQLRWPHFKRLYSAQMAEYHSKRMHIPEPYSVVRAFLYYLYTDSISGHPEYCSSIIDVAGMLVMANLYDMPKLRLLLRKFSPPFLGKNPPGPRKKIF

SEQ ID NO: 41526 - protein, 630 aa, A.fumigatus
YTIRWVLHITNMATPLISTPVKSHHGLFSSKTAGGRMPLTPSPHARRASVASNHSSPFTPPRQSADATKDNGRLVYGGNLSSYFAKSVAKTSKTYRESPKSNIARTRKSPRHLELGVSDWSLTGTGPSSGQSPSSRERARKEVSARTRSGKTTVRIPHNAGDRFIPNRSASEGLTTTGTAKPEENQRPKSGSSEGSAVLASAASAFDIGGRGVDDDLTAALENLGLEDNDNSTTSYTKPAPDAVAYESSLADACGVNLNTRILAFKPLPPESSKPIDLRAQYNRPLKSSKAKGSQFRRRVQTAPERVLDAPGLLDDYYLNLLDWSSGNQVAIGLERNVYVWSADSGSVNCLLETSPDTYVSSVKWSGDGAYVGVGLGTGEVQIWDVEEGTKLRSMFGHDSRVGVMGWSKHTLSTGARSGLVFNHDVRIAQHKVAELVSHTSEVCGLEWRPDGAQLATGGNDNLVNIWDARSLSAPKFTKTNHRAAVKALSWCPWQLNLLATGGGSYDRHIHFWNTTTGARTNSIDTGSQVTSLRWSNHYREIVSSSGFPDNSLSIWSYPTLVRNVEIPAHETRVLHSCLSPDGQLLATAAADESLKFWKIFERKPGTSASASREGGVGSKAQMTKSMTIR

SEQ ID NO: 41527 - protein, 150 aa, A.fumigatus
NYIPLQSWQKKLSSLGVAHFPWDPAPPQPAPPQTQNQILPPTAPVPSNAPRPAPPQQTQQQHVPPQQHLPQSLPGTIPPMQAPAPAHMGQQSHIKSEPGLNGQPGMPHMSNMMSAPSSNPQSARERAANMLHQRYGAAAGLHHGAGRTRA

SEQ ID NO: 41528 - protein, 76 aa, A.fumigatus
YQSPALIRRQGRQFIAKQPVFLQVNAKNFAHMILITVARSGANVKAASQQPGFGATSVDCTIMPAVPGLENLLPIS

SEQ ID NO: 41529 - protein, 163 aa, A.fumigatus
CCFPHYPLRDILLKLYPITELAEKTLVAWCRPFPLGSCATTARPSSDSKPNTPSYCSCAFKRSSTCSSTTDTATTCSAPTTSSPIPTGDDTSDASACARAHGAAISHQERTGPQWATGNASHEQHDVGSFLKSSVGTRTCCQYASSEIRCRSRSSPRGWKDPR

SEQ ID NO: 41530 - protein, 238 aa, A.fumigatus
SGYCRFSWPLRANTELLWANSLLSPTYPQITMRSTFRLLANVKSARYLEPFAPTGLTGLVTHPSPRPTLIHLYRTTLENLKRFPESSVYRQSTEALTRHRLQIVESVKPPGYDAWLERVKKAVSAEPERFASLRLADGTYAGFMRNDGTDNPRGEEWDGEALEPTTEGPARTAEEEARWHKAIEEATATTQAKDSDFATEQMKWENEPALEAEQYVDLRPYSAVTSRATDHRSQDCRD

SEQ ID NO: 41531 - protein, 67 aa, A.fumigatus
SGRMSQPSRQNSTSTYALILRSLAGQLTIDRRIAEIEKQIGAGLIEEVIQVAENELKLVDEMYKSKV

SEQ ID NO: 41532 - protein, 432 aa, A.fumigatus
PIFFPKSIIKTFELTDVPVRAGRFIARKNWIVCGSDDFQLRVYNYNTSEKIASFEAHPDYIRSIAVHPTQPFVLTASDDMTIKLWDWEKGWKCVQVYEGHSHYVMGLAINPKDTNTFASACLDRTVKIWSLGSPHANFTLEAHETKGVNHVDYYPQADKPYLLTTSDDRTVKVWDYTTKALIATLEGHTSNVSFACYHPELPVIISGSEDGTIKLWHANTYRLEQSLSYGLERAWCVAYQRGRQGIAMGFDDGAVVVKMGREEPAVSMDGSGKIVWARHNEVVSTVIKGGDSSIKDGTPLSLPTKELGSCEIYPQTLSHSPNGRFVSVCGDGEYIIYTALAWRNKAFGQALDFAWGSKDNSNDYAIRESPTSVKIFKNFKEVTGGLDVGFQAEGLTGGVLLGVKGQGGIGMFDWETGNLVRRIEVEPKAVSL

SEQ ID NO: 41533 - protein, 88 aa, A.fumigatus
KRSLARASGSISIVSPLLRLNRLLTSHIMCSNENYLYLLANVALHLNGHPFETITFRFYEFEDPLLVIVAPHGSYTLAPACGTSLYME

SEQ ID NO: 41534 - protein, 405 aa, A.fumigatus
VCDWKFCYNIALSYQSSQVYWSESGELVTLACEDTFYVLRFSKENYINGLNAGEADEDGVESAFEVVTDVNESVRTGQWVGDCFIYTNSTNRLNYLVGDQTYTISHFDQGMYVLGYLPRDGRIYLADKDVNIVSFGLSLSMVEYQTVVLRGDMDMAAELLKDVPRDQMNKVARFLEGQGYKEMALEVATDPEHRFELALSLNNLDTALEIAREANVEHKWKIVGDAAMAAWNLALAEECFTNAKDLGSLLLLHTASGNRAGLRQLAEQASEAGLQNVAFSSLWSLGDVDGCIDLLVRTNRLAEAVLFAQTYKPSRAPKLVVQWKASLEQSGKSKVARLIGVPPGAPDAVATDDDLFPEWDEYLRLEKEGVVPEPPSSESLIDINADDEAVTRSAENGTAEVQTEA

SEQ ID NO: 41535 - protein, 550 aa, A.fumigatus
TSKPISSSSEPSDTQSLNSFQNFYNFHFASMNCLAFSDFCKRLDVKWFPTFSLYHNGKLIEQFEGAKTMEGLSEFIEGKLESIRPGSRPPKGVKLPKPGDKQVDTEAAPDVPAAKDKDRVAGVKAGEKHNEQVAQLASAEAPVKSATPKVNSKPSAPANPQGISVPLTAESFQKLVTTTRDPWFVKFYAPWCHHCQALAPVWQGMAREMQHVLNVGEVNCDAEPRLCKDARVNAYPTMYFFRGGERVEYTGLRGLGDLVNYAKKAVDIGSGVQDVDAAQFKQLEEKEEVIFLYFYDHATTSEDFEALERLTLSLVGHARLVKTSSAALAERFKITTWPRLLVSRDGRPSYYNALAPKDMRDVRQILNWMRSVWLPIVPELTVSNAREIMDGKYVVLGILSRRRSDDFILAKRELKSAALEWMDKQTQLFRLERQELRDAKQLRIEEAEDRNDQRALRAAKNMRISIREDDKKQVGFAWVDGEFWERWLRTTFGIDIENGERVIINDQDVSIIQELLCLPLLTTSPQNRRYWDATSQWSSDLLHDGTGRRR

SEQ ID NO: 41536 - protein, 182 aa, A.fumigatus
TPASMRSSLLAWSFLSLLSIPTFAIPSGGIANDLNLANNRLVKRAEPVEKTESEPVSTTFNGVEVPPLKELTPENFEELTKNGYWFVATVPVAFTVDIVLLTGNRFVKHYSPSCPHCKAIAPTWQTLYEYYYVSAQSTFGMFVLGHCLTCARHLNRYLPLPSRLILNPLTPSKISTTFTSLR

SEQ ID NO: 41537 - protein, 63 aa, A.fumigatus
TIPLFRYYYYYYLVPVSDKILPTLMSSYNGFHTRFLDALIKAFSSGQTSQNVRARVFGLDDWV

SEQ ID NO: 41538 - protein, 86 aa, A.fumigatus
  UNSURE (60),(66): Identity of amino acid sequences at the above locations are unknown.
KSTWEIVCLACRFFCAPIYYDESEGRSKLPKRVGDNQIPVFYGLLSLLFAAFQWSIEAKXKRGKRXKTPIVREYSSNSVSYNQDQL

SEQ ID NO: 41539 - protein, 71 aa, A.fumigatus
FKIDFDRDINERHLFISLHFATEGSGKKVLGKSSVLLADSFVHQYIMMNLKDDLSYLSESVTIRSRYSMDY

SEQ ID NO: 41540 - protein, 430 aa, A.fumigatus
LSSPPPVSATAPLTASPLLQYRAIFASFLDLIIYRSYEIICLEPILCSIASAITTPVPIRYTGVLQQIYPSCRLHSSPGVRTQMTHLASLSDELLTPRLSAPPSELENTISLIDPQRDALYRYDEETHKALSAARPWAKDPHYFKSIRISAVALIKMTMHARSGGSLEVMGLMQGYILPETFVVTDAFRLPVEGTETRVNAQEEANEYMVSYLQSCRDAGRMENAVGWYHSHPGYGCWLSGIDVTTQDMQQLGGPFVAVVIDPERTISVGKVDIGAFRTFPKDYTPPKEGNEDEDYQTIPLSKAEDFGAYAHQYYSLEVSFFKSSLDTELLSQLWNKYWVATLSQSPLFTTRDYGSRQMMDLSQKVRRAARGIESSGSRGGATTPKDQQLEKIVRDGQRIVSEEVKGLLAAEVKMKLFQGIGEGTQTGAS

SEQ ID NO: 41541 - protein, 71 aa, A.fumigatus
RATRFDQLTSTIQDNKRRNETPYLRLSCFALMARNSNIIKYGMQLRNDSVDLSGQVTRVDRHRDHEPQVWG

SEQ ID NO: 41542 - protein, 910 aa, A.fumigatus
RRADPSAPVVPDEYEEEHGHEHDEDEVDSAGNPRDSQPLLPIEGVAAPKEQEEAAFWIPQATPDGRLFYFNTLTGYSTMELPFENPSANESGPFDRNNFFVPDQTRPPPELMARGFERDEDDYDGSASEAEGESLMLASHDSMSRRRRSYIDGVSPATSLDSLHPPSATKSINEGKISHQSSRDLQKTTTAGSNASAAIHFHRPSVSSQAPSRFVDDGLTAPVTWPMLVDNMRHAIEVYRQTLLNGDRSEYVRKAEDISDHLRMLLAAGSDTTDNHSGNPSIISQNKPLYPHFREMMSKFSKLVLSSHVAAADWPGPDSVNKCLHEADGVMQGVYGYVEVARQQRGENIRRIVPGFVVGSSSGGGWQNNGVSLDDSGPTSFLDQDGADPRVEPSVPMDSSLLDHIDILRRSFVGTIRRLEERLTLNQKKIVTYAEQREISDSVVAAAIKVVEQFRPWISAVESINLAPLGTSFQNPQLVDFSLQKQRAYDAIADFVISCQAVSAPLGDEWAELRGDSLEDRLNAVRSIARQLENFVSQIGFSLSLLLEQIPEPSTTFRSESRLEGDKEAYKGIHSRGDSLARIPTETIGIPSSYSVDLPSEKVRRNMDKAQRFFGQAPPVAITREPIREPVREPEETPWFLKMDHEGEVFYDTKADVPTLKCGTLAGLVEHLTRHDKLDASFNNTFLLTYRSFTTASELFEMLAERFNIQPPFGLNPDEMQMWIDRKQKPIRFRVVNILKSWFEHFWMEPNDEAHMNLLARVHAFTKDSIATTKTPGSPQLMAVIEQRLKGQDTTVKRLVPTQATAAPSPILPKNMKKLKFLDIDPTEFARQLTIIESRLYSKIRPIECLNKTWQRKVGPDEPEPATNVKALILHSNQLTNWVAEMILTQSDVKKRVVVIKHFVNVADVC

SEQ ID NO: 41543 - protein, 79 aa, A.fumigatus
LCAQRCRALNNYSTLTSIISALGTAPIHRLGRTWSQVSGRTSAILEQMRRLMASTKNFGEYRETLHLANPPCIPFFGTK

SEQ ID NO: 41544 - protein, 122 aa, A.fumigatus
QVAKLQPGVYLTDLTFIEDGIPSLTPSELINFNKRAKTAEVIRDIQQYQNVPYLLQPVPELQDYILSNLQAAGDVHDMYDRSLEVEPREREDEKIARYAAASSRDLRSHSTMAIASIVIASR

SEQ ID NO: 41545 - protein, 84 aa, A.fumigatus
SRISLLIAFCSERTSMTEEAERLITAIQQMEESLVDEKANGQYQLNHDDLRVTYPLNRCLSFLREKHGAMSKMHRERFEQVKSK

SEQ ID NO: 41546 - protein, 245 aa, A.fumigatus
QAVELVAALESYSSHLESSFVTIELPPTAPGSSISPSFDLSPTYVTALDNEFTRVYEEYHRRLEFVKTTCEEIIKLWAELGTPQVQTDTNIVKHYRESPEQLGLHESDLANLTAKREKLLEEKRSRERKLKELRTAVESLWERFGVEECDRKAFLAANRGCGLRTINEFEEELARLNELKRQNLHLFVEDARCRLQELWDGLYFSEEEMLDFTPAFSDVYSDALLEAHEAAIARLELYHAAAGRI

SEQ ID NO: 41547 - protein, 88 aa, A.fumigatus
SDETALMIFVDMTRGLDARYMISRLRPKKFKVLSLTTIATPHRGMLRPWNNPRLFTQTIQVLRLQIMSLSELVVRSMITLYKEPNSCL

SEQ ID NO: 41548 - protein, 92 aa, A.fumigatus
LTWLKFPFNNSCSSHNSMLTNLNFTGLKVEVAKDTNRHVKKTLPPSLSGFPGMAEIKYYVKATVIRPQFYKENLRAVCTRIFSVENIVMNSC

SEQ ID NO: 41549 - protein, 438 aa, A.fumigatus
TLQGTVPSGLRRAINATNCDGGSRSSRSLGALPAEADFAALREWEAKNGVWYEPPEHKANEKRRTNEEEQAEFEAKRQKLLHALATGGVDVDAIMEKENEPPETKTTNGSAEEDAECNGAVVESANKRRTLDVASSRRLLFGSLGVRAPRSKEDEEITRKKLAGKVNNSRIKVSEEQAPTEGSDSEAEENWQEKLVLKATECVFDDIELSTPPFPFEQRWDAEAHQIIKKRKGWGRKRKRRQQLHVFEADEYEDYAEESNKHYTEEDMQLNYDDPEQQPSTEPTNGVESAGEEPSENTEDDLPPLPADLSSVPDLTEGDLKQGSVIAFKQLVVSKETNWQPTVSDYLVARIDDVFEDNVLKLQLAKRDRRQVEQPDKDDEEDGTRGYDKFEMPGMDDDQAEDDGFREISFANLFDAKLVQAADVADVGVVDKVSKSVH

SEQ ID NO: 41550 - protein, 108 aa, A.fumigatus
STFVITSETPKYPVVLAHGLLGFDELRLAGPLLPGVQYWRGIKEALTQKGVQVITATVPPSGSIEMRAEELVKDIDEGAQGKAVNIIAYVFSTLIGSRVAFRLTNVQT

SEQ ID NO: 41551 - protein, 92 aa, A.fumigatus
ALCSYFSYGAAMQPSFWSMFRLSHRVLQEVEGYNDGLVSVASSKWGKYKGTLEGASHLDLINWTNRLKWLAGEITGNRQRFVKSISGFEVVH

SEQ ID NO: 41552 - protein, 392 aa, A.fumigatus
IFSIRALQIADLRARRLSGRHQISSDGKHLIDGVPFGRPFLKRQTSSRPAIAIPPRKKRRTMLATWDGVVDDGDDEVQWTLPGRVSSMKELSRLKAHDDDGIHDEYTDYHHDDDYEDYHESQDESGDGTVIRHSLGEGEEDEASESDADDSDFEAEDLAEELEALKEDRETVGLSSAEVLEEKPTGPGGYPLRTRASILRNASGHHADHQAATKSPSEAGSSRRDSKAVRFKEAQRQTSPCPSQSESDSHLSQAEQVSEGSPSIYKSFSSSSSSDTDNSTSDEEDSTSPSETTTSASEVSSSESEAEDAESEDEDSSSESDKSSTSESEDESLPTPAPNRQLQPKMNPPGHGSLRTKKSNQRNKLRRRLSKLKELGRSACRSRLCSPPRMGS

SEQ ID NO: 41553 - protein, 148 aa, A.fumigatus
THEKAHLGFLHPGLPTLGLDQPGSKQHNSGNVGPCCLWAQLPRFGVVFCTGCVAWFHCIVVDGYSRTSLWNPHHGMFSSRLRDLRDKHLSLTVMQAFGRYAMGWWPSKIVVILNLIQMLGYCLIDCVVGGQILSAVSPNGNLSVAVGE

SEQ ID NO: 41554 - protein, 259 aa, A.fumigatus
QDFVRASDAIRLSFFSICVSAAITYAPLAADFFVYYPEGTSKLAIFSLSLSGLMVSFTLAFLAGIGLASGIPSHLEYSAAYAKGAGALIVEGFGPLHGFGKFCSVVVALGLIANTVAPTYSAGVDFQILGRYAEMVPRAIWNTIGVVIYIVCGLAGRSHLSEIFTNFLALMGYWVAIWFAIILEERCIFRLRSGYNWYAWNDPSKLPMGIAAFIAFLVGWAGAVLCMAQLWYIGPLAKLVGEYGADVSAIIVPVPVNSP

SEQ ID NO: 41555 - protein, 166 aa, A.fumigatus
RLTQDNSMSSEIANPSLGMHSEKEPSGFRSEEQPTPRPHKTGETNSESPSGRVIPSRVGMYLRRFEQQLVEYNFEARGIERVHEGERMKKLTWVSYTQAFLLWVSINLAANNITLGMLGPVVYGLSFLDSALCSVLGALLGSIVSSWMATRGPLSGIRTMVCSRLA

SEQ ID NO: 41556 - protein, 85 aa, A.fumigatus
VSRDRPIERCGECGNVVKLEYIGPDEDPHARKFPSLGSYRSLPSFSRLVFRLLTYPFTDEHHSHHPPHEEPKTFADYVKPEYWYR

SEQ ID NO: 41557 - protein, 322 aa, A.fumigatus
CMSVTLADPYRDYALDYAQHAKPEGHENALAYQTQHSHLQRHKEANPPFPQGSPHNTAYEQHHASTTVLPAANPDISQSVVLTAAHMLPRQLPMQYTPTTFEIPPVQRGKKRPHSEAEGEGDYGDHGVRPRLSALPTQASTETAQSPGMLFSVQGDSSQQQAHHQQQQRQPQQHHHHQPMPSHGFGPPESMALPQQHHHHRLPPQASLHSAERHGTNAETSPIPSGLPSVVGQPGMPDPAPRPRGPKLKFTQEEDALLVELKENKNLTWKQIADFFPGRTSGTLQVRYCTKLKAKDVTWTDEMVSIALWGRSVNLPREPLTY

SEQ ID NO: 41558 - protein, 153 aa, A.fumigatus
RLVITRSSGLLSIMQHYENAAEYQSVSLSRSTYLCYAMCHWARSWSRSYIFVMRDPIDFPSATTPLCIRHCADLYDCFAEIKTEEDLIAPGAKPGTVPTDVEQATGLERLELIGKMQGIDIFDMRPLDASRKGMRISLQEIRRGSSKCHAFES

SEQ ID NO: 41559 - protein, 114 aa, A.fumigatus
LTKLASLGTLDNPIIVKSAGDEQYAGCTGYPADSHHTVWLTVSIACFVALCPQIAQMAKTYLFSHHRYLVIVLSSAAASVVMSSSSSILDLMRTPMLVSSLHLDHIAPCLPFLG

SEQ ID NO: 41560 - protein, 65 aa, A.fumigatus
FFGFLHIHSQTSITATTPLTRNPRPSPTTSSLSTGTGKYSMLRILCDCPLASSSTKNDLGEKNGR

SEQ ID NO: 41561 - protein, 91 aa, A.fumigatus
CLMRLSRSGSSTRYRAGSGLPPSSFHTKNNTQRQLLYPSSPRYNLVFYFNLFFYHLSAQIEFSSLFTLLWLSSKRFLKGKYQSSLLSGCLD

SEQ ID NO: 41562 - protein, 65 aa, A.fumigatus
STQPCVQHLMHEATSLLQRNIEATDHQRTIFYLGPEMDNTTCVTSVAPIRRNVLPEIRLELHMIV

SEQ ID NO: 41563 - protein, 125 aa, A.fumigatus
QVAAALSVAWYGALIESKPPLNIALALVLLISFCITAAYNVMNVLIVDLYYTTPATAMAANNLVRCFLGAAATAVIHPMILKWGNRTTYLAVAGAMLSVSPLLGMVYWKGLVWRRRRIAGIAIAG

SEQ ID NO: 41564 - protein, 82 aa, A.fumigatus
TVLIMNTLISLILFTAISSAQWALPQGTPTLQMRYPSTPWISPGDTIKQPGTSITILVTDMNNEAHASGDKQTPSQFRASEL

SEQ ID NO: 41565 - protein, 216 aa, A.fumigatus
  UNSURE (3): Identity of amino acid sequences at the above locations are unknown.
GAXFLQSHRRSFQPRGEDFPETCRTIVGDGSIPATGWNQSVWNRWHKQQTIATSNSDPEGTRDTCRDSHPRLQKTNIAIPNPLSTISLLFQLPTGPLVLANGIVFASYYSVTAGIPSQFKATYGLSDLGIGLSFIPAGLGSLLSATLNGLIVDWNYIRLRRKTGDIISKDQKQDHGAFPIERTRLQIGLPMTVRCVAPSDLLYFTRVVVVVGIATC

SEQ ID NO: 41566 - protein, 234 aa, A.fumigatus
SQLKGNENSKRCPSPSTYGRPSVPTFNQLVYTKHGKRMNWLEQEHTCYPEQYLHSRSFLSFVGMNRDKQPKPSPDRLPKSVKVRSTCNACQQAKIRCSHEKPSCRRCLKHNIECIYSMSRRLGRPAKRRESQYAGLPPDTQRVDARCHQQDKKGPASKKKAKEGQDRRKDDEDDFPQRLAETVAYDTMAVDQTVLDDISLNDTNLSTSTFSERDQPPSFAGSLRSLRDIIRPSH

SEQ ID NO: 41567 - protein, 88 aa, A.fumigatus
AIGSSLQLKPSVLFLSISGSDCRIEIGISDLGAPQLLTADFTFPSTNQRFAFEMQLSMYLIIDFDSSFPSLNLDLPALPLPIQSIRDE

SEQ ID NO: 41568 - protein, 249 aa, A.fumigatus
AAVKVERGYRMLTIIDEPVLTLNLSVSELPCFYLRFQSRNELEIWRRALRDLHTSDALSRHTDYDLDHSGAEEEDYRASQIKRQASINSSYGAGRSNNTAITDYTTGADNLPTSSVHIPLDVVVVIPVSSSMQGLKITLLRDALKFLVQNLGPRDRMGLVTFGSSGGGVPLVGMTTKSWGGWNKILSSIRPVGQKSLRADVVEGANVAMDLLMQRKSSNPISTILLISDSSTSDPESVDFVVSRAEAAK

SEQ ID NO: 41569 - protein, 82 aa, A.fumigatus
YIIFTTSEPYSPFSFLVCFTPSILLSPALSIPTIFDTDKSSSKKIVASPDPQLSLLPIGVLTESRTSGPFLPLTDEHLQPFA

SEQ ID NO: 41570 - protein, 423 aa, A.fumigatus
PADFPSRPESPSRSPLKGFRSFSRSHADRPGTSTSGQTHTSRSRAPSTISTSLQSDHPGLGWHSTIGTNSSRASFNSRSGRPMAGLMDVDRSRARRDRTFVGTECAVCEEPLEHTLRGERVLQFSCTHVAHEACFYEYIKEFEGQYCPTCDAPLGLDTSRGGHVLDIGKRKMHFRATQRRAIAGILTIVVVEKLSNIVRSVTSDAATQRSGLTTPTPWDQPSARGRAPSETGGRSYNNRESRDIWARRDSRDTGNAGSHRERERVERMTTGSRQQHSRNGSAAGSSGEYDAQQQSNGRRHDYDVQAMESDLSPRAAPMKNPIPAPTVTIRSEFPTLNRSRQQQALTCLVTVEVPEGVWRPDSEDLRQTSSGASQPQDEPYGGVVRFPTADARSIQYEPQENLDEIAEDLRTRVDNWHGLEFSR

SEQ ID NO: 41571 - protein, 90 aa, A.fumigatus
MISRSGKLRLHGHMRVGKDRESWQDLECYLFAEMLICIKEKKTNTHQYDDQIKRKTRSSLKGSILIKKHLRSIEASPGKLPSKLREVIGC

SEQ ID NO: 41572 - protein, 170 aa, A.fumigatus
LTICRVSIHSFGLGLTHKPDTMIELSTRTKGSYLYVKDWMMLRECVAGCLGALQTTSHQNVKLKLRLPEGSPAKFVKISGALHTTKRATGRDAEAALGDLRFGDKRDVLVQLVIQPDNSTQESMPQDPWESLVSGLEALGGGSDADEQRVPSVEEVPLIQADLTYGDLLP

SEQ ID NO: 41573 - protein, 65 aa, A.fumigatus
PRSSQFFWIIVSSLFTFPLILLFDYSLTPCSTPLYLIFVLLSGYPAELAGFSCYDTTLFDNDGAA

SEQ ID NO: 41574 - protein, 234 aa, A.fumigatus
HPSGMNVENKQYIPESKKLSHSASFIARLSHILPLLTRCHNSYQFNPHLLQPETVTNILAKALTVFPSPAFSLCLALLPAHTQPFPTADTDASQTSDFVESIQKLARLSTLLESAQYAQFWSTLNSDDLYADLVADVAGFEELVRIRIAIEVGKAFREINAEVLEQWLDLRSREALEKFVTEVCSWEVDKTGPNGTVVKVPTNKENEARSEVKSERVGVEMFGRVIRRGFEQAA

SEQ ID NO: 41575 - protein, 128 aa, A.fumigatus
SGLLQQEKEIQRQRESILLIASENVTSRAVFDALGSPMSNKYSEGYPGARYYGGNQHIDAIELTCQARALKAFNLDPEKWGVNVQCLSGSPANLEVYQALMRPHDRLMGLDLPHGGHLSHGYQTPSRK

SEQ ID NO: 41576 - protein, 70 aa, A.fumigatus
GTDPAHRLPPPSPDFPVLFSSPSFAQPFFLLSPLLSSSLSSHFTLLSIVFFHLDNTITHNGHLRFVAGSP

SEQ ID NO: 41577 - protein, 347 aa, A.fumigatus
VTVTRLPPESRSPSLPSVVEHCVNLPRISAVSTYFETFPYRVNTETGIIDYDTLEANAELYRPKCLVAGTSAYCRLIDYGRMRKIADKVGAYLIVDMAHISGLVAAGVIPSPFEYADVVTTTTHKSLRGPRGAMIFFRKGVRSTDPKTGKEIMYDLEGPINFSVFPGHQGGPHNHTITALAVALKQAATPEFRQYQEQVLKNAKALEVEFKALGHKLVSDGTDSHMVLLDLRPKGLDGARVEAVLEQINIACNKNSIPGDKSALTPCGIRIGTPAMTSRGMSEEDFKRVARYIDQVINLCKSIQADLPKEANKLKDFKAKVASGSVPEILALRKEVAEWASTYPLPV

SEQ ID NO: 41578 - protein, 346 aa, A.fumigatus
GDHIAHLARELLLDTSVEEERNVRVLFGLSDVALLDVLLAEPLGQHVAHVLRRERNGEGVVGLVLGHGGDLDVLGVREVGLRRAVIVAQQLGDLTDTVRTVVEEEEGIVVCKTRLVFERAVLRVPSKHTLHAPFLAANNDGLEELIVLTLLIALLDSLNGIRALFALTADNTLHGNFDSVPTLVTVHSVVAANHRGDLTDADLLGVIEQVLHILDGALGVGITAITEEVNEDLRDLHFLGDLQQTDQVSDVGVNTAIGDQTQQVQTTIALLGASEGLDDVVDLVQFALLEGLIDANAVLPDDTASTNVQMANLTVAHQTLWQTDGQRRGIQLCISLSRLRVLFGKA

SEQ ID NO: 41579 - protein, 206 aa, A.fumigatus
TDENPTSCGLLETPSDHTAEHLHTHALALDLAARLVLLVRGHLDNSPVGASLVHLPAADLGDELLERLAAAQVKPLLQHLGVDLPEGLAHFDGDTNTHELLEAGDIGDQVRVQVIGVQGRPELGVLGGLEESGQAGELLDGFHEVGGLGGVGVGGGEGLGVGGEEGKAEGEGRRGKDGERLGEDVGNGFGLEEVRVELVAVMTSCQ

SEQ ID NO: 41580 - protein, 107 aa, A.fumigatus
EEKAKSEITSLIGISLMSSDRARSFIRSEIPSWRLTDTVKDAVEQWNKEVLSKTQVPLDRTANMAHVRLLYSSLYFMHPMPSNRTGDNPLWRKVSEWVSGVADTLES

SEQ ID NO: 41581 - protein, 250 aa, A.fumigatus
VVVIDGWGIPGPDSPKDGDAIAAAETPYMSGFAEENSKTAQGYTELDASSLAVGLPEGLMGNSEVGHLNIGAGRVVWQDSVRIDQTLKKGELNKVDNVVKSFTRAKEGNGRLHLLGLVSDGGVHSNITHLVGLLKVAKEMEIPQVFIHFFGDGRDTDPKSAIKYMQDLLDHTKEIGIGEIATVVGRYYAMDRDKRWDRVEVAMKGIVSGEGEESSDPVKTIKERYEKGENDEFLKPIIVGGKERRVQGMF

SEQ ID NO: 41582 - protein, 199 aa, A.fumigatus
PCLADNDTLFFFNYRSDRVREITQLLGDYDRSPKPDFPYPKNIQITTMTQYKTDYTFPVAFPPQHMGNVLAEWLSKKDIQQCHVAETEKYAHVTFFFNGGIEKQFPGEVRDMIPSPKVPTYDHEPEMSAEAVGKKMAERIAEGKFEFVMNNFAPPDMVGHTGVYEAAIKGVAATDKAIGEIYQACKKHGYILFITADHG

SEQ ID NO: 41583 - protein, 89 aa, A.fumigatus
VGVVSVLGFYLSRLTYLLPSNAEEMLTEKGTPKTSHTTNKVPFVLANAPEGWSLKKEEGVLGDVAPTVLAAMGIEQPEEMSGKSLLVKA

SEQ ID NO: 41584 - protein, 210 aa, A.fumigatus
DEKKEQEKELRKNPHFKPMKTPLHAACSKPRLITRPNISTPTRSLLTSLRASFSLFVGTLTTVPLGPVLSTSQLQTSVTNFSSASRLRRSSHCSNTSALISRKALPTSMAIRIRTSSSKPATSATRSAYRSSEFRVDQNWAYWADSRRVDRRASFWMDSTKSEVWEASVSAVGKGWVWAGRRARQREKAGEGKTVSALARMLVTVSGWRR

SEQ ID NO: 41585 - protein, 155 aa, A.fumigatus
VPPCFSPSFSLAQLGIMLFKCLRLERGFSFPLLLVAYVGAPSAILRPRTLLTYSVEIIGYIGRAMSSKETPDWTLGPYIVQTLFLLLAPALLAASVYMLLGRIILLLQAESHALLGRKWLTKIFVTGDVLSFLLQGAGKHLIAKHRNMEWQADII

SEQ ID NO: 41586 - protein, 81 aa, A.fumigatus
PMFVSFCFFHRWTPPFFLPAKYVYENEWVCGHYSVPWRAWRNYLATIESACLAEFWLGQSECSIVPWIQHAELKVFYRVFI

SEQ ID NO: 41587 - protein, 66 aa, A.fumigatus
PNHNEEVDCIEDPQVFTPGAVQFYCFLCLTLDQTPVEDRAGNNEEAEKKNLYKKACDNNLLTIVYG

SEQ ID NO: 41588 - protein, 130 aa, A.fumigatus
ISRAERNTSGGRIFLCQLGTFCFLLFNSLQLSSTLFSSTSFLFYLLIIYFEPVVIVTIHTLHMKMPDTGDSEEAFFAFYRYDPSMSAAVLFTLLFIGTTGYHAFQMFKTRTWFFIPFVIGGICGCTFCNP

SEQ ID NO: 41589 - protein, 156 aa, A.fumigatus
YNLGGGIQSSGNLDNLKNGERIIVVGLFVQIFFFGFFIITASHFYWKIKKYPIPRSCTPEIPWGKHLHVLYLTSFLIMIRSVFRLAEYLQGNNGYLLHHEIYLYIFDALLMFITMVTFNVVHPCEVGRLLRSTVNYELTHRPQTCANKPYASSLVR

SEQ ID NO: 41590 - protein, 83 aa, A.fumigatus
QAGRLPILDVHSTMSLWAREPTTGADASYQTAVWAYYRYYPSKAAAILFTILFLITTFVHLYQLFRRRTWFFIPFVIGGFCEC

SEQ ID NO: 41591 - protein, 107 aa, A.fumigatus
LSGTRAWIVANSNKSTVEWVGYLGRILSSQESPNWSMGPYIQQTLLLLLAPALFAASVYMMLGRIVVLLDAEHLCIIKKKWLTKFFVCGDVLSFTVQAAGEHTSPLL

SEQ ID NO: 41592 - protein, 100 aa, A.fumigatus
RLTAMSLTQTEKDTEVFTEDKSSTLSLTSTLTCDTLDEKHFAFFHPSRTLHIAAQGIAAFRLPFPSRELEIPIYDTAEGTIAYVSTRSSICSGNAILSDP

SEQ ID NO: 41593 - protein, 110 aa, A.fumigatus
VRVSFQPRGDDIPEVITDIVHSYKALVLEVSIAEMDVHTLNTTLHTDIYSAVITEALDARITDISFWGFTDKYAYTWLEGAKPLMFDEYYNPKGAFYATHTALTSLDNEP

SEQ ID NO: 41594 - protein, 142 aa, A.fumigatus
QQTTGGGVMASGSLSAVHNGEKIVIAGLLIQILFFGLFIVTCAIFHWRLIKGQTEKAIELNSAWRKHLWILYAVNFLIMIRSVFRLIEYAMGNNGYLLRHEAFLYVFDGVLMLAAMILFNIVHPSSLIPSRRKSLEQDSSAA

SEQ ID NO: 41595 - protein, 75 aa, A.fumigatus
FAMLHSKGTEEPGDYKTSGTNGHHASVSVLGLLRLRDVYRTPAYISCRFVTVWAHSVLPVLTIAELLLLQLSSVK

SEQ ID NO: 41596 - protein, 153 aa, A.fumigatus
RDNFRFIFSRLGLCSVDNDRRLGLGSGFSRSRFRLGSFSLGGFNLGSFGLGSFGLGSFGLGGFGLGSFGLRGFGRRRSFHLRCSLNRRSGGLRCRCRCHYTGPTIISLSRRFLFSVSRSLRLSPPGPCLFFCSLLLHLPLLNLCVCVSLSELK

SEQ ID NO: 41597 - protein, 137 aa, A.fumigatus
DPSAAPRESVPASAAPPANPVLAPSPSPSRRDSCSAPLDRRPTRPLNQLLSLDSRLSSRCSSSPAVPSATIFASSSAGWGCAVSIMTGASAWVAASVVAGSAWGASALGASIWGASAWGASAWGALAWGASAWGASA

SEQ ID NO: 41598 - protein, 109 aa, A.fumigatus
SRLHPGAIGEATMRIFSFLFLLLLGILTGQGLVSGTDNGKTTDVTWDKYSLSVKGQRLFVFSGEFHYQRLPVPELWLDVFQKLRANGFNAISGMICLILHYAWVSPTGN

SEQ ID NO: 41599 - protein, 376 aa, A.fumigatus
  UNSURE (142),(160),(169): Identity of amino acid sequences at the above locations are unknown.
VSKLNGYASFVMRDTDRKGRVYTGNSQVKKIKWNGKTIETRKTAYGSLIGTAPGAEDVKIQLPSLDSWKAQDTLPEIQPDYDDSKWTVCNKTTSVNAIAPLSLPVLYSGDYGYHAGTKVYRGRFDGRNVTGANVTVQNGAAXGWAAWVNGQYAGGSAGSXNLAATSAVXTFNSSSLKDQDNVLTVVTDYTGHDQNSVRPKGTQNPRGILGATLIGGGNFTSWRIQGNAGGEKNIDPVRGPMNEGGLYGERMGWHLPGYKVPKSASKSSPLDGVSGAEGRFYTTTFKLKLDKDLDVPIGLQLGAPEGTKAVVQVFMNGYQFGHYLPHTGPQSLFPFPPGVINNRGENTLAISMWALTDAGAKLDKVELVAAGSLHET

SEQ ID NO: 41600 - protein, 483 aa, A.fumigatus
RHSFHMTGDPKATGSLNLSHASASAALAQARSHHKNLTTDRPGGVGYQTQDRRTAESPVARPSPEGYKAAITAVRDRRAITSLPPVATGFKYDISTTSDQAYDVQRESSDRDKALRAATGAYRLSRKRADSAPSKPTMAREAPYAASAAGSAKPAPEVEDPLARIDSSMEASRIHHMSNVNAQLYTEHPPIGLEEQDRKDVLRAAVISMAHDMYEITEKREEVPTGEPSAALYGAQRGLSRMRSQRAVPKSDPAALKQAVKVQEAAQQRAAEKLAKINEPTYQEYYGVEPHVQRPTLSIRRRRASVDSETSAADAERSREIRHQMSSLRSRLDAVDEQRTKDRANLMEAARRNVTATIQDMEMRVYHETGRPPPSMQKEWEEAALERAQREVQEQEPYRPYNKVNIGTERYIDMADVEAVARSRLQPTFDEITDRAEKQRARELEARLDAEERERYEAITRERERETRAEEKRQLGMFSRLTT

SEQ ID NO: 41601 - protein, 382 aa, A.fumigatus
VRRGTKRARVVYFFWSFHSASEGEFDFENGAHDIQRLFDYAKEAGLYVIARAGPYCNAETSAGGFALWAANGQMGNERTSDEAYYEKWRPWILEVGKIIAKNQITNGGPVILNQHENELVETTYDPNHTLVVYMKQIAQVFEEAGIVVPSSHNEKGMRGVSWSTDYHNVGGAVNIYGLDSYPGGLSCTNPNSGFNLVRTYHQWFQNYSFTQPSYLPEFEGGWFQPWGGSFYDTCATELSPEFPDVYYKNNIGSRVTLHSIYMTYGGTNWGHSAAPVVYTSYDYAAPLRETREIRDKLKQTKLIGLFTRVSKDLLKTYMEGNGTGYTSDSSIYTWSLRNPDTNAGFYVLAHSTSSTRDVTTFTLNVTTSAGMALACSFSLTCC

SEQ ID NO: 41602 - protein, 170 aa, A.fumigatus
PDLGAISIPDIELNGRQSKIIVTDYNFGTNSTLLFSSAEVLTYANLDVNVLVFYLNVGQKGTFVFKDEPKLAFQTYGNSNLTTSESSYGTQYSYTQGKGVTAVKFSNGVLAYFLDKESAWNFFAPPTTSSPQVAPNEHILVQGPYLVRGASVNHGTVEITGDNANTTSIE

SEQ ID NO: 41603 - protein, 101 aa, A.fumigatus
HPWICPLQPTSQTTHSVLNSLPLSFRLVHPTGRHHYYLFSLPSSSFPPSFFSFDLLPSGMPIPAVLSYSPHHGADLILSWLLLSLILESIASPSSVPGLPS

SEQ ID NO: 41604 - protein, 355 aa, A.fumigatus
LLEFRQAHTDAEIQKRQMKEKTTEEKTWSWWRKSKRTRDTEQKPSAETDYRGPSVVAPAPAPQPTTPPVEAASQVEAAPAAEAPQAEAPQAEAPQAKAPQAEAPQAEAPQIEAPKAEAPQAEPATTEAATQAEAPVIIDTAQPQPAEDEAKIVALGTAGEEEHRLERRESRLKSWFKGRVGRRSNGAEHESLREGEGEGARTGFAGGAALAGTDSRGAALGSHPVTGNDLATVQQRMSVDEGSLGNDATRRGSSGVAEQTGENRKPSRLRSSFMKIVSGGSQDNKTNGVSKPSDDHRTASEPAEIGVRNPEGSNASTATKEELRESAAEHGLPAPPAIGKHATNGSRESRFSEDL

SEQ ID NO: 41605 - protein, 1061 aa, A.fumigatus
ILLLRPSSGLSDVSGAKAAISMFKYSVSRTCLANEAYRIHEYNTSFTILTFLPYYTTPLFLNLLAILPEDLTPTFKVLIPYKKSSINPPRHPLVHSATTNKPFLAALNSYVLQVSRQQAHHHALLAFWAGVYTEAVAGMLDASRSGRREIEKQKHEDIVISVLPILNDGFAMKNVSELIIGCYMVSVVLAQKASLQDKVLDSLMEAVAGSWTEETVESGLVCLAVLAQQKPETKLPRRALKAILRLDDIFKRLTELATQYKTSHLLLGVVAGCLDDLPRQKDTARLDLLSQIFQNQLLGEPEMSKAMALVLEATSSVHKDGAMSLDAQARLADLVQVFSQSESLRPTFQKTIAESSFDIAALEHNLQTVIDTAPAPRTVEDVEMEDVEKEEEQDHFSSTVESLSGEKLFKGSFLSTQSIPLFEKLAQAFTLAIGSKEKCQTFSDLAALGKNEAEKSPQYLSFFIRVFSGPYSMGTRVTALNMITSFLTSTESTNLDFQALLPFLLVTLTDPSERVRREAAAALAAVGSLYKKNRKGEDIWARDNLYGQPKDIKWLPTRDAQKVFERAVLPSLEECIFDATHIGKVLENTLRGVSVDANASELKKPLRLAFFTFLCSHAIELPLFTPKLGLLNILNRIDKAGGTTRTKELEPLLKTWRGFSEREVQDICEKERVPVSDVERQMVAIVTPKEKDSIMILLSNVSSHSESLRPSFIAAVFGRIKDIWARVAEDRQTVAAEQLFDISLGLSDLPLVNNSRDLLRSVQLPGSVLAQFLERIPVSLTDMEALGPAPKRRRTSQNNMIAMTVKDEAEFGKVMEKMTFILELVDSSSPETHPELADGLFQTLAALHHFKSQIQSGMSYLLSLTLGSLLAIVNRSKESAKAQFDTSVIRADLVVDCVRTTESPQVQNAALLLVAGLSVIAPELVLHSVMPIFTFMGSSVLRKDDDYSVSVIDQTIDQVVPALIQSLRDQKRDVVSGTSELLLSFTAAFEHIPSHRRLRLFHALITKLGTQDFLFAVLAMLANRYAMDKDVLVLMTGLVSDASAPVELTVRVVIPRFWTIY

SEQ ID NO: 41606 - protein, 432 aa, A.fumigatus
QVSFLMPVLLSSLPYVLSSRVSGLFTDSKQTYSKFLGLVSDSLKPKPGISQVLLGIGSDDGREPQKVAVDLLRDLAYLFRHCSLKVKMAKTFASEDEEAIRQLRSTFSQILEQVLTIGDSVQSMKLVSQANGDVLAALFGTLTLVDFLDTIEVLLERPNDELRRKVLRLLEGRLRQNPERDSASQIRVLDFLPTLVDIIRNSTDILLKHAAVACIDRIAEKYGKKDPSRVIGAAQVVASEACIGQTDDRIRIMGVLCLASMAETLGQVMIPALPEALSRSLALLELSLEEGKENSRLHDAVFSLFSALFVHIPYMISGPHLDKILLLSFKSANAEECEDDSRQEALKMMARKVDMAATLGAVDRNWQYAVQAGPVATKETLEVVSLAVEKHPKSATGKNIGVLSSILFKAFDLRREQLALGANATFDAADVD

SEQ ID NO: 41607 - protein, 156 aa, A.fumigatus
SDCPIKYKILSTMASSLAAQLSQIAAKSTNQLDLKAQRIAHSQSLIFDRKVASIQDFDTVYQICYEGFQELCQLDSRFTAFERTIFSEQSKAEDRTQLTAAQNKELDVALEAFLALVGGRLLLNPAIKAVEWLVRRFRCESGNLNVQVLGFSDVFG

SEQ ID NO: 41608 - protein, 148 aa, A.fumigatus
CSPKEKKSIPRFASFKPPPAPPPKADRPSDRRSHELAHRDEKSKHHSRHRSHRDRSRSRERRRERKEHHPTRRDAEQRDLEPTREPVRAPKTIVKEGEDEASDLYVIDRKGDKYNLIYGTLHRYNVPLYHRVRRGNVLGLPTSYRIDR

SEQ ID NO: 41609 - protein, 128 aa, A.fumigatus
EGRGSVGSAFERPEEEFTPGLSTSSVLRRIELSVLFLLFFSPQIILIITVIIARQARALTSLSCSFLLSPHSSFFSPLSLDHVSSQLSFYLSSSPLIGNALSLYLLASTDRYFSSPDILDTIFGNQYH

SEQ ID NO: 41610 - protein, 150 aa, A.fumigatus
RYLMMASQVQSSDVNGGAKSLAAMLEEEHARNEAHKVTVEDTVDEEDLLHPPPSLGKDQQTVPAQPTAAIEEAVATTPSASNAAPKRSPAFDVRSEELFPALGSGPKPKAPAAATWGARPSAAAALANGAAGRPQSSMFVLSTFLYCGLL

SEQ ID NO: 41611 - protein, 401 aa, A.fumigatus
  UNSURE (325): Identity of amino acid sequences at the above locations are unknown.
QSVRIPIPTSARAHIIGRQGAIVQDIQQRTGARVQVPRADDSAAKDDEDDNDTIDVLIEGDAVAAEMARREIEAIVKERASNMSLRLKSIPAEFFPFIAGAHNANLKAIEERTKAQVHVPRYDTWQSQPPPQEAEPGRVQFVPAPDKHIQITGERTAAQEARAEIERLAADLQRRLTLRQLAINRGQHQFILGDGANALHDFLADTGCAIVLPPASDDSEFLTITGPQDCIEAGINRAMELATSMQMASIDLSRQHPNAPSGPHAHARALTRYLQQRQIIRQLEQMYDARIALPPSADGPVTWEVYSRDGKNTIRARSDIMNLVXAHPPARLRYVSVDPYYHPYLESHGLGKLRNEYGVHLLVPDELDNSDVVLVQEGTSAANSLPEIPRQRPSPAEVGCL

SEQ ID NO: 41612 - protein, 241 aa, A.fumigatus
GWCATMGPGTGLRQVAISRYSLGFYPSSIIAALNVIEQLGWASVNCITGGLALSAVSDGRVSIAVGVVIVACVSFLFSFVGLRGVLMYEQYAWILFFIIFMIIYGESAHRANLAAPATVTGLTRSGNALTLIGVVYGSSASWSSIVSDFYVHYPANTPKIKIFLYTTLGITIPTCIGMLLGACISSALDTNPEWAAAYENGIGEILKTIIYPRGFARFLLVLLVLSGSMCYFFRELYSAPA

SEQ ID NO: 41613 - protein, 168 aa, A.fumigatus
YSSLVGVNCIAIYSGALSAQLLAKPFAKLPRAVWSFLVFVCILLLGIAGRDHLLDVLENFLSLLGYWNTSFFVILFTEHYLFRGGSLSNYDLDAWNTPSRMPVGYAGLTAFLCGAAGWIVGMVETYYVGAIAKMIGQDGGDVANELAFVFTSVTYIPLRKLELKYVGR

SEQ ID NO: 41614 - protein, 85 aa, A.fumigatus
SSHSAAVSEAIHSNQDRSMDVPKDRLCHKSAARLIQIVLSLSVFYFSFAGKPQSLKGLSQTLKSTANGISDFRGHYVVGSSLQHM

SEQ ID NO: 41615 - protein, 77 aa, A.fumigatus
VHDTRPQAARPNFNDLSSVEKYVLPSATYESLPNSVLAWKKTQKLGRFDPKALSPKESMQKQAEKDTEDVRVRGRSR

SEQ ID NO: 41616 - protein, 109 aa, A.fumigatus
LEGPLLFSVLTLSLNEDLVRYRGSRPWSLLKPIVWFQCSNTTYYLHISLALYENTSLVFSCSSIWKIPHTRLYDSHGVLSSRCLQFACHHVTDRRVHDFNWDSFIVNSI

SEQ ID NO: 41617 - protein, 98 aa, A.fumigatus
STLATLVMAFQPPPTDVSVIVTTPGTATGSEPRFLTERRVTPTWTVLQLKSKLETMTGIPTNCQRLLLKAPGRADQCVDGDDSIIGNWGLTKGCEIEV

SEQ ID NO: 41618 - protein, 123 aa, A.fumigatus
RLFRLFTDRGMAGIAVSRRAIILPSSPPHVRRGTIRYVGPVPTIPFPGVDVTSEETSDLGPQPIWVGIELDEPTGKNDGSVGGRRYFTCPNKTGVFVKPEKVEVGDFPPLDLFDDLDDEMEEI

SEQ ID NO: 41619 - protein, 382 aa, A.fumigatus
INLPVLELISSLDFVPAANMGESGLSVAGTPDAWTSAGSFIPPSIDRARLLSGESYAYYSPFPLASTGRSSQVTGDNHTITADFSTPSTSSSPSYFVLGVDEAGRGPVLGPMVYSAFYIPHTLHHSLLARDYSFNDSKVLTPGVRANLMRLLCTAGNPLHASCGWATKVLSARDISAGMMRPTSGAYNLNAQAMDATVEIIRGIVEERRVDIREVYIDTIGNPATYQQKLERIFPTLKITVAKKADALYPCVSAASVVAKVTRDMALEFCHEAVYGLQRYEAPSMEVATDSWGSGYPSDSKCVSWLRNHMDPIFGWGNECRFSWGTAKEMLELKGGTRVDWPVEEEGAAPIKDFLLTTARNAKRTEQDELREWFGRRSTEVL

SEQ ID NO: 41620 - protein, 63 aa, A.fumigatus
AVHSGVQLLSLYHDSFVSPGHCETSFNSSAAGSNTSFSIYKILDISFGSLSSGGSYASDGTIH

SEQ ID NO: 41621 - protein, 80 aa, A.fumigatus
SWEVSNAGAYLLRNPPSFRQGNPDHGTGCRRTGVTLKEGKRDEHGMEEIDGIFSSPEKSPEAYGNNTTIGSDGMSMDEGV

SEQ ID NO: 41622 - protein, 428 aa, A.fumigatus
STSSDLSPTMLILCLVTGNGLGPADFLGGTNGGRASFLPPPVARSPMKSGLSGSPRRTPGLRSSASPQRDILSSSPSDGKGLGSAKGETRRDVSPLTNRSINAPSLNHVNGLRNNKGINKTADTTVTVDFSDSDANSQMNGDENANAFEHMRNDYDDITDAGDDTLAEDQQDDSERVNRVDIGISSYTAAGSRKTERSRIAPKTKKLAQTEKTGSQDVTQKSETSEQGNVQKRKRPGRPPKSQKMNNDEDDTVGQRPSKKSKTASQTGQGLKSSGNPMLDKVVENYVNRTGPLKGRSLYILKREIPTDGSATHTRSGRVSVRPLAYWKNERCVYGDGEAAEGHRYPLSTIKEIIRTEELEPEKRKVSKRRSSKKSKSRKGRDDDSDNEDDDYVDPWEKEGGVLHGYVRKWDPDTQAGSIEEEVLGKYL

SEQ ID NO: 41623 - protein, 310 aa, A.fumigatus
  UNSURE (14): Identity of amino acid sequences at the above locations are unknown.
SILANIHMLTIFFXEQSILAFSSFRSIMIASSPRVIARLPSTVPRPAPTPHSRYTKYWISHSALYHQVALTLQMVRYTELLWEMIARRRGEKVRWRVVVLIEIIKATCRLLLLRLTNSRPLVSPPLPEREVDPRSTEEEASDWNGMQTPVSERSADLSWTMPRTGLSLPSLPDANDISNFLISKVLTADDIKPPKSLLHRVSGQGQLAEVLHILRPVIYALALQRWRQDKRSWRPWLIGFAMEYGCRQLAKSDFRERVAGGLRGLTGLEREELRKRGWAMGWWLMRSAFYENITKYAIPGLSFGVKETTS

SEQ ID NO: 41624 - protein, 111 aa, A.fumigatus
PRVIVDIAYAPSGIETRDVKDSTFRFAKLLSSPFIGSGIVELPPGGVKKPKNSKKMHMVFYVCHGRVQVDISGVQFSAGKGCVFQVPRGKEPLQGVLALCLAPLQFIAHAD

SEQ ID NO: 41625 - protein, 115 aa, A.fumigatus
GCHHCAEDSGIGTYAKSQNLDGNASSEQGQPTSAVLPHLGNLLHLTTGKGKLGVTDLFVSFTYLQSSELAKIIVTVSRAHDDGKRAGIPLVKIDLIIISLHHPYWRGESATAPMD

SEQ ID NO: 41626 - protein, 439 aa, A.fumigatus
PLLVVLQTRHDPGLHRGRRTYVSDCPLSIIGHLTCSSSTRLPFSRWGQCPPRAGIGRLDAVYGSADHLWLLLARLTDFGYRDRKRKLHVARTTGQDWRPGPSLHKFMSRFAKGSATVPRGPPPGSAQNRGPEPNRQSPVDGPSAGRENSPPMYGMVPPRGPTRLPSAFASTAHRSLSPGKDEEGDVMSYKDAESEWEDIRAAFDTFAGALGPDFLPLPADTIPPIATPFGPALQYRTHTVAVLWGFYYAGRILLHRLHPSMPPAMMVAAGVAAPTTADYAQIIGKVAAGIYFPQWFNVEAGKLSPTLGACLIEMTVPIFFAAVQFVDAAQRSWTISKLRDVSRLTGWKSSEAIALGCENAWAVAAKQGRGPPYERTQENLRKRPKEDPSPNEGVSEEHHAGVNTERRLVTISKSMHVHWAMGLLSLEDDVLIMETDDRR

SEQ ID NO: 41627 - protein, 224 aa, A.fumigatus
PFLLYSSQYSNEAYDYPPNIRESFNDLGRTISEKVQLLSQASSPAEAQAALVAPPSAKPQPKTFNHAIARASLAGSQTLAQVHPGEDPLATALEKYALASEKVGEARLAQDAQIQSRFLAGWNTTLNTNLMFAAKARKNVENARLMLDSIKARRKAAAGGDLDNLSEEARAEIEQAEDEFVGQTEEAVSVMKNVCFVPHLHESTPALTRSRSLTPLSLCGTWQT

SEQ ID NO: 41628 - protein, 516 aa, A.fumigatus
  UNSURE (3): Identity of amino acid sequences at the above locations are unknown.
LHXRGSFQPRGEDQETNIDTLQPRPQQYESARLVAVPSAPGTLPYGFPQLQLDIQNHDYLRHGTSAPTYNVVPARDQQFPPQQASAWPEPPVPVMNPQGTSMDPTPAFATAPIPQVCDHILIGLVTSYSTLYQKFHQAGPATTTAFASGTRQEQQPVHEPTAIPLMTSSKEFIYVDDESEEYYDVESDEEMEEQTSAEDFNQLSLIVASANQDERQLRSFTTYLNEPNMLASYHPTLGSSPLNNPKTARIFVHFIHSTGPSLSIFERHPADSAHTLGSPVPAAQQGLWTHTMPLKALEHQALLQAILALSSLHISYLQQAPPTVSLKHYHYALKRVGHAVGLPQRRKQVGTLAATLLLAYYEVMTAEHSKWNSHVAGSAQLVREIDFATLTRDIRSHRRRVWAQRQRLLEAQSAYAGYYAFDEEFLEMTYLLKKKSSIDENFIGSLLGRAVNFDQFGQVEDGRTRQRERHFTRKDIETYRIHCDLYWWYCKQDMIQAFIGGGGLMLVTALFRSLAI

SEQ ID NO: 41629 - protein, 60 aa, A.fumigatus
HDGVISHSASFTPFAARTQQLIKEQLGQAEDKTQLPDEYIELEKRVDALKLVHQKLLQVT

SEQ ID NO: 41630 - protein, 239 aa, A.fumigatus
KLADDLPFADHRKSNRLEFYSPTPDGLDLVASCAIYAKVTMLARLPAPANSPTDHLFVGTDRYTYFTLSWDSSEKRVRTERDYVDMSDPSSRESQTGNRCLIDPSGRFMTLEIYEGVIAVIPIIQLPSKKRRRAVALPSGPDAPRVGELGEPTTARIEELFVRSSAFLHVQEGLPRLALLYEDNQKKVRLRVRELQYHAATGSNSTADATFGEPADFTQDLELGSSHLIPVPAPLGNLP

SEQ ID NO: 41631 - protein, 266 aa, A.fumigatus
  UNSURE (259): Identity of amino acid sequences at the above locations are unknown.
TGGLLILGEMSIKYVDADNNEIISRPLDEATIFVAWEQVDSQRWLLADDYGRLFFLMLVLDSDSQVESWKLDHLGNTSRASVLVYLGGGILFLGSHQGDSQVLRISNGPLEVVQTLSNIAPILDFTIMDLGNRSSESQTHEFSSGQARIVTGSGAFDDGTLRSVRSGVGMEELGVLGDMDHITDLWGLQVGSSGDFLDTLLVTFVDETRVFRFSSDGEVEEMDHFLGLSLSESTLLATNLPGGRILQVTEQRVLIAKNXGRNVILE

SEQ ID NO: 41632 - protein, 404 aa, A.fumigatus
TPPTQFIITAASANDDSIVLVAGGELVTVLNITNEVQVVTQKDFGADSQISGVTVPSSPTGVCIAGFPQLAKVSVLKLQDLSELHTTSVGMAGEAFPRSVLVANVLTDSPPTLFVSMADGSVITYSFNTNNFSLTGMTKLILGSEQPTFKKLPRGSGLFNVFATCENPSMIYGSEGRIIYSAVNSEGASRICHFNSEAYPESIAVATSHDLKIALVDKERTTQIQTLPIGATVRRVAYSPSEKAFGIGTIERKLVDGTEIVKSRFVLADEILFRRLDAFELRPEELVESVIRAEFPAGKGANDRDEVKDRFIVGTAYLDDEGDESIRGRILIFEVDNGRKLTQVAELPVKGACRALAMLGDKIVAALVKTVSVHSPLVYLLLRYPTNAPPRSSYIRSSTTISAP

SEQ ID NO: 41633 - protein, 89 aa, A.fumigatus
ESYGSLVNISSVSLHKEIVRSLLRDVLLLYKDGSVVEPIYSLAALEYGVHYIAPSSYVDGIGPLILSYLSIVIKSAKQNMTLCCLGGSQ

SEQ ID NO: 41634 - protein, 626 aa, A.fumigatus
GQVCLFERQQSNMAQLDTLDIVVLVVLLVGSVAYFTKGSYWAVPKDPYAAANSAMNGAAKTGKTRDIIQKMEETGKNCVIFYGSQTGTAEDYASRLAKEGSQRFGLKTMVADLEDYDYENLDKFPEDKIAFFVLATYGEGEPTDNAVEFYQFITGEDVAFESGASAEEKPLSSLKYVAFGLGNNTYEHYNAMVRHVDAALTKLGAQRIGTAGEGDDGAGTMEEDFLAWKEPMWAALSESMNLQEREAVYEPVFSVIEDESLSPEDDSVYLGEPTQGHLSGSPKGPYSAHNPYIAPIVESRELFTAKDRNCLHMEIGIAGSNLTYQTGDHIAIWPTNAGVEVDRFLEVFGIEKNRHTVINIKGLDVTAKVPIPTPTTYDAAVRFYMEICAPVSRQFVSSLVPFAPDEESKAEIVRLGNDKDYFHEKISNQCFNIAQALQNITSKPFSAVPCSLLIEGLNRLQPRYYSISSSSLVQKDKISITAVVESVRLPGASHIVKGVTTNYLLALKQKQNGDPSPDPHGLTYAITGPRNKYDGIHVPVHVRHSNFKLPSDPSKPIIMVGPGTGVAPFRGFIQERAALAESGKDVGPTILFFGCRNRNEDFLYKEEWKVCLQSSYEHIRSRLSDS

SEQ ID NO: 41635 - protein, 98 aa, A.fumigatus
VYQEKLGDKLKIITAFSRETAKKVYVQHRLQEHADLVSDLLKQKATFYVCGDAANMAREVNLVLGQIIAKSRGLPAEKGEEMVKHMRSSGSYQEDVWS

SEQ ID NO: 41636 - protein, 63 aa, A.fumigatus
HMLRGKKFRRSLISRIGSRLYVQVNTLMLFSRLLHETVLVSRMIQLYFYFYRLLGIPKEEDIC

SEQ ID NO: 41637 - protein, 62 aa, A.fumigatus
VFFRVLTEAVSFKFLPSVFLITSEQIFTAQFFFTLGSPATITRAVPRKSGEYPPRGHAYSNC

SEQ ID NO: 41638 - protein, 194 aa, A.fumigatus
RSTKVVVYKVINNNFGAMRLEKLASYRTSTAPVDVTVTGNLIAVSDLMKSMCLVEYKEGENGTPDTMTEVARHFQTVWATGVANIAPDTFLESDAEGNLIVLHRNTTGVEEDDKRRLEVTGEISLGEMVNRIRPVNIQQLASVAVTPRAFLGTVSFSLFLLTNSARPTDRTNHDHRWKVLFTYLLSSIPITRTS

SEQ ID NO: 41639 - protein, 92 aa, A.fumigatus
  UNSURE (65): Identity of amino acid sequences at the above locations are unknown.
GYCDTRNLTICPKVLLRYDLDFVGNIQDCHKLAACNKNDGIIVGRSGSYNELGRWSSFENYIPAXIFCNEDPLLSDLQYSPTGQIGRQKSAF

SEQ ID NO: 41640 - protein, 196 aa, A.fumigatus
SLPSTMATSESSSVVSDALNDFFSQLYTFIETVFRRFFKNLYRSFVEMSAKRWTKIIVIVVVYILIRPYIEAWFRKMAEKDRKKQLEKEKAEREAKRKNKAKISANALRGGATGGGKVLGEVENTDDEIESGEDFATASGVPEWGKNARKRQKKYMKELQREAEQRTDKLSDEQLLELLDWSESEDEKKQEETKEE

SEQ ID NO: 41641 - protein, 85 aa, A.fumigatus
ISLGSSAEDTAIISCIAFQVNDTDARMLAWLVMQEDGKAHLSYYLSCQGHYWVRTSTYGMTITCGFQLIPEFLLSPTLGPIRTLQ

SEQ ID NO: 41642 - protein, 407 aa, A.fumigatus
VIRGHALDDMGRTRQADRFNDSCDTNLILLNKGGRRDGVVTRLKPVEAFDKERTRDSRERLRGDILKSLSDVEALVADLLVKVILIITKAHDLGFAFFVGGEWHQRGHELTRNRCANFHVEANGRVVCGWGRNGNLGSDIKTFDVNNCMAILFNAKDLEETIDFNTRVGRPDSDVVTSLISEVTASNADLHVKAITILGRKQFTGLNDGSDVRIVCRVGTLGAAAEMTLSRLAKVDAIVLGAQRFIFNHRENRFIDSLALLQVHRFRQRGPHGLLPCQEVLLHCTSAVITLTSGSDALRTKLCKSSIDVANHSIVVLVGVVTKAESNILEGGEWLFLSGGTTLESDVLTGDKLVKLDGVIGWLALTVGSQNKESDLILGELIKIFIVVIFEISDHGLQAETLGTFLC

SEQ ID NO: 41643 - protein, 233 aa, A.fumigatus
SYRSPTEHLSYPKSPTSHLTGGFWLGLLHFNMSATTAATDLVSKLPLRLRNFFARYPPQIYSAAVRPPITEPETAAEESLPSPYTPNRDAKGFKKPDPKAFSPSKALLYSNPEHPNPFLPRKNFRNGKWIGPPIGLRRQAELVKLAIKYNVEALLPPGRKSTEYKETRRAERGLAIKGTGVGQKVKGHKWERTMEARLEDRRKAMMEMPEMIRLWKQVSIQLMFECPVGMCRG

SEQ ID NO: 41644 - protein, 247 aa, A.fumigatus
GVWIVKRSLFVGKEILTGVVTLRAAWIFENSQTKDALMAFQRSLVSSKAQELGWEFSDKDGHILQQFKALMFGSAGMAEDPVVVKAAQDMFQRFAGGDLGAIHPNIRGSVFSIVLKHGGEKEYNVVLDRFRNAPTSDEKTTALRCLGSAEDPALIQRTLGLASSDEVKNQDIYMPLGGLRGSPAAIEARWDWMKTNWDALYKRLPPALGMLGTVVQLCTASFCTEEQLKDVQTFFENKDTKVSFDAC

SEQ ID NO: 41645 - protein, 269 aa, A.fumigatus
IEKSAYHILLIILRREESKNGGGMDIHDVCILVAEESDSHTTLTCTTGTTDTMRVALDGVGHIEVDDETDVGDVDTTTCEIRGDKDVRRAVTHGGKRSFTLFLGLASVQGNGGEAHLFDLTGDGVAVALDVDEDDDRGSELARGEDVGEPFLAFVFTGDHLDALLDGVDRLAGAADRHDGGPAEVFAGDALDGRGHGGRVHHCLAVAVTPHGGGVLGFFRVGLLVGDGKGVEDFVHGLLEAEIDHPVSFVHDDVAALAKHEETALNAVN

SEQ ID NO: 41646 - protein, 94 aa, A.fumigatus
EIPQPGVRLSHISLGLAARKGGRCVAGESGFFLNLVKFYLCLSRNRLTCVIQESLSPPFIAFPLSQVSPFIAYYSFSPVLALLAPLSDCHYGGL

SEQ ID NO: 41647 - protein, 80 aa, A.fumigatus
LTDVHLRPMTLTTSRRGRSLFALPRRWKVESIATPIRQAITTVRNVYDRFLAKFPLLFGYWKKYADLEFSITGTEAADMV

SEQ ID NO: 41648 - protein, 495 aa, A.fumigatus
CLPSLPSPLSVYPPLPRFCSNNVLVAGANILFCRLFERGASSVGLDFLAHPFWDKYIEFEERVEAPEKIFAILGRVIHIPMHQYARYFERYRQLAQTRPLSELAPAETLSQFRAELEAAAGQIPPGAKAEAEIERDLRLRVDAYHLEIFSKTQTETTKRWTYESEIKRPYFHVTELDEGQLTNWKKYLDFEEAEGSYPRIQFLYERCLVTCAHYDEFWQRYARWMSAQPGKEEEVRNIYQRASCFYVPIANPATRLQYAYFEEMSGRVDVAKDIHDAILATLPNHVETIISLANMCRRHGGLEAAIEVYKNQLDSPQCDLATKAALVAEWARLLWKIKGSAEDARQVFQKNQQYYLDSRPFWNSYLMFELDQPTSAATENVQYERIKQVVNDIRSKSALSPDVVRDLVQIYMVYLLERGTKDAAKEYMTLDREVHGPASVAHTKTGGAVQAPQNSSQAAPVATVVDPTVAAAGAAPQTSPYPYYQQTPVNGGVSA

SEQ ID NO: 41649 - protein, 669 aa, A.fumigatus
LTAQPKFLSKAERERIALEKRAKEVEAGRRLKLDPFTDGTDRSGTQSPSVYPETPNGDERSIPTGPRAMRNSEVPTGPAAMRNKTYDMSPPPPPKAMSFSLTDGKGDSKRQAEEDEAAAQAALIKQKYMGTEKTSSFSAKKKRKRTTDRKFNFEWNAEEDTSGDYNPLYQQRHEANFYGRGRLAGFGDDVADTLAQKYARALEDRDREAGSIRAREILEMERRRREESTRNQLDKHWSEKKLEHMRERDWRIFKEDFNISTKGGSVPNPMRSWEESGLPKRLLELVDQVGYKEPTPIQRAAIPIALQSRDLIGVAVTGSGKTASFLLPLLVYISELPRIDEFEWRKNDGPYAIVLAPTRELAQQIEIEARKFTQPLGFNVVSIVGGHSFEEQAYSLRNGAEIIIATPGRLVDCIERRLLVLSQCCYVIMDEADRMIDLGFEEPVNKILDALPVTNEKPDTEEAENSAAMRSHRYRQTMMYTATMPSAVERIARKYLRRPAIVTIGSAGEAVDTVEQRVEMIAGEDKRKKRLADILSSGEFRPPIIVFVNIKRNCDAIAREIKQMGFSSVTLHGSKTQEQREAALASVRNGSTDVLVATDLAGRGIDVPDVSLVVNFNMANSIESYTHRIGRTGRAGKSGVAITFLGNEDADVMYVHSPPIFAFFPSQNY

SEQ ID NO: 41650 - protein, 212 aa, A.fumigatus
SPVKTNARNGSPTSSPRASSDPRSSSSSTSSATATPSPVRSNKWASPPLPCTEARPRNSVKLRLPPCVTARRTSLSPRISQVVVSTSPTSVSSSTSIWPTPSRATRIVSVVPVVQVRVVWLSLSSATRMQTSCMSIPPPFLLSSRLRIIRRIWYADFSIYYRYDLKQMLMKSPISRVPEELRKHEAAQSKPNRGLAKKSDDSSGFGTKSGWQ

SEQ ID NO: 41651 - protein, 535 aa, A.fumigatus
LALCQCSGAWLTFVFRVSRRFHALAGDSELWKRQYYSRWVRPRARRVANIRHATLCASKATYSPHVSTWLGHSHLAEGKVTNWKRQYRLRHNWSKGICQVTEVELPQPPHSPMLIRFCAGFVFTADCEHGLRCWRASHQISCTARLPLVQSELETSAFPTALAVSRCLAQNLIKVTVGFADGRFGVYDMDTKSLYLRLRSSNAASADGAITAMAISNSYLLMVSEHKVLSLYEMFLAEPEHSTRSNAANTSKQSAAEDVKLLESLKADSILSPMSLSIRLAHSKIIASIVYSFFHIGCGWSLGIQELHFGKNGEQIGSRLATTVNAQYGAMPLHHLTRSRRGYSSSFQSEPSSGESLVELTEPSILHQETPTSISYSHPYLLTSHADNTLTVYLVVSTGAKLFIKGGQRLWGHTSSVSAVQVSDHGKAISVSSRGDEIRVWELESLIPSLGSSKEARVENSIQVNPENKLCKIHGGGAPLALFLACQHCGPQLASGQMSREYARMGDCVGFDDERLLLSSRKETGAHLIAMYDFT

SEQ ID NO: 41652 - protein, 139 aa, A.fumigatus
KKISLRNRINQPLINLFSEKEKEIQYNKITLPVFAHILSKWNIKLEVVDASTVSPCKPNKKISAIVNLCVLRSHPYLSHCRCFPLYCAVCISRFQCIQRSRWSRQPSINTLCLLARVLYFLRLTIMRSFEILAICSFGK

SEQ ID NO: 41653 - protein, 124 aa, A.fumigatus
LVDQWHLLPLGRECTVAPKEKSCYRCGVAGHISRECSQAGSGDNYNGAPSGGQECYKCGQVGHIARNCSQGGNYGGGFGHGGYGGRQQTCYSCGGFGHMARDCTHGQKCYNCEFLVNLRFALVE

SEQ ID NO: 41654 - protein, 425 aa, A.fumigatus
LMVFLALSALGVPSTRALAITLLPKSKVLRERIEPGAIVARFAETWLRIGSFDLPHSRGNRDLIRKLATFTAEDVFGGWETLPGVVSLGSDQSADAVDNPARGIPRDHAEEHQGVTENRFARLYREIVRRNAKTVAAWQAYGFMNGVLNTDNTSILGLSLDFGPFAFMDNFDPQYTPNHDDHLLRYSYKNQPTVIWWNLVRLGEALGELIGAGDKVDEEWFLKDGLTEETAPPVVKRAEAIIERTGDEYRSVFLNEYKRLMSRRLGLKTQKESDFHELFSEMLDTLEALELDFNHFFRRLSNVALADIETDQQRMDTAPIFFHSEGFGGIGYTERSAKERIAKWLAAWRIRILEDWGIENDADRQKDMNAVNPKVSLKRFLFLTSSLFILCCLYLAHTLAMVSTHDASLTCTCYSLYHADGFSMK

SEQ ID NO: 41655 - protein, 156 aa, A.fumigatus
RRCFMSLRSRLSRLRSMRYPLGHMANQLSTRAAGVSLAELPKSNVFTTKLPPDPAFETPESSHKAPRETLGPRLVKGALYTFVRPEPAGETELLSVSPKAMKDLGLKMGEELTPQFQALVSGNEIWWNAKDGGIYPWAQCYGGMTNSRLESIRSDC

SEQ ID NO: 41656 - protein, 63 aa, A.fumigatus
NEPPAREIDPYQRAISLFECINPQTKRRFELQLKGAEKTPYSRFADGQGCSSVEYPRVRCVRR

SEQ ID NO: 41657 - protein, 75 aa, A.fumigatus
CLADVYMLQFIPRGWILDEVIERVEKRGDRKILDRVMQMALDPFRDSWGLDKDEEERFCGDVPRYKRAMMCSCSS

SEQ ID NO: 41658 - protein, 68 aa, A.fumigatus
RDTEDRRPEMSQLVRASGLDVSRLLALVANSFTLGFSGAVAGYMSNISTYDHCYSTSAKRRLTRNSQL

SEQ ID NO: 41659 - protein, 223 aa, A.fumigatus
  UNSURE (26): Identity of amino acid sequences at the above locations are unknown.
VVASTANVTFYVVEDHSLEDGVQSQXKRNILAYFSKGDILIGFIGDSQLVGWLSHTPALAESIGAFSVSCRRRLHLDLPQVVCSRFKDKMASEPAATVADLDFDNEQYDSAEDEDFQLDPDQEDADLTGSDSDDEATEPAAKRRKTGPTKAATEDQELDSGDEAMIEKVKARKEGKQKGKKSQGTASDEDEDDVDFDDDDEGGPGGFVRTRAMRMRMCVEPLY

SEQ ID NO: 41660 - protein, 256 aa, A.fumigatus
GCECALSLCTDLSLHPEDQYLLLHRQEERKPLAKIDGATVDVDAIWAQMNAPDSSAGILPSQTQAKDATPAKDENKNADTAEEQVLSPDSKPQYKEEMVKIKRTYKFAGEVITEEKIVPKDSAEAKLFLAKGESVETVTDADVEHAANAKDALKLRRPLRKISRFDPNPTGTIKKSWEKQPTAGITGQTENISGPKINTVEKSRLDWAAYVDQAGIKDELKEHSKAKEGFLGRMDFLNRVVAKREEERRNARLKGL

SEQ ID NO: 41661 - protein, 160 aa, A.fumigatus
STRVLPYSFASGTVSPLLKGSEEGLTLCRQPQRALTYIKRKQAHKLVPAFLACFETMWNGQLDISKPENLSKALSKAFSGTEVEEILAAAASPEIKHELTATTERVVKELGAFGCPWFWVTNGEGKSEPFFGSDRFHFMWDFLELPHEDLRLKVDEKAKL

SEQ ID NO: 41662 - protein, 115 aa, A.fumigatus
PLFVLTPNFFRLCQPVHPAKMPATHFPSMGKLALGAMHLASGFHNHNLQSCPGDIPVSCSNTTAVPDSCCFNYPGGSLLLTQFWDTNPATGPSDSWTVHGLWYARAEGNNKKYGH

SEQ ID NO: 41663 - protein, 82 aa, A.fumigatus
TIFSDAILGILNSPTDVVNGQLLLDEDFLRDHCGVSDFSKYAVIPGSQPRRIMPKELPVLEVAEQDDEGMRVDSTMLRKAKL

SEQ ID NO: 41664 - protein, 68 aa, A.fumigatus
LWSQRNPDQQSSKINKIVPGHSLTVPQFYPDGLPSAKRQSCNYKFETDHMIGQTLSDRLPASTRMATK

SEQ ID NO: 41665 - protein, 253 aa, A.fumigatus
LNSGTPIRPLVLQIPGLFMVFGMPEQREIIKNMATNNQRRPDNCDGTYEQFCDSSREYSNITEILQAQGRTELLSYMQTYWKDYQGDDESFWEHEWNKHGSFVPIWQSRPGTNDDIGTCINTIEPSCYTDYKPQEEVGDYFQKAVDLFKGLDTYKVCIRHGLLIILRLTGQALAAAGITPSSSKTYKLSDILSALSAITGHEPSVGCSNGELNEAWYFFNIKGNLINGKYVPIDPRMLSVYPQPHRQQLTSNN

SEQ ID NO: 41666 - protein, 147 aa, A.fumigatus
DLIQFNRSENYVTLSATKRRIWKRIWWTLYTRDRSVAAAFGRPLHINSEDCTVEDLKESDFIEYDEENDSATDRTAIVFFMQYVKLCQLMDLGLCLKLSSRSTEDSRMKGAAQCELGLNDWLVSCPSELQWRQSRHNFWSAILYSTF

SEQ ID NO: 41667 - protein, 141 aa, A.fumigatus
TVDHLDPLDVDILHQRHAFDLPSQAVCDALVDVFFKWIAPVLPVINRHDFMRRYRNPQDPPSILLLQAVLMVASRFHYDAQSSGNGIISPRILYKKVKALYDAGYERDPTTVLQAVVLLGVYWDGPDGRTLLNALMCIVLC

SEQ ID NO: 41668 - protein, 181 aa, A.fumigatus
TWPRMATKVCSNHTHIFKHVTDTILVVVAAKTTSNAYATVPFPPDPNSSQSTINTVEREIKESGGEAFALPVDVRDVKQVENLVHEAVRLTGRLDVLVYNSGAIWWSSVANTPTKRFQLMQRVNPEGLYASVQAALPYFEKNGWKGRIIVVSPPIYSRFFRGKTAYAMGISSVLPSHRSLG

SEQ ID NO: 41669 - protein, 69 aa, A.fumigatus
PSRNFAGYSPLAWLVSAPLLVLWSRNTSLTGISASITPLRAMMNQGYGVVGPFRVSPASSRTIIGMFST

SEQ ID NO: 41670 - protein, 86 aa, A.fumigatus
SHRNNGFLRYWTVSNIPLFALASPMLAIMTYSALWTLNVESGRLTGAGRLLRSLAAPQLIMAALTFSTHHVQIITRMSWGYPVWYL

SEQ ID NO: 41671 - protein, 140 aa, A.fumigatus
  UNSURE (61): Identity of amino acid sequences at the above locations are unknown.
TDTQTRKLSDFRGRMQTQPICTDMMYDRRHQIELKKLFCKFRNTHVHTQKDLGPENMFVGXRSDEAIDALLRCFCAPGKGQDPYVSSYVWHVCGQRGSQRCRDCEGAPGRQQWLPAAAGQDQRGVVCGPDDQNGIYLLPW

SEQ ID NO: 41672 - protein, 311 aa, A.fumigatus
DVSVLPGKDKILTCPPTYGMYAVSAEVNDVEIVKVPLDVNNGFQLQPDKINEALSADPTIKMAYICSPGNPTANLIRKEDIQKVLEHPTWNGVVIVDEAYIDFAPEGSSLAEWVTEWPNLVVMQTLSKAFGLAGIRLGVAFTSPEIARLLNSLKAPYNISSPTSAIATAALSPENMAVMRNYREQIIAQRKRMLQELPKIPGVGRFLGGQESNFLLVEMLDKPASEGGKPSNAVALAAYEAMAEKRGVVVRFRGKELGCEGCLRITVGTEQEVTRFLRELRAVLDGLLKGVEIKSVRDEVNKENQANQVVG

SEQ ID NO: 41673 - protein, 370 aa, A.fumigatus
RYATHLEAGTDMTITITQVYNNNITLTPSQFQSPIHDASKMVPQLFPPRHVYFPSNPSHTSTVILLHDTNSTGAELAAALDVSTTPATETATAGNPKSIFEHFPSCRWVFPSAQPRQIDICYASRGNWINVDVDVAVAVDTDANEDTDPGANSLQQPQPQLSPSTKDVDNNYNNNADQNDDLETCVEYILQVVEEEIIRLDGDSRRVVLGGFGQGMAVAIAALLAAQRRLGGFVGVSGWVPHPERIGSLAGRGRGLLVENEARMGASEGSAGADGVEVDPGADSMLETPVLLSYLEDDPCVDIQTALTVDETLNRLGFVKVVWDACPSSPQGEGSLLHLHHLDTIMGFLTQVFDHEGSNLPQYDMLGYST

SEQ ID NO: 41674 - protein, 198 aa, A.fumigatus
VRDYPGPLWEPRSTRLTHFLQPYSRTKMKISARPTAAMQAKYTPLPTPANPDPQPDCGTIYVEFCADSTGVGTKQVRAFNHFVDENNFHTGVFITQTPISPSAVRLLSGIPGRICEHFQEQDLLVNITRHELVPKHVLLSPEEKKNLLQRYRLKESQLPRIQVSDPVARYLGLRRGQVVKIIRKSETAGRYASYRWVI

SEQ ID NO: 41675 - protein, 519 aa, A.fumigatus
  UNSURE (318): Identity of amino acid sequences at the above locations are unknown.
QDANPMIRQALFAKTQSGSYMRLRSLYPSIPRWSQARHSLRSFSNESRSRSSIDTFLPSGYQDSLTRSSNHPGHGPWTPSQSTASFSTSSSLSEPADWDENPNLSISTFSELPSKDFGVNQHMIINQEFKEALRQILWQFRAPIRYAFAYGSGVFPQSGSAAGSSQCHPSAPAAIQNMQQGKGKMIDFIFGVSYTQHWHALNLSQHRDHYSALGSTGSYMVSQVQDRFGAGVYFNPYVTVNGTLIKYGVVNLDTLCRDLSQWDTLYLAGRLQKPVKILRDHPRVRLANQINLLSAVRVALLLLPAEFSEFELYTTIAXISYMGDLRMSLPAEDPRKVRNIVSGQMAHFRRLYAPLIENLPNVTFNDRRCTEEDWIDDPNANVRLTQDMDPVKRGNMVRRLPESFKQKLYFQYQSRFEIPQVEFNKMMKESSDSDSEVVRRRQGGPFEQRIAADENLKKEIQASITKTIRWPSTVQTIKGLFTSGISRTWRYLSEKQSKYRTSGRKAKASSEESPSSKHE

SEQ ID NO: 41676 - protein, 68 aa, A.fumigatus
VSLTHFPFLLPPLQFSKVMAAAANAAPATEQKARPTKPNEEAFKADLAQAEKEHAAVQEKLVCEVSVN

SEQ ID NO: 41677 - protein, 94 aa, A.fumigatus
  UNSURE (78): Identity of amino acid sequences at the above locations are unknown.
DPGGELTQRFQCWQFKCANLFDRTSRGFRRRSGVWKRKRRTLTANVLTDHAKKVGYENSGVNGKVSAEAELKQENDAXADVSEELQKASIEDTA

SEQ ID NO: 41678 - protein, 82 aa, A.fumigatus
EPSDFLLCSYSDSQTALTTEFLAPEPDNNAPLLSHSLVRCQGYGVTGLSAFTGRFVQHLYEEEVGFLSTKETTYTWDLGELL

SEQ ID NO: 41679 - protein, 419 aa, A.fumigatus
RYVFTTSCKLRNIYKDTNYAQNQIKAKIESAKPNNQDSPSAKRQQELRAELSSIRQKQQGFKASRTSTQEKINALELTLKARITEQNNSRTRMPFKNVEDIDREIARLEKQVDSGTLRLVDERKALSDISTLRKQRKNFAGLDEQQKVINDLKAQIATLKKTLDNPEAKALSDKYTEIQKELDAIKAEHDSAFKNLNALRDERTKLHAEQQKKWNAIREIKDNYYKARKAYKEYEDEAWRIRREKQKAQREAFEREKKKKIADKKLEEASRPAYTDEILIAQGLIRHFNPSYDFSTLGLDDKKDQSSAFRAQVGRTVDDSNIKGMKVLKKEDREEDYFVGTGGKKSKKGKKGTANGSPAPGTPAEPTKFNLNVGVIEDFAKVKIDPPMNQSDVPAVIEKLPPKITEWKANQAAKTRGVS

SEQ ID NO: 41680 - protein, 612 aa, A.fumigatus
VTLAPSFSMAKDELQEANQQSHQVGDRPNKTDSIGSDEVVMNRGANFKGRNQRQLWGGSVHLNSDSRYRARPRTTQQIPRQNANGTPNRPAAMENHTTEDDVRCQIKGPPSAQKTANKAPSLEALDELKRLQKEIVLQAHLNRYKDHEDDTANPESLAKCRDGPGTDPKSDVYKSIARCRLTANPNATSSHPGSSPEDKFEGDVNDRYFVDEIRSRVQKFYAAKLDAQRESYHNSVSVYPAIVDGQIFLSRYPSAEHERPEKTLSNTERQTGSQDGSHKPEHCSMVKWEDRWELRPRACSTYEGFRDWFRHWLEMETGDSPNIDIHHQTFFDGTAHMDGIKSFYILDLGDVPTRLDMTSEATRLHYHETAEGYCHNLALHMRAAEEEAKTRRKQARDAFIEGLKVCSPKDPNSPRANVYLRSVEDGDVPGLLMIMNWYGQKSNLSSNLGTLDEQDVRQQIEDSRRAKLPFIVAAERRRGPSVHDTPENIFGYALARDSLGLQTTGRYTAELEIFIKPDQKRRGIGKCLLDKLIEVCDVTYVPKRGIFYDAGCDDKTGFYPGGSRTLKRLVFIISYSVPERSQIKWLIDWLERDYHFEQQGVLKGARVKFERL

SEQ ID NO: 41681 - protein, 75 aa, A.fumigatus
  UNSURE (45): Identity of amino acid sequences at the above locations are unknown.
SALQRIKSVENFREGKVAFLLATDLASRGLDIKGVETVINYKTAXNHEIYLPRVGRTARAGRSGRACTIATEPER

SEQ ID NO: 41682 - protein, 662 aa, A.fumigatus
TFFFLSAQEILDRSRRPGRKNRSGLSPSTSLSLALREFLQSCAPLFAFRRPNNGRSPRKMAPNAATKKRAAARDDDFVLTLSDDENDIFENGVEEDGDNAQEDTLSSSKKRKREAAEAPKGKNKKQKQLKKSKKGESAAGAVSDDQSSEEDEAEAMDAGEDDGALDSEFEFDVGGNANTGVIEGFDGWEARNGASLADAPKNGDKKAVDIDDIISRRKAKKEAELKKKQQKEKKRREEEGEEESEGEDADSDGGMSVDFQDDELLAADGFGMGADGADESDDDVENGSNDSDDSEGKGSEDEESGDEYNDDDAASDNDSVATPVHHPDDEAASDEESEAESEVDAEEAEKRKAFFAPEEKSTAVSTFNRSFQDFNLSRPILRGLASVNFTTPTPIQQKTIPVALLGKDIVGSAVTGSGKTAAFVVPILERLLFRPRKVPTSRVAILMPTRELAVQCYNVATKLATHTDITFCQLVGGFSLREQENILKKRPDVIIATPGRFIDHMRNSPSFTVDTLEILVLDEADRMLEDGFADELNEILTTIPKSRQTMLFSATMTDSVDKLIRVGLNRPVRLMVDSKKNTSMNLTQEFVRLRPGREDKRLGYLLYLCNEIYTGRVIVFFRQKREAHRVRIVFGLLGLKAAELHGSMSQEQVCQLINQIVT

SEQ ID NO: 41683 - protein, 133 aa, A.fumigatus
RRYPKRLSSLPGRNRTNSWVRFMDVFFFESTIKRTGRLRPTRMSLSTESVIVAEKSIVCRDLGMVVKISLSSSAKPSSNIRSASSRTKISSVSTVKLGEFRMWSIKRPGVAMITSGRFFKMFSCSRRLKPPTS

SEQ ID NO: 41684 - protein, 64 aa, A.fumigatus
SKLAQLDIFDELYGHLLTSLQRLRLDSIKTHKWTILPCSAMTGKNLYEGLQWVVQDAKDRLFLY

SEQ ID NO: 41685 - protein, 153 aa, A.fumigatus
KSTRLWTFLQVQRKPCASLLPQHQPRSRLQIPRQTLLRHQDGVLEWQLSRYRKQHHHHYIHHHSPRPRCPFPPNRRCHWSRSPHRRHSHLHHRHPYQIRLQQAIRRPESPLTYRHQSRHLHLHSPPLLPPPSSFSPSAASFSVQPLSSLSSWI

SEQ ID NO: 41686 - protein, 82 aa, A.fumigatus
KDKFSQNAVNIEKSSLKGQGDENFDAVSLLTTEKQPIWMLTFDVSGLDNAGKTTIVKQIMNEDVRTVSPTLGFIIKTIDFEG

SEQ ID NO: 41687 - protein, 81 aa, A.fumigatus
EKPTARTPQGTSIDFCPPGDVGGQKTLRSYWKNYFEKTDTLVWVVDATDRLRVDDCRDELAGLLLEEVRVANVPARLQNFR

SEQ ID NO: 41688 - protein, 98 aa, A.fumigatus
LWMGTHPSLPSKDLETQRTLLDMVQDNQALISQEVSERYGGKLPFLFKVLSIRKALSIQAHPNKKLAEKLHARDPRNYPGEYTAFKRTFVVYFQTAFH

SEQ ID NO: 41689 - protein, 332 aa, A.fumigatus
LFSDDNHKPEMTIAITPFEGLCGFRPLVEIIHFLKAVAPLRQLVGERAASEFENTVKGSEESEDPAVTEKNKQALRTLFTSLMRSSPESIEAATKELVAIAQNSPETFTTSSSTPETNPTNPAELAAITVRLNGQFPNDIGSFVFFFLNFVKLEPGEAMFLKADDIHAYISGDIIECMASSDNVVRAGFTPKFKDVDTLVDMLTYSYAPIAEQKLEPTDYPYAVLNAPAYSSGSSCILYDPPIEEFSVVKTDLKRQGAKATFDGISGPSIVICTAGAGKITVGPKTEEVNEGYVFFVGANAECIIESTGEDTFTTFKAFCDLTGKEDMVNGN

SEQ ID NO: 41690 - protein, 101 aa, A.fumigatus
FKMADHPDDVRLTLLEKADLIPGYLSVLATALYSAVAGIFRGNTGAKEYGVHVGHAIVRKMVTRFSMRQMQYVDQHPPLRSVNTVADVQEQVNFLLNEQSV

SEQ ID NO: 41691 - protein, 130 aa, A.fumigatus
TAPCSPFSFGSGSCTSYLEVNGSIFLHSERASDGDRPLLRTFTGDSLDDTLDPLPFNALFVLIMFENHFGANDKLPVALRDRASDTFCRFFNFDHDTVTNFAAVTRLRTGSTGATLYAFDAANLVRYRRT

SEQ ID NO: 41692 - protein, 214 aa, A.fumigatus
EQSGGGFAIGGAPGHFDLYSHIVADLNANGHDVAIFFLAYTLTPHAAYPTQLRQAAEALRYIVTETNRSPSNVIVGGDSAGGNLALALLLHLSHPHPEIEPVALSTNLAGVFGFAPWVSFRTDGTSMDANKYRDVIPSDALKRWSSAYLAGAKSNAWSEPALAPVEWWADAKTEQVLILAGQHEILSSVIDDFVERIKVFILRHILGSRLCLGC

SEQ ID NO: 41693 - protein, 89 aa, A.fumigatus
QGGEKYQSAFYVYEELASAPGTSAPLSIVGQAVAEIHLGRLPEAEAALSAALEKYPEEAELIANAIVLNVLAGKPTEELERYILLSNMI

SEQ ID NO: 41694 - protein, 247 aa, A.fumigatus
RGERLKRPASPEAGGAVSSPHTLPRSSLKEALLVRIHSECYTGETAWSARCDCGEQLDEAARLMSLPMETLAEAASPPDGAVPSNAAGGVIVYLRQEGRGIGLGEKLKAYNLQDLGSDTVEANLLLRHPADARSYGLATAILVDLGLGIDSNPHGIRLLTNNPDKIRAVEGPNREVVVKERVPMVPLAWRSGGKMGIKSSEVEGYLRTKVCRQSISCKLAYFLIILEQCLILSSQISGSPRGRKDRT

SEQ ID NO: 41695 - protein, 246 aa, A.fumigatus
PRFVKHLKQKLHSTAPLLWSSHERREVMWMDQQQTRPVPQVRLYRTRLAASKAYNVAPVLPVLRRVTAAKFVTVSWSKLKKRQKVSEARSRSATGSLSLAPKWFSNIIRTNRALKGRGSSVSSRESPVKVLRRGLSPSLALSECKKIDPFTSRYDVQDPEPNENGEQGAVYKTTAASLIPIPQVGSTLPVFPVGKQVLARYPDTTTFYRAEVMGTKKDTYRLKFEGEEDDKEMEVDRRFVLDIPGK

SEQ ID NO: 41696 - protein, 214 aa, A.fumigatus
NCTFASLLPLKSVIAMSNLPSHASPSFGAQTPTTPQPVDELSLKSNITSAPALHSRLDELRDETSSQISSIDTDRGDMTPAVPASLLSPSFTPPATPGGSINTAELLQQTQLAGARQGSTHTKPPRLLSRLPNVECIVRARIPTTTGAEMFLHLYHNDLDNKEHLAIVFGNTIRSRSLDKIRPGETEMDRMIRGAYVGKLRPGRVSSWYDEEKG

SEQ ID NO: 41697 - protein, 70 aa, A.fumigatus
KCPHAADFLSLMRTIHTHYISDSPPPTVSMSITFGMNPFFNLSPPLLFLDTLASHEFWANIKLLCHGPLV

SEQ ID NO: 41698 - protein, 68 aa, A.fumigatus
PQRGTPSIHTVIMPSSTLDLSQRILRISRSDDTQGYVLLQVSPISSSALDLDIVATEGENPYTGTGMF

SEQ ID NO: 41699 - protein, 87 aa, A.fumigatus
FQIQRTLWNYKPIKPFILALACPATGGTRTNNRDCRAWNRTVVSLCATETNPYTTFGPIQVEIVCSSASGLRNVFAKRKMTKKIFCW

SEQ ID NO: 41700 - protein, 164 aa, A.fumigatus
LMALNKASEIRSAITGTLPLSSPSNSKTKRSAQEMLDSESDSEDRFERMEVDHSGRNDGRSDDQETEDEETSTPQPLEDDEYTNTGESLVSPSIEHKREDNKQASDETPHNRTIVTNSAVPPPRRELSFAKKPQMNHMSQRSNESVAAGEDAEETAGETDDDEL

SEQ ID NO: 41701 - protein, 112 aa, A.fumigatus
QQRLGSVTLRQDDEQAIQLFDWSGAAVARADVLEERLSTLTDRYRAAENTIQRLNQQLEEFMRAKTQHDELLMTNFVQLLNEKKLKIRNQQRLLASAKVDSEKGMILSWQLH

SEQ ID NO: 41702 - protein, 85 aa, A.fumigatus
AKYNWLTRTRAFSQLIHLSRRLSRTSILLIPLLGGQSISQICVMPTANRESSSPTMARCSAAKATGNPETNFMAAGEMSPQALYG

SEQ ID NO: 41703 - protein, 233 aa, A.fumigatus
GRAPRNRSVRVVPIHMSCFKVDNFFLGVNGMQYNPDSFQWEGNETSVIGFDSLRSPKSPKPAPALITNVSAMQNVQVVGGMVFDPRRMCWLKLASSQPGAQGMVAVQVEDDVFAGLDDLEEKSQRKPPGGPGSGSYDVVERTVSGDEPSCGDSSDEWPMTEEFDVGPEFVRRQRVEEEKWRRKVEKWVHSERDRHGNCWRWAIRDIVGVDGSHQTQEVRRMWTFSTYFVFRRA

SEQ ID NO: 41704 - protein, 499 aa, A.fumigatus
  UNSURE (24),(26),(76): Identity of amino acid sequences at the above locations are unknown.
IGSSSGEIIDLCPGGCSNIGNLCXPXLVPWELKHTESIDVHDAMGSNVRIDTRGMEVMRVLPRLNDDINEEWIDDXSRFACDGLKTQRLTTPLIRRDGKFVPATWEQALTEISSAQQKLQLKENEFKAVAGHLVDAESLVAMKDLANKLGSDNLALDQPRGDSPIAHGIDIRSNYLFNSKIYGIEEADVILLVATNPRHEAAVLNARIRKQYLRSDLQIGLVGEEFESTFEYEHLGSNISSLKAALSGKFGEKLASAKRPMIIVGSAAAEHQDAKSVFETVGSFVEKHRNNFNTPEWQGYNVLQRAASRAAAYEVGFTTPSSEVAQTKPKMIWLLGADEVSQSEIPSDAFVIYQGHHGDRGAQLADVVLPGAAYTEKSGTYINTEGRVQVTRAATSLPGAARDDWKIIRAASEFLNKPLPYDDIEALRDRMEEISPVMRRYDVVEPTSLSSLSKVQLVDQNKGVQPTNTPFKKVIEDFYFTNSIARRSVYFSNMRHAYR

SEQ ID NO: 41705 - protein, 829 aa, A.fumigatus
SLLSPPVLREAVRNMESSTCQVPHGDEETIECWDDDGDLHCYEDIHIRTASTATSVTNVSTRRSGHRDSISSRRSTRSDLDSNAAEDEDLQVQLPDDDEDLSEDAIASAKNAGIPLPVNVPKSALIGGTIKRLGRRKPRKNFIDDWSDDVELPGPDAALELKKFKDTVFPETLRQLSSATNSPVKRSPSPLWEDDLSTRLQSALTNLSPIYRMITITAWAGILTRAPTIKVAKPSITQNWTKSITKHNVTKIDALFENVEDDFELPAEDFLRHLSLRKDVTEATSTAADDFDLDWSEGSIGIRFGGTKRDHRSIPSSAVSVVSPSASSCRTGESEDEGLDGLVIPEGPLDLESMLKKRQSTCSTDKPRFSPSGQAEYELTSSDDFFAGLEIESGDAFDLKKLSLNPNVKYKVERPSSPARRSTTSITFTNTAVSPRSRIPRLFGHDRHSTHLETVSESGAPLSKFPGLRSWARGHVNHASISSLPSRPISTSPTPSTPARRSVTSRSPKTPLSSDRATSGTQPLRNKRSMPTIRSVPQSAHLSYSQGSLSREDESARSSISHVRARMPGECAENDSRFLSRKAQTPFIPAGASETQSHHVNVKGPRHFRRTNSDGSSEIFSSRVPVSRYSRSGRHSISNSVTDESQCKNLITAAKQTITRPTRRRNFGDGTELELFDDLPTSSLAESKFIKHPIGRGVPRSLRSRLGHNQTRPSRTEVLKPPSTSSTVPTSCDLTPRFARDTNASRNAREQRIASMAFSLKSRESNPLGLLSSNSKNPNIARAPSNPATLGRKTRGVTASGGKPFLIKSIGKGSQEPKCTCCPHTYELF

SEQ ID NO: 41706 - protein, 76 aa, A.fumigatus
DRMSVYIQELDNTVRAFYEGKGDLVRHHNDSANMYDFSFKAWVANFTMRLSVQQKQAQQTLTEVSISKPQHSMQGH

SEQ ID NO: 41707 - protein, 277 aa, A.fumigatus
PCAQLIEKLPNRDYLTHAHFYLIRISQIDDREVFKICLEYWTRLVQELYEEMQQLPITDINPLVSMGVSGLSNGGAPHPSTLANYPLRKHKYEEVLSNLRTVMIEKMVRPEEVLIVENDEGEIVREFVKESDTIQLYKTIRECLVYLTHLDVVDTENIMIEKLAKQVDGSEWSWANCNTLCWAIGSISGAMNEETEKRFLVTVIKDLLGLTEMKRGKDNKAVVASNIMYIVGQYPRFLKAHWKFLKTVVNKLFEFMHETHEGQLRMLIYSASLSDTH

SEQ ID NO: 41708 - protein, 128 aa, A.fumigatus
QPRSGKYWPYNVPRTDEQYGRDRYANIEHFLSPIFHPYPPRRLLCSYRQRSQSRFVHIHGTRGAHTYLLAGFKSQAMLLSRMFYFIESGKVQEPIYSPEQAPLGTSNKDFLQEYVANLLQNAFKNLQE

SEQ ID NO: 41709 - protein, 251 aa, A.fumigatus
HSQASMAFENAIEADLLHQSLMEDKVPLIMESVFECTLEMINKDFHEYPEHRVQFFKLLQAINLYCFPALLKLDATQFKFVIDSCMWASKHDNREVENTGLTMCLELMNNMAETDTQTSSIFFRQFFIPILQDVFFVLTDSDHKAGSYTSMVLEELTLTFWQGSNLKQCYCPVCSTSSNPGRSKNPSIPPNKRRSGHPTKTSCKNTLPTSYKMLSRIFRSKLAASPVSIERVLILSQDTNQAVCSWLVYLQ

SEQ ID NO: 41710 - protein, 246 aa, A.fumigatus
DYLGIRNFIVNFIIENSKSEEKLRSERAFLNKLNLVLVSILKQEWPHNWPTFINEIISSCHTSLSICENNMAILRLLSEEVFDFSQDQMTSIKARNLKTSMTQEFSSIFQLCSEVLNTANQPSLIKATLETLLRFLNWIPLGYIFETPIINTLLTRFLDVPDFRNVTLKCLTEIGGLQIGNPYNYDERLVQMFTETLTIVSKTIPLSMDLKQTYAKSNSRDQEFVLNLALFLSSFFSAHLTVSVTK

SEQ ID NO: 41711 - protein, 162 aa, A.fumigatus
HTLGVQDMACDTFIKIANKCRRHFVALQPGENEPFIEEIVRNMRKITCDLSPQQVHTFYEACGYMISAQGQKSLQDRLIENLMSLPNSAWDAIIAQANQDPSILQDGETIKIIGNIMKTNVAACSSIGTYFYSQIGRIYHDMLNMYRASSQLINDAVAHDGK

SEQ ID NO: 41712 - protein, 110 aa, A.fumigatus
RRTGNIATKTPKVRGLRTIKKEILKLIDTYVQKADDLEMVNANMVPPLLEAVLVDYNRNVPDAREAEVLNVMTTIVHKLHVCNIPRQAWLLRMLSKLTYFTRALWKTRFL

SEQ ID NO: 41713 - protein, 83 aa, A.fumigatus
FCLRIQIKQFVVGLFTFNDDFNKFKTHLRDFLISLKEFAGDNAELYAEEREQALRDAQAAERDRAMRVGGLLKPSEMDQEDEL

SEQ ID NO: 41714 - protein, 385 aa, A.fumigatus
ITENGNLSITSDEQPPTTTHDGTSKKSQRQKGPLNLVEPGEESICQQQGNFGNSFSQCSNDNERKETNAHEIVALPNKKGQKSESLSPAKTVSIFQGASGMTSSILNAPPSRPSRRQRSVVSYAEPNLRDKMRRHTNEFVPAVGGERQTKTLNTAALPKSTDEGDVGLQTDISRAKKPENSPGTTRDHISILEKASGHTSRSTVNMVSLRKKKNILANIVTAGEEDHDTLQSELSSGASERPNFSVENSKPRGCEDQNTLRISNAARNNELDSQSTDDTDSLQRHIAEESAPTSDRRKQPRRHSSHSKTSTQHTQGELRTDLQSTRKLSTSGAPSKVLRPTMQAENADTDSAVLDEETGSLSKAMVGGRLKRGHRAVARRKSMVL

SEQ ID NO: 41715 - protein, 583 aa, A.fumigatus
NFSNLPLSASETMSSARNLSVALRRARIPTPQCWLRPIIANRAAVPAARSFSVSSVVGGNTTREIKYTTNAYPELKRNPNFAEITEQDVKYFKDLLGAQSAVIDGVTADATDDIEPFNADWMRKYRGHTKLVLKPQNKEEVSQVLKYCNEKKLAVVPQGGNTGLVGGSVPVFDEIVINTSRMNKIRSFDEASGVLVVDAGVILEVADQYLAERDHLFPLDLGAKGSCHVGGNVATNAGGLRLLRYGSLHGNVLGLEAVLADGTIVDSLSTLRKNNTGYDLKQLFIGSEGTIGIITGVAILCPPRPKAVNVAYFGLESYDQVRQAYKEAKGHLSEILSAFELMDGRSQKLVHESTGSKYPLEGEYPFYCLVETSGSNAEHDMEKLEGFLEHIMGEGIVADGVLAQDETQFQSIWRWREGITEALSHLGGTYKYDVSIPLPELYQLVEDCRERLTTMGFVGDDDSFPVRAVVGYGHMGDSNLHLNISVRQYNKEVEKAIEPWVYEWIQKRNGSISAEHGLGLAKKEFIGYSQNDTMLKLMKQLKTLYDPVSLAHFSTSFEGTNNVLAWDHEPLQVHLGIKRLHGV

SEQ ID NO: 41716 - protein, 60 aa, A.fumigatus
TIAIGLLLTGKLLVAGGSFGTVYKAIEKSTGEIVAIKHVRSHHSVICFHFFIDRLGLDLD

SEQ ID NO: 41717 - protein, 201 aa, A.fumigatus
LKPGVFSEAHVAIICQQLLQGMDYLHSEGKIHRDIKAANVLLSHTGKVKLADFGVAAQLTNIKSQRNTFVGTPFWMAPEVIQQAGYDYKADIWSLGITAIEMINGEPPHASTHPMKVLFLIPKEPAPRLEGNEYSSAFKDFIAQCLTKDPERRPSAKELLRHKFIRNAGKTEALQELIQRKQDWDAGKGVRQNVKYYAESL

SEQ ID NO: 41718 - protein, 74 aa, A.fumigatus
CCLARPLCIISPNLSSFSPSVTYFFVSSHQSIAIHWLGKSSRSFCHDRFTPLSTTIAKFYALFCPEDGGLPGNG

SEQ ID NO: 41719 - protein, 71 aa, A.fumigatus
IDLESSEDDIQEIQQEISVLATCASPYVTQYKASFLRGHKLWIVMEYLGGGSCLDLVNISIGQVSLELCDR

SEQ ID NO: 41720 - protein, 307 aa, A.fumigatus
QRFQGLYRAMLDQGPGAETQCEGAFETQVHSQCREDRGVAGTHPTEAGLGCWQRRETERQILCGVPVSSDALGFELSLSLIYIHSNTITRLEDDDGWVFDTVKAPPTSIPEDPHDLVSERDTRDRLYDEASELMDNLHMSSPPVPPKHSSNSTVRRNPAADRSPSVRRPKRRSSGVKQPLGVDLTFGNSPSTVRQFRRVSDKTGPDSSYNNQYQIAVDENASPKTVYSDSNSKEAQLGRRAYSKAVGLACQEVLGTTADQEKREAISRLAEAWSDLEMVDPEGLYHILKSINEKLQRSVITDSRVRH

SEQ ID NO: 41721 - protein, 175 aa, A.fumigatus
TGRLVNEFLTASVHQLKGGQDLGEMTLGLLVSLADLVIAFETEVGHIDCLGPRGAQDGDAGDNANCTFRADEQLLQIIACVVLSQGGEGVDDSAIRQDRFKTKHVAVKTAVTQQTESSRVGRDVPSDMARTLCTQIQGEQVVALRKVLIGYLEDNTRIDDQHTRGLIERANLVHA

SEQ ID NO: 41722 - protein, 79 aa, A.fumigatus
SATSRITPASTTSTPEASSKERILFMREVLITISSNTGTEPPTNPVLPPWGTTASFFSLQYFKTWLTSSLFCGLRTSFV

SEQ ID NO: 41723 - protein, 62 aa, A.fumigatus
TKVQIKMSTTVLITGATGLLGRQVFNTFKHSGCFVVGQGYSKATPPTILKADLEKPEDIKNL

SEQ ID NO: 41724 - protein, 753 aa, A.fumigatus
SPSSKPSVSASELKTPTIIFLSTTPFLPCSASHSIPCSYHTPPTNVLPMSRPPSASENTLPDTLVTPAASAQHDCSAQPELSSGKQRRHNARDQQLMHQDVQQAPSPSRAESPTAHQWSKPASTLTLKRALTLPLERLSHPDRSHSPQLSERDSIFATHYLPSDNEASNTPQLGPVQDVDSALTTDLSPGLDNAPASPISSVKIPFRRPSVDRSPMEVEIRRTHPLRSSTYVSPSLPAHTSSLRPVASDVAWDAPHKESDRKLNAPLRESLHLPGKVLSDGIGTKHTPLEDPVPNFSLISASLRDPSSPSHHPEYPEQTRDRNYETKVERSASRSRCGRVENSIEANLTNAEPTSHVRSRKSSHYLGLFKENTTSPDRKRREDRDGKHGEFPTGDETSDVTVLSEPEQIRDRFHTQAGDLLLEEVGPRTSKSSPQLLLSAAPSIGPTARQENRPHPLSDDISKRPLKSLPRSLLEEIRSFHLTPGGGRGSSFSKSIPTQYAEGGRDYFAEIPPSDGLSPPNTIREERRDSGPFDDEEEEQISSAVYFPHERVAVSEEVDQVEPFLENEPDVERFDESAPKSSLALVPKVHTVPIGQESSHVDISLRSKNENRILHGELQELHSSTLKEFDRKPLGAISERSGEYSTCESEFASADDSSMSAREEESSLTDDADVTPTATPTQRARFPRPRRKHSSTAPVGAVELKPYRHQVGGHTTVFRFSRRAVCKQLNNRENEFYERIERRHPEMLMFLPR

SEQ ID NO: 41725 - protein, 84 aa, A.fumigatus
IGRSRITGVLLAPLLFIPHHNNNLLFHLTGLQGELTFVTSWSIAYPSWPGELSISIQPAIYINIQHNNFSAVFTTGLEGPRHIE

SEQ ID NO: 41726 - protein, 98 aa, A.fumigatus
FPLFRYIGVLNVTYSKNSKRPTASSGNNAEPTDTEHSKELTQDEIGSRKTSISKPKSGDAEPERIFSQKQVTGVIPKVILENNRHIIPADLFMRWPKT

SEQ ID NO: 41727 - protein, 90 aa, A.fumigatus
ARSNARYGQWTKRKPWQFLAEETPYVNYIAPALSVYICLSHLMQFQPGSTTGICSTAVIDQSSMLRQSLDYLLDEVSRTRMYDCMRKSSR

SEQ ID NO: 41728 - protein, 581 aa, A.fumigatus
  UNSURE (64): Identity of amino acid sequences at the above locations are unknown.
YSRTTATLFRLICLCAGQRPRTADCAASGSRRALNGNETSAGKQSVGGSTAGSVSAPTLDKPIXRWGATTVNRKLQEQVLREVFSLPAIHHHRRHARGHLNLPRTSSDCGRRRANLSEDQSVSLNRYASDRVEAASSSLGIDASKPSKESPALSSSASTALDAGHGRLEKVRTEEPQPRASSLSRTRRVRRRHSGSGLQRRGSISSNKGVGQLMFFEDDGYGGDKEDGIFPMERDASLLSSSDPNVNSSTSALIYKDDMSKDVPSAPLATRDSPPKSLRLQAKDESQMIVPSNPKEAQTRRDERVQFFLLLEDLTAGMNKPCVLDLKMGTRQYGIEASEKKRKSQRRKCQSTTSQQLGVRLCGMQTWNVRKQEYTFEDKYFGRDLKSGREFQDALTRFLYDGISYRSVAKKIPIILDKLAKLESMIRKLKRYRLYASSLLILYDGEQNPTEKSQVDEAHNADKRPPLHLHRRASEDGHNNTEVHLKIVDFANCVTGEDELPPDAPCPPQHPDDIDRGYLRGLRSLRMYFQRILKEVTQDEFVERGEGEAVALRSRDSGREESTDRFWDESVLEEDPGEVSF

SEQ ID NO: 41729 - protein, 161 aa, A.fumigatus
MMRRKCKRNSLENPLLPRLPHPLPLPVPALTAMPMMKRMTMPPPRLLQRRRPPAPSARLNPAHLNRLRNQNPRTKHRRPKRLSSRRSPIHPHLPSRRILRTRNPTPPTVRAVLHPPIPTLIPAPTPTPLTVRAFHRLIPAQTPIPTPNPRRNPPRRLLRRS

SEQ ID NO: 41730 - protein, 418 aa, A.fumigatus
AKTVGPPPELVASVAAFLSQFGFKSTSEALSKEQSKKAIAKVDSKEVPSLLDIFRSWQDRKSESSSDSESSSSSSEDESSDSDVEMNDAPKMQKKQSRESSPSSSSSSSSSSSSSSDSDADDEEDDDAAPAPAPAPKTTGTKRKAESSSSESSSESESEDEAPKAKKAKLSTKSDSSSSSESSDSEDEESDSSDSESSASSSDSDSDSGSDSDSSDSESVSSSDSSSDSDSDSESEKEPAKKAAKKILKTAAKTPLPESSSSSSSDSDSSSSDESSDESSSDEDQNTNSRSSSSSQNSSGSSKTVQPSDSDAKEPINKTTKQAQETSSSSASPAPGNGPATKKKHTGARPTPLAQLSELPHNHPSNAYVPYAYAEKAWKDLSVTRGKGFTKEKNKKKRGSYRGGPIDISGGKSFKFED

SEQ ID NO: 41731 - protein, 389 aa, A.fumigatus
KDCAEIDFEMLLSDLPSDIIYVIATYLPSASSLAALAQTCQRLHKVIAAEDWRVFHAHFKNRFPFVETPPFWKDATQALTARARALDRLGLLCRFVLPPRDAVKVGSHRGTRQDNPTHGYRPSIDSYESWPGGSWSERKEVLVWGAADELVLRIRQPTYNGGETWFMFNDVKTKISSYHDICGVHLLKQEHHTRKSGDEHIIFGRLNGDLCHVAISPDSASHKYYQRFMTNGHGLERTDLSGGDEPILAAHLNNGSIVFYQTTTGEPEVEPFAHCKITPDGTARNKYSKFLSPECIAYGTGRQENALTIATISNERLSVSREISVTSLDIGESIGLRRKANVSAIAPLTAQSTAESSGQVFLAAWGDRCIRYLSTLRCSVIYISSNSPN

SEQ ID NO: 41732 - protein, 79 aa, A.fumigatus
FSSPVVKTTKSSKITIESDVYMETTIFAGWVEVTSQLRLLRVLKMPHQPKWRQEKLINNLSADTYTPIYLYQLTPVRRN

SEQ ID NO: 41733 - protein, 475 aa, A.fumigatus
  UNSURE (473): Identity of amino acid sequences at the above locations are unknown.
CSGHFRLTISTGTVVESYITHVRITEDAAHPSTPAPPNSPPENKKPRVIIVAVRRSGRVRMHKARENNDGTFSIGKTWMLDDLSSIQSYTGFVPSTPLEQQHKQWAATVGFVVTVGKPYYWHARSSKEKDFFIGSLVKIYRKYTGGKVPNLIGFDDRERQLLVGSPSPAPPGSRGMGQGPATRSPSSQGSRPQSPYTGRAPSRDGPRDIPREFKRQPSEEQALRAQRSRDQMQRPSTSQSGRVAAPSPLGQTSQPLGAVSPDPRGEPPPRSNERLPKAPVLPPPEPRTKEVTDSLAAAKPVSHTPSSQADLGSDPRPSPFLQDGKAVLDPSPVPRTEDLSSSLHEVGHDKDARPSTAVSGSAENLDVMQTPASSMEANKTVGESRENLSLPETQVEPQIIDKPAGPVKMQPPDIPPALRPASSRSNNVPTPSVAAAPPETTRSVTPPTAAEPSETPRERSPSPPLANSPESSXPG

SEQ ID NO: 41734 - protein, 264 aa, A.fumigatus
SSSDEDSSEDSSEEDESESLDELELDSGKGVLAAVFRIFLAAFLAGSFSDSESESESELESDDETLSLSEESESEPESESESEDEALLSLSEESDSSSSESDDSEDEDESDFVESLAFLAFGASSSDSDSEDDSDELDSALRLVPVVFGAGAGAGAASSSSSSSASLSELELEEEEDEEDEEGEDSLDCFFCIFGASFISTSESLDSSSLLLELLSLSELLSLFRSCQLRKMSSSEGTSFESTLAIAFLDCSLERASLVLLKPN

SEQ ID NO: 41735 - protein, 238 aa, A.fumigatus
HANHAAINRTRQVAKPYFREWSNMRYHEGKTFKSNPRLFKRDKALYFPNMYGITLASPKQPQNTTSILRGKVSVVNVFSSVWAESQVATFTGPKQNPGLWEAMKSGSELVQKVDINLEENAMKAWLVRMFMWRMRANLPKEQHERYFLVRKGLTDGLKEAIGMMNSKVGYVYLLDENCRIRWAGSGPAEEGELNGLNNGVRKLIQERRISLESKLPAEEWAGRNQGESASPKPRVIMR

SEQ ID NO: 41736 - protein, 164 aa, A.fumigatus
TRNPSLCICNFTSKNETPHGTEIYWKDNGTTHWEESGLPESQIAQYTQDAMFGDRNADLLRFYSHDVRKSIARVLTVINANQRAQLRLFYKNKKYTPLDLRPRLTRALRRRLTKHEATLKTEKQRKKEIHFPQRKYAVKVCFLLHHTMRNKNPAIVQAFPILAS

SEQ ID NO: 41737 - protein, 201 aa, A.fumigatus
RPSSPSSVSRRSLPVPRRRLRECAFELETLPCASAILPRKMKPLMARKFTGKTTERHTGKNRAYQNRRLRNIHKMQCLGTGMLICCGSTATTFASRSLAFSPSSTPTSAPSSVCSTRTRSTLLLTSDPASPVPSAADSPSTRPPSRRRSSARRRSTSPSGSTPSRYVSYCITPCGTKTPQSFKHFQFWPVESLMRSFYRPK

SEQ ID NO: 41738 - protein, 72 aa, A.fumigatus
IAVGINVGADVRQKIGSVAGLGDCGVQALQFAAMILEDFAIAGKIALFQGRCGKSGFGVKETGELGDEGFTL

SEQ ID NO: 41739 - protein, 167 aa, A.fumigatus
REALISQLSRLLDSEATLTASALKQSNLARNREVLQDHRRELQRLNAAIAESRDRANLLSNVRSDIDAYRNSNPAAAEADYMLEERGRIDESHNMIDGVLSQAYAINESFGLQRETLASINRRIVGAANKVPGMNALIGKIGTKRRRDAIILGAFIGFCFLMVFFFR

SEQ ID NO: 41740 - protein, 77 aa, A.fumigatus
WCSSSDEMLVLRIPPIFLCYNSLLNVIYIGYRTEFGCFHVLLFCMQALITMVMAFQVVYFTFMYIQGHTAVALRLTA

SEQ ID NO: 41741 - protein, 390 aa, A.fumigatus
MQPLDPLEEDSVGVNDTETSDASDTESVGKKESHLSEEDKMIEAWQQKFACMQKHDSSSNLDNPNCKTIEVLQQMLDYYTRTSDQWRTLAYRKAIAALRRQPRKIVTRAQALAIPGIGPRLADKIEEIVFTNRLRRLESTNNRPEDLILQEFLGVYGAGISQASRWIAQGYRTLDDLKTKAALTRSQRIGVEHYHDFAQRIPRREVEAHGEIVRKAVQKADPGMQVIIGGSYRRGASDSGDIDLLITKDDATIEQITTMMMDTVIPRLFQDGFLQVSLASTSRGDGSKWHGASVLPGSKIWRRIDLLFVPGSEIGAALIYFTGNDIFNRSMRLLASKKGMRLNQRGLYADVQCGEQRRKLSEGRLLEGRNERRIFEILGVPWRPPEHRIC

SEQ ID NO: 41742 - protein, 80 aa, A.fumigatus
TYGRSPWQDWSNEIRATLVSHFHRCYFPAICPEANLRCRYRKLAKFDRKRALDTFEKHKGFYHPICRAMVEKDLFGKKDE

SEQ ID NO: 41743 - protein, 395 aa, A.fumigatus
FLGRGEQPANPARQGSLSTAVSLSGLGAAGQFNSGSSRSTLLKLALQNTNENKVNAMHTGSSPLKGAQSTLAHRDTDENGESRHTTPLYEQPGPKKLHLGMFEIGKPLGKGKFGRVYLAKERSSGFVCALKVLHKSELQQGGVQKQVRREIEIQSNLRHPNVLRLYGHFHDSKRIFLILEFAGRGELYKHLRKEHRFPEWKAAQYIAQMAAALKYLHKKHVMHRDIKPENILVGIHGEIKISDFGWSVHAPNNRRQTMCGTLDYLPPEMLKPNSQDNYYSEKVDLWSLGVLTYEFLVGEAPFEDTPVMTQRRIARADMTVPSFVSPEAKDLIKRVCEPYRSRQVHFLTFKQLLVLDPDKRISLDEIQRHPWILKHCLKDDRVTKQSSGSSKEVKA

SEQ ID NO: 41744 - protein, 65 aa, A.fumigatus
RVSERQLTPELSKLMGEIYGLAASQNIEVANLYFQVGLQAGDASVVEPTADLLGKIGRMKFVRPL

SEQ ID NO: 41745 - protein, 222 aa, A.fumigatus
VLEPLEVFILTSHGIAIHSCPLVISPSELGPYGNRLTNICCPGPIIRFLSDNIRQLGGDLSSHNIYCRRCTSRKAGGFDPEYGILLCANEMKDQGHLEDTMAHEMVHAYDHLRFKVDWTDNLRHAACTEVLKSLARPKPASTTDSLQIRASSLSGECRWAREFFRRGQWKFTQQHQECVRRRAILSVRARPGCKDEAHAEKVVNEVWDSCFRDTRPFDEIYR

SEQ ID NO: 41746 - protein, 178 aa, A.fumigatus
RAGSCRQDGHLYAQSRAFKGMAKEQVSQFRIVQLSLIYLTRNREKAHEGIKDVVKPFDWSYTTDYTGTVHPNSRPFETTTKPIPIELLKRPDPILFFDEVILYEDELADNGIAMLSCKIRVMPDRLLLLSRFFMRLDNVLFRLRDTRLYVDFESKEVIREYQSKECDYERVRQVLCSK

SEQ ID NO: 41747 - protein, 175 aa, A.fumigatus
VRPELGLIPTFSTWSQVTFLHMYLLTVRLRALPSYESLQTYSRHLIDHFSHNAEHRMDVLHGLTSRAIRNKFLKDLFIQWRGVLAAYDEGLVKGDAVLGAAVWRNLWKASHTGPHGEDMDWTKVARVVAYMRRVISELSQINEADLILHIGPRPGGKPGIFSYSELDKQLVDGKR

SEQ ID NO: 41748 - protein, 125 aa, A.fumigatus
RGSTIKSHFLVLERNQRMASAGSTSTMNAAAVSPGVQRPNVISVKGFRIITQKLPILKAEPIEEMTRRLGIAPPEMIFGDNHVTIESENKDWGITFNAFDALDRVDKTGTSMLRVAHSKEWQKSR

SEQ ID NO: 41749 - protein, 173 aa, A.fumigatus
PDNHRQASRALQGKTFYRNPDTIMDDEHHSTDEYIAFLNTNASNADRPRDIYWGLAMIPLFLYGHHTKVIETGMSMMDTIPRLWSARVGYVVYFYLALSLLTLHNDYPAGGYMDGDNLKTVLKYKAEVDFARSACDANYGMWSLILEALISEVRNDHTSAIQAFEVSLQRNDT

SEQ ID NO: 41750 - protein, 667 aa, A.fumigatus
ATSARSFHVTNGSLDIIDLSSILESSQVMSSELQIDKLLTKMIEIVLESCNGSDFAAIATDFDDNGFAVAATGDLETGQRSFVDGLPLSEFDDKMAQQICHYVIRTKEEVLVHNLLEDDRFSNTSEAYQNKYPMGRSVIALPIMQADHLLGVIHIEGKPNSFTQRNVVVLHLLCNQIGISLANALLFREVRRVSATNAAMIEAQKRALAQAREAEHKAKVAEAEAKHNVKLKEDAARAKSIFLANISHDLRTPMNGVIGLSELLKGTILSKEQDEYVESIRVCADTLLTLINDILDFSKLEAGKMKISTVPLNVKETISEVVRALRYTHRDRGLVTIEDLDKVPPDLVVLGDPVRLHQIFMNLLSNSYKFTPKGSITVRAKVSREGKNRVRLECAVSDTGIGIPEEQKSRLFKPFSQADSSTARSYGGSGLGLSICKAIIEDVLGGAIWLDSTPGVGTTVTFHLSFNKAKESLAKAPWSNGSADGENQVAPRPMARDLTMIPRDQIRVCIAEDNPINQKIAVKFVTGLNLQCEAYSDGRQAVEALRTRSQEGNPFHVVLMDVQMPTLDGYNATREIRKDPDPNVNEVLVIAMTASAIEGDREKCLEAGMNNYLPKPVRSTVLSEMLDNYLAPAPTYTKTRLAMRARGSINPLNRELQIMRRHPVRGR

SEQ ID NO: 41751 - protein, 1006 aa, A.fumigatus
LVEMEEDNHILGEDLPLPPARLFETLAQLPGYIWDQSVEPFHSTYNHWHVLGLRHCAESDVSTPAATSSGPSSLARNSPRAEPRPFFRHHWRSSLSESSSELSLSRADHEPVWAPVVARVSSHVVRLEREFHMLRSIVQTSDPDCNHTIRPIDLIRLPPDPGDIGPLLVAIFESPGPNFLRELVAFGPAWFAAGVKSDNIPTPDEQVSLPVFLDFAIGACDCLELLHYGLKTVHGEIRGDAFHFDRETGSVKLLSTGNGARSFENILSDGWSSLSRELGVKNKLQFVAPEQTGRMPTEPDSRTDIYALGVLFWTMLIGKPAFTGADPVEVVQNVFGKKLPPVSSKRMDVPDAISAVIQKMTQKAVNERYHTISSVKRDLTQISQLLGDGDSEALKDFQIAQRDVSSFFTLPTGMFGRREEYDKVISVVERVYRRQQSAHARAAAQSSSGVGSNSSVSDGRVDSFEIASGSSDSGSFQLAPRTNSYNTQYNFGRVSTHESLHSTESSLSTTIHGYASNKAKIPVEPRASVDSTERDTHSPSVANAQTYTDPVVPDARQKAANKLRKNGKCEVITISGPAGIGKTDLVNRVQPAIRKLGYIGIARLDRARRIPFEPFAKILASLLRQIFSERDVTTDYHNSVRMALRPMWTTLHRVLELPEQLMSAGGKDLEFSPKLSVAQHIFRDVSNRGSDPSKRLAMPRLDHGQSSVEFFLSNAASKNMRLMETFLEILRTLSQFKLICVCVDDLHYADDETLELILNILRAKIPCVLIVTSRKAELESEAIKSLFESEDHNVTRIELSSLGENEIMQYVAVTMHQDPNPGLTPLAAVIQEKSLGNPFYVRLMLETCYSKNCIWYSWKNSRWEFDLDRIFTEFVAPRYGEGLGLGFIAKRLQEIPVAARSILIWGALLGSPFPFSLVQKLLTSEFLYSSEDDDEAVDLTCPQSASMIRQSEADIVVGLQYLVQANLIVPGKTDDEFRCALSILSFYLLFFLPFLFFELCFRDPTR

SEQ ID NO: 41752 - protein, 402 aa, A.fumigatus
LLTLTRFANDRLAQAATSLTEGRNVDKMHFIISQAMMKYYHDSRSRYAIARHIGLASRIVRSRVIQRVDYRKILWDAAQTASQSGARPTALWYFHHCIALLQDNPWDDNNTDVYYDETLRLHIATAEMLWSQGHHTEALRLLDEVFAHGKSAVCKARAWIVKAKIYAQMGNHYKSMDSLLTCLEELGVHLREPTTYEACDAAYGNLKAYIENADLEVIVRKPKSKDINMVTIGAVMAEAMAVTYWDDALTFYRMAIEMMNLHLFKGGFVQISIGCSHLSMISFSRFRDLEFAAKLNECALTLLDCCPEPWTQRRGTIVHNLYISHLRVPMPSTLPVLERSVEVSFTMGDPYITLISLSSMAMTRLWLGHDVGQVEQFCTESPDDIPDWSKDTRGGASLLAVR

SEQ ID NO: 41753 - protein, 406 aa, A.fumigatus
LQEKVNCSFQSRTQLIFFNPAIPVRKPRPSYLITGTMTSSEKVTYVPAGEIDKVFAHTTNLASSGLNTKILACSDEFFAAASNLLTPTPPINRPGVFVHTGAWYDGWETRRHNPEPYDWVVIKLGVASGAIQGVEVDTGFFHGNYGEKAELQGTYAPVDSGVTDEQIADPSFNGWTTILPPQPCGPSQRRAWKLNDYDPSNPKPYTHVRLLMYPDGGFARLRLYGHAIPPPAPEHINSAEAPVEELSSALLGGLALSASNQHYTPISNLILPGRGKDMGDGWETARSRIPGYTDWAIFQLGLPGSVAKIVVDTKDFRGNFPRAVRVHGLLEGSVAAGEVPAHDHPDWIPLLSGDKFCKADTEHVYEGAELAAGGEDTRTFTHMKLTLIPDGGVKRFRIFGRRANRA

SEQ ID NO: 41754 - protein, 155 aa, A.fumigatus
RKARTTSEMVSLTLRGTVEIFIFPASNFEKSKMSLMSVRSVSAQTRIDSTYSSCSLLKIVPLRSSDKPITPFIGVRRSWEMLARKMDLALAASSFSFTLCLASASATLALCSASRACARARFCASIIAAFVALTLRTSRKSSALAKEMPIWLQSR

SEQ ID NO: 41755 - protein, 122 aa, A.fumigatus
NGKSTPKLVVCLSWDNQVRLDKILKSNYYISLRLSDHTGTLWACQVDSLIIVFAGIQELAGKQFLNKRKRKGTSQQSSPYQDGPGSYWDFLEAFCDESKAKPLAVPWSDKLGENTIQVKLPP

SEQ ID NO: 41756 - protein, 89 aa, A.fumigatus
SSWVLPAAPSKASKWTQVSSMATMARRPSCREPTPPSTAASQTNRSPIPASTAGPLFYPLSPADRRSVAPGNSTTTTPPTPSPTPMSVC

SEQ ID NO: 41757 - protein, 175 aa, A.fumigatus
ITSKNHHKISQAKMPSIPLHPHASSSPHHPHNPLPQILQTPSGLAILELQGTINLPSLDDQGAVPRSADADDPNAAITTFETPIGKLMFPDYSPQNTSLDDTKWMKRVYLYVGRYQRMTGEVKKLAQPLALVQKRKKRPDDNNGIAESEGEELEIVEIIKYKLLFKNRPEPVNDS

SEQ ID NO: 41758 - protein, 186 aa, A.fumigatus
SELSTARNIATLTTSLVDLVAFCVSAGDTFLPDPASYDDLFYKLVETGPIITRFRDVYSLKPPTPSASKIPDPTTIASKDIHVAAIDTLISVSTHFYALLFNPDRNVDVSLKPGGEASNPVPIPANRKKNLSPREVHRIIKQGYDTLSIQPPEGLSAWTRWREADWKTELKRAARCAVEDARQLVA

SEQ ID NO: 41759 - protein, 278 aa, A.fumigatus
SYLPSVIQEFSHQSEDTSWLHHPIRQASYCAGVKDQHRRQEYNCRRLANRLGEPEYLSGPKHAKEGRVSLALLLCSHHFSMAPSEASILSNFLLSPASLPTIISLQQFTELFPKKLRAHPHIRVLYRELQQLREQDMDTVNGNIDQEVRQAETQKAELRKKIMKNGVDGMEENDRREMDMDVQLFGQGVNAASSEYHSISSLLSAMETACSNIEHEISQVDQEAANVLTGLSATVGELSDLRYGKMQGPAGSSGEEMVKEAIDGLEHLEQACNRKTSQ

SEQ ID NO: 41760 - protein, 196 aa, A.fumigatus
LQEEHFYTRPSVRIVMPDNLKSLLVDDWENVTKNQQVVALPAKASVNQILEDFVAEEKPKRTSSADLDVLEEVIMGIKEYFDKALDKILLYRFEREQYKALRKKWEAGSGEYSEKGPLDVYGAEHLTRLFGMLLDNLFSEDHLLTYSSSNYAGAHCADKHGSPVHEQTPGGAVEIHALAQQELRQIFCHEVHDCNK

SEQ ID NO: 41761 - protein, 2331 aa, A.fumigatus
  UNSURE (1131): Identity of amino acid sequences at the above locations are unknown.
RDRLHRAIREWIHSFNEAKEQQSASQLSIGTQHPAAGEPEAVSYKIEFPELVHEISMRNQVLHLDPPLQYARASWFSHFDNWLGVICHLEKIKSSRYQISIDVQKVQLSEACFADLPQHCTEDLSHVYSVVEGRLKEVSEYVDKWLQFQSLWDLRSEQVYDILGDDLAQWLQLLQEIRKSRATFDTSEVSRSFGNIKIDYEQVQTRVNAKYDQWQHEILLKFGSKLGARMREVHSEIAAARRDLEGQTLEASSTAHAVSFITIVQQCKRKAKVWEPEVNIFRQGQATLARQRYQFPSDWLHVENVDGEWAALNELLARKSKIVHDQTEGLRAKITAEDKVIGDKITEVIAQWNEEKPVSGTIPPEEASRTLSSFQSRLEALQAEFEMVSKAKEALDLPASVESSLPAILEEVQDFMSVWAALSTIWKSLNDLRDMLWTSVQPRKLRQSIDGLIKMTKEMPSRMRQYAAFEHIQNVLRQLLKVNPLLSDMKSEAVRERHWQKIYKALKPGKRFSLVSLTLGDVWDLQLATSESVIRDIIAQAQGEMALEEFLKSVRETWQNYSLDLVNYQNKCRLIRGFDDLFAKCSENLNSLQAMRHSPYYKEFEEEAASWEDKLNRVHVLFDVWIDVQRQWVYLEGVFTGNADIKHLLPLESSRFQNINSEFFAVMKKVYKSPFVLDVLAINGVQKSLERLAELLNKIQKALGEYLERERISFPRFYFVGDEDLLEIIGNSNDIFRVAKHFKKMFAGLSGVLMDDENNIVGITSKEGEEVRLKREISLVKTPRINDWLTALETSMKLTLAELLGEAIEQFETIYNAPEVDRTAFNDYLANYPAQIVVLASQVVWTNAVQKSLENGGANLKELYDAQVRVLELLAVTVLGDLDAISRKKCEHMITEFVHQRDVISKLMTANANIPTHYLWLLQMRYVYHAEGDFLQRLHVHMANAKLSYGFEYLGVPERLVRTPLTDRCFLTLTQALCQRLGGSPYGPAGTGKTESVKALGLQLGRFTLVFCCDDTFDFQAMGRIFLGICQVGAWGCFDEFNRLEERILSAVSQQIQNIQLGLKTGVDNEKAQIELVGRRLSVNPNTGIFITMNPGYAGRSNLPDNLKKLFRSVAMSKPDKELIAEVMLFXQGFKQAKRLSKQTVPFFDHCASQLSKQAHYDFGLRALKSVLVSSGGLKRARLANTDGDLGPDEIIEPQIIVQSLRETIAPKLVREDVDKMLEIQAHNFSGVEYVPANYEKLTQAIRDIAHEQHYVDSEMWIAKILQLYQIQSIHHGVMMVGRSGSGKSAAWKILLQALQRIEGVEGVSHIIDSKVMSKEALYGNLDSTTREWTDGLFTGILRKIVDNLRGEDTKRHWIVFDGDVDPEWVENLNSVLDDNKLLTLPNGERLNLPPNVRIMFEVESLKYATLATVSRCGMVWFNDDTVTPLMMISNYVESLRTKTFEDLDDDSAPAGQAAAKTQDAQNMLSTILKQLLETDQLVLKSLDEAKKYNHIMEFTDIRALNTLFSLLNKACRNVLEYNIQHVDFPLDHEQIQSYISKKLLLALVWSFTGDCPLADRQAFGQFVSGMSTTELPPDGASSLIDFDITLPKSEWMSWQSQVPSIEINTHSITQTDVVIPTVDTVRHEDVLYSWLAEHKPLLLCGPPGSGKTMTLFAALRKLPNMEVVGLNFSSATTPDLLIKTFEQYCEYKKTLNGVVMSPNQIGRWLVIFCDEINLPAPDRYGTQRAITFLRQLVEQNGFWRTSDKTWVTLDRIQFVGACNPPTDAGRTPLAERFLRHSPLIMVDYPGEISLMQIYGTFNSAVLKIIPLLRGYSEALTKAMVQFYLESQRRFTPQIQPHYVYSPRELTRWVRGVYEAIKPLETLSVEGLVRIWAHEALRLFQDRLVPEEERSWTADAVRRIALDNFPTIDEEQALKGPILFSNWLSKNYVPVERERLRDFVKARLKTFCEEEVDVPLVLFNDVLEHALRIDRVFRQPQGHLILIGVSGSGKTTLSRFVAWMNGLKVFQIKVHGKYSSEDFDDDLRTVLRRAGCKGEQICFIMDESNVLDSGFLERMNTLLANAEVPGLFEGDEFSSLMTACKEGAQRQGLLLDSQEELYKWFTQQIVKNLHVVFTMNPPEEGLSSKAATSPALFNRCVLNWMGDWSDQALFQVGSELTQSLDLDKPNFVAPDSIPVAYRDLSLPASHRDAVVNSMVYIHYSLQRFNQRLQKQQGKTTFLTPRHYLDFVAQYVKLFNEKREDLEEQQRHLNVGLEKLRDTVDKVSDLRASLAQKKMQLEKKDAEANEKLQRMVADQREAEQRKAVSLEVQAALGETGERSSSAQGSCAQ

SEQ ID NO: 41762 - protein, 349 aa, A.fumigatus
RRRMRKQTKSCNAWLPTKGRQSNERLCLLRSRQPWEKQEKEVALRKEVVLNDLARAEPAVLEAQKSVQNIKRQHLTEVRSMGNPPASVRLALEAVCTLLGHKVDSWKTIQGIVRRDDFIASIVNYDNEKQMTKNHRLKMQNEFLSKEDFTYERVNRASRACGPLVQWVEAQVNYSEILDRVGPLREEVGQLEEQALQTKAEAQAIENTVQNLERSIATYKAEYAALISETQAIKAEMSRVQFKVDRSVRLLDSLASERTRWEEGSKSFETQISTLVGDVLIAAAFLAYAGLYDQQFRKAMIDDWVNQLAQSGINFKPHNPITEYLSNADERLTWQVFTTGWRIRPYWRE

SEQ ID NO: 41763 - protein, 212 aa, A.fumigatus
MEEHAQEPSRQDVTGYAPIHHFQYRANRPQPYRESQPNLQRLVQHDQRDQLYKHRVCLHRSSSSLYLTILTLLYSWGPTICGEWSQADTDCAKYLNNVGRGTRWEGTFSLTDSTQYCPTADTGPPCSCANANADVSKYSADYKKFLQTYAEAQMSAFETGQGWFYWTWRTESAAQWSYRTAWKNGFMPAKAYAPSFRCGDAVPDFGDLLEYY

SEQ ID NO: 41764 - protein, 68 aa, A.fumigatus
CEKLFWLVAKDFFGVLARNLDDEIPFGFLQHYECTKPMNVPEVWFILHVLYPGCCFSLVDPGPCSGEV

SEQ ID NO: 41765 - protein, 304 aa, A.fumigatus
RPEGAADEELLGNERDPGPRASRSYGDDYDARRREHSRAREAPRRSERHRDRDREGRSRRRAYEDDGRHRTRDGRRDRGRESDGEARRSRPREAGRETAARKHRSSDSTNSASHLLSADALAKLGAQYEKEERRKREIAKDAAKAERKRQKKLAVVGEETRALRDPPGESHRDRTKARVASGAYLEEGRSPEMRVRHRGGGGPAMEARWRKEGSWGGTMDDSGGGRPFWKRKRWIGLGALIIILVIVIPVAVVVSKKHDNKSDPADSQGTSPGKSNLDGLSHDSIPVRLISKRIYTLGLILMLF

SEQ ID NO: 41766 - protein, 352 aa, A.fumigatus
  UNSURE (226): Identity of amino acid sequences at the above locations are unknown.
AYAQGTYLDPWTWYDTTDFNVTFTNETVGGLSIMGLNSTWDDSARPNDNVPPLNEPFPYGSQPIRGVNLGGWLSIEPFIVPSLFDSYSSVSGIIDEWTLSKRLGSSAASTLEKHYATFITEQDFADIRDAGLDHVRIQYSYWAVATYDDDPYVAKISWRYLLRAIEYCRKYGLRVNLDPHGIPGSQNGWNHSGREGVIGWLNGTDGELNRNRSLAVHDSVSKFFAXDRYKNIVTIYGLVNEPLMLSLSIEDVLDWTTEATKLVQKNGITAYVALHDGFLNLSKWKSMLKNRPDKMLLDTHQYTIFNTGQIGLNHTAKVNLICNDWYNMIKEINSTSTGFVFIVLPHLFISPY

SEQ ID NO: 41767 - protein, 176 aa, A.fumigatus
PFSIAGAQRSAANGPKPIQTAPNTSTTSVAAPVGKEPSPSQTQPNTVQPPTLGLLAAAPTPTQMSASTQPTTRSSCRHTQRRRCLRSRPDRVGSTGPGAQSLRHSGATGPLGRMASCQPRHMRHHSGAEMQCLISETCWSTIDLPMSERLVLRLWFAFSLPWVKSPASCRRCTSYS

SEQ ID NO: 41768 - protein, 1171 aa, A.fumigatus
TLKWNQPLRLHSDKMRSNRILRSRKPRAPRNTPDEHGSNPEPLRVLNFANDDEPSPSAPGIFVLKLPNLSPESTERIFPISSVVSVDSSTPPTPAVENPEEQNSPWAESLRSEITGGKQSPGQSATPSPDDRKDAPSIQSTVEAYGSSLNVITASRKRNPLKIGLARGISDISFGDANASSQGTSGLPSSAEAPDSYFAGAGSWIDQAETAAWVQNMKNEPNFRHIHGLGALIVLQESKGNLIVQIASKNTEEVLGYKPEQLFALPTFCDIVQNDQKENFLGRFNLVRGKWYDVEQHGPDIHEVDVRQSCGATRRLWCTIHATKANTDHIVCEFELKGAVLESWRNSRPSKSVYAVYDNTSSDGRSDEKNSTPSMPPEMQNMLRGIRGKIRSSDMLCALSLIIQLAASASSLSMLFNYFTGIIRELTGFSRVTVFYFDRDGNAIPMNDAVDSHIIANFPEDLHYPKPLSPRDLERFHLGSKVCLEYSHRQFHTELVYRDSENLPSEFDLDHSYMLARSPYILDPVTGMPVFACMSININALGRAWGLIMCQSYEEEMRLPPPVQKFFWLVSDTLSSNIERLSNTMTAQMQGPFTSSHDGDEKGDSFQVKDLLTLFKADYAASLMLGETRILGKPHDAQEVLALVEYLKLKELSAVLCSTDITRDFPDLNYTPGFKYLSNLLYVPLSTDGREFIVFFKESQRGDTFHAGTDDNARCLNQGRPTELGSEAKLVDRETAIWNAGDLQKGPFLSLIYRAMLKEVWQQKETTMQSTQLMRLLLANCAHEFRTPLNAIINYLEIALDGDLTQETRESLSRSHSASKSLIYIINDLLDLTNAENGISLIKDENFDLVETIHEASRIFNEEARQKGVELHVVRYTGIPPVLGDQRRVRQVITNLISNAVQHTTSSGTVTVESCLLPDYTETGKVGIEVAIHDTGTGMSQNDIEALFCELEQVSNKDYIRSRGPQRCDNVITSDGSGSGNILGLGLALVARIVRNMNGQLSVKSEEGHGSCFRIKMQFPLPFDEANDENLDSNRALPVGKGKGRESEPEDDRNVPPKPDETQCSEDDGAWAGKNPAFSDSAGSTKNDSHTSDDTVTADVAQHDSASKQEESTLRPDIRNKPPSTEEVRQAHQAHSRPAEQCYQSSIRSTDKANRGSNVGVLREDGRTESN

SEQ ID NO: 41769 - protein, 145 aa, A.fumigatus
GTNPRLPRRSGKLIKRILGPRSNATRVLSDQPTKPIGEATSESSERTAEQSQIKAKTQSDIPPKEGATTASEGSSKKNLHILVAEDDPTNSAILRKRLEKSAHTVHITENGKECASAFRDNAHSFDAVLMDIQVSHRTPVGSDQS

SEQ ID NO: 41770 - protein, 110 aa, A.fumigatus
TDLQQMPIVDGMGSTKMIREYEALTASPTSVSATCRRQRIPIFAVSASLVEKDRQTYIDAGFDGWIMKPIDFKRVAHLLDGVYKEDVREDSLYKPGMWEKGGWFDKGGES

SEQ ID NO: 41771 - protein, 63 aa, A.fumigatus
IAFACTGAWPQRASDYQIYALFCLFLFSLILFLRFLPFLPSFPLPITTVASTLDVSQSFRHPT

SEQ ID NO: 41772 - protein, 737 aa, A.fumigatus
HINILASDHISHGMFRLLPWSSALGGNKVMAEELKMLAISPHCASPGLNSIGLPQLKRKRSDSSDAAAVEDAPVATKLRSDDASSNSLSGKKTLSSTVNGEPVASRMSASLGESSSNSAISKSSKSPRRRQSSSSSGSIVADKRAAPHKIDVDTLRETLEAQLSLEVLLKHNELRLIDQEIAKCQIALEQLRRCAEIPYPGSHVAGVSQAVSNGTGMAVRAPGNGVAPISPAPWGVTDGPYTRHYARWLIPDPRFDGGEFDSGNPLTPGALGTPLVEGRSTRGNPIDGGYLASKTRPQRGTAGAKLQSLPSGYPTPKEKAGPMIIRRKSDGVLVKLICLDCRRDNFSSTQGFINHCRIAHNRNFASHDAAAMASGEPVEVDEAGAVVPGKNETPSATAAGFVHPLIRSAHVIEPSTKTPSLVPEGTGDTTTPRRHTVASRQASSAVETPAMHFQAGKRTTSVGGKASHRNSFTGSSDTPHLSSLMQRRGVGVDLDKLVGEAKTTMDLEAYSSDAESEDDPAETSVDAATQAQKPLGNRAVRQSMRTTGSKIASQRPGSGKGFDNKNHHSPSPNGYFQSSYGPASSVSRSTAMEDLREELSPTTLESNQAPSLVSDDDDYGAASEPDSPEPSSSEAGDRDEEFSHIDVEDDEDAAASPATTGSKSDPDMASGAAHPSKSLSRSLRRSSTKKKDRVISASIAPVKRSKDEKRVSFVSPNSKSAKGKRNASKKSSGGRKQ

SEQ ID NO: 41773 - protein, 70 aa, A.fumigatus
RSQNAIDVQIQEIIPIIPLIRNIRPPISTIHFYPFTLFPLIYLNCVRLHRCMASTRIRLPNLRSVLSILV

SEQ ID NO: 41774 - protein, 121 aa, A.fumigatus
CSETVWLKYISVDPTTPGYLLDDDDDNNSMALSERKDSPSDPGIEPRGQLEGLSKFSPSHITIDMFNNLLARYPNTVKTVIRRKETARATKAATAREEENKRKGEETRGRFCYLEAYIDTR

SEQ ID NO: 41775 - protein, 94 aa, A.fumigatus
RKRCYNNCPGHPDSFGAEQSKTSYCNAAQAYSPSSTSTTGTATRASSATQTTETAATTTTTSSGFSPTPSGAAAGLAVEGGSVLAAILAGFVAL

SEQ ID NO: 41776 - protein, 99 aa, A.fumigatus
PGVVGSTEIYFNHTVSEHHDMSSTQSVKSDSIAVLILQLITRLALNFAMAGLIYAVMTRANCLRLLIQAPSAKAYYNRINTPERLRETLNHRHMWRHDC

SEQ ID NO: 41777 - protein, 81 aa, A.fumigatus
SLHSCPHNVISDGESADLSTTYTDRSSATYLEPAPTWLDCIHKFIYLFSLVKFASSQSNQYHLVKCVHGVCSPDWPPTRQE

SEQ ID NO: 41778 - protein, 301 aa, A.fumigatus
RKNLPDPEADVKALFMETKRCVLYIIRVQTGANLMEIMVKPPTKEDEERWMTLVRDELTTNTSQRSAYSEASTLVDIASMTYSELKRTALENILQLERTGKIRRDNHYQDLLNAIAIDIRTKHRRRIQRQRELESARLTLGRLNDQAAWLEQQLKTYNDYIEQAMVTLQNKKGKKRFLMPFTKQWDHQRELQKSGKVFKFGSYKYSARNLADKGVLVYWKGYSERQWDRVDLTISSNEVGVFTLDGSSGPMMVPGANAQVPLDDLLQAQFNNMQFMDFFDGHLRVNVNLFLHLIMRKFYNE

SEQ ID NO: 41779 - protein, 69 aa, A.fumigatus
SVIPSLHTCRDVDYSMGLGSMLTSVANSQLLNEIMPMIYKRFTDKSAEEWRQIYKVRLRGLASTRDRLD

SEQ ID NO: 41780 - protein, 1398 aa, A.fumigatus
SSKFPISLDLCILAHTTSSVMASQPISPRRTQTDHPQHTSSPLRHGSTASTSSSIYSLSSNSQAPSRTSTISSNASMGSAPRIGHRRGKSELNSITLGAMAKDTSGGESWTSAATTYENVRRSLRPLPQAPNADPPTSKTSIYRHTRSQTVDNPHYWKENRPGTPDSRHPHSLETGGLSERQSLNSQTPPKKNSIQPGSLHAVSPHSRPHIRPHHSHSLSSPLPPPLTTTLSTPELETFKKSSTGHLRTLSKFAKSGETEEFALEAYSPSVVGLQGRRRLKRAGSVAGAQGSRVARKQNASAWAAGNWMDKQRQFLQAYEYLCHIGEAKEWIEEVIQKQIPPIVQLEEALRDGVTLAEVVQAMYPNRTFRIFRHPKLQYRHSDNIALFFRFLDEVELPELFRFELIDLYEKKNIPKVIHCVHALSWLLFKKGLVDFRMGNLVGQLEFEHHELEQTQKGLDKSGVSMPSFSGMAANFGAEPEPEPEPEPETEEERIERELHENETSIAEFQAQIKGAMLRLKLGNVMNELWDFEPFLIDLQSRLRGDWARQVIQYRLNMRSFAVNLQAACRGFIVRSRQQGDREWCRAQELDVLRLQALIRGAKARTQVQYLRRQSRKEESGIKQFQAAIRGALQRKTVYAVYEDTRAIEPQVIVLQAAVRGALCRRMISEQHEETQCAEDGITQLQSLIRGAHFRRQLSAQQDDIKNTGNNVQQLQAAIRGTLTRKAVIQLKSSLAEATPTVISIQAGVRALATRERYFQLIDGLAKKKNECISLQAFVRGGAVRGHLNSLRQALEEHTLSIIGLQSILREKAVRVALDAQRAALVQEERSILQLQSAARAVILRRRLEADAEALRAQEHIIVDLQALSRAAILRIKVGAVLDELEDCEDEVSQLQAHIRAMIVRVDVGQDLADLAAEEELITDLQSRMRGHIIRSKFEEKRQYYRANMEKVIKAQSIVRGRIQGQAYKSLTTGKNPPVNTVKGFVHLLNDSEFDFDEEIEFERLRKLVVQQVRQNELAEQYISQLDIKIALLVKNKITLDEVVKHQKHFGGHVGSLLSNADISSKDPFDLKALNKTSRKKLEHYQVLFFLLQTQSQYLAKLFRRLRELNTPEKEYERIRHLMMGLFGYSQKRREEYYLIKLLSRSAKEEIESFDSLHEYLRCNSFWNKLFASYIKSPRDRKFMRDVLGPLIKENVVENPELDLESDPIQIYRSAINNEELRTGRRSRRPLDLPREEAIRDPETRATFIQNLQDLRDIADQFFTALKELLYRMPFGIRYISQQMYECLLSRFPGEDPGFILQAVGHWVWRNYFQPAMVEPEKFGVIERGLTQEQKRNLSEIAKVVAQVASGRLFGAENVYLQPLNSYVADSIQRLGRIWGDSKLAAFLSTWLYHAEAN

SEQ ID NO: 41781 - protein, 101 aa, A.fumigatus
NIVVSVQDAETYFDIDEFNDLYAKTKPTLYIKMSDIFSIHQLVASEINYICPHPDDILREIIRDLGNVKTNENELMSVNSSEINLTLNPKLAQVEGKLCCY

SEQ ID NO: 41782 - protein, 69 aa, A.fumigatus
VAPSHPTPCSSILYLNPALFFSPPPPLAFTYPKRSNRFFIVVDFSFNLSQLTLSLLLSILSQSSSTKRE

SEQ ID NO: 41783 - protein, 99 aa, A.fumigatus
VCAMDFSSLKEQVSNLTLYDIKAGVRKVQNGRYSNPASSGIPSSSPDSFSPEPTVYNGVRANNFSCFLAVMNYTEMESKVCCHRPANRIGRFALVLRER

SEQ ID NO: 41784 - protein, 101 aa, A.fumigatus
QPAVKRNYADDLQAIHRQERGGMATDLQGTIARAGVYQRPARLICLFFDIQSLQLLEFLIKNGSERVVDDARSHLSLIRMLRQFHYIDQNGKDQGVNVRTR

SEQ ID NO: 41785 - protein, 70 aa, A.fumigatus
ISQILADVDPNDHRTDMRLQLANLILTIFQLIKNSSNFDSQNCRSGESLKIHDDVFLCSEGFCVGFQSPS

SEQ ID NO: 41786 - protein, 631 aa, A.fumigatus
  UNSURE (523),(529): Identity of amino acid sequences at the above locations are unknown.
ESVSFVRAWYVRHRALFAELSLLLDTTRFVDELFATFGPKQQAPPAVSHTQAQPPLTHDLPQPVSLPQQAFPYNVPSGPSTDAYGAPMGGAAPAHTGHDGLNFNRKRTYHEGFQTEQEREDVPHNRTYKTPRRGRGGGRGDWMGRDGRAPQGAPGQFPPTGAGFPVMPPSFPAIDQNDPMAAMMALQSMGFPQMPGMPPMPMAAHGGAGQPQEQMMAKSSERCPFYETQGICYLGAACPYQHDTGPSAKEDGKRLASCFQRRLLLISDTTEYDPKSASIMVDLQRRDGGPMRGGDRGRGRGRGGDRGGFGGRGRRSEFSAAGPSDDPSMKTIVVEQIPDEKLDEATVRDFFAQYGEIVEISLQPHRKLALITYDSHAAAKRAWSSPKVIFDNRFVKVYWHKPKAERNGDQRPRGDAMDESPAFDPQEFQRQQEEAQKAYEEKMRKRKETEEAKQRLEKQREELLKKQQEEKERLLRKLGARATSNGTSPDGEARQSPADENVSEQTKQLRAQLAAFEAEAKTXGIDPNXSEAGATLFSYRGRGRGYTGYRGGFAPRARGYAPPFRGSFRGRGAARGRGGVLRLDNRPKRIAVSGVELNTEKDEALRQFLIVSIFPPPLSLFFFKFTRIDNY

SEQ ID NO: 41787 - protein, 121 aa, A.fumigatus
QLPFQGVGEYESIESHPEQPNTVVVAFKERYQAEKFMRGPWNIPSVGEVQLSWVPNPAVSAATSAQISGPGSDTKPTSDEDTVMESTAGSSQPADQLNSRKDGSHDVDYDVAEMDDSWGVE

SEQ ID NO: 41788 - protein, 110 aa, A.fumigatus
FFVFSTFEPFVLIQQLLLIVLSFHNSHFSSLFSANIITLIIFRLFQHLTTAEETDTTLCLTEQFALTLQTDNQLLSQAAILIVIIFTSFEIRCLDVNVNGILIDQNTTDI

SEQ ID NO: 41789 - protein, 169 aa, A.fumigatus
VPALKPSALALEAGSRVSNSARLMSCCFCSFAFCSSYHWSSPNSSSPTPPCRALSFELAKPSRSSSSNRSRSSSFFLALRSRSASRSTGPSSFLGSSPSSLSESPLNTSPVSRSSKAPSPSSSSSKASSRSSSSTSSSSSCPPESLAVAKRLRRASIISLSCHFCSSFS

SEQ ID NO: 41790 - protein, 1099 aa, A.fumigatus
  UNSURE (6): Identity of amino acid sequences at the above locations are unknown.
FVVIPXRHLVHPKGLWTVVTAKRRRLTIIECPSDSFASMIDISKIADIVLLMIDGNYGFEMETMEFLNVLASSGMPGNVFGILTHLDLFKKQSTLRAAKKRLKHRFWSELYNGAKLFYLSGVVNGRYPDREIHNLSRFLSVMKNPRPLVWRNSHPYALADRFLDITPPTQIEENPKCDRTVALYGYLRGTNFPAQGARVHVPGVGDLTVAGIEALPDPCPTPYMDQQLAKTSGKSSKRRLGEKQKLLFAPMSDVGGVLVDKDAVYIDVKTSNFERGEDDDNQDRGLGEQLVVGLQGERKLLGEAEGGVRLFSGGEVLEKAEDDEGDNVGRKERRKVRIMEGEHDQQELLDEDEGFESGEDEELDEDGEDDDLSDEEDGDLEDVSAPPDFEENFKARQNGSAHREEGDLAFADSDSDLGSISSVEDQELESDVDEDEVEEDDDGALRWKENMIANAKALHGKRPKFRVADLSRMMYDESIAPADVVKRWRGEDDEDEQPEAEEHQEDEDDFFKKTNTEKEEQSDYRAVPEYDYEKLEQKWQDSDMIEALRSRFATAKLSGGHDDDDDVDDDDLDDAFDEDDEGDGAFEDLETGEVFNGLSDNEDGEEPKKEEGPVDLEAERERNAKKKEELRLRFEEEDREGFANSKDNARQGGVGEEEFGEDQWYELQKAKLQKQQDINRAEFETLDPASRARAEGFRAGTYARIVLEKVPCEFATKFNPRFPVIVGGLAPTEDRFGYVQVRIKRHRWHKKILKTNDPLIFSLGWRRFQTLPMYSTSDNRTRNRMLKYTPEHMHCFATFYGPLVAPNTGFSCVQSLSNKTPGFRIAATGVVLSVDEHTEIVKKLKLTGVPYKIFKNTAFIKDMFNSSLEIAKFEGASIRTVSGIRGQIKRALAKPEGCFRATFEDKILMSDIVFLRAWYPIKPHRFYNPVTNLLDLDEEGKGDSGWLGMRLTGEVRREKGIPTPQNKDSAYRPIERPTRHFNPLRVPRQLAADLPFKSQITQMKAHKDKTYMQKRAVVLGGEEKKARDLMQKLTTLRNEKQAKRAAKQEERRKVYRAKVAESLEKKAEREKRERDEYWRREGRKRKNQDAEGGGGKKRK

SEQ ID NO: 41791 - protein, 616 aa, A.fumigatus
ETLRLEDLFEPIALHLVCFPLRTSFAAFLCQPSSLSRAVIPSLVSLKVGDCPGWSWKLSVCRRTILDRLPILGFLLDPKLRAAKQALSGLGSLEVSTQKSPVVGYRLVAMSGSNIDVPLPEHSTAHSTCLNDSFSAAGEDNHPVSESDKAHEVAKQTSHSPLGLTLQSPVARGEPVGSGSNLDFSHVSRGQLPEVGTLPGGSTAGSLPSLSSQRSNLTRGLSSRNPSSGQEHDVASSSGTERSPQLARSHKRTATGEIKPSNTSVAPPSPGTISAEGHPAESIGWRSRGSRIAAVNWPCNSIFCIILLVLISKTLLSVHLRTRLSYAAAKIEKSRQSLNTQEKLPLDLLKESSSTPPVIVKGAPNTDGSRRRDKDSPNGSPVSAPDIPIQSNFFSPHTRVSPAARSDDLSSVSQSKYSPGSPFSSKRMSATPTLAPPADIVPSGSSSSRRRRPNPNQALEASRYIASFDDRQHRFQHESTNGSQKILVPGTPPLQSLSQQTSTPYNGLSRQSTHSQNASMEQDAIETLLFMSSPGNSAYHPSSQRQQSTSHISQTSLSTESSTRGSQLQDSQAAGEDHRRAGQARYLEAQAGDEIDRMLDQMEDSDSDNESKPIYR

SEQ ID NO: 41792 - protein, 159 aa, A.fumigatus
AFCNTNLAIRMNADQGSNSSASTSSSLFDPGVFLPGGHNNDPPLPENSPTVGYKLNHFMLRIREPQRSLHFYINLMGMRTVFTMNAGPFTLYYLGYPPTSEDRADLPSWSARVAKPPVLTQTPGLLELYHVHGTEKADAEGGFNMSTGNTAPHLGFGHL

SEQ ID NO: 41793 - protein, 76 aa, A.fumigatus
IPCGKIIDKSSRMQLRQSKILSCWFSYSLSHHHLRECSVFRKDSIVTRTHIYPVSVCIQKRPQATKEHNSRGMLRR

SEQ ID NO: 41794 - protein, 65 aa, A.fumigatus
SISFIDSTRFYIIFQRGTIAQLADAVQGLPVNNKAVFLFIYTQGRKCLLWLYYFVFTHQILNIFI

SEQ ID NO: 41795 - protein, 68 aa, A.fumigatus
PVSHGGSAGSGERMTDSKTSDTRMFRPLDVFPKLENCHQSAEFMIYQYSVWPIDPKRCRLSPEARVLI

SEQ ID NO: 41796 - protein, 61 aa, A.fumigatus
LLILQGHSDQPIVHIFSGFSTNRLLIYPFLLSSFALHELLVKDLEMNRWPSKRCESQMPCS

SEQ ID NO: 41797 - protein, 422 aa, A.fumigatus
FPLRVLGRPGAGCSTFLRTVAGYHSSFLGVTGHIDYSGLTLEHVTKHYRGEVVYVPEDDAHFPTLNVQQTLEFALQSKTPKRYRERIPRYLEIYGRVFGMSHTMKTLVGNEYIRGVSGGERKRISIIESLATDSSVMCWDNSTRGLDASSALDYVRSLRIMTDTCGKATILTLYQASDAIFDLVDKVLLIDEGRMLYQGPAQEAKGYFENLGYQCAEMQTVSDFLTSITIPERRRFQPGWENRAPKGAIELEDAFRKSAAFHQILEDLRNYEEKQAGIQGLRTSQSDCDRRSLKAFKSTVQAEKSRFVSAKSPYTISLFRQVVLCGKRQMWQVKGHISPLLIKLVSCVIYGLLIGSMFYELPENTDGMYSRGGVIFYSSILLAWLQMSELEEAMQGRDILSRQKKFAFVRPRSSPRGSKDPR

SEQ ID NO: 41798 - protein, 95 aa, A.fumigatus
VVLIICDPFMLFLHARNRLGSCLLVFLQLLKLMTKLLHLKSLFGDPGVLRFDCLLEFTQFLVKTGQFSSLVLKLRLGNVMSILRNGIRSTQMIHG

SEQ ID NO: 41799 - protein, 147 aa, A.fumigatus
TALSYFLYSLFNFTKMSKSDYIQNMFQTKSFVDRYKYTEKLTGLYAQTLVDYSGVANTSQKPLVVLDNACGIGAVSSVLNHTLQDEAKKTWKLTCGDLSEGMLETTKRRLQDEGWVNAETKIVNALDTGLPDGHYTHVFVAFGMLIN

SEQ ID NO: 41800 - protein, 132 aa, A.fumigatus
VQHIVNWIPIMKAAIETIPGNLPFPTQKEFIALHNAGWDSESYIQSELEKLGFRDVKVIPVPKETSIPIDEFFEVCMMIIPYLLPKFWTEEQRESHEKDVPMVLRQYLQDTYGANGQVPLEAVALITTGLKP

SEQ ID NO: 41801 - protein, 324 aa, A.fumigatus
LLSQPSEPHAHPLTKEQMEFQDRKRRLGVSATRAHSHSLTKFGIQDLNVTTMANQHNFTEQQQAQQPQAAAGEAQDVTAAAQSTEQQPLAQMSELDRFGLAGLLRMIHSDSPDVASLAVGQDLMTLGLDLNQPEYVVAVMAQKLSFALLTSVVRRPLHTSFASPFVASMSAVPMEQNFSLPACYNVANIQPLQTRIPSFSDETLFYIFYSMPRDIMQELAAEELMGRKWRYHKIERCWLTRDETYPGPVDVEPRVSERGVYLIWDPTTWKKIRVCILGPILNPSWNANTWYQQREFILRYEDLDNRLDHNRGLARPLGFPHQAS

SEQ ID NO: 41802 - protein, 268 aa, A.fumigatus
SESFMADFVADRASNRTLCVQSSQDGMRFSCDGFMDCRLLFTAIFGCLRFCATVAGRELTVMRRDESFNSITGLNGSGKSNILDAICFVLGITNMSTVRAQNLQDLIYKRGQAGVTKASVTIVFDNRDTAKSPIGFEEYATISVTRQIVLGGTSKYLINGHRAQQQTVQNLFQSVQLNINNPNFLIMQGRITKVLNMKPVEILSMIEEAAGTRMFEDRREKAVKTMSKKELKLREIEGLLKEEIEPKLEKLRAEKRAFLDFQQTQNDL

SEQ ID NO: 41803 - protein, 521 aa, A.fumigatus
RLTRLVVAHDYLRSGERLRVTGEECESKRRRMQALEENAAKLKNEISHLEEDMKRVRAARDKELRKGGKFQALENEVKSHSHELVRLTTQLDLKNASVSEEQEKRETVRKTVKDLEKVLKEKREVYDKLQAEYDAAKAELDAQTAEVEQKEELLQTLQTGVASKEGQESGYQGQLQDARNRASAAATEQEQAKLKIAHLEKRIKEDEPRAKKAKQQNSGLLDELEGLRAQAKRLEAELTRLGFEPGKEEAIYQEQSELQRDIRDLRERADGLKRKVANVDFTYADPHPNFDRSKVKGLVAQLFTLDKDKVQAATALEICAGGRLYNVVVDTAETGTQLLQNGKLRKRVTIIPLNKISSFRASAEKIAAAQNIAPGKVDLALSLIGYDEEVTAAMNYVFGNTLICEDADTAKRVTFDPAVRIMSVTLEGDVYDPSGTLSGGSSPNSSGVLVTLQKLNEITREMRSKERRLAALEDTMRKEKKKLDTVRAVKQELDLKSHEIKLTEEQISNNSSSSVGGPTGI

SEQ ID NO: 41804 - protein, 135 aa, A.fumigatus
LWSSSDFGQIIQAVEEMKSNIEQLKKDISDAKTRQAEAMKDIKRIEKDMSEFNNNKDSKLAELQATLDSLKKKLAKNSNSVKALQKELQISRLESEQVGSDLSAAEEQYAEAENTLKAQMEEIQSMKREQARVKV

SEQ ID NO: 41805 - protein, 203 aa, A.fumigatus
FFRDFPSLSGAPQQSQTPNPGLVWGQRALQQTPQRQQHPTSQAPSRAPQTQSHHPQQQSQPSHDDVFLSGAQFANRLDDFRNGGQGISGQLGGSAQPQTGNIDEFPPLGRNVAADLGQDRRESLMQSAGLGNFGGTMPFTGANQNQSAQNRTMIGGSINGQDTSRMMSPTNAGSTGMFFFLIFFDGEQGADCFLSHRNLTLTR

SEQ ID NO: 41806 - protein, 82 aa, A.fumigatus
DAHDIAQAQLEDERAKLTGFDEELRELEEAIKSKNSRITEEGLEMQKLGHQLEKLQKDQQAAAQTVARMEEEHEWIADDKDN

SEQ ID NO: 41807 - protein, 200 aa, A.fumigatus
RIPSSQLHSNRLKKEAARAEATFKSEKAKADKAMKNREFQIARIHAASAVREKRRQVTLRAEAARADVIINELKAAQSTRDTSRTLALASRGLDAASKSVNLENLVSHANNFLARSEDFKIASSAIEDVAQGVSMQEYGAEGEAEVDRLMEQLADEAGVDMRLALDADAAPKEDVKEQKQADSELEDGLGARLRALRAAS

SEQ ID NO: 41808 - protein, 75 aa, A.fumigatus
  UNSURE (9),(15),(39),(49),(61),(75): Identity of amino acid sequences at the above locations are unknown.
YMLTSACSXRKGLDXALHQIEEAIKRPKTDAAGSDAARXLISDLQDLLXRTQGHSARSEVXETSDDPDQSRTKSX

SEQ ID NO: 41809 - protein, 443 aa, A.fumigatus
SPCLGTSAPALPLLTVSPADTSLKAPETIVQETKTEEKNHLRKGSHGDRSYPFQRPTCLQGMFYRVRRSQLGQLTYTSQRKRAKTEDEKEQRRIERVLRNRAAAQTSRERKRLEMEKLENEKIQMEQQNQFLLQRLSQMEAENNRLSQQLAQLTAEVRNSRNSTPKPGSPATASPTLTPTLFKQEGDELPLERIPFPTPSITDYSPTLKPSSLAESSDVTQHPAAVLCDLQCQLADSKDLEVPSRFLTSALAWNMTLQMTLQLLFLTMTSTAYSTVIHPLSQILRSLKTGSPLTFSTQEIYQHFHLILWLISTPSLSPSKASNRPTVFRMRLLTRLLACNPALARPLRDATGRALQLAVSENVSRGTWSAGDDAGRLHWESLLTLVWAIDRFERTRGRGRILFAKFERGARRDTLGNRHRSPRSSWSSKRLSETLTSLMDKER

SEQ ID NO: 41810 - protein, 466 aa, A.fumigatus
VSFPRSTLWEHSSQVQPKKMAPSHSFPLASLSLILHQTSCAFAAPWIVTKVYEQDVYTEDYGYRTTTRTLIDEITPTASPMPAALSTATHVTSDSYDDAVTVVQVLYPSGAGIESTYKYYIYQDSNIITQYFVDMVLTAPTSCSSQWTVTTAVPVYVPNAIEDALLATSMSTSYSVDDRQPFQPTTYTRALAFIDPTQLPASSLNRLSNSYQHTIYHEYGCYDSSADSGSSYSYYDGSDGGSWLYDRYYYGVISPLGILLACILGWFGVWLIIGLIESWFQFQRLMRGWQARRGFPISWCMLAPIVSCLLLLFCRKGFQARTFEEAQVLQEKWQQMGFWRKVGLWLRWGFGFSYPPMLGPAPVKVERPSKRPVAATAPLLGVSPPRSVMSDVHSDSGSNRGDSAASGPAMAYIPTPGQTLQVPPSIPSNRQQQAPDQPIPEVPSTTSGALPANTHATETASEPRTS

SEQ ID NO: 41811 - protein, 85 aa, A.fumigatus
ISTHIPFLLPSSFFFFFFFFLFLFLFFSFFFFLAPRKYQVCTTPYIADLPGLADLNGAYVDAEIPGNGRPHNSLMENIVVDYFRQ

SEQ ID NO: 41812 - protein, 60 aa, A.fumigatus
RPNDRRDLTGDFHILDVSKEEARVTFIQGSFVWLARHDHQIAEYSSPRLEIIQYVTHVRL

SEQ ID NO: 41813 - protein, 348 aa, A.fumigatus
LSWMKYQRWLLTRNNLWAPKRPSVVASTNQPGSISLISSRDGRSVSTTSQSRFHPLKPLREVKIDEFRRSYFHPELPVLLPYRHFRDLPACERWFQVVPSSNGHDRRLNTAYLQEHGGDAFVPLELTQSPADTTAPDATVPESNELSFQQFHAPLSLFLDWMRTAELQSQATRLYLAQCQLLDLPPVLRDDFPTPELVLKAGKGDIYDTNVWIGHPPTYTPLHRDPNPNLFVQIAGHKVVRLLAPDAGKRVFASVRRRLGRSGDREAAAFRGEEMMQGQERTLLEHAVWDDADSDGTNNVLDFGYEAHLETGDGLFIPKGWWHSIKGVGEGVTASVSFVYPPVGYALL

SEQ ID NO: 41814 - protein, 93 aa, A.fumigatus
SGKMPSSVARIHKRHSYGKDAHTYSPVLVIGAGVSGIATGCRLKEALGFDQFRIFERQSGIGGTWWINRYPGAACDVYGHLKAFMLCRSDSFC

SEQ ID NO: 41815 - protein, 335 aa, A.fumigatus
VFISPALLYSFSFAPKKDWTTLHPPGPEIVQYLADVCEKYQIVDKIQLNTAVKEMRWLEDAEEWQVTLLHLVPGTGDLSEGERNARISKEGERSVYVKTEIVRAKIVVSGVGVLVEPKKWPETVPGIETFEGEVVHTARWKSDLDLCGKDVVIIGSGCSATQVVSELTKPEYKIRSITQLMRSPAWFMPDFLTPKSLKKWEKYTPPLFKNVPGLAFAARALLFLLLEWDFLTIFKDNKYSRRNRSRIERKFLEHMRATAPEKYHDILIPNYSLGCKRRIVESNYYASIHAPNFELTTKPLIGVQARSVLLGPDRHYPAGKSGVNGWGETDSGGCH

SEQ ID NO: 41816 - protein, 134 aa, A.fumigatus
FWPNGYETNKFLHPLPVFGRRGKTLDEIWEERGGAQAYLGIAMDHMPNLFLSFGPNTATGHSSVIFAVENAVNYSLNFIKPILEGRVSWFEVKENAERDWTDKVQRSLQGTVFRRGACTSWYQTDEGWNSSTYP

SEQ ID NO: 41817 - protein, 98 aa, A.fumigatus
QATYHFHTDDDAMAYRVIGFAARMCLELGLHRREALMKSFPNEDQWADVTKVFWTIYSLDRRWSLGTGLPFVIQDEDVDPNLPEPVSQKPGTTRVTHV

SEQ ID NO: 41818 - protein, 383 aa, A.fumigatus
RRFCYSNECKRRKIKCNGQVPCQRCGHLKLECQYYVSSGCFRRSMTFEFLWRENDCAIGRYAPNCCNNNFKDSEYVLSPLSLIWLTLLSVRQLTSVVRDREFRSMKDQITTLQEQVNSLFTSLNDLRNQRSSLDSPNLEDLSRDGSQSVFTSMHAATVRPRVRHLRFHGPTSSAFNFDVARSSLQTMGIAPAEEVMNDDMTTAQATPAASPPAQQAVFTQSIHPTKDPIWAIKREEALRLCHVYEEEVGIMYPLVDIEKVTNQVNLLYTFMEAALRTGFAQRAFPGPDSLLDDNTILLKMILAITLIVEGSGRSDLGQRLFLSVKPIIEAKLWGPIDIKTIQLFGMVVCIVILMISDPPGTLTKCSDRQLTISTRMTMRWPTE

SEQ ID NO: 41819 - protein, 69 aa, A.fumigatus
  UNSURE (2): Identity of amino acid sequences at the above locations are unknown.
LXGQASVFHWYCLLVGQFAVLSAPLYNFFHIPLIIKMYPVYSISSVPITSFADSSAPDLQASDKTVMFA

SEQ ID NO: 41820 - protein, 563 aa, A.fumigatus
MLLPYEDTASQIVEIIWPLSAVASRSDSTTGCKGVLPLRTFIQETLRRSRTSYSTLQVALYYLIKIKEHVPRYNAEQEQPPRSKPVCRAMQCGRRMFLAALILASKYLQDRNYSARAWSKISGLNTAEINQNELMFLEAIGWRLHVTEATFQRWTDIVLKYTPGAGGPFTGEGQCWRTVIPKLTPELDTVDVELSTPSSMVGFESGLVSDSPSPRSPSTGEHPSPSSIFNQGSAYQRYSPVSAGASSLPSMPRPPMLPTPQLTPQTVVATAPAASGSTFCARRASICAAMSQVQNVCMARSTLDLRPSLAFCQKANTFDGYPTVVRRSSLARSTSSASSPESMISDVSTLSSSSLSSCSSGSGPVSILGTSASTKPRLAMKATHRCTSNSLKEGRKALAIASPIDEGPLGEIYSSPETYLGAAGQVPDLSNISLGTPVDHEAAQSLCELSGAISRSAQTFEQGTTTQRQCRKRGRTGSEDILWQNHVRHLMNPNARNEGKASDCSMSDTRSYPKHSQSLSAAQLSLLAVSAPLSGPAGMKRACCGSEARKIALNPSVRSEYLG

SEQ ID NO: 41821 - protein, 131 aa, A.fumigatus
ITLHTVPTLPIGQRLEPSVKEKKRGGKNFKLSRDMRARLLQFFSKAPAGPTITRTFASRRAAANNARDTNHTTAEPDEKDLTAAREWLNKFNSKTVTIPRDICEISFSRSGGPGGQNVNKSVPLPCSFILH

SEQ ID NO: 41822 - protein, 173 aa, A.fumigatus
AVASIILVTWAVGFPKSSQMMMRVRRQLEAVPANVSATTNKPRGATSAESPVELKTSISYLQITFATILLLTILPLYPYSHSNLIYYTLIKMGWLPWSSDDSTKASDGGRIAPDRSSREKCWEGRDLFFSCLDKSNIIDSIKEDKEARRQCGKELAQFEGSCAKAWVCISSQA

SEQ ID NO: 41823 - protein, 60 aa, A.fumigatus
ESDTVCLFHMVTENGVSHDDRTVQEFYPEICTHLFLGTDVEMAIVEGVDNRRVCGGSAHL

SEQ ID NO: 41824 - protein, 180 aa, A.fumigatus
VHITDISADPVLKDHFWMNPFAKHFSTIKASDLVLVDSEGYVTEGGAQLPINEAGFMIHSEIHKARPDVVAAAHTHSIHGKTWSAFGRPVEMLTQGLCYRYTMKGCGWRTLTLPVDACNFYGKLSVYDDHGGIALAREEGEQIAKALGEKNIACILQNHGYGNLLVTHRASARADCLLVC

SEQ ID NO: 41825 - protein, 292 aa, A.fumigatus
AFPSIKSIRSSRRGSSTAPAIAANSSLTVLPSSDPAAPLTHPNPDVPPSASSQAAQILPVANEVNHAVASWAAQSAPHDRLDYQAKPEDNTGEGGVDFQNLLDNLPPPSTAAPSPPLPSETAPSSADDVSEAPQGLPPRPPPQEKPSIHPNYHPTDDIRSYHQLHPHPASTSTTYPSQQSNYQSNLGLPSLAASGAPGTASGASSLPPPPGPSFQQPAPSTAESSQEPPATAASPNGRIEKPVGRVVKPGDEDVPWGPDVQKKYDQFLHDERVYVTEGLWDRFPAGSRLFVG

SEQ ID NO: 41826 - protein, 253 aa, A.fumigatus
SYLILAGNPGNLPTERVTKRDLFHIFHQYGKLAQISIKQAYGFIQFVDASACKHALDCEQGAVVRGRKIRKLALRSLRIFGPGLTLPYADLEISKPQRNTRAGPPPPEPSRGAPPRRSRSPEYSRGGPPSSRNTRASGDRYDRPYESGRVPFSDFRDEPNHRRRDDYRPPPRSPSPRPFRGRDGYRSRDRTPERYDRRERRRSRSPYGRDRRYRTPSPRGRSAYDSDSDLPVPRRAPRDVPEVQILVLEEVDR

SEQ ID NO: 41827 - protein, 101 aa, A.fumigatus
FMPPRRRAPAGSRTDLPPLKIVRKIILLQTAYYVSATALILFTTLVYGTGFSLDFVFSWDALRGDTTIGWMLGLVWMLNSLLGYCIRLSLLQMLGSLTKYD

SEQ ID NO: 41828 - protein, 135 aa, A.fumigatus
PNMIDSVIFLLLLVSRSKLIPDFAITIHFLHLIATSFYTRSIPRNLLWWCLQCASAALMTFLGIWACQWRELRPITFGIAGGRGTAQSSSSASQPQTDDVENEPFLPSRGRGRGRHLGEGSGEYELTEMKGEQAV

SEQ ID NO: 41829 - protein, 118 aa, A.fumigatus
  UNSURE (38): Identity of amino acid sequences at the above locations are unknown.
PCSLLKSDLCLLFYVSSKMSTTTITESAKQTLVVTPDXITPAAADEKFQAIARGNREGTLKLQGIPTFSDPYEQRKWMKEHMAAAFRFFGKQGYGEGVSGHISMRGKESLYTDMSPHY

SEQ ID NO: 41830 - protein, 65 aa, A.fumigatus
LSFSLLTVGHTVDEAAFLFFSLDNACRSQLMADAAAANGVPKKIINHEVAQYTADAVQNPVCFPC

SEQ ID NO: 41831 - protein, 134 aa, A.fumigatus
YSCIPNCAQPYLKVSIDIEKCLPDSHASHPLSPAPLASSRSASPSPATAPAPTPTTPSSKPNKSPPQAPAASASSSSTAPKLVTPSRDTSSTPFPSKSTPSPPRAAPAQPAPWSSPATSTPPFAPAQTSKSAPR

SEQ ID NO: 41832 - protein, 214 aa, A.fumigatus
QRRSKKPPTPCGDRQRTASFVDQGRTNEFLTKLRGTFHDLAALQIPTISAISSTALGGGLELALCTHLRVFGSSAIVGLPETRLAIIPGAGGTYRLPALIGVNRARDLILTGRRVSGPEAYFLGLCDRLVEILPEEEGKEGVAREKVLRESIKLALDICEGGPIALKQAIQAVAGFHRGEAAENEAYNGVIETEDRYEALRAFAEKRKPAFRGR

SEQ ID NO: 41833 - protein, 1091 aa, A.fumigatus
DRFSRNFSRPTHHVKWHLNGFLCSAGVFREYRYISTASPTETDSPIDTNGEEDRWHDFWCRVRNQSRLSRSLSPSGSNHLCGHNQSSGESDNSPSIVDVYSSEHDATLTAYSETKAMSSRKATKVKGKQSSIVTPTQYLLDVLRDSARSTGDGLGQTQPVNSIVNDFGKRQKKAPRKQPRLSLQTILAHWIQCVDPVLGRAQRAHHDTEATAELEIVLQQAFPPKIIEYLTARHYSPSDVLLWSWILKGNTHEAALRILMAESAEGARPGSQRRLIPPFIPLLLLRRPSLDAKSFRLLLIYSLHLITGRKIPPLDAFKRVQRTAQELEDSLGSRQTEALIDTTTCFVLVTRLLRHAREVWPQAQLTIARAFASYLTLLRNDQEISQIARHRRNQFMADKFNACLWLLSLPCKAGPFKFVSVQQQAQFELLKAMAGHSPVLPVTRQGYQGIIAVQLAHKKTSAERQSAELKAPSWPPWKEEKLGIDSQRGNEGMKSRAMRVMAQMREAGYSHTRWEEVSAILAGWDTDKSPTVQTRALMRRPQLLRGPAGSKPDHHAVWVARIRATRTVREAWACFLSYQDQGLPPRASIYVAMAEKLIFRRKALENDFDHISHSLPGDGLEVFPEPASARDLIYVHTEPPTLEELLKQMLAQGIRPSGRFLALLLRSAPTFNCGLDYLSCSDLSNEQIQALCTVRESTSDYDVLDSTVLDELPDYLFSSFVGFLCNYSSLDSLHLERHDIRTADLFPIIMSSMSRTHPNEPKTSTLFSNIQTSGESGTLQHPKTLSHAIQLLKLRKSRFTPPWIHLLTALSKDRIRTPYRRMSRSAQRVLAWYEMVEVIGWMKERAIDPGLQGHQVLCASFSKAVMAGLKHPNAAEEGLALVHEAARRGNIKHSKVLRPHFEDMVRGGLAILKELFSQLVLSDPKNAPFGERSEGPFESATSSPVAIPSMLHVPSPAALHAFVRALGLAAEHDGLLNLLRWMSQNATTLKETADEHLNGDRMMRRTLVALRVFLEGYRGKRPRGESDNLPSESMAAGEPLPSDVSAPAANGSNSKLQEAYEIVAATPLWGSWPSDDEVWEYLQWEPQQSVH

SEQ ID NO: 41834 - protein, 122 aa, A.fumigatus
YRKMPPRLPRLAPALSSPPRIVSLRVTISRYSTSTNTDDAVIQTQQVPAPGSGSIRVLLLNRPKARNALSRHLLDTLSKQIHSIAAEGGTGPTRALVIASNIDAAFCAGADLKERAKMTKEE

SEQ ID NO: 41835 - protein, 238 aa, A.fumigatus
LSLQQRKMPPPRRHISYLPPPKRRLPLLRKSPKRLIPVLRLNHPIVRLILRRFAPVEPRNGLNRLLEGNGTPLTDIQRKLDTLPQHLLPRHPFLPLLLGQDLHQPITKTQEVRLGTRHPSPGQDQVPRAVHPNQRRETIRAARAGDNRQPGLWETDDSRRPKHAQVRAQRQLEAAAQRCGGDRGDGGDLQRGEVVECAAEFGEEFVRPTLVNKRCGTLAVATGGRGFLTPPLSSWRAL

SEQ ID NO: 41836 - protein, 294 aa, A.fumigatus
IACLRAMGPPSQISSASLILSRSTFSLATPSFPSSSGKISTNRSQRPRKYASGPDTRRPVKIKSRARFTPISAGRRYVPPAPGIIASRVSGRPTIADDPNTRRCVHSASSRPPPSAVEEIAEMVGICSAARSWNVPRSLVRNSFVLPWSTKDAVRWRSPQGVGGFLLLLCHLGALFEVCAGAKGGVDVAGDDQGAGWAGAALGGDGVDLLGKGVEEVSREGVTSFGAVEEEDADAAGAWGGDLLGLDDGVVGVGAGAVAGDGDAERDDARGAGESGCEAWESGRHFSISIETFR

SEQ ID NO: 41837 - protein, 804 aa, A.fumigatus
VVLTCSRNDTELQLLSCPLPSSPAKPRSKRAKVSGEKDESTSIQARVASDRYNTLSEFLSDIDRASTAVIERSKAQSGEGEATDGNRLTETVNRIAAFKKLLNSLVRQASVGQASFKKESTEDSSEAPEKSTPSTNEARSDNVVLTILGNPSNPKQLYSSLQKSVKVSLPSGESAVEKYVEVQTPLREIGLPNGITTTKVAAYHTDNKPKESKRTFGEVFTPRPTLPQLEPPRRARSSSRTAPGGWIDPFEAVTNYKTFPGERNNYCLAPLPSGQWLQYGGITSSPSFWDRRQKQQSAQPHGDERYNEDPALWTDDDASLLQGVYYSFAPSFDSSGAIVQADSKDMVWWGKRGTKRLYTLLTKTYSEEHQEVSDVSATEQPGNIGELDESTLEEMVKSFNPEDFADHVSLTNTLEKDKEEAESKSMDDLLRDVSELLETLSSYQKIRNLELPAPGAEPKETAADQGTPSRASAAEQGIYETLKSSLAVLVSNLPPYAVAKLDGDQLAELNISTKIVVDNPDYHGVMEKDDFTLQQERAAALAPMATGTNRTSTPSRSGSYQAGYNQRAYTANARVQQPQAGFQAPQPYYGGRQPSTSGPYTPGPPQHYANVRPPATPSQRPAFVPGYQQPTPQYNQANLQQFQRPGQNGYSPYAAPQALPPAQASPQAYAPRPAQPGAYAPQYAAGRSGSPQKQPAYASPRTRAPYMAPSSATPQQRYVPQQQPSNYNYPSNQAPLAPNTYSNSAAAMTYARSAAEQAALMDRNKAQLAQQTRQSSTPQPATDASSQDRSITPAIKQNGTPVPS

SEQ ID NO: 41838 - protein, 108 aa, A.fumigatus
DEVNSRPRVQGAKNQLQQRRISELEAMSADEGGETLSIPATNGEPQSATPDPPVLSTPGKRKRGSSHDVHAAQDAGASESQVQERVKLHETLSNLVDILSKCASPMFC

SEQ ID NO: 41839 - protein, 67 aa, A.fumigatus
GEIRGFKGAVSCPPEVWKPTNLMTPRIEQPDQSIEAEVLKAETQAAMDTLQELQAQFEVVSAEARSR

SEQ ID NO: 41840 - protein, 278 aa, A.fumigatus
PALPRSVTLGGGVVFPVPAGCTADTERDRTGNAHGRSGRDHGAEWFWQIYAHPPIDGQSTANAGEGIHPLQAETRILRAAFDRGAPRTRSHRSYTDRIRFHGQGDQYFTRRGRDPWFAVVTGSAGQDSLRRAHCTIIGRPTGTFCKSEKRSAAVDNVQVRLAIAKVIWNAPHLLVLDEITTHLDFHTVTALATALSSFNGAILLVSHDRFLVRSVIEGKRDDDHSLDEEFEGVDQEVEEQSRRRSVYVMKGGKLIEQPNGVEQFEQSLVKRVKKMLSQ

SEQ ID NO: 41841 - protein, 304 aa, A.fumigatus
QVKTPKSCGESPATLALSSGPYDNYFYSDCNVAAQVVVTSPLPDSNLSLIGPRLIVAWPAGNSGICTYFAPENGVNGTLGISVVNSTVGSPLSLNYTAKEPNPGVGVQGTLRFNSSAVLTVPILGSIRTIRDFVEGPSLLQPKIQDAIQLISSPDGSVMLQRLWLDNVTTSAIKFTPVNSTSKAAVSGKTVRFDAGDYVFSAEIDYPQLTQLPPAKVLNNASADLVTKMPVQATALSFLSYSEKLLAGAWRFLTYFGRDLMISALLMDPVMSYGNASAIEAVLGSVCERINATDGSTCHEETIG

SEQ ID NO: 41842 - protein, 392 aa, A.fumigatus
AWQMKLVEIEKQARQILIGLGFDEAMLSKPFLTLSGGWRMRCLLASVLIQNPDIMILDEPTNFLDLLGVVWLENYLQRLRDSSQTTILLVSHDRDFVNAVCEEIVILRDQKLTYFRGNLSAYEKDFEAQKLYWGRMKEAQERQIAHMKATIRENIKLGKKTNDDNKLRMAKSRQKKVDDRMGVQVNANGGRFKLNRDLAGYHLTARAEIEVPTDERCISIILPDASDLRFPGPLLSAEGLCFRYQRDAPPILNGIELVMHMGDRVGIMGLNGSGKSTLIRLLTGNLQPTQGKVSTHSRLKLGYYAQHSIEELHEQGRTDPTLTALGFMAKEINTSLGEGEIRGLLSSLGLQGRIVSDVPIARLSGGQLVRFASLRSDLQLLTMSRSVLQLPR

SEQ ID NO: 41843 - protein, 70 aa, A.fumigatus
LMIASWWRNRYERNASMAGITSIIKEKRSLYLFVLTGLSTLDIIMIVKEAQYGRRKSAMPSVEVAPVQEI

SEQ ID NO: 41844 - protein, 68 aa, A.fumigatus
FLSQGYVNTSLRYIQDSWLKHRLFSLKFHVSATYHSNMLTSGIYPFNFQGKQFFFTFKQNSCIIGSEF

SEQ ID NO: 41845 - protein, 211 aa, A.fumigatus
SLVKLNNVEYALSQLDRLEREINVDGCAEVIAQHAGPQLQKIRRSTTYVFTIKIVEAEDLKACDMNGSSDPYVVLTDEYQKRIAKTRIIYNNLNPRWDDAVDITTQGPLNIIATIWDWDAVGDHDYVGRTSIKLDPLHFSDFLPREYWLDLDTQGRLLLRVSMEGERDDIQFYFGKAFRTLKRTERDMTRKITEKVSHPSIADRQVRSSGH

SEQ ID NO: 41846 - protein, 107 aa, A.fumigatus
NGGYQNPPRVKRAFRDPYGDWWDKQERRNFGEPVHEENEILGVFSPEQYTHVTPRKGLFQIGAFIATFLTLCGVVSLYYPDKPSVPQTYPGGLEKELGGARAVPVRL

SEQ ID NO: 41847 - protein, 664 aa, A.fumigatus
IVRRGREKENLPMSTSSTQSRGINRRINSLQNEVRHSRNLSASRRRPVNSSAAYSYALRVAYLTYLLNPRSRRIQNVSAAPQPRPKRASTSFHDLMSDFSLVRDSKSTRFPSGFVSELEKRLTGVLMGKERRKEYQDHLVVRTFAAFLNTLKDQSFKKRMEKDRRAEDLVLIFYSNATKELSKGKDSDDDSWKFMVDRHVALFVRLFALILKDHDWDKDRPELANRLSVLENKLLSQDHDLMQASGPTATVETTTSLTYDVRDMPLVQHVAKIFGISIHQVQSDIDKNRGVWTGKAALQDLKTYQAHLNLQTRKTLSREDFDNEEAYEHWKKSEGPDLSQMMLAIVQSNPELAKSTPGGALPQFNVNAADQSNDPSAAPLSRTMSDRPVSYVIDQPIDLSSLSLSDDPNNNSEESDTYTFIPSDPRSMYKFILGLTLSHDLKDREIEATAATSETTSMKLLSKQSTELLNELCLRWRIPNFSRVVLFLDIIRTKFVDNEIDLDTLDSAFTFVKETPPSDGKKRQSYMASVVFDRSKWTIQDLLLIQELLSSLHEALLRELYDVMMDCFEAKPRPIGPVMYVLENHIQLDPNYTEDLEDIDRFRSYVQDGLAQKATEKYQELLGQIVPVQAETWEPHHVIQLGDAIMKLAQKIRKRYRNNPEIMG

SEQ ID NO: 41848 - protein, 185 aa, A.fumigatus
RWDSVTFPFHVESLLEDFVWRWIRLTDQKVMDWVEQAVRQDPFTVRAGDWTDVVPEDHRHSVSVIDIFRSFNQVVEQMVQLGWDDDLQYAKFMTALSKSIGKGVARYCELLEQMFSREMDRLSPDQEAAMNQTTQEKIMQMAKEAWTSKEKIEPFQFFPEVSLRFQSSAPPGPEYLTKGYSLSSN

SEQ ID NO: 41849 - protein, 92 aa, A.fumigatus
RVDLGPSAGITMATSLLSLALDHPLDPTIAMTGELTVTGKVLRIGGLREKTVAARRAGAKKIIFPADNMSDWLELPEVSRIQNTSSLVHSSS

SEQ ID NO: 41850 - protein, 757 aa, A.fumigatus
IIGCSTSEFDYYRPFSQCRPQFLWTWGIQLAGCSSRSLHDSGATESICMAISIADSSYSPTRHLGFLLDPEKVNPRPKQSMWHRLGLRRLLGRDDRDLSSRSPSGDSSPPANPAPTANNSGNAHHSSKLHDNLTRRLSRRVGVGLPRSTTFKRQDSERRDRLAPVEPEPRRAVSADRRRPLSAQRTRSPQPTVDPRLSAPEVPWHDHAEEPMVEEVEPPATTNDDNEVMSDWNPCPDVADVPEQPPEDLIEMELEKRWILNLSMHFRDRSEREKFFVTYAEAPNRWRRVTISCDYRGAPPDSLEQDLKELRYQRDKCARIYESIRESLPEIQFYDTVTNLKLETRDGRLHVHVTEDVNEIIPYPPTSCIGHLPEARLVPEYQLHFEAHLSGFVYNVRLDGKNYIKKEIPGPDTVDEFLYEINALHALNGSPNVIQVEGIVVNDSRDVVKGLLISYAEQGALVDILYEQRGTISWERRARWARQIIQGLGEIHESGYVQGDFTLSNIVVDADDNAKIIDINRRGCPVGWEPPEIAAKIESNQRISMYIGVKTDLYQLGMTLWALATEEDEPERQPRPLLLGQEVDVPDWYRRIVSICLSPSPRQRLSAKELLVFFPQELSTTTTTTTTTPQFHSTHLPHGGLGVGLYNSPLPLYNARAITTAATFAGPNNRPVYQPGHFHGRSVSLDETGSRLYANSVDSFPAYPEDCYSVSLDDEKVPTTNEHSNSMREYAADNQTCEVIFDPRNSETNGQRPQFFF

SEQ ID NO: 41851 - protein, 587 aa, A.fumigatus
RLPKALVVLKKELMNAQLQSKISKDVEAKIQKRQREYWLMEQMKGIKRELGIESDGKDKLVEKFKEKASKLAMPDAVKKVFDEEINKLAHLEPAASEFNVTRNYLDWLTQIPWGQKSVENFGIKHAMTVLDEDHYGLKDVKDRILEFIAVGKLRGTVEGKILCLVGPPGVGKTSIGKSIARALNRQYYRFSVGGLTDVAEIKGHRRTYVGALPGRIIQALKKCQTENPLILIDEVDKIGRGHQGDPSSALLELLDPEQNSSFLDHYMDVPVDLSKVLFVCTANVTDTIPRPLLDRMELIELSGYVADEKMAIAERYLAPAARELTGLKDVDVNLQKDAIEELIKSYARESGVRNLKKQIEKVYRKAAFKIVQDLGEEVLGEDKALTDEGKAAQEESKKETEEGDPKDPPADPEKSTTETPRLALKVPESVHLSIGKDSLTDYLGPPVFTADRLYDTFPPGVTMGLAWTSMGGAALYVESILENALTPESRPGIDITGNLQPVMKESTQIAYSFAKSVLAKQFPENKFFEKAKLHMHCPEGAVPKDGKLKKFLSILLFLHGGLTSGFRSICRHHYGHFSPFAGPGPPS

SEQ ID NO: 41852 - protein, 257 aa, A.fumigatus
VTKNFSRSDRSRKCILRFSIHRFSNSISIRSSGGCSGTSATSGHGFQSDITSLSSFVVAGGSTSSTMGSSAWSCHGTSGADNLGSTVGCGDLVRWALNGRRRSAETARRGSGSTGARRSLRSESCLLNVVERGRPTPTLRESLRVRLSWSLEEWWALPLLFAVGAGFAGGEESPEGDREDKSRSSRPSSLRRPSRCHMLCLGRGLTFSGSSRNPRCLVGLYELSAMEMAIQIDSVAPLSCKERLEHPANWIPHVHKN

SEQ ID NO: 41853 - protein, 156 aa, A.fumigatus
NLLNDLFQSSSSRGPFFGFPASCFCQSLLAASLSSSAKRMLNTSEYQLTAWPSIPSLMFCIHCQLEEWTKDDVFWILLTSGSSNQSDILSAGKIIFFAPARRAATVFSRKPPIRRTLPVTVSSPVIAIVGSRGWSRASERREVAIVMPADGPKSTR

SEQ ID NO: 41854 - protein, 186 aa, A.fumigatus
WIALMTSSDFIHLINQNQRILGLALLEGLNDTTGKCTHIGPTMSLDLSNICEATNGEPVILPVQSSGDRLADTGLSDTWGSYKAENLAFHGSPKLSNRNELKDTILNILQAVVIFVQDSHGMLNTEVLHALLTPRNLSQPVKVIPSNVEFRRGWLKVGQLVDFLVEHLFDSIWHGQLRCLLFELLH

SEQ ID NO: 41855 - protein, 130 aa, A.fumigatus
ARRILPSLALTLVVLGLSYAFAANYEAPARADRMWPDMPPAAATAFAIMGANLTIFLLWKFPPAWRMLNRYFISVPFKPHALSIVGNVFSHQQFKHMSLNMLMLWFIGTKRECWSNLSQGLLMLTVPSPR

SEQ ID NO: 41856 - protein, 76 aa, A.fumigatus
VAPGPNSPSFPPSVDSPAPYDPDAPKYFFQEKYAPLNVKGNFLTLCACPKNVELGEWLAHQSKRFMYIAVWSDPRC

SEQ ID NO: 41857 - protein, 205 aa, A.fumigatus
KHLSNYVCGSVSDLSIPRTRPNFIPPLTEFPNSLTYTWLVDGRAAKISAPKFINRVEKWIVSKIHDPVMFPTEKVTGTPDTFALHEATNANPGSADANSTGEEWIGKSSGFPQTFYKDCQGIMKQMFRCYAHLYHAHWLNPFWHINKHDILNMCFVHFVTVAKYYKLVSDKEMEPMQPLIDLFIKQQRIPQEALAGGHWGQPSSS

SEQ ID NO: 41858 - protein, 91 aa, A.fumigatus
LADYAHNREKFTIFFLPREWQEVISAKGWVLLTGFVAFEIFNLVSPFRVMKLDHFAHLGGYLIGAVWALAWKGEQKKRRQNRTWFERLMSE

SEQ ID NO: 41859 - protein, 534 aa, A.fumigatus
EDSDRDIHLINGTSATRRALAKMMALEVKDETYDESEIFLSFAPWVPLSATEDTHVVEPEALTSSVKHPWGIIDYHLYLNSLEAGKDMHIRRENLYLFDDTDCEPIRYCDLFVAEIYRMEEDSQRARLLFAILPIAEKGAVFGERNYVLGYDWKYRSLFARHFNWMPHDIRDIWSVWSEGTTVYTISISRLFNLLQSTFQKRTGRAGEGILSSNPLCASLQVGDDPGMEMVIVTMFAQFAADFIDVIFIQEEYQKQKFRHQLAYYEDQCRQVLQRASYRAWFALRPGSARAKYRTEKNDENDSFRQLLQDLYALEDEERQEQEQSHGFVMQGGEWRAADLETKTWQREEDRQRRREEAVRRLEGLFAIPDDLPCTQSPGQAFENIMIKAGEHPTIDENYPPDAPRTPSPPFRHRSVLQQIQCLSPGSPGIVRPATEEFDDFEVTEYHKIPLPLLLGRALELLEEWPDLDSLDNRGRFGSLLTDLGVRVRKRPVDELTLAPSLGYDNDSWKLEVQTHPEVEDQPPRCLLPSPLFD

SEQ ID NO: 41860 - protein, 173 aa, A.fumigatus
KKTKTLGICYYSSSRRFVPQLAEMSEEAQPIALEAFAEAIRELPLSAVYAKVSEIRNSIAHLRRSNSELKAFIDETCESESDKRELEGYIAENEGVIATMNDRIGLLKTEIESRGERWIEEEIEANIKVDGDEVSTSQPIINGTAGDERPRAHEDATRRPEDRQTNEEEGVYL

SEQ ID NO: 41861 - protein, 145 aa, A.fumigatus
DQFNEWPIHTITLDQIQKQLPAKDIDMASAAVQLPTTHGSQTQRAPLLPTSNTPHHVQTTLNFLKENEDGSPPAPSYVGKPETYDRPSVTLPVTIHDVSGHELEYTLDKNGFQFYYHESKEKDFLDDEKIKAEYYPEVEQLLKDA

SEQ ID NO: 41862 - protein, 142 aa, A.fumigatus
EHPPSGTILTEQPAPAHPKSSSSTIQSAANQETNAVLPPNSAVPSSASTSTSPTPPAKTASRTTSPTKPPNSSRAGTRSSTSGGRSGLFSRTRWPSQTRTPSRTMTSSRPNSSTRTGWARRTRCDRIPASSGTSGMRSRRSW

SEQ ID NO: 41863 - protein, 198 aa, A.fumigatus
ALMTAITLGHGCFLKTGIWIQNVLGWMKIVMFAAMTLTGLWVIFFRREEPCMSMSNEAGRTGYDVFLWDNLWKGSNWSWSLLSTSLFKVFYSYAGLNNVNNVLNEVQDPIRTVKSVCPSALVTACGLYLLANISYFLVVPIDEIKNSGELVGALLFERVFGPHVGRTLFPLAIAISAAGNVMVVTFAWVSCFDDLEIQ

SEQ ID NO: 41864 - protein, 461 aa, A.fumigatus
PVVSKETVKWYRSTFYNALILGLCNFLAPGIWGAMNSLGAGGAEKPYLVNAANALTFCLMVVTCFFGSAVVRLVGIKWTLVIGTMGYAPYAAGLYTNNRFGTEWFVLLGAALCGLSAGLFWMAEGAIALSYPEPHNQGRFLGFWLSFRVGGQILGGAINLGINANRSTAGSVSYTVYLVFIALQALGPFAALLLNKPSRVQRTDGLPVRLGISHSPLYELKAMAKLFIRRDFLLIVPLVVQAVFTEAVMFTFLSLWFSVRARALGSFLSGIIALIVGNLLGAFLDSRKLSLRSRSRGAFFVVLGLQGAWWVWATVIVTEYHRTLPSYDWADAGFGRGFALYLFWVAGFQLNYMYLYVSCLGLGLWVCAHKLGSLSSAIWRRVKKRLSGWPVSYVGQSRPRRLYRYATSPDGTMLLLTPVVWPGQCQDHELCGQHLPELRFVGHRSATCVACDQGDWSVSGG

SEQ ID NO: 41865 - protein, 201 aa, A.fumigatus
AIRGTGVHERDRMKSHTAAKVHKMDDSENQSLLHPTSGLYETLSYESIHDIRTNGRPVSSRSPIPETAPYGRNLTWTSAYILVISRVIGSGIFATPGSIVKSVGSVGLALLVWLVGTVLAACGLAVSMEFGCMLPRSGGDKVYLEYTYPRPRFLASTLIAGQGGSIGLYGEQLHYILQGPHGFALSFGANGVAAKGYGGRP

SEQ ID NO: 41866 - protein, 134 aa, A.fumigatus
ARVNQEIARQGFLPFASVLSSSRPFNSPLGGLIVHYIPSLLVIVLPPPGDVYNFILDVEGYPGQIFALAIAVGLLVLRRRQPDITRPFKAWLPAVWLRIIVCVALLVAPFIPPPDRKGDVGFFYATYAVVGVGM

SEQ ID NO: 41867 - protein, 212 aa, A.fumigatus
EDQSRVLPRGRAVAQRCVSVRASSLRNDTDRTASTGASKIFIFDHTIRRQPRDERSVAAQLRGPVQRVHIDQSYAASKDRVSYHLPDEAPELLQGRYQIINVWRPIRTILKDPLAVADAHSVPDDDLVPTKLIYPNRVGETYSVRPNPGFKWYFRYAQPPELVTLIKCFDSKTDGRARRVPHSAFVDPATEGEAPRESIEVRALVFHPEDRE

SEQ ID NO: 41868 - protein, 69 aa, A.fumigatus
NTLKRDVESKLQLQFDPFHKLSHRKTSYPVLPASFDMDMQGSSRRKNITQSPVSVIAANMTIFIHPSTF

SEQ ID NO: 41869 - protein, 299 aa, A.fumigatus
GFRFSQNQGVRLSPPPWPVLALIDFCPTGDPAVAKLIHFHGFSDHINNTYDLFPSLARRGIFCTGIDQRGWGRSAQTKADRGNTGPTAAILADMAAFIEAQFEVPPDVPVFVMGHSMGGGLVATLASTPKYQELVSRLGGILLEAPFIGLDPKQKPSIITVFLGRLAGRLLPRFQIVQPIKVETVVRDPVVQKTLKEDPLNHATGTLEMFAHMLGRAADLTSGKLVLNDGVKSVYVAHGTADQVTSYDASKHWFDAQTGKVADRQFKSYEGWSHLLHADLPENRQVFADDVAEWILARV

SEQ ID NO: 41870 - protein, 204 aa, A.fumigatus
NRRSSKSPPAVCRLILDGIYLSLFPLEGFGSSNNSITFKMDWIILLYGLYVAAFGVTVVDGIGETAGDTTTLSQWRLQSSLAVSNVSAWSLPGNDDSSWYQVGARATVMAGLLENGVYDDTTLFYSNNMETKIGDAAKFDAPWLYRHELLIKNKIRQGEHYLLHTHGITSKGGYIRQRGAGCTELGSAGIVRRSHVRHHKIPAC

SEQ ID NO: 41871 - protein, 328 aa, A.fumigatus
GHLVIANNYRNTDLFWALRGGGGGTFGVVVAVTLRTFDEVPVVFGNLNVSTVAGDPNFWQVMTDFHAALPAINGHAGGYYWMTPNMPVDKTLNVSSLSIILMAANQSSTAMMDRLFAPFRSKLNETSGVFTEYESLAFPDIHTLLSDLLLPGREDQTGHNTILGSRLFSHDLLVSSDGPKKLVSALQKIKFDPGQGITGHIVAGGLVTKNGRSIDSALNPAWRKAATHIDFGRAWPPSATLAQRDAIIRRLTDVEMPILKAVEGKKMGSYMNEANAYEPDFQTEFWGSNYPRLYRIKQKWDPSGLFIARKGVGSEDWDDAGLCRVHRK

SEQ ID NO: 41872 - protein, 61 aa, A.fumigatus
DRISARSDNDLVQRGIPTWIAQIPARFCSILNMIRLFIAAVYLRTIYMPTMTCEPLCPRGG

SEQ ID NO: 41873 - protein, 69 aa, A.fumigatus
SSMEIRHHLPEIGIPGHGADIEIAKDNWNLVKGAQGHCHNNTKGAPSSAAKSPEEVGVPIVVRNNQVAL

SEQ ID NO: 41874 - protein, 146 aa, A.fumigatus
  UNSURE (60),(61),(62): Identity of amino acid sequences at the above locations are unknown.
QEGETQKERTERKKRAGNKERMKEQGKEEQEESRREPKVERGKKEEGSKSKDQEGGGRKXXXTSHPSHLSRHSHPAMTINPISSARSYNSGCSCLPSSRTVFSPMSSIYWKIFRTRLASNRRNKSGEYPPPRTRNGEPFTVNAVSL

SEQ ID NO: 41875 - protein, 289 aa, A.fumigatus
LYAITAISQNKNLGKSPLKLDDWGLAESGPRIYIYDSSCSEPRMKLSITHPEIDSRILQIAMASSYPTLKENIRKAYDNVAVKYAEWTKSSYPTRVQYLQKLLACLPPAPVEKSVLELGCGSGQPCTAILASDPAMKVTANDISPVQLSLAKEHLPSANVALIEGDMMELSFGDHSFDAVIAMYSILHLPKEEQVTLLKRIFKWLKPGALFLGSFAAGLKEEDLFDKHWLDGTDGEMFWSGWGEERTCEIVSLIGFELILREVVAEIEEEKGEGREIPFLWVLGKKPDN

SEQ ID NO: 41876 - protein, 147 aa, A.fumigatus
PSQWAIFDLGDHPVPTFYKGRICISGDAAHATSPHHGAGAGFCIEDTAVLATLLEDERVQSHKDLEAALAAYDTSRRERSQWLVQSSRFIGNSYEWLAEGVGDDFKKIEEAINHRNGIIANADIPKMCQEAREQLGKRLSRSRRGFL

SEQ ID NO: 41877 - protein, 90 aa, A.fumigatus
VSKVKADTIRVHQKLAHVSGLMDYVSISIRLSYSAAMCSYNLGVLVCRRSVDTREEALSAIPVSNDGLSPVYMQTPTGTKHGERLWTTGD

SEQ ID NO: 41878 - protein, 240 aa, A.fumigatus
ETEMTPKKNFHVSVIGGGIAGVTLAIALYHRQIPVTIYEQAPAFGEVGAGVSFSPNAVEAMKVCHQGIYEAFEKVCTRNLWPSKQKVWFDYLDGYNKGTSTTAKNSSRQEIAFTISNSLGQTGVHRAHFLDELIKLVPRDISRFNKRLEHITEREDGKLVMKFADGSEEVTDVVIGCDGIKSQVRRILVGDGHPSANPSYTHKYAYRGLVPMEKAIEAVGEELASNSCMHVRVSFSMLTG

SEQ ID NO: 41879 - protein, 71 aa, A.fumigatus
MGPGGHVLTFPVNQGKTLNIVAFHSSPDKWTDYPRLTRQDTREEALRDFAGYGPNVINLLKLTEEKLSVVC

SEQ ID NO: 41880 - protein, 407 aa, A.fumigatus
STQAILGVNSGITRLVCDSCPDTWDNEEERDRYLGVSSSVLDGWAPRLIRLQTLWYNMGKHLHVDNARSIARYCPRFKNLIVWEWMEFTISSARFVDDDSDSETDEEETSAGDFLMALRRNTLERFEISRDSHFKPSMVQGLVAHSQSMRVLKLPKFRSELVVELLKSNPLQSLEAVHFFLGYEKRAEIAQPFGQWLGACQNLRRIETWLYHDELLMLANALQHPIPSLEVLIVQQNYEDDPRIIDAFYRGVSRQRSLQELTLNTEMTSNKSVFMWCLFHLKKLRKLNLRRVSSQLTLPDIGTLTSNFPDLTWLGLCVTPVVDEIWDYIVAPKLRYLHLVGIGVLHAQPVLDFIHRLGEQNRGFTLKLKFSTFAELYTTVSDEDHRAIAYALFSHLDGRLLPYREML

SEQ ID NO: 41881 - protein, 64 aa, A.fumigatus
SIRPLTWANFWWTLIVSAFTFETYLPYAALLCTLDLCDLALLIHLDKDFAEYVAYARSCSSDHC

SEQ ID NO: 41882 - protein, 61 aa, A.fumigatus; identical to SEQ ID NO: 40738

SEQ ID NO: 41883 - protein, 81 aa, A.fumigatus
KPCRLDSYIILCAMKTINMNGQVIISGYIKRICHREDMTLKEQTQYVINMPHGIVNTQEGIKSADNQIKIVTRCPPGYFPT

SEQ ID NO: 41884 - protein, 232 aa, A.fumigatus
TVKLPSGSLAVFSPVSLTPQVREMISQMGQVKYIAALDLEHHIHLTPWKEAYPDAEIIAPESLWEKRQSNPEYKNTPFSHIFRKEDQHKGSRKISEEFDAEFESEYVYGHPSRELVFLHKRSRTLIEADLMFNLPAREQYSWTKEGATSGIFAKIINTVMSAEPPATWQKRFAWYILSSADRKAFTESMRRIDQWDFNRLIPCHGDTIESGAKGSFRTVMEWFLENNRRGST

SEQ ID NO: 41885 - protein, 86 aa, A.fumigatus
QGKPTVDVVISFAWFAAFGILVDAIHKLNCGSIWHWHFNTYSTNSCGRWKAAEAFSFLSAIVWLASALVVRIIKSATTDYDSDSTC

SEQ ID NO: 41886 - protein, 302 aa, A.fumigatus
TACSDTGADCRNEYMQAGNIGIRETIEKANEIFQNVKQTSDATIDSRLLVTAADLGYKKTAQFTLGDATAGIDVDEFVSKCISFMRRGPSDPDVAISNTQRRRPRPSGRSQADLDESDDETGDAMNWDWLGRAACLRHNSRPSVSGFLLGPLSVQKRSRLVTQRRARERIDPSEAVRPQDLQEKDLDRQETSNLTTMCANINKLLAETVTHGQNTVDRILSQMEEEPTEELIQEVMAKYHVADDGGVPLFHFCINPRSFGQSVENLFYVSFLVRDGTVGISADSRQLPTLRKFLAGLLLCGL

SEQ ID NO: 41887 - protein, 66 aa, A.fumigatus
PARPLDPAKPYAPSEAQRKGVQKHQAIFSLDFETWRQLIDVYDIKESIIKHRPEEPSESTGGGWYS

SEQ ID NO: 41888 - protein, 84 aa, A.fumigatus
FNHVQIIIMQHGITLEDIYNFNKTGFTMGLVATAKIVTRAEMLSQPFLIQPGNREWVTSIEYINSTSWVLPPCIIFKGKVHIKG

SEQ ID NO: 41889 - protein, 108 aa, A.fumigatus
FDQICTENDIILIYMPIYSLHLLQPLDIGCFSPLKHAYGRLIEDKMWLGFNHIDKFDFLKAYPQACTVIFSVDNIKSGFSATGLIPLNLDWVLSQLNIQLRTPTPPGS

SEQ ID NO: 41890 - protein, 75 aa, A.fumigatus; identical to SEQ ID NO: 40742

SEQ ID NO: 41891 - protein, 460 aa, A.fumigatus
LSSSSLLFAGPRSLFQNAQLNFSAYIIPQRASSVPLSPSSFCDLPLVSPPPAIPFRMASDDGPQEIAALLLLPPPPAVKFEQFKGAYEPTLSTVFSKLCKTLNGVNSIAILDIAISIPGLISRSSQPRAKIFPSLQRYLANIYRLIGIVSAEHSIELDAPGGIDARVIFIDFPTTSAEDRQAPRHGPILDLHSLANSARLWDWIYYPENKAGQQLATAFDSIYSKNKDPNAGSLHALSNQPDWPSPRTLIVPEVKAQSPHYSVAVGGTFDHFHIGHKLLLTATALALEPVEEFDPIPERYLTVGVTGDALLKNKKYAEFLESWDDRCQSTSSFLLAIMDFSRPNESAPRIERVSQPGPNGHYVLMKVRCGLTLKLVQITDPFGPTITDESIDALVVSAETRSGGAAVNDERAKKGWKSLDVFEIDVLHSGEVPTTDGESFASKISSTDIRRRRMEMATAQ

SEQ ID NO: 41892 - protein, 110 aa, A.fumigatus
FVFCSPGAGWASAALSWTKGDDGISRGPDSAGCFFCRIIGSIIILMSTSVFDFPSWTPFSPASSSGLPLNSQPLVLCLCQMFCRFALDNRMLFQSCDWCVPVGEPISSRP

SEQ ID NO: 41893 - protein, 184 aa, A.fumigatus
HAAASEIANGGAGTRTGTDASQNSHLTSDSSDTEHGTTSAFSTTSGSGAASAPSSRGIPLRINTNLFGRSHHHTDRDREDSISNASTATSVSSYDYSDSEFTGSESQSQPRRRRVRRDTDAQLRPHREIWTGDLSSVIGLQKRGLRGLMEGRRLMRERNAKPGSSGGLTSLPATAVDQSAASGV

SEQ ID NO: 41894 - protein, 75 aa, A.fumigatus
HVVIVKSDWLGRARGQMRHEGERWNGLYHTKPRAAAVTMPATATVRVVGGLCSSDIIDVVQVYTFQLLHLFAEAG

SEQ ID NO: 41895 - protein, 133 aa, A.fumigatus
MRPPVKSLTVAPAPEQAPTPRRTAISPPTPPTPNTAPLPPSLPLAAAALPARPPPAASRYASTPTSSVAAITTLTATARTLSATPAPPPPCRATTTQTPNSPVASRSRSPVDAVSAATRTPSSGPTERSGRAI

SEQ ID NO: 41896 - protein, 79 aa, A.fumigatus
WQRCSPRSTPTREREPSSSSVYEHSAFCAPNAYPTVYPAATAGIATATTTAATDDPSFGHGQFARPFQIQSFEPRATQI

SEQ ID NO: 41897 - protein, 210 aa, A.fumigatus
IQIIDTHLTQPDPDTPDLAPGDMKIEYVKTAEATHSYPVTRILWEPPSSQKQSTDLLATSGDHLRLWSLPTTQPLHSSNSITRPANQRDPPAAKLSPLALLSNSKSPEHTAPITSLDWNTISPSLIITSSIDTTCTIWDIPTLTAKTQLIAHDKEVYDVRFCANSVDVFVSCGADGSVRMFDLRSLEHSTIIYEPTEKNDKCISPTFSCF

SEQ ID NO: 41898 - protein, 190 aa, A.fumigatus
VLLTRASLVMSPGNGSPFSSVQFYLAPATFTYRKCVLLIACMARTYLNAVAALPHDAHLLATFSQDSNIVRVLDVRQPGQAILELKGHSAPINCVDWSPNRRGVLASGADDCFVLLWDLINQHNAAPVAPVVHNPGTPSTTSERGPAAAWQCDYEVSNLSWSPQGGTTSSGHPRDWLGVCGGRGVWGVAL

SEQ ID NO: 41899 - protein, 60 aa, A.fumigatus
ESVVAEACGELHYEMETDETIFLLLDNFYLFPFGSFPPPPPYFLIILESWFALLIILSDG

SEQ ID NO: 41900 - protein, 2467 aa, A.fumigatus
  UNSURE (2458): Identity of amino acid sequences at the above locations are unknown.
NFDKSQRISLKSMLRFAKWFKTTFQSSSNTSLSIRDLLAWVDFVNKCQTTDLKFSIVQGAAMVFVDTLGANPAAMLAVSLYDLEKNRQLCLDKLRELFDVDACGIYFQKSTIKLEDRALRVGPFALPISGDAAPDPQFIMDAPTTIANSVRIARGLQLPKPILLEGSPGVGKTTLVTALARALGKPLTRINLSEQTDLTDLFGSDVPVEGGDVGQFTWRDAPFLQAMQRGDWVLLDEMNLASQSVLEGLNSCLDHRQTVYVAELDQTFSRHPDFVLFAAQNPHHQGGGRKGLPASFVNRFTVVYADSFTQTDLKKICAKLFPGSPPPQTDGLVDFVSLLNETINQERRLGAVGGPWEVNLRDIQRWLQLADRGDLQVPANNFLDVVISQRFRSEEDRQLVSQLYQRVFTDAPTVAKSLYHNLTQEYFQVGFGVMRRDALLQHIPEPQMKIFPGDLPILESLMLCIEQSWPSILVGPSGCGKTTLIRKLAALNGADLVELALSADTDTMDLIGGFEQIDYKREVLSLVRELSLYLRRHLISASSAIEKTDAFSAFLELFERLQSSDISLDFVCSSLPVLMQLHPQKALEDFLQRAQHLMELSTQSNKMKVGFEWTEGVLTQAVQQGHWVVLDNANLCNPSVLDRLNSLTEPNGALILNEQRTEDGSAKIIRPHPSFRLFLTMDPRHGELSRAMRNRCVEICFLASEIPEPANRSIPAYTCQSSLYRLRHIWDFNQLEDRGELPRLLCELGIDHLSVEDLKIIQQSSEMALAGLLDFSAGESLPSMLDRYVPVVLEDCSWEPSTFCKAQAVKLSGASFAVHGQFQPLHPLVNEPLALILGQHVTLSRLMVLAHLQECKLNLHRLRQSLLRADESAKLLKPSQMSSLERSLASRRIASLMKDATQPIGSFLADCGQAVYDFIQGLDRQVLDTPEAVHALRAVVSFCADLLRISGDGQVDEGEFQVYLQIGKELFDFLLDSWPPLKSVALALSQCLGRFQENWALKTGLSMQKLWESWRPATPATQEQLRSKLDLEKVAAEFTDIALKTHLDLAQLSRVRDSLVDAQRTILLDGADEGRLVEALKQTVMELAKVVQASDSAQSPYFMSEFEALCQYHDLSSIQHTESKSDSVVSSILPLLAGRQARPLDASSLQSQIPRVLHKLSLFAGANQPSMSGFAVNGIFSLSLLEKLTFVGTTTLDQMDSLEEEKRTLSKAITLTSREISKDQFQLLRQVLSALAAELLNMHKDFIEPKSLETVLATLREIQEQGWCNSSDLPAVVLDQSLSEDHYFGPIAKYAIPQLMASLMTGPKDTEKYNEETGLALVQMASLLLQLFVPDKPFDPSLGLTVQRRRHTQRVIELTTKSEALAVFEQNFSGRSSNMRQEFIQQELRSLGSAPPPSQVTRPPVSEISILQGEFSSLLSSVLDRCIELDVTAVKRNDLEAERTLTFLRENIRQLIQRLSTNYRSYDDITVLVVRFLEILDLGLSLQSGQTQRSSDSRILQAVSKRTPFLGGTVYPVSALESQKGPANQAHFVELRFHELSSLRVAINTDPDVLHSEAGRHALHRILEQFHILWKAKLREDQEEEARKSELYRYRGSWEDEEEVDQNELNQLFPTYESDTAEDDGKATRIDPKAISVRLATLHAELFQSEDAKKALSDYVRQSAKLLGSIWSAGDSSKSHIRPSEHLSGALLLLEDAMNAGNRSPSGKYNFYTDSNFSEARRLVSLAHSVKSRFLQIQQAWPEHAVLQDVIICCKEVLQFKHTEPVAKFLTKVEKLHALVHEWQLVASKEYSAASLYNELTNLIISWRRLELSTWAKLLDLEKEKCAQDVSSWWFVAYEAVIAAPIQLAASGEAELSAHIQSVISTLEQFFMSTTVGQYSERLRLVANFRSLLALYVRDYPALEQLVFALGNFLEHFRPFEPAVHKSMEDRRAAIEKDIKQQIQLASWKDTNIIALKESARRSHFRLFKLVRKYREVLAQPVQPIIQQGMTNEPIEPNMVTDEVVLASASFPDALALCQEEPTIWPSRPPRFRNADSTAGNMTDLYSSMPNEFDISEDLDSFVKFFIESITEFKSQTPKVLTEDNKDDVQHLKVQKRRFYADTLKRLLEMGIKRNASTNLIESQSSIAQVLATTPSLKVGNSASHLIKGSDLYFHRFLDLLPRVRQSSREYSEDLSNVEISRSVGTVEHLMFLLRKQRGVISPALSHLEMMKSTIMKMSNLWTSGSASLCKSHSDVSKDRQDLRRAVAWLIPILGLAAEIVQLHAKFSEVDASKVSDGLHAWSSTFSRLKSSLDNIPELPSGLTSQRHNNILEEVSSSLASLVADVSKWTAERPDLSFALAQIIPWAEAKGNATVRADSQDSLAIQEFDARLLAAMDKILVSLQKLKDVPASLTSTGSLSRSDEFFTRAMKAVRLSDVTFSLESVLGTLQHLQADSHNTYVIASALVASFLRLTYRIXNAVEVMSPP

SEQ ID NO: 41901 - protein, 68 aa, A.fumigatus
AFGNSRRIRKDALIELRNQLPIFFTPESLGNDNIKEVVCWHLKIAAIRKLEPSLDITQIDLPRSANSP

SEQ ID NO: 41902 - protein, 744 aa, A.fumigatus
YSALPTDQSQANRIGGGNHFRRRMAPNPAVPATLPLHHVTSQIQQLLDPSFSNARSGGVLLPDYIRGLPSRLQREDIEYLSMKGALTVPDVGLRNELLKAYIHYVHTYMPLLDLEEFLQTIVQNDGIHRMSLLLFQAVMFAGTAFIDLKHLHAAGYPSRKAARKVFFQRARLLYDFDYEVDRISLVQSLLLMTYWYETPDDQKDTWHWMGVSLSLAHTIGLHRDPGNSRMDARRQRMWKRIWWSTYTRDRLIALGMRRPMRVKDDDCDVPMLTLDDFEFHPFSPEIVRMVGNSEILQNVEHQKKLALMFIEKAKLCLCVSHVLSAQYSVLSHKFGGTMETTMMLVPKKSAAETFEVRRCDQELEDWLANLPAEIQYTPAASAKLTEAQEVLHSHRALLKMVYLTTSSALHRPQVLPANPFPSMDAELQEISRNKVRFAAVEITNIAQDLHSLDLTRYFPTTGVTVLLPAVIIHLLDIKSSDPSVRMTSLQRFYQCMRILQRLREIYASADFATSFLEAAIRKAGIQLTVAPQDVQARPGSSFDAGARVDTLTPPPDSLAQKIPDLTYPKPAVVGTARQPVEEGDTLFASTPPPSDGSENGSTANINPNYHRDAFSIPNLDSELSISELMDLANDAEVTQNDFDALINFDDAGADFFTADDHLNLNGSGPNSKGFGFSMDPINGMSDLMGLDAGNKPDIASLGDRQLHSDHMATTTGHSNTGTAASESNGLTANVDADLGICLSG

SEQ ID NO: 41903 - protein, 67 aa, A.fumigatus
DSLCRLGEKRYEHQWLSSDISTERLRVKYLCVTDVIDLTRGVNAQEWRQYSGLCTQYSYTEQVIRKV

SEQ ID NO: 41904 - protein, 116 aa, A.fumigatus
YPIISGRTLHRFACFLLFAMTDLAVSSTPASANTMESESQSKRKASAAGLSANSRPVKRRASKACCCCRARKVRCDVVENGSPCTNCRLDQVECVVTESKRRKFVLHMSTRCSICG

SEQ ID NO: 41905 - protein, 63 aa, A.fumigatus
EVFRAPFQSSRKRRSETHSPKFENPTATSWIAFKLANKAFQSCTDTAIWRSLKHDENYEAVYY

SEQ ID NO: 41906 - protein, 217 aa, A.fumigatus
LSILLSTNMAHLEERPSSLDGSAWTWIFDHCLRYPETYEIPLRTMYALNCNPTRQPSSGTRTPETAFSNRSSSSSKTSVSSQDFILDPAADFRAQLTHHIARMPSQPCSLPPSFVTSFLRRCFAPQLDEVDFPQALTALDYLKDLENRRRREVAAALQRLNIHPDDLKEKTELAKKYPGVLTWIESINVQGRKVEALYTQIYLGLRRWVSWFPSFPG

SEQ ID NO: 41907 - protein, 66 aa, A.fumigatus
KFHCATARFTGRLLWATLLTSLRSVRGIASEYFKPGFEMISIASGARDLPKMPRAILLAGCKKKEV

SEQ ID NO: 41908 - protein, 1703 aa, A.fumigatus
LICAPTGAGKTDAAMLTILNTIGKNTVPNRIEQPDAIEFAVQVDDFKIVYVAPMKALAAEVTEKLGKRLAWPGIRVRELTGDMQPTKREIVETQIIVTTPEKWDVVTRKSTGDTELVQKVRLLIIDEVHMLHDERGAVIESLVARTQRQVESTQSLIRIVGLSATLPNYVDVAEFLKVNKMAGLFFFDASFRPVPLEQHFIGVKGKPGSKQSRENLDIVAFEKVREMLERGHQVMVFVHSRKDTVLTARMLRQMAVENGCEDLFSCHEHENYSNALRDMKHARARELRDLFASGFGTHHAGMTRSDRNLMERMFSEGLIKVLCCTATLAWGVNLPAAAVVIKGTQLYNPQEGKFVDLGILDVLQIFGRAGRPQFQDTGIGFICTTHDKLHHYLSAVTAQQPIESRFSSRLVDNLNAEISLGTVTSVSEGVQWLGYSYLFVRMLREPRNYGIDFAEIRDDPMLVQRRRQLIIQAARVLQKSQMIIFNEKTEELRAKDVGRIASQYYVLQTSIEIFNEMMRPRAGEADVLRMISMSGEFDNIQARENESKELDRLRDEAIQTEVEGGNDSPHAKTNILLQSYISRAKLEDFALVSDMGYVAQNAARICRALFMIALNRRWGYQCQVLLSLCKSIEKQIWPFDHPFHQFDLPQPILKNLDEKLPTSSLESMREMDVAEIGQLVHNQRMGKTLSKLLDNFPTLSVEAEIAPLNRDVLRIRLSLYPEFSWNDRHHGASEAYWIWVENSETSEIYHHEYFILSRKKLHDEHELNFTIPLSDPLPSQIYVRAISDRWLGAETVTPVSFQHLIRPDTESVYTDLLNLQPLPISALNNPILEELYGQRFQFFNPMQTQIFHLLYHTSANVLLGSPTGSGKTVACELAMWWAFREKPGSKVVYIAPMKALVRERVMDWGKRLAAPMGLKLVELTGDNTPDTRTIRDADIIITTPEKWDGISRSWQTRDYVRKVSLVIIDEIHLLGGDRGPILEIIVSRMNYIASQSKGSVRLMGMSTACANATDLANWLGVKEGLFNFRHSVRPVPLEIYIDGFPEQRGFCPLMQSMNRPTFLAIKNHSPEKPVIVFVASRRQTRLTAKDLINYCGMEDNPRRFVRMSEEDLQLNLARVKDEALREALSFGIGLHHAGLVESDRQLAEELFANNKIQILVATSTLAWGVNLPAHLVVVKGTQYFDAKIEGYKDMDLTDVLQMLGRAGRPQFDSSGIARIFTQESKKAFYKHFLHTGFPVESTLHKVLDNHLGAEISAGTIATKQDALDYLTWTFFFRRLHKNPSYYGLEISAEEHNTMAAQAIAQDFMIDLVDKSLGELAESSCVVFDSATGEVDSTPFGKIMSYYYLSHKTVRYLRSHAIPNPTFHDVLSWLCSATEFDELPVRHNEDLINAELARNLPLSVESMGDLPLWDPHVKAFLLLQAYMSRIDLPISDYVGDQTSVLDQGIRIIQASIDIMAELGYVRACETLVSLLQSIKSARWPEDNALSILPGIEPTSKLQGLPGSLVALSSLPTASVSGLARKLQLPAEFTKAASYLPQVSVSVANVSSTGITVFLSRRNPPTNAEHRVYAPRFPKPQTEGYFLIVCSASADGKDGELLALKRVSWSANNKNQSSNSGSGSGSSQNPSGRSNYRNGALTVRSSVKFPQDFLAQYTTATGKGVNVKVISDTYPGMQWVVSNVEVELKPETQSVPESSNYPEKA

SEQ ID NO: 41909 - protein, 121 aa, A.fumigatus
QHGCTARRLWKDYFPEVSGIVFLVDAKDHERFPESKAELDALLAMEELAKVPFLILGNKIDHPDAVSEDELRHQLGLYQTTGKGKVPLEGIRPIEVFMCSVVMRQGEFSFLTFCAMSSTTF

SEQ ID NO: 41910 - protein, 766 aa, A.fumigatus
QVGIFTELVITSPTFLFYYLPPPHNLSSTILNIRPYHQLPPLDLNPVSKPSNLLEAMAYLRGGDRPFSIHKLLKMLLSPHQSNKPVQQESDMLEDVDEPPDHRFLNNSAMNVDDGVVYVKSPTTMSRGKESLLTRALKHSPELAPADHQDHPFYRSYHSGTVSGISTAELTSDGGLTSPSLSNTPSPPLSPQLNGRSGLDATESTVEANLGRKRCISFACGRKAEEMKPERPTAPESTANSTPAEPPKRKTVLTFVCPARDSCSTRERPPVRTAALRSRPRGSPAPVARKASPDKDVSCPVKAQQDEKPSASSSQRGVPVKGLGKFEESEATRFHEFASSVSEDDEWVNKVGEFTEKITMTDCMRKEIAIRKLGEEAEEEALEEEDEEEDEDDADSTIHDFSDDGNESDNEAGFADSDDESDDGSEYEFWAPTAITTATSPQALDSARQALERRGSNTSLDSVTDDPHKKWPPALAWKANGRSPFKPPPVKMRPGTPNLPDSTDFVCGTLDEDRPLEVAYKSCIEQRRLSKQVIIPQDIDPSFPTSDIDDQDDLEEDEMELSFRADELTRGRTGGDSVRQHSPRLSPRRMMSPPPRRYSRMSPRRLRSPPPPVKMGPTQSGDGVSDDQLPSRRPQGVNISELVQRPLMTRTKSLPRTPNPFFTSLDKAHRWSSIADVQESPERGSSCTREVHTRGPIDIVEGLEKKRQKRREKFWRQHCRKAAKEQMERRPIPGKGAERMKELGLEVAERFRAYGVGHDAQLVLSV

SEQ ID NO: 41911 - protein, 62 aa, A.fumigatus
IRLGRPVLFAHPHRCLGGHPSCIYREITFFKFVFASPIHIYPFLISLNYIFTFPHCCGRGPV

SEQ ID NO: 41912 - protein, 121 aa, A.fumigatus
VSSWSLFCPAKLRVLDISKFHPCVRFCYHTEPSRGTKLASYLHYWFDPLPVSAANEYSLSVVYDILASLGLLNKHAKLLFLGLDNAGKTTLLHMLKVSILEEPGSVGYGVSYMLTLLALDC

SEQ ID NO: 41913 - protein, 168 aa, A.fumigatus
ICGDIHGQYYDLLRLFEYGGFPPEANYLFLGDYVDRGKQSLETICLLLAYKIKYPENFFVLRGNHECASINRIYGFYDECKRRYNIKLWKTFTDCFNCLPIAAIIDEKIFTMHGGLSPDLNSMEQIRRVMRPTDVSFSPMHSLYHGLGPFSRGGPLWISFCLYYSTVE

SEQ ID NO: 41914 - protein, 103 aa, A.fumigatus
IGVPSAPETTISPRPSFLPFVVRRLCINSFLFLRFCLENQHVMADQEVDLDNIIDRLLEVRGSRPGKQVQLLEAEIRYLCTKAREIFISQPILLELEAPIKVR

SEQ ID NO: 41915 - protein, 147 aa, A.fumigatus
YRFLGLLPRLGDYASLHRIETDEFAFIRSVVTFTANTTISCVFSNTVASRLKPITSSSETTSTVASSRLRPSASSLRTRSNILKTSLFSVVTTNVPPSTVSMASMTSASGGTTLSSGRHSLIASTACPSLQSSTRRSSPCMAVSAPI

SEQ ID NO: 41916 - protein, 75 aa, A.fumigatus
LRESSLSTGGALYNHVVSLLAPTSQFGLHGGRQGLLTLLVTAQIERCKPVVADGKFLRCWNHQYQSPARIFRRQS

SEQ ID NO: 41917 - protein, 105 aa, A.fumigatus
IPDCGLLCDLLWSDPDKDITGWSENDRGVSFTFGPDVVSRFLQKHDMDLICRAHQVVEDGYEFFSKRQLVTLFSAPNYCGEFDNAGAMMSVDESLLCSFQVCCVL

SEQ ID NO: 41918 - protein, 140 aa, A.fumigatus
PLSLVAYVCCGKLTCTVAAYIILGLATIGSEIENPFGQDVNDLPLDTYCRQIAVELDIITAMPPPSVDDFTSRDENLVLFPLSSSGYPEWKDRSVEDIRAALRAKVIANHSSSGASDSSTILGDGSLRSQTDTSMAKASV

SEQ ID NO: 41919 - protein, 136 aa, A.fumigatus
PAQSPHTSSSASPRSAAKSRTPLARMSTISPWTHTADRSPSSSTSSPPCHPPVWTTSPPATKTWFSSLLAPPDTRSGRTAALRISAPRCGQRSSPTTHLQGLRTRPPSSGTEACGPRLIRAWPRHPSETWLQIPQK

SEQ ID NO: 41920 - protein, 60 aa, A.fumigatus
LASFQTNTLSATKDLIQPHYSQYTINARLVSDFKLRSTMSTRILPLPRTGGPFSSQRQSI

SEQ ID NO: 41921 - protein, 66 aa, A.fumigatus
GRLVTMDISTRMGLFQKAFHQSSGLSPGPGFYTGLEFYSNEERADPPTLEASKFLLKPAQGRPSTQ

SEQ ID NO: 41922 - protein, 74 aa, A.fumigatus
EQRVLWRIARASKQNILSVSTFFILHQPLQFHLFSFISLLAYTASSKFINLRIMLRVEVPSHHIYSLTYRKSSI

SEQ ID NO: 41923 - protein, 119 aa, A.fumigatus
SSTSPNWTRFLSNLSPHNGDLSRMRLTFIPSLIGVANAVCPYMTGELNRRDEISDGDAAAATEEFLSQYYLNDNDAFMTSDVGGPIEDQNSLSAGERGPTLLEDFIFRQKIQRFDHERV

SEQ ID NO: 41924 - protein, 83 aa, A.fumigatus
VPERAVHARGAGAHGVFTSYGDFSNITAASFLAKEGKQTPVFVRFSTVAGSRGSSDLARDVHGFATRFYTDEGNFGTLVNSHN

SEQ ID NO: 41925 - protein, 177 aa, A.fumigatus
SFHISAGQMFIPLNPHAYSPKTSVNGSPKQANQTVGDGFFTAPGRTTSGKLVRAVSSSFEDVWSQPRLFYNSLVPAEKQFVIDAIRFENANVKSPVVKNNVIIQLNRIDNDLARRVARAIGVAEPEPDPTFYHNNKTADVGTFGTKLKKLDGLKVGVLGSVQHPGSVEWSFPPSATV

SEQ ID NO: 41926 - protein, 143 aa, A.fumigatus
  UNSURE (142): Identity of amino acid sequences at the above locations are unknown.
LHRYWSLLGLPVSLERRYRAFLDVSMDCERRHKDVPRAAFSHLRLRCHHVFEHCSAQWFVLDADQYDRSGTFDYLGIAYLETNQFSKDEYANHIDAGGFTMPLISETLSYAQFLPKQVGLDQNETWTGNFLKWSFSLGKTGXT

SEQ ID NO: 41927 - protein, 262 aa, A.fumigatus
CTGLSDRVRRSPSVRSMPVVPAPMESSLHMATSRTSLRLLSWPRKASKPLYLSASRRSQEAEVVRIWPVMFTVLPLVSIPTRAISVRWSIRTTDIVLLSVIDIVGNNIPVFFIQDAILFPDLIHAVKPRGDNEIPQAATAHDSAWDFFSQQPSTMHTLLWAMSGHGIPRSFRHVDGFGVHTFRFVTDDGASKLVKFHWKSLQGKASMVWEEAQQTSGKNPDFMRQDLHDAIEAGRYPEWEVSRLPSSSRPPNLVDIKQPSRS

SEQ ID NO: 41928 - protein, 173 aa, A.fumigatus
SDCKQFQPGHIVRGVDFTEDPLLQGRLFSYLDTQLNRHGGPNFEQLPINQPRVPVHNNNRDGAGETFQTFKASASINLFIFLQAKCSFPSTLTRTRPRPPSTVPQNKPTRPSAMASSQLLDVPPVASLSVRSAQALRMSGLSHGSSTILWFLPRSSSLLTPSASKMQTLNLPW

SEQ ID NO: 41929 - protein, 619 aa, A.fumigatus
QNLATWVSLLACLPAAIGLPNNNDRVARSLKRHGGHGHKQVDTNSSHVYKTRFPGVTWDDDHWLLSTTTLDQGHYQSRGSIANGYLGINVASVGPFFELDVPVSGDVINGWPLYSRRQTFATIAGFFDYQPTTNGSNFPWLNQYGGESVISGIPHWSGLILDLGDGNYLDATVDNKTITDFRSTYDFKSGVLSWSYTWTPKCNKGSFNITYRLFAHKLHVNQAVVDMEITPSQGSEATVVNVIDGFSAVRTDFVESGQDNGALFSAVRPWGISNVTAYVYTNLTASAGVDLTSRALVNDKPYVHSNESSIAQAVDVKFRANETVRITKFVGAASSDAFPNPQQTAKQAVSAAMGAGYMGSLQSHVEEWASILLDGSVDSFVDPATGKLPDDDHILNSQIIAVANTYYLLQNTVGKNAIKAVSGAPVNVDSISVGGLTSDSYAGLVFWDADVWMQPGLVASHPEAAQRVTNYRTKLYPQALENINTAFTSSKNRTTFSPSAAIYPWTSGRFGNCTGTGPCWDYQYHLNGDIGLSLMYQWIASGDTKTFREQHFPIYDSVATMYSNIVQRNGSSWTLTNMTDPVRLTTWVLRTSKLINFLRMNMPTTLMPVASQCLLSPRP

SEQ ID NO: 41930 - protein, 68 aa, A.fumigatus
FNQLGVQIMDEEDQLRFGFDLLDPTKIVPEEFVPITKLGKMQLNRNPRNYFAETEQVMVWCHQEADTE

SEQ ID NO: 41931 - protein, 145 aa, A.fumigatus
VELPTLRDRLKDDGVHVVLVAERLADGVDQTYSTSDAIQFDAVVVAAGAESLFAASSFTGGSANSASGASSLYPTGRPLQILIDGFRFGKTVGALGSGTAALRNAGIATSRDGVYVAQSVTDDFANDLKEGLRTFKFLDRFPVDH

SEQ ID NO: 41932 - protein, 83 aa, A.fumigatus
SSTHLTGLEYAMCILLTFTSTQKVVEAAMLGNICNSIGLDTPNIPTSTITFICSDVDGFNLASLTTDNHSTLLHVHSPSSCWS

SEQ ID NO: 41933 - protein, 148 aa, A.fumigatus
RWKTTYFPLRIASSLDCIVQILTHEVRILARGLLGLFPDHAGLALQRLPVKFDELGCTVICHESEGMHTEPINMSERTRNAMPRHSPEQCVHRAWLLAEEVPGRVMSSGSLRDLVVTSGLDGVDQIGEEDSILDEEYRDIVSNDIYDT

SEQ ID NO: 41934 - protein, 130 aa, A.fumigatus
EEVCNWQCCMFCIHSPLHIEYLLTFEKKAGKTAAMEGQHLTKVDRSDDIVKPKTVGLQVADAIKKRRNEEGYKMTQKELATKCNTTITVIQDFERGTAAPDQKVLSAMERVLNIKLRGSDIGKEKFPKKK

SEQ ID NO: 41935 - protein, 153 aa, A.fumigatus
CRTGFFIMPTSVAHLANVSQELEFLADASVITRQQLSSILAHLPNEAPQQANTPVPPPQQQQPVVAQSQPPPASYAPPTSQFANTSLNEKAALQQQQYSTPSIPPPAYPQAAPVLSVATALYAYTPTDAGDLALQPHDRVQVLEHMNADCTLV

SEQ ID NO: 41936 - protein, 99 aa, A.fumigatus
RRCQEFKLTDIGWRGRNERTNLEGIFPRSYVNVIEEKGVSSPPPTNYGNLPLDVSQSGSAAPDEKRPGSKFEEHGKKFGKKMGNAGTSIVAPLISVCGH

SEQ ID NO: 41937 - protein, 144 aa, A.fumigatus
SQRGIVHDSPPNCVAQGSRSFCVISINSVALWTLSLSVITSRDHSLRHLLLYHFGHLSYSQHRPPSIPSYASSIRILKMSDWDSVTRIGAKHRAGAAPRETVVRGKSALNAAQRQGLVIATEKKYATGNAVCSAFTPLSILNTY

SEQ ID NO: 41938 - protein, 129 aa, A.fumigatus
ESPAQKARPPWRAGVIWASTSLLDTKTAVSANTMERWAYSAPGIWKTMLICAQTGEQLENVQAHEFDHQINDIQFSQDRTYFITASKDKSAKVRSDPFHPSICCQSLTIASSSPLVISPFSKHTLPILP

SEQ ID NO: 41939 - protein, 198 aa, A.fumigatus
YFISLQERSLNQIKFNRDGDLLFSVAKDKIVCAWWSANGERLGTYSGHQGAIWTVDVSPNTVLLATGSADNTVRLWNVKTGECVKVWDFPTAVKRVAFNPDGSRLLAVTEKRMGFLGTIAVLDINYGDSQGGGLENQADEPSLRITCTESKATVAGWSYLGKYIIAGHEDGSVSQYDGKVGLFCTWNLENYADLRADW

SEQ ID NO: 41940 - protein, 119 aa, A.fumigatus
LISSRNLAILKTYVADTPLNSATITPKKDYVILGGGQAAMDVTTTSARQGKFEARFYHKVFEDEIGRVRGHFGPLNTVDVHPNGTAYASGGEDGYVRVHHFDKPYFDFMYEVEREQLRK

SEQ ID NO: 41941 - protein, 69 aa, A.fumigatus
APIVRKILRDRLFINLYLYFRPNFLPIKKEHGELTFKSFTEILWIYRSIRHIYLGKSSVCHLWYFGATP

SEQ ID NO: 41942 - protein, 432 aa, A.fumigatus
DPVLCFLSYHIFTKLDIDFLVCISYSFHTRTRAEHLAATMFNDHDHVPPTSSQSDSGFFEQEMKKSPRLSLRERLRHFTWAWYTLTMSTGGLALLIASQPYTFNGMKGIGMVVYILNLLLFALVCSLMVLRFVLHGGFLDSLRHPREGLFFPTFWLSIATIITGLHRYFGSDDLESYLIALEVLFWVYCSCTLATAVIQYSFLFAAHSYGLQTMMPSWILPAFPIMLSGTIASVISESQPARSAMPIITAGVTFQGLGFSISFIMYAHYIGRLMQSGLPCREHRPAMFICVGPPSFTALALVGMAKGLPDEFKIIKDAHVEDARILELMAIIVGVFLWALSLWFFFIAFVAVVRCRPTAFHLSWWAMVFPNTGFTLATITLGRALGSPGVLGVGSAMSVGVVCMWVFVFVYHIRAVIRQDIMYPGKDEDVLD

SEQ ID NO: 41943 - protein, 68 aa, A.fumigatus
CLLGLKSPVGSARCIGTTPNFPLILAASSQYEHIPKAIFQLWAYTCNLKKLRVCQEPLRQLANTPHEQ

SEQ ID NO: 41944 - protein, 412 aa, A.fumigatus
PPLRPAYPRERASAILSQFERKRRAAAMAVPTDDNRVRARLRELGEPITLFGEGPVDRRDRLRELLTDLAERQEAAAAEGDVSMRGTTEETEAAEEEAEQQEEFYTEGSQELLNARKAIARYSLPRAKARVERLREESTIPLRTHIKHRKAIKEKLQGFDLYGSQIAGDRPVSICRFAPDGKTIAAGNWGGGIRLLTVPNLEEKSNLNGHTDRVGGLAWFPGATLPSSNVSESSVNLVSGGGEGNVALWSLDKDTPLATLSGHSGRVCRTEFHPSGRYIASASFDTTWRLWDVETTVELLLQEGHSREVYTVAFNNDGSLLASGGLDSIGRIWDLRTGRTVMILEGHVREIYGLDWGVNGYRVLSGSGDGWIKCWDLRQVRNIGGIGAHKSVVSDVRWYKGTEFGCILSAVH

SEQ ID NO: 41945 - protein, 110 aa, A.fumigatus
ESHRNNTRWRKWCSTSSESTARLRQKTYILSKDGSIISNAAASTAIAALHSSPGTDGGHTLAIPNRRLYFLPAKTKSLGCSACAAPLSDFAYPSTCLDLIYNSPRDEQSG

SEQ ID NO: 41946 - protein, 83 aa, A.fumigatus
GAFSIPWFIPGFEFEIEASRLEKSQDSDHDKFGNHFRRQSREAGQRREPDTVRSKRSQNADKLGNMPYLSFSGRCDKPLLSSL

SEQ ID NO: 41947 - protein, 146 aa, A.fumigatus
MDTVSCQVRGMAGSSVGTSAKYAILVGSAHIKVSCRMYGGTRALNSAASYLPSTESNGRMDVDSNPTLTTSEQSTPATPIQPKKSGTFFVSSGFDKNVNIFSADDWSLVKSLSGHAGNVLSTDISDDAQWIASCGHDRTVKLWGIE

SEQ ID NO: 41948 - protein, 272 aa, A.fumigatus
AKMAASFQMQRLAQRSLLSTVPLARTEATHSLFLTGACIFCQLRPRAWAAQPARRPCLTLPTRRLASTSSTTAPETSNQDSNLPDLTNHYTIFRETLPAGPPPASAFDIPLSDLRREFLRLQNVIHPDKFPPGPEKQRAEALSARINEAYRTLSDPLQRAHYLLREIHGIDVTAEDGSTQHALDPETLMEVMEVQERIEEVGAGPEAEGTIAALKKENDARVAACVKSLAQAFERGDIEAARQECVRLRFWYSVGEGLREWEPGRTEIRLIH

SEQ ID NO: 41949 - protein, 623 aa, A.fumigatus
VQHLLRSKLGGDHLSLFSTSCLCCVLALLSLIPHIQATSNSSLHANHDSVATDSSNHSPGYSIIHSPPFTFLVGPNHDKLTIQSGLARHVSQPLDHLMNSGLTRESKHHIAVLEEEDAETFVAFCEYAYTGDYSVPTPGSREDDRVESSNNPAFNQMFSNPNPFASAVPPPAPSPPPGAKFSDRNLDVPDSGDAKTAEATEESAQPLKEGEGEGVKDATDDVREDVAAPDDPPQDLASNCDEPSEQPLATSTAEEGSSWGLEENAMPSKGKKAKKSKKGKKKQQGGATAEEPMSNLTPPTTPPPGNVDDQIDNPLTVEATTMLDDPIPVIEPTKVDEVAEAVEVPEPTGADQSPDAAALSDTESWDRATSVPPNVKDTLNQKVELDPDSQKQDRVKEEVASPRSQMKAFIDTSFAKQLYLSRRPTGVGLWDEFVNLDYFDHPSTYGTRPLTPTATHSDTTKSDLPYLLFHAKLYVFAVRYLIPGLAQLCLRKLHADLLRLDFPGPKDDERKEERAAWTATKGRMVLDLLHFTYTKTTRLEPISPTSATQLRDNELRKLVVHYAACKVRELAEYCGPMESIVSSPFPSPVDKQPRRANRPSSRGFRALLDSTTELASDLVFRMM

SEQ ID NO: 41950 - protein, 129 aa, A.fumigatus
HILVFARVHDVLPDDSTNVVDENEDPHADNTDRHGRADAQDARAPQCPPQGNSGQREPSVGEDHGPPAKVERSGPAPDDSNKGNEEEPETQGPQEHADDNSHQLEDPGVLDVCVFDYLEFVGQALGHPY

SEQ ID NO: 41951 - protein, 106 aa, A.fumigatus
FFVWSLKVRFLSKRHRHNELPESVINGSGGSPSCLVPTLASLHPHCTRIATAHTPDAQPRYPPVQRLAPSSSHTPPPAHHSPFSAQQWFPQPPALHRPPQSSPEPP

SEQ ID NO: 41952 - protein, 224 aa, A.fumigatus
LRVSLTLGGTEVARSQLSVSDSAAASGDWSAPVGSGTSTASATSSTLVGSITGIGSSSIVVASTVSGLSIWSSTFPGGGVVGGVRLDIGSSAVAPPCCFFLPFFDFFAFLPFEGMAFSSRPQEDPSSAVEVARGCSLGSSQFDARSCGGSSGAATSSLTSSVASFTPSPSPSFSGCADSSVASAVFASPLSGTSRFLSENLAPGGGDGAGGGTAEAKGLGFENI

SEQ ID NO: 41953 - protein, 176 aa, A.fumigatus
PPRLLCVSRLVDEITFKLADEAADAPTATAILGPFFRADTPYRNNGDNIVKDVPDGEMVFMHGRVIDFQTKKPLVGATVEVWQASTNGLYEQQDPNQEEFNLRGKFKTDADGRYYFYCLRPTPYPVPNDGAYSDAPSPIALETLQTLILNDVQVPPGSYSSSWTDTPSALPISTSL

SEQ ID NO: 41954 - protein, 231 aa, A.fumigatus
STGVEIVTYAKQGMSKFYQVTLDTLLRQMEFNTSATSLTSNEPVKPVLLASPGFVAAGFQKYIQSVASTTTPALKRLLPSIVVVHSASGYLHSLAEVLQSPAVKTILADTKYARETKLMDDFLGHLRKETNKAIYGPREVEAAVDQGAVGRGGGVLIISNRLFRSQDVAERKRWVSLVDRVRDVEGGEVRVLSSDHESGRRLDGLGGVAALCTFPVVEEDFESDEEPAEAS

SEQ ID NO: 41955 - protein, 195 aa, A.fumigatus
LLLILIPILSSQRRYRIYLTSLPDTTLEAHTVMATHRFDPNFTDNVINAMGPKTNPRFRKVMASLIRHVHDFARENELTVDEWMAGVKLLNWAGQMSDDKRNEGQLVCDVIGLESYVLHPPNSQSQTSSTNRLACCACPGLSTKSPSSSLMRPPTHPPRPPSSAPSSALIPPTATTATISSRTCRTARWCSCTAG

SEQ ID NO: 41956 - protein, 181 aa, A.fumigatus
RRPCIKWHAYNLIRPGDLLRASAIRRVTTTHDTGTTTSSRVHLTLEIRVKSLDFDPQSSQLHVGGTIVNETPHTKVGQHHTLDLELNRNFTLEKEIGANGEGVGWDSIAVQMLQDAVDESGKRRAEAVAVVMQEGLAHICFIGQFQTVLKQKVEMSVPRKRQGGGGGDHDKVLHPSANPLA

SEQ ID NO: 41957 - protein, 137 aa, A.fumigatus
RPVLPAHVDGTAHSAMGSSGLNDGRVISGMRRDAQILIYIDIKKAMAAGCPFWRSENGVILSEGVDVGENQEVGDGASPKIIPLEFFDVVVERKCGLGKIWERGQTIKELPSELLQKGNPKGPKARLDGRRGSKRNG

SEQ ID NO: 41958 - protein, 91 aa, A.fumigatus
APPWGKYNPIRTTYNALTLEYTYYWLSIFSTSHIYTPTGQMRLIKNKIEHGGSGTVTLCPEEPEDMVCDPLLHWILSCSDDGPALSGTPTT

SEQ ID NO: 41959 - protein, 67 aa, A.fumigatus
SASFSRFFVRFKVLLDYWERAQSGHTSQSVQSSPALMVGAEYTHFAPLDVPDSVNKGHPSFALRHVL

SEQ ID NO: 41960 - protein, 61 aa, A.fumigatus
IDSAKYYANEKECAVAMKKSGIDRSKIFFTTKVPASSMSYEKAKEAIEQSVAATDLGYIDL

SEQ ID NO: 41961 - protein, 142 aa, A.fumigatus
QRCWRRRFWWQDEIHPWCAREDIVAWLKKRNVVIEAYSPLVQAQRLDEPVLQNLAKKHNKTGAQILIRWSLQKVPPLSLLSIESVTNGVLQGYVPLPKSVTDSRIVENTQVFDFELSGEDMESLNTGIYAPVCWDPAKDVPL

SEQ ID NO: 41962 - protein, 94 aa, A.fumigatus
SSVRDNISPPDKDVNNNSLRDVCTIYCSQLAERSLLLRSSNAPLHLDLENLDFSLPVVPLPCPISRGALFWKNPRQCAAGINAATNVSNLQLHK

SEQ ID NO: 41963 - protein, 155 aa, A.fumigatus
  UNSURE (49): Identity of amino acid sequences at the above locations are unknown.
SQRIEKMPCLEVCGHSIHYADSHPNGAPKDGATIVFIHGLGSSQNYYFXILHHLTLKHRCITLDTYGSARSPYTGQAITISTIASDVIAVLDAVHIPKAVVVGHSMGGLVVTLLGAQYSDRITTVVAVGPTHPSESLASTMRQRSDTVLEGRLLP

SEQ ID NO: 41964 - protein, 80 aa, A.fumigatus
LGCRILLHAPYGGKEGRLGAWRALVEAQKAGHVRSIGVSNYGIHHLEELEEYINSGVGGEDSGGRMRFIPGVRERTLLPG

SEQ ID NO: 41965 - protein, 123 aa, A.fumigatus
PKIVGMEAMANTVPNAATGCQASPLAKAFIRELLLGQNPNGYATLCQAIAKAPAIDYSRITVPFLLIAGEEDKSASLEGCKYIFDRVSSKTKKMEVLPKVGHWHCIEAPDLVGGMIAGFIERV

SEQ ID NO: 41966 - protein, 132 aa, A.fumigatus
LFLRQWISRWVEYLIMIPASAALSFSRNRHLDLLLQDGLELPNEANVGQSLLHHNSNRFRPPFAALVNGILEHLYSNTVPPNSFPIRTDLFLQGEIAIQLQIQCMMLSDFGVRCLVHNCSSDMQLGALRVEI

SEQ ID NO: 41967 - protein, 270 aa, A.fumigatus
PTCRPSTMPDQPRRIILEKSKTVRRRYQRSNKRFQFTASQIERIQREEEREARAKRLREKEKKRQANKKKKAEKEAKAREARRRLGLPDPHALPIPSSQPLLSKFLKKPAAKPDTETETCEDTESDSHSQGSIATEIDESLLSDLDVAAFDGQTAAGASGPDNHPASIDEKGHVGRTQGDDDEFSECSIFYDEDIIKEVETIATAQVTTGRLGEIDQAMKESCKPALTVGESFQDDTAILLEEFGHEFASDEEFEQELIKLDTVSVGKQS

SEQ ID NO: 41968 - protein, 1097 aa, A.fumigatus
  UNSURE (37): Identity of amino acid sequences at the above locations are unknown.
HQKASRREGTLETEKASLSARHDNMQKRLRKLQAEAXAMRSERSQLEREVADVKKLLEEKISEDAEAGESRKLLEQQIQDLKNQLFQAQADLSRERQSRDDVQMLAEHNLAELRDKYASLNESKIIIEKEMYIQQDTLRRATEARAAAEKSRKELQTELIKLRDRFTKVESARLNAEAEIERNVKKQANERLDSVRKDLEEKARQLEDVEEERSRLSLRVQELTNAIAESENFRIRHDQHKERLERELVTLKGRLTASENDNRALLTKIQQKNLDIARSNSKASESQRLRITNLQREKAKLEEDNRKLTRQLGDLQLSITSLEKQKEKLSLSLEDLNHEVNREHKASRNAEKAASTAGIQLAEANRNLETERQLRTQAQANTRKLQGSLDTAHKEIEALHRQLMLLHKFVEPLSDKPPESWESVQPDLVEKVNLAQLLDTAQSKLQVMEEKYNRAESQLAEMRRRHEDEMKELDARYSSSKRALLEEIDQNQVAGNRTPTHLRKNSENGLVKKFATPTTPNRRLNLNEATMDSGRSDRTVDTIGYQKRMDLATEIEELQNKLQMSEMQNRHLQNQLEQLKPVRDLWQDESPSLRRMQLLERENGRLHDQLDDSAKKVSALERSIRSGELSLRDVQAKSHEELYDLINSQEQSRRSLLKVHNEAMTDFTEAKAQFEKLKRAKATLEVELRDALSEAQELKVAREQDAVSRNQLLEEFSDLQIRLDAETSKSADLASSLSLYKSRADDYFNKLEQAEIAVLKATRAEQFAKSQAQEAEETCAQIMAERKQMDALVEDLQRQTQMLEARMEDQAAELQGALQAKQRLQNELEDYRNQRAIDIEDKETSMEQTRLKYQREFSTLNNELEMEREKVLNVRSENARLREELEDLRSKWDNEVLNSSTWAKEKARMEITLQDVTTSRDEAVNAHNEAQGRVVSLLSQVRSLRTSFDDITAERDTLFKEKKMLEARLAEAAERLEELAKGESPSMRSAASMDRELLELKSKLAQQEDVSAAAVGKMRRAEALVTEMQKEVTAEREANAQLFKDKAALEKQLKEAQLRCVDLETKSYSTGSQDVRFLHKRIKEVSFHPTEMRHPRY

SEQ ID NO: 41969 - protein, 66 aa, A.fumigatus
  UNSURE (50),(56),(64): Identity of amino acid sequences at the above locations are unknown.
LWCKDSDSNFLVELPKYSRIDPLSYQLIVTKCCGVLSAEPRPALEIESCXHYFSRXRAGPETSXCG

SEQ ID NO: 41970 - protein, 937 aa, A.fumigatus
SCGALQYLTLERRGESGAGKTENTKKVIQYLAAVATTDTPYARSGSKQLSTLSQQILRANPILEAFGNAQTVRNNNSSRFGKFIRIEFTRSGQISGASIDWYLLEKSRVVKPNSHERNYHIFYQLLQGADPKLRESLLLTDLHIEDFAYTRDGNDSIAGVSDVDEWNSLIEAFHVMKFSEEDQMCILRTVAAVLHLGNITIVKESLRADQAALGPDSLNSVERACQLLGIEPEPFVKGLLHPRVKAGREWVEKAQTPEQVRLALDALAKGIYERGFGDLVNRINNRLDRSTMAGDDSFFIGVLDIAGFEIFKNNSFEQLCINYTNEKLQQFFNHHMFVLEQEEYAREQIEWQFIDFGKDLQPTIDLIELTNPIGIFSCLDEDSVMPKATDRSFTDKLHSLWDRKSPKYRASRLSQGFVLTHYAAEVEYDTEGWLEKNKDPLNDNVTRLLARSTDKHVACLFSDCGDPDEDNELPKSRVKKGLFRTVAQRHKEQLSSLMNQLHQTHPHFVRCIIPNHKKRPKMLNAPLVLDQLRCNGVLEGIRIARTGFPNRLSFIEFRQRYEVLCPNMPKGYMDGQSVAHNMLQKLGLDPAWYRVGRTKVFFRAGVLAELEEQRDQLIRTIMTQFQSAARGFIQRRISNKRLYRAEATRIIQHNFQVYLDMKRNPWWRLFSRMKPLLGETRTANEVKKRDEKIKELEAKIKQDIAERQKLDEERRRTEIEIQKIQHTLESERALALDKEEIFKRLQLREIELTEKLAGAIADQESLEDQLDTLIAAKKKADEQLSQRITQLEQAGEIIERLEAEKRDLQSRLDVLDRQLEEARSSVAEQEARVKELGQEIKMLQSHLSLKDRKIQDLEAKLLKTDQDLDIKLARTSKDLELSKKQIKDLVEENRSIRQQISDLSSTSTGYEEMLKRKRSEIAVLRNDTKKHQEEKEP

SEQ ID NO: 41971 - protein, 75 aa, A.fumigatus
TYSGLFLVTINPYCPLPIYTNEYVKMYKGRSREETRPHIFAMADEAFRNLVEEGENQSILVTYIPPHEAVEHCNI

SEQ ID NO: 41972 - protein, 78 aa, A.fumigatus
  UNSURE (69),(76): Identity of amino acid sequences at the above locations are unknown.
NASPKILTPQIKQLETHLEEQENKHSSEQRSLRNVDRTVKDLQSQLERRDKLNAQLEEDVNVFTAGLEXSCYVYIXKR

SEQ ID NO: 41973 - protein, 60 aa, A.fumigatus
SSALRIGVFDPQLLTLMQSKLHTIYMMCDASTRAANTAHVLLTQYTTESYQNSLVLNSLS

SEQ ID NO: 41974 - protein, 74 aa, A.fumigatus
LDLTKLQSLEDLLFVKSQSSFAFKCVLDFLNLNLSTASLFIKFLAFSNVLLYFGFQLFNLFIPFLDFISSTCLS

SEQ ID NO: 41975 - protein, 63 aa, A.fumigatus
  UNSURE (22),(36),(44),(50): Identity of amino acid sequences at the above locations are unknown.
FCTAYDPPGSGNPDPFMSNGAXGASSHEDTSFSTTXRCFWARTXAGKIVXAAFDFKRRARLCA

SEQ ID NO: 41976 - protein, 229 aa, A.fumigatus
HPTTFRYNELVREGINPAVLRQLYEEVGIRVLTPQLEGVSPAINPPTKPVDVPGKPAGAGLDSASSSSVDNGPAPVALDRSKGETETPVAAAAANAPAPAPTSTIQHSTTAKPLERKEVIARMLAAKAAKTSGMPSTPQTDSAKEALSSESSVSALVGKDTPASSGRETPPKEKDIRTREKNKAKPELARQRIEQLKKQGLVRSQQKAQIDPMRRDEMSSPRGWKVRAG

SEQ ID NO: 41977 - protein, 226 aa, A.fumigatus
RQNLLQRQRRDGAAGIPKPDDSTLPLDHLQTSFPGILSDGIIDDIHTPAASDLLHLLHPVLPLFTAVVNNMIRTKALNQLDLLRTTRSADDMRADRLEDLRHEKAGTTSGSMQKNPVALLHGVGLLRQRQDSQSAQERSHNILIRNAVGDFDCLGRRDGSVLRISASAEPGDAVTHLEVVVVWSGPQGDDGAGAFATQNFRLWGGVEPCTEIGVDVIDSGDVVLDE

SEQ ID NO: 41978 - protein, 67 aa, A.fumigatus
QECYGLLPNLLTRGNTNVVTLQGTFDNGLSKSNEISASYAWSFPHPGLINDPFFSGQQSSMTALKRG

SEQ ID NO: 41979 - protein, 517 aa, A.fumigatus
  UNSURE (379): Identity of amino acid sequences at the above locations are unknown.
EKVLSALLLPWKSPHIYLGLIAANMPRFGRKRSQWPPPPMVEDEAISLSRELHGMSILGEKPGVEGVRARGTIDQYPVILDAPISESAKPKQYGLDECSREISSSDDSAGPATPPERFVQDPLIRVADDSQEFHLTAPTVPVTLPVKETRPQTKPRKEDRQPPRIFQDTSSSRQGTEPSQTIPKPQSRTGKTSIDVKATTQIPTRNPERVSVPVRNGQGSLGMPVEKTTSAAVPKRSGSVRDGRRQSPGETQQPRSSAGYVSASAANKAPMDPGNAHQEPPSQTSKRAHAVPSMVPPTRSGLAERLEEKLRQRQKVRESGSSSQPSELPLGRPTGPTEPSSSEPPRACRCNAPPETVPGATSRGTRFRALSTPAKPAPXAPRSDEVDPFPASLRTATSEPVPPVSSQSTTKRTVSFYGEQEHGQEREKSRSSRRQSPSKAVVRQPSPEEAGPCLLPCPRSVPVTGYQDWYTIKGLEHLDICPSCTKQMRNSRFQDLFIPSLPVPRVVFTTGLEGTAL

SEQ ID NO: 41980 - protein, 103 aa, A.fumigatus
PGVQLACAKSMRRRSCTLGGSSSSSSSSKSIPPNCAVSGPRFILIACCGIPSCPTRRLTTSKEPSPCRAKSKSSSSSSASSGDLSLGFFSSSSACSIASGSPS

SEQ ID NO: 41981 - protein, 303 aa, A.fumigatus
RLNRTSYFPYYFNPETEDMVKLATVTIWNFLTYILYHDVAPEYKANIEEARKSCDIAGKELWKNQQFTSKGPGDFNTACSTLFGGVFFDLYVENNQWNNSKDDTVRMTNGIARKVVKFALAGAGIDRQVVQFQELANEDALRAMRVQDIDGFEVTAIIFPDGETKEFYQVHAPDLHPVGRMLAKAYRDPGKPDIDLSPEERLQWEKGGAPALEFDFFLEETLLKFCYPGMKVITAVWELNCGFHYFDEISTAYCSIYTVLANDLMIGWKKPKDLRVGDDREADETFDEEGKGSKRKETEGPSC

SEQ ID NO: 41982 - protein, 82 aa, A.fumigatus
PSRSCTIIFRCLLSVDMFEASPLIFTVGHQARPDICTWKFDSLPINAQLLSLCSDRAAKMKHTAQLGPLRYLYTKLSAAGSC

SEQ ID NO: 41983 - protein, 322 aa, A.fumigatus
LRLTSLTILSSHRMHLSRTFVPRLSNSLAATSPALVRLSGVRCHLQPSFRPTASLRSSSQPHTMSIPTTMKAVLIEKTGGPEVLGFKTDHPVPTPQEGQLLVKNNISGINYIDTYFRTGLYPAPKPEVLGREGAGTVVALGPGPNHYNFQVGDRVAWLSTGGYAEYTAVPAAKAVKIPDGISDEDVMASFLSGLTVLSLAKETYAVQKGDWVLLHAAAGGAGFLMTQILKSIGAHVIGTAGGPEKVELVKGLGADHVIDYRSEEGKDWVKQVKEITGGRGVDVVYDSVGKDTWEGSLEVVKRKGTIVWFGNASGPVPPLPLK

SEQ ID NO: 41984 - protein, 462 aa, A.fumigatus
VSIRSRLTFLAHVIISQPLERLYYPALSIQSLSAQYASCAYTGSHDWSNTFHYSDGVRCTTSGSFIAKPCTPQEVAFYESSAFHPAFRDFIPTYIGTLSSADQQGPLALTAAAQQSGAIVLPTADDSSSSATPTTAEAPQLGLQAGLGSNGTTENKPWVPSGGKKLETGLSIVLENIASGFKRPNVLDVKLGARLWADDAPPAKRAKLEAVAKETTSGSLGFRIAGMKIWTGAHGETDEGSKTNPYATKHEGSEGARGKIVEKDGYKRYDKWYGRSFNEKNVKEGFETFLAGAKAGPVDRSKLIAKRLADELRRVQSILESEESRMYSSSVLIVYEGDPEAMEQALEEEKKPRDRSPEEADEEDEDFDFALQGDGSFEVVNLRVGQEGIPQQAINMNLGPETAQLGGIDFEDEEEEDDPPKVHDLRLIDFAHASWTPGQGPDENVLMGVRSLIRLLDELAVE

SEQ ID NO: 41985 - protein, 92 aa, A.fumigatus
SKFCLHVFFWFGHGLTLDSKLSPKCVKVARPQLFGYIETREEFEFYVNELFHLLQSGQLKVRIHKVYPLEQVQQAHIDLEGRKTTGKSLLKP

SEQ ID NO: 41986 - protein, 180 aa, A.fumigatus
VLTFLAPAPHIKLYGYEATQRSLERILYVWAIRHPASGYVQGINDLVTPFWQVFLGMYMTDLNVEEDMDPGQLPRSVLDAVEADSFWCLTKLLDGIQDNYIYAQPGIHRQVRALRDLTMRIDSTLAKHLENEGVEFMQFSFRWMNCLLMREMSVQNTIRMWDTYMVCSRVRAALITSESY
